United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 40

SEQ ID NO: 1783677 - RNA, 18 nt, Human
cagaucuuggacucauga

SEQ ID NO: 1783678 - RNA, 19 nt, Human
cagaucuuggacucaugag

SEQ ID NO: 1783679 - RNA, 20 nt, Human
cagaucuuggacucaugagg

SEQ ID NO: 1783680 - RNA, 22 nt, Human
cagaucuuggacucaugaggag

SEQ ID NO: 1783681 - RNA, 13 nt, Human
cagaaagccaaca

SEQ ID NO: 1783682 - RNA, 16 nt, Human
cagaaacccugagcag

SEQ ID NO: 1783683 - RNA, 13 nt, Human
cagaaacaggacc

SEQ ID NO: 1783684 - RNA, 17 nt, Human
cacuuuugacaaaggca

SEQ ID NO: 1783685 - RNA, 18 nt, Human
cacuuuugacaaaggcaa

SEQ ID NO: 1783686 - RNA, 21 nt, Human
cagaaaaauaacuucaagcaa

SEQ ID NO: 1783687 - RNA, 13 nt, Human
cagaaguaagccu

SEQ ID NO: 1783688 - RNA, 15 nt, Human
cagaaguaagccuca

SEQ ID NO: 1783689 - RNA, 16 nt, Human
cagaaguaagccucau

SEQ ID NO: 1783690 - RNA, 19 nt, Human
cagaagggagcuagccaga

SEQ ID NO: 1783691 - RNA, 20 nt, Human
cagaagggagcuagccagag

SEQ ID NO: 1783692 - RNA, 21 nt, Human
cagaagggagcuagccagagg

SEQ ID NO: 1783693 - RNA, 20 nt, Human
cagaagcucuuacucuuucc

SEQ ID NO: 1783694 - RNA, 21 nt, Human
cagaagcucuuacucuuuccu

SEQ ID NO: 1783695 - RNA, 22 nt, Human
cagaagcucuuacucuuuccua

SEQ ID NO: 1783696 - RNA, 16 nt, Human
cagaagccucuggguc

SEQ ID NO: 1783697 - RNA, 13 nt, Human
cagaaggagacag

SEQ ID NO: 1783698 - RNA, 17 nt, Human
cagaaggagacaggcag

SEQ ID NO: 1783699 - RNA, 18 nt, Human
cagaaggagacaggcaga

SEQ ID NO: 1783700 - RNA, 18 nt, Human
cagaaggcaaacccauca

SEQ ID NO: 1783701 - RNA, 22 nt, Human
cagaaggagacaggcagagcug

SEQ ID NO: 1783702 - RNA, 21 nt, Human
cagaagacacugaugggcaac

SEQ ID NO: 1783703 - RNA, 14 nt, Human
cagaacuugcugcu

SEQ ID NO: 1783704 - RNA, 17 nt, Human
cagaacuugcugcuguc

SEQ ID NO: 1783705 - RNA, 18 nt, Human
cagaacuugcugcugucu

SEQ ID NO: 1783706 - RNA, 20 nt, Human
cagaacuugcugcugucuug

SEQ ID NO: 1783707 - RNA, 19 nt, Human
cagaacccuuggcuugccc

SEQ ID NO: 1783708 - RNA, 15 nt, Human
cagaacccugccaug

SEQ ID NO: 1783709 - RNA, 18 nt, Human
cagaacccugccauggaa

SEQ ID NO: 1783710 - RNA, 14 nt, Human
cagaacccuuggcu

SEQ ID NO: 1783711 - RNA, 16 nt, Human
cagaaccuuguuauuu

SEQ ID NO: 1783712 - RNA, 17 nt, Human
cagaaccuuguuauuuc

SEQ ID NO: 1783713 - RNA, 18 nt, Human
cagaaccuuguuauuucu

SEQ ID NO: 1783714 - RNA, 21 nt, Human
cagaaccuuguuauuucucag

SEQ ID NO: 1783715 - RNA, 21 nt, Human
cagaacgaaccuuggccuggg

SEQ ID NO: 1783716 - RNA, 14 nt, Human
cagaacucuuucaa

SEQ ID NO: 1783717 - RNA, 15 nt, Human
cagaacucuuucaaa

SEQ ID NO: 1783718 - RNA, 16 nt, Human
cagaacucuuucaaaa

SEQ ID NO: 1783719 - RNA, 16 nt, Human
cagaacugugccacaa

SEQ ID NO: 1783720 - RNA, 17 nt, Human
cagaacugugccacaau

SEQ ID NO: 1783721 - RNA, 22 nt, Human
cagaauuuguguugaaggaacu

SEQ ID NO: 1783722 - RNA, 20 nt, Human
cagacaaaagcgcuuuuccu

SEQ ID NO: 1783723 - RNA, 11 nt, Human
cagacaaaaug

SEQ ID NO: 1783724 - RNA, 20 nt, Human
cagacaaaauggauacauaa

SEQ ID NO: 1783725 - RNA, 22 nt, Human
cagacaaaugugguuacacacu

SEQ ID NO: 1783726 - RNA, 12 nt, Human
cagacacacaca

SEQ ID NO: 1783727 - RNA, 14 nt, Human
cagacacacacaca

SEQ ID NO: 1783728 - RNA, 12 nt, Human
cagaaugaaucu

SEQ ID NO: 1783729 - RNA, 13 nt, Human
cagacacaggccc

SEQ ID NO: 1783730 - RNA, 14 nt, Human
cagacacaggcccg

SEQ ID NO: 1783731 - RNA, 15 nt, Human
cagacacaggcccgg

SEQ ID NO: 1783732 - RNA, 17 nt, Human
cagacacaggcccggcu

SEQ ID NO: 1783733 - RNA, 18 nt, Human
cagacacaggcccggcuc

SEQ ID NO: 1783734 - RNA, 21 nt, Human
cagacacaggcccggcuccag

SEQ ID NO: 1783735 - RNA, 22 nt, Human
cagacacaggcccggcuccagg

SEQ ID NO: 1783736 - RNA, 23 nt, Human
cagacacaggcccggcuccaggc

SEQ ID NO: 1783737 - RNA, 19 nt, Human
cagacaccuugacagggca

SEQ ID NO: 1783738 - RNA, 20 nt, Human
cagacaccuugacagggcac

SEQ ID NO: 1783739 - RNA, 22 nt, Human
cagacaccuugacagggcacac

SEQ ID NO: 1783740 - RNA, 19 nt, Human
cagagaaacuuaagcaaag

SEQ ID NO: 1783741 - RNA, 20 nt, Human
cagagaaacuuaagcaaagg

SEQ ID NO: 1783742 - RNA, 19 nt, Human
cagagaaaguacuucucca

SEQ ID NO: 1783743 - RNA, 23 nt, Human
cagagaaaguacuucuccacccu

SEQ ID NO: 1783744 - RNA, 19 nt, Human
cagacuuuggaaaaugcau

SEQ ID NO: 1783745 - RNA, 22 nt, Human
cagacuuuggaaaaugcauugu

SEQ ID NO: 1783746 - RNA, 23 nt, Human
cagacuuuggaaaaugcauugua

SEQ ID NO: 1783747 - RNA, 16 nt, Human
cagacgccugaggaac

SEQ ID NO: 1783748 - RNA, 16 nt, Human
cagacccggcugcgug

SEQ ID NO: 1783749 - RNA, 12 nt, Human
cagacccggcug

SEQ ID NO: 1783750 - RNA, 14 nt, Human
cagacccggcugcg

SEQ ID NO: 1783751 - RNA, 14 nt, Human
cagcucaccagccc

SEQ ID NO: 1783752 - RNA, 14 nt, Human
cagcaagugguccu

SEQ ID NO: 1783753 - RNA, 22 nt, Human
cagcaagugguccuagaggccc

SEQ ID NO: 1783754 - RNA, 19 nt, Human
cagcaagugagagcugggu

SEQ ID NO: 1783755 - RNA, 21 nt, Human
cagcaagugagagcugggugu

SEQ ID NO: 1783756 - RNA, 14 nt, Human
cagcaagugagagc

SEQ ID NO: 1783757 - RNA, 15 nt, Human
cagcaagugagagcu

SEQ ID NO: 1783758 - RNA, 16 nt, Human
cagcaagugagagcug

SEQ ID NO: 1783759 - RNA, 17 nt, Human
cagcaagugagagcugg

SEQ ID NO: 1783760 - RNA, 12 nt, Human
cagcaagugaga

SEQ ID NO: 1783761 - RNA, 16 nt, Human
cagcaagaagggaguu

SEQ ID NO: 1783762 - RNA, 11 nt, Human
cagcagacuga

SEQ ID NO: 1783763 - RNA, 18 nt, Human
cagcagacugaucaggac

SEQ ID NO: 1783764 - RNA, 13 nt, Human
cagcagcccaagc

SEQ ID NO: 1783765 - RNA, 18 nt, Human
cagcagcccaagcuuccc

SEQ ID NO: 1783766 - RNA, 19 nt, Human
cagcagcccaagcuucccu

SEQ ID NO: 1783767 - RNA, 20 nt, Human
cagcagcccaagcuucccuc

SEQ ID NO: 1783768 - RNA, 15 nt, Human
cagcagcagcccaag

SEQ ID NO: 1783769 - RNA, 16 nt, Human
cagcagcagcccaagc

SEQ ID NO: 1783770 - RNA, 12 nt, Human
cagaugcccgag

SEQ ID NO: 1783771 - RNA, 18 nt, Human
cagaugcccgagggaggg

SEQ ID NO: 1783772 - RNA, 19 nt, Human
cagaugcccgagggagggg

SEQ ID NO: 1783773 - RNA, 17 nt, Human
cagauguucccccaucu

SEQ ID NO: 1783774 - RNA, 16 nt, Human
cagauuccccuguguc

SEQ ID NO: 1783775 - RNA, 17 nt, Human
cagauuccccuguguca

SEQ ID NO: 1783776 - RNA, 12 nt, Human
cagauuaauauu

SEQ ID NO: 1783777 - RNA, 16 nt, Human
cagauuuugauagcaa

SEQ ID NO: 1783778 - RNA, 20 nt, Human
cagauuuugauagcaaagcg

SEQ ID NO: 1783779 - RNA, 19 nt, Human
cagauuuugauagcaaagc

SEQ ID NO: 1783780 - RNA, 18 nt, Human
cagauuuugauagcaaag

SEQ ID NO: 1783781 - RNA, 15 nt, Human
cagcccacuucugcc

SEQ ID NO: 1783782 - RNA, 19 nt, Human
cagccaucucaugagggga

SEQ ID NO: 1783783 - RNA, 23 nt, Human
cagccaucucaugaggggagagg

SEQ ID NO: 1783784 - RNA, 18 nt, Human
cagcccacuucugccaua

SEQ ID NO: 1783785 - RNA, 19 nt, Human
cagcccagauuccccugug

SEQ ID NO: 1783786 - RNA, 22 nt, Human
cagcccagauuccccuguguca

SEQ ID NO: 1783787 - RNA, 23 nt, Human
cagccacggccaggccagaggga

SEQ ID NO: 1783788 - RNA, 15 nt, Human
cagccacuaagaacc

SEQ ID NO: 1783789 - RNA, 19 nt, Human
cagccacuaagaaccccuc

SEQ ID NO: 1783790 - RNA, 21 nt, Human
cagccacuccccuccacucuc

SEQ ID NO: 1783791 - RNA, 14 nt, Human
cagccacggccagg

SEQ ID NO: 1783792 - RNA, 15 nt, Human
cagccacggccaggc

SEQ ID NO: 1783793 - RNA, 16 nt, Human
cagccacggccaggcc

SEQ ID NO: 1783794 - RNA, 17 nt, Human
cagccacggccaggcca

SEQ ID NO: 1783795 - RNA, 18 nt, Human
cagccacggccaggccag

SEQ ID NO: 1783796 - RNA, 19 nt, Human
cagccacggccaggccaga

SEQ ID NO: 1783797 - RNA, 21 nt, Human
cagccacggccaggccagagg

SEQ ID NO: 1783798 - RNA, 22 nt, Human
cagccacggccaggccagaggg

SEQ ID NO: 1783799 - RNA, 17 nt, Human
cagccaauuauguuaaa

SEQ ID NO: 1783800 - RNA, 18 nt, Human
cagccaauuauguuaaac

SEQ ID NO: 1783801 - RNA, 21 nt, Human
cagccaccgaagccgccugug

SEQ ID NO: 1783802 - RNA, 11 nt, Human
cagcagggcua

SEQ ID NO: 1783803 - RNA, 19 nt, Human
cagcagggcuacccugagc

SEQ ID NO: 1783804 - RNA, 21 nt, Human
cagcagggcuacccugagcug

SEQ ID NO: 1783805 - RNA, 14 nt, Human
cagcauccuggcac

SEQ ID NO: 1783806 - RNA, 15 nt, Human
cagcauccuggcacc

SEQ ID NO: 1783807 - RNA, 16 nt, Human
cagcauccuggcaccc

SEQ ID NO: 1783808 - RNA, 17 nt, Human
cagcauccuggcacccg

SEQ ID NO: 1783809 - RNA, 17 nt, Human
cagcagcggaaccgccc

SEQ ID NO: 1783810 - RNA, 14 nt, Human
cagcaggaggccag

SEQ ID NO: 1783811 - RNA, 15 nt, Human
cagcaggaggccagg

SEQ ID NO: 1783812 - RNA, 18 nt, Human
cagcaggaggccaggccg

SEQ ID NO: 1783813 - RNA, 15 nt, Human
cagccaaaggcuggc

SEQ ID NO: 1783814 - RNA, 14 nt, Human
cagcauuugaucug

SEQ ID NO: 1783815 - RNA, 16 nt, Human
cagcauuugaucuguu

SEQ ID NO: 1783816 - RNA, 19 nt, Human
cagcauugcuggacucuga

SEQ ID NO: 1783817 - RNA, 18 nt, Human
cagcauucucaggcacca

SEQ ID NO: 1783818 - RNA, 19 nt, Human
cagcauucucaggcaccag

SEQ ID NO: 1783819 - RNA, 20 nt, Human
cagcauucucaggcaccagu

SEQ ID NO: 1783820 - RNA, 21 nt, Human
cagcauccuggcacccggccc

SEQ ID NO: 1783821 - RNA, 19 nt, Human
cagcauccuggcacccggc

SEQ ID NO: 1783822 - RNA, 20 nt, Human
cagcauccuggcacccggcc

SEQ ID NO: 1783823 - RNA, 17 nt, Human
cagcccucaucccgagc

SEQ ID NO: 1783824 - RNA, 13 nt, Human
cagcccucauccc

SEQ ID NO: 1783825 - RNA, 14 nt, Human
cagcccucaucccg

SEQ ID NO: 1783826 - RNA, 18 nt, Human
cagcccuaggguggagag

SEQ ID NO: 1783827 - RNA, 13 nt, Human
cagccccagugcc

SEQ ID NO: 1783828 - RNA, 14 nt, Human
cagccccagugccc

SEQ ID NO: 1783829 - RNA, 15 nt, Human
cagccccagugccca

SEQ ID NO: 1783830 - RNA, 16 nt, Human
cagccccagugcccac

SEQ ID NO: 1783831 - RNA, 17 nt, Human
cagccccagugcccaca

SEQ ID NO: 1783832 - RNA, 18 nt, Human
cagccccagugcccacag

SEQ ID NO: 1783833 - RNA, 12 nt, Human
cagccccagccu

SEQ ID NO: 1783834 - RNA, 13 nt, Human
cagccccagccug

SEQ ID NO: 1783835 - RNA, 14 nt, Human
cagccccagccugc

SEQ ID NO: 1783836 - RNA, 15 nt, Human
cagccccagccugcu

SEQ ID NO: 1783837 - RNA, 16 nt, Human
cagccccagccugcua

SEQ ID NO: 1783838 - RNA, 17 nt, Human
cagccccagccugcuag

SEQ ID NO: 1783839 - RNA, 18 nt, Human
cagccccagccugcuagc

SEQ ID NO: 1783840 - RNA, 19 nt, Human
cagccccagccugcuagcu

SEQ ID NO: 1783841 - RNA, 16 nt, Human
cagccccauucugccu

SEQ ID NO: 1783842 - RNA, 17 nt, Human
cagccccauucugccug

SEQ ID NO: 1783843 - RNA, 18 nt, Human
cagccccauucugccugc

SEQ ID NO: 1783844 - RNA, 13 nt, Human
cagccccauucug

SEQ ID NO: 1783845 - RNA, 14 nt, Human
cagccccauucugc

SEQ ID NO: 1783846 - RNA, 19 nt, Human
cagccucccaaagugcugg

SEQ ID NO: 1783847 - RNA, 20 nt, Human
cagccucccaaagugcuggg

SEQ ID NO: 1783848 - RNA, 21 nt, Human
cagccucccaaagugcuggga

SEQ ID NO: 1783849 - RNA, 23 nt, Human
cagccucccaaagugcugggauu

SEQ ID NO: 1783850 - RNA, 20 nt, Human
cagccucccgaauagcuggg

SEQ ID NO: 1783851 - RNA, 18 nt, Human
cagccuccccugccaggg

SEQ ID NO: 1783852 - RNA, 19 nt, Human
cagccuccccugccagggc

SEQ ID NO: 1783853 - RNA, 20 nt, Human
cagccuccccugccagggca

SEQ ID NO: 1783854 - RNA, 22 nt, Human
cagccuccccugccagggcagg

SEQ ID NO: 1783855 - RNA, 21 nt, Human
cagccucccgaauagcuggga

SEQ ID NO: 1783856 - RNA, 22 nt, Human
cagccucccgaauagcugggac

SEQ ID NO: 1783857 - RNA, 16 nt, Human
cagccuccccugccag

SEQ ID NO: 1783858 - RNA, 17 nt, Human
cagccuccccugccagg

SEQ ID NO: 1783859 - RNA, 17 nt, Human
cagccucagcgcggccc

SEQ ID NO: 1783860 - RNA, 18 nt, Human
cagccucagcgcggcccu

SEQ ID NO: 1783861 - RNA, 20 nt, Human
cagccucagcgcggcccucc

SEQ ID NO: 1783862 - RNA, 19 nt, Human
cagccucaaccuccugggc

SEQ ID NO: 1783863 - RNA, 20 nt, Human
cagccucaaccuccugggcu

SEQ ID NO: 1783864 - RNA, 21 nt, Human
cagccucaaccuccugggcua

SEQ ID NO: 1783865 - RNA, 17 nt, Human
cagccucaaccuccugg

SEQ ID NO: 1783866 - RNA, 18 nt, Human
cagccucaaccuccuggg

SEQ ID NO: 1783867 - RNA, 22 nt, Human
cagcucaccagccccagugccc

SEQ ID NO: 1783868 - RNA, 20 nt, Human
cagcucaccagccccagugc

SEQ ID NO: 1783869 - RNA, 21 nt, Human
cagcucaccagccccagugcc

SEQ ID NO: 1783870 - RNA, 13 nt, Human
cagcucaccagcc

SEQ ID NO: 1783871 - RNA, 19 nt, Human
cagcucaaggaaaggccug

SEQ ID NO: 1783872 - RNA, 20 nt, Human
cagcucaaggaaaggccuga

SEQ ID NO: 1783873 - RNA, 20 nt, Human
cagcuauguuauauugaaaa

SEQ ID NO: 1783874 - RNA, 21 nt, Human
cagcuauguuauauugaaaaa

SEQ ID NO: 1783875 - RNA, 15 nt, Human
cagcucaccagcccc

SEQ ID NO: 1783876 - RNA, 16 nt, Human
cagcucaccagcccca

SEQ ID NO: 1783877 - RNA, 17 nt, Human
cagcucaccagccccag

SEQ ID NO: 1783878 - RNA, 19 nt, Human
cagcucaccagccccagug

SEQ ID NO: 1783879 - RNA, 15 nt, Human
cagcuauaccugugc

SEQ ID NO: 1783880 - RNA, 16 nt, Human
cagcuauaccugugcc

SEQ ID NO: 1783881 - RNA, 17 nt, Human
cagcuauaccugugccu

SEQ ID NO: 1783882 - RNA, 19 nt, Human
cagcuauaccugugccucg

SEQ ID NO: 1783883 - RNA, 21 nt, Human
cagcuauaccugugccucggc

SEQ ID NO: 1783884 - RNA, 22 nt, Human
cagcuauaccugugccucggcu

SEQ ID NO: 1783885 - RNA, 23 nt, Human
cagcuauaccugugccucggcuu

SEQ ID NO: 1783886 - RNA, 21 nt, Human
cagcgagcccugguggcagug

SEQ ID NO: 1783887 - RNA, 16 nt, Human
cagcgaggaggcucca

SEQ ID NO: 1783888 - RNA, 17 nt, Human
cagcgaggaggcuccag

SEQ ID NO: 1783889 - RNA, 18 nt, Human
cagcgaggaggcuccaga

SEQ ID NO: 1783890 - RNA, 13 nt, Human
cagcgagcccugg

SEQ ID NO: 1783891 - RNA, 16 nt, Human
cagcgagcccuggugg

SEQ ID NO: 1783892 - RNA, 17 nt, Human
cagcgagcccugguggc

SEQ ID NO: 1783893 - RNA, 19 nt, Human
cagcgagcccugguggcag

SEQ ID NO: 1783894 - RNA, 20 nt, Human
cagcgagcccugguggcagu

SEQ ID NO: 1783895 - RNA, 15 nt, Human
cagcuaaugggacac

SEQ ID NO: 1783896 - RNA, 16 nt, Human
cagcuaaugggacacu

SEQ ID NO: 1783897 - RNA, 20 nt, Human
cagccuuucuggcagguccu

SEQ ID NO: 1783898 - RNA, 23 nt, Human
cagccucccgaauagcugggacu

SEQ ID NO: 1783899 - RNA, 19 nt, Human
cagccucccgaguagcugg

SEQ ID NO: 1783900 - RNA, 20 nt, Human
cagccucccgaguagcuggg

SEQ ID NO: 1783901 - RNA, 21 nt, Human
cagccucccgaguagcuggga

SEQ ID NO: 1783902 - RNA, 22 nt, Human
cagccucccgaguagcugggac

SEQ ID NO: 1783903 - RNA, 23 nt, Human
cagccucccgaguagcugggacu

SEQ ID NO: 1783904 - RNA, 12 nt, Human
cagcucuguccu

SEQ ID NO: 1783905 - RNA, 13 nt, Human
cagcucuguccug

SEQ ID NO: 1783906 - RNA, 14 nt, Human
cagcucuguccugg

SEQ ID NO: 1783907 - RNA, 16 nt, Human
cagcucuguccuggga

SEQ ID NO: 1783908 - RNA, 17 nt, Human
cagcucuguccugggag

SEQ ID NO: 1783909 - RNA, 18 nt, Human
cagcucuguccugggagu

SEQ ID NO: 1783910 - RNA, 23 nt, Human
cagcucuguccugggagugagcu

SEQ ID NO: 1783911 - RNA, 13 nt, Human
cagcucuucucca

SEQ ID NO: 1783912 - RNA, 14 nt, Human
cagcucuucuccag

SEQ ID NO: 1783913 - RNA, 15 nt, Human
cagcucuucuccagg

SEQ ID NO: 1783914 - RNA, 16 nt, Human
cagcucuucuccaggc

SEQ ID NO: 1783915 - RNA, 17 nt, Human
cagcucuucuccaggcu

SEQ ID NO: 1783916 - RNA, 18 nt, Human
cagcucuucuccaggcug

SEQ ID NO: 1783917 - RNA, 19 nt, Human
cagcucuucuccaggcugu

SEQ ID NO: 1783918 - RNA, 23 nt, Human
cagcucuucuccaggcuguaucc

SEQ ID NO: 1783919 - RNA, 13 nt, Human
cagcucagcuucc

SEQ ID NO: 1783920 - RNA, 14 nt, Human
cagcucagcuuccc

SEQ ID NO: 1783921 - RNA, 16 nt, Human
cagcuccuucuguccu

SEQ ID NO: 1783922 - RNA, 17 nt, Human
cagcuccuucuguccua

SEQ ID NO: 1783923 - RNA, 21 nt, Human
cagcuccuucuguccuacucu

SEQ ID NO: 1783924 - RNA, 23 nt, Human
cagcuccuucuguccuacucugu

SEQ ID NO: 1783925 - RNA, 18 nt, Human
cagcucugaaaccagugu

SEQ ID NO: 1783926 - RNA, 19 nt, Human
cagcucugaaaccaguguu

SEQ ID NO: 1783927 - RNA, 14 nt, Human
cagcucucugcccu

SEQ ID NO: 1783928 - RNA, 15 nt, Human
cagcucucugcccug

SEQ ID NO: 1783929 - RNA, 17 nt, Human
cagcucucugcccugug

SEQ ID NO: 1783930 - RNA, 19 nt, Human
cagcucucugcccugugua

SEQ ID NO: 1783931 - RNA, 21 nt, Human
cagcucucugcccuguguacu

SEQ ID NO: 1783932 - RNA, 16 nt, Human
cagcucgguacccggg

SEQ ID NO: 1783933 - RNA, 13 nt, Human
cagcucggcucag

SEQ ID NO: 1783934 - RNA, 14 nt, Human
cagcucggcucagc

SEQ ID NO: 1783935 - RNA, 15 nt, Human
cagcucggcucagcu

SEQ ID NO: 1783936 - RNA, 13 nt, Human
cagcuccuuccug

SEQ ID NO: 1783937 - RNA, 14 nt, Human
cagcuccuuccugg

SEQ ID NO: 1783938 - RNA, 16 nt, Human
cagcuccuuccuggag

SEQ ID NO: 1783939 - RNA, 18 nt, Human
cagcugcgguccacccag

SEQ ID NO: 1783940 - RNA, 15 nt, Human
cagcugccuuagcuu

SEQ ID NO: 1783941 - RNA, 16 nt, Human
cagcugccuuagcuuc

SEQ ID NO: 1783942 - RNA, 19 nt, Human
cagcugccuuagcuucagg

SEQ ID NO: 1783943 - RNA, 20 nt, Human
cagcugccuuagcuucagga

SEQ ID NO: 1783944 - RNA, 21 nt, Human
cagcugccuuagcuucaggaa

SEQ ID NO: 1783945 - RNA, 22 nt, Human
cagcugccuuagcuucaggaac

SEQ ID NO: 1783946 - RNA, 23 nt, Human
cagcugccuuagcuucaggaacc

SEQ ID NO: 1783947 - RNA, 19 nt, Human
cagcugcgguccacccagg

SEQ ID NO: 1783948 - RNA, 20 nt, Human
cagcugcgguccacccagga

SEQ ID NO: 1783949 - RNA, 21 nt, Human
cagcugcgguccacccaggag

SEQ ID NO: 1783950 - RNA, 22 nt, Human
cagcugcgguccacccaggagc

SEQ ID NO: 1783951 - RNA, 23 nt, Human
cagcugcgguccacccaggagcc

SEQ ID NO: 1783952 - RNA, 24 nt, Human
cagcugcgguccacccaggagccc

SEQ ID NO: 1783953 - RNA, 23 nt, Human
cagcuggaugagaauuugagugc

SEQ ID NO: 1783954 - RNA, 18 nt, Human
cagcuggaugauggucuu

SEQ ID NO: 1783955 - RNA, 23 nt, Human
cagcugcuuuugucuaugggacu

SEQ ID NO: 1783956 - RNA, 22 nt, Human
cagcugcuuuugucuaugggac

SEQ ID NO: 1783957 - RNA, 23 nt, Human
caggaagccgccaguacuuguca

SEQ ID NO: 1783958 - RNA, 17 nt, Human
caggaauauaugugugc

SEQ ID NO: 1783959 - RNA, 20 nt, Human
caggaccuucgggcugugcc

SEQ ID NO: 1783960 - RNA, 21 nt, Human
caggaccuucgggcugugccc

SEQ ID NO: 1783961 - RNA, 22 nt, Human
caggaccuucgggcugugcccg

SEQ ID NO: 1783962 - RNA, 21 nt, Human
caggaccucugaaacccugga

SEQ ID NO: 1783963 - RNA, 13 nt, Human
caggaccugccug

SEQ ID NO: 1783964 - RNA, 19 nt, Human
caggaccugccuguagccc

SEQ ID NO: 1783965 - RNA, 14 nt, Human
caggaccugccugu

SEQ ID NO: 1783966 - RNA, 15 nt, Human
caggaccugccugua

SEQ ID NO: 1783967 - RNA, 14 nt, Human
caggaagaaagaau

SEQ ID NO: 1783968 - RNA, 17 nt, Human
caggaagaaagaauguu

SEQ ID NO: 1783969 - RNA, 18 nt, Human
caggaaccucgaguacug

SEQ ID NO: 1783970 - RNA, 19 nt, Human
caggaaccucgaguacugu

SEQ ID NO: 1783971 - RNA, 20 nt, Human
caggaaccucgaguacugug

SEQ ID NO: 1783972 - RNA, 21 nt, Human
caggaaccucgaguacugugg

SEQ ID NO: 1783973 - RNA, 23 nt, Human
caggaaccucgaguacugugggc

SEQ ID NO: 1783974 - RNA, 18 nt, Human
cagcuugaggguugggcu

SEQ ID NO: 1783975 - RNA, 19 nt, Human
cagcuugaggguugggcug

SEQ ID NO: 1783976 - RNA, 20 nt, Human
cagcuugaggguugggcugg

SEQ ID NO: 1783977 - RNA, 21 nt, Human
cagcuugaggguugggcuggu

SEQ ID NO: 1783978 - RNA, 14 nt, Human
cagcuugaggguug

SEQ ID NO: 1783979 - RNA, 15 nt, Human
cagcuugaggguugg

SEQ ID NO: 1783980 - RNA, 20 nt, Human
cagcuucauuuccugugucu

SEQ ID NO: 1783981 - RNA, 21 nt, Human
cagcuucauuuccugugucuu

SEQ ID NO: 1783982 - RNA, 18 nt, Human
cagcuucuauccuugacu

SEQ ID NO: 1783983 - RNA, 21 nt, Human
cagcuuguaaauagcucaggu

SEQ ID NO: 1783984 - RNA, 22 nt, Human
cagcuuguaaauagcucaggug

SEQ ID NO: 1783985 - RNA, 18 nt, Human
cagcuuguaaauagcuca

SEQ ID NO: 1783986 - RNA, 19 nt, Human
cagcuuguaaauagcucag

SEQ ID NO: 1783987 - RNA, 20 nt, Human
cagcuuguaaauagcucagg

SEQ ID NO: 1783988 - RNA, 16 nt, Human
caguccauagcagaga

SEQ ID NO: 1783989 - RNA, 13 nt, Human
caguccacaaaau

SEQ ID NO: 1783990 - RNA, 16 nt, Human
caguauuacuucugcu

SEQ ID NO: 1783991 - RNA, 15 nt, Human
caguaugguacauuu

SEQ ID NO: 1783992 - RNA, 16 nt, Human
caguaugguacauuuu

SEQ ID NO: 1783993 - RNA, 17 nt, Human
caguaugguacauuuuu

SEQ ID NO: 1783994 - RNA, 18 nt, Human
caguaugguacauuuuuc

SEQ ID NO: 1783995 - RNA, 20 nt, Human
caguaugguacauuuuucaa

SEQ ID NO: 1783996 - RNA, 23 nt, Human
caguaugguacauuuuucaacuu

SEQ ID NO: 1783997 - RNA, 18 nt, Human
caguauuacuucugcuac

SEQ ID NO: 1783998 - RNA, 19 nt, Human
caguauuacuucugcuaca

SEQ ID NO: 1783999 - RNA, 21 nt, Human
cagucaggaaaggaaucauuu

SEQ ID NO: 1784000 - RNA, 22 nt, Human
caguaggagcccagcucugaaa

SEQ ID NO: 1784001 - RNA, 12 nt, Human
caguaggagccc

SEQ ID NO: 1784002 - RNA, 14 nt, Human
caguaggagcccag

SEQ ID NO: 1784003 - RNA, 15 nt, Human
caguaggagcccagc

SEQ ID NO: 1784004 - RNA, 21 nt, Human
caguaggagcccagcucugaa

SEQ ID NO: 1784005 - RNA, 18 nt, Human
caguagaaauaauaugca

SEQ ID NO: 1784006 - RNA, 19 nt, Human
caguagaaauaauaugcau

SEQ ID NO: 1784007 - RNA, 23 nt, Human
caguauaauugaguuuucagugg

SEQ ID NO: 1784008 - RNA, 14 nt, Human
cagugcucgcuguu

SEQ ID NO: 1784009 - RNA, 14 nt, Human
cagugcucccucac

SEQ ID NO: 1784010 - RNA, 22 nt, Human
cagugcucgcuguugcugaaua

SEQ ID NO: 1784011 - RNA, 21 nt, Human
cagugcucgcuguugcugaau

SEQ ID NO: 1784012 - RNA, 20 nt, Human
cagugcucgcuguugcugaa

SEQ ID NO: 1784013 - RNA, 19 nt, Human
cagugcucgcuguugcuga

SEQ ID NO: 1784014 - RNA, 18 nt, Human
cagugcucgcuguugcug

SEQ ID NO: 1784015 - RNA, 17 nt, Human
cagugcucgcuguugcu

SEQ ID NO: 1784016 - RNA, 16 nt, Human
cagugcucgcuguugc

SEQ ID NO: 1784017 - RNA, 15 nt, Human
cagugcucgcuguug

SEQ ID NO: 1784018 - RNA, 19 nt, Human
cagugagucgaggacaggg

SEQ ID NO: 1784019 - RNA, 20 nt, Human
cagugagucgaggacaggga

SEQ ID NO: 1784020 - RNA, 22 nt, Human
cagugagucgaggacagggagg

SEQ ID NO: 1784021 - RNA, 23 nt, Human
cagugagucgaggacagggaggu

SEQ ID NO: 1784022 - RNA, 23 nt, Human
cagugauguaccaugaaacaaag

SEQ ID NO: 1784023 - RNA, 13 nt, Human
cagugagccacuc

SEQ ID NO: 1784024 - RNA, 17 nt, Human
cagugagucgaggacag

SEQ ID NO: 1784025 - RNA, 18 nt, Human
cagugagucgaggacagg

SEQ ID NO: 1784026 - RNA, 18 nt, Human
cagugaaugauucagugu

SEQ ID NO: 1784027 - RNA, 20 nt, Human
cagugaaugauucaguguua

SEQ ID NO: 1784028 - RNA, 17 nt, Human
cagugacacgucucgcc

SEQ ID NO: 1784029 - RNA, 23 nt, Human
cagugacacgucucgccaagcag

SEQ ID NO: 1784030 - RNA, 16 nt, Human
cagugaauuuuugcaa

SEQ ID NO: 1784031 - RNA, 17 nt, Human
cagugaauuuuugcaau

SEQ ID NO: 1784032 - RNA, 18 nt, Human
cagugaauuuuugcaaua

SEQ ID NO: 1784033 - RNA, 19 nt, Human
cagugaauuuuugcaauaa

SEQ ID NO: 1784034 - RNA, 20 nt, Human
cagugaauuuuugcaauaau

SEQ ID NO: 1784035 - RNA, 21 nt, Human
cagugaauuuuugcaauaaug

SEQ ID NO: 1784036 - RNA, 22 nt, Human
cagugaauuuuugcaauaaugc

SEQ ID NO: 1784037 - RNA, 23 nt, Human
cagugaauuuuugcaauaaugca

SEQ ID NO: 1784038 - RNA, 17 nt, Human
cagugaaugauucagug

SEQ ID NO: 1784039 - RNA, 22 nt, Human
caguccugaucagagccguggu

SEQ ID NO: 1784040 - RNA, 19 nt, Human
cagucuggaaugcaguggu

SEQ ID NO: 1784041 - RNA, 15 nt, Human
cagucuuccauuugc

SEQ ID NO: 1784042 - RNA, 16 nt, Human
cagucuuccacaaaga

SEQ ID NO: 1784043 - RNA, 17 nt, Human
cagucuuccacaaagaa

SEQ ID NO: 1784044 - RNA, 18 nt, Human
cagucuuccacaaagaaa

SEQ ID NO: 1784045 - RNA, 19 nt, Human
cagucuuccacaaagaaaa

SEQ ID NO: 1784046 - RNA, 20 nt, Human
cagucuuccacaaagaaaau

SEQ ID NO: 1784047 - RNA, 21 nt, Human
cagucuuccacaaagaaaauu

SEQ ID NO: 1784048 - RNA, 17 nt, Human
cagucuuccauuugcaa

SEQ ID NO: 1784049 - RNA, 18 nt, Human
cagucuuccauuugcaag

SEQ ID NO: 1784050 - RNA, 21 nt, Human
cagucuuccauuugcaaggga

SEQ ID NO: 1784051 - RNA, 20 nt, Human
cagugaaagaaaauaacaau

SEQ ID NO: 1784052 - RNA, 16 nt, Human
cagugaaagaaaauaa

SEQ ID NO: 1784053 - RNA, 18 nt, Human
caggucuugaacuccugg

SEQ ID NO: 1784054 - RNA, 19 nt, Human
caggucuugaacuccuggc

SEQ ID NO: 1784055 - RNA, 20 nt, Human
caggucuugaacuccuggcc

SEQ ID NO: 1784056 - RNA, 21 nt, Human
caggucuugaacuccuggccu

SEQ ID NO: 1784057 - RNA, 22 nt, Human
caggucuugaacuccuggccuc

SEQ ID NO: 1784058 - RNA, 23 nt, Human
caggucuugaacuccuggccuca

SEQ ID NO: 1784059 - RNA, 22 nt, Human
caggugcuggagcacugggcuc

SEQ ID NO: 1784060 - RNA, 23 nt, Human
caggugcuggagcacugggcucc

SEQ ID NO: 1784061 - RNA, 13 nt, Human
caggugcugucca

SEQ ID NO: 1784062 - RNA, 14 nt, Human
caggugcuguccau

SEQ ID NO: 1784063 - RNA, 15 nt, Human
caggugcuggagcac

SEQ ID NO: 1784064 - RNA, 18 nt, Human
caggugcuggagcacugg

SEQ ID NO: 1784065 - RNA, 19 nt, Human
caggugcuggagcacuggg

SEQ ID NO: 1784066 - RNA, 21 nt, Human
caggugcuggagcacugggcu

SEQ ID NO: 1784067 - RNA, 16 nt, Human
caggugaaacccaguc

SEQ ID NO: 1784068 - RNA, 20 nt, Human
cagguaacaggcagauacag

SEQ ID NO: 1784069 - RNA, 21 nt, Human
cagguaacaggcagauacagg

SEQ ID NO: 1784070 - RNA, 21 nt, Human
cagguacccuucucgcuuuug

SEQ ID NO: 1784071 - RNA, 13 nt, Human
cagguagggggga

SEQ ID NO: 1784072 - RNA, 15 nt, Human
cagguagccugcugg

SEQ ID NO: 1784073 - RNA, 16 nt, Human
caggguuuugccaugu

SEQ ID NO: 1784074 - RNA, 17 nt, Human
cagggucucacucuguc

SEQ ID NO: 1784075 - RNA, 16 nt, Human
cagggucucacucugu

SEQ ID NO: 1784076 - RNA, 14 nt, Human
cagguaacaggcag

SEQ ID NO: 1784077 - RNA, 15 nt, Human
cagguaacaggcaga

SEQ ID NO: 1784078 - RNA, 16 nt, Human
cagguaacaggcagau

SEQ ID NO: 1784079 - RNA, 17 nt, Human
cagguaacaggcagaua

SEQ ID NO: 1784080 - RNA, 21 nt, Human
cagggucucacuauguugccc

SEQ ID NO: 1784081 - RNA, 22 nt, Human
cagggucucacuauguugccca

SEQ ID NO: 1784082 - RNA, 23 nt, Human
cagggucucacuauguugcccag

SEQ ID NO: 1784083 - RNA, 15 nt, Human
cagggucucacucug

SEQ ID NO: 1784084 - RNA, 18 nt, Human
cagggucagaaacaggac

SEQ ID NO: 1784085 - RNA, 19 nt, Human
cagggucagaaacaggacc

SEQ ID NO: 1784086 - RNA, 10 nt, Human
cagggucaga

SEQ ID NO: 1784087 - RNA, 16 nt, Human
cagggucagaaacagg

SEQ ID NO: 1784088 - RNA, 13 nt, Human
cagguggggcagc

SEQ ID NO: 1784089 - RNA, 14 nt, Human
cagguggggcagcu

SEQ ID NO: 1784090 - RNA, 19 nt, Human
cagguggggagacugggcu

SEQ ID NO: 1784091 - RNA, 20 nt, Human
cagguggggagacugggcug

SEQ ID NO: 1784092 - RNA, 22 nt, Human
cagguggggagacugggcugag

SEQ ID NO: 1784093 - RNA, 15 nt, Human
cagguggggcagcuu

SEQ ID NO: 1784094 - RNA, 16 nt, Human
cagguggggcagcuug

SEQ ID NO: 1784095 - RNA, 17 nt, Human
cagguggggcagcuuga

SEQ ID NO: 1784096 - RNA, 23 nt, Human
cagguggggagacugggcugagg

SEQ ID NO: 1784097 - RNA, 17 nt, Human
cagguggggguugcugu

SEQ ID NO: 1784098 - RNA, 21 nt, Human
cagguggggguugcuguauaa

SEQ ID NO: 1784099 - RNA, 13 nt, Human
caggugggucccg

SEQ ID NO: 1784100 - RNA, 22 nt, Human
caggugggucccggcucugugg

SEQ ID NO: 1784101 - RNA, 11 nt, Human
caggugucccu

SEQ ID NO: 1784102 - RNA, 14 nt, Human
caggugucccugca

SEQ ID NO: 1784103 - RNA, 22 nt, Human
caggugugagucaccaagccca

SEQ ID NO: 1784104 - RNA, 23 nt, Human
caggugugagucaccaagcccag

SEQ ID NO: 1784105 - RNA, 16 nt, Human
caggugugagucacca

SEQ ID NO: 1784106 - RNA, 20 nt, Human
caggugugagucaccaagcc

SEQ ID NO: 1784107 - RNA, 21 nt, Human
caggugugagucaccaagccc

SEQ ID NO: 1784108 - RNA, 16 nt, Human
caggugugaaccacca

SEQ ID NO: 1784109 - RNA, 19 nt, Human
caggugugaaccaccacac

SEQ ID NO: 1784110 - RNA, 22 nt, Human
caggugugaaccaccacaccca

SEQ ID NO: 1784111 - RNA, 23 nt, Human
caggugugaaccaccacacccag

SEQ ID NO: 1784112 - RNA, 15 nt, Human
caggugucccugcac

SEQ ID NO: 1784113 - RNA, 16 nt, Human
caggugucccugcacu

SEQ ID NO: 1784114 - RNA, 18 nt, Human
caggugucccugcacuug

SEQ ID NO: 1784115 - RNA, 19 nt, Human
caggugucccugcacuugc

SEQ ID NO: 1784116 - RNA, 12 nt, Human
caggugugaacc

SEQ ID NO: 1784117 - RNA, 12 nt, Human
cagguucagcuu

SEQ ID NO: 1784118 - RNA, 13 nt, Human
cagguucauggau

SEQ ID NO: 1784119 - RNA, 22 nt, Human
cagguucauggauuacuucucu

SEQ ID NO: 1784120 - RNA, 13 nt, Human
cagguucagcuug

SEQ ID NO: 1784121 - RNA, 23 nt, Human
caguaccuucaaacuagggccaa

SEQ ID NO: 1784122 - RNA, 12 nt, Human
caguacuuguca

SEQ ID NO: 1784123 - RNA, 13 nt, Human
caguacuugucau

SEQ ID NO: 1784124 - RNA, 22 nt, Human
caggagucucugguagccugca

SEQ ID NO: 1784125 - RNA, 23 nt, Human
caggagccccgaggccuucucug

SEQ ID NO: 1784126 - RNA, 20 nt, Human
caggagccccgaggccuucu

SEQ ID NO: 1784127 - RNA, 22 nt, Human
caggagccccgaggccuucucu

SEQ ID NO: 1784128 - RNA, 15 nt, Human
caggagccccgaggc

SEQ ID NO: 1784129 - RNA, 16 nt, Human
caggagccccgaggcc

SEQ ID NO: 1784130 - RNA, 18 nt, Human
caggagccccgaggccuu

SEQ ID NO: 1784131 - RNA, 12 nt, Human
caggagugagca

SEQ ID NO: 1784132 - RNA, 12 nt, Human
caggacucugac

SEQ ID NO: 1784133 - RNA, 14 nt, Human
caggacucugaccc

SEQ ID NO: 1784134 - RNA, 17 nt, Human
caggacgugggcugggc

SEQ ID NO: 1784135 - RNA, 16 nt, Human
caggacgugggcuggg

SEQ ID NO: 1784136 - RNA, 16 nt, Human
caggacucagaagccu

SEQ ID NO: 1784137 - RNA, 18 nt, Human
caggacucagaagccucu

SEQ ID NO: 1784138 - RNA, 19 nt, Human
caggacucagaagccucug

SEQ ID NO: 1784139 - RNA, 20 nt, Human
caggacucagaagccucugg

SEQ ID NO: 1784140 - RNA, 21 nt, Human
caggacucagaagccucuggg

SEQ ID NO: 1784141 - RNA, 21 nt, Human
caggagcacacccagccccca

SEQ ID NO: 1784142 - RNA, 15 nt, Human
caggagcacacccag

SEQ ID NO: 1784143 - RNA, 16 nt, Human
caggagcacacccagc

SEQ ID NO: 1784144 - RNA, 19 nt, Human
caggagcacacccagcccc

SEQ ID NO: 1784145 - RNA, 15 nt, Human
caggacuuccccgga

SEQ ID NO: 1784146 - RNA, 21 nt, Human
caggacuuccccggagggcug

SEQ ID NO: 1784147 - RNA, 22 nt, Human
caggacuuccccggagggcugc

SEQ ID NO: 1784148 - RNA, 19 nt, Human
caggagaaggccaauuccu

SEQ ID NO: 1784149 - RNA, 21 nt, Human
caggagaaggccaauuccuau

SEQ ID NO: 1784150 - RNA, 22 nt, Human
caggagaaggccaauuccuaua

SEQ ID NO: 1784151 - RNA, 13 nt, Human
caggcccggcucc

SEQ ID NO: 1784152 - RNA, 13 nt, Human
caggccccuggag

SEQ ID NO: 1784153 - RNA, 14 nt, Human
caggccccuggagg

SEQ ID NO: 1784154 - RNA, 16 nt, Human
caggccccuggaggcu

SEQ ID NO: 1784155 - RNA, 19 nt, Human
caggccccuggaggcugcc

SEQ ID NO: 1784156 - RNA, 20 nt, Human
caggccccuggaggcugccu

SEQ ID NO: 1784157 - RNA, 22 nt, Human
caggccccuggaggcugccucc

SEQ ID NO: 1784158 - RNA, 23 nt, Human
caggccccuggaggcugccuccc

SEQ ID NO: 1784159 - RNA, 14 nt, Human
caggcccggcucca

SEQ ID NO: 1784160 - RNA, 15 nt, Human
caggcccggcuccag

SEQ ID NO: 1784161 - RNA, 15 nt, Human
caggccccugccacc

SEQ ID NO: 1784162 - RNA, 17 nt, Human
caggccccugccacccu

SEQ ID NO: 1784163 - RNA, 19 nt, Human
caggccccugccacccugg

SEQ ID NO: 1784164 - RNA, 20 nt, Human
caggccccugccacccuggg

SEQ ID NO: 1784165 - RNA, 16 nt, Human
caggcccggcuccagg

SEQ ID NO: 1784166 - RNA, 15 nt, Human
caggccauugugaac

SEQ ID NO: 1784167 - RNA, 20 nt, Human
caggccauugugaaccaaug

SEQ ID NO: 1784168 - RNA, 15 nt, Human
caggccccaggaaag

SEQ ID NO: 1784169 - RNA, 13 nt, Human
caggccccugcca

SEQ ID NO: 1784170 - RNA, 14 nt, Human
caggcagguccagg

SEQ ID NO: 1784171 - RNA, 15 nt, Human
caggcagguccaggg

SEQ ID NO: 1784172 - RNA, 19 nt, Human
caggcagguccaggguuug

SEQ ID NO: 1784173 - RNA, 12 nt, Human
caggcaggucuu

SEQ ID NO: 1784174 - RNA, 13 nt, Human
caggcaggucuug

SEQ ID NO: 1784175 - RNA, 22 nt, Human
caggcaggucuugaacuccugg

SEQ ID NO: 1784176 - RNA, 23 nt, Human
caggcaggucuugaacuccuggc

SEQ ID NO: 1784177 - RNA, 19 nt, Human
caggcauugccaagggcuu

SEQ ID NO: 1784178 - RNA, 16 nt, Human
caggcauuuagcccuc

SEQ ID NO: 1784179 - RNA, 17 nt, Human
caggcauuuagcccuca

SEQ ID NO: 1784180 - RNA, 15 nt, Human
caggcauguucucug

SEQ ID NO: 1784181 - RNA, 18 nt, Human
caggcauguucucugagg

SEQ ID NO: 1784182 - RNA, 19 nt, Human
caggcauguucucugagga

SEQ ID NO: 1784183 - RNA, 20 nt, Human
caggcauguucucugaggac

SEQ ID NO: 1784184 - RNA, 13 nt, Human
caggcagguccag

SEQ ID NO: 1784185 - RNA, 14 nt, Human
caggcaaugcuggc

SEQ ID NO: 1784186 - RNA, 14 nt, Human
caggcaagcaccuc

SEQ ID NO: 1784187 - RNA, 15 nt, Human
caggcaagcaccucc

SEQ ID NO: 1784188 - RNA, 16 nt, Human
caggcaagcaccuccu

SEQ ID NO: 1784189 - RNA, 21 nt, Human
caggcaagcaccuccugccuc

SEQ ID NO: 1784190 - RNA, 14 nt, Human
caggauuugcacag

SEQ ID NO: 1784191 - RNA, 15 nt, Human
caggauuugcacaga

SEQ ID NO: 1784192 - RNA, 16 nt, Human
caggauuugcacagaa

SEQ ID NO: 1784193 - RNA, 22 nt, Human
caggauuugcacagaagcacau

SEQ ID NO: 1784194 - RNA, 13 nt, Human
caggaucagucug

SEQ ID NO: 1784195 - RNA, 14 nt, Human
caggaucagucuga

SEQ ID NO: 1784196 - RNA, 24 nt, Human
caggaucagauugcaugugacucu

SEQ ID NO: 1784197 - RNA, 20 nt, Human
caggaucagauugcauguga

SEQ ID NO: 1784198 - RNA, 23 nt, Human
caggaucagauugcaugugacuc

SEQ ID NO: 1784199 - RNA, 23 nt, Human
caggcugggcuucaguggcagcu

SEQ ID NO: 1784200 - RNA, 22 nt, Human
caggcuguaucccaugagccuc

SEQ ID NO: 1784201 - RNA, 23 nt, Human
caggcuguaucccaugagccuca

SEQ ID NO: 1784202 - RNA, 12 nt, Human
caggcuggucuc

SEQ ID NO: 1784203 - RNA, 19 nt, Human
caggcuggucucaaacucu

SEQ ID NO: 1784204 - RNA, 14 nt, Human
caggcuguauccca

SEQ ID NO: 1784205 - RNA, 20 nt, Human
caggcuguaucccaugagcc

SEQ ID NO: 1784206 - RNA, 21 nt, Human
caggcuguaucccaugagccu

SEQ ID NO: 1784207 - RNA, 16 nt, Human
cagggaaacagcuaau

SEQ ID NO: 1784208 - RNA, 22 nt, Human
caggcccggcuccaggcuccuu

SEQ ID NO: 1784209 - RNA, 20 nt, Human
caggcccggcuccaggcucc

SEQ ID NO: 1784210 - RNA, 21 nt, Human
caggcccggcuccaggcuccu

SEQ ID NO: 1784211 - RNA, 17 nt, Human
caggcccggcuccaggc

SEQ ID NO: 1784212 - RNA, 18 nt, Human
caggcccggcuccaggcu

SEQ ID NO: 1784213 - RNA, 19 nt, Human
caggcccggcuccaggcuc

SEQ ID NO: 1784214 - RNA, 21 nt, Human
caggcuccuuuagcgcccagu

SEQ ID NO: 1784215 - RNA, 14 nt, Human
caggcuccuuuagc

SEQ ID NO: 1784216 - RNA, 19 nt, Human
caggcuccuuuagcgccca

SEQ ID NO: 1784217 - RNA, 20 nt, Human
caggcuccuuuagcgcccag

SEQ ID NO: 1784218 - RNA, 13 nt, Human
caggccggcagcc

SEQ ID NO: 1784219 - RNA, 17 nt, Human
caggccggcagccccag

SEQ ID NO: 1784220 - RNA, 20 nt, Human
caggccggcagccccagccu

SEQ ID NO: 1784221 - RNA, 21 nt, Human
caggccggcagccccagccug

SEQ ID NO: 1784222 - RNA, 22 nt, Human
caggccggcagccccagccugc

SEQ ID NO: 1784223 - RNA, 23 nt, Human
caggccggcagccccagccugcu

SEQ ID NO: 1784224 - RNA, 19 nt, Human
caggccggcgagcccugug

SEQ ID NO: 1784225 - RNA, 20 nt, Human
caggccggcgagcccugugg

SEQ ID NO: 1784226 - RNA, 22 nt, Human
cagggcacaccgggcacucaga

SEQ ID NO: 1784227 - RNA, 23 nt, Human
cagggcacaccgggcacucagaa

SEQ ID NO: 1784228 - RNA, 15 nt, Human
cagggcacaccgggc

SEQ ID NO: 1784229 - RNA, 17 nt, Human
cagggcacaccgggcac

SEQ ID NO: 1784230 - RNA, 19 nt, Human
cagggcacaccgggcacuc

SEQ ID NO: 1784231 - RNA, 21 nt, Human
cagggcacaccgggcacucag

SEQ ID NO: 1784232 - RNA, 13 nt, Human
cagggcagaguga

SEQ ID NO: 1784233 - RNA, 19 nt, Human
cagggcagagugagaccca

SEQ ID NO: 1784234 - RNA, 15 nt, Human
cagggcaccugccac

SEQ ID NO: 1784235 - RNA, 14 nt, Human
cagggcacaccggg

SEQ ID NO: 1784236 - RNA, 20 nt, Human
cagggcaaggguuaaggccu

SEQ ID NO: 1784237 - RNA, 21 nt, Human
cagggcaaggguuaaggccug

SEQ ID NO: 1784238 - RNA, 22 nt, Human
cagggcaaggguuaaggccuga

SEQ ID NO: 1784239 - RNA, 23 nt, Human
cagggcaaggguuaaggccugaa

SEQ ID NO: 1784240 - RNA, 22 nt, Human
cagggcaagcuccgcaggacuu

SEQ ID NO: 1784241 - RNA, 13 nt, Human
cagggcaagcucc

SEQ ID NO: 1784242 - RNA, 15 nt, Human
cagggcaagcuccgc

SEQ ID NO: 1784243 - RNA, 18 nt, Human
cagggcaagcuccgcagg

SEQ ID NO: 1784244 - RNA, 21 nt, Human
cagggcaagcuccgcaggacu

SEQ ID NO: 1784245 - RNA, 20 nt, Human
cagggccaaacgcugagcca

SEQ ID NO: 1784246 - RNA, 22 nt, Human
cagggccaaacgcugagccacc

SEQ ID NO: 1784247 - RNA, 15 nt, Human
cagggcaucuugcug

SEQ ID NO: 1784248 - RNA, 18 nt, Human
cagggcaucuugcuggcu

SEQ ID NO: 1784249 - RNA, 19 nt, Human
cagggcaucuugcuggcua

SEQ ID NO: 1784250 - RNA, 20 nt, Human
cagggcaucuugcuggcuac

SEQ ID NO: 1784251 - RNA, 13 nt, Human
cagggcagggccc

SEQ ID NO: 1784252 - RNA, 20 nt, Human
cagggccccaggcauugcca

SEQ ID NO: 1784253 - RNA, 14 nt, Human
cagggccgccaggg

SEQ ID NO: 1784254 - RNA, 16 nt, Human
cagggccgccagggag

SEQ ID NO: 1784255 - RNA, 22 nt, Human
cagggccgccagggagaccugg

SEQ ID NO: 1784256 - RNA, 16 nt, Human
cagggccugagccugg

SEQ ID NO: 1784257 - RNA, 17 nt, Human
cagggccugagccuggc

SEQ ID NO: 1784258 - RNA, 18 nt, Human
cagggccugagccuggcc

SEQ ID NO: 1784259 - RNA, 19 nt, Human
cagggccugagccuggcca

SEQ ID NO: 1784260 - RNA, 20 nt, Human
cagggccugagccuggccag

SEQ ID NO: 1784261 - RNA, 21 nt, Human
cagggccugagccuggccagc

SEQ ID NO: 1784262 - RNA, 22 nt, Human
cagggccugagccuggccagcc

SEQ ID NO: 1784263 - RNA, 22 nt, Human
cagggccugcaggaccugccug

SEQ ID NO: 1784264 - RNA, 22 nt, Human
cagggaaacagcuaaugggaca

SEQ ID NO: 1784265 - RNA, 20 nt, Human
cagggaaaauuauuugcaua

SEQ ID NO: 1784266 - RNA, 19 nt, Human
caucuugcucugcugacag

SEQ ID NO: 1784267 - RNA, 16 nt, Human
caucuugcucugcuga

SEQ ID NO: 1784268 - RNA, 17 nt, Human
caucuugcucugcugac

SEQ ID NO: 1784269 - RNA, 14 nt, Human
caucuucuucacca

SEQ ID NO: 1784270 - RNA, 19 nt, Human
caucuucuucaccauuugg

SEQ ID NO: 1784271 - RNA, 22 nt, Human
caucuugaauacucugcccucu

SEQ ID NO: 1784272 - RNA, 16 nt, Human
caucuccugccuuccu

SEQ ID NO: 1784273 - RNA, 15 nt, Human
caucuccccucagcu

SEQ ID NO: 1784274 - RNA, 16 nt, Human
caucuccccucagcuc

SEQ ID NO: 1784275 - RNA, 17 nt, Human
caucuccccucagcucg

SEQ ID NO: 1784276 - RNA, 21 nt, Human
caucuccccucagcucggcuc

SEQ ID NO: 1784277 - RNA, 22 nt, Human
caucucgcucccucccaggacu

SEQ ID NO: 1784278 - RNA, 21 nt, Human
caucucgcucccucccaggac

SEQ ID NO: 1784279 - RNA, 19 nt, Human
caucuccugccuuccuccu

SEQ ID NO: 1784280 - RNA, 22 nt, Human
caucuccugccuuccuccuggg

SEQ ID NO: 1784281 - RNA, 14 nt, Human
caucucgcucccuc

SEQ ID NO: 1784282 - RNA, 17 nt, Human
caucucgcucccuccca

SEQ ID NO: 1784283 - RNA, 19 nt, Human
caucucgcucccucccagg

SEQ ID NO: 1784284 - RNA, 20 nt, Human
caucucgcucccucccagga

SEQ ID NO: 1784285 - RNA, 15 nt, Human
caucugaagagcaga

SEQ ID NO: 1784286 - RNA, 22 nt, Human
caugagccucagcauccuggca

SEQ ID NO: 1784287 - RNA, 23 nt, Human
caugagccucagcauccuggcac

SEQ ID NO: 1784288 - RNA, 12 nt, Human
caugagccugcu

SEQ ID NO: 1784289 - RNA, 14 nt, Human
caugagccugcugg

SEQ ID NO: 1784290 - RNA, 15 nt, Human
caugagccugcugga

SEQ ID NO: 1784291 - RNA, 16 nt, Human
caugagccugcuggaa

SEQ ID NO: 1784292 - RNA, 18 nt, Human
caugagccugcuggaagc

SEQ ID NO: 1784293 - RNA, 19 nt, Human
caugagccugcuggaagcc

SEQ ID NO: 1784294 - RNA, 20 nt, Human
caugagccugcuggaagccc

SEQ ID NO: 1784295 - RNA, 22 nt, Human
caugagccugcuggaagcccag

SEQ ID NO: 1784296 - RNA, 23 nt, Human
caugagccugcuggaagcccagc

SEQ ID NO: 1784297 - RNA, 13 nt, Human
caugaggaggggc

SEQ ID NO: 1784298 - RNA, 21 nt, Human
caugaggaggggccccccugc

SEQ ID NO: 1784299 - RNA, 13 nt, Human
caugaggggagag

SEQ ID NO: 1784300 - RNA, 14 nt, Human
caugaggggagagg

SEQ ID NO: 1784301 - RNA, 15 nt, Human
caugaggggagagga

SEQ ID NO: 1784302 - RNA, 18 nt, Human
caugaggggagaggagac

SEQ ID NO: 1784303 - RNA, 22 nt, Human
caugaggaggggccccccugcc

SEQ ID NO: 1784304 - RNA, 23 nt, Human
caugaggaggggccccccugccc

SEQ ID NO: 1784305 - RNA, 17 nt, Human
caugauacucauuucuu

SEQ ID NO: 1784306 - RNA, 20 nt, Human
caugauccaagcaagacuga

SEQ ID NO: 1784307 - RNA, 15 nt, Human
caugaguucugcuga

SEQ ID NO: 1784308 - RNA, 16 nt, Human
caugaguucugcugaa

SEQ ID NO: 1784309 - RNA, 12 nt, Human
caugagccucag

SEQ ID NO: 1784310 - RNA, 15 nt, Human
caugagccucagcau

SEQ ID NO: 1784311 - RNA, 17 nt, Human
caugagccucagcaucc

SEQ ID NO: 1784312 - RNA, 18 nt, Human
caugagccucagcauccu

SEQ ID NO: 1784313 - RNA, 19 nt, Human
caugagccucagcauccug

SEQ ID NO: 1784314 - RNA, 20 nt, Human
caugagccucagcauccugg

SEQ ID NO: 1784315 - RNA, 21 nt, Human
caugagccucagcauccuggc

SEQ ID NO: 1784316 - RNA, 18 nt, Human
caugaagauucuuuccca

SEQ ID NO: 1784317 - RNA, 13 nt, Human
caugaaacaaagc

SEQ ID NO: 1784318 - RNA, 13 nt, Human
caugaaauaugca

SEQ ID NO: 1784319 - RNA, 14 nt, Human
caugaaauaugcau

SEQ ID NO: 1784320 - RNA, 15 nt, Human
caugaaauaugcauc

SEQ ID NO: 1784321 - RNA, 13 nt, Human
caucaacaaaaau

SEQ ID NO: 1784322 - RNA, 15 nt, Human
caucaacaaaaauug

SEQ ID NO: 1784323 - RNA, 17 nt, Human
cauauugcacaugucuu

SEQ ID NO: 1784324 - RNA, 16 nt, Human
cauauugcacaugucu

SEQ ID NO: 1784325 - RNA, 15 nt, Human
cauauugcacauguc

SEQ ID NO: 1784326 - RNA, 14 nt, Human
cauauugcacaugu

SEQ ID NO: 1784327 - RNA, 22 nt, Human
cauauugcacaugucuuaauga

SEQ ID NO: 1784328 - RNA, 23 nt, Human
cauauugcacaugucuuaaugaa

SEQ ID NO: 1784329 - RNA, 21 nt, Human
cauauugcacaugucuuaaug

SEQ ID NO: 1784330 - RNA, 20 nt, Human
cauauugcacaugucuuaau

SEQ ID NO: 1784331 - RNA, 19 nt, Human
cauauugcacaugucuuaa

SEQ ID NO: 1784332 - RNA, 18 nt, Human
cauauugcacaugucuua

SEQ ID NO: 1784333 - RNA, 22 nt, Human
cauauucuguuggccaguguga

SEQ ID NO: 1784334 - RNA, 15 nt, Human
cauaugaauuguaca

SEQ ID NO: 1784335 - RNA, 16 nt, Human
cauaugaauuguacag

SEQ ID NO: 1784336 - RNA, 17 nt, Human
cauaugaauuguacaga

SEQ ID NO: 1784337 - RNA, 11 nt, Human
cauaucugccu

SEQ ID NO: 1784338 - RNA, 18 nt, Human
cauaucugccuuuauugu

SEQ ID NO: 1784339 - RNA, 15 nt, Human
cauaucugccuuuau

SEQ ID NO: 1784340 - RNA, 13 nt, Human
cauaucugccuuu

SEQ ID NO: 1784341 - RNA, 12 nt, Human
cauaucugccuu

SEQ ID NO: 1784342 - RNA, 20 nt, Human
cauaucugccuuuauugugu

SEQ ID NO: 1784343 - RNA, 15 nt, Human
cauaugaaaggagag

SEQ ID NO: 1784344 - RNA, 16 nt, Human
cauaugaaaggugcca

SEQ ID NO: 1784345 - RNA, 19 nt, Human
cauaugaaaggugccaugg

SEQ ID NO: 1784346 - RNA, 20 nt, Human
cauaugaaaggugccaugga

SEQ ID NO: 1784347 - RNA, 21 nt, Human
cauaugaaaggugccauggaa

SEQ ID NO: 1784348 - RNA, 16 nt, Human
cauaguaugguggcug

SEQ ID NO: 1784349 - RNA, 17 nt, Human
cauaguaugguggcugg

SEQ ID NO: 1784350 - RNA, 12 nt, Human
cauagucccugc

SEQ ID NO: 1784351 - RNA, 15 nt, Human
cauaguaugguggcu

SEQ ID NO: 1784352 - RNA, 15 nt, Human
cagugcugcagcucc

SEQ ID NO: 1784353 - RNA, 19 nt, Human
cagugcugcagcucccugg

SEQ ID NO: 1784354 - RNA, 13 nt, Human
cauagucccugcc

SEQ ID NO: 1784355 - RNA, 22 nt, Human
cauauccuggugccccccaccc

SEQ ID NO: 1784356 - RNA, 13 nt, Human
caucaucuccugc

SEQ ID NO: 1784357 - RNA, 20 nt, Human
caucaucuccugccuuccuc

SEQ ID NO: 1784358 - RNA, 21 nt, Human
caucaucuccugccuuccucc

SEQ ID NO: 1784359 - RNA, 12 nt, Human
caucaucagagc

SEQ ID NO: 1784360 - RNA, 13 nt, Human
caucaucagagcc

SEQ ID NO: 1784361 - RNA, 13 nt, Human
caucaugucuggc

SEQ ID NO: 1784362 - RNA, 14 nt, Human
caucaugaguucug

SEQ ID NO: 1784363 - RNA, 16 nt, Human
caucaugaguucugcu

SEQ ID NO: 1784364 - RNA, 17 nt, Human
caucaugaguucugcug

SEQ ID NO: 1784365 - RNA, 18 nt, Human
caucaugaguucugcuga

SEQ ID NO: 1784366 - RNA, 14 nt, Human
caucaugucuggcu

SEQ ID NO: 1784367 - RNA, 15 nt, Human
caucaugucuggcua

SEQ ID NO: 1784368 - RNA, 13 nt, Human
caucaagaagggc

SEQ ID NO: 1784369 - RNA, 16 nt, Human
caucaagaagggcugc

SEQ ID NO: 1784370 - RNA, 17 nt, Human
caucaagaagggcugca

SEQ ID NO: 1784371 - RNA, 20 nt, Human
caucaagaagggcugcauga

SEQ ID NO: 1784372 - RNA, 21 nt, Human
caucaagaagggcugcaugau

SEQ ID NO: 1784373 - RNA, 22 nt, Human
caucaagaagggcugcaugaug

SEQ ID NO: 1784374 - RNA, 15 nt, Human
caucagugcucccuc

SEQ ID NO: 1784375 - RNA, 16 nt, Human
caucagugcucccuca

SEQ ID NO: 1784376 - RNA, 24 nt, Human
caucagugcucccucacaugucag

SEQ ID NO: 1784377 - RNA, 13 nt, Human
cauccaucaucau

SEQ ID NO: 1784378 - RNA, 14 nt, Human
cauccaucaucaug

SEQ ID NO: 1784379 - RNA, 20 nt, Human
cauccagagauucauuuucu

SEQ ID NO: 1784380 - RNA, 14 nt, Human
cauccacugugcca

SEQ ID NO: 1784381 - RNA, 15 nt, Human
caucauucucugucu

SEQ ID NO: 1784382 - RNA, 16 nt, Human
caucauucucugucuc

SEQ ID NO: 1784383 - RNA, 17 nt, Human
caucauucucugucuca

SEQ ID NO: 1784384 - RNA, 17 nt, Human
cauccacugugccaugu

SEQ ID NO: 1784385 - RNA, 23 nt, Human
cauccacugugccaugugccagg

SEQ ID NO: 1784386 - RNA, 12 nt, Human
caucauucucug

SEQ ID NO: 1784387 - RNA, 14 nt, Human
caucauucucuguc

SEQ ID NO: 1784388 - RNA, 17 nt, Human
caugucugcagugugcc

SEQ ID NO: 1784389 - RNA, 20 nt, Human
caugucugcagugugccccc

SEQ ID NO: 1784390 - RNA, 12 nt, Human
caugucuggcua

SEQ ID NO: 1784391 - RNA, 20 nt, Human
caugucuuaaugaaguuuga

SEQ ID NO: 1784392 - RNA, 18 nt, Human
caugucuuaaugaaguuu

SEQ ID NO: 1784393 - RNA, 17 nt, Human
caugucuuaaugaaguu

SEQ ID NO: 1784394 - RNA, 16 nt, Human
caugucuuaaugaagu

SEQ ID NO: 1784395 - RNA, 15 nt, Human
caugucuuaaugaag

SEQ ID NO: 1784396 - RNA, 14 nt, Human
caugucuuaaugaa

SEQ ID NO: 1784397 - RNA, 13 nt, Human
caugucuuaauga

SEQ ID NO: 1784398 - RNA, 23 nt, Human
caugucuucucacaagccagcca

SEQ ID NO: 1784399 - RNA, 13 nt, Human
caugugacucuga

SEQ ID NO: 1784400 - RNA, 16 nt, Human
caugugacucugaagc

SEQ ID NO: 1784401 - RNA, 23 nt, Human
caugucuuaaugaaguuugaaug

SEQ ID NO: 1784402 - RNA, 22 nt, Human
caugucuuaaugaaguuugaau

SEQ ID NO: 1784403 - RNA, 21 nt, Human
caugucuuaaugaaguuugaa

SEQ ID NO: 1784404 - RNA, 17 nt, Human
caugugacucugaagcu

SEQ ID NO: 1784405 - RNA, 14 nt, Human
caugugcacaugca

SEQ ID NO: 1784406 - RNA, 16 nt, Human
cauguguuaaguauuu

SEQ ID NO: 1784407 - RNA, 15 nt, Human
cauggugaaaagcuc

SEQ ID NO: 1784408 - RNA, 17 nt, Human
cauggugaaaagcucca

SEQ ID NO: 1784409 - RNA, 18 nt, Human
cauggugaaaagcuccau

SEQ ID NO: 1784410 - RNA, 21 nt, Human
caugguggguccaugggcaga

SEQ ID NO: 1784411 - RNA, 22 nt, Human
caugguggguccaugggcagag

SEQ ID NO: 1784412 - RNA, 15 nt, Human
cauguaaacugugca

SEQ ID NO: 1784413 - RNA, 22 nt, Human
cauguaaacacgccugcaaacg

SEQ ID NO: 1784414 - RNA, 16 nt, Human
cauguaaacugugcac

SEQ ID NO: 1784415 - RNA, 21 nt, Human
cauguaaauccccacugggac

SEQ ID NO: 1784416 - RNA, 13 nt, Human
caugggagccggg

SEQ ID NO: 1784417 - RNA, 22 nt, Human
caugggagccgggucugccucu

SEQ ID NO: 1784418 - RNA, 18 nt, Human
caugggccuccugugugu

SEQ ID NO: 1784419 - RNA, 15 nt, Human
caugggcagagccca

SEQ ID NO: 1784420 - RNA, 17 nt, Human
caugggcagagcccaag

SEQ ID NO: 1784421 - RNA, 14 nt, Human
caugggaggcucac

SEQ ID NO: 1784422 - RNA, 22 nt, Human
cauggagcuauaacuaagcauc

SEQ ID NO: 1784423 - RNA, 16 nt, Human
cauggaaaaacuuccu

SEQ ID NO: 1784424 - RNA, 19 nt, Human
caugcacuguucccccugu

SEQ ID NO: 1784425 - RNA, 23 nt, Human
caugcacuguucccccugugcag

SEQ ID NO: 1784426 - RNA, 22 nt, Human
cauuuaauaauauacuugugga

SEQ ID NO: 1784427 - RNA, 20 nt, Human
cauuuaauaauauacuugug

SEQ ID NO: 1784428 - RNA, 17 nt, Human
cauuuaauaauauacuu

SEQ ID NO: 1784429 - RNA, 21 nt, Human
cauugaauucuugguugagga

SEQ ID NO: 1784430 - RNA, 22 nt, Human
cauugaauucuugguugaggaa

SEQ ID NO: 1784431 - RNA, 23 nt, Human
cauugaauucuugguugaggaaa

SEQ ID NO: 1784432 - RNA, 18 nt, Human
cauuuaaauacagucuuc

SEQ ID NO: 1784433 - RNA, 17 nt, Human
cauuuaaauacagucuu

SEQ ID NO: 1784434 - RNA, 20 nt, Human
cauuuaaauacagucuucca

SEQ ID NO: 1784435 - RNA, 14 nt, Human
cauuuaauaauaua

SEQ ID NO: 1784436 - RNA, 13 nt, Human
cauuuaauaauau

SEQ ID NO: 1784437 - RNA, 12 nt, Human
cauuuaauaaua

SEQ ID NO: 1784438 - RNA, 22 nt, Human
cauuugcaagggaaaagucucu

SEQ ID NO: 1784439 - RNA, 14 nt, Human
cauuugagucucuu

SEQ ID NO: 1784440 - RNA, 17 nt, Human
cauuugaucuguugcaa

SEQ ID NO: 1784441 - RNA, 17 nt, Human
cauuuuuaguagagaca

SEQ ID NO: 1784442 - RNA, 16 nt, Human
ccaaaauuuauuuuau

SEQ ID NO: 1784443 - RNA, 21 nt, Human
ccaaaauuuauuuuauaagaa

SEQ ID NO: 1784444 - RNA, 22 nt, Human
ccaaaauuuauuuuauaagaaa

SEQ ID NO: 1784445 - RNA, 16 nt, Human
ccaaacaaauaugcaa

SEQ ID NO: 1784446 - RNA, 12 nt, Human
cauuuucuagau

SEQ ID NO: 1784447 - RNA, 13 nt, Human
cauuuucuagaua

SEQ ID NO: 1784448 - RNA, 17 nt, Human
cauuuucuagauacaau

SEQ ID NO: 1784449 - RNA, 18 nt, Human
cauuuucuagauacaaua

SEQ ID NO: 1784450 - RNA, 20 nt, Human
cauuuucuagauacaauaaa

SEQ ID NO: 1784451 - RNA, 21 nt, Human
cauuuucuagauacaauaaau

SEQ ID NO: 1784452 - RNA, 23 nt, Human
cauuuucuagauacaauaaauug

SEQ ID NO: 1784453 - RNA, 17 nt, Human
cauuuuccauauccugg

SEQ ID NO: 1784454 - RNA, 19 nt, Human
cauuuuccauauccuggug

SEQ ID NO: 1784455 - RNA, 21 nt, Human
cauuuuccauauccuggugcc

SEQ ID NO: 1784456 - RNA, 17 nt, Human
cauuccagaucccaggc

SEQ ID NO: 1784457 - RNA, 12 nt, Human
cauuccaaaguu

SEQ ID NO: 1784458 - RNA, 15 nt, Human
cauucacuugcauuu

SEQ ID NO: 1784459 - RNA, 18 nt, Human
cauucacuugcauuucuu

SEQ ID NO: 1784460 - RNA, 16 nt, Human
cauucaggagcuuccu

SEQ ID NO: 1784461 - RNA, 23 nt, Human
cauucuucuguacgucugacagg

SEQ ID NO: 1784462 - RNA, 13 nt, Human
cauucuuugcagg

SEQ ID NO: 1784463 - RNA, 12 nt, Human
cauucugccugc

SEQ ID NO: 1784464 - RNA, 13 nt, Human
cauucugccugcc

SEQ ID NO: 1784465 - RNA, 15 nt, Human
cauucugccugccca

SEQ ID NO: 1784466 - RNA, 16 nt, Human
cauucugccugcccag

SEQ ID NO: 1784467 - RNA, 17 nt, Human
cauucugccugcccagg

SEQ ID NO: 1784468 - RNA, 18 nt, Human
cauucugccugcccaggc

SEQ ID NO: 1784469 - RNA, 19 nt, Human
cauucugccugcccaggcc

SEQ ID NO: 1784470 - RNA, 20 nt, Human
cauucugccugcccaggccc

SEQ ID NO: 1784471 - RNA, 13 nt, Human
cauucuggaauaa

SEQ ID NO: 1784472 - RNA, 21 nt, Human
cauuccugggaaauauucccu

SEQ ID NO: 1784473 - RNA, 17 nt, Human
ccagguuuuuggucuga

SEQ ID NO: 1784474 - RNA, 15 nt, Human
ccaguaaaauugcca

SEQ ID NO: 1784475 - RNA, 13 nt, Human
ccaguaaaauugc

SEQ ID NO: 1784476 - RNA, 11 nt, Human
ccaguaaaauu

SEQ ID NO: 1784477 - RNA, 18 nt, Human
ccagucuggaaugcagug

SEQ ID NO: 1784478 - RNA, 23 nt, Human
ccaguaaaauugccauauugcac

SEQ ID NO: 1784479 - RNA, 19 nt, Human
ccaguaaaauugccauauu

SEQ ID NO: 1784480 - RNA, 17 nt, Human
ccaguaaaauugccaua

SEQ ID NO: 1784481 - RNA, 19 nt, Human
ccagucuggaaugcagugg

SEQ ID NO: 1784482 - RNA, 20 nt, Human
ccagucuggaaugcaguggu

SEQ ID NO: 1784483 - RNA, 14 nt, Human
ccagggcugccccu

SEQ ID NO: 1784484 - RNA, 16 nt, Human
ccaggguugaccccag

SEQ ID NO: 1784485 - RNA, 18 nt, Human
ccaggguugaccccagag

SEQ ID NO: 1784486 - RNA, 21 nt, Human
ccaggguugaccccagaggau

SEQ ID NO: 1784487 - RNA, 23 nt, Human
ccagggagaccuggacacaggcc

SEQ ID NO: 1784488 - RNA, 21 nt, Human
ccagggagaccuggacacagg

SEQ ID NO: 1784489 - RNA, 22 nt, Human
ccagggagaccuggacacaggc

SEQ ID NO: 1784490 - RNA, 20 nt, Human
ccaggagaaggccaauuccu

SEQ ID NO: 1784491 - RNA, 19 nt, Human
ccaggagccccgaggccuu

SEQ ID NO: 1784492 - RNA, 20 nt, Human
ccaggagccccgaggccuuc

SEQ ID NO: 1784493 - RNA, 18 nt, Human
ccaggccggcgagcccug

SEQ ID NO: 1784494 - RNA, 24 nt, Human
ccaggcuguaucccaugagccuca

SEQ ID NO: 1784495 - RNA, 17 nt, Human
ccaguguuagggaaggg

SEQ ID NO: 1784496 - RNA, 20 nt, Human
ccaguguuagggaagggccu

SEQ ID NO: 1784497 - RNA, 17 nt, Human
ccaguuaaaaaaaauuu

SEQ ID NO: 1784498 - RNA, 23 nt, Human
ccauauucuguuggccaguguga

SEQ ID NO: 1784499 - RNA, 14 nt, Human
ccauagcugcugcc

SEQ ID NO: 1784500 - RNA, 18 nt, Human
ccauagcugcugcccuag

SEQ ID NO: 1784501 - RNA, 23 nt, Human
ccauauugcacaugucuuaauga

SEQ ID NO: 1784502 - RNA, 21 nt, Human
ccauauugcacaugucuuaau

SEQ ID NO: 1784503 - RNA, 18 nt, Human
ccauauugcacaugucuu

SEQ ID NO: 1784504 - RNA, 13 nt, Human
ccauauugcacau

SEQ ID NO: 1784505 - RNA, 13 nt, Human
ccauagucccugc

SEQ ID NO: 1784506 - RNA, 14 nt, Human
ccauagucccugcc

SEQ ID NO: 1784507 - RNA, 17 nt, Human
ccauguuggccaggcug

SEQ ID NO: 1784508 - RNA, 16 nt, Human
ccauguuggccaggcu

SEQ ID NO: 1784509 - RNA, 15 nt, Human
cccaaauccgaaccu

SEQ ID NO: 1784510 - RNA, 18 nt, Human
cccaaauccgaaccuccu

SEQ ID NO: 1784511 - RNA, 23 nt, Human
cccaaauccgaaccuccucugug

SEQ ID NO: 1784512 - RNA, 16 nt, Human
cccaaagugcugggau

SEQ ID NO: 1784513 - RNA, 13 nt, Human
cccaaagugcugg

SEQ ID NO: 1784514 - RNA, 15 nt, Human
cccaaagugcuggga

SEQ ID NO: 1784515 - RNA, 19 nt, Human
ccauuuggcagagcuucuu

SEQ ID NO: 1784516 - RNA, 16 nt, Human
ccagcaagugagagcu

SEQ ID NO: 1784517 - RNA, 20 nt, Human
ccagcaagugagagcugggu

SEQ ID NO: 1784518 - RNA, 21 nt, Human
ccagcaagugagagcugggug

SEQ ID NO: 1784519 - RNA, 22 nt, Human
ccagcaagugagagcugggugu

SEQ ID NO: 1784520 - RNA, 15 nt, Human
ccagcaagugagagc

SEQ ID NO: 1784521 - RNA, 12 nt, Human
ccagccucagcg

SEQ ID NO: 1784522 - RNA, 13 nt, Human
ccagccucagcgc

SEQ ID NO: 1784523 - RNA, 21 nt, Human
ccagccucagcgcggcccucc

SEQ ID NO: 1784524 - RNA, 16 nt, Human
ccagccccagugccca

SEQ ID NO: 1784525 - RNA, 13 nt, Human
ccagcccucaucc

SEQ ID NO: 1784526 - RNA, 14 nt, Human
ccagcccucauccc

SEQ ID NO: 1784527 - RNA, 16 nt, Human
ccagcccuuagcaggg

SEQ ID NO: 1784528 - RNA, 17 nt, Human
ccagcccuuagcaggga

SEQ ID NO: 1784529 - RNA, 13 nt, Human
ccagccccagugc

SEQ ID NO: 1784530 - RNA, 15 nt, Human
ccagccccagugccc

SEQ ID NO: 1784531 - RNA, 14 nt, Human
ccagcauucucagg

SEQ ID NO: 1784532 - RNA, 16 nt, Human
ccagcauucucaggca

SEQ ID NO: 1784533 - RNA, 20 nt, Human
ccagcauucucaggcaccag

SEQ ID NO: 1784534 - RNA, 14 nt, Human
ccagccagcagcag

SEQ ID NO: 1784535 - RNA, 16 nt, Human
ccagccagcagcagcc

SEQ ID NO: 1784536 - RNA, 19 nt, Human
ccagccagcagcagcccaa

SEQ ID NO: 1784537 - RNA, 22 nt, Human
ccagccagcagcagcccaagcu

SEQ ID NO: 1784538 - RNA, 12 nt, Human
ccagcacugcuu

SEQ ID NO: 1784539 - RNA, 20 nt, Human
ccagcacuaugcuuuccuuc

SEQ ID NO: 1784540 - RNA, 21 nt, Human
ccagcacuaugcuuuccuucu

SEQ ID NO: 1784541 - RNA, 15 nt, Human
ccagcacugcuugag

SEQ ID NO: 1784542 - RNA, 18 nt, Human
ccagcacugcuugaggaa

SEQ ID NO: 1784543 - RNA, 19 nt, Human
ccagcacugcuugaggaaa

SEQ ID NO: 1784544 - RNA, 22 nt, Human
ccagcacugcuugaggaaaaca

SEQ ID NO: 1784545 - RNA, 21 nt, Human
ccagauugcaacaggcugggc

SEQ ID NO: 1784546 - RNA, 15 nt, Human
ccagauuccccugug

SEQ ID NO: 1784547 - RNA, 16 nt, Human
ccagauuccccugugu

SEQ ID NO: 1784548 - RNA, 17 nt, Human
ccagauuccccuguguc

SEQ ID NO: 1784549 - RNA, 18 nt, Human
ccagauuccccuguguca

SEQ ID NO: 1784550 - RNA, 19 nt, Human
ccagauugcaacaggcugg

SEQ ID NO: 1784551 - RNA, 20 nt, Human
ccagauugcaacaggcuggg

SEQ ID NO: 1784552 - RNA, 15 nt, Human
ccagaggcugcccca

SEQ ID NO: 1784553 - RNA, 22 nt, Human
ccagagggagugacagaggcag

SEQ ID NO: 1784554 - RNA, 23 nt, Human
ccagagggagugacagaggcagc

SEQ ID NO: 1784555 - RNA, 15 nt, Human
ccagagauucauuuu

SEQ ID NO: 1784556 - RNA, 17 nt, Human
ccagagauucauuuucu

SEQ ID NO: 1784557 - RNA, 17 nt, Human
ccagaggaaggggccag

SEQ ID NO: 1784558 - RNA, 19 nt, Human
ccagaggaaggggccagag

SEQ ID NO: 1784559 - RNA, 14 nt, Human
ccagagcuggugga

SEQ ID NO: 1784560 - RNA, 18 nt, Human
ccagagcugguggaccca

SEQ ID NO: 1784561 - RNA, 22 nt, Human
ccagagcugguggacccaggga

SEQ ID NO: 1784562 - RNA, 16 nt, Human
ccagagggagugacag

SEQ ID NO: 1784563 - RNA, 17 nt, Human
ccagagggagugacaga

SEQ ID NO: 1784564 - RNA, 11 nt, Human
ccagaggcucg

SEQ ID NO: 1784565 - RNA, 18 nt, Human
ccagagggagugacagag

SEQ ID NO: 1784566 - RNA, 19 nt, Human
ccagagggagugacagagg

SEQ ID NO: 1784567 - RNA, 20 nt, Human
ccagagggagugacagaggc

SEQ ID NO: 1784568 - RNA, 21 nt, Human
ccagagggagugacagaggca

SEQ ID NO: 1784569 - RNA, 22 nt, Human
ccagaggaaggggccagaggcu

SEQ ID NO: 1784570 - RNA, 20 nt, Human
ccagaggacugugaugcccu

SEQ ID NO: 1784571 - RNA, 22 nt, Human
ccagaggacugugaugcccugc

SEQ ID NO: 1784572 - RNA, 21 nt, Human
ccagaggauugcugccccauc

SEQ ID NO: 1784573 - RNA, 22 nt, Human
ccagaggcaccucaagaagaag

SEQ ID NO: 1784574 - RNA, 20 nt, Human
ccagacaccuugacagggca

SEQ ID NO: 1784575 - RNA, 21 nt, Human
ccagagaggguggugaccucu

SEQ ID NO: 1784576 - RNA, 23 nt, Human
ccagagaggguggugaccucugc

SEQ ID NO: 1784577 - RNA, 14 nt, Human
ccagagaggguggu

SEQ ID NO: 1784578 - RNA, 17 nt, Human
ccagacaccuugacagg

SEQ ID NO: 1784579 - RNA, 19 nt, Human
ccagacaccuugacagggc

SEQ ID NO: 1784580 - RNA, 15 nt, Human
ccacuggcugcuaac

SEQ ID NO: 1784581 - RNA, 16 nt, Human
ccacuggcugcuaaca

SEQ ID NO: 1784582 - RNA, 16 nt, Human
ccacugggaccaaccc

SEQ ID NO: 1784583 - RNA, 17 nt, Human
ccacugggaccaacccu

SEQ ID NO: 1784584 - RNA, 18 nt, Human
ccacugggaccaacccug

SEQ ID NO: 1784585 - RNA, 23 nt, Human
ccacugggaccaacccuggggaa

SEQ ID NO: 1784586 - RNA, 12 nt, Human
ccacacccagcc

SEQ ID NO: 1784587 - RNA, 13 nt, Human
ccacacccagccc

SEQ ID NO: 1784588 - RNA, 14 nt, Human
ccacacccagccca

SEQ ID NO: 1784589 - RNA, 14 nt, Human
ccaccacacccagc

SEQ ID NO: 1784590 - RNA, 16 nt, Human
ccaccacacccagccc

SEQ ID NO: 1784591 - RNA, 16 nt, Human
ccacccaccucagccu

SEQ ID NO: 1784592 - RNA, 14 nt, Human
ccacccaccucagc

SEQ ID NO: 1784593 - RNA, 15 nt, Human
ccacccaccucagcc

SEQ ID NO: 1784594 - RNA, 13 nt, Human
ccacccaccucag

SEQ ID NO: 1784595 - RNA, 15 nt, Human
ccacacucccaaggu

SEQ ID NO: 1784596 - RNA, 23 nt, Human
ccacacucccaagguuggagccc

SEQ ID NO: 1784597 - RNA, 14 nt, Human
ccacaucuugcucu

SEQ ID NO: 1784598 - RNA, 18 nt, Human
ccacaucuuccauuucca

SEQ ID NO: 1784599 - RNA, 16 nt, Human
ccacaucuugcucugc

SEQ ID NO: 1784600 - RNA, 22 nt, Human
ccacaucuugcucugcugacag

SEQ ID NO: 1784601 - RNA, 23 nt, Human
ccacaucuugcucugcugacaga

SEQ ID NO: 1784602 - RNA, 21 nt, Human
ccacccaggagccccgaggcc

SEQ ID NO: 1784603 - RNA, 12 nt, Human
ccaccucagccu

SEQ ID NO: 1784604 - RNA, 13 nt, Human
ccaccucagccuc

SEQ ID NO: 1784605 - RNA, 14 nt, Human
ccaccucagccucc

SEQ ID NO: 1784606 - RNA, 15 nt, Human
ccaccucagccuccc

SEQ ID NO: 1784607 - RNA, 12 nt, Human
ccacccaggagc

SEQ ID NO: 1784608 - RNA, 14 nt, Human
ccacccaggagccc

SEQ ID NO: 1784609 - RNA, 12 nt, Human
ccacggagccac

SEQ ID NO: 1784610 - RNA, 12 nt, Human
ccacggccaggc

SEQ ID NO: 1784611 - RNA, 20 nt, Human
ccacggagccacuccucuga

SEQ ID NO: 1784612 - RNA, 21 nt, Human
ccacggagccacuccucugac

SEQ ID NO: 1784613 - RNA, 13 nt, Human
ccacggccaggcc

SEQ ID NO: 1784614 - RNA, 14 nt, Human
ccacggccaggcca

SEQ ID NO: 1784615 - RNA, 15 nt, Human
ccacggccaggccag

SEQ ID NO: 1784616 - RNA, 17 nt, Human
ccaccugcaucuggggc

SEQ ID NO: 1784617 - RNA, 18 nt, Human
ccaccugcaucuggggcc

SEQ ID NO: 1784618 - RNA, 18 nt, Human
ccaccugcccuuuuuucu

SEQ ID NO: 1784619 - RNA, 22 nt, Human
ccaccugcccuuuuuucugccu

SEQ ID NO: 1784620 - RNA, 23 nt, Human
ccacguucugcucaucauucucu

SEQ ID NO: 1784621 - RNA, 22 nt, Human
ccacuccccuccacucucuacc

SEQ ID NO: 1784622 - RNA, 23 nt, Human
ccacuacggaauaguuggcuagg

SEQ ID NO: 1784623 - RNA, 20 nt, Human
ccacuaagaaccccucugcu

SEQ ID NO: 1784624 - RNA, 21 nt, Human
ccacuaagaaccccucugcuu

SEQ ID NO: 1784625 - RNA, 22 nt, Human
ccacuacggaauaguuggcuag

SEQ ID NO: 1784626 - RNA, 11 nt, Human
ccacugcucug

SEQ ID NO: 1784627 - RNA, 14 nt, Human
ccugcaucuggggc

SEQ ID NO: 1784628 - RNA, 15 nt, Human
ccugcaucuggggcc

SEQ ID NO: 1784629 - RNA, 20 nt, Human
ccugcauguaaacacgccug

SEQ ID NO: 1784630 - RNA, 21 nt, Human
ccugcauguaaacacgccugc

SEQ ID NO: 1784631 - RNA, 22 nt, Human
ccugcauguaaacacgccugca

SEQ ID NO: 1784632 - RNA, 23 nt, Human
ccugcauguaaacacgccugcaa

SEQ ID NO: 1784633 - RNA, 17 nt, Human
ccugcaaaaggacucuc

SEQ ID NO: 1784634 - RNA, 20 nt, Human
ccugauuguguauauucaua

SEQ ID NO: 1784635 - RNA, 19 nt, Human
ccugcaaaaggacucucag

SEQ ID NO: 1784636 - RNA, 15 nt, Human
ccugcaaacgcugcc

SEQ ID NO: 1784637 - RNA, 16 nt, Human
ccugcaaacgcugccu

SEQ ID NO: 1784638 - RNA, 17 nt, Human
ccugcaaacgcugccug

SEQ ID NO: 1784639 - RNA, 18 nt, Human
ccugcaaacgcugccugc

SEQ ID NO: 1784640 - RNA, 19 nt, Human
ccugcaaacgcugccugcc

SEQ ID NO: 1784641 - RNA, 22 nt, Human
ccugcaaacgcugccugcccac

SEQ ID NO: 1784642 - RNA, 21 nt, Human
ccugcaaacgcugccugcccg

SEQ ID NO: 1784643 - RNA, 22 nt, Human
ccugcaaacgcugccugcccgu

SEQ ID NO: 1784644 - RNA, 19 nt, Human
ccugaggaugggucagagc

SEQ ID NO: 1784645 - RNA, 20 nt, Human
ccugaggaugggucagagcu

SEQ ID NO: 1784646 - RNA, 18 nt, Human
ccugaggaacccuuacag

SEQ ID NO: 1784647 - RNA, 13 nt, Human
ccugacacucccu

SEQ ID NO: 1784648 - RNA, 13 nt, Human
ccuggacacaggc

SEQ ID NO: 1784649 - RNA, 16 nt, Human
ccuggacacaggccug

SEQ ID NO: 1784650 - RNA, 20 nt, Human
ccuggacacaggccugcucu

SEQ ID NO: 1784651 - RNA, 18 nt, Human
ccuggagacugcccagcu

SEQ ID NO: 1784652 - RNA, 22 nt, Human
ccuggcacccggccccugcugg

SEQ ID NO: 1784653 - RNA, 23 nt, Human
ccuggcacccggccccugcuggu

SEQ ID NO: 1784654 - RNA, 14 nt, Human
ccuggcuccaguga

SEQ ID NO: 1784655 - RNA, 18 nt, Human
ccuggcugcagccugcgc

SEQ ID NO: 1784656 - RNA, 14 nt, Human
ccuggcagcucagc

SEQ ID NO: 1784657 - RNA, 15 nt, Human
ccuggccagaugcac

SEQ ID NO: 1784658 - RNA, 15 nt, Human
ccugggggugccagg

SEQ ID NO: 1784659 - RNA, 16 nt, Human
ccugggggugccagga

SEQ ID NO: 1784660 - RNA, 14 nt, Human
ccugggggugccag

SEQ ID NO: 1784661 - RNA, 17 nt, Human
ccugguccacagggcac

SEQ ID NO: 1784662 - RNA, 17 nt, Human
ccuggguuuuguucccu

SEQ ID NO: 1784663 - RNA, 12 nt, Human
ccuggguuuugu

SEQ ID NO: 1784664 - RNA, 19 nt, Human
ccuggguuuuguauucucu

SEQ ID NO: 1784665 - RNA, 20 nt, Human
ccuggguuuuguauucucug

SEQ ID NO: 1784666 - RNA, 21 nt, Human
ccuggguuuuguauucucuga

SEQ ID NO: 1784667 - RNA, 22 nt, Human
ccuggguuuuguauucucugag

SEQ ID NO: 1784668 - RNA, 23 nt, Human
ccuggguuuuguauucucugagc

SEQ ID NO: 1784669 - RNA, 21 nt, Human
ccugcucuccgaccagacacc

SEQ ID NO: 1784670 - RNA, 22 nt, Human
ccugcucuccgaccagacaccu

SEQ ID NO: 1784671 - RNA, 14 nt, Human
ccuggaagagccca

SEQ ID NO: 1784672 - RNA, 15 nt, Human
ccuggaagagcccag

SEQ ID NO: 1784673 - RNA, 16 nt, Human
ccuggaagagcccagu

SEQ ID NO: 1784674 - RNA, 18 nt, Human
ccuggaagagcccagucu

SEQ ID NO: 1784675 - RNA, 20 nt, Human
ccuggaagagcccagucugu

SEQ ID NO: 1784676 - RNA, 11 nt, Human
ccugccucagc

SEQ ID NO: 1784677 - RNA, 16 nt, Human
ccugccgggcugaggg

SEQ ID NO: 1784678 - RNA, 19 nt, Human
ccugccgggcugagggccu

SEQ ID NO: 1784679 - RNA, 20 nt, Human
ccugccgggcugagggccug

SEQ ID NO: 1784680 - RNA, 21 nt, Human
ccugccgggcugagggccugc

SEQ ID NO: 1784681 - RNA, 23 nt, Human
ccugccgggcugagggccugcug

SEQ ID NO: 1784682 - RNA, 15 nt, Human
ccugccgguaaacac

SEQ ID NO: 1784683 - RNA, 20 nt, Human
ccugccgguaaacacgccug

SEQ ID NO: 1784684 - RNA, 21 nt, Human
ccugccgguaaacacgccugc

SEQ ID NO: 1784685 - RNA, 22 nt, Human
ccugccgguaaacacgccugca

SEQ ID NO: 1784686 - RNA, 23 nt, Human
ccugccgguaaacacgccugcaa

SEQ ID NO: 1784687 - RNA, 13 nt, Human
ccugcgccugcug

SEQ ID NO: 1784688 - RNA, 14 nt, Human
ccugcgccugcugc

SEQ ID NO: 1784689 - RNA, 18 nt, Human
ccugcgccugcugcaugc

SEQ ID NO: 1784690 - RNA, 15 nt, Human
ccugcgccugcugca

SEQ ID NO: 1784691 - RNA, 20 nt, Human
ccugcgccaccgcccagaga

SEQ ID NO: 1784692 - RNA, 16 nt, Human
ccugcgccaguccugc

SEQ ID NO: 1784693 - RNA, 17 nt, Human
ccugcgccaguccugcu

SEQ ID NO: 1784694 - RNA, 14 nt, Human
ccugccuuccuccu

SEQ ID NO: 1784695 - RNA, 16 nt, Human
ccugccuuccuccugg

SEQ ID NO: 1784696 - RNA, 17 nt, Human
ccugccuuccuccuggg

SEQ ID NO: 1784697 - RNA, 22 nt, Human
ccugccuuccuccugggcccuc

SEQ ID NO: 1784698 - RNA, 17 nt, Human
ccuuagaagucacacag

SEQ ID NO: 1784699 - RNA, 18 nt, Human
ccuuagaagucacacagu

SEQ ID NO: 1784700 - RNA, 17 nt, Human
ccuuacaguaggagccc

SEQ ID NO: 1784701 - RNA, 21 nt, Human
ccuuacaguaggagcccagcu

SEQ ID NO: 1784702 - RNA, 20 nt, Human
ccuuaaacaaaaauuaaaau

SEQ ID NO: 1784703 - RNA, 23 nt, Human
ccuguuuuuguuucuuguuuuga

SEQ ID NO: 1784704 - RNA, 20 nt, Human
ccugugugugcgccuacagg

SEQ ID NO: 1784705 - RNA, 21 nt, Human
ccugugugugcgccuacagga

SEQ ID NO: 1784706 - RNA, 20 nt, Human
ccuguguguccaaaacugcc

SEQ ID NO: 1784707 - RNA, 21 nt, Human
ccuguguguccaaaacugccu

SEQ ID NO: 1784708 - RNA, 22 nt, Human
ccugugucuugcaauggcagcc

SEQ ID NO: 1784709 - RNA, 23 nt, Human
ccugugucuucuccaccacgcug

SEQ ID NO: 1784710 - RNA, 13 nt, Human
ccuguguccugaa

SEQ ID NO: 1784711 - RNA, 17 nt, Human
ccugugucuugcaaugg

SEQ ID NO: 1784712 - RNA, 19 nt, Human
ccugugucuugcaauggca

SEQ ID NO: 1784713 - RNA, 21 nt, Human
ccugugucuugcaauggcagc

SEQ ID NO: 1784714 - RNA, 22 nt, Human
ccuggugccccccaccccugga

SEQ ID NO: 1784715 - RNA, 15 nt, Human
ccugugugcuugguc

SEQ ID NO: 1784716 - RNA, 12 nt, Human
ccuugggcccuu

SEQ ID NO: 1784717 - RNA, 14 nt, Human
ccuugggcccuuug

SEQ ID NO: 1784718 - RNA, 17 nt, Human
ccuugggcccuuugagu

SEQ ID NO: 1784719 - RNA, 19 nt, Human
ccuuggcuuuaugcacauu

SEQ ID NO: 1784720 - RNA, 15 nt, Human
ccuuucgaggccuga

SEQ ID NO: 1784721 - RNA, 16 nt, Human
ccuuucgaggccugaa

SEQ ID NO: 1784722 - RNA, 18 nt, Human
ccuuucgaggccugaagc

SEQ ID NO: 1784723 - RNA, 14 nt, Human
ccuuguccccauga

SEQ ID NO: 1784724 - RNA, 21 nt, Human
ccuuguuauuucucagacuuu

SEQ ID NO: 1784725 - RNA, 14 nt, Human
ccuucuguggggac

SEQ ID NO: 1784726 - RNA, 20 nt, Human
ccuucuguggggacuccggc

SEQ ID NO: 1784727 - RNA, 14 nt, Human
ccuucgggcugugc

SEQ ID NO: 1784728 - RNA, 16 nt, Human
ccuugacuuagauucu

SEQ ID NO: 1784729 - RNA, 13 nt, Human
ccuugacuuugcu

SEQ ID NO: 1784730 - RNA, 20 nt, Human
ccuugacuuugcuccucaca

SEQ ID NO: 1784731 - RNA, 19 nt, Human
ccuugaccugcauuguaaa

SEQ ID NO: 1784732 - RNA, 20 nt, Human
ccuugaccugcauuguaaau

SEQ ID NO: 1784733 - RNA, 22 nt, Human
cgauucaccugagcaggaccuc

SEQ ID NO: 1784734 - RNA, 18 nt, Human
cgagcccugguggcagug

SEQ ID NO: 1784735 - RNA, 13 nt, Human
cgauguaaauuau

SEQ ID NO: 1784736 - RNA, 15 nt, Human
cgagcccugguggca

SEQ ID NO: 1784737 - RNA, 16 nt, Human
cgagcccugguggcag

SEQ ID NO: 1784738 - RNA, 16 nt, Human
cgccagggagaccugg

SEQ ID NO: 1784739 - RNA, 19 nt, Human
cgcagagcgcgccccuagc

SEQ ID NO: 1784740 - RNA, 21 nt, Human
cgcagagcgcgccccuagccg

SEQ ID NO: 1784741 - RNA, 13 nt, Human
cgcagagcgcgcc

SEQ ID NO: 1784742 - RNA, 22 nt, Human
cgaaagggacuuggaagcuccg

SEQ ID NO: 1784743 - RNA, 19 nt, Human
cgaaagggacuuggaagcu

SEQ ID NO: 1784744 - RNA, 18 nt, Human
cgaaccuuggccugggcc

SEQ ID NO: 1784745 - RNA, 19 nt, Human
cgaaccuuggccugggccg

SEQ ID NO: 1784746 - RNA, 15 nt, Human
cgaaccuccucugug

SEQ ID NO: 1784747 - RNA, 16 nt, Human
cgaaccuccucuguga

SEQ ID NO: 1784748 - RNA, 17 nt, Human
cgaaccuuggccugggc

SEQ ID NO: 1784749 - RNA, 12 nt, Human
cgaacuggcugc

SEQ ID NO: 1784750 - RNA, 14 nt, Human
cgaacuggcugcaa

SEQ ID NO: 1784751 - RNA, 16 nt, Human
ccuuuuuuuuuuuucc

SEQ ID NO: 1784752 - RNA, 17 nt, Human
ccuuuuuuuuuuuucca

SEQ ID NO: 1784753 - RNA, 15 nt, Human
ccuugggggcuccca

SEQ ID NO: 1784754 - RNA, 18 nt, Human
cgagaucacgccacugca

SEQ ID NO: 1784755 - RNA, 20 nt, Human
cgagaucacgccacugcacu

SEQ ID NO: 1784756 - RNA, 20 nt, Human
cgagagucuggcccuagacu

SEQ ID NO: 1784757 - RNA, 13 nt, Human
cgagcaccuccac

SEQ ID NO: 1784758 - RNA, 18 nt, Human
cgagcaccuccagccuga

SEQ ID NO: 1784759 - RNA, 17 nt, Human
cgagaucacgccacugc

SEQ ID NO: 1784760 - RNA, 17 nt, Human
cgagagucuggcccuag

SEQ ID NO: 1784761 - RNA, 19 nt, Human
cgagagucuggcccuagac

SEQ ID NO: 1784762 - RNA, 14 nt, Human
cgagagucuggccc

SEQ ID NO: 1784763 - RNA, 15 nt, Human
cgagagucuggcccu

SEQ ID NO: 1784764 - RNA, 13 nt, Human
cgaauagcuggga

SEQ ID NO: 1784765 - RNA, 14 nt, Human
cgaauagcugggac

SEQ ID NO: 1784766 - RNA, 11 nt, Human
cgacugucucc

SEQ ID NO: 1784767 - RNA, 19 nt, Human
cgaauacuuuugcccuuug

SEQ ID NO: 1784768 - RNA, 16 nt, Human
cccaccauaugaauug

SEQ ID NO: 1784769 - RNA, 18 nt, Human
cccaccaucaugucuggc

SEQ ID NO: 1784770 - RNA, 19 nt, Human
cccacgcuggagugcagug

SEQ ID NO: 1784771 - RNA, 17 nt, Human
cccacgaaacugcccug

SEQ ID NO: 1784772 - RNA, 18 nt, Human
cccacgaaacugcccugg

SEQ ID NO: 1784773 - RNA, 20 nt, Human
cccacgaaacugcccuggcu

SEQ ID NO: 1784774 - RNA, 20 nt, Human
cccacgcuggagugcaguga

SEQ ID NO: 1784775 - RNA, 21 nt, Human
cccacgcuggagugcagugag

SEQ ID NO: 1784776 - RNA, 12 nt, Human
cccacuucugcc

SEQ ID NO: 1784777 - RNA, 19 nt, Human
cccaccugcaucuggggcc

SEQ ID NO: 1784778 - RNA, 19 nt, Human
cccacaggacauuucucua

SEQ ID NO: 1784779 - RNA, 20 nt, Human
cccacaggacauuucucuaa

SEQ ID NO: 1784780 - RNA, 15 nt, Human
cccacaaaggcaaag

SEQ ID NO: 1784781 - RNA, 21 nt, Human
cccgaggccuucucugaagga

SEQ ID NO: 1784782 - RNA, 13 nt, Human
cccgaguagcugg

SEQ ID NO: 1784783 - RNA, 23 nt, Human
cccgagggaggggaagcuucugu

SEQ ID NO: 1784784 - RNA, 14 nt, Human
cccgaguagcuggg

SEQ ID NO: 1784785 - RNA, 15 nt, Human
cccgaguagcuggga

SEQ ID NO: 1784786 - RNA, 16 nt, Human
cccgaguagcugggac

SEQ ID NO: 1784787 - RNA, 17 nt, Human
cccgaguagcugggacu

SEQ ID NO: 1784788 - RNA, 18 nt, Human
cccgaguagcugggacua

SEQ ID NO: 1784789 - RNA, 21 nt, Human
cccgaguagcugggacuacag

SEQ ID NO: 1784790 - RNA, 14 nt, Human
cccgggccagggcu

SEQ ID NO: 1784791 - RNA, 15 nt, Human
cccgggccagggcug

SEQ ID NO: 1784792 - RNA, 11 nt, Human
cccgggcccca

SEQ ID NO: 1784793 - RNA, 22 nt, Human
cccgaguagcugggacuacagg

SEQ ID NO: 1784794 - RNA, 18 nt, Human
cccuagccgguuccuguc

SEQ ID NO: 1784795 - RNA, 23 nt, Human
cccuagccgguuccugucccugc

SEQ ID NO: 1784796 - RNA, 17 nt, Human
cccuagccgguuccugu

SEQ ID NO: 1784797 - RNA, 22 nt, Human
cccggggaaaggcaagguccgg

SEQ ID NO: 1784798 - RNA, 16 nt, Human
cccggggcccagggca

SEQ ID NO: 1784799 - RNA, 15 nt, Human
cccggggcccagggc

SEQ ID NO: 1784800 - RNA, 13 nt, Human
cccgggggugggg

SEQ ID NO: 1784801 - RNA, 19 nt, Human
cccgggggugggggguggg

SEQ ID NO: 1784802 - RNA, 22 nt, Human
cccugcacuugcagacucuaca

SEQ ID NO: 1784803 - RNA, 19 nt, Human
cccugcacuugcagacucu

SEQ ID NO: 1784804 - RNA, 12 nt, Human
cccugcacuugc

SEQ ID NO: 1784805 - RNA, 20 nt, Human
cccucuguccaggcacugag

SEQ ID NO: 1784806 - RNA, 24 nt, Human
cccucuguccaggcacugagauac

SEQ ID NO: 1784807 - RNA, 21 nt, Human
cccuaguuuucuuuccuccuu

SEQ ID NO: 1784808 - RNA, 23 nt, Human
cccuaguuuucuuuccuccuuuc

SEQ ID NO: 1784809 - RNA, 11 nt, Human
cccuauaaauc

SEQ ID NO: 1784810 - RNA, 12 nt, Human
cccuccacucuc

SEQ ID NO: 1784811 - RNA, 20 nt, Human
cccucccaggacucugaccc

SEQ ID NO: 1784812 - RNA, 21 nt, Human
cccucuccuuuguucccggcu

SEQ ID NO: 1784813 - RNA, 14 nt, Human
cccucucugcucug

SEQ ID NO: 1784814 - RNA, 15 nt, Human
cccucucugcucugc

SEQ ID NO: 1784815 - RNA, 16 nt, Human
cccucucugcucugcg

SEQ ID NO: 1784816 - RNA, 14 nt, Human
cccucucuugucag

SEQ ID NO: 1784817 - RNA, 19 nt, Human
cccucuggauucugaaucu

SEQ ID NO: 1784818 - RNA, 16 nt, Human
cccuggaccagugguc

SEQ ID NO: 1784819 - RNA, 17 nt, Human
cccuggaccaguggucu

SEQ ID NO: 1784820 - RNA, 21 nt, Human
cccuggaccaguggucucaca

SEQ ID NO: 1784821 - RNA, 23 nt, Human
cccuggaccaguggucucacaug

SEQ ID NO: 1784822 - RNA, 17 nt, Human
ccucccgaauagcuggg

SEQ ID NO: 1784823 - RNA, 22 nt, Human
ccucuaucauggugaaaagcuc

SEQ ID NO: 1784824 - RNA, 23 nt, Human
ccuccuucauaugaaaggugcca

SEQ ID NO: 1784825 - RNA, 20 nt, Human
ccucuaaccucgcccucucc

SEQ ID NO: 1784826 - RNA, 14 nt, Human
ccucuagagccuuc

SEQ ID NO: 1784827 - RNA, 21 nt, Human
ccucuagagccuucagccuua

SEQ ID NO: 1784828 - RNA, 22 nt, Human
ccucuagagccuucagccuuaa

SEQ ID NO: 1784829 - RNA, 23 nt, Human
ccuccugccucgaacuggcugca

SEQ ID NO: 1784830 - RNA, 20 nt, Human
ccuccugacccauugcuguu

SEQ ID NO: 1784831 - RNA, 21 nt, Human
ccuccugacccauugcuguug

SEQ ID NO: 1784832 - RNA, 12 nt, Human
ccuccugagaaa

SEQ ID NO: 1784833 - RNA, 14 nt, Human
ccuccugggcuaag

SEQ ID NO: 1784834 - RNA, 22 nt, Human
ccuccucugugaccaaugucuu

SEQ ID NO: 1784835 - RNA, 12 nt, Human
ccuccucuguga

SEQ ID NO: 1784836 - RNA, 13 nt, Human
ccuccucugugaa

SEQ ID NO: 1784837 - RNA, 11 nt, Human
ccuccucugug

SEQ ID NO: 1784838 - RNA, 20 nt, Human
ccucccgaguagcugggacu

SEQ ID NO: 1784839 - RNA, 21 nt, Human
ccucccgaguagcugggacua

SEQ ID NO: 1784840 - RNA, 17 nt, Human
ccucaucuucuucacca

SEQ ID NO: 1784841 - RNA, 15 nt, Human
ccucaucugucccuc

SEQ ID NO: 1784842 - RNA, 17 nt, Human
ccucaucugucccuccg

SEQ ID NO: 1784843 - RNA, 15 nt, Human
ccucaucuucuucac

SEQ ID NO: 1784844 - RNA, 15 nt, Human
ccucaucaucagagc

SEQ ID NO: 1784845 - RNA, 18 nt, Human
ccucaucuucuucaccau

SEQ ID NO: 1784846 - RNA, 14 nt, Human
ccuccacauccucc

SEQ ID NO: 1784847 - RNA, 15 nt, Human
ccuccacauccucca

SEQ ID NO: 1784848 - RNA, 16 nt, Human
ccuccacauccuccac

SEQ ID NO: 1784849 - RNA, 20 nt, Human
ccuccacauccuccacguuc

SEQ ID NO: 1784850 - RNA, 14 nt, Human
ccucaucccgagca

SEQ ID NO: 1784851 - RNA, 20 nt, Human
ccucaucccgagcaccucca

SEQ ID NO: 1784852 - RNA, 21 nt, Human
ccuaugcuauugacaauaaaa

SEQ ID NO: 1784853 - RNA, 22 nt, Human
ccuaugcuauugacaauaaaau

SEQ ID NO: 1784854 - RNA, 23 nt, Human
ccuaugcuauugacaauaaaaua

SEQ ID NO: 1784855 - RNA, 11 nt, Human
ccucagugcca

SEQ ID NO: 1784856 - RNA, 20 nt, Human
ccucauaguaugguggcugg

SEQ ID NO: 1784857 - RNA, 21 nt, Human
ccucauaguaugguggcuggg

SEQ ID NO: 1784858 - RNA, 22 nt, Human
ccucauaguaugguggcugggu

SEQ ID NO: 1784859 - RNA, 23 nt, Human
ccuccaugugggcuaguugggcu

SEQ ID NO: 1784860 - RNA, 15 nt, Human
ccucccaaagugcug

SEQ ID NO: 1784861 - RNA, 16 nt, Human
ccucccaaagugcugg

SEQ ID NO: 1784862 - RNA, 17 nt, Human
ccuccacguucugcuca

SEQ ID NO: 1784863 - RNA, 18 nt, Human
ccuccacguucugcucau

SEQ ID NO: 1784864 - RNA, 21 nt, Human
ccuccacguucugcucaucau

SEQ ID NO: 1784865 - RNA, 14 nt, Human
ccgaggccuucucu

SEQ ID NO: 1784866 - RNA, 20 nt, Human
ccgaguagcugggacuacag

SEQ ID NO: 1784867 - RNA, 17 nt, Human
ccgaggccuucucugaa

SEQ ID NO: 1784868 - RNA, 17 nt, Human
ccgaguagcugggacua

SEQ ID NO: 1784869 - RNA, 16 nt, Human
ccgauucaccugagca

SEQ ID NO: 1784870 - RNA, 13 nt, Human
ccgauuucuguaa

SEQ ID NO: 1784871 - RNA, 14 nt, Human
ccgauuucuguaaa

SEQ ID NO: 1784872 - RNA, 16 nt, Human
ccgauuucuguaaacu

SEQ ID NO: 1784873 - RNA, 21 nt, Human
ccgcggggcugucggcgcugc

SEQ ID NO: 1784874 - RNA, 21 nt, Human
ccgcgaugggucagguagggg

SEQ ID NO: 1784875 - RNA, 15 nt, Human
ccgcgccacaggacc

SEQ ID NO: 1784876 - RNA, 16 nt, Human
ccgcgccacaggaccc

SEQ ID NO: 1784877 - RNA, 15 nt, Human
ccggcugugcuggga

SEQ ID NO: 1784878 - RNA, 16 nt, Human
ccggcugugcugggag

SEQ ID NO: 1784879 - RNA, 17 nt, Human
ccggcugugcugggaga

SEQ ID NO: 1784880 - RNA, 19 nt, Human
ccgcuuucuacccagcgag

SEQ ID NO: 1784881 - RNA, 23 nt, Human
ccgcuuucuacccagcgagcccu

SEQ ID NO: 1784882 - RNA, 23 nt, Human
ccgcugagcgaggagaugcuccu

SEQ ID NO: 1784883 - RNA, 12 nt, Human
ccgcuuucuacc

SEQ ID NO: 1784884 - RNA, 15 nt, Human
ccgggcugagggccu

SEQ ID NO: 1784885 - RNA, 16 nt, Human
ccgggcugagggccug

SEQ ID NO: 1784886 - RNA, 18 nt, Human
ccgggcugagggccugcu

SEQ ID NO: 1784887 - RNA, 21 nt, Human
ccgggcugagggccugcugga

SEQ ID NO: 1784888 - RNA, 17 nt, Human
ccgggaccuggugcugc

SEQ ID NO: 1784889 - RNA, 15 nt, Human
ccggggaaaggcaag

SEQ ID NO: 1784890 - RNA, 14 nt, Human
ccgggucugccucu

SEQ ID NO: 1784891 - RNA, 22 nt, Human
ccgguaaacacgccugcaaacg

SEQ ID NO: 1784892 - RNA, 15 nt, Human
ccuaaaauucagugg

SEQ ID NO: 1784893 - RNA, 14 nt, Human
ccgugguccuuugg

SEQ ID NO: 1784894 - RNA, 17 nt, Human
ccgugucaagcugcucu

SEQ ID NO: 1784895 - RNA, 18 nt, Human
ccgugucaagcugcucug

SEQ ID NO: 1784896 - RNA, 23 nt, Human
ccgugucaagcugcucugagcca

SEQ ID NO: 1784897 - RNA, 15 nt, Human
ccgugguaugucugc

SEQ ID NO: 1784898 - RNA, 18 nt, Human
ccgugguaugucugccau

SEQ ID NO: 1784899 - RNA, 13 nt, Human
ccguggucccuga

SEQ ID NO: 1784900 - RNA, 14 nt, Human
ccguggucccugag

SEQ ID NO: 1784901 - RNA, 16 nt, Human
ccguggucccugagga

SEQ ID NO: 1784902 - RNA, 18 nt, Human
ccuagggaacagaaauug

SEQ ID NO: 1784903 - RNA, 12 nt, Human
ccuagggccccc

SEQ ID NO: 1784904 - RNA, 20 nt, Human
ccuagggcccccacaguugc

SEQ ID NO: 1784905 - RNA, 18 nt, Human
ccuaguucuguagaaaug

SEQ ID NO: 1784906 - RNA, 19 nt, Human
ccuaguucuguagaaaugg

SEQ ID NO: 1784907 - RNA, 22 nt, Human
ccuauacgcagcgugcuuuaaa

SEQ ID NO: 1784908 - RNA, 16 nt, Human
ccuaguuuucuuuccu

SEQ ID NO: 1784909 - RNA, 19 nt, Human
ccuaguuuucuuuccuccu

SEQ ID NO: 1784910 - RNA, 20 nt, Human
ccuaguuuucuuuccuccuu

SEQ ID NO: 1784911 - RNA, 22 nt, Human
ccuaguuuucuuuccuccuuuc

SEQ ID NO: 1784912 - RNA, 15 nt, Human
ccuaguuuuccuacu

SEQ ID NO: 1784913 - RNA, 12 nt, Human
ccuauaaggaag

SEQ ID NO: 1784914 - RNA, 21 nt, Human
cuguaucccaugagccucagc

SEQ ID NO: 1784915 - RNA, 22 nt, Human
cuguaucccaugagccucagca

SEQ ID NO: 1784916 - RNA, 20 nt, Human
cuguaucccaugagccucag

SEQ ID NO: 1784917 - RNA, 19 nt, Human
cuguauaaaaucagccaau

SEQ ID NO: 1784918 - RNA, 17 nt, Human
cuguauaaaaucagcca

SEQ ID NO: 1784919 - RNA, 11 nt, Human
cuguauaaaau

SEQ ID NO: 1784920 - RNA, 20 nt, Human
cuguauuuuguauuguuuca

SEQ ID NO: 1784921 - RNA, 20 nt, Human
cuguauuuugaaaaugcuuu

SEQ ID NO: 1784922 - RNA, 19 nt, Human
cuguacgucugacaggcaa

SEQ ID NO: 1784923 - RNA, 20 nt, Human
cuguacgucugacaggcaau

SEQ ID NO: 1784924 - RNA, 14 nt, Human
cuguacgucugaca

SEQ ID NO: 1784925 - RNA, 15 nt, Human
cuguacgucugacag

SEQ ID NO: 1784926 - RNA, 16 nt, Human
cuguacgucugacagg

SEQ ID NO: 1784927 - RNA, 18 nt, Human
cuguacgucugacaggca

SEQ ID NO: 1784928 - RNA, 15 nt, Human
cugguggcagcugcg

SEQ ID NO: 1784929 - RNA, 14 nt, Human
cugguggcaguggg

SEQ ID NO: 1784930 - RNA, 18 nt, Human
cugguggcagugggagcu

SEQ ID NO: 1784931 - RNA, 15 nt, Human
cugguauucuguucu

SEQ ID NO: 1784932 - RNA, 18 nt, Human
cugguauucuguucugga

SEQ ID NO: 1784933 - RNA, 19 nt, Human
cugguauucuguucuggag

SEQ ID NO: 1784934 - RNA, 20 nt, Human
cugguauucuguucuggagg

SEQ ID NO: 1784935 - RNA, 16 nt, Human
cugguggcaggggcuu

SEQ ID NO: 1784936 - RNA, 22 nt, Human
cugguggcaggggcuucuagcu

SEQ ID NO: 1784937 - RNA, 16 nt, Human
cugguuaggauggcag

SEQ ID NO: 1784938 - RNA, 18 nt, Human
cugguuaggauggcagga

SEQ ID NO: 1784939 - RNA, 19 nt, Human
cugguuaggauggcaggac

SEQ ID NO: 1784940 - RNA, 15 nt, Human
cugggggugccagga

SEQ ID NO: 1784941 - RNA, 19 nt, Human
cugggggugccaggaccag

SEQ ID NO: 1784942 - RNA, 14 nt, Human
cugggggugccagg

SEQ ID NO: 1784943 - RNA, 15 nt, Human
cugggcuucaguggc

SEQ ID NO: 1784944 - RNA, 11 nt, Human
cugggcccucu

SEQ ID NO: 1784945 - RNA, 20 nt, Human
cuggguuuuguauucucuga

SEQ ID NO: 1784946 - RNA, 22 nt, Human
cuggguuuuguauucucugagc

SEQ ID NO: 1784947 - RNA, 14 nt, Human
cuggguccuuccug

SEQ ID NO: 1784948 - RNA, 15 nt, Human
cuggguccuuccuga

SEQ ID NO: 1784949 - RNA, 19 nt, Human
cuggguccuuccugaaacu

SEQ ID NO: 1784950 - RNA, 13 nt, Human
cugggcccucucu

SEQ ID NO: 1784951 - RNA, 14 nt, Human
cugggcccucucug

SEQ ID NO: 1784952 - RNA, 15 nt, Human
cugggcccucucugc

SEQ ID NO: 1784953 - RNA, 18 nt, Human
cugggcccucucugcucu

SEQ ID NO: 1784954 - RNA, 15 nt, Human
cugggcaaagccuag

SEQ ID NO: 1784955 - RNA, 21 nt, Human
cugggauuacaagcgugagcc

SEQ ID NO: 1784956 - RNA, 12 nt, Human
cugggcugaggg

SEQ ID NO: 1784957 - RNA, 13 nt, Human
cugggcugaggga

SEQ ID NO: 1784958 - RNA, 16 nt, Human
cugggcugagggagcc

SEQ ID NO: 1784959 - RNA, 18 nt, Human
cugggcugagggagccug

SEQ ID NO: 1784960 - RNA, 19 nt, Human
cugggcugagggagccugg

SEQ ID NO: 1784961 - RNA, 23 nt, Human
cugggcugagggagccuggcccc

SEQ ID NO: 1784962 - RNA, 14 nt, Human
cugggcccucucuu

SEQ ID NO: 1784963 - RNA, 15 nt, Human
cugggcccucucuuc

SEQ ID NO: 1784964 - RNA, 18 nt, Human
cugggccuggcagcucag

SEQ ID NO: 1784965 - RNA, 20 nt, Human
cugggccuggcagcucagcu

SEQ ID NO: 1784966 - RNA, 15 nt, Human
cuguguguccaaaac

SEQ ID NO: 1784967 - RNA, 19 nt, Human
cuguguguccaaaacugcc

SEQ ID NO: 1784968 - RNA, 21 nt, Human
cuguguguccaaaacugccuc

SEQ ID NO: 1784969 - RNA, 22 nt, Human
cuguguguccaaaacugccuca

SEQ ID NO: 1784970 - RNA, 20 nt, Human
cugugucuuuuuucacuaca

SEQ ID NO: 1784971 - RNA, 18 nt, Human
cugugugugcgccuacag

SEQ ID NO: 1784972 - RNA, 17 nt, Human
cuguguucaaaaauaua

SEQ ID NO: 1784973 - RNA, 19 nt, Human
cuguggaugagcccucaga

SEQ ID NO: 1784974 - RNA, 15 nt, Human
cuguggaugagcccu

SEQ ID NO: 1784975 - RNA, 17 nt, Human
cuguggaugagcccuca

SEQ ID NO: 1784976 - RNA, 14 nt, Human
cugugcccuccuga

SEQ ID NO: 1784977 - RNA, 16 nt, Human
cugugcccuccugacc

SEQ ID NO: 1784978 - RNA, 17 nt, Human
cugugcccuccugaccc

SEQ ID NO: 1784979 - RNA, 22 nt, Human
cuguggggucaacccuucugga

SEQ ID NO: 1784980 - RNA, 14 nt, Human
cugugggaugggau

SEQ ID NO: 1784981 - RNA, 14 nt, Human
cugugggcaauuua

SEQ ID NO: 1784982 - RNA, 15 nt, Human
cugugggcaauuuag

SEQ ID NO: 1784983 - RNA, 18 nt, Human
cugugggcaauuuagaaa

SEQ ID NO: 1784984 - RNA, 13 nt, Human
cugugggugaugg

SEQ ID NO: 1784985 - RNA, 16 nt, Human
cugugggugaugggga

SEQ ID NO: 1784986 - RNA, 18 nt, Human
cugugggugauggggagg

SEQ ID NO: 1784987 - RNA, 19 nt, Human
cugugggugauggggaggg

SEQ ID NO: 1784988 - RNA, 21 nt, Human
cugugggugauggggaggggc

SEQ ID NO: 1784989 - RNA, 14 nt, Human
cugugguguguccc

SEQ ID NO: 1784990 - RNA, 15 nt, Human
cuguggugugucccc

SEQ ID NO: 1784991 - RNA, 22 nt, Human
cuguggugugucccccucuguc

SEQ ID NO: 1784992 - RNA, 14 nt, Human
cugugccaugugcc

SEQ ID NO: 1784993 - RNA, 14 nt, Human
cugugcaccaagca

SEQ ID NO: 1784994 - RNA, 16 nt, Human
cugugcagccgcugag

SEQ ID NO: 1784995 - RNA, 17 nt, Human
cugugcagccgcugagc

SEQ ID NO: 1784996 - RNA, 19 nt, Human
cugugcagccgcugagcga

SEQ ID NO: 1784997 - RNA, 21 nt, Human
cugugcagccgcugagcgagg

SEQ ID NO: 1784998 - RNA, 15 nt, Human
cugugccaugugcca

SEQ ID NO: 1784999 - RNA, 14 nt, Human
cugugaugcccugc

SEQ ID NO: 1785000 - RNA, 19 nt, Human
cugugaacccuggggccug

SEQ ID NO: 1785001 - RNA, 20 nt, Human
cugugaacccuggggccuga

SEQ ID NO: 1785002 - RNA, 20 nt, Human
cugugagcucccaggugcag

SEQ ID NO: 1785003 - RNA, 23 nt, Human
cugucauuugagcagggcucagc

SEQ ID NO: 1785004 - RNA, 11 nt, Human
cugucugcccc

SEQ ID NO: 1785005 - RNA, 13 nt, Human
cugucugccccag

SEQ ID NO: 1785006 - RNA, 15 nt, Human
cugucugccccagcc

SEQ ID NO: 1785007 - RNA, 18 nt, Human
cugucugccccagcccag

SEQ ID NO: 1785008 - RNA, 19 nt, Human
cugucugccccagcccaga

SEQ ID NO: 1785009 - RNA, 21 nt, Human
cugucauuugagcagggcuca

SEQ ID NO: 1785010 - RNA, 22 nt, Human
cugucauuugagcagggcucag

SEQ ID NO: 1785011 - RNA, 17 nt, Human
cugucuucaccugauuc

SEQ ID NO: 1785012 - RNA, 18 nt, Human
cugucuucaccugauuca

SEQ ID NO: 1785013 - RNA, 22 nt, Human
cugucuucaccugauucaacua

SEQ ID NO: 1785014 - RNA, 22 nt, Human
cugucuuguugcggauggaugg

SEQ ID NO: 1785015 - RNA, 12 nt, Human
cuuccugugucc

SEQ ID NO: 1785016 - RNA, 14 nt, Human
cuuccuguguccug

SEQ ID NO: 1785017 - RNA, 15 nt, Human
cuuccuguguccuga

SEQ ID NO: 1785018 - RNA, 14 nt, Human
cuuccuggagacug

SEQ ID NO: 1785019 - RNA, 22 nt, Human
cuuccuggagacugcccagcua

SEQ ID NO: 1785020 - RNA, 14 nt, Human
cuucccugacucau

SEQ ID NO: 1785021 - RNA, 13 nt, Human
cuucccugacuca

SEQ ID NO: 1785022 - RNA, 20 nt, Human
cuucccugacucauucugaa

SEQ ID NO: 1785023 - RNA, 22 nt, Human
cuuccuauuccaagcuuccaua

SEQ ID NO: 1785024 - RNA, 20 nt, Human
cuuccccccaaaacccggga

SEQ ID NO: 1785025 - RNA, 16 nt, Human
cuuccacaaagaaaau

SEQ ID NO: 1785026 - RNA, 17 nt, Human
cuuccacaaagaaaauu

SEQ ID NO: 1785027 - RNA, 23 nt, Human
cuuccacaaagaaaauuccuaua

SEQ ID NO: 1785028 - RNA, 15 nt, Human
cuuccacugagggca

SEQ ID NO: 1785029 - RNA, 18 nt, Human
cuuccacugagggcaguc

SEQ ID NO: 1785030 - RNA, 19 nt, Human
cuuccagauccucucuggg

SEQ ID NO: 1785031 - RNA, 21 nt, Human
cuuccagauccucucuggggc

SEQ ID NO: 1785032 - RNA, 22 nt, Human
cuuccagauccucucuggggcu

SEQ ID NO: 1785033 - RNA, 18 nt, Human
cuuccccaacacgcagga

SEQ ID NO: 1785034 - RNA, 17 nt, Human
cuucgcuccugugucuu

SEQ ID NO: 1785035 - RNA, 15 nt, Human
cuuccuuaugcuucu

SEQ ID NO: 1785036 - RNA, 17 nt, Human
cuuccuuaugcuucuuu

SEQ ID NO: 1785037 - RNA, 15 nt, Human
cuuccugugugucca

SEQ ID NO: 1785038 - RNA, 23 nt, Human
cuuccuguguguccaaaacugcc

SEQ ID NO: 1785039 - RNA, 16 nt, Human
cuucgggcugugcccg

SEQ ID NO: 1785040 - RNA, 12 nt, Human
cuucgggaccag

SEQ ID NO: 1785041 - RNA, 14 nt, Human
cuucgggaccagga

SEQ ID NO: 1785042 - RNA, 15 nt, Human
cuucgggaccaggau

SEQ ID NO: 1785043 - RNA, 21 nt, Human
cuucgugcggaaucagcuucu

SEQ ID NO: 1785044 - RNA, 13 nt, Human
cuucguucgcaga

SEQ ID NO: 1785045 - RNA, 17 nt, Human
cuucguucgcagagcuu

SEQ ID NO: 1785046 - RNA, 12 nt, Human
cuucucaccagc

SEQ ID NO: 1785047 - RNA, 13 nt, Human
cuucucaccagcu

SEQ ID NO: 1785048 - RNA, 14 nt, Human
cuucucaccagcug

SEQ ID NO: 1785049 - RNA, 15 nt, Human
cuucucaccagcugc

SEQ ID NO: 1785050 - RNA, 16 nt, Human
cuucucaccagcugca

SEQ ID NO: 1785051 - RNA, 17 nt, Human
cuucucaccagcugcaa

SEQ ID NO: 1785052 - RNA, 19 nt, Human
cuucucaccagcugcaaag

SEQ ID NO: 1785053 - RNA, 20 nt, Human
cuucucaccagcugcaaagu

SEQ ID NO: 1785054 - RNA, 21 nt, Human
cuucucaccagcugcaaagug

SEQ ID NO: 1785055 - RNA, 22 nt, Human
cuucucaccagcugcaaagugu

SEQ ID NO: 1785056 - RNA, 21 nt, Human
cuucagaggcccucgcugcca

SEQ ID NO: 1785057 - RNA, 23 nt, Human
cuucagaggcccucgcugccagc

SEQ ID NO: 1785058 - RNA, 13 nt, Human
cuucagccuuaau

SEQ ID NO: 1785059 - RNA, 21 nt, Human
cuucaggaaccucgaguacug

SEQ ID NO: 1785060 - RNA, 22 nt, Human
cuucaggaaccucgaguacugu

SEQ ID NO: 1785061 - RNA, 16 nt, Human
cuucagccucccgagu

SEQ ID NO: 1785062 - RNA, 20 nt, Human
cuucagccucccgaguagcu

SEQ ID NO: 1785063 - RNA, 20 nt, Human
cuucagccucuuucuguccc

SEQ ID NO: 1785064 - RNA, 14 nt, Human
cuucagccucccga

SEQ ID NO: 1785065 - RNA, 20 nt, Human
cuucaguaacccccacugga

SEQ ID NO: 1785066 - RNA, 22 nt, Human
cuucaguaacccccacuggacu

SEQ ID NO: 1785067 - RNA, 16 nt, Human
cuucauguggcuuccc

SEQ ID NO: 1785068 - RNA, 15 nt, Human
cuucauggcagaagg

SEQ ID NO: 1785069 - RNA, 21 nt, Human
cuucauggcagaaggcaaacc

SEQ ID NO: 1785070 - RNA, 16 nt, Human
cuuaguagauuaaaaa

SEQ ID NO: 1785071 - RNA, 21 nt, Human
cuuaguagauuaaaaauuaua

SEQ ID NO: 1785072 - RNA, 12 nt, Human
cuuacucuuucc

SEQ ID NO: 1785073 - RNA, 14 nt, Human
cuuacucuuuccua

SEQ ID NO: 1785074 - RNA, 15 nt, Human
cuuacucuuuccuau

SEQ ID NO: 1785075 - RNA, 16 nt, Human
cuuacucuuuccuauu

SEQ ID NO: 1785076 - RNA, 23 nt, Human
cuuacucuuuccuauuucagugu

SEQ ID NO: 1785077 - RNA, 17 nt, Human
cuuagaagucacacagu

SEQ ID NO: 1785078 - RNA, 20 nt, Human
cuuagaagucacacaguauu

SEQ ID NO: 1785079 - RNA, 22 nt, Human
cuuaaugaaguuugaauguuaa

SEQ ID NO: 1785080 - RNA, 23 nt, Human
cuuaaugaaguuugaauguuaaa

SEQ ID NO: 1785081 - RNA, 21 nt, Human
cuuaaugaaguuugaauguua

SEQ ID NO: 1785082 - RNA, 20 nt, Human
cuuaaugaaguuugaauguu

SEQ ID NO: 1785083 - RNA, 12 nt, Human
cuuaauauaaau

SEQ ID NO: 1785084 - RNA, 13 nt, Human
cuuaauauaaauu

SEQ ID NO: 1785085 - RNA, 14 nt, Human
cuuaauauaaauuc

SEQ ID NO: 1785086 - RNA, 21 nt, Human
cuuaauauaaauucacuuuca

SEQ ID NO: 1785087 - RNA, 21 nt, Human
cuuaauaugcugcaacaaaau

SEQ ID NO: 1785088 - RNA, 23 nt, Human
cuuaauaugcugcaacaaaaugu

SEQ ID NO: 1785089 - RNA, 19 nt, Human
cuuaaugaaguuugaaugu

SEQ ID NO: 1785090 - RNA, 18 nt, Human
cuuaaugaaguuugaaug

SEQ ID NO: 1785091 - RNA, 17 nt, Human
cuuaaugaaguuugaau

SEQ ID NO: 1785092 - RNA, 15 nt, Human
cuuaaugaaguuuga

SEQ ID NO: 1785093 - RNA, 14 nt, Human
cuuaaugaaguuug

SEQ ID NO: 1785094 - RNA, 12 nt, Human
cuuaaugaaguu

SEQ ID NO: 1785095 - RNA, 22 nt, Human
cuguugaauuuuguucucuggg

SEQ ID NO: 1785096 - RNA, 23 nt, Human
cuguugaauuuuguucucuggga

SEQ ID NO: 1785097 - RNA, 12 nt, Human
cuguugcccagg

SEQ ID NO: 1785098 - RNA, 16 nt, Human
cuguugcaagccccuc

SEQ ID NO: 1785099 - RNA, 22 nt, Human
cuguugcaagccccucuuucug

SEQ ID NO: 1785100 - RNA, 13 nt, Human
cuguugcccaggc

SEQ ID NO: 1785101 - RNA, 14 nt, Human
cuguugcccaggcu

SEQ ID NO: 1785102 - RNA, 15 nt, Human
cuguugcccaggcug

SEQ ID NO: 1785103 - RNA, 16 nt, Human
cuguugcccaggcugg

SEQ ID NO: 1785104 - RNA, 16 nt, Human
cuguuaauaguucagg

SEQ ID NO: 1785105 - RNA, 18 nt, Human
cuguuuguggggugacgg

SEQ ID NO: 1785106 - RNA, 18 nt, Human
cuguugcccaggcuggcg

SEQ ID NO: 1785107 - RNA, 17 nt, Human
cuguugcccaggcuggc

SEQ ID NO: 1785108 - RNA, 18 nt, Human
cuguuuagguuccccugu

SEQ ID NO: 1785109 - RNA, 19 nt, Human
cuguuuagguuccccuguc

SEQ ID NO: 1785110 - RNA, 20 nt, Human
cuguuuagguuccccuguca

SEQ ID NO: 1785111 - RNA, 21 nt, Human
cuguuuagguuccccugucaa

SEQ ID NO: 1785112 - RNA, 18 nt, Human
cuguuucaaagccaagac

SEQ ID NO: 1785113 - RNA, 21 nt, Human
cuguuucaaagccaagaccuc

SEQ ID NO: 1785114 - RNA, 23 nt, Human
cuguuuauugaaagaauuauccu

SEQ ID NO: 1785115 - RNA, 17 nt, Human
cuguuucaacacagacc

SEQ ID NO: 1785116 - RNA, 15 nt, Human
cuuguggacuaaaag

SEQ ID NO: 1785117 - RNA, 19 nt, Human
cuugggggcucccagggca

SEQ ID NO: 1785118 - RNA, 19 nt, Human
cuuguggacuaaaagauau

SEQ ID NO: 1785119 - RNA, 18 nt, Human
cuuguggacuaaaagaua

SEQ ID NO: 1785120 - RNA, 17 nt, Human
cuuguggacuaaaagau

SEQ ID NO: 1785121 - RNA, 16 nt, Human
cuuguggacuaaaaga

SEQ ID NO: 1785122 - RNA, 19 nt, Human
cuuuagaaagguuuugagc

SEQ ID NO: 1785123 - RNA, 20 nt, Human
cuuuagaaagguuuugagca

SEQ ID NO: 1785124 - RNA, 12 nt, Human
cuuuagaaaaua

SEQ ID NO: 1785125 - RNA, 13 nt, Human
cuuuagaaaauau

SEQ ID NO: 1785126 - RNA, 18 nt, Human
cuuuagaaaauauaagua

SEQ ID NO: 1785127 - RNA, 10 nt, Human
cuuucauuuu

SEQ ID NO: 1785128 - RNA, 15 nt, Human
cuuucauuuuugaua

SEQ ID NO: 1785129 - RNA, 18 nt, Human
cuuuccaaaccuuaucuc

SEQ ID NO: 1785130 - RNA, 22 nt, Human
cuuuccaaaccuuaucuccaca

SEQ ID NO: 1785131 - RNA, 21 nt, Human
cuuuauuuucuauaauuuaaa

SEQ ID NO: 1785132 - RNA, 18 nt, Human
cuuuauuguguuugucau

SEQ ID NO: 1785133 - RNA, 16 nt, Human
cuuuauuguguuuguc

SEQ ID NO: 1785134 - RNA, 23 nt, Human
cuuuauuguguuugucauuagcc

SEQ ID NO: 1785135 - RNA, 20 nt, Human
cuuuauuguguuugucauua

SEQ ID NO: 1785136 - RNA, 19 nt, Human
cuuuauuguguuugucauu

SEQ ID NO: 1785137 - RNA, 16 nt, Human
cuugcucugcugacag

SEQ ID NO: 1785138 - RNA, 17 nt, Human
cuugcucugcugacaga

SEQ ID NO: 1785139 - RNA, 13 nt, Human
cuuggaagcuccg

SEQ ID NO: 1785140 - RNA, 22 nt, Human
cuuggaaccguaggacccaagc

SEQ ID NO: 1785141 - RNA, 14 nt, Human
cuugcucugcugac

SEQ ID NO: 1785142 - RNA, 17 nt, Human
cuucuccacccugcucu

SEQ ID NO: 1785143 - RNA, 18 nt, Human
cuucuccacccugcucuc

SEQ ID NO: 1785144 - RNA, 21 nt, Human
cuucuccacccugcucuccga

SEQ ID NO: 1785145 - RNA, 19 nt, Human
cuugccagaaccaaauuaa

SEQ ID NO: 1785146 - RNA, 21 nt, Human
cuugccagaaccaaauuaacu

SEQ ID NO: 1785147 - RNA, 16 nt, Human
cuuggcugcagggagu

SEQ ID NO: 1785148 - RNA, 17 nt, Human
cuuggcugcagggaguc

SEQ ID NO: 1785149 - RNA, 19 nt, Human
cuuguaaaggaauuuaaaa

SEQ ID NO: 1785150 - RNA, 15 nt, Human
cuuugcugcagagaa

SEQ ID NO: 1785151 - RNA, 14 nt, Human
cuuugcugucccau

SEQ ID NO: 1785152 - RNA, 22 nt, Human
cuuugcugucccauagucccug

SEQ ID NO: 1785153 - RNA, 23 nt, Human
cuuugcugucccauagucccugc

SEQ ID NO: 1785154 - RNA, 23 nt, Human
cuuugggaauauuugaaucuugu

SEQ ID NO: 1785155 - RNA, 20 nt, Human
cuuugggaauauuugaaucu

SEQ ID NO: 1785156 - RNA, 19 nt, Human
cuuugggaauauuugaauc

SEQ ID NO: 1785157 - RNA, 18 nt, Human
cuuugggaauauuugaau

SEQ ID NO: 1785158 - RNA, 17 nt, Human
cuuugggaauauuugaa

SEQ ID NO: 1785159 - RNA, 15 nt, Human
cuuugucuaaaacaa

SEQ ID NO: 1785160 - RNA, 19 nt, Human
cuuugucuaaaacaauaaa

SEQ ID NO: 1785161 - RNA, 14 nt, Human
cuuuguucccggcu

SEQ ID NO: 1785162 - RNA, 14 nt, Human
cuuuuaccugcugc

SEQ ID NO: 1785163 - RNA, 15 nt, Human
cuuuuaccugcugcu

SEQ ID NO: 1785164 - RNA, 18 nt, Human
cuuuuaccugcugcuucu

SEQ ID NO: 1785165 - RNA, 20 nt, Human
cuuuuaccugcugcuucucc

SEQ ID NO: 1785166 - RNA, 17 nt, Human
cuuuguuucaaccaagu

SEQ ID NO: 1785167 - RNA, 22 nt, Human
cuuuucauaaccuagccuuaga

SEQ ID NO: 1785168 - RNA, 20 nt, Human
cuuuucauaaccuagccuua

SEQ ID NO: 1785169 - RNA, 16 nt, Human
cuuuucagauugugga

SEQ ID NO: 1785170 - RNA, 13 nt, Human
cuuuucucagcug

SEQ ID NO: 1785171 - RNA, 15 nt, Human
cuuuuccccuuuccu

SEQ ID NO: 1785172 - RNA, 16 nt, Human
cuuuuccccuuuccug

SEQ ID NO: 1785173 - RNA, 17 nt, Human
cuuuuccccuuuccugu

SEQ ID NO: 1785174 - RNA, 18 nt, Human
cuuuuccccuuuccuguc

SEQ ID NO: 1785175 - RNA, 20 nt, Human
cuuuuccccuuuccuguccc

SEQ ID NO: 1785176 - RNA, 21 nt, Human
cuuuuccccuuuccuguccca

SEQ ID NO: 1785177 - RNA, 22 nt, Human
cuuuuccccuuuccugucccac

SEQ ID NO: 1785178 - RNA, 12 nt, Human
gaaacagcugcc

SEQ ID NO: 1785179 - RNA, 13 nt, Human
gaaacagcugccu

SEQ ID NO: 1785180 - RNA, 14 nt, Human
gaaacagcugccuu

SEQ ID NO: 1785181 - RNA, 15 nt, Human
gaaacagcugccuua

SEQ ID NO: 1785182 - RNA, 16 nt, Human
gaaacagcugccuuag

SEQ ID NO: 1785183 - RNA, 19 nt, Human
gaaacagcugccuuagcuu

SEQ ID NO: 1785184 - RNA, 20 nt, Human
gaaacagcugccuuagcuuc

SEQ ID NO: 1785185 - RNA, 22 nt, Human
gaaacagcugccuuagcuucag

SEQ ID NO: 1785186 - RNA, 18 nt, Human
gaaacagcuaaugggaca

SEQ ID NO: 1785187 - RNA, 20 nt, Human
gaaaaucuuauaauuuaaaa

SEQ ID NO: 1785188 - RNA, 13 nt, Human
gaaaagcugcuga

SEQ ID NO: 1785189 - RNA, 17 nt, Human
gaaaagcugcugacagu

SEQ ID NO: 1785190 - RNA, 19 nt, Human
gaaaauaacgauaaaagac

SEQ ID NO: 1785191 - RNA, 19 nt, Human
gaaaaucuuauaauuuaaa

SEQ ID NO: 1785192 - RNA, 13 nt, Human
cuuuuuucugccu

SEQ ID NO: 1785193 - RNA, 14 nt, Human
cuuuuuucugccuc

SEQ ID NO: 1785194 - RNA, 15 nt, Human
cuuuuuucugccucc

SEQ ID NO: 1785195 - RNA, 16 nt, Human
cuuuuuucugccuccu

SEQ ID NO: 1785196 - RNA, 19 nt, Human
cuuuuuucugccuccuuua

SEQ ID NO: 1785197 - RNA, 17 nt, Human
gaaaaauaaacacuaca

SEQ ID NO: 1785198 - RNA, 15 nt, Human
cuuuuuucacuacau

SEQ ID NO: 1785199 - RNA, 22 nt, Human
cuuuuuucccauaagacaauga

SEQ ID NO: 1785200 - RNA, 19 nt, Human
gaaaaauaacuucaagcaa

SEQ ID NO: 1785201 - RNA, 22 nt, Human
gaaaacaauaacgauaaaagac

SEQ ID NO: 1785202 - RNA, 19 nt, Human
gaagcccagccccuacugc

SEQ ID NO: 1785203 - RNA, 20 nt, Human
gaagcccagccccuacugcu

SEQ ID NO: 1785204 - RNA, 22 nt, Human
gaagcccagccccuacugcugu

SEQ ID NO: 1785205 - RNA, 23 nt, Human
gaagcccagccccuacugcugug

SEQ ID NO: 1785206 - RNA, 15 nt, Human
gaagcuucugucucc

SEQ ID NO: 1785207 - RNA, 23 nt, Human
gaagcuucugucuccagcuuccc

SEQ ID NO: 1785208 - RNA, 12 nt, Human
gaagccagcugc

SEQ ID NO: 1785209 - RNA, 13 nt, Human
gaagccagcugcc

SEQ ID NO: 1785210 - RNA, 15 nt, Human
gaagccagcugcccu

SEQ ID NO: 1785211 - RNA, 19 nt, Human
gaagacucauucuucugua

SEQ ID NO: 1785212 - RNA, 21 nt, Human
gaagacucauucuucuguacg

SEQ ID NO: 1785213 - RNA, 15 nt, Human
gaaggagacaggcag

SEQ ID NO: 1785214 - RNA, 16 nt, Human
gaaggagacaggcaga

SEQ ID NO: 1785215 - RNA, 18 nt, Human
gaaggagacaggcagagc

SEQ ID NO: 1785216 - RNA, 20 nt, Human
gaaggagccccauuccuggg

SEQ ID NO: 1785217 - RNA, 21 nt, Human
gaaggagccccauuccuggga

SEQ ID NO: 1785218 - RNA, 22 nt, Human
gaaggagccccauuccugggaa

SEQ ID NO: 1785219 - RNA, 17 nt, Human
gaaggagauagggaaaa

SEQ ID NO: 1785220 - RNA, 18 nt, Human
gaauccagacccggcugc

SEQ ID NO: 1785221 - RNA, 12 nt, Human
gaaucagcuucu

SEQ ID NO: 1785222 - RNA, 22 nt, Human
gaaucauuucuauuucuccucc

SEQ ID NO: 1785223 - RNA, 15 nt, Human
gaauagcugggacua

SEQ ID NO: 1785224 - RNA, 21 nt, Human
gaaucacguuagaggaaaaau

SEQ ID NO: 1785225 - RNA, 14 nt, Human
gaauagcugggacu

SEQ ID NO: 1785226 - RNA, 14 nt, Human
gaaugaaagggccc

SEQ ID NO: 1785227 - RNA, 22 nt, Human
gaaucuugucucaaugcucaua

SEQ ID NO: 1785228 - RNA, 21 nt, Human
gaaucuugucucaaugcucau

SEQ ID NO: 1785229 - RNA, 14 nt, Human
gaaucuugucucaa

SEQ ID NO: 1785230 - RNA, 13 nt, Human
gaaucuugucuca

SEQ ID NO: 1785231 - RNA, 20 nt, Human
gaaucuugucucaaugcuca

SEQ ID NO: 1785232 - RNA, 18 nt, Human
gaaucuugucucaaugcu

SEQ ID NO: 1785233 - RNA, 16 nt, Human
gaaucuugucucaaug

SEQ ID NO: 1785234 - RNA, 15 nt, Human
gaaucuugucucaau

SEQ ID NO: 1785235 - RNA, 19 nt, Human
gaaugaaagggcccagaga

SEQ ID NO: 1785236 - RNA, 21 nt, Human
gaaugaaagggcccagagagg

SEQ ID NO: 1785237 - RNA, 19 nt, Human
gaaucucaagaugggggca

SEQ ID NO: 1785238 - RNA, 11 nt, Human
gaauaaagaau

SEQ ID NO: 1785239 - RNA, 13 nt, Human
gaauaaagaauac

SEQ ID NO: 1785240 - RNA, 15 nt, Human
gaauaaagaauacuu

SEQ ID NO: 1785241 - RNA, 17 nt, Human
gaauaaagaauacuuga

SEQ ID NO: 1785242 - RNA, 18 nt, Human
gaauaaagaauacuugaa

SEQ ID NO: 1785243 - RNA, 19 nt, Human
gaauaaagaauacuugaac

SEQ ID NO: 1785244 - RNA, 19 nt, Human
gaauacuuuugcccuuuga

SEQ ID NO: 1785245 - RNA, 19 nt, Human
gaauaauuuauaguaauga

SEQ ID NO: 1785246 - RNA, 21 nt, Human
gaauaauuuauaguaaugagu

SEQ ID NO: 1785247 - RNA, 14 nt, Human
gaauacuugaacuu

SEQ ID NO: 1785248 - RNA, 15 nt, Human
gaauacuugaacuug

SEQ ID NO: 1785249 - RNA, 16 nt, Human
gaauacuugaacuugu

SEQ ID NO: 1785250 - RNA, 14 nt, Human
gaauacuuuauaaa

SEQ ID NO: 1785251 - RNA, 20 nt, Human
gaauaauccuaaacauauga

SEQ ID NO: 1785252 - RNA, 14 nt, Human
gaaauucugaauuu

SEQ ID NO: 1785253 - RNA, 15 nt, Human
gaaauucugaauuug

SEQ ID NO: 1785254 - RNA, 16 nt, Human
gaaauucugaauuugc

SEQ ID NO: 1785255 - RNA, 17 nt, Human
gaaauucugaauuugca

SEQ ID NO: 1785256 - RNA, 18 nt, Human
gaaauucugaauuugcaa

SEQ ID NO: 1785257 - RNA, 19 nt, Human
gaaauucugaauuugcaaa

SEQ ID NO: 1785258 - RNA, 21 nt, Human
gaaauucugaauuugcaaagu

SEQ ID NO: 1785259 - RNA, 18 nt, Human
gaaauucuuuauacauuc

SEQ ID NO: 1785260 - RNA, 20 nt, Human
gaaauucuuuauacauucua

SEQ ID NO: 1785261 - RNA, 13 nt, Human
gaaaugcugcugg

SEQ ID NO: 1785262 - RNA, 15 nt, Human
gaaaugcugcuggcc

SEQ ID NO: 1785263 - RNA, 16 nt, Human
gaaaugcugcuggcca

SEQ ID NO: 1785264 - RNA, 17 nt, Human
gaaaugcugcuggccaa

SEQ ID NO: 1785265 - RNA, 15 nt, Human
gaaauauucccuaga

SEQ ID NO: 1785266 - RNA, 15 nt, Human
gaaaugguggaacug

SEQ ID NO: 1785267 - RNA, 20 nt, Human
gaaaugguuguauuagaugu

SEQ ID NO: 1785268 - RNA, 19 nt, Human
gaaaugguuguauuagaug

SEQ ID NO: 1785269 - RNA, 18 nt, Human
gaaaugguuguauuagau

SEQ ID NO: 1785270 - RNA, 17 nt, Human
gaaaugguuguauuaga

SEQ ID NO: 1785271 - RNA, 15 nt, Human
gaaaugguuguauua

SEQ ID NO: 1785272 - RNA, 14 nt, Human
gaaaugguuguauu

SEQ ID NO: 1785273 - RNA, 13 nt, Human
gaaaugguuguau

SEQ ID NO: 1785274 - RNA, 21 nt, Human
gaaacagguugggaugggaua

SEQ ID NO: 1785275 - RNA, 22 nt, Human
gaaacagguugggaugggauag

SEQ ID NO: 1785276 - RNA, 13 nt, Human
gaaauaauaugca

SEQ ID NO: 1785277 - RNA, 14 nt, Human
gaaauaauaugcau

SEQ ID NO: 1785278 - RNA, 15 nt, Human
gaaauaauaugcauu

SEQ ID NO: 1785279 - RNA, 13 nt, Human
gaaauaugcaucu

SEQ ID NO: 1785280 - RNA, 22 nt, Human
gaaauacagauuuugauagcaa

SEQ ID NO: 1785281 - RNA, 17 nt, Human
gaaauacagauuuugau

SEQ ID NO: 1785282 - RNA, 21 nt, Human
gaaauacaauucuacauuguc

SEQ ID NO: 1785283 - RNA, 16 nt, Human
gaaauacagucuucca

SEQ ID NO: 1785284 - RNA, 15 nt, Human
gaacagacuggaagc

SEQ ID NO: 1785285 - RNA, 16 nt, Human
gaacagacuggaagca

SEQ ID NO: 1785286 - RNA, 19 nt, Human
gaacagacuggaagcacag

SEQ ID NO: 1785287 - RNA, 21 nt, Human
gaaccacaucuugcucugcug

SEQ ID NO: 1785288 - RNA, 12 nt, Human
gaacagaaauug

SEQ ID NO: 1785289 - RNA, 16 nt, Human
gaaccaccacacccag

SEQ ID NO: 1785290 - RNA, 17 nt, Human
gaaccaccacacccagc

SEQ ID NO: 1785291 - RNA, 15 nt, Human
gaaccguaggaccca

SEQ ID NO: 1785292 - RNA, 19 nt, Human
gaaccgugguaugucugcc

SEQ ID NO: 1785293 - RNA, 15 nt, Human
gaacuauaaagaagu

SEQ ID NO: 1785294 - RNA, 13 nt, Human
gaaccuuguuauu

SEQ ID NO: 1785295 - RNA, 18 nt, Human
gaaccuuguuauuucuca

SEQ ID NO: 1785296 - RNA, 13 nt, Human
gaaccuuggccug

SEQ ID NO: 1785297 - RNA, 16 nt, Human
gaaccuuggccugggc

SEQ ID NO: 1785298 - RNA, 17 nt, Human
gaaccuuggccugggcc

SEQ ID NO: 1785299 - RNA, 22 nt, Human
gaacuggguacuuguggacaca

SEQ ID NO: 1785300 - RNA, 14 nt, Human
gaacuggucuuccu

SEQ ID NO: 1785301 - RNA, 13 nt, Human
gaacuucauggau

SEQ ID NO: 1785302 - RNA, 20 nt, Human
gaacuuacuguagccucaga

SEQ ID NO: 1785303 - RNA, 22 nt, Human
gaacuuagccauuuuucaaagc

SEQ ID NO: 1785304 - RNA, 20 nt, Human
gaacuuauccuaaaacaaau

SEQ ID NO: 1785305 - RNA, 14 nt, Human
gaacugugccacaa

SEQ ID NO: 1785306 - RNA, 12 nt, Human
gaacuugccucu

SEQ ID NO: 1785307 - RNA, 14 nt, Human
gaacuugcugcugu

SEQ ID NO: 1785308 - RNA, 15 nt, Human
gaacuugcugcuguc

SEQ ID NO: 1785309 - RNA, 18 nt, Human
gaacuugcugcugucuug

SEQ ID NO: 1785310 - RNA, 21 nt, Human
gaacuuguaaaggaauuuaaa

SEQ ID NO: 1785311 - RNA, 23 nt, Human
gaagaaaauggaaccaggcuugg

SEQ ID NO: 1785312 - RNA, 17 nt, Human
cugagucaucuguuagg

SEQ ID NO: 1785313 - RNA, 21 nt, Human
cugagucaucuguuagggccu

SEQ ID NO: 1785314 - RNA, 22 nt, Human
cugagucaucuguuagggccuu

SEQ ID NO: 1785315 - RNA, 15 nt, Human
cugagggaucuuuac

SEQ ID NO: 1785316 - RNA, 20 nt, Human
cugaggcugggggagagccg

SEQ ID NO: 1785317 - RNA, 12 nt, Human
cugagggagccu

SEQ ID NO: 1785318 - RNA, 13 nt, Human
cugagggagccug

SEQ ID NO: 1785319 - RNA, 17 nt, Human
cugagggagccuggccc

SEQ ID NO: 1785320 - RNA, 20 nt, Human
cugagggagcuccaacucag

SEQ ID NO: 1785321 - RNA, 14 nt, Human
cugaucagagccgu

SEQ ID NO: 1785322 - RNA, 20 nt, Human
cugaucagagccgugguccu

SEQ ID NO: 1785323 - RNA, 18 nt, Human
cugaucaggaccuccaag

SEQ ID NO: 1785324 - RNA, 15 nt, Human
cugaucccucuacag

SEQ ID NO: 1785325 - RNA, 19 nt, Human
cugcaaacgcugccugccg

SEQ ID NO: 1785326 - RNA, 17 nt, Human
cugcaaaaggacucuca

SEQ ID NO: 1785327 - RNA, 19 nt, Human
cugcaaacgcugccugccc

SEQ ID NO: 1785328 - RNA, 20 nt, Human
cugcaaacgcugccugccca

SEQ ID NO: 1785329 - RNA, 17 nt, Human
cugauuguugucaggcc

SEQ ID NO: 1785330 - RNA, 18 nt, Human
cugcacuugcagacucua

SEQ ID NO: 1785331 - RNA, 12 nt, Human
cugcaccgggcc

SEQ ID NO: 1785332 - RNA, 15 nt, Human
cugccccaaacaaau

SEQ ID NO: 1785333 - RNA, 21 nt, Human
cugcauguaaacacgccugca

SEQ ID NO: 1785334 - RNA, 17 nt, Human
cugcaugcccucucagg

SEQ ID NO: 1785335 - RNA, 18 nt, Human
cugcaugcccucucaggc

SEQ ID NO: 1785336 - RNA, 19 nt, Human
cugcaugcccucucaggcc

SEQ ID NO: 1785337 - RNA, 20 nt, Human
cugcaugcccucucaggccg

SEQ ID NO: 1785338 - RNA, 21 nt, Human
cugcaugcccucucaggccgg

SEQ ID NO: 1785339 - RNA, 13 nt, Human
cugcaugauguuu

SEQ ID NO: 1785340 - RNA, 15 nt, Human
cugcaugauguuugc

SEQ ID NO: 1785341 - RNA, 16 nt, Human
cugcaugauguuugcc

SEQ ID NO: 1785342 - RNA, 20 nt, Human
cugcaugauguuugcccaaa

SEQ ID NO: 1785343 - RNA, 15 nt, Human
cugcaugcccucuca

SEQ ID NO: 1785344 - RNA, 16 nt, Human
cugcaugcccucucag

SEQ ID NO: 1785345 - RNA, 14 nt, Human
cugcaucuggggcc

SEQ ID NO: 1785346 - RNA, 18 nt, Human
cugcaucuggggcccaua

SEQ ID NO: 1785347 - RNA, 20 nt, Human
cugcagaaacccugagcaga

SEQ ID NO: 1785348 - RNA, 21 nt, Human
cugcauccagagauucauuuu

SEQ ID NO: 1785349 - RNA, 22 nt, Human
cugcauccagagauucauuuuc

SEQ ID NO: 1785350 - RNA, 23 nt, Human
cugcacuugcagacucuacagag

SEQ ID NO: 1785351 - RNA, 15 nt, Human
cugccucagccuccc

SEQ ID NO: 1785352 - RNA, 19 nt, Human
cugccucagccucccaaag

SEQ ID NO: 1785353 - RNA, 21 nt, Human
cugccccaaacaaauaugcaa

SEQ ID NO: 1785354 - RNA, 17 nt, Human
cugccucugacacacag

SEQ ID NO: 1785355 - RNA, 18 nt, Human
cugccucugacacacagc

SEQ ID NO: 1785356 - RNA, 21 nt, Human
cugccucugacacacagcucu

SEQ ID NO: 1785357 - RNA, 21 nt, Human
cugccugcccaggccccugcc

SEQ ID NO: 1785358 - RNA, 22 nt, Human
cugccugcccaggccccugcca

SEQ ID NO: 1785359 - RNA, 19 nt, Human
cugcgguccacccaggagc

SEQ ID NO: 1785360 - RNA, 20 nt, Human
cugcgguccacccaggagcc

SEQ ID NO: 1785361 - RNA, 18 nt, Human
cugcgguccacccaggag

SEQ ID NO: 1785362 - RNA, 22 nt, Human
cugccuuuauuguguuugucau

SEQ ID NO: 1785363 - RNA, 24 nt, Human
cugccuuuauuguguuugucauua

SEQ ID NO: 1785364 - RNA, 17 nt, Human
cugcggcguacaggcug

SEQ ID NO: 1785365 - RNA, 18 nt, Human
cucugucgcccagucugg

SEQ ID NO: 1785366 - RNA, 19 nt, Human
cucugucgcccagucugga

SEQ ID NO: 1785367 - RNA, 17 nt, Human
cucugucgcccagucug

SEQ ID NO: 1785368 - RNA, 15 nt, Human
cucuggggcuguguu

SEQ ID NO: 1785369 - RNA, 13 nt, Human
cucugucgcccag

SEQ ID NO: 1785370 - RNA, 14 nt, Human
cucuguccugggag

SEQ ID NO: 1785371 - RNA, 15 nt, Human
cucuguccugggagu

SEQ ID NO: 1785372 - RNA, 22 nt, Human
cucuguccugggagugagcugg

SEQ ID NO: 1785373 - RNA, 12 nt, Human
cucugggagaaa

SEQ ID NO: 1785374 - RNA, 14 nt, Human
cucugggagaaaau

SEQ ID NO: 1785375 - RNA, 18 nt, Human
cucugggagaaaaucauc

SEQ ID NO: 1785376 - RNA, 20 nt, Human
cucugggagaaaaucaucaa

SEQ ID NO: 1785377 - RNA, 21 nt, Human
cucugggagaaaaucaucaag

SEQ ID NO: 1785378 - RNA, 14 nt, Human
cucugggccacuug

SEQ ID NO: 1785379 - RNA, 17 nt, Human
cucugggccacuuggag

SEQ ID NO: 1785380 - RNA, 18 nt, Human
cucugggccacuuggagu

SEQ ID NO: 1785381 - RNA, 10 nt, Human
cucugccuga

SEQ ID NO: 1785382 - RNA, 19 nt, Human
cucugccucugacacacag

SEQ ID NO: 1785383 - RNA, 20 nt, Human
cucugccucugacacacagc

SEQ ID NO: 1785384 - RNA, 15 nt, Human
cucuucuccaggcug

SEQ ID NO: 1785385 - RNA, 13 nt, Human
cucuucuccaggc

SEQ ID NO: 1785386 - RNA, 13 nt, Human
cucuuccccccaa

SEQ ID NO: 1785387 - RNA, 14 nt, Human
cucuuccccccaaa

SEQ ID NO: 1785388 - RNA, 20 nt, Human
cucugugucagguggggcag

SEQ ID NO: 1785389 - RNA, 21 nt, Human
cucugugucagguggggcagc

SEQ ID NO: 1785390 - RNA, 22 nt, Human
cucugugucagguggggcagcu

SEQ ID NO: 1785391 - RNA, 23 nt, Human
cucugugucagguggggcagcuu

SEQ ID NO: 1785392 - RNA, 14 nt, Human
cucugugaccaaug

SEQ ID NO: 1785393 - RNA, 15 nt, Human
cucugugaccaaugu

SEQ ID NO: 1785394 - RNA, 17 nt, Human
cucugugaccaaugucu

SEQ ID NO: 1785395 - RNA, 18 nt, Human
cucugugaccaaugucuu

SEQ ID NO: 1785396 - RNA, 18 nt, Human
cucugugaagcauucgag

SEQ ID NO: 1785397 - RNA, 19 nt, Human
cucugugaccaaugucuug

SEQ ID NO: 1785398 - RNA, 14 nt, Human
cucuguuugugggg

SEQ ID NO: 1785399 - RNA, 16 nt, Human
cucuguuuguggggug

SEQ ID NO: 1785400 - RNA, 16 nt, Human
cucugagcugugcagg

SEQ ID NO: 1785401 - RNA, 16 nt, Human
cucugaggacacuaac

SEQ ID NO: 1785402 - RNA, 12 nt, Human
cucugaggacac

SEQ ID NO: 1785403 - RNA, 14 nt, Human
cucugaggacacua

SEQ ID NO: 1785404 - RNA, 17 nt, Human
cucugacucagggcucc

SEQ ID NO: 1785405 - RNA, 20 nt, Human
cucugacucagggcuccugg

SEQ ID NO: 1785406 - RNA, 21 nt, Human
cucugacucagggcuccuggg

SEQ ID NO: 1785407 - RNA, 14 nt, Human
cucugacucagggc

SEQ ID NO: 1785408 - RNA, 15 nt, Human
cucugacucagggcu

SEQ ID NO: 1785409 - RNA, 16 nt, Human
cucugacucagggcuc

SEQ ID NO: 1785410 - RNA, 20 nt, Human
cucugaccccagcauucuca

SEQ ID NO: 1785411 - RNA, 14 nt, Human
cucugacacacagc

SEQ ID NO: 1785412 - RNA, 15 nt, Human
cucugacacacagcu

SEQ ID NO: 1785413 - RNA, 16 nt, Human
cucugacacacagcuc

SEQ ID NO: 1785414 - RNA, 17 nt, Human
cucugacacacagcucu

SEQ ID NO: 1785415 - RNA, 18 nt, Human
cucugacacacagcucug

SEQ ID NO: 1785416 - RNA, 19 nt, Human
cucugacacacagcucugu

SEQ ID NO: 1785417 - RNA, 22 nt, Human
cucugaaggacauugcggacag

SEQ ID NO: 1785418 - RNA, 12 nt, Human
cucgcugccagc

SEQ ID NO: 1785419 - RNA, 18 nt, Human
cucgcugcacaaauacuc

SEQ ID NO: 1785420 - RNA, 13 nt, Human
cugaagaaagugu

SEQ ID NO: 1785421 - RNA, 16 nt, Human
cucuucuccaggcugu

SEQ ID NO: 1785422 - RNA, 14 nt, Human
cucuuuucaaaaca

SEQ ID NO: 1785423 - RNA, 18 nt, Human
cucuuuuccccuuuccug

SEQ ID NO: 1785424 - RNA, 14 nt, Human
cucuuugucuaaaa

SEQ ID NO: 1785425 - RNA, 16 nt, Human
cucuuugucuaaaaca

SEQ ID NO: 1785426 - RNA, 17 nt, Human
cucuuugucuaaaacaa

SEQ ID NO: 1785427 - RNA, 18 nt, Human
cucuuugucuaaaacaau

SEQ ID NO: 1785428 - RNA, 21 nt, Human
cucuuugucuaaaacaauaaa

SEQ ID NO: 1785429 - RNA, 22 nt, Human
cucuuugucuaaaacaauaaaa

SEQ ID NO: 1785430 - RNA, 14 nt, Human
cucuuuuaccugcu

SEQ ID NO: 1785431 - RNA, 16 nt, Human
cucuuuuaccugcugc

SEQ ID NO: 1785432 - RNA, 17 nt, Human
cucuuuuaccugcugcu

SEQ ID NO: 1785433 - RNA, 18 nt, Human
cucuuuuaccugcugcuu

SEQ ID NO: 1785434 - RNA, 21 nt, Human
cugaagucacacagugagucg

SEQ ID NO: 1785435 - RNA, 18 nt, Human
cugaagucacacagugag

SEQ ID NO: 1785436 - RNA, 19 nt, Human
cugaagucacacagugagu

SEQ ID NO: 1785437 - RNA, 17 nt, Human
cugaagucacacaguga

SEQ ID NO: 1785438 - RNA, 21 nt, Human
cugaaugccgcgaugggucag

SEQ ID NO: 1785439 - RNA, 22 nt, Human
cugaaugccgcgaugggucagg

SEQ ID NO: 1785440 - RNA, 21 nt, Human
cugacgaacuuccauggcccu

SEQ ID NO: 1785441 - RNA, 12 nt, Human
cugaauuugcaa

SEQ ID NO: 1785442 - RNA, 13 nt, Human
cugaauuugcaaa

SEQ ID NO: 1785443 - RNA, 14 nt, Human
cugaauuugcaaag

SEQ ID NO: 1785444 - RNA, 15 nt, Human
cugaauuugcaaagu

SEQ ID NO: 1785445 - RNA, 16 nt, Human
cugaauuugcaaagua

SEQ ID NO: 1785446 - RNA, 18 nt, Human
cugaauuugcaaaguacu

SEQ ID NO: 1785447 - RNA, 19 nt, Human
cugaauuugcaaaguacug

SEQ ID NO: 1785448 - RNA, 20 nt, Human
cugaauuugcaaaguacugu

SEQ ID NO: 1785449 - RNA, 21 nt, Human
cugaauuugcaaaguacugua

SEQ ID NO: 1785450 - RNA, 22 nt, Human
cugaauuugcaaaguacuguaa

SEQ ID NO: 1785451 - RNA, 16 nt, Human
cugacagacacaggcc

SEQ ID NO: 1785452 - RNA, 20 nt, Human
cugaauuuuggggauuuuca

SEQ ID NO: 1785453 - RNA, 21 nt, Human
cugaauuuuggggauuuucaa

SEQ ID NO: 1785454 - RNA, 17 nt, Human
cugacagacacaggccc

SEQ ID NO: 1785455 - RNA, 18 nt, Human
cugacagacacaggcccg

SEQ ID NO: 1785456 - RNA, 13 nt, Human
cugacugcucaga

SEQ ID NO: 1785457 - RNA, 14 nt, Human
cugacugcucagaa

SEQ ID NO: 1785458 - RNA, 21 nt, Human
cugacugcucagaacuugcug

SEQ ID NO: 1785459 - RNA, 12 nt, Human
cugacugggagu

SEQ ID NO: 1785460 - RNA, 16 nt, Human
cugacucagggcuccu

SEQ ID NO: 1785461 - RNA, 18 nt, Human
cugacucagggcuccugg

SEQ ID NO: 1785462 - RNA, 19 nt, Human
cugacucagggcuccuggg

SEQ ID NO: 1785463 - RNA, 21 nt, Human
cugacucagggcuccuggguu

SEQ ID NO: 1785464 - RNA, 16 nt, Human
cugacucauucugaag

SEQ ID NO: 1785465 - RNA, 15 nt, Human
cugacucagggcucc

SEQ ID NO: 1785466 - RNA, 18 nt, Human
cugagauucaauauugaa

SEQ ID NO: 1785467 - RNA, 18 nt, Human
cugagcaggaccucugaa

SEQ ID NO: 1785468 - RNA, 20 nt, Human
cugagcagugaaugauucag

SEQ ID NO: 1785469 - RNA, 13 nt, Human
cugagccacagug

SEQ ID NO: 1785470 - RNA, 12 nt, Human
cugagccaccug

SEQ ID NO: 1785471 - RNA, 14 nt, Human
cugagccaccugcc

SEQ ID NO: 1785472 - RNA, 15 nt, Human
cugagccaccugccc

SEQ ID NO: 1785473 - RNA, 17 nt, Human
cugagccaccugcccuu

SEQ ID NO: 1785474 - RNA, 17 nt, Human
cugagcagaaagaggcc

SEQ ID NO: 1785475 - RNA, 16 nt, Human
cugagcaggaccucug

SEQ ID NO: 1785476 - RNA, 11 nt, Human
cugagcacaga

SEQ ID NO: 1785477 - RNA, 13 nt, Human
cugagcacagaug

SEQ ID NO: 1785478 - RNA, 14 nt, Human
cugagcacccucug

SEQ ID NO: 1785479 - RNA, 15 nt, Human
cugagcacccucugg

SEQ ID NO: 1785480 - RNA, 16 nt, Human
cugagcacccucugga

SEQ ID NO: 1785481 - RNA, 17 nt, Human
cugagcacccucuggau

SEQ ID NO: 1785482 - RNA, 20 nt, Human
cugagcacccucuggauucu

SEQ ID NO: 1785483 - RNA, 17 nt, Human
cugagcaccgugucaag

SEQ ID NO: 1785484 - RNA, 20 nt, Human
cugagcaccgugucaagcug

SEQ ID NO: 1785485 - RNA, 23 nt, Human
cugagcaccgugucaagcugcuc

SEQ ID NO: 1785486 - RNA, 20 nt, Human
cucgccggacccucuaaccu

SEQ ID NO: 1785487 - RNA, 18 nt, Human
cucgcucccucccaggac

SEQ ID NO: 1785488 - RNA, 15 nt, Human
cucgcucccucccag

SEQ ID NO: 1785489 - RNA, 19 nt, Human
cuccuugggcccuuugagu

SEQ ID NO: 1785490 - RNA, 17 nt, Human
cuccuugggcccuuuga

SEQ ID NO: 1785491 - RNA, 18 nt, Human
cuccuugggcccuuugag

SEQ ID NO: 1785492 - RNA, 15 nt, Human
cuccuuccugugugu

SEQ ID NO: 1785493 - RNA, 12 nt, Human
cuccuugggccc

SEQ ID NO: 1785494 - RNA, 13 nt, Human
cuccuugggcccu

SEQ ID NO: 1785495 - RNA, 16 nt, Human
cuccuugggcccuuug

SEQ ID NO: 1785496 - RNA, 12 nt, Human
cuccuuccuggc

SEQ ID NO: 1785497 - RNA, 14 nt, Human
cuccuuccuggccu

SEQ ID NO: 1785498 - RNA, 16 nt, Human
cuccuuccuggccuga

SEQ ID NO: 1785499 - RNA, 17 nt, Human
cuccuuccuggccugag

SEQ ID NO: 1785500 - RNA, 18 nt, Human
cuccuuccuggccugaga

SEQ ID NO: 1785501 - RNA, 13 nt, Human
cuccuuccugugu

SEQ ID NO: 1785502 - RNA, 14 nt, Human
cuccuuccuggaga

SEQ ID NO: 1785503 - RNA, 13 nt, Human
cuccuuccuggag

SEQ ID NO: 1785504 - RNA, 21 nt, Human
cuccugugugugcgccuacag

SEQ ID NO: 1785505 - RNA, 23 nt, Human
cuccugugugugcgccuacagga

SEQ ID NO: 1785506 - RNA, 24 nt, Human
cuccugugugugcgccuacaggag

SEQ ID NO: 1785507 - RNA, 17 nt, Human
cuccugccucagccucc

SEQ ID NO: 1785508 - RNA, 12 nt, Human
cuccugccucag

SEQ ID NO: 1785509 - RNA, 11 nt, Human
cuccugccuca

SEQ ID NO: 1785510 - RNA, 13 nt, Human
cuccucuccccag

SEQ ID NO: 1785511 - RNA, 15 nt, Human
cuccucuccccagca

SEQ ID NO: 1785512 - RNA, 22 nt, Human
cuccugccucgaacuggcugca

SEQ ID NO: 1785513 - RNA, 18 nt, Human
cuccugccucgaacuggc

SEQ ID NO: 1785514 - RNA, 20 nt, Human
cuccugccucgaacuggcug

SEQ ID NO: 1785515 - RNA, 21 nt, Human
cuccugccucgaacuggcugc

SEQ ID NO: 1785516 - RNA, 14 nt, Human
cuccucccagccca

SEQ ID NO: 1785517 - RNA, 18 nt, Human
cuccgagugaacuggucu

SEQ ID NO: 1785518 - RNA, 19 nt, Human
cuccgagugaacuggucuu

SEQ ID NO: 1785519 - RNA, 23 nt, Human
cuccgagugaacuggucuuccuu

SEQ ID NO: 1785520 - RNA, 12 nt, Human
cuccgcaggacu

SEQ ID NO: 1785521 - RNA, 13 nt, Human
cuccgcaggacuu

SEQ ID NO: 1785522 - RNA, 22 nt, Human
cuccgcaggacuuccccggagg

SEQ ID NO: 1785523 - RNA, 13 nt, Human
cucccuugggcuc

SEQ ID NO: 1785524 - RNA, 14 nt, Human
cucccuugggcucc

SEQ ID NO: 1785525 - RNA, 18 nt, Human
cucccuugggcucccugu

SEQ ID NO: 1785526 - RNA, 19 nt, Human
cucccuguaaccucuucag

SEQ ID NO: 1785527 - RNA, 19 nt, Human
cucccgaguagcugggacu

SEQ ID NO: 1785528 - RNA, 20 nt, Human
cucccgaguagcugggacua

SEQ ID NO: 1785529 - RNA, 22 nt, Human
cuccccagcaagugagagcugg

SEQ ID NO: 1785530 - RNA, 23 nt, Human
cuccccagcaagugagagcuggg

SEQ ID NO: 1785531 - RNA, 21 nt, Human
cucauaguaugguggcugggu

SEQ ID NO: 1785532 - RNA, 22 nt, Human
cucaggugauccacccaccuca

SEQ ID NO: 1785533 - RNA, 20 nt, Human
cucaggugauccacccaccu

SEQ ID NO: 1785534 - RNA, 18 nt, Human
cucaggugauccacccac

SEQ ID NO: 1785535 - RNA, 19 nt, Human
cucaggugauccacccacc

SEQ ID NO: 1785536 - RNA, 23 nt, Human
cucauaguaugguggcuggguug

SEQ ID NO: 1785537 - RNA, 13 nt, Human
cucaucauucucu

SEQ ID NO: 1785538 - RNA, 14 nt, Human
cucaucauucucug

SEQ ID NO: 1785539 - RNA, 15 nt, Human
cucaucauucucugu

SEQ ID NO: 1785540 - RNA, 17 nt, Human
cucaucauucucugucu

SEQ ID NO: 1785541 - RNA, 18 nt, Human
cucaucauucucugucuc

SEQ ID NO: 1785542 - RNA, 19 nt, Human
cucaucauucucugucuca

SEQ ID NO: 1785543 - RNA, 20 nt, Human
cucaucauucucugucucau

SEQ ID NO: 1785544 - RNA, 22 nt, Human
cucaucauucucugucucaucc

SEQ ID NO: 1785545 - RNA, 22 nt, Human
cucaucccgagcaccuccacau

SEQ ID NO: 1785546 - RNA, 18 nt, Human
cucagcauccuggcaccc

SEQ ID NO: 1785547 - RNA, 14 nt, Human
cucaggcaccaguc

SEQ ID NO: 1785548 - RNA, 13 nt, Human
cucagggcuccug

SEQ ID NO: 1785549 - RNA, 14 nt, Human
cucagggcuccugg

SEQ ID NO: 1785550 - RNA, 15 nt, Human
cucagggcuccuggg

SEQ ID NO: 1785551 - RNA, 17 nt, Human
cucagggcuccuggguu

SEQ ID NO: 1785552 - RNA, 15 nt, Human
cuccacguucugcuc

SEQ ID NO: 1785553 - RNA, 16 nt, Human
cuccacguucugcuca

SEQ ID NO: 1785554 - RNA, 17 nt, Human
cuccacguucugcucau

SEQ ID NO: 1785555 - RNA, 18 nt, Human
cuccacguucugcucauc

SEQ ID NO: 1785556 - RNA, 14 nt, Human
cuccagcucaccag

SEQ ID NO: 1785557 - RNA, 15 nt, Human
cuccaggaagaaaga

SEQ ID NO: 1785558 - RNA, 11 nt, Human
cuccaggagcu

SEQ ID NO: 1785559 - RNA, 17 nt, Human
cuccaggagcuucuugu

SEQ ID NO: 1785560 - RNA, 20 nt, Human
cuccauccacaugggagccg

SEQ ID NO: 1785561 - RNA, 23 nt, Human
cuccaucccccuuuacccucuuu

SEQ ID NO: 1785562 - RNA, 15 nt, Human
cuccacccugcucuc

SEQ ID NO: 1785563 - RNA, 13 nt, Human
cuccacccugcuc

SEQ ID NO: 1785564 - RNA, 14 nt, Human
cuccacauccucca

SEQ ID NO: 1785565 - RNA, 15 nt, Human
cuccacauccuccac

SEQ ID NO: 1785566 - RNA, 17 nt, Human
cuccacauccuccacgu

SEQ ID NO: 1785567 - RNA, 17 nt, Human
cuccacaaccucuuccc

SEQ ID NO: 1785568 - RNA, 22 nt, Human
cuccacaaccucuuccccccaa

SEQ ID NO: 1785569 - RNA, 13 nt, Human
cuccacauccucc

SEQ ID NO: 1785570 - RNA, 17 nt, Human
cucauuugucacacacu

SEQ ID NO: 1785571 - RNA, 11 nt, Human
cucauuaaauu

SEQ ID NO: 1785572 - RNA, 15 nt, Human
cucauuaaugacacu

SEQ ID NO: 1785573 - RNA, 16 nt, Human
cucauuaaugacacuu

SEQ ID NO: 1785574 - RNA, 18 nt, Human
cucauuugucacacacuu

SEQ ID NO: 1785575 - RNA, 16 nt, Human
cuccaaaaaucugccu

SEQ ID NO: 1785576 - RNA, 17 nt, Human
cuccaaaaaucugccug

SEQ ID NO: 1785577 - RNA, 18 nt, Human
cuccaaaaaucugccugg

SEQ ID NO: 1785578 - RNA, 19 nt, Human
cuccaaaaaucugccuggg

SEQ ID NO: 1785579 - RNA, 20 nt, Human
cuccaaaaaucugccugggu

SEQ ID NO: 1785580 - RNA, 21 nt, Human
cuccaaaaaucugccuggguu

SEQ ID NO: 1785581 - RNA, 18 nt, Human
cuaugggacucaaugcac

SEQ ID NO: 1785582 - RNA, 22 nt, Human
cuaugggacucaaugcacugac

SEQ ID NO: 1785583 - RNA, 23 nt, Human
cuaugggacucaaugcacugaca

SEQ ID NO: 1785584 - RNA, 21 nt, Human
cuauggguuuaguuacuuuag

SEQ ID NO: 1785585 - RNA, 22 nt, Human
cuauucaagaggaaaugucaca

SEQ ID NO: 1785586 - RNA, 23 nt, Human
cuauucaagaggaaaugucacag

SEQ ID NO: 1785587 - RNA, 17 nt, Human
cuaugcuuuccaaaccu

SEQ ID NO: 1785588 - RNA, 16 nt, Human
cuauaaggcagccuug

SEQ ID NO: 1785589 - RNA, 23 nt, Human
cuagugcuuuccuuuuuuaaaaa

SEQ ID NO: 1785590 - RNA, 21 nt, Human
cuagugcuuuccuuuuuuaaa

SEQ ID NO: 1785591 - RNA, 22 nt, Human
cuagugcuuuccuuuuuuaaaa

SEQ ID NO: 1785592 - RNA, 13 nt, Human
cuagugcuuuccu

SEQ ID NO: 1785593 - RNA, 17 nt, Human
cuauagccuaggugaca

SEQ ID NO: 1785594 - RNA, 23 nt, Human
cgcccaguuggguggaugccugg

SEQ ID NO: 1785595 - RNA, 14 nt, Human
cgcccaucucagga

SEQ ID NO: 1785596 - RNA, 22 nt, Human
cgcccaguuggguggaugccug

SEQ ID NO: 1785597 - RNA, 18 nt, Human
cgccagggagaccuggac

SEQ ID NO: 1785598 - RNA, 14 nt, Human
cuaggugacagagu

SEQ ID NO: 1785599 - RNA, 18 nt, Human
cuaggugacagagugaga

SEQ ID NO: 1785600 - RNA, 15 nt, Human
cuagguaggguuuaa

SEQ ID NO: 1785601 - RNA, 24 nt, Human
cuaggugacagagugagacucugu

SEQ ID NO: 1785602 - RNA, 18 nt, Human
cuaguaagcaucuacuuc

SEQ ID NO: 1785603 - RNA, 15 nt, Human
cuaguacuagaaacu

SEQ ID NO: 1785604 - RNA, 17 nt, Human
cuagugaaggcuucucu

SEQ ID NO: 1785605 - RNA, 21 nt, Human
cuagugaaggcuucucucugu

SEQ ID NO: 1785606 - RNA, 19 nt, Human
cucaagaagaagaggggca

SEQ ID NO: 1785607 - RNA, 20 nt, Human
cucaagaagaagaggggcau

SEQ ID NO: 1785608 - RNA, 17 nt, Human
cucaagugauucuccug

SEQ ID NO: 1785609 - RNA, 21 nt, Human
cucaaguccucuuuucugaga

SEQ ID NO: 1785610 - RNA, 17 nt, Human
cucaccagccccagugc

SEQ ID NO: 1785611 - RNA, 18 nt, Human
cucaccagccccagugcc

SEQ ID NO: 1785612 - RNA, 13 nt, Human
cucaccagcccca

SEQ ID NO: 1785613 - RNA, 14 nt, Human
cucaccagccccag

SEQ ID NO: 1785614 - RNA, 15 nt, Human
cucaccagccccagu

SEQ ID NO: 1785615 - RNA, 22 nt, Human
cucacauuuauucugcucacau

SEQ ID NO: 1785616 - RNA, 15 nt, Human
cucacauuuauucug

SEQ ID NO: 1785617 - RNA, 19 nt, Human
cucacauuuauucugcuca

SEQ ID NO: 1785618 - RNA, 13 nt, Human
cucaaccuccugg

SEQ ID NO: 1785619 - RNA, 15 nt, Human
cucaaccuccugggc

SEQ ID NO: 1785620 - RNA, 17 nt, Human
cucaaccuccugggcua

SEQ ID NO: 1785621 - RNA, 19 nt, Human
cuauuucaguguuaccugu

SEQ ID NO: 1785622 - RNA, 21 nt, Human
cuauuucaguguuaccugugu

SEQ ID NO: 1785623 - RNA, 21 nt, Human
cucacuguugcccaggcuggc

SEQ ID NO: 1785624 - RNA, 22 nt, Human
cucacuguugcccaggcuggcg

SEQ ID NO: 1785625 - RNA, 17 nt, Human
cucagacuuuggaaaau

SEQ ID NO: 1785626 - RNA, 22 nt, Human
cucagacuuuggaaaaugcauu

SEQ ID NO: 1785627 - RNA, 20 nt, Human
cucacuguugcccaggcugg

SEQ ID NO: 1785628 - RNA, 16 nt, Human
cucagcauccuggcac

SEQ ID NO: 1785629 - RNA, 17 nt, Human
cucagcauccuggcacc

SEQ ID NO: 1785630 - RNA, 19 nt, Human
cucacuauguugcccaggc

SEQ ID NO: 1785631 - RNA, 20 nt, Human
cucacuauguugcccaggca

SEQ ID NO: 1785632 - RNA, 14 nt, Human
cucacucccaccug

SEQ ID NO: 1785633 - RNA, 23 nt, Human
cucacuauguugcccaggcaggu

SEQ ID NO: 1785634 - RNA, 14 nt, Human
cucacucaccuuca

SEQ ID NO: 1785635 - RNA, 21 nt, Human
cucacuauguugcccaggcag

SEQ ID NO: 1785636 - RNA, 22 nt, Human
cucacuauguugcccaggcagg

SEQ ID NO: 1785637 - RNA, 11 nt, Human
cucacucuguc

SEQ ID NO: 1785638 - RNA, 12 nt, Human
cucacucugucg

SEQ ID NO: 1785639 - RNA, 22 nt, Human
cucacucugucgcccagucugg

SEQ ID NO: 1785640 - RNA, 13 nt, Human
cucacucugucgc

SEQ ID NO: 1785641 - RNA, 21 nt, Human
cucacucugucgcccagucug

SEQ ID NO: 1785642 - RNA, 12 nt, Human
cucacugcagcc

SEQ ID NO: 1785643 - RNA, 13 nt, Human
cucacugcagccu

SEQ ID NO: 1785644 - RNA, 14 nt, Human
cucacugcagccuc

SEQ ID NO: 1785645 - RNA, 14 nt, Human
gagggacgccuggg

SEQ ID NO: 1785646 - RNA, 15 nt, Human
gagggacgccugggg

SEQ ID NO: 1785647 - RNA, 16 nt, Human
gagggacgccuggggg

SEQ ID NO: 1785648 - RNA, 23 nt, Human
gagggacgccugggggugccagg

SEQ ID NO: 1785649 - RNA, 19 nt, Human
gagggaacggaaauaaagg

SEQ ID NO: 1785650 - RNA, 13 nt, Human
gagggagugacag

SEQ ID NO: 1785651 - RNA, 14 nt, Human
gagggagugacaga

SEQ ID NO: 1785652 - RNA, 16 nt, Human
gagggagugacagagg

SEQ ID NO: 1785653 - RNA, 14 nt, Human
gaggccuucucuga

SEQ ID NO: 1785654 - RNA, 16 nt, Human
gaggcccuuugcuguc

SEQ ID NO: 1785655 - RNA, 17 nt, Human
gaggcccuuugcugucc

SEQ ID NO: 1785656 - RNA, 17 nt, Human
gaggcccucgcugccag

SEQ ID NO: 1785657 - RNA, 19 nt, Human
gaggccagggcagagugag

SEQ ID NO: 1785658 - RNA, 15 nt, Human
gaggccagugagcca

SEQ ID NO: 1785659 - RNA, 12 nt, Human
gaggauguucug

SEQ ID NO: 1785660 - RNA, 17 nt, Human
gaggauguucugggaca

SEQ ID NO: 1785661 - RNA, 20 nt, Human
gaggauguucugggacacag

SEQ ID NO: 1785662 - RNA, 17 nt, Human
gaggaugggucagagcu

SEQ ID NO: 1785663 - RNA, 14 nt, Human
gaggaguggaggug

SEQ ID NO: 1785664 - RNA, 19 nt, Human
gaggaggggccccccugcc

SEQ ID NO: 1785665 - RNA, 21 nt, Human
gaggaggggccccccugcccu

SEQ ID NO: 1785666 - RNA, 22 nt, Human
gaggaggggccccccugcccug

SEQ ID NO: 1785667 - RNA, 13 nt, Human
gaggcagccccau

SEQ ID NO: 1785668 - RNA, 13 nt, Human
gaggcagcagugu

SEQ ID NO: 1785669 - RNA, 20 nt, Human
gaggcagcagugugaggcca

SEQ ID NO: 1785670 - RNA, 21 nt, Human
gaggcagcagugugaggccag

SEQ ID NO: 1785671 - RNA, 22 nt, Human
gaggcagcagugugaggccagg

SEQ ID NO: 1785672 - RNA, 23 nt, Human
gaggcagccccauucugccugcc

SEQ ID NO: 1785673 - RNA, 18 nt, Human
gaggcagccccauucugc

SEQ ID NO: 1785674 - RNA, 22 nt, Human
gaggcagccccauucugccugc

SEQ ID NO: 1785675 - RNA, 13 nt, Human
gaggccagggcag

SEQ ID NO: 1785676 - RNA, 15 nt, Human
gaggccagggcagag

SEQ ID NO: 1785677 - RNA, 13 nt, Human
gaggacagggagg

SEQ ID NO: 1785678 - RNA, 22 nt, Human
gaggacagggaggugaccccag

SEQ ID NO: 1785679 - RNA, 23 nt, Human
gaggacagggaggugaccccagg

SEQ ID NO: 1785680 - RNA, 18 nt, Human
gaggaggcuccagagggc

SEQ ID NO: 1785681 - RNA, 22 nt, Human
gagcuucuuccaggugcccagc

SEQ ID NO: 1785682 - RNA, 18 nt, Human
gagcuucuuguuuccuug

SEQ ID NO: 1785683 - RNA, 14 nt, Human
gaggaauccagacc

SEQ ID NO: 1785684 - RNA, 19 nt, Human
gaggaaggggccagaggcu

SEQ ID NO: 1785685 - RNA, 13 nt, Human
gaggaaguucaga

SEQ ID NO: 1785686 - RNA, 14 nt, Human
gaggaaguucagau

SEQ ID NO: 1785687 - RNA, 17 nt, Human
gaggaaguucagaucuu

SEQ ID NO: 1785688 - RNA, 15 nt, Human
gaggaauccagaccc

SEQ ID NO: 1785689 - RNA, 14 nt, Human
gaggaauggacaga

SEQ ID NO: 1785690 - RNA, 18 nt, Human
gagcccugguggcagugg

SEQ ID NO: 1785691 - RNA, 20 nt, Human
gagccucagcauccuggcac

SEQ ID NO: 1785692 - RNA, 21 nt, Human
gagccucagcauccuggcacc

SEQ ID NO: 1785693 - RNA, 15 nt, Human
gagcccugguggcag

SEQ ID NO: 1785694 - RNA, 16 nt, Human
gagcccugguggcagu

SEQ ID NO: 1785695 - RNA, 19 nt, Human
gagccucagcauccuggca

SEQ ID NO: 1785696 - RNA, 17 nt, Human
gagcccugguggcagug

SEQ ID NO: 1785697 - RNA, 12 nt, Human
gagccugcugga

SEQ ID NO: 1785698 - RNA, 15 nt, Human
gagccugcuggaagc

SEQ ID NO: 1785699 - RNA, 16 nt, Human
gagccugcuggaagcc

SEQ ID NO: 1785700 - RNA, 20 nt, Human
gagccugcuggaagcccagc

SEQ ID NO: 1785701 - RNA, 15 nt, Human
gagccuggccagccu

SEQ ID NO: 1785702 - RNA, 13 nt, Human
gagcuacaaaugc

SEQ ID NO: 1785703 - RNA, 12 nt, Human
gagcuacaaaug

SEQ ID NO: 1785704 - RNA, 16 nt, Human
gagcuucauggcagaa

SEQ ID NO: 1785705 - RNA, 16 nt, Human
gagcuuagcauaucug

SEQ ID NO: 1785706 - RNA, 19 nt, Human
gagcuucauggcagaaggc

SEQ ID NO: 1785707 - RNA, 13 nt, Human
gagcuucccugac

SEQ ID NO: 1785708 - RNA, 17 nt, Human
gagcuucccugacucau

SEQ ID NO: 1785709 - RNA, 19 nt, Human
gagcuuccuguccucccag

SEQ ID NO: 1785710 - RNA, 18 nt, Human
gagcuaaacuccuuccug

SEQ ID NO: 1785711 - RNA, 19 nt, Human
gagcuaaacuccuuccugg

SEQ ID NO: 1785712 - RNA, 20 nt, Human
gagcuaaacuccuuccuggc

SEQ ID NO: 1785713 - RNA, 22 nt, Human
gagcuaaacuccuuccuggccu

SEQ ID NO: 1785714 - RNA, 14 nt, Human
gagcuacaaaugca

SEQ ID NO: 1785715 - RNA, 22 nt, Human
gagcuaauuuacuggacaaaga

SEQ ID NO: 1785716 - RNA, 18 nt, Human
gagcuccaacucagaagg

SEQ ID NO: 1785717 - RNA, 19 nt, Human
gagcuccaacucagaaggg

SEQ ID NO: 1785718 - RNA, 20 nt, Human
gagaucaaccccuucgcucc

SEQ ID NO: 1785719 - RNA, 14 nt, Human
gagcacccucugga

SEQ ID NO: 1785720 - RNA, 15 nt, Human
gagcacccucuggau

SEQ ID NO: 1785721 - RNA, 14 nt, Human
gagcaccuccacau

SEQ ID NO: 1785722 - RNA, 18 nt, Human
gagcaccgugucaagcug

SEQ ID NO: 1785723 - RNA, 21 nt, Human
gagcaccgugucaagcugcuc

SEQ ID NO: 1785724 - RNA, 22 nt, Human
gagcaccgugucaagcugcucu

SEQ ID NO: 1785725 - RNA, 23 nt, Human
gagcaccgugucaagcugcucug

SEQ ID NO: 1785726 - RNA, 19 nt, Human
gagcaccuccacauccucc

SEQ ID NO: 1785727 - RNA, 17 nt, Human
gagcaccuccagccuga

SEQ ID NO: 1785728 - RNA, 13 nt, Human
gagcacacccagc

SEQ ID NO: 1785729 - RNA, 15 nt, Human
gagcacacccagccc

SEQ ID NO: 1785730 - RNA, 16 nt, Human
gagcacacccagcccc

SEQ ID NO: 1785731 - RNA, 22 nt, Human
gagccacugcaccgggccacag

SEQ ID NO: 1785732 - RNA, 14 nt, Human
gagccacuccucug

SEQ ID NO: 1785733 - RNA, 15 nt, Human
gagccacuccucuga

SEQ ID NO: 1785734 - RNA, 14 nt, Human
gagcccaagggaau

SEQ ID NO: 1785735 - RNA, 13 nt, Human
gagccaccugccc

SEQ ID NO: 1785736 - RNA, 15 nt, Human
gagccacuccggccc

SEQ ID NO: 1785737 - RNA, 13 nt, Human
gagccacugcacc

SEQ ID NO: 1785738 - RNA, 21 nt, Human
gagcagcagguagccugcugg

SEQ ID NO: 1785739 - RNA, 16 nt, Human
gagcagaggggcugaa

SEQ ID NO: 1785740 - RNA, 14 nt, Human
gagcacugggcucc

SEQ ID NO: 1785741 - RNA, 22 nt, Human
gagucucacuguugcccaggcu

SEQ ID NO: 1785742 - RNA, 23 nt, Human
gagucucacuguugcccaggcug

SEQ ID NO: 1785743 - RNA, 19 nt, Human
gagucucacuguugcccag

SEQ ID NO: 1785744 - RNA, 20 nt, Human
gagucucacuguugcccagg

SEQ ID NO: 1785745 - RNA, 21 nt, Human
gagucucacuguugcccaggc

SEQ ID NO: 1785746 - RNA, 17 nt, Human
gagucgaggacagggag

SEQ ID NO: 1785747 - RNA, 12 nt, Human
gaguagcuggga

SEQ ID NO: 1785748 - RNA, 14 nt, Human
gaguagcugggacu

SEQ ID NO: 1785749 - RNA, 14 nt, Human
gauauaaucuuuca

SEQ ID NO: 1785750 - RNA, 16 nt, Human
gauauaaucuuucaaa

SEQ ID NO: 1785751 - RNA, 21 nt, Human
gaucaaccccuucgcuccugu

SEQ ID NO: 1785752 - RNA, 22 nt, Human
gaucaaccccuucgcuccugug

SEQ ID NO: 1785753 - RNA, 11 nt, Human
gauacaauaaa

SEQ ID NO: 1785754 - RNA, 12 nt, Human
gauacaauaaau

SEQ ID NO: 1785755 - RNA, 13 nt, Human
gagugucuuucca

SEQ ID NO: 1785756 - RNA, 15 nt, Human
gagugucuuuccacg

SEQ ID NO: 1785757 - RNA, 19 nt, Human
gagugucuuuccacggagc

SEQ ID NO: 1785758 - RNA, 21 nt, Human
gagugucuuuccacggagcca

SEQ ID NO: 1785759 - RNA, 17 nt, Human
gagucuggcccuagacu

SEQ ID NO: 1785760 - RNA, 22 nt, Human
gagugucuuuccacggagccac

SEQ ID NO: 1785761 - RNA, 14 nt, Human
gaguuagacuguug

SEQ ID NO: 1785762 - RNA, 12 nt, Human
gaguuagacugu

SEQ ID NO: 1785763 - RNA, 16 nt, Human
gaguuuuggaugcagu

SEQ ID NO: 1785764 - RNA, 21 nt, Human
gaguugaaaaucuuauaauuu

SEQ ID NO: 1785765 - RNA, 12 nt, Human
gaguuccaguca

SEQ ID NO: 1785766 - RNA, 15 nt, Human
gaugguggagggcca

SEQ ID NO: 1785767 - RNA, 15 nt, Human
gauggugugccuucc

SEQ ID NO: 1785768 - RNA, 17 nt, Human
gauggugugccuuccag

SEQ ID NO: 1785769 - RNA, 14 nt, Human
gaugguggagggcc

SEQ ID NO: 1785770 - RNA, 16 nt, Human
gauguucugggacaca

SEQ ID NO: 1785771 - RNA, 14 nt, Human
gauucaccugagca

SEQ ID NO: 1785772 - RNA, 22 nt, Human
gauucccaagcucugcuccucu

SEQ ID NO: 1785773 - RNA, 14 nt, Human
gauucacaucugca

SEQ ID NO: 1785774 - RNA, 23 nt, Human
gauucaacuaaaaaaaaaaaagu

SEQ ID NO: 1785775 - RNA, 13 nt, Human
gauucaagccauu

SEQ ID NO: 1785776 - RNA, 17 nt, Human
gauucaagccauuccaa

SEQ ID NO: 1785777 - RNA, 21 nt, Human
gauucaauauugaauuuuucc

SEQ ID NO: 1785778 - RNA, 19 nt, Human
gauucuaauuuuuaagcaa

SEQ ID NO: 1785779 - RNA, 14 nt, Human
gauuccccuguguc

SEQ ID NO: 1785780 - RNA, 15 nt, Human
gauuccccuguguca

SEQ ID NO: 1785781 - RNA, 16 nt, Human
gauuguggaauguugg

SEQ ID NO: 1785782 - RNA, 21 nt, Human
gauuguggaauguuggauaag

SEQ ID NO: 1785783 - RNA, 18 nt, Human
gaucacgauguaaauuau

SEQ ID NO: 1785784 - RNA, 15 nt, Human
gaucacgccacugca

SEQ ID NO: 1785785 - RNA, 23 nt, Human
gaucaaccccuucgcuccugugu

SEQ ID NO: 1785786 - RNA, 13 nt, Human
gaucacgccacug

SEQ ID NO: 1785787 - RNA, 14 nt, Human
gaucacgccacugc

SEQ ID NO: 1785788 - RNA, 19 nt, Human
gauccucccaccucagccu

SEQ ID NO: 1785789 - RNA, 20 nt, Human
gauccucccaccucagccuc

SEQ ID NO: 1785790 - RNA, 21 nt, Human
gauccucccaccucagccucc

SEQ ID NO: 1785791 - RNA, 15 nt, Human
gaucuuaauauaaau

SEQ ID NO: 1785792 - RNA, 16 nt, Human
gaucuuaauauaaauu

SEQ ID NO: 1785793 - RNA, 17 nt, Human
gaucuuugcagacaggc

SEQ ID NO: 1785794 - RNA, 16 nt, Human
gaucuuugcagacagg

SEQ ID NO: 1785795 - RNA, 11 nt, Human
gaugagaaagg

SEQ ID NO: 1785796 - RNA, 22 nt, Human
gaugagaaagguugaagcacca

SEQ ID NO: 1785797 - RNA, 14 nt, Human
gaugcaaagaaaau

SEQ ID NO: 1785798 - RNA, 13 nt, Human
gaugcccugcccu

SEQ ID NO: 1785799 - RNA, 20 nt, Human
gaugcucaaaaucuuuccaa

SEQ ID NO: 1785800 - RNA, 20 nt, Human
gauggcaggacgugggcugg

SEQ ID NO: 1785801 - RNA, 22 nt, Human
gaugggcaacccccagccugcu

SEQ ID NO: 1785802 - RNA, 15 nt, Human
gcagcucagcuuccc

SEQ ID NO: 1785803 - RNA, 21 nt, Human
gcaggaccuucgggcugugcc

SEQ ID NO: 1785804 - RNA, 17 nt, Human
gcaggacgugggcuggg

SEQ ID NO: 1785805 - RNA, 13 nt, Human
gcagcagcccaag

SEQ ID NO: 1785806 - RNA, 14 nt, Human
gcagcagcccaagc

SEQ ID NO: 1785807 - RNA, 20 nt, Human
gcagcagcccaagcuucccu

SEQ ID NO: 1785808 - RNA, 21 nt, Human
gcagcagcccaagcuucccuc

SEQ ID NO: 1785809 - RNA, 16 nt, Human
gcagcaggaggccagg

SEQ ID NO: 1785810 - RNA, 21 nt, Human
gcagcaggaauauaugugugc

SEQ ID NO: 1785811 - RNA, 16 nt, Human
gcagccgcugagcgag

SEQ ID NO: 1785812 - RNA, 17 nt, Human
gcagccgcugagcgagg

SEQ ID NO: 1785813 - RNA, 16 nt, Human
gcagaucuuggacuca

SEQ ID NO: 1785814 - RNA, 18 nt, Human
gcagacugaucaggaccu

SEQ ID NO: 1785815 - RNA, 20 nt, Human
gcagagaaacuuaagcaaag

SEQ ID NO: 1785816 - RNA, 21 nt, Human
gcagagaaacuuaagcaaagg

SEQ ID NO: 1785817 - RNA, 17 nt, Human
gcagagaagcucucggg

SEQ ID NO: 1785818 - RNA, 17 nt, Human
gcagacucuacagaggc

SEQ ID NO: 1785819 - RNA, 18 nt, Human
gcagacucuacagaggcc

SEQ ID NO: 1785820 - RNA, 19 nt, Human
gcagacucuacagaggcca

SEQ ID NO: 1785821 - RNA, 22 nt, Human
gcagacucuacagaggccaugg

SEQ ID NO: 1785822 - RNA, 14 nt, Human
gcacuugcagacuc

SEQ ID NO: 1785823 - RNA, 16 nt, Human
gcacuugcagacucua

SEQ ID NO: 1785824 - RNA, 16 nt, Human
gcaccccuacucacau

SEQ ID NO: 1785825 - RNA, 15 nt, Human
gcaccaagcaggaaa

SEQ ID NO: 1785826 - RNA, 23 nt, Human
gcacagcuucauuuccugugucu

SEQ ID NO: 1785827 - RNA, 21 nt, Human
gcacagcuucauuuccugugu

SEQ ID NO: 1785828 - RNA, 14 nt, Human
gcacgugugugcac

SEQ ID NO: 1785829 - RNA, 20 nt, Human
gcacuaaggugugcucugau

SEQ ID NO: 1785830 - RNA, 14 nt, Human
gcacugggcucccg

SEQ ID NO: 1785831 - RNA, 18 nt, Human
gcacugggcucccgggcc

SEQ ID NO: 1785832 - RNA, 20 nt, Human
gcacuaccacuccugccaag

SEQ ID NO: 1785833 - RNA, 15 nt, Human
gcacuguucccccug

SEQ ID NO: 1785834 - RNA, 18 nt, Human
gcacuguucccccugugc

SEQ ID NO: 1785835 - RNA, 19 nt, Human
gcacuguucccccugugca

SEQ ID NO: 1785836 - RNA, 20 nt, Human
gcacuguucccccugugcag

SEQ ID NO: 1785837 - RNA, 22 nt, Human
gcaggacuuccccggagggcug

SEQ ID NO: 1785838 - RNA, 20 nt, Human
gcaggcagguguuuauuaaa

SEQ ID NO: 1785839 - RNA, 16 nt, Human
gcagggucucacucug

SEQ ID NO: 1785840 - RNA, 13 nt, Human
gcagggcugugcu

SEQ ID NO: 1785841 - RNA, 15 nt, Human
gcagggcugugcuug

SEQ ID NO: 1785842 - RNA, 23 nt, Human
gcagggcugugcuugaaggcccu

SEQ ID NO: 1785843 - RNA, 11 nt, Human
gcagugggagc

SEQ ID NO: 1785844 - RNA, 12 nt, Human
gcagugggagcu

SEQ ID NO: 1785845 - RNA, 18 nt, Human
gcaguggugcgaucuggg

SEQ ID NO: 1785846 - RNA, 19 nt, Human
gcaguggugcgaucugggu

SEQ ID NO: 1785847 - RNA, 22 nt, Human
gcaguggugcgaucuggguuca

SEQ ID NO: 1785848 - RNA, 20 nt, Human
gcaguggugcgaucuggguu

SEQ ID NO: 1785849 - RNA, 21 nt, Human
gcaguggugcgaucuggguuc

SEQ ID NO: 1785850 - RNA, 15 nt, Human
gcaugcccucucagg

SEQ ID NO: 1785851 - RNA, 14 nt, Human
gcauguucucugag

SEQ ID NO: 1785852 - RNA, 16 nt, Human
gcaugcccucucaggc

SEQ ID NO: 1785853 - RNA, 14 nt, Human
gcaugacagccugc

SEQ ID NO: 1785854 - RNA, 15 nt, Human
gcaugacagccugca

SEQ ID NO: 1785855 - RNA, 16 nt, Human
gcaugacagccugcag

SEQ ID NO: 1785856 - RNA, 18 nt, Human
gcaugacagccugcagca

SEQ ID NO: 1785857 - RNA, 23 nt, Human
gcauccacuucuuucagcagacu

SEQ ID NO: 1785858 - RNA, 22 nt, Human
gcauccacuucuuucagcagac

SEQ ID NO: 1785859 - RNA, 12 nt, Human
gcaucuggggcc

SEQ ID NO: 1785860 - RNA, 20 nt, Human
gcaucuggggcccauacugg

SEQ ID NO: 1785861 - RNA, 12 nt, Human
gcaucucccaga

SEQ ID NO: 1785862 - RNA, 13 nt, Human
gcaucucccagau

SEQ ID NO: 1785863 - RNA, 21 nt, Human
gcaucucccagauaaugugaa

SEQ ID NO: 1785864 - RNA, 15 nt, Human
gcccagagagggugg

SEQ ID NO: 1785865 - RNA, 19 nt, Human
gcccagagacccaagcugc

SEQ ID NO: 1785866 - RNA, 20 nt, Human
gcccagcacugcuugaggaa

SEQ ID NO: 1785867 - RNA, 19 nt, Human
gcccagauuccccuguguc

SEQ ID NO: 1785868 - RNA, 20 nt, Human
gcccagauuccccuguguca

SEQ ID NO: 1785869 - RNA, 21 nt, Human
gcccagauuccccugugucau

SEQ ID NO: 1785870 - RNA, 21 nt, Human
gcccagcacugcuugaggaaa

SEQ ID NO: 1785871 - RNA, 17 nt, Human
gcccagccccuacugcu

SEQ ID NO: 1785872 - RNA, 18 nt, Human
gcccagccccuacugcug

SEQ ID NO: 1785873 - RNA, 19 nt, Human
gcccagccccuacugcugu

SEQ ID NO: 1785874 - RNA, 20 nt, Human
gcccagccccuacugcugug

SEQ ID NO: 1785875 - RNA, 21 nt, Human
gcccagccccuacugcuguga

SEQ ID NO: 1785876 - RNA, 18 nt, Human
gcccagcuauaccugugc

SEQ ID NO: 1785877 - RNA, 19 nt, Human
gcccagcuauaccugugcc

SEQ ID NO: 1785878 - RNA, 22 nt, Human
gcccaggcuggcgugcaguggu

SEQ ID NO: 1785879 - RNA, 19 nt, Human
gcccaggcuggcgugcagu

SEQ ID NO: 1785880 - RNA, 20 nt, Human
gcccaggcuggcgugcagug

SEQ ID NO: 1785881 - RNA, 19 nt, Human
gcccagucuggaaugcagu

SEQ ID NO: 1785882 - RNA, 20 nt, Human
gcccagucuggaaugcagug

SEQ ID NO: 1785883 - RNA, 15 nt, Human
gcccaguugggugga

SEQ ID NO: 1785884 - RNA, 17 nt, Human
gccagguuuuuggucug

SEQ ID NO: 1785885 - RNA, 21 nt, Human
gccagggagaccuggacacag

SEQ ID NO: 1785886 - RNA, 22 nt, Human
gccagggagaccuggacacagg

SEQ ID NO: 1785887 - RNA, 15 nt, Human
gccagggcagaguga

SEQ ID NO: 1785888 - RNA, 16 nt, Human
gccagggcagagugag

SEQ ID NO: 1785889 - RNA, 21 nt, Human
gccagggcagagugagaccca

SEQ ID NO: 1785890 - RNA, 14 nt, Human
gccagggcagggcc

SEQ ID NO: 1785891 - RNA, 19 nt, Human
gccagggcagggccccagg

SEQ ID NO: 1785892 - RNA, 15 nt, Human
gccagggagaccugg

SEQ ID NO: 1785893 - RNA, 18 nt, Human
gccagggagaccuggaca

SEQ ID NO: 1785894 - RNA, 19 nt, Human
gccagggagaccuggacac

SEQ ID NO: 1785895 - RNA, 18 nt, Human
gccaucucaugaggggag

SEQ ID NO: 1785896 - RNA, 19 nt, Human
gccaucucaugaggggaga

SEQ ID NO: 1785897 - RNA, 20 nt, Human
gccaucucaugaggggagag

SEQ ID NO: 1785898 - RNA, 21 nt, Human
gccaucucaugaggggagagg

SEQ ID NO: 1785899 - RNA, 15 nt, Human
gccagugagccacuc

SEQ ID NO: 1785900 - RNA, 18 nt, Human
gccauuuuucaaagcaau

SEQ ID NO: 1785901 - RNA, 19 nt, Human
gccauuuuucaaagcaauu

SEQ ID NO: 1785902 - RNA, 13 nt, Human
gcccaaaauuuau

SEQ ID NO: 1785903 - RNA, 15 nt, Human
gcccaaaauuuauuu

SEQ ID NO: 1785904 - RNA, 21 nt, Human
gcccaaaauuuauuuuauaag

SEQ ID NO: 1785905 - RNA, 23 nt, Human
gcccaaaauuuauuuuauaagaa

SEQ ID NO: 1785906 - RNA, 17 nt, Human
gccauggaacuguuucc

SEQ ID NO: 1785907 - RNA, 22 nt, Human
gccauggaagaggcuacagggc

SEQ ID NO: 1785908 - RNA, 19 nt, Human
gccacggccaggccagagg

SEQ ID NO: 1785909 - RNA, 20 nt, Human
gccacuaagaaccccucugc

SEQ ID NO: 1785910 - RNA, 18 nt, Human
gccacggccaggccagag

SEQ ID NO: 1785911 - RNA, 17 nt, Human
gccacggccaggccaga

SEQ ID NO: 1785912 - RNA, 15 nt, Human
gccacagugggauga

SEQ ID NO: 1785913 - RNA, 20 nt, Human
gccacagugggaugaaccag

SEQ ID NO: 1785914 - RNA, 11 nt, Human
gccaccugccc

SEQ ID NO: 1785915 - RNA, 21 nt, Human
gccagagggagugacagaggc

SEQ ID NO: 1785916 - RNA, 22 nt, Human
gccagagggagugacagaggca

SEQ ID NO: 1785917 - RNA, 23 nt, Human
gccagagggagugacagaggcag

SEQ ID NO: 1785918 - RNA, 16 nt, Human
gccagaugcaccagcc

SEQ ID NO: 1785919 - RNA, 17 nt, Human
gccagaugcaccagccc

SEQ ID NO: 1785920 - RNA, 18 nt, Human
gccagaugcaccagcccu

SEQ ID NO: 1785921 - RNA, 23 nt, Human
gccacuccucugacucagggcuc

SEQ ID NO: 1785922 - RNA, 18 nt, Human
gccaaucugcaauuucua

SEQ ID NO: 1785923 - RNA, 16 nt, Human
gccaagggcuuuguuu

SEQ ID NO: 1785924 - RNA, 13 nt, Human
gccaauuccuaua

SEQ ID NO: 1785925 - RNA, 20 nt, Human
gccaauuauguuaaacuagc

SEQ ID NO: 1785926 - RNA, 19 nt, Human
gccaauuauguuaaacuag

SEQ ID NO: 1785927 - RNA, 17 nt, Human
gccaauuauguuaaacu

SEQ ID NO: 1785928 - RNA, 16 nt, Human
gccaauuauguuaaac

SEQ ID NO: 1785929 - RNA, 15 nt, Human
gccaauuauguuaaa

SEQ ID NO: 1785930 - RNA, 14 nt, Human
gccaauuauguuaa

SEQ ID NO: 1785931 - RNA, 20 nt, Human
gccacaaugcaguucugagc

SEQ ID NO: 1785932 - RNA, 21 nt, Human
gccacaaugcaguucugagca

SEQ ID NO: 1785933 - RNA, 23 nt, Human
gccacagagaaaguacuucucca

SEQ ID NO: 1785934 - RNA, 21 nt, Human
gccacagccuccccugccagg

SEQ ID NO: 1785935 - RNA, 16 nt, Human
gccacagccuccccug

SEQ ID NO: 1785936 - RNA, 11 nt, Human
gccacaggacc

SEQ ID NO: 1785937 - RNA, 12 nt, Human
gccacaggaccc

SEQ ID NO: 1785938 - RNA, 13 nt, Human
gccacagagaaag

SEQ ID NO: 1785939 - RNA, 14 nt, Human
gccacagagaaagu

SEQ ID NO: 1785940 - RNA, 20 nt, Human
gccacagagaaaguacuucu

SEQ ID NO: 1785941 - RNA, 11 nt, Human
ggacagcuccu

SEQ ID NO: 1785942 - RNA, 15 nt, Human
ggacagcuccuucug

SEQ ID NO: 1785943 - RNA, 16 nt, Human
ggacagcuccuucugu

SEQ ID NO: 1785944 - RNA, 17 nt, Human
ggacagcuccuucuguc

SEQ ID NO: 1785945 - RNA, 15 nt, Human
ggaccagccagcagc

SEQ ID NO: 1785946 - RNA, 23 nt, Human
ggaccagccagcagcagcccaag

SEQ ID NO: 1785947 - RNA, 18 nt, Human
ggaccuugaacuggguac

SEQ ID NO: 1785948 - RNA, 16 nt, Human
ggaccuuuugggggag

SEQ ID NO: 1785949 - RNA, 22 nt, Human
ggacgcagcaggaggccaggcc

SEQ ID NO: 1785950 - RNA, 19 nt, Human
ggaccagucaaccugggca

SEQ ID NO: 1785951 - RNA, 23 nt, Human
ggaccaugcgacacugggaggcc

SEQ ID NO: 1785952 - RNA, 23 nt, Human
ggacgcagcaggaggccaggccg

SEQ ID NO: 1785953 - RNA, 12 nt, Human
ggagacaggcag

SEQ ID NO: 1785954 - RNA, 12 nt, Human
ggagcuagccag

SEQ ID NO: 1785955 - RNA, 15 nt, Human
ggagcuagccagagg

SEQ ID NO: 1785956 - RNA, 20 nt, Human
ggagcuccaacucagaaggg

SEQ ID NO: 1785957 - RNA, 13 nt, Human
ggagcacugggcu

SEQ ID NO: 1785958 - RNA, 15 nt, Human
ggagcacugggcucc

SEQ ID NO: 1785959 - RNA, 18 nt, Human
ggagccgggucugccucu

SEQ ID NO: 1785960 - RNA, 17 nt, Human
ggagccgggucugccuc

SEQ ID NO: 1785961 - RNA, 14 nt, Human
ggagcacacccagc

SEQ ID NO: 1785962 - RNA, 15 nt, Human
ggagcacacccagcc

SEQ ID NO: 1785963 - RNA, 17 nt, Human
ggagcacacccagcccc

SEQ ID NO: 1785964 - RNA, 17 nt, Human
ggagacaggcagagcug

SEQ ID NO: 1785965 - RNA, 22 nt, Human
ggagucccaccuuggcugcagg

SEQ ID NO: 1785966 - RNA, 19 nt, Human
ggagggccacaugggaggc

SEQ ID NO: 1785967 - RNA, 23 nt, Human
ggagggccacaugggaggcucac

SEQ ID NO: 1785968 - RNA, 18 nt, Human
ggaggauguucugggaca

SEQ ID NO: 1785969 - RNA, 21 nt, Human
ggaggauguucugggacacag

SEQ ID NO: 1785970 - RNA, 20 nt, Human
ggcauguucucugaggacac

SEQ ID NO: 1785971 - RNA, 19 nt, Human
ggcaguauuuuguguccuc

SEQ ID NO: 1785972 - RNA, 19 nt, Human
ggcagucgauagagcugua

SEQ ID NO: 1785973 - RNA, 16 nt, Human
ggcaugauccaagcaa

SEQ ID NO: 1785974 - RNA, 18 nt, Human
ggcaugauccaagcaaga

SEQ ID NO: 1785975 - RNA, 15 nt, Human
ggcaugauccaagca

SEQ ID NO: 1785976 - RNA, 17 nt, Human
ggcagggucucacucug

SEQ ID NO: 1785977 - RNA, 18 nt, Human
ggcagggucucacucugu

SEQ ID NO: 1785978 - RNA, 23 nt, Human
ggcagcugcgguccacccaggag

SEQ ID NO: 1785979 - RNA, 24 nt, Human
ggcagcugcgguccacccaggagc

SEQ ID NO: 1785980 - RNA, 21 nt, Human
ggcagcugcgguccacccagg

SEQ ID NO: 1785981 - RNA, 21 nt, Human
ggauuagguuucagcagagcu

SEQ ID NO: 1785982 - RNA, 18 nt, Human
ggaugccugguggcagcu

SEQ ID NO: 1785983 - RNA, 19 nt, Human
ggaugccugguggcagcug

SEQ ID NO: 1785984 - RNA, 20 nt, Human
ggaugccugguggcagcugc

SEQ ID NO: 1785985 - RNA, 21 nt, Human
ggaugccugguggcagcugcg

SEQ ID NO: 1785986 - RNA, 16 nt, Human
ggauucucuaaccuuu

SEQ ID NO: 1785987 - RNA, 13 nt, Human
ggaugccuggugg

SEQ ID NO: 1785988 - RNA, 17 nt, Human
ggaugccugguggcagc

SEQ ID NO: 1785989 - RNA, 23 nt, Human
ggagucccaccuuggcugcaggg

SEQ ID NO: 1785990 - RNA, 22 nt, Human
ggaugagaguuuuggaugcagu

SEQ ID NO: 1785991 - RNA, 20 nt, Human
ggaugagaguuuuggaugca

SEQ ID NO: 1785992 - RNA, 20 nt, Human
ggcacccaccaucaugucug

SEQ ID NO: 1785993 - RNA, 18 nt, Human
ggcacccggccccugcug

SEQ ID NO: 1785994 - RNA, 19 nt, Human
ggcacccggccccugcugg

SEQ ID NO: 1785995 - RNA, 20 nt, Human
ggcacccggccccugcuggu

SEQ ID NO: 1785996 - RNA, 18 nt, Human
ggcacucagaagacacug

SEQ ID NO: 1785997 - RNA, 19 nt, Human
ggcacucagaagacacuga

SEQ ID NO: 1785998 - RNA, 20 nt, Human
ggcacucagaagacacugau

SEQ ID NO: 1785999 - RNA, 12 nt, Human
ggcagagcccaa

SEQ ID NO: 1786000 - RNA, 16 nt, Human
ggcagagcccaaggga

SEQ ID NO: 1786001 - RNA, 14 nt, Human
ggcagagcugcauc

SEQ ID NO: 1786002 - RNA, 18 nt, Human
ggcagagcugcuccccuc

SEQ ID NO: 1786003 - RNA, 15 nt, Human
ggcagaguccuggag

SEQ ID NO: 1786004 - RNA, 14 nt, Human
ggcaccagucccug

SEQ ID NO: 1786005 - RNA, 15 nt, Human
ggcaccagucccugu

SEQ ID NO: 1786006 - RNA, 17 nt, Human
ggcaccagucccugucc

SEQ ID NO: 1786007 - RNA, 18 nt, Human
ggcaccagucccuguccg

SEQ ID NO: 1786008 - RNA, 18 nt, Human
ggcacccaagaccucagg

SEQ ID NO: 1786009 - RNA, 22 nt, Human
ggcacccaagaccucagggcac

SEQ ID NO: 1786010 - RNA, 18 nt, Human
ggcaagcaccuccugccu

SEQ ID NO: 1786011 - RNA, 19 nt, Human
ggcaagcaccuccugccuc

SEQ ID NO: 1786012 - RNA, 16 nt, Human
ggcaagcauguaacuu

SEQ ID NO: 1786013 - RNA, 21 nt, Human
ggcaagcauguaacuuauauu

SEQ ID NO: 1786014 - RNA, 14 nt, Human
ggcaagcuccgcag

SEQ ID NO: 1786015 - RNA, 18 nt, Human
ggcaagcuccgcaggacu

SEQ ID NO: 1786016 - RNA, 17 nt, Human
ggcaagcaccuccugcc

SEQ ID NO: 1786017 - RNA, 13 nt, Human
ggauugagucugu

SEQ ID NO: 1786018 - RNA, 17 nt, Human
ggccggcgagcccugug

SEQ ID NO: 1786019 - RNA, 18 nt, Human
ggccggcgagcccugugg

SEQ ID NO: 1786020 - RNA, 19 nt, Human
ggccuaaauuuauuaaaua

SEQ ID NO: 1786021 - RNA, 15 nt, Human
ggccggcgagcccug

SEQ ID NO: 1786022 - RNA, 14 nt, Human
ggccucaagugauu

SEQ ID NO: 1786023 - RNA, 22 nt, Human
ggccucaagugauucuccugcc

SEQ ID NO: 1786024 - RNA, 23 nt, Human
ggccucaagugauucuccugccu

SEQ ID NO: 1786025 - RNA, 17 nt, Human
ggccucaacuccuccca

SEQ ID NO: 1786026 - RNA, 18 nt, Human
ggccucaacuccucccau

SEQ ID NO: 1786027 - RNA, 20 nt, Human
ggccucaacuccucccauag

SEQ ID NO: 1786028 - RNA, 14 nt, Human
ggccuccugugugu

SEQ ID NO: 1786029 - RNA, 15 nt, Human
ggccugagccuggcc

SEQ ID NO: 1786030 - RNA, 16 nt, Human
ggccugagccuggcca

SEQ ID NO: 1786031 - RNA, 15 nt, Human
ggccugagagucagc

SEQ ID NO: 1786032 - RNA, 18 nt, Human
ggccugagagucagcucu

SEQ ID NO: 1786033 - RNA, 21 nt, Human
ggccugagagucagcucucug

SEQ ID NO: 1786034 - RNA, 13 nt, Human
ggccugacugcuc

SEQ ID NO: 1786035 - RNA, 14 nt, Human
ggccugacugcuca

SEQ ID NO: 1786036 - RNA, 15 nt, Human
ggccugacugcucag

SEQ ID NO: 1786037 - RNA, 21 nt, Human
ggccugggccguaucuccggc

SEQ ID NO: 1786038 - RNA, 23 nt, Human
ggccugggccguaucuccggcuc

SEQ ID NO: 1786039 - RNA, 15 nt, Human
ggcuccaggcuccuu

SEQ ID NO: 1786040 - RNA, 16 nt, Human
ggcuccagagggcacu

SEQ ID NO: 1786041 - RNA, 14 nt, Human
ggcuccaggcuccu

SEQ ID NO: 1786042 - RNA, 23 nt, Human
ggcgcugccccaucuccccucag

SEQ ID NO: 1786043 - RNA, 18 nt, Human
ggcgggacagugcugcag

SEQ ID NO: 1786044 - RNA, 13 nt, Human
ggcuccagagggc

SEQ ID NO: 1786045 - RNA, 22 nt, Human
ggcuccagagggcacucugcuu

SEQ ID NO: 1786046 - RNA, 12 nt, Human
ggcuccaggcuc

SEQ ID NO: 1786047 - RNA, 13 nt, Human
ggcuccaggcucc

SEQ ID NO: 1786048 - RNA, 22 nt, Human
ggcucacccccuucuccaucca

SEQ ID NO: 1786049 - RNA, 17 nt, Human
ggcucacccccuucucc

SEQ ID NO: 1786050 - RNA, 14 nt, Human
ggcugggcagagcu

SEQ ID NO: 1786051 - RNA, 11 nt, Human
ggcugggcuuc

SEQ ID NO: 1786052 - RNA, 21 nt, Human
ggcugggcuucaguggcagcu

SEQ ID NO: 1786053 - RNA, 22 nt, Human
ggcugggcuucaguggcagcug

SEQ ID NO: 1786054 - RNA, 14 nt, Human
ggcugggggccuca

SEQ ID NO: 1786055 - RNA, 15 nt, Human
ggcugggggagagcc

SEQ ID NO: 1786056 - RNA, 16 nt, Human
ggcugggggagagccg

SEQ ID NO: 1786057 - RNA, 18 nt, Human
ggcugggggagagccgug

SEQ ID NO: 1786058 - RNA, 19 nt, Human
ggcugggggagagccgugg

SEQ ID NO: 1786059 - RNA, 15 nt, Human
ggcugagggagccug

SEQ ID NO: 1786060 - RNA, 13 nt, Human
ggcugucggcgcu

SEQ ID NO: 1786061 - RNA, 15 nt, Human
ggcugucggcgcugc

SEQ ID NO: 1786062 - RNA, 12 nt, Human
ggcugugcuggg

SEQ ID NO: 1786063 - RNA, 13 nt, Human
ggcugugcuggga

SEQ ID NO: 1786064 - RNA, 16 nt, Human
ggcugugcugggagaa

SEQ ID NO: 1786065 - RNA, 17 nt, Human
ggcugugcuugaaggcc

SEQ ID NO: 1786066 - RNA, 19 nt, Human
ggcugugcuugaaggcccu

SEQ ID NO: 1786067 - RNA, 20 nt, Human
ggcugugcuugaaggcccug

SEQ ID NO: 1786068 - RNA, 21 nt, Human
ggcugugcuugaaggcccugc

SEQ ID NO: 1786069 - RNA, 23 nt, Human
ggcugugcuugaaggcccugcug

SEQ ID NO: 1786070 - RNA, 14 nt, Human
ggcuguuggcuggg

SEQ ID NO: 1786071 - RNA, 15 nt, Human
ggcuguuggcugggg

SEQ ID NO: 1786072 - RNA, 16 nt, Human
ggcuguuggcuggggg

SEQ ID NO: 1786073 - RNA, 20 nt, Human
ggcuguuggcugggggccuc

SEQ ID NO: 1786074 - RNA, 15 nt, Human
ggcuuaaaacaacac

SEQ ID NO: 1786075 - RNA, 21 nt, Human
gggagcuccaacucagaaggg

SEQ ID NO: 1786076 - RNA, 15 nt, Human
gggagcuagccagag

SEQ ID NO: 1786077 - RNA, 18 nt, Human
gggagcuagccagaggac

SEQ ID NO: 1786078 - RNA, 13 nt, Human
gggagcugccugu

SEQ ID NO: 1786079 - RNA, 21 nt, Human
gggagcugccuguucagcucc

SEQ ID NO: 1786080 - RNA, 22 nt, Human
gggagcugccuguucagcucca

SEQ ID NO: 1786081 - RNA, 17 nt, Human
gggagugacagaggcag

SEQ ID NO: 1786082 - RNA, 22 nt, Human
gggaggauguucugggacacag

SEQ ID NO: 1786083 - RNA, 17 nt, Human
gggacucaaugcacuga

SEQ ID NO: 1786084 - RNA, 19 nt, Human
gggacucaaugcacugaca

SEQ ID NO: 1786085 - RNA, 21 nt, Human
gggacgccugggggugccagg

SEQ ID NO: 1786086 - RNA, 22 nt, Human
gggacgccugggggugccagga

SEQ ID NO: 1786087 - RNA, 13 nt, Human
gggaccuuuuggg

SEQ ID NO: 1786088 - RNA, 23 nt, Human
gggacucaaugcacugacauugu

SEQ ID NO: 1786089 - RNA, 19 nt, Human
gggaauguuugccucugcc

SEQ ID NO: 1786090 - RNA, 21 nt, Human
gggaauguuugccucugccuc

SEQ ID NO: 1786091 - RNA, 18 nt, Human
gggaauauuugaaucuug

SEQ ID NO: 1786092 - RNA, 14 nt, Human
gggaauauuugaau

SEQ ID NO: 1786093 - RNA, 13 nt, Human
gggaauauuugaa

SEQ ID NO: 1786094 - RNA, 21 nt, Human
gcugggcuucaguggcagcug

SEQ ID NO: 1786095 - RNA, 22 nt, Human
gcugggcuucaguggcagcugc

SEQ ID NO: 1786096 - RNA, 20 nt, Human
gcugggcuucaguggcagcu

SEQ ID NO: 1786097 - RNA, 14 nt, Human
gcugggggccucag

SEQ ID NO: 1786098 - RNA, 15 nt, Human
gcugggggccucagu

SEQ ID NO: 1786099 - RNA, 18 nt, Human
gcugggggccucagugcc

SEQ ID NO: 1786100 - RNA, 14 nt, Human
gcuggucccacuca

SEQ ID NO: 1786101 - RNA, 21 nt, Human
gcugucccauagucccugcca

SEQ ID NO: 1786102 - RNA, 23 nt, Human
gcugucccauagucccugccacg

SEQ ID NO: 1786103 - RNA, 18 nt, Human
gcugucccauagucccug

SEQ ID NO: 1786104 - RNA, 20 nt, Human
gcugucccauagucccugcc

SEQ ID NO: 1786105 - RNA, 14 nt, Human
gcuggugucaccug

SEQ ID NO: 1786106 - RNA, 15 nt, Human
gcuggugucaccuga

SEQ ID NO: 1786107 - RNA, 14 nt, Human
gcuuggagcagagg

SEQ ID NO: 1786108 - RNA, 16 nt, Human
gcuuggaccagaucua

SEQ ID NO: 1786109 - RNA, 19 nt, Human
gcuugcucuguuugugggg

SEQ ID NO: 1786110 - RNA, 12 nt, Human
gcuuucauguaa

SEQ ID NO: 1786111 - RNA, 19 nt, Human
gcuuuccaaaccuuaucuc

SEQ ID NO: 1786112 - RNA, 22 nt, Human
gcuuuccaaaccuuaucuccac

SEQ ID NO: 1786113 - RNA, 15 nt, Human
gcuuucauguaaacu

SEQ ID NO: 1786114 - RNA, 20 nt, Human
gcuuucauguaaacugugca

SEQ ID NO: 1786115 - RNA, 21 nt, Human
gcuuucauguaaacugugcac

SEQ ID NO: 1786116 - RNA, 19 nt, Human
gcuucaguggcagcugcuu

SEQ ID NO: 1786117 - RNA, 20 nt, Human
gcuucaguggcagcugcuuu

SEQ ID NO: 1786118 - RNA, 17 nt, Human
gcuucauggcagaaggc

SEQ ID NO: 1786119 - RNA, 17 nt, Human
gcuucauguggcuuccc

SEQ ID NO: 1786120 - RNA, 17 nt, Human
gcugacgaacuuccaug

SEQ ID NO: 1786121 - RNA, 19 nt, Human
gcugacgaacuuccauggc

SEQ ID NO: 1786122 - RNA, 15 nt, Human
gcugacgaacuucca

SEQ ID NO: 1786123 - RNA, 20 nt, Human
gcugacagacacaggcccgg

SEQ ID NO: 1786124 - RNA, 18 nt, Human
gcugacagacacaggccc

SEQ ID NO: 1786125 - RNA, 19 nt, Human
gcugacagacacaggcccg

SEQ ID NO: 1786126 - RNA, 13 nt, Human
gcugccaaaugcg

SEQ ID NO: 1786127 - RNA, 22 nt, Human
gcugcaaaggguaucaggugcu

SEQ ID NO: 1786128 - RNA, 23 nt, Human
gcugcaaaggguaucaggugcug

SEQ ID NO: 1786129 - RNA, 12 nt, Human
gcugccuuagcu

SEQ ID NO: 1786130 - RNA, 14 nt, Human
gcugccuuagcuuc

SEQ ID NO: 1786131 - RNA, 20 nt, Human
gcugccuuagcuucaggaac

SEQ ID NO: 1786132 - RNA, 20 nt, Human
gcugccuguucagcuccagc

SEQ ID NO: 1786133 - RNA, 22 nt, Human
gcugccuguucagcuccagcuc

SEQ ID NO: 1786134 - RNA, 18 nt, Human
gcugccuguucagcucca

SEQ ID NO: 1786135 - RNA, 19 nt, Human
gcugccuguucagcuccag

SEQ ID NO: 1786136 - RNA, 14 nt, Human
gcugcgguccaccc

SEQ ID NO: 1786137 - RNA, 15 nt, Human
gcugcgguccaccca

SEQ ID NO: 1786138 - RNA, 22 nt, Human
gcugcgguccacccaggagccc

SEQ ID NO: 1786139 - RNA, 17 nt, Human
gcugcggcguacaggcu

SEQ ID NO: 1786140 - RNA, 18 nt, Human
gcugcggcguacaggcug

SEQ ID NO: 1786141 - RNA, 16 nt, Human
gcugcgguccacccag

SEQ ID NO: 1786142 - RNA, 21 nt, Human
gcugcgguccacccaggagcc

SEQ ID NO: 1786143 - RNA, 22 nt, Human
gcugcuuuugucuaugggacuc

SEQ ID NO: 1786144 - RNA, 12 nt, Human
gcuggaagccca

SEQ ID NO: 1786145 - RNA, 13 nt, Human
gcuggaagcccag

SEQ ID NO: 1786146 - RNA, 14 nt, Human
gcuggaagcccagc

SEQ ID NO: 1786147 - RNA, 22 nt, Human
gcuggaagcccagccccuacug

SEQ ID NO: 1786148 - RNA, 23 nt, Human
gcuggccaucugguuaggauggc

SEQ ID NO: 1786149 - RNA, 16 nt, Human
gcuggaccuugaacug

SEQ ID NO: 1786150 - RNA, 15 nt, Human
gcuggaccuugaacu

SEQ ID NO: 1786151 - RNA, 19 nt, Human
gcuggccaaauagcaaaga

SEQ ID NO: 1786152 - RNA, 21 nt, Human
gcuggcaugauccaagcaaga

SEQ ID NO: 1786153 - RNA, 16 nt, Human
gcgccugcugcaugcc

SEQ ID NO: 1786154 - RNA, 13 nt, Human
gcgccccuagccg

SEQ ID NO: 1786155 - RNA, 22 nt, Human
gcgccccuagccgguuccuguc

SEQ ID NO: 1786156 - RNA, 12 nt, Human
gcgccccuagcc

SEQ ID NO: 1786157 - RNA, 23 nt, Human
gcgcccaguuggguggaugccug

SEQ ID NO: 1786158 - RNA, 14 nt, Human
gcgcagugccuugc

SEQ ID NO: 1786159 - RNA, 13 nt, Human
gcgccacaggacc

SEQ ID NO: 1786160 - RNA, 14 nt, Human
gcgccacaggaccc

SEQ ID NO: 1786161 - RNA, 19 nt, Human
gcggagacggagucccacc

SEQ ID NO: 1786162 - RNA, 14 nt, Human
gcggggacagcucc

SEQ ID NO: 1786163 - RNA, 18 nt, Human
gcggggacagcuccuucu

SEQ ID NO: 1786164 - RNA, 19 nt, Human
gcgcauucuaaccuggagg

SEQ ID NO: 1786165 - RNA, 15 nt, Human
gcggggacagcuccu

SEQ ID NO: 1786166 - RNA, 17 nt, Human
gcggggacagcuccuuc

SEQ ID NO: 1786167 - RNA, 19 nt, Human
gcggugagaggggaacaga

SEQ ID NO: 1786168 - RNA, 15 nt, Human
gcggugccaugucug

SEQ ID NO: 1786169 - RNA, 21 nt, Human
gcggugccaugucugcagugu

SEQ ID NO: 1786170 - RNA, 13 nt, Human
gcgguccacccag

SEQ ID NO: 1786171 - RNA, 14 nt, Human
gcgguccacccagg

SEQ ID NO: 1786172 - RNA, 20 nt, Human
gccuuaaaccuaccucccac

SEQ ID NO: 1786173 - RNA, 19 nt, Human
gccuuaauaaaaaaugaaa

SEQ ID NO: 1786174 - RNA, 13 nt, Human
gccuuccuccugg

SEQ ID NO: 1786175 - RNA, 14 nt, Human
gccuuccuccuggg

SEQ ID NO: 1786176 - RNA, 16 nt, Human
gccuuccuccugggcc

SEQ ID NO: 1786177 - RNA, 17 nt, Human
gccuuccuccugggccc

SEQ ID NO: 1786178 - RNA, 22 nt, Human
gccuuccuccugggcccucucu

SEQ ID NO: 1786179 - RNA, 15 nt, Human
gccuuguugaugugg

SEQ ID NO: 1786180 - RNA, 17 nt, Human
gccuugucccagaggcu

SEQ ID NO: 1786181 - RNA, 14 nt, Human
gccuuuccucaaaa

SEQ ID NO: 1786182 - RNA, 20 nt, Human
gccuuuccucaaaacuggag

SEQ ID NO: 1786183 - RNA, 21 nt, Human
gccuuuccucaaaacuggagu

SEQ ID NO: 1786184 - RNA, 13 nt, Human
gccuuuccucucu

SEQ ID NO: 1786185 - RNA, 13 nt, Human
gccuuuaaaauuu

SEQ ID NO: 1786186 - RNA, 14 nt, Human
gccuuuccucucua

SEQ ID NO: 1786187 - RNA, 15 nt, Human
gccuuucgaggccug

SEQ ID NO: 1786188 - RNA, 16 nt, Human
gccuuucgaggccuga

SEQ ID NO: 1786189 - RNA, 19 nt, Human
gccuuucgaggccugaagc

SEQ ID NO: 1786190 - RNA, 23 nt, Human
gccuuuccuuuucgccuuuccuc

SEQ ID NO: 1786191 - RNA, 16 nt, Human
gccuggccccaugguc

SEQ ID NO: 1786192 - RNA, 20 nt, Human
gccuggccagaugcaccagc

SEQ ID NO: 1786193 - RNA, 21 nt, Human
gccuggccagaugcaccagcc

SEQ ID NO: 1786194 - RNA, 22 nt, Human
gccuggccagaugcaccagccc

SEQ ID NO: 1786195 - RNA, 13 nt, Human
gccugucugcccc

SEQ ID NO: 1786196 - RNA, 15 nt, Human
gccugucugccccag

SEQ ID NO: 1786197 - RNA, 21 nt, Human
gccugucugccccagcccaga

SEQ ID NO: 1786198 - RNA, 22 nt, Human
gccuggguuuuguucccuauuu

SEQ ID NO: 1786199 - RNA, 22 nt, Human
gccugggccguaucuccggcuc

SEQ ID NO: 1786200 - RNA, 14 nt, Human
gccugcugcaugcc

SEQ ID NO: 1786201 - RNA, 18 nt, Human
gccugcugcaugcccucu

SEQ ID NO: 1786202 - RNA, 21 nt, Human
gccugcugcaugcccucucag

SEQ ID NO: 1786203 - RNA, 22 nt, Human
gccugcugcaugcccucucagg

SEQ ID NO: 1786204 - RNA, 16 nt, Human
gccugcauguaaacac

SEQ ID NO: 1786205 - RNA, 17 nt, Human
gccugagccuggccagc

SEQ ID NO: 1786206 - RNA, 16 nt, Human
gccugagccuggccag

SEQ ID NO: 1786207 - RNA, 10 nt, Human
gccugaggga

SEQ ID NO: 1786208 - RNA, 22 nt, Human
gccugcaggaccugccuguagc

SEQ ID NO: 1786209 - RNA, 19 nt, Human
gcccaguuggguggaugcc

SEQ ID NO: 1786210 - RNA, 21 nt, Human
gcccaguuggguggaugccug

SEQ ID NO: 1786211 - RNA, 22 nt, Human
gcccaguuggguggaugccugg

SEQ ID NO: 1786212 - RNA, 16 nt, Human
gccugaagucacacag

SEQ ID NO: 1786213 - RNA, 17 nt, Human
gccugaagucacacagu

SEQ ID NO: 1786214 - RNA, 18 nt, Human
gccugaagucacacagug

SEQ ID NO: 1786215 - RNA, 24 nt, Human
gcuccgcuuucuacccagcgagcc

SEQ ID NO: 1786216 - RNA, 14 nt, Human
gcuccuuccuggag

SEQ ID NO: 1786217 - RNA, 23 nt, Human
gcuccuuccuggagacugcccag

SEQ ID NO: 1786218 - RNA, 12 nt, Human
gcuccugugucu

SEQ ID NO: 1786219 - RNA, 13 nt, Human
gcuccugugucuu

SEQ ID NO: 1786220 - RNA, 15 nt, Human
gcuccuucuguccua

SEQ ID NO: 1786221 - RNA, 14 nt, Human
gcuccuugggcccu

SEQ ID NO: 1786222 - RNA, 17 nt, Human
gcuccuugggcccuuug

SEQ ID NO: 1786223 - RNA, 19 nt, Human
gcuccuugggcccuuugag

SEQ ID NO: 1786224 - RNA, 13 nt, Human
gcuccuucugucc

SEQ ID NO: 1786225 - RNA, 17 nt, Human
gcuccuuuagcgcccag

SEQ ID NO: 1786226 - RNA, 13 nt, Human
gcuccuuugugug

SEQ ID NO: 1786227 - RNA, 12 nt, Human
gcuccaggcucc

SEQ ID NO: 1786228 - RNA, 19 nt, Human
gcuccagggaugauucaag

SEQ ID NO: 1786229 - RNA, 23 nt, Human
gcuccagggaugauucaagccau

SEQ ID NO: 1786230 - RNA, 13 nt, Human
gcuccgcaggacu

SEQ ID NO: 1786231 - RNA, 14 nt, Human
gcuccgcaggacuu

SEQ ID NO: 1786232 - RNA, 17 nt, Human
gcuccgcaggacuuccc

SEQ ID NO: 1786233 - RNA, 16 nt, Human
gcuccgcaggacuucc

SEQ ID NO: 1786234 - RNA, 18 nt, Human
gcuccgcuuucuacccag

SEQ ID NO: 1786235 - RNA, 21 nt, Human
gcuccgcuuucuacccagcga

SEQ ID NO: 1786236 - RNA, 22 nt, Human
gcuccgcuuucuacccagcgag

SEQ ID NO: 1786237 - RNA, 23 nt, Human
gcuccgcuuucuacccagcgagc

SEQ ID NO: 1786238 - RNA, 18 nt, Human
gcucaaguccucuuuucu

SEQ ID NO: 1786239 - RNA, 17 nt, Human
gcucaaggaaaggccug

SEQ ID NO: 1786240 - RNA, 19 nt, Human
gcucaaguccucuuuucug

SEQ ID NO: 1786241 - RNA, 22 nt, Human
gcucaaguccucuuuucugaga

SEQ ID NO: 1786242 - RNA, 19 nt, Human
gcucaaggaaaggccugaa

SEQ ID NO: 1786243 - RNA, 20 nt, Human
gcucaaggaaaggccugaaa

SEQ ID NO: 1786244 - RNA, 16 nt, Human
gcucaaucaagaaaau

SEQ ID NO: 1786245 - RNA, 15 nt, Human
gcuauaacuaagcau

SEQ ID NO: 1786246 - RNA, 17 nt, Human
gcuauaccugugccucg

SEQ ID NO: 1786247 - RNA, 15 nt, Human
gcuauaccugugccu

SEQ ID NO: 1786248 - RNA, 16 nt, Human
gcuauaccugugccuc

SEQ ID NO: 1786249 - RNA, 20 nt, Human
gcuauccugccaaaaucauu

SEQ ID NO: 1786250 - RNA, 21 nt, Human
gcuaguugggcuuccucauag

SEQ ID NO: 1786251 - RNA, 16 nt, Human
gcucacauaucuguca

SEQ ID NO: 1786252 - RNA, 12 nt, Human
gcucaccagccc

SEQ ID NO: 1786253 - RNA, 13 nt, Human
gcucaccagcccc

SEQ ID NO: 1786254 - RNA, 14 nt, Human
gcucaccagcccca

SEQ ID NO: 1786255 - RNA, 15 nt, Human
gcucaccagccccag

SEQ ID NO: 1786256 - RNA, 18 nt, Human
gcucaccagccccagugc

SEQ ID NO: 1786257 - RNA, 17 nt, Human
gcucagcggggacagcu

SEQ ID NO: 1786258 - RNA, 18 nt, Human
gcucagcggggacagcuc

SEQ ID NO: 1786259 - RNA, 19 nt, Human
gcucagcggggacagcucc

SEQ ID NO: 1786260 - RNA, 23 nt, Human
gcucagcggggacagcuccuucu

SEQ ID NO: 1786261 - RNA, 16 nt, Human
gcucaucauucucugu

SEQ ID NO: 1786262 - RNA, 18 nt, Human
gcucaucauucucugucu

SEQ ID NO: 1786263 - RNA, 19 nt, Human
gcucaucauucucugucuc

SEQ ID NO: 1786264 - RNA, 20 nt, Human
gcucaucauucucugucuca

SEQ ID NO: 1786265 - RNA, 20 nt, Human
ucacucuuauugcccacgcu

SEQ ID NO: 1786266 - RNA, 17 nt, Human
ucacucuuauugcccac

SEQ ID NO: 1786267 - RNA, 13 nt, Human
ucaccagccccag

SEQ ID NO: 1786268 - RNA, 16 nt, Human
ucaccagccccagugc

SEQ ID NO: 1786269 - RNA, 14 nt, Human
ucagaaacaggacc

SEQ ID NO: 1786270 - RNA, 22 nt, Human
ucagaauuuguguugaaggaac

SEQ ID NO: 1786271 - RNA, 13 nt, Human
ucagacaaaaugg

SEQ ID NO: 1786272 - RNA, 14 nt, Human
ucagacaaaaugga

SEQ ID NO: 1786273 - RNA, 21 nt, Human
ucagacaaaauggauacauaa

SEQ ID NO: 1786274 - RNA, 22 nt, Human
ucagacaaaauggauacauaaa

SEQ ID NO: 1786275 - RNA, 16 nt, Human
ucagacgccugaggaa

SEQ ID NO: 1786276 - RNA, 17 nt, Human
ucagacgccugaggaac

SEQ ID NO: 1786277 - RNA, 15 nt, Human
ucagacuuuggaaaa

SEQ ID NO: 1786278 - RNA, 20 nt, Human
ucagacuuuggaaaaugcau

SEQ ID NO: 1786279 - RNA, 16 nt, Human
ucagacuuuggaaaau

SEQ ID NO: 1786280 - RNA, 19 nt, Human
ucagacuuuggaaaaugca

SEQ ID NO: 1786281 - RNA, 21 nt, Human
ucagacuuuggaaaaugcauu

SEQ ID NO: 1786282 - RNA, 20 nt, Human
ucagccucccgaguagcugg

SEQ ID NO: 1786283 - RNA, 18 nt, Human
ucagccucccgaguagcu

SEQ ID NO: 1786284 - RNA, 21 nt, Human
ucagccucccgaauagcuggg

SEQ ID NO: 1786285 - RNA, 22 nt, Human
ucagccucccgaauagcuggga

SEQ ID NO: 1786286 - RNA, 14 nt, Human
ucagccucccaaag

SEQ ID NO: 1786287 - RNA, 19 nt, Human
ucagccucccaaagugcug

SEQ ID NO: 1786288 - RNA, 21 nt, Human
ucagccucccaaagugcuggg

SEQ ID NO: 1786289 - RNA, 21 nt, Human
ucagccucccgaguagcuggg

SEQ ID NO: 1786290 - RNA, 22 nt, Human
ucagccucccgaguagcuggga

SEQ ID NO: 1786291 - RNA, 20 nt, Human
ucagggauuuuuuuuuuaaa

SEQ ID NO: 1786292 - RNA, 12 nt, Human
ucaggcaccagu

SEQ ID NO: 1786293 - RNA, 18 nt, Human
ucaggcaccagucccugu

SEQ ID NO: 1786294 - RNA, 19 nt, Human
ucaggcaccagucccuguc

SEQ ID NO: 1786295 - RNA, 13 nt, Human
ucauuuccugugu

SEQ ID NO: 1786296 - RNA, 16 nt, Human
ucauuuccugugucuu

SEQ ID NO: 1786297 - RNA, 13 nt, Human
ucauuucuauuuc

SEQ ID NO: 1786298 - RNA, 18 nt, Human
ucauuccagaucccaggc

SEQ ID NO: 1786299 - RNA, 13 nt, Human
ucaggugcugcca

SEQ ID NO: 1786300 - RNA, 14 nt, Human
ucaggugcugccau

SEQ ID NO: 1786301 - RNA, 15 nt, Human
ucaggugcugccauc

SEQ ID NO: 1786302 - RNA, 14 nt, Human
ucagggcuccuggg

SEQ ID NO: 1786303 - RNA, 16 nt, Human
ucaucuucuucaccau

SEQ ID NO: 1786304 - RNA, 12 nt, Human
ucaucuuccugu

SEQ ID NO: 1786305 - RNA, 13 nt, Human
ucaucuuccugug

SEQ ID NO: 1786306 - RNA, 14 nt, Human
ucaucuuccugugu

SEQ ID NO: 1786307 - RNA, 15 nt, Human
ucaucuuccuguguc

SEQ ID NO: 1786308 - RNA, 16 nt, Human
ucaucuuccugugucc

SEQ ID NO: 1786309 - RNA, 19 nt, Human
ucaucuuccuguguccuga

SEQ ID NO: 1786310 - RNA, 15 nt, Human
ucaucagagccuuuc

SEQ ID NO: 1786311 - RNA, 13 nt, Human
uccaggugcccag

SEQ ID NO: 1786312 - RNA, 15 nt, Human
uccagguucagcuug

SEQ ID NO: 1786313 - RNA, 16 nt, Human
uccagguucagcuugu

SEQ ID NO: 1786314 - RNA, 18 nt, Human
uccagcucaccagcccca

SEQ ID NO: 1786315 - RNA, 15 nt, Human
uccagccaucucaug

SEQ ID NO: 1786316 - RNA, 16 nt, Human
uccagcucaccagccc

SEQ ID NO: 1786317 - RNA, 17 nt, Human
uccagcucaccagcccc

SEQ ID NO: 1786318 - RNA, 14 nt, Human
uccagcuucccgag

SEQ ID NO: 1786319 - RNA, 20 nt, Human
uccagccacuggcugcuaac

SEQ ID NO: 1786320 - RNA, 12 nt, Human
uccacccugcuc

SEQ ID NO: 1786321 - RNA, 17 nt, Human
ucauuucuauuucuccu

SEQ ID NO: 1786322 - RNA, 21 nt, Human
ucauuucuauuucuccuccau

SEQ ID NO: 1786323 - RNA, 11 nt, Human
uccaauucuau

SEQ ID NO: 1786324 - RNA, 17 nt, Human
uauuaauaguaauuugu

SEQ ID NO: 1786325 - RNA, 18 nt, Human
uauuaauaguaauuugua

SEQ ID NO: 1786326 - RNA, 20 nt, Human
uauuaauaguaauuuguaaa

SEQ ID NO: 1786327 - RNA, 13 nt, Human
uauguugcccagg

SEQ ID NO: 1786328 - RNA, 16 nt, Human
uauguugcccaggcag

SEQ ID NO: 1786329 - RNA, 19 nt, Human
uauguugcccaggcagguc

SEQ ID NO: 1786330 - RNA, 20 nt, Human
uauguugcccaggcaggucu

SEQ ID NO: 1786331 - RNA, 22 nt, Human
uauguauuuaccaaaaauuuug

SEQ ID NO: 1786332 - RNA, 16 nt, Human
uauguaacaauuguuu

SEQ ID NO: 1786333 - RNA, 21 nt, Human
uauguaaaaggccaaaccucu

SEQ ID NO: 1786334 - RNA, 22 nt, Human
uauguaaaaggccaaaccucug

SEQ ID NO: 1786335 - RNA, 23 nt, Human
uauguaaaaggccaaaccucugu

SEQ ID NO: 1786336 - RNA, 20 nt, Human
uauguacuccucuuuacacu

SEQ ID NO: 1786337 - RNA, 11 nt, Human
uauguaacaug

SEQ ID NO: 1786338 - RNA, 12 nt, Human
uauguaacaugu

SEQ ID NO: 1786339 - RNA, 21 nt, Human
uauguacuccucuuuacacug

SEQ ID NO: 1786340 - RNA, 15 nt, Human
uauguagcaaaauac

SEQ ID NO: 1786341 - RNA, 19 nt, Human
uauguagccuucacacaga

SEQ ID NO: 1786342 - RNA, 23 nt, Human
uauguagccuucacacagauaga

SEQ ID NO: 1786343 - RNA, 21 nt, Human
uauucccuagaaacuuccaaa

SEQ ID NO: 1786344 - RNA, 17 nt, Human
uauuccaagcuuccaua

SEQ ID NO: 1786345 - RNA, 11 nt, Human
uauugccuucu

SEQ ID NO: 1786346 - RNA, 16 nt, Human
uauugccuucucacca

SEQ ID NO: 1786347 - RNA, 17 nt, Human
uauugccuucucaccag

SEQ ID NO: 1786348 - RNA, 19 nt, Human
uauugccuucucaccagcu

SEQ ID NO: 1786349 - RNA, 20 nt, Human
uauugccuucucaccagcug

SEQ ID NO: 1786350 - RNA, 21 nt, Human
uauugccuucucaccagcugc

SEQ ID NO: 1786351 - RNA, 22 nt, Human
uauugccuucucaccagcugca

SEQ ID NO: 1786352 - RNA, 16 nt, Human
uauuguguuugucauu

SEQ ID NO: 1786353 - RNA, 14 nt, Human
uauuguguuuguca

SEQ ID NO: 1786354 - RNA, 18 nt, Human
uauuguguuugucauuag

SEQ ID NO: 1786355 - RNA, 17 nt, Human
uauuguguuugucauua

SEQ ID NO: 1786356 - RNA, 21 nt, Human
uauuguguuugucauuagccu

SEQ ID NO: 1786357 - RNA, 18 nt, Human
ucacauuuauucugcuca

SEQ ID NO: 1786358 - RNA, 19 nt, Human
ucacauuuauucugcucac

SEQ ID NO: 1786359 - RNA, 17 nt, Human
ucacauuuauucugcuc

SEQ ID NO: 1786360 - RNA, 16 nt, Human
ucaccacaugugcaca

SEQ ID NO: 1786361 - RNA, 15 nt, Human
ucaccaaaagacacu

SEQ ID NO: 1786362 - RNA, 16 nt, Human
ucaccaaaagacacug

SEQ ID NO: 1786363 - RNA, 18 nt, Human
ucaccaaaagacacugca

SEQ ID NO: 1786364 - RNA, 16 nt, Human
ucacaggcagguccag

SEQ ID NO: 1786365 - RNA, 17 nt, Human
ucacaggcagguccagg

SEQ ID NO: 1786366 - RNA, 18 nt, Human
ucacaggcagguccaggg

SEQ ID NO: 1786367 - RNA, 19 nt, Human
ucacaggcagguccagggu

SEQ ID NO: 1786368 - RNA, 22 nt, Human
ucaauaaaguauuuaauuagug

SEQ ID NO: 1786369 - RNA, 20 nt, Human
ucaauaaaguauuuaauuag

SEQ ID NO: 1786370 - RNA, 18 nt, Human
ucaauaaaguauuuaauu

SEQ ID NO: 1786371 - RNA, 17 nt, Human
ucaauaaaguauuuaau

SEQ ID NO: 1786372 - RNA, 16 nt, Human
ucaauaaaguauuuaa

SEQ ID NO: 1786373 - RNA, 15 nt, Human
ucaauaaaguauuua

SEQ ID NO: 1786374 - RNA, 14 nt, Human
ucaauaaaguauuu

SEQ ID NO: 1786375 - RNA, 11 nt, Human
ucaauaaagua

SEQ ID NO: 1786376 - RNA, 18 nt, Human
ucaaccugggcaaagccu

SEQ ID NO: 1786377 - RNA, 16 nt, Human
ucaacccuucuggaaa

SEQ ID NO: 1786378 - RNA, 20 nt, Human
ucaagugauucuccugccuc

SEQ ID NO: 1786379 - RNA, 18 nt, Human
ucaagugauucuccugcc

SEQ ID NO: 1786380 - RNA, 21 nt, Human
ucaagugauucuccugccuca

SEQ ID NO: 1786381 - RNA, 18 nt, Human
ucaauaaagcacugagca

SEQ ID NO: 1786382 - RNA, 11 nt, Human
uauuuuccagg

SEQ ID NO: 1786383 - RNA, 22 nt, Human
uauuuuccaaaaguggccucuu

SEQ ID NO: 1786384 - RNA, 23 nt, Human
ucaaccccuucgcuccugugucu

SEQ ID NO: 1786385 - RNA, 21 nt, Human
ucaaauuccuauuuuuaaaua

SEQ ID NO: 1786386 - RNA, 18 nt, Human
ucugccauauucuguugg

SEQ ID NO: 1786387 - RNA, 14 nt, Human
ucugccugcccagg

SEQ ID NO: 1786388 - RNA, 13 nt, Human
ucugccugcccag

SEQ ID NO: 1786389 - RNA, 16 nt, Human
ucucuggggcuguguu

SEQ ID NO: 1786390 - RNA, 15 nt, Human
ucugccugcccaggc

SEQ ID NO: 1786391 - RNA, 16 nt, Human
ucugccugcccaggcc

SEQ ID NO: 1786392 - RNA, 18 nt, Human
ucugcuccucuccccagc

SEQ ID NO: 1786393 - RNA, 21 nt, Human
ucugcuccucuccccagcaag

SEQ ID NO: 1786394 - RNA, 18 nt, Human
ucugcugacagacacagg

SEQ ID NO: 1786395 - RNA, 17 nt, Human
ucugcugacagacacag

SEQ ID NO: 1786396 - RNA, 21 nt, Human
ucuggacaggcauguucucug

SEQ ID NO: 1786397 - RNA, 16 nt, Human
ucuggaaugcaguggu

SEQ ID NO: 1786398 - RNA, 14 nt, Human
ucuggacaggcaug

SEQ ID NO: 1786399 - RNA, 15 nt, Human
ucuggaaugcagugg

SEQ ID NO: 1786400 - RNA, 19 nt, Human
ucugcugacagacacaggc

SEQ ID NO: 1786401 - RNA, 20 nt, Human
ucugcugacagacacaggcc

SEQ ID NO: 1786402 - RNA, 21 nt, Human
ucugcugacagacacaggccc

SEQ ID NO: 1786403 - RNA, 22 nt, Human
ucugcugacagacacaggcccg

SEQ ID NO: 1786404 - RNA, 14 nt, Human
ucuguccuacucug

SEQ ID NO: 1786405 - RNA, 17 nt, Human
ucugguuaggauggcag

SEQ ID NO: 1786406 - RNA, 13 nt, Human
ucugggagaaaau

SEQ ID NO: 1786407 - RNA, 20 nt, Human
ucugggagaaaaucaucaag

SEQ ID NO: 1786408 - RNA, 22 nt, Human
ucugggagaaaaucaucaagaa

SEQ ID NO: 1786409 - RNA, 23 nt, Human
ucugggagaaaaucaucaagaag

SEQ ID NO: 1786410 - RNA, 16 nt, Human
ucugucgcccagucug

SEQ ID NO: 1786411 - RNA, 14 nt, Human
ucugucgcccaguc

SEQ ID NO: 1786412 - RNA, 21 nt, Human
ucuguccugggagugagcugg

SEQ ID NO: 1786413 - RNA, 20 nt, Human
ucuguccuacucugugucag

SEQ ID NO: 1786414 - RNA, 15 nt, Human
ucuguccuacucugu

SEQ ID NO: 1786415 - RNA, 19 nt, Human
ucuguccuacucuguguca

SEQ ID NO: 1786416 - RNA, 14 nt, Human
ucugggacacaguu

SEQ ID NO: 1786417 - RNA, 15 nt, Human
ucugucuucaccuga

SEQ ID NO: 1786418 - RNA, 12 nt, Human
ucuucuccacca

SEQ ID NO: 1786419 - RNA, 13 nt, Human
ucuuccugugucc

SEQ ID NO: 1786420 - RNA, 14 nt, Human
ucuuccuguguccu

SEQ ID NO: 1786421 - RNA, 15 nt, Human
ucuuccuguguccug

SEQ ID NO: 1786422 - RNA, 16 nt, Human
ucuuccuguguccuga

SEQ ID NO: 1786423 - RNA, 12 nt, Human
ucuugaacuccu

SEQ ID NO: 1786424 - RNA, 18 nt, Human
ucuucaucuaauaugaua

SEQ ID NO: 1786425 - RNA, 22 nt, Human
ucuucagccucuuucugucccu

SEQ ID NO: 1786426 - RNA, 9 nt, Human
ucugaaaca

SEQ ID NO: 1786427 - RNA, 23 nt, Human
ucugaaacccuggaccagugguc

SEQ ID NO: 1786428 - RNA, 15 nt, Human
ucugaaaccaguguu

SEQ ID NO: 1786429 - RNA, 20 nt, Human
ucugaaaccaguguuaggga

SEQ ID NO: 1786430 - RNA, 10 nt, Human
ucugaaacag

SEQ ID NO: 1786431 - RNA, 11 nt, Human
ucugaaacagc

SEQ ID NO: 1786432 - RNA, 12 nt, Human
ucugaaacagcu

SEQ ID NO: 1786433 - RNA, 13 nt, Human
ucugaaacagcug

SEQ ID NO: 1786434 - RNA, 14 nt, Human
ucugaaacagcugc

SEQ ID NO: 1786435 - RNA, 15 nt, Human
ucugaaacagcugcc

SEQ ID NO: 1786436 - RNA, 17 nt, Human
ucugaaacagcugccuu

SEQ ID NO: 1786437 - RNA, 18 nt, Human
ucugaaacagcugccuua

SEQ ID NO: 1786438 - RNA, 22 nt, Human
ucugaaacagcugccuuagcuu

SEQ ID NO: 1786439 - RNA, 16 nt, Human
ucugacacacagcucu

SEQ ID NO: 1786440 - RNA, 17 nt, Human
ucugacacacagcucug

SEQ ID NO: 1786441 - RNA, 18 nt, Human
ucugacacacagcucugu

SEQ ID NO: 1786442 - RNA, 19 nt, Human
ucugacacacagcucuguc

SEQ ID NO: 1786443 - RNA, 12 nt, Human
ucugacaggcaa

SEQ ID NO: 1786444 - RNA, 21 nt, Human
ucugacaggcaaugcuggcug

SEQ ID NO: 1786445 - RNA, 22 nt, Human
ucugacaggcaaugcuggcugu

SEQ ID NO: 1786446 - RNA, 13 nt, Human
ucugacccacugc

SEQ ID NO: 1786447 - RNA, 14 nt, Human
ucugacccacugcu

SEQ ID NO: 1786448 - RNA, 15 nt, Human
ucugacccacugcuu

SEQ ID NO: 1786449 - RNA, 23 nt, Human
ucugaggaauccagacccggcug

SEQ ID NO: 1786450 - RNA, 13 nt, Human
ucugccaccccua

SEQ ID NO: 1786451 - RNA, 22 nt, Human
ucugccaccccuaaacuccagg

SEQ ID NO: 1786452 - RNA, 21 nt, Human
ucugcauccagagauucauuu

SEQ ID NO: 1786453 - RNA, 22 nt, Human
ucugcauccagagauucauuuu

SEQ ID NO: 1786454 - RNA, 23 nt, Human
ucugcauccagagauucauuuuc

SEQ ID NO: 1786455 - RNA, 17 nt, Human
ucucugaggacacuaac

SEQ ID NO: 1786456 - RNA, 13 nt, Human
ucucugggagaaa

SEQ ID NO: 1786457 - RNA, 14 nt, Human
ucucugggagaaaa

SEQ ID NO: 1786458 - RNA, 16 nt, Human
ucucugggagaaaauc

SEQ ID NO: 1786459 - RNA, 17 nt, Human
ucucugggagaaaauca

SEQ ID NO: 1786460 - RNA, 18 nt, Human
ucucugggagaaaaucau

SEQ ID NO: 1786461 - RNA, 19 nt, Human
ucucugggagaaaaucauc

SEQ ID NO: 1786462 - RNA, 22 nt, Human
ucucugggagaaaaucaucaag

SEQ ID NO: 1786463 - RNA, 12 nt, Human
ucucugucucau

SEQ ID NO: 1786464 - RNA, 14 nt, Human
ucucugucucaucc

SEQ ID NO: 1786465 - RNA, 15 nt, Human
ucucugucucaucca

SEQ ID NO: 1786466 - RNA, 16 nt, Human
ucucugucucauccau

SEQ ID NO: 1786467 - RNA, 21 nt, Human
ucucugucucauccaucauca

SEQ ID NO: 1786468 - RNA, 23 nt, Human
ucucugucucauccaucaucaug

SEQ ID NO: 1786469 - RNA, 19 nt, Human
ucuccugccucagccuccc

SEQ ID NO: 1786470 - RNA, 17 nt, Human
ucuccugccucagccuc

SEQ ID NO: 1786471 - RNA, 15 nt, Human
ucuccugccucagcc

SEQ ID NO: 1786472 - RNA, 21 nt, Human
ucucaagaugggggcagggcu

SEQ ID NO: 1786473 - RNA, 22 nt, Human
ucucaagaugggggcagggcug

SEQ ID NO: 1786474 - RNA, 13 nt, Human
ucucaaugcucau

SEQ ID NO: 1786475 - RNA, 18 nt, Human
ucuaugcuuuccaaaccu

SEQ ID NO: 1786476 - RNA, 13 nt, Human
ucuaugcuuucca

SEQ ID NO: 1786477 - RNA, 17 nt, Human
ucuaugcuuuccaaacc

SEQ ID NO: 1786478 - RNA, 14 nt, Human
ucuaauauguaaca

SEQ ID NO: 1786479 - RNA, 12 nt, Human
ucuacuuugaag

SEQ ID NO: 1786480 - RNA, 20 nt, Human
ucuacuuugaagucauacca

SEQ ID NO: 1786481 - RNA, 22 nt, Human
ucgugagcucuugugaggaaag

SEQ ID NO: 1786482 - RNA, 16 nt, Human
ucgugagcucuuguga

SEQ ID NO: 1786483 - RNA, 15 nt, Human
ucgugagcucuugug

SEQ ID NO: 1786484 - RNA, 12 nt, Human
ucgaguacugug

SEQ ID NO: 1786485 - RNA, 13 nt, Human
ucgaguacugugg

SEQ ID NO: 1786486 - RNA, 14 nt, Human
ucgaguacuguggg

SEQ ID NO: 1786487 - RNA, 16 nt, Human
ucgaguacugugggca

SEQ ID NO: 1786488 - RNA, 17 nt, Human
ucgaguacugugggcaa

SEQ ID NO: 1786489 - RNA, 20 nt, Human
ucgaguacugugggcaauuu

SEQ ID NO: 1786490 - RNA, 23 nt, Human
ucgaguacugugggcaauuuaga

SEQ ID NO: 1786491 - RNA, 18 nt, Human
ucgugcggaaucagcuuc

SEQ ID NO: 1786492 - RNA, 13 nt, Human
uccuguccucccu

SEQ ID NO: 1786493 - RNA, 15 nt, Human
uccuguccucccuca

SEQ ID NO: 1786494 - RNA, 17 nt, Human
uccuguccucccucacc

SEQ ID NO: 1786495 - RNA, 10 nt, Human
uccuguccuc

SEQ ID NO: 1786496 - RNA, 13 nt, Human
uccuggcacugga

SEQ ID NO: 1786497 - RNA, 18 nt, Human
uccuggcacuggacccca

SEQ ID NO: 1786498 - RNA, 19 nt, Human
uccuggcacuggaccccag

SEQ ID NO: 1786499 - RNA, 21 nt, Human
uccuggcacuggaccccagca

SEQ ID NO: 1786500 - RNA, 20 nt, Human
uccuggcacccggccccugc

SEQ ID NO: 1786501 - RNA, 21 nt, Human
uccuggcacccggccccugcu

SEQ ID NO: 1786502 - RNA, 22 nt, Human
uccuggcacccggccccugcug

SEQ ID NO: 1786503 - RNA, 17 nt, Human
uccugccucagccuccc

SEQ ID NO: 1786504 - RNA, 16 nt, Human
uccugccucagccucc

SEQ ID NO: 1786505 - RNA, 13 nt, Human
uccugccucagcc

SEQ ID NO: 1786506 - RNA, 15 nt, Human
uccugccucagccuc

SEQ ID NO: 1786507 - RNA, 14 nt, Human
uccuggcacccggc

SEQ ID NO: 1786508 - RNA, 16 nt, Human
uccuggcacccggccc

SEQ ID NO: 1786509 - RNA, 19 nt, Human
uccuggcacccggccccug

SEQ ID NO: 1786510 - RNA, 14 nt, Human
uccugccucagccu

SEQ ID NO: 1786511 - RNA, 20 nt, Human
ucgaggccugaagccagcug

SEQ ID NO: 1786512 - RNA, 15 nt, Human
uccuuuguucccggc

SEQ ID NO: 1786513 - RNA, 21 nt, Human
uccuuggcaguggacucagaa

SEQ ID NO: 1786514 - RNA, 20 nt, Human
uccuugaccugcauuguaaa

SEQ ID NO: 1786515 - RNA, 22 nt, Human
uccuugaccugcauuguaaaua

SEQ ID NO: 1786516 - RNA, 18 nt, Human
uccuaauaaaguucugua

SEQ ID NO: 1786517 - RNA, 13 nt, Human
uccgaccagacac

SEQ ID NO: 1786518 - RNA, 17 nt, Human
uccgaccagacaccuug

SEQ ID NO: 1786519 - RNA, 18 nt, Human
uccuacccacccuccuuu

SEQ ID NO: 1786520 - RNA, 21 nt, Human
uccuauucuuucgaaagaaga

SEQ ID NO: 1786521 - RNA, 18 nt, Human
uccuauguuuuuguucaa

SEQ ID NO: 1786522 - RNA, 23 nt, Human
uccuaugugauuuuaacucuguc

SEQ ID NO: 1786523 - RNA, 22 nt, Human
uccuaugugauuuuaacucugu

SEQ ID NO: 1786524 - RNA, 19 nt, Human
uccuauguuuuuguucaaa

SEQ ID NO: 1786525 - RNA, 17 nt, Human
uccuauucaaauuccua

SEQ ID NO: 1786526 - RNA, 18 nt, Human
uccuauacgcagcgugcu

SEQ ID NO: 1786527 - RNA, 19 nt, Human
uccuauacgcagcgugcuu

SEQ ID NO: 1786528 - RNA, 17 nt, Human
uccuauaaggaagauuu

SEQ ID NO: 1786529 - RNA, 21 nt, Human
uccuauaaggaagauuuggaa

SEQ ID NO: 1786530 - RNA, 23 nt, Human
uccuaguucuguagaaaugguug

SEQ ID NO: 1786531 - RNA, 16 nt, Human
uccuaguuuuccuacu

SEQ ID NO: 1786532 - RNA, 17 nt, Human
uccuaguuuuccuacuu

SEQ ID NO: 1786533 - RNA, 17 nt, Human
uccuaguucuguagaaa

SEQ ID NO: 1786534 - RNA, 16 nt, Human
uccuaguucuguagaa

SEQ ID NO: 1786535 - RNA, 19 nt, Human
uccuaguucuguagaaaug

SEQ ID NO: 1786536 - RNA, 18 nt, Human
uccuaguucuguagaaau

SEQ ID NO: 1786537 - RNA, 17 nt, Human
uccucauuaaauuaccu

SEQ ID NO: 1786538 - RNA, 16 nt, Human
uccuccuuuccuccuc

SEQ ID NO: 1786539 - RNA, 17 nt, Human
uccuccuuuccuccucu

SEQ ID NO: 1786540 - RNA, 19 nt, Human
uccucuacuaacaaucagc

SEQ ID NO: 1786541 - RNA, 17 nt, Human
uccucuacuaacaauca

SEQ ID NO: 1786542 - RNA, 18 nt, Human
uccucuacuaacaaucag

SEQ ID NO: 1786543 - RNA, 22 nt, Human
uccuccacguucugcucaucau

SEQ ID NO: 1786544 - RNA, 23 nt, Human
uccuccacguucugcucaucauu

SEQ ID NO: 1786545 - RNA, 21 nt, Human
uccuccacguucugcucauca

SEQ ID NO: 1786546 - RNA, 20 nt, Human
uccucaugucuucucacaag

SEQ ID NO: 1786547 - RNA, 23 nt, Human
uccucaugucuucucacaagcca

SEQ ID NO: 1786548 - RNA, 20 nt, Human
uccuccugggcccucucugc

SEQ ID NO: 1786549 - RNA, 22 nt, Human
uccuccugggcccucucugcuc

SEQ ID NO: 1786550 - RNA, 15 nt, Human
ucccugcgccuuucc

SEQ ID NO: 1786551 - RNA, 16 nt, Human
ucccugcgccuuuccu

SEQ ID NO: 1786552 - RNA, 13 nt, Human
ucccugcacuugc

SEQ ID NO: 1786553 - RNA, 14 nt, Human
ucccugcacuugca

SEQ ID NO: 1786554 - RNA, 18 nt, Human
uccgaaccuccucuguga

SEQ ID NO: 1786555 - RNA, 22 nt, Human
uccgaaccuccucugugaagca

SEQ ID NO: 1786556 - RNA, 19 nt, Human
uccgaaccuccucugugaa

SEQ ID NO: 1786557 - RNA, 20 nt, Human
uccgaccacuaauugccaag

SEQ ID NO: 1786558 - RNA, 15 nt, Human
ucccgggacgcagca

SEQ ID NO: 1786559 - RNA, 15 nt, Human
ucccgggccagggcu

SEQ ID NO: 1786560 - RNA, 16 nt, Human
ucccgggccagggcug

SEQ ID NO: 1786561 - RNA, 21 nt, Human
ucccgggccagggcugccccu

SEQ ID NO: 1786562 - RNA, 17 nt, Human
ucccgggccccacagac

SEQ ID NO: 1786563 - RNA, 19 nt, Human
ucccucgcugcacaaauac

SEQ ID NO: 1786564 - RNA, 22 nt, Human
ucccucgcugcacaaauacucc

SEQ ID NO: 1786565 - RNA, 21 nt, Human
ucccucuacagagcuucccug

SEQ ID NO: 1786566 - RNA, 22 nt, Human
ucccucuacagagcuucccuga

SEQ ID NO: 1786567 - RNA, 16 nt, Human
uggugucaccugaaga

SEQ ID NO: 1786568 - RNA, 14 nt, Human
ugguucccuuccua

SEQ ID NO: 1786569 - RNA, 18 nt, Human
ugguugaugaucuuugca

SEQ ID NO: 1786570 - RNA, 12 nt, Human
ugguugaggaaa

SEQ ID NO: 1786571 - RNA, 16 nt, Human
ugguggguccaugggc

SEQ ID NO: 1786572 - RNA, 17 nt, Human
ugguggguccaugggca

SEQ ID NO: 1786573 - RNA, 18 nt, Human
ugguggguccaugggcag

SEQ ID NO: 1786574 - RNA, 13 nt, Human
ugguggcuggguu

SEQ ID NO: 1786575 - RNA, 20 nt, Human
ugguggcagugggagcugcc

SEQ ID NO: 1786576 - RNA, 13 nt, Human
ugguggcaguggg

SEQ ID NO: 1786577 - RNA, 18 nt, Human
ugguggcagugggagcug

SEQ ID NO: 1786578 - RNA, 20 nt, Human
uggguacuuguggacacagc

SEQ ID NO: 1786579 - RNA, 23 nt, Human
uggguacuuguggacacagcucu

SEQ ID NO: 1786580 - RNA, 21 nt, Human
uguaaaaggccaaaccucugu

SEQ ID NO: 1786581 - RNA, 22 nt, Human
uguaaaaggccaaaccucuguu

SEQ ID NO: 1786582 - RNA, 23 nt, Human
uguaaaaggccaaaccucuguuc

SEQ ID NO: 1786583 - RNA, 23 nt, Human
uguaaaaucuuucuuucuuagaa

SEQ ID NO: 1786584 - RNA, 22 nt, Human
uguaaaaucuuucuuucuuaga

SEQ ID NO: 1786585 - RNA, 13 nt, Human
uguaaaaucuuuc

SEQ ID NO: 1786586 - RNA, 21 nt, Human
uguaaaaucuuucuuucuuag

SEQ ID NO: 1786587 - RNA, 14 nt, Human
uguaaaaucuuucu

SEQ ID NO: 1786588 - RNA, 16 nt, Human
ugguuuuuacuuaacu

SEQ ID NO: 1786589 - RNA, 16 nt, Human
ugguuguauuagaugu

SEQ ID NO: 1786590 - RNA, 14 nt, Human
ugguuguauuagau

SEQ ID NO: 1786591 - RNA, 12 nt, Human
ugguuguauuag

SEQ ID NO: 1786592 - RNA, 24 nt, Human
ugguugguuuugacuucagauuga

SEQ ID NO: 1786593 - RNA, 18 nt, Human
ugguuguauuagauguuc

SEQ ID NO: 1786594 - RNA, 12 nt, Human
ugguuggauaag

SEQ ID NO: 1786595 - RNA, 14 nt, Human
uguaacaagccacc

SEQ ID NO: 1786596 - RNA, 14 nt, Human
uguaaacugugcac

SEQ ID NO: 1786597 - RNA, 15 nt, Human
uguaaacugugcacc

SEQ ID NO: 1786598 - RNA, 17 nt, Human
uguaacaagccacccca

SEQ ID NO: 1786599 - RNA, 11 nt, Human
uguaacaugua

SEQ ID NO: 1786600 - RNA, 15 nt, Human
uguacagaauauuuc

SEQ ID NO: 1786601 - RNA, 23 nt, Human
uguacagaauauuucuauugaau

SEQ ID NO: 1786602 - RNA, 15 nt, Human
ugucacaggcagguc

SEQ ID NO: 1786603 - RNA, 16 nt, Human
ugucacaggcaggucc

SEQ ID NO: 1786604 - RNA, 17 nt, Human
ugucacaggcaggucca

SEQ ID NO: 1786605 - RNA, 21 nt, Human
ugucacaggcagguccagggu

SEQ ID NO: 1786606 - RNA, 17 nt, Human
ugucaauuuaugaauau

SEQ ID NO: 1786607 - RNA, 19 nt, Human
ugucaauuuaugaauauaa

SEQ ID NO: 1786608 - RNA, 13 nt, Human
ugucacacacuuu

SEQ ID NO: 1786609 - RNA, 14 nt, Human
ugucacaggcaggu

SEQ ID NO: 1786610 - RNA, 21 nt, Human
uguauguaacaauuguuuguu

SEQ ID NO: 1786611 - RNA, 16 nt, Human
uguauaaaaucagcca

SEQ ID NO: 1786612 - RNA, 14 nt, Human
uguauaaaaucagc

SEQ ID NO: 1786613 - RNA, 21 nt, Human
uguaggaaccgugguaugucu

SEQ ID NO: 1786614 - RNA, 22 nt, Human
uguaggaaccgugguaugucug

SEQ ID NO: 1786615 - RNA, 12 nt, Human
uguccccuccca

SEQ ID NO: 1786616 - RNA, 15 nt, Human
uguccuccaggagcu

SEQ ID NO: 1786617 - RNA, 16 nt, Human
uguccuccaggagcuu

SEQ ID NO: 1786618 - RNA, 21 nt, Human
uguccuccaggagcuucuugu

SEQ ID NO: 1786619 - RNA, 18 nt, Human
uguccucccagcuccuca

SEQ ID NO: 1786620 - RNA, 10 nt, Human
uguccugccu

SEQ ID NO: 1786621 - RNA, 14 nt, Human
uguccugccugucu

SEQ ID NO: 1786622 - RNA, 15 nt, Human
uguccugccugucug

SEQ ID NO: 1786623 - RNA, 16 nt, Human
uguccugccugucugc

SEQ ID NO: 1786624 - RNA, 17 nt, Human
uguccugccugucugcc

SEQ ID NO: 1786625 - RNA, 19 nt, Human
uguccugccugucugcccc

SEQ ID NO: 1786626 - RNA, 21 nt, Human
uguccugccugucugccccag

SEQ ID NO: 1786627 - RNA, 12 nt, Human
uguccugggagu

SEQ ID NO: 1786628 - RNA, 19 nt, Human
uguccugggagugagcugg

SEQ ID NO: 1786629 - RNA, 20 nt, Human
uguccugggagugagcuggu

SEQ ID NO: 1786630 - RNA, 14 nt, Human
ugucuaugggacuc

SEQ ID NO: 1786631 - RNA, 15 nt, Human
ugucuaugggacuca

SEQ ID NO: 1786632 - RNA, 16 nt, Human
ugucuaugggacucaa

SEQ ID NO: 1786633 - RNA, 22 nt, Human
ugucuuaaugaaguuugaaugu

SEQ ID NO: 1786634 - RNA, 21 nt, Human
ugucuuaaugaaguuugaaug

SEQ ID NO: 1786635 - RNA, 20 nt, Human
ugucuuaaugaaguuugaau

SEQ ID NO: 1786636 - RNA, 19 nt, Human
ugucuuaaugaaguuugaa

SEQ ID NO: 1786637 - RNA, 18 nt, Human
ugucuuaaugaaguuuga

SEQ ID NO: 1786638 - RNA, 15 nt, Human
ugucuuaaugaaguu

SEQ ID NO: 1786639 - RNA, 14 nt, Human
ugucuuaaugaagu

SEQ ID NO: 1786640 - RNA, 14 nt, Human
uggccccugcccgg

SEQ ID NO: 1786641 - RNA, 17 nt, Human
uggcagcugcgguccac

SEQ ID NO: 1786642 - RNA, 19 nt, Human
uggcagcugcgguccaccc

SEQ ID NO: 1786643 - RNA, 18 nt, Human
uggccucaagugauucuc

SEQ ID NO: 1786644 - RNA, 23 nt, Human
uggccucaagugauucuccugcc

SEQ ID NO: 1786645 - RNA, 22 nt, Human
uggcuuccuaaaauucagugga

SEQ ID NO: 1786646 - RNA, 10 nt, Human
uggcugggca

SEQ ID NO: 1786647 - RNA, 20 nt, Human
uggcugggcagagcugcauc

SEQ ID NO: 1786648 - RNA, 19 nt, Human
uggcucccgcggugccaug

SEQ ID NO: 1786649 - RNA, 22 nt, Human
ugggcuucaguggcagcugcuu

SEQ ID NO: 1786650 - RNA, 21 nt, Human
ugggcuucaguggcagcugcu

SEQ ID NO: 1786651 - RNA, 19 nt, Human
ugggccugccgggcugagg

SEQ ID NO: 1786652 - RNA, 20 nt, Human
ugggccugccgggcugaggg

SEQ ID NO: 1786653 - RNA, 13 nt, Human
uggggcagcuuga

SEQ ID NO: 1786654 - RNA, 16 nt, Human
ugggggccucagugcc

SEQ ID NO: 1786655 - RNA, 13 nt, Human
ugggggcagggcu

SEQ ID NO: 1786656 - RNA, 14 nt, Human
ugggggcagggcug

SEQ ID NO: 1786657 - RNA, 15 nt, Human
ugggggcagggcugu

SEQ ID NO: 1786658 - RNA, 19 nt, Human
ugggguggguauaaaagau

SEQ ID NO: 1786659 - RNA, 15 nt, Human
ugggguggguauaaa

SEQ ID NO: 1786660 - RNA, 18 nt, Human
ugggaugguggagggcca

SEQ ID NO: 1786661 - RNA, 16 nt, Human
ugggaugguggagggc

SEQ ID NO: 1786662 - RNA, 17 nt, Human
ugggaugguggagggcc

SEQ ID NO: 1786663 - RNA, 13 nt, Human
ugggcccuuugag

SEQ ID NO: 1786664 - RNA, 21 nt, Human
ugggccguaucuccggcuccc

SEQ ID NO: 1786665 - RNA, 20 nt, Human
ugggccguaucuccggcucc

SEQ ID NO: 1786666 - RNA, 19 nt, Human
ugggaugagaguuuuggau

SEQ ID NO: 1786667 - RNA, 12 nt, Human
ugggauagagaa

SEQ ID NO: 1786668 - RNA, 17 nt, Human
ugggauagagaauguuc

SEQ ID NO: 1786669 - RNA, 22 nt, Human
ugggaguugaucgccuuuccca

SEQ ID NO: 1786670 - RNA, 15 nt, Human
uggaugcagugcucg

SEQ ID NO: 1786671 - RNA, 14 nt, Human
uggaugcagugcuc

SEQ ID NO: 1786672 - RNA, 16 nt, Human
uggcacuggaccccag

SEQ ID NO: 1786673 - RNA, 18 nt, Human
uggcacuggaccccagca

SEQ ID NO: 1786674 - RNA, 23 nt, Human
uggacuaaaagauauaagugcug

SEQ ID NO: 1786675 - RNA, 22 nt, Human
uggacuaaaagauauaagugcu

SEQ ID NO: 1786676 - RNA, 21 nt, Human
uggacuaaaagauauaagugc

SEQ ID NO: 1786677 - RNA, 15 nt, Human
uggacuaaaagauau

SEQ ID NO: 1786678 - RNA, 14 nt, Human
uggacuaaaagaua

SEQ ID NO: 1786679 - RNA, 13 nt, Human
uggacuaaaagau

SEQ ID NO: 1786680 - RNA, 18 nt, Human
uggacaggcauguucucu

SEQ ID NO: 1786681 - RNA, 22 nt, Human
uggacaggcauguucucugagg

SEQ ID NO: 1786682 - RNA, 23 nt, Human
uggacaggcauguucucugagga

SEQ ID NO: 1786683 - RNA, 18 nt, Human
ugcuuucgaacugcuagu

SEQ ID NO: 1786684 - RNA, 21 nt, Human
ugcuucuccaaaaaucugccu

SEQ ID NO: 1786685 - RNA, 22 nt, Human
ugcuucuccaaaaaucugccug

SEQ ID NO: 1786686 - RNA, 24 nt, Human
ugcuucuccaaaaaucugccuggg

SEQ ID NO: 1786687 - RNA, 13 nt, Human
ugcuucgggcccu

SEQ ID NO: 1786688 - RNA, 21 nt, Human
ugauccacccaccucagccuc

SEQ ID NO: 1786689 - RNA, 22 nt, Human
ugauccacccaccucagccucc

SEQ ID NO: 1786690 - RNA, 13 nt, Human
ugaucauccacug

SEQ ID NO: 1786691 - RNA, 24 nt, Human
ugaucauccacugugccaugugcc

SEQ ID NO: 1786692 - RNA, 21 nt, Human
ugauccaagcuggucccacuc

SEQ ID NO: 1786693 - RNA, 15 nt, Human
ugauccacccaccuc

SEQ ID NO: 1786694 - RNA, 16 nt, Human
ugauccacccaccuca

SEQ ID NO: 1786695 - RNA, 20 nt, Human
ugauccacccaccucagccu

SEQ ID NO: 1786696 - RNA, 22 nt, Human
ugaucacggcucacugcagccu

SEQ ID NO: 1786697 - RNA, 21 nt, Human
ugaucagagccgugguccuuu

SEQ ID NO: 1786698 - RNA, 22 nt, Human
ugaucagagccgugguccuuug

SEQ ID NO: 1786699 - RNA, 23 nt, Human
ugaucagagccgugguccuuugg

SEQ ID NO: 1786700 - RNA, 16 nt, Human
ugauauaaucuuucaa

SEQ ID NO: 1786701 - RNA, 14 nt, Human
ugaugcccugcccu

SEQ ID NO: 1786702 - RNA, 22 nt, Human
ugauguaaucuugaauuguaac

SEQ ID NO: 1786703 - RNA, 18 nt, Human
ugauguaccaugaaacaa

SEQ ID NO: 1786704 - RNA, 20 nt, Human
ugauguaccaugaaacaaag

SEQ ID NO: 1786705 - RNA, 21 nt, Human
ugaucuuugcagacaggcaag

SEQ ID NO: 1786706 - RNA, 23 nt, Human
ugaucuuugcagacaggcaagca

SEQ ID NO: 1786707 - RNA, 19 nt, Human
ugaucuuugcagacaggca

SEQ ID NO: 1786708 - RNA, 20 nt, Human
ugaucuuugcagacaggcaa

SEQ ID NO: 1786709 - RNA, 22 nt, Human
ugaugaucuuugcagacaggca

SEQ ID NO: 1786710 - RNA, 23 nt, Human
ugaugaucuuugcagacaggcaa

SEQ ID NO: 1786711 - RNA, 20 nt, Human
ugaugaugaaaugaggucag

SEQ ID NO: 1786712 - RNA, 23 nt, Human
ugagcucuugugaggaaagucau

SEQ ID NO: 1786713 - RNA, 14 nt, Human
ugagucgaggacag

SEQ ID NO: 1786714 - RNA, 16 nt, Human
ugaguccuagagcuac

SEQ ID NO: 1786715 - RNA, 15 nt, Human
ugagucgaggacagg

SEQ ID NO: 1786716 - RNA, 16 nt, Human
ugagucgaggacaggg

SEQ ID NO: 1786717 - RNA, 18 nt, Human
ugagucgaggacagggag

SEQ ID NO: 1786718 - RNA, 12 nt, Human
ugaguuuaaaaa

SEQ ID NO: 1786719 - RNA, 16 nt, Human
ugaguuuaaaaaucaa

SEQ ID NO: 1786720 - RNA, 18 nt, Human
ugaguuuaaaaaucaacu

SEQ ID NO: 1786721 - RNA, 19 nt, Human
ugaguuuaaaaaucaacuu

SEQ ID NO: 1786722 - RNA, 20 nt, Human
ugaguuuaaaaaucaacuuu

SEQ ID NO: 1786723 - RNA, 14 nt, Human
ugaguuuaaagcaa

SEQ ID NO: 1786724 - RNA, 16 nt, Human
ugauaaaaccauguag

SEQ ID NO: 1786725 - RNA, 15 nt, Human
ugauaaaucagucaa

SEQ ID NO: 1786726 - RNA, 17 nt, Human
ugauaaaucagucaagc

SEQ ID NO: 1786727 - RNA, 13 nt, Human
ugagccucagcau

SEQ ID NO: 1786728 - RNA, 15 nt, Human
ugagccucagcaucc

SEQ ID NO: 1786729 - RNA, 20 nt, Human
ugagcccucagaacccuugg

SEQ ID NO: 1786730 - RNA, 12 nt, Human
ugagcccucaga

SEQ ID NO: 1786731 - RNA, 14 nt, Human
ugagcccucagaac

SEQ ID NO: 1786732 - RNA, 17 nt, Human
ugagcccucagaacccu

SEQ ID NO: 1786733 - RNA, 13 nt, Human
ugagcucuuguga

SEQ ID NO: 1786734 - RNA, 22 nt, Human
ugagcucuugugaggaaaguca

SEQ ID NO: 1786735 - RNA, 18 nt, Human
ugagcucuugugaggaaa

SEQ ID NO: 1786736 - RNA, 21 nt, Human
ugagcucccaggugcagccag

SEQ ID NO: 1786737 - RNA, 23 nt, Human
ugagcucccaggugcagccagag

SEQ ID NO: 1786738 - RNA, 12 nt, Human
ugagacucuguc

SEQ ID NO: 1786739 - RNA, 13 nt, Human
ugagacucugucu

SEQ ID NO: 1786740 - RNA, 14 nt, Human
ugagacucugucuc

SEQ ID NO: 1786741 - RNA, 16 nt, Human
ugagagucagcucucu

SEQ ID NO: 1786742 - RNA, 19 nt, Human
ugacgaacuuccauggccc

SEQ ID NO: 1786743 - RNA, 19 nt, Human
ugacgggacucaggcggga

SEQ ID NO: 1786744 - RNA, 11 nt, Human
ugacucugggu

SEQ ID NO: 1786745 - RNA, 13 nt, Human
ugacucugggucc

SEQ ID NO: 1786746 - RNA, 15 nt, Human
ugacucuggguccuu

SEQ ID NO: 1786747 - RNA, 17 nt, Human
ugacucuggguccuucc

SEQ ID NO: 1786748 - RNA, 18 nt, Human
ugacucuggguccuuccu

SEQ ID NO: 1786749 - RNA, 19 nt, Human
ugacucuggguccuuccug

SEQ ID NO: 1786750 - RNA, 20 nt, Human
ugacucuggguccuuccuga

SEQ ID NO: 1786751 - RNA, 21 nt, Human
ugacucuggguccuuccugaa

SEQ ID NO: 1786752 - RNA, 23 nt, Human
ugacugguguuaucaccgugggc

SEQ ID NO: 1786753 - RNA, 22 nt, Human
ugaccucaggugauccacccac

SEQ ID NO: 1786754 - RNA, 12 nt, Human
ugaccucugccu

SEQ ID NO: 1786755 - RNA, 18 nt, Human
ucuugaauacucugcccu

SEQ ID NO: 1786756 - RNA, 20 nt, Human
ucuugaauacucugcccucu

SEQ ID NO: 1786757 - RNA, 15 nt, Human
ucuugaacuccuggc

SEQ ID NO: 1786758 - RNA, 18 nt, Human
ugcacugacauuguuggc

SEQ ID NO: 1786759 - RNA, 21 nt, Human
ugcacugacauuguuggccaa

SEQ ID NO: 1786760 - RNA, 13 nt, Human
ugcacuguucccc

SEQ ID NO: 1786761 - RNA, 14 nt, Human
ugcacuguuccccc

SEQ ID NO: 1786762 - RNA, 19 nt, Human
ugcacuguucccccugugc

SEQ ID NO: 1786763 - RNA, 20 nt, Human
ugcacuguucccccugugca

SEQ ID NO: 1786764 - RNA, 21 nt, Human
ugcacuguucccccugugcag

SEQ ID NO: 1786765 - RNA, 23 nt, Human
ugcacuguucccccugugcagcc

SEQ ID NO: 1786766 - RNA, 14 nt, Human
ugcaauuucuacua

SEQ ID NO: 1786767 - RNA, 13 nt, Human
ugcaauggcagcc

SEQ ID NO: 1786768 - RNA, 14 nt, Human
ugcaauggcagccu

SEQ ID NO: 1786769 - RNA, 15 nt, Human
ugcaauggcagccuu

SEQ ID NO: 1786770 - RNA, 16 nt, Human
ugcaauggcagccuug

SEQ ID NO: 1786771 - RNA, 22 nt, Human
ugcaagaccccaagaggaaguu

SEQ ID NO: 1786772 - RNA, 22 nt, Human
ugcaaccucgcuggacucucag

SEQ ID NO: 1786773 - RNA, 14 nt, Human
ugcaaccucgcugg

SEQ ID NO: 1786774 - RNA, 19 nt, Human
ugcaaccucgcuggacucu

SEQ ID NO: 1786775 - RNA, 20 nt, Human
ugcaaccucgcuggacucuc

SEQ ID NO: 1786776 - RNA, 18 nt, Human
ugcaaccuccgccucuug

SEQ ID NO: 1786777 - RNA, 20 nt, Human
ugcaaccuccgccucuuggg

SEQ ID NO: 1786778 - RNA, 21 nt, Human
ugcaaccuccgccucuugggu

SEQ ID NO: 1786779 - RNA, 13 nt, Human
ugcaaccuccgcc

SEQ ID NO: 1786780 - RNA, 14 nt, Human
ugcaaccuccgccu

SEQ ID NO: 1786781 - RNA, 19 nt, Human
ugcaacaggcugggcuuca

SEQ ID NO: 1786782 - RNA, 20 nt, Human
ugcaacaggcugggcuucag

SEQ ID NO: 1786783 - RNA, 14 nt, Human
ugcaacaggcuggg

SEQ ID NO: 1786784 - RNA, 15 nt, Human
ugcaacaggcugggc

SEQ ID NO: 1786785 - RNA, 16 nt, Human
ugcaacaggcugggcu

SEQ ID NO: 1786786 - RNA, 17 nt, Human
ugcaacaggcugggcuu

SEQ ID NO: 1786787 - RNA, 22 nt, Human
ugcaaaaggacucucaggacca

SEQ ID NO: 1786788 - RNA, 22 nt, Human
ugcaaaagguucacuaaagcag

SEQ ID NO: 1786789 - RNA, 23 nt, Human
ugcaaaagguucacuaaagcagu

SEQ ID NO: 1786790 - RNA, 14 nt, Human
ugauuuuaacucug

SEQ ID NO: 1786791 - RNA, 15 nt, Human
ugauuuuaacucugu

SEQ ID NO: 1786792 - RNA, 17 nt, Human
ugauuuuaacucugucu

SEQ ID NO: 1786793 - RNA, 19 nt, Human
ugcaaaaggacucucagga

SEQ ID NO: 1786794 - RNA, 13 nt, Human
ugccucuucuggg

SEQ ID NO: 1786795 - RNA, 13 nt, Human
ugccugcccaggc

SEQ ID NO: 1786796 - RNA, 17 nt, Human
ugccugguggcagcugc

SEQ ID NO: 1786797 - RNA, 18 nt, Human
ugccugguggcagcugcg

SEQ ID NO: 1786798 - RNA, 19 nt, Human
ugccugguggcagcugcgg

SEQ ID NO: 1786799 - RNA, 13 nt, Human
ugccuguaaacau

SEQ ID NO: 1786800 - RNA, 12 nt, Human
ugccucccuuga

SEQ ID NO: 1786801 - RNA, 18 nt, Human
ugcccggggaaaggcaag

SEQ ID NO: 1786802 - RNA, 21 nt, Human
ugcccggggaaaggcaagguc

SEQ ID NO: 1786803 - RNA, 20 nt, Human
ugcccguaaacacgccugca

SEQ ID NO: 1786804 - RNA, 23 nt, Human
ugcccguaaacacgccugcaaac

SEQ ID NO: 1786805 - RNA, 20 nt, Human
ugccgguaaacacgccugca

SEQ ID NO: 1786806 - RNA, 13 nt, Human
ugcccuaaacccu

SEQ ID NO: 1786807 - RNA, 14 nt, Human
ugccaugugccagg

SEQ ID NO: 1786808 - RNA, 15 nt, Human
ugccaugugccaggu

SEQ ID NO: 1786809 - RNA, 22 nt, Human
ugccaugucugcagugugcccc

SEQ ID NO: 1786810 - RNA, 18 nt, Human
ugcccacgcuggagugca

SEQ ID NO: 1786811 - RNA, 15 nt, Human
ugccauguugccccu

SEQ ID NO: 1786812 - RNA, 21 nt, Human
ugccauguugccccuuucucu

SEQ ID NO: 1786813 - RNA, 12 nt, Human
ugccauguuggc

SEQ ID NO: 1786814 - RNA, 15 nt, Human
ugccauguuggccag

SEQ ID NO: 1786815 - RNA, 16 nt, Human
ugccauguuggccagg

SEQ ID NO: 1786816 - RNA, 16 nt, Human
ugccaccaacuuacaa

SEQ ID NO: 1786817 - RNA, 19 nt, Human
ugccaccaacuuacaaaaa

SEQ ID NO: 1786818 - RNA, 17 nt, Human
ugccagguuuuuggucu

SEQ ID NO: 1786819 - RNA, 15 nt, Human
ugccagggcagggcc

SEQ ID NO: 1786820 - RNA, 16 nt, Human
ugccagggcagggccc

SEQ ID NO: 1786821 - RNA, 15 nt, Human
ugccauccagguuca

SEQ ID NO: 1786822 - RNA, 20 nt, Human
ugccauccagguucagcuug

SEQ ID NO: 1786823 - RNA, 12 nt, Human
ugccauccaggu

SEQ ID NO: 1786824 - RNA, 22 nt, Human
ugcauuuuguuugguauuguau

SEQ ID NO: 1786825 - RNA, 18 nt, Human
ugcauuuuguuugguauu

SEQ ID NO: 1786826 - RNA, 20 nt, Human
ugcauguaaacacgccugca

SEQ ID NO: 1786827 - RNA, 23 nt, Human
ugcauguuuguuguauacuuccu

SEQ ID NO: 1786828 - RNA, 14 nt, Human
uuuguugccccaga

SEQ ID NO: 1786829 - RNA, 19 nt, Human
uuuguuggaguguuucuaa

SEQ ID NO: 1786830 - RNA, 15 nt, Human
uuuguuauuuugcaa

SEQ ID NO: 1786831 - RNA, 11 nt, Human
uuuguguccuc

SEQ ID NO: 1786832 - RNA, 12 nt, Human
uuuguguccucc

SEQ ID NO: 1786833 - RNA, 16 nt, Human
uuuguguccuccagga

SEQ ID NO: 1786834 - RNA, 18 nt, Human
uuuguguccuccaggagc

SEQ ID NO: 1786835 - RNA, 19 nt, Human
uuuguguccuccaggagcu

SEQ ID NO: 1786836 - RNA, 15 nt, Human
uuuguguguguguca

SEQ ID NO: 1786837 - RNA, 14 nt, Human
uuuguauucucuga

SEQ ID NO: 1786838 - RNA, 16 nt, Human
uuuguauucucugagc

SEQ ID NO: 1786839 - RNA, 21 nt, Human
uuuguauuguuucaauugcau

SEQ ID NO: 1786840 - RNA, 14 nt, Human
uuugguauuguauu

SEQ ID NO: 1786841 - RNA, 13 nt, Human
uuugguauuguau

SEQ ID NO: 1786842 - RNA, 16 nt, Human
uuugcauaacaauucc

SEQ ID NO: 1786843 - RNA, 17 nt, Human
uuugcauaacaauuccu

SEQ ID NO: 1786844 - RNA, 18 nt, Human
uuugcauaacaauuccuc

SEQ ID NO: 1786845 - RNA, 20 nt, Human
uuugcauaacaauuccucua

SEQ ID NO: 1786846 - RNA, 22 nt, Human
uuugcauaacaauuccucuacu

SEQ ID NO: 1786847 - RNA, 15 nt, Human
uuuggaaaaugcauu

SEQ ID NO: 1786848 - RNA, 13 nt, Human
uuugagugcucug

SEQ ID NO: 1786849 - RNA, 14 nt, Human
uuugagugcucuga

SEQ ID NO: 1786850 - RNA, 17 nt, Human
uuuugaaauuaaccucu

SEQ ID NO: 1786851 - RNA, 20 nt, Human
uuuuccuaauaaaguucugu

SEQ ID NO: 1786852 - RNA, 15 nt, Human
uuuuccccuuuccug

SEQ ID NO: 1786853 - RNA, 16 nt, Human
uuuuccccuuuccugu

SEQ ID NO: 1786854 - RNA, 17 nt, Human
uuuuccccuuuccuguc

SEQ ID NO: 1786855 - RNA, 15 nt, Human
uuuucccauaagaca

SEQ ID NO: 1786856 - RNA, 16 nt, Human
uuuucccauaagacaa

SEQ ID NO: 1786857 - RNA, 14 nt, Human
uuuucaaaagauaa

SEQ ID NO: 1786858 - RNA, 15 nt, Human
uuuucaaaagauaau

SEQ ID NO: 1786859 - RNA, 18 nt, Human
uuuucaaaagauaauauu

SEQ ID NO: 1786860 - RNA, 12 nt, Human
uuuucaaagcaa

SEQ ID NO: 1786861 - RNA, 13 nt, Human
uuuucaaagcaau

SEQ ID NO: 1786862 - RNA, 18 nt, Human
uuuuauuuuuagacagag

SEQ ID NO: 1786863 - RNA, 14 nt, Human
uuuuaccugcugcu

SEQ ID NO: 1786864 - RNA, 15 nt, Human
uuuuaccugcugcuu

SEQ ID NO: 1786865 - RNA, 21 nt, Human
uuuuaaaguaacccuacaaaa

SEQ ID NO: 1786866 - RNA, 10 nt, Human
uuuuucaugu

SEQ ID NO: 1786867 - RNA, 11 nt, Human
uuuuucauguu

SEQ ID NO: 1786868 - RNA, 18 nt, Human
uuuuucauguuuuaacaa

SEQ ID NO: 1786869 - RNA, 20 nt, Human
uuuuucauguuuuaacaaaa

SEQ ID NO: 1786870 - RNA, 13 nt, Human
uuuuuuuccaauu

SEQ ID NO: 1786871 - RNA, 15 nt, Human
uuuuuucccauaaga

SEQ ID NO: 1786872 - RNA, 20 nt, Human
uuuuuucauguuuuaacaaa

SEQ ID NO: 1786873 - RNA, 18 nt, Human
uuuuucccauaagacaau

SEQ ID NO: 1786874 - RNA, 11 nt, Human
uuuuuuuucau

SEQ ID NO: 1786875 - RNA, 11 nt, Human
uuuuuuuucca

SEQ ID NO: 1786876 - RNA, 17 nt, Human
uuguaaauagcucaggu

SEQ ID NO: 1786877 - RNA, 13 nt, Human
uuggucuguguga

SEQ ID NO: 1786878 - RNA, 21 nt, Human
uugguauuguauuuauucaau

SEQ ID NO: 1786879 - RNA, 14 nt, Human
uugguauuguauuu

SEQ ID NO: 1786880 - RNA, 13 nt, Human
uugguauuguauu

SEQ ID NO: 1786881 - RNA, 12 nt, Human
uugguauuguau

SEQ ID NO: 1786882 - RNA, 17 nt, Human
uugguacuauaaaagcu

SEQ ID NO: 1786883 - RNA, 22 nt, Human
uuggguucaagcgauucuucug

SEQ ID NO: 1786884 - RNA, 17 nt, Human
uugucucaaugcucaua

SEQ ID NO: 1786885 - RNA, 16 nt, Human
uugucucaaugcucau

SEQ ID NO: 1786886 - RNA, 18 nt, Human
uugucucaaugcucauaa

SEQ ID NO: 1786887 - RNA, 17 nt, Human
uugucuaaaacaauaaa

SEQ ID NO: 1786888 - RNA, 18 nt, Human
uugucuaaaacaauaaaa

SEQ ID NO: 1786889 - RNA, 22 nt, Human
uugugccaaccuauuuugaagu

SEQ ID NO: 1786890 - RNA, 23 nt, Human
uugugcuucuuucuuugggaaua

SEQ ID NO: 1786891 - RNA, 17 nt, Human
uuguggacacagcucuu

SEQ ID NO: 1786892 - RNA, 13 nt, Human
uuguggaauguug

SEQ ID NO: 1786893 - RNA, 18 nt, Human
uuguggaauguuggauaa

SEQ ID NO: 1786894 - RNA, 19 nt, Human
uuguggaauguuggauaag

SEQ ID NO: 1786895 - RNA, 16 nt, Human
uuguggacacagcucu

SEQ ID NO: 1786896 - RNA, 22 nt, Human
uuguggacuaaaagauauaagu

SEQ ID NO: 1786897 - RNA, 18 nt, Human
uuguggacuaaaagauau

SEQ ID NO: 1786898 - RNA, 16 nt, Human
uuguggacuaaaagau

SEQ ID NO: 1786899 - RNA, 13 nt, Human
uuguggacuaaaa

SEQ ID NO: 1786900 - RNA, 17 nt, Human
uuguguugaaggaacuu

SEQ ID NO: 1786901 - RNA, 14 nt, Human
uuguguuugucauu

SEQ ID NO: 1786902 - RNA, 20 nt, Human
uuguguuugucauuagccug

SEQ ID NO: 1786903 - RNA, 15 nt, Human
uuguguuugucauua

SEQ ID NO: 1786904 - RNA, 17 nt, Human
uuguuuccuuuuuuccc

SEQ ID NO: 1786905 - RNA, 16 nt, Human
uuguuucaauugcauc

SEQ ID NO: 1786906 - RNA, 18 nt, Human
uuuaagaaaaaauaacac

SEQ ID NO: 1786907 - RNA, 22 nt, Human
uuuaagaaaaaauaacacacau

SEQ ID NO: 1786908 - RNA, 22 nt, Human
uuuaagacagucccaucaaaac

SEQ ID NO: 1786909 - RNA, 15 nt, Human
uuuaauaauauacuu

SEQ ID NO: 1786910 - RNA, 15 nt, Human
uuuaacaaaaaccaa

SEQ ID NO: 1786911 - RNA, 18 nt, Human
uuuaacaaaaagugcuuc

SEQ ID NO: 1786912 - RNA, 19 nt, Human
uuuaacaaaaagugcuuca

SEQ ID NO: 1786913 - RNA, 19 nt, Human
uuuaacucuauaauguguu

SEQ ID NO: 1786914 - RNA, 18 nt, Human
uuuaacucuagaauuugg

SEQ ID NO: 1786915 - RNA, 12 nt, Human
uuuaacucuguc

SEQ ID NO: 1786916 - RNA, 13 nt, Human
uuuaacucugucu

SEQ ID NO: 1786917 - RNA, 14 nt, Human
uuuaacucugucuu

SEQ ID NO: 1786918 - RNA, 17 nt, Human
uuuaacucugucuucac

SEQ ID NO: 1786919 - RNA, 12 nt, Human
uuuagacagagu

SEQ ID NO: 1786920 - RNA, 22 nt, Human
uuuagaaagcauuugaaugcau

SEQ ID NO: 1786921 - RNA, 19 nt, Human
uuuagaaagcauuugaaug

SEQ ID NO: 1786922 - RNA, 18 nt, Human
uuuagaaagcauuugaau

SEQ ID NO: 1786923 - RNA, 16 nt, Human
uuuagaaagcauuuga

SEQ ID NO: 1786924 - RNA, 14 nt, Human
uuuagaaagcauuu

SEQ ID NO: 1786925 - RNA, 13 nt, Human
uuuagaaagcauu

SEQ ID NO: 1786926 - RNA, 17 nt, Human
uuuaauaauauacuugu

SEQ ID NO: 1786927 - RNA, 14 nt, Human
uuuaccaaaaauuu

SEQ ID NO: 1786928 - RNA, 14 nt, Human
uuucagcagacuga

SEQ ID NO: 1786929 - RNA, 16 nt, Human
uuucagauuguggaau

SEQ ID NO: 1786930 - RNA, 21 nt, Human
uuucagauuguggaauguugg

SEQ ID NO: 1786931 - RNA, 21 nt, Human
uuucaguggggcagucauuau

SEQ ID NO: 1786932 - RNA, 16 nt, Human
uuucaguguuaccugu

SEQ ID NO: 1786933 - RNA, 17 nt, Human
uuucaguguuaccugug

SEQ ID NO: 1786934 - RNA, 13 nt, Human
uuucaacuuugaa

SEQ ID NO: 1786935 - RNA, 12 nt, Human
uuuauaagaaaa

SEQ ID NO: 1786936 - RNA, 14 nt, Human
uuuauaagaaaaac

SEQ ID NO: 1786937 - RNA, 17 nt, Human
uuuauaagaaaaacuuu

SEQ ID NO: 1786938 - RNA, 18 nt, Human
uuuauaagaaaaacuuuu

SEQ ID NO: 1786939 - RNA, 16 nt, Human
uucucuccaauuuaac

SEQ ID NO: 1786940 - RNA, 16 nt, Human
uucucugagcugugca

SEQ ID NO: 1786941 - RNA, 17 nt, Human
uucucugagcugugcag

SEQ ID NO: 1786942 - RNA, 18 nt, Human
uucucugagcugugcagg

SEQ ID NO: 1786943 - RNA, 14 nt, Human
uucucugaggacac

SEQ ID NO: 1786944 - RNA, 20 nt, Human
uucucugaggacacuaacca

SEQ ID NO: 1786945 - RNA, 16 nt, Human
uucuccacccugcucu

SEQ ID NO: 1786946 - RNA, 18 nt, Human
uucuccaaaaaucugccu

SEQ ID NO: 1786947 - RNA, 13 nt, Human
uucuaucuuuugu

SEQ ID NO: 1786948 - RNA, 20 nt, Human
uucuaucuuuuguuuccuuu

SEQ ID NO: 1786949 - RNA, 19 nt, Human
uucugcucacauaucuguc

SEQ ID NO: 1786950 - RNA, 13 nt, Human
uucugcucaucau

SEQ ID NO: 1786951 - RNA, 14 nt, Human
uucugcucaucauu

SEQ ID NO: 1786952 - RNA, 19 nt, Human
uucugcucaucauucucug

SEQ ID NO: 1786953 - RNA, 20 nt, Human
uucugcucaucauucucugu

SEQ ID NO: 1786954 - RNA, 21 nt, Human
uucugcucaucauucucuguc

SEQ ID NO: 1786955 - RNA, 15 nt, Human
uucugagugccuucu

SEQ ID NO: 1786956 - RNA, 16 nt, Human
uucugagugccuucug

SEQ ID NO: 1786957 - RNA, 18 nt, Human
uucugagugccuucugug

SEQ ID NO: 1786958 - RNA, 22 nt, Human
uucugagugccuucugugggga

SEQ ID NO: 1786959 - RNA, 19 nt, Human
uucugagauucaauauuga

SEQ ID NO: 1786960 - RNA, 21 nt, Human
uucugagauucaauauugaau

SEQ ID NO: 1786961 - RNA, 20 nt, Human
uucuacccagcgagcccugg

SEQ ID NO: 1786962 - RNA, 21 nt, Human
uucuacccagcgagcccuggu

SEQ ID NO: 1786963 - RNA, 20 nt, Human
uucgugcggaaucagcuucu

SEQ ID NO: 1786964 - RNA, 13 nt, Human
uucggugugcacc

SEQ ID NO: 1786965 - RNA, 12 nt, Human
uucuacccagcg

SEQ ID NO: 1786966 - RNA, 19 nt, Human
uucuacccagcgagcccug

SEQ ID NO: 1786967 - RNA, 17 nt, Human
uuccauggcccucauua

SEQ ID NO: 1786968 - RNA, 21 nt, Human
uuccauggugugaucgucuga

SEQ ID NO: 1786969 - RNA, 16 nt, Human
uuccauggcccucauu

SEQ ID NO: 1786970 - RNA, 15 nt, Human
uuccauggcccucau

SEQ ID NO: 1786971 - RNA, 20 nt, Human
uuccauguccccucccagag

SEQ ID NO: 1786972 - RNA, 18 nt, Human
uucggugagcuacaaaug

SEQ ID NO: 1786973 - RNA, 20 nt, Human
uuccuuguagcgacuaaacu

SEQ ID NO: 1786974 - RNA, 18 nt, Human
uucuggauggugugccuu

SEQ ID NO: 1786975 - RNA, 20 nt, Human
uucuggauggugugccuucc

SEQ ID NO: 1786976 - RNA, 23 nt, Human
uucuggauggugugccuuccaga

SEQ ID NO: 1786977 - RNA, 15 nt, Human
uucugucccucacag

SEQ ID NO: 1786978 - RNA, 14 nt, Human
uucugucccuucug

SEQ ID NO: 1786979 - RNA, 11 nt, Human
uucugucucca

SEQ ID NO: 1786980 - RNA, 13 nt, Human
uucugucuccagc

SEQ ID NO: 1786981 - RNA, 16 nt, Human
uucuguccccucuucc

SEQ ID NO: 1786982 - RNA, 19 nt, Human
uucuggaggaaagggagga

SEQ ID NO: 1786983 - RNA, 14 nt, Human
uucugcuucagccu

SEQ ID NO: 1786984 - RNA, 15 nt, Human
uucugcuucagccuc

SEQ ID NO: 1786985 - RNA, 16 nt, Human
uucugcuucagccucc

SEQ ID NO: 1786986 - RNA, 19 nt, Human
uucugcuucagccucccga

SEQ ID NO: 1786987 - RNA, 16 nt, Human
uugaaaaccugacaaa

SEQ ID NO: 1786988 - RNA, 22 nt, Human
uugaaaaaauagagccugaggg

SEQ ID NO: 1786989 - RNA, 20 nt, Human
uugaaaaaauagagccugag

SEQ ID NO: 1786990 - RNA, 15 nt, Human
uugaacuccuggccu

SEQ ID NO: 1786991 - RNA, 16 nt, Human
uugaacuccuggccuc

SEQ ID NO: 1786992 - RNA, 14 nt, Human
uucuuguuuccuug

SEQ ID NO: 1786993 - RNA, 15 nt, Human
uucuuguuuccuugu

SEQ ID NO: 1786994 - RNA, 16 nt, Human
uucuuguuuccuuguu

SEQ ID NO: 1786995 - RNA, 19 nt, Human
uucuuccaggugcccagcu

SEQ ID NO: 1786996 - RNA, 20 nt, Human
uucuuccaggugcccagcua

SEQ ID NO: 1786997 - RNA, 12 nt, Human
uugcaaauaguc

SEQ ID NO: 1786998 - RNA, 13 nt, Human
uugcaaaguacug

SEQ ID NO: 1786999 - RNA, 14 nt, Human
uugcaaaguacugu

SEQ ID NO: 1787000 - RNA, 15 nt, Human
uugcaaaguacugua

SEQ ID NO: 1787001 - RNA, 16 nt, Human
uugaugaucuuugcag

SEQ ID NO: 1787002 - RNA, 16 nt, Human
uugaggguugggcugg

SEQ ID NO: 1787003 - RNA, 13 nt, Human
uugaggguugggc

SEQ ID NO: 1787004 - RNA, 21 nt, Human
uugacucuggguccuuccuga

SEQ ID NO: 1787005 - RNA, 18 nt, Human
uugauagcugucccaucu

SEQ ID NO: 1787006 - RNA, 18 nt, Human
uugacucuggguccuucc

SEQ ID NO: 1787007 - RNA, 19 nt, Human
uugacucuggguccuuccu

SEQ ID NO: 1787008 - RNA, 12 nt, Human
uugacucugggu

SEQ ID NO: 1787009 - RNA, 13 nt, Human
uugacucuggguc

SEQ ID NO: 1787010 - RNA, 21 nt, Human
uugaccucaggugauccaccc

SEQ ID NO: 1787011 - RNA, 18 nt, Human
uugacaaggucaaauuua

SEQ ID NO: 1787012 - RNA, 12 nt, Human
uugacaauaaaa

SEQ ID NO: 1787013 - RNA, 13 nt, Human
uugacaauaaaau

SEQ ID NO: 1787014 - RNA, 14 nt, Human
uugacaauaaaaua

SEQ ID NO: 1787015 - RNA, 15 nt, Human
uugacaauaaaauau

SEQ ID NO: 1787016 - RNA, 16 nt, Human
uugacaauaaaauauu

SEQ ID NO: 1787017 - RNA, 19 nt, Human
uugacaauaaaauauuauu

SEQ ID NO: 1787018 - RNA, 18 nt, Human
uugaacuggguacuugug

SEQ ID NO: 1787019 - RNA, 20 nt, Human
uugaauuuuguucucuggga

SEQ ID NO: 1787020 - RNA, 22 nt, Human
uugaauuuuguucucugggaga

SEQ ID NO: 1787021 - RNA, 13 nt, Human
uugaauuuuuccu

SEQ ID NO: 1787022 - RNA, 16 nt, Human
uugaauuuuuccuaug

SEQ ID NO: 1787023 - RNA, 17 nt, Human
uugaauuuuuccuaugc

SEQ ID NO: 1787024 - RNA, 18 nt, Human
uugacaaaggcaagcacu

SEQ ID NO: 1787025 - RNA, 22 nt, Human
uucaaauuccuauuuuuaaaua

SEQ ID NO: 1787026 - RNA, 16 nt, Human
uucaauauugaauuuu

SEQ ID NO: 1787027 - RNA, 19 nt, Human
uucaauauugaauuuuucc

SEQ ID NO: 1787028 - RNA, 12 nt, Human
uuauuuugcaac

SEQ ID NO: 1787029 - RNA, 12 nt, Human
uuauuugucaaa

SEQ ID NO: 1787030 - RNA, 18 nt, Human
uuauuugguucccuuccu

SEQ ID NO: 1787031 - RNA, 11 nt, Human
uuauuugcaua

SEQ ID NO: 1787032 - RNA, 20 nt, Human
uuauuaguaaaugcuuauca

SEQ ID NO: 1787033 - RNA, 21 nt, Human
uuauuagagauuaccuccuga

SEQ ID NO: 1787034 - RNA, 17 nt, Human
uuauuagagugucuuuc

SEQ ID NO: 1787035 - RNA, 22 nt, Human
uucagcuuguaaauagcucagg

SEQ ID NO: 1787036 - RNA, 14 nt, Human
uucaguggcagcug

SEQ ID NO: 1787037 - RNA, 22 nt, Human
uucagcuccagcucaccagccc

SEQ ID NO: 1787038 - RNA, 12 nt, Human
uucagcuccagc

SEQ ID NO: 1787039 - RNA, 15 nt, Human
uucagcuccagcuca

SEQ ID NO: 1787040 - RNA, 13 nt, Human
uucaguguaaaua

SEQ ID NO: 1787041 - RNA, 17 nt, Human
uucaguggcagcugcuu

SEQ ID NO: 1787042 - RNA, 14 nt, Human
uucaguggggcagu

SEQ ID NO: 1787043 - RNA, 15 nt, Human
uucaguggcagcugc

SEQ ID NO: 1787044 - RNA, 16 nt, Human
uucaguggcagcugcu

SEQ ID NO: 1787045 - RNA, 15 nt, Human
uucauaaccuagccu

SEQ ID NO: 1787046 - RNA, 23 nt, Human
uucaguuauuauauuuacaaaug

SEQ ID NO: 1787047 - RNA, 12 nt, Human
uucaguguuaaa

SEQ ID NO: 1787048 - RNA, 18 nt, Human
uucaguguuaaaugugau

SEQ ID NO: 1787049 - RNA, 22 nt, Human
uucaguguuaaaugugaugaau

SEQ ID NO: 1787050 - RNA, 18 nt, Human
uucaguguuaccugugug

SEQ ID NO: 1787051 - RNA, 22 nt, Human
uucaguguuaccugugugcuug

SEQ ID NO: 1787052 - RNA, 11 nt, Human
uuccagaaucc

SEQ ID NO: 1787053 - RNA, 22 nt, Human
uuccagacauucucgcuucccu

SEQ ID NO: 1787054 - RNA, 15 nt, Human
uuccauauccuggug

SEQ ID NO: 1787055 - RNA, 15 nt, Human
uuccagaucccaggc

SEQ ID NO: 1787056 - RNA, 22 nt, Human
uuccagaucccaggccccugga

SEQ ID NO: 1787057 - RNA, 15 nt, Human
uuccagauccucucu

SEQ ID NO: 1787058 - RNA, 16 nt, Human
uuccagauccucucug

SEQ ID NO: 1787059 - RNA, 18 nt, Human
uuccagauccucucuggg

SEQ ID NO: 1787060 - RNA, 15 nt, Human
uuccaaauaaaaugu

SEQ ID NO: 1787061 - RNA, 17 nt, Human
uuccaaauaaaauguuc

SEQ ID NO: 1787062 - RNA, 11 nt, Human
uuccaaagcaa

SEQ ID NO: 1787063 - RNA, 12 nt, Human
uuccaaagcaaa

SEQ ID NO: 1787064 - RNA, 22 nt, Human
uuccaaaaguggccucuuuguc

SEQ ID NO: 1787065 - RNA, 16 nt, Human
uuccaaaaguggccuc

SEQ ID NO: 1787066 - RNA, 17 nt, Human
uuccaaaaguggccucu

SEQ ID NO: 1787067 - RNA, 18 nt, Human
uuccaaaaguggccucuu

SEQ ID NO: 1787068 - RNA, 21 nt, Human
uuccaaaaguggccucuuugu

SEQ ID NO: 1787069 - RNA, 23 nt, Human
uucauuuuugauagcugucccau

SEQ ID NO: 1787070 - RNA, 14 nt, Human
uuauaauuuuccua

SEQ ID NO: 1787071 - RNA, 16 nt, Human
uuauaauuuuccuaau

SEQ ID NO: 1787072 - RNA, 15 nt, Human
uuauacaauaucauc

SEQ ID NO: 1787073 - RNA, 20 nt, Human
uuauauuaauaguaauuugu

SEQ ID NO: 1787074 - RNA, 12 nt, Human
uuauaauuuaaa

SEQ ID NO: 1787075 - RNA, 15 nt, Human
uuagugcuaagugug

SEQ ID NO: 1787076 - RNA, 12 nt, Human
uuagugcuaagu

SEQ ID NO: 1787077 - RNA, 14 nt, Human
uuauaagaaaaacu

SEQ ID NO: 1787078 - RNA, 16 nt, Human
uuauaagaaaaacuuu

SEQ ID NO: 1787079 - RNA, 17 nt, Human
uuauaagaaaaacuuuu

SEQ ID NO: 1787080 - RNA, 21 nt, Human
uuagugcuaagugugaacugg

SEQ ID NO: 1787081 - RNA, 20 nt, Human
uuagugcuaagugugaacug

SEQ ID NO: 1787082 - RNA, 19 nt, Human
uuagugcuaagugugaacu

SEQ ID NO: 1787083 - RNA, 17 nt, Human
uuagugcuaagugugaa

SEQ ID NO: 1787084 - RNA, 16 nt, Human
uuagugcuaaguguga

SEQ ID NO: 1787085 - RNA, 11 nt, Human
uuauuaaauag

SEQ ID NO: 1787086 - RNA, 16 nt, Human
uuauauuuacaaaugg

SEQ ID NO: 1787087 - RNA, 19 nt, Human
uuauccuaaaacaaauagu

SEQ ID NO: 1787088 - RNA, 20 nt, Human
uuauccucuuuagaguuaga

SEQ ID NO: 1787089 - RNA, 18 nt, Human
uuauccucuuuagaguua

SEQ ID NO: 1787090 - RNA, 17 nt, Human
uuauccucuuuagaguu

SEQ ID NO: 1787091 - RNA, 15 nt, Human
uuauccucuuuagag

SEQ ID NO: 1787092 - RNA, 14 nt, Human
uuauccucuuuaga

SEQ ID NO: 1787093 - RNA, 21 nt, Human
uuaucuccacaaccucuuccc

SEQ ID NO: 1787094 - RNA, 15 nt, Human
caaaauguaggguua

SEQ ID NO: 1787095 - RNA, 14 nt, Human
caaaauaaaacuuu

SEQ ID NO: 1787096 - RNA, 12 nt, Human
caaaauaaaacu

SEQ ID NO: 1787097 - RNA, 16 nt, Human
caaaauuguuacaaau

SEQ ID NO: 1787098 - RNA, 15 nt, Human
caaacacauacagga

SEQ ID NO: 1787099 - RNA, 20 nt, Human
caaacccuucagugccaaaa

SEQ ID NO: 1787100 - RNA, 15 nt, Human
caaagcuaggccugg

SEQ ID NO: 1787101 - RNA, 19 nt, Human
caaagcuaggccuggccag

SEQ ID NO: 1787102 - RNA, 14 nt, Human
caaagcuaggccug

SEQ ID NO: 1787103 - RNA, 13 nt, Human
caaagcuaggccu

SEQ ID NO: 1787104 - RNA, 12 nt, Human
caaaggaagcac

SEQ ID NO: 1787105 - RNA, 13 nt, Human
caaaggaagcaca

SEQ ID NO: 1787106 - RNA, 18 nt, Human
caaaggguaucaggugcu

SEQ ID NO: 1787107 - RNA, 16 nt, Human
caaaggguaucaggug

SEQ ID NO: 1787108 - RNA, 23 nt, Human
caaaggccuaauucuaugccugu

SEQ ID NO: 1787109 - RNA, 14 nt, Human
caaaggaagcacau

SEQ ID NO: 1787110 - RNA, 17 nt, Human
caaacucaccugccccu

SEQ ID NO: 1787111 - RNA, 17 nt, Human
caaagccuccuccagcc

SEQ ID NO: 1787112 - RNA, 18 nt, Human
caaagccuccuccagccg

SEQ ID NO: 1787113 - RNA, 11 nt, Human
caaauuucuaa

SEQ ID NO: 1787114 - RNA, 14 nt, Human
caaauuucuaaauc

SEQ ID NO: 1787115 - RNA, 12 nt, Human
caaauuucuaaa

SEQ ID NO: 1787116 - RNA, 21 nt, Human
caaauuguaagcaugcacaaa

SEQ ID NO: 1787117 - RNA, 19 nt, Human
caaaggguaucaggugcug

SEQ ID NO: 1787118 - RNA, 19 nt, Human
caaagugcugggauuacag

SEQ ID NO: 1787119 - RNA, 23 nt, Human
caaagugcugggauuacaggugu

SEQ ID NO: 1787120 - RNA, 20 nt, Human
caaagugcugggauuacagg

SEQ ID NO: 1787121 - RNA, 23 nt, Human
caaaacucuccucugcugcuggc

SEQ ID NO: 1787122 - RNA, 22 nt, Human
caaaacucuccucugcugcugg

SEQ ID NO: 1787123 - RNA, 20 nt, Human
caaaacucuccucugcugcu

SEQ ID NO: 1787124 - RNA, 21 nt, Human
caaaacucuccucugcugcug

SEQ ID NO: 1787125 - RNA, 17 nt, Human
caaaauaaaaaugaggu

SEQ ID NO: 1787126 - RNA, 23 nt, Human
caaaacuucagacauagaauuaa

SEQ ID NO: 1787127 - RNA, 22 nt, Human
caaaacaaaggccuaauucuau

SEQ ID NO: 1787128 - RNA, 16 nt, Human
caaaacaaaggccuaa

SEQ ID NO: 1787129 - RNA, 15 nt, Human
caaaacaaaggccua

SEQ ID NO: 1787130 - RNA, 12 nt, Human
caaaacaaaggc

SEQ ID NO: 1787131 - RNA, 20 nt, Human
caaaaacauggccuuugcuu

SEQ ID NO: 1787132 - RNA, 13 nt, Human
caaaaaggcagga

SEQ ID NO: 1787133 - RNA, 21 nt, Human
auuuugggguacccacugcuc

SEQ ID NO: 1787134 - RNA, 23 nt, Human
auuuugggguacccacugcucug

SEQ ID NO: 1787135 - RNA, 22 nt, Human
auuuugggguacccacugcucu

SEQ ID NO: 1787136 - RNA, 16 nt, Human
caaaaaaugcuugcuu

SEQ ID NO: 1787137 - RNA, 17 nt, Human
caagugagagcugggug

SEQ ID NO: 1787138 - RNA, 15 nt, Human
caagugagagcuggg

SEQ ID NO: 1787139 - RNA, 14 nt, Human
caagugagagcugg

SEQ ID NO: 1787140 - RNA, 21 nt, Human
caaguccucuuuucugagagg

SEQ ID NO: 1787141 - RNA, 18 nt, Human
caagugagagcugggugu

SEQ ID NO: 1787142 - RNA, 17 nt, Human
caagugauucucaugcc

SEQ ID NO: 1787143 - RNA, 18 nt, Human
caagugauucucaugccu

SEQ ID NO: 1787144 - RNA, 20 nt, Human
caagugauucucaugccuca

SEQ ID NO: 1787145 - RNA, 21 nt, Human
caagugauucucaugccucag

SEQ ID NO: 1787146 - RNA, 19 nt, Human
caaguggcucccacacccu

SEQ ID NO: 1787147 - RNA, 14 nt, Human
caaguuaaauaaau

SEQ ID NO: 1787148 - RNA, 14 nt, Human
caaguccucuuuuc

SEQ ID NO: 1787149 - RNA, 18 nt, Human
caaggguagggugggccu

SEQ ID NO: 1787150 - RNA, 20 nt, Human
caaggucauuuuuuuuaaga

SEQ ID NO: 1787151 - RNA, 14 nt, Human
caaggucauuuuuu

SEQ ID NO: 1787152 - RNA, 18 nt, Human
caaggggcccaaauucuu

SEQ ID NO: 1787153 - RNA, 17 nt, Human
caaggggcccaaauucu

SEQ ID NO: 1787154 - RNA, 12 nt, Human
caaggcugcagu

SEQ ID NO: 1787155 - RNA, 15 nt, Human
caaggcugcagugag

SEQ ID NO: 1787156 - RNA, 23 nt, Human
caaggcugucaauuacaggaagu

SEQ ID NO: 1787157 - RNA, 14 nt, Human
caagccagcuggag

SEQ ID NO: 1787158 - RNA, 18 nt, Human
caagcaggacauggacaa

SEQ ID NO: 1787159 - RNA, 14 nt, Human
caagcaggacaugg

SEQ ID NO: 1787160 - RNA, 22 nt, Human
caagcgauucuucugcuucagc

SEQ ID NO: 1787161 - RNA, 20 nt, Human
caagcgauucuucugcuuca

SEQ ID NO: 1787162 - RNA, 14 nt, Human
caagccuggcaagg

SEQ ID NO: 1787163 - RNA, 19 nt, Human
caagcgauucuucugcuuc

SEQ ID NO: 1787164 - RNA, 18 nt, Human
caagccguggcuucccgc

SEQ ID NO: 1787165 - RNA, 17 nt, Human
caaggcugauuaaacca

SEQ ID NO: 1787166 - RNA, 14 nt, Human
caaggagccaaaca

SEQ ID NO: 1787167 - RNA, 22 nt, Human
caaggacugcagggacugccag

SEQ ID NO: 1787168 - RNA, 19 nt, Human
caagcuggucccacucagu

SEQ ID NO: 1787169 - RNA, 17 nt, Human
caagcuggucccacuca

SEQ ID NO: 1787170 - RNA, 18 nt, Human
caaggacagccccuccuc

SEQ ID NO: 1787171 - RNA, 15 nt, Human
caaggacugcaggga

SEQ ID NO: 1787172 - RNA, 17 nt, Human
caagcaccuccugccuc

SEQ ID NO: 1787173 - RNA, 16 nt, Human
caagcaccuccugccu

SEQ ID NO: 1787174 - RNA, 15 nt, Human
caagcaccuccugcc

SEQ ID NO: 1787175 - RNA, 14 nt, Human
caagagggcacugg

SEQ ID NO: 1787176 - RNA, 15 nt, Human
caagagggcacuggu

SEQ ID NO: 1787177 - RNA, 13 nt, Human
caagagggcacug

SEQ ID NO: 1787178 - RNA, 16 nt, Human
caagagcccaggccuc

SEQ ID NO: 1787179 - RNA, 17 nt, Human
caagagcccaggccucc

SEQ ID NO: 1787180 - RNA, 19 nt, Human
caagacgcugugcugcccu

SEQ ID NO: 1787181 - RNA, 18 nt, Human
caagacgcugugcugccc

SEQ ID NO: 1787182 - RNA, 23 nt, Human
caagacgcugugcugcccugccc

SEQ ID NO: 1787183 - RNA, 14 nt, Human
caagagcccaggcc

SEQ ID NO: 1787184 - RNA, 15 nt, Human
caagagcccaggccu

SEQ ID NO: 1787185 - RNA, 18 nt, Human
caagacucuuuggacacu

SEQ ID NO: 1787186 - RNA, 19 nt, Human
caacugaccagccuccaug

SEQ ID NO: 1787187 - RNA, 20 nt, Human
caagaacuuuccaggaaggc

SEQ ID NO: 1787188 - RNA, 14 nt, Human
caagaccuucuccu

SEQ ID NO: 1787189 - RNA, 16 nt, Human
caagaccuucuccuuc

SEQ ID NO: 1787190 - RNA, 17 nt, Human
caagaccuucuccuuca

SEQ ID NO: 1787191 - RNA, 18 nt, Human
caagaccuucuccuucac

SEQ ID NO: 1787192 - RNA, 16 nt, Human
caagacgcugugcugc

SEQ ID NO: 1787193 - RNA, 17 nt, Human
caagacgcugugcugcc

SEQ ID NO: 1787194 - RNA, 22 nt, Human
caacacucacauuuauucugcu

SEQ ID NO: 1787195 - RNA, 18 nt, Human
caacacucauugaccuga

SEQ ID NO: 1787196 - RNA, 20 nt, Human
caacacucauugaccugagg

SEQ ID NO: 1787197 - RNA, 22 nt, Human
caacacucauugaccugaggcc

SEQ ID NO: 1787198 - RNA, 22 nt, Human
caaccccuucgcuccugugucu

SEQ ID NO: 1787199 - RNA, 17 nt, Human
caacccuggcacccagg

SEQ ID NO: 1787200 - RNA, 13 nt, Human
caacccucagagc

SEQ ID NO: 1787201 - RNA, 15 nt, Human
caacugaccagccuc

SEQ ID NO: 1787202 - RNA, 17 nt, Human
caacugaccagccucca

SEQ ID NO: 1787203 - RNA, 13 nt, Human
caacgucugugcc

SEQ ID NO: 1787204 - RNA, 14 nt, Human
caacgucugugcca

SEQ ID NO: 1787205 - RNA, 20 nt, Human
caaccuguucugcuuuccuc

SEQ ID NO: 1787206 - RNA, 19 nt, Human
caaccuucgccaccugggu

SEQ ID NO: 1787207 - RNA, 14 nt, Human
caaccuccugggcu

SEQ ID NO: 1787208 - RNA, 15 nt, Human
caaccuccugggcua

SEQ ID NO: 1787209 - RNA, 12 nt, Human
caauaggaaaaa

SEQ ID NO: 1787210 - RNA, 13 nt, Human
caauaggaaaaac

SEQ ID NO: 1787211 - RNA, 17 nt, Human
caauauucgcuguguca

SEQ ID NO: 1787212 - RNA, 15 nt, Human
caauauuguacaguu

SEQ ID NO: 1787213 - RNA, 14 nt, Human
caauauuguacagu

SEQ ID NO: 1787214 - RNA, 23 nt, Human
caaugaccuuucaauaggaaaaa

SEQ ID NO: 1787215 - RNA, 18 nt, Human
caaugacuuacuguacau

SEQ ID NO: 1787216 - RNA, 17 nt, Human
caaugacuuacuguaca

SEQ ID NO: 1787217 - RNA, 15 nt, Human
caaugacuuacugua

SEQ ID NO: 1787218 - RNA, 23 nt, Human
caauucucauuugucacacacuu

SEQ ID NO: 1787219 - RNA, 13 nt, Human
caauucuccugcc

SEQ ID NO: 1787220 - RNA, 16 nt, Human
caauuacaggaaguac

SEQ ID NO: 1787221 - RNA, 14 nt, Human
caauucuccugccu

SEQ ID NO: 1787222 - RNA, 15 nt, Human
caauucuccugccuc

SEQ ID NO: 1787223 - RNA, 16 nt, Human
caauucuccugccuca

SEQ ID NO: 1787224 - RNA, 15 nt, Human
caaugugauaaaacc

SEQ ID NO: 1787225 - RNA, 17 nt, Human
caaugugauaaaacccc

SEQ ID NO: 1787226 - RNA, 17 nt, Human
caaugcacuuuguucug

SEQ ID NO: 1787227 - RNA, 22 nt, Human
caaugcacuuuguucuggcucu

SEQ ID NO: 1787228 - RNA, 20 nt, Human
caaugcacuuuguucuggcu

SEQ ID NO: 1787229 - RNA, 21 nt, Human
caaugcacuuuguucuggcuc

SEQ ID NO: 1787230 - RNA, 14 nt, Human
caauguucucucuu

SEQ ID NO: 1787231 - RNA, 14 nt, Human
caauaggaaaaacu

SEQ ID NO: 1787232 - RNA, 21 nt, Human
cacauagugaugguuccccug

SEQ ID NO: 1787233 - RNA, 22 nt, Human
cacagcuucauuuccugugucu

SEQ ID NO: 1787234 - RNA, 21 nt, Human
cacagcuucauuuccuguguc

SEQ ID NO: 1787235 - RNA, 22 nt, Human
cacagcugggguggggaccuca

SEQ ID NO: 1787236 - RNA, 23 nt, Human
cacagcugggguggggaccucag

SEQ ID NO: 1787237 - RNA, 15 nt, Human
cacaggcagguccag

SEQ ID NO: 1787238 - RNA, 14 nt, Human
cacaggcaggucca

SEQ ID NO: 1787239 - RNA, 11 nt, Human
cacaggcaggu

SEQ ID NO: 1787240 - RNA, 19 nt, Human
cacaggagggagggggaag

SEQ ID NO: 1787241 - RNA, 21 nt, Human
cacaggagggagggggaaggc

SEQ ID NO: 1787242 - RNA, 14 nt, Human
cacaggagggaggg

SEQ ID NO: 1787243 - RNA, 17 nt, Human
cacagugcaucucagcc

SEQ ID NO: 1787244 - RNA, 14 nt, Human
cacaguucucuccu

SEQ ID NO: 1787245 - RNA, 15 nt, Human
cacaguucucuccuu

SEQ ID NO: 1787246 - RNA, 22 nt, Human
cacagugagucgaggacaggga

SEQ ID NO: 1787247 - RNA, 19 nt, Human
cacaggcagguccaggguu

SEQ ID NO: 1787248 - RNA, 14 nt, Human
cacagugcaucuca

SEQ ID NO: 1787249 - RNA, 13 nt, Human
cacaguccuuacc

SEQ ID NO: 1787250 - RNA, 15 nt, Human
cacaguccuuaccag

SEQ ID NO: 1787251 - RNA, 21 nt, Human
cacaguccuuaccagcagagc

SEQ ID NO: 1787252 - RNA, 22 nt, Human
cacaguccuuaccagcagagca

SEQ ID NO: 1787253 - RNA, 22 nt, Human
uuuuuagacagagucucacugu

SEQ ID NO: 1787254 - RNA, 11 nt, Human
uuuuuacuaau

SEQ ID NO: 1787255 - RNA, 12 nt, Human
uuuuuaucaugu

SEQ ID NO: 1787256 - RNA, 20 nt, Human
uuuuuaucgucacugcuuaa

SEQ ID NO: 1787257 - RNA, 12 nt, Human
uuuuuauggcuu

SEQ ID NO: 1787258 - RNA, 23 nt, Human
uuuuuauacauaaacaagaccac

SEQ ID NO: 1787259 - RNA, 15 nt, Human
uuuuguuccacaagu

SEQ ID NO: 1787260 - RNA, 21 nt, Human
uuuuguuccacaaguuaaaua

SEQ ID NO: 1787261 - RNA, 19 nt, Human
uuuuguuucauauugaugu

SEQ ID NO: 1787262 - RNA, 12 nt, Human
uuuuguuucaua

SEQ ID NO: 1787263 - RNA, 14 nt, Human
uuuugcuguagaag

SEQ ID NO: 1787264 - RNA, 13 nt, Human
uuuugcuguagaa

SEQ ID NO: 1787265 - RNA, 21 nt, Human
uuuugugaugucccaacuugu

SEQ ID NO: 1787266 - RNA, 20 nt, Human
uuuugugcauuaucuagaua

SEQ ID NO: 1787267 - RNA, 17 nt, Human
uuuugugcauuaucuag

SEQ ID NO: 1787268 - RNA, 23 nt, Human
uuuugugcauuaucuagauacug

SEQ ID NO: 1787269 - RNA, 17 nt, Human
uuuugauccaagcuggu

SEQ ID NO: 1787270 - RNA, 17 nt, Human
uuuugagugccuuacac

SEQ ID NO: 1787271 - RNA, 23 nt, Human
uuuugccauguuggccaggcugg

SEQ ID NO: 1787272 - RNA, 18 nt, Human
uuuugauguaaagauguu

SEQ ID NO: 1787273 - RNA, 16 nt, Human
uuuugauguaaagaug

SEQ ID NO: 1787274 - RNA, 19 nt, Human
uuuuugugaaaagcuccau

SEQ ID NO: 1787275 - RNA, 20 nt, Human
uuuuuguagagccagggucu

SEQ ID NO: 1787276 - RNA, 19 nt, Human
uuuuuguagagccaggguc

SEQ ID NO: 1787277 - RNA, 22 nt, Human
uuuuuauggcuuuugugcauua

SEQ ID NO: 1787278 - RNA, 21 nt, Human
uuuuuauggcuuuugugcauu

SEQ ID NO: 1787279 - RNA, 20 nt, Human
uuuuuauggcuuuugugcau

SEQ ID NO: 1787280 - RNA, 20 nt, Human
auuaaguuguuaauaaaagu

SEQ ID NO: 1787281 - RNA, 19 nt, Human
auuaaguuguuaauaaaag

SEQ ID NO: 1787282 - RNA, 14 nt, Human
auuaaguacuaugu

SEQ ID NO: 1787283 - RNA, 14 nt, Human
auuaaguuguuaau

SEQ ID NO: 1787284 - RNA, 16 nt, Human
auuaaguacuauguau

SEQ ID NO: 1787285 - RNA, 17 nt, Human
auguuuaguaaucauau

SEQ ID NO: 1787286 - RNA, 23 nt, Human
auuaaaacacaacaucuuuuucu

SEQ ID NO: 1787287 - RNA, 22 nt, Human
auuaaaaaucucaaauuucuaa

SEQ ID NO: 1787288 - RNA, 20 nt, Human
auuaaaaaucucaaauuucu

SEQ ID NO: 1787289 - RNA, 19 nt, Human
auuaaaaaucucaaauuuc

SEQ ID NO: 1787290 - RNA, 15 nt, Human
auuaaaaaucucaaa

SEQ ID NO: 1787291 - RNA, 14 nt, Human
uuuucaguuuucag

SEQ ID NO: 1787292 - RNA, 12 nt, Human
uuuucaguuuuc

SEQ ID NO: 1787293 - RNA, 11 nt, Human
uuuuauuuuau

SEQ ID NO: 1787294 - RNA, 20 nt, Human
uuuuaggccaaaaaaaugua

SEQ ID NO: 1787295 - RNA, 13 nt, Human
uuuuauuaugcau

SEQ ID NO: 1787296 - RNA, 20 nt, Human
uuuucauuuaggugaggaag

SEQ ID NO: 1787297 - RNA, 21 nt, Human
auguuaaacuuacuuaguguu

SEQ ID NO: 1787298 - RNA, 12 nt, Human
auguugcccagg

SEQ ID NO: 1787299 - RNA, 17 nt, Human
auguugcccaggcaggu

SEQ ID NO: 1787300 - RNA, 17 nt, Human
auguugcauagaauaaa

SEQ ID NO: 1787301 - RNA, 18 nt, Human
auguugcauagaauaaaa

SEQ ID NO: 1787302 - RNA, 18 nt, Human
auguucaucaaugaauga

SEQ ID NO: 1787303 - RNA, 20 nt, Human
auguugcccaggcaggucuu

SEQ ID NO: 1787304 - RNA, 20 nt, Human
auguugcccuguugcugccu

SEQ ID NO: 1787305 - RNA, 22 nt, Human
augugccagguuuuuggucuga

SEQ ID NO: 1787306 - RNA, 14 nt, Human
uuuuaauaaacacu

SEQ ID NO: 1787307 - RNA, 20 nt, Human
auggggcccugccuccuuug

SEQ ID NO: 1787308 - RNA, 12 nt, Human
augugugugugc

SEQ ID NO: 1787309 - RNA, 23 nt, Human
auguguguuuuaaaaugagaaau

SEQ ID NO: 1787310 - RNA, 24 nt, Human
auguggaguucaucuugaauugua

SEQ ID NO: 1787311 - RNA, 20 nt, Human
auguggaguucaucuugaau

SEQ ID NO: 1787312 - RNA, 15 nt, Human
auucccaagcucugc

SEQ ID NO: 1787313 - RNA, 14 nt, Human
auucccaagcucug

SEQ ID NO: 1787314 - RNA, 16 nt, Human
auucccaagcucugcu

SEQ ID NO: 1787315 - RNA, 15 nt, Human
auucaguaauaacuc

SEQ ID NO: 1787316 - RNA, 19 nt, Human
auucaguaauaacucuacc

SEQ ID NO: 1787317 - RNA, 20 nt, Human
auucaggaagcucagggccu

SEQ ID NO: 1787318 - RNA, 17 nt, Human
auucaggaagcucaggg

SEQ ID NO: 1787319 - RNA, 19 nt, Human
auucaggaagcucagggcc

SEQ ID NO: 1787320 - RNA, 17 nt, Human
auucagaguugaugguu

SEQ ID NO: 1787321 - RNA, 14 nt, Human
auucaggaagcuca

SEQ ID NO: 1787322 - RNA, 13 nt, Human
auucuccugccuc

SEQ ID NO: 1787323 - RNA, 14 nt, Human
auucuccugccuca

SEQ ID NO: 1787324 - RNA, 11 nt, Human
auucuccugcc

SEQ ID NO: 1787325 - RNA, 12 nt, Human
auucuccugccu

SEQ ID NO: 1787326 - RNA, 21 nt, Human
auucuccaccugccagggaca

SEQ ID NO: 1787327 - RNA, 17 nt, Human
auucuccugccucagcc

SEQ ID NO: 1787328 - RNA, 15 nt, Human
auucuccugccucag

SEQ ID NO: 1787329 - RNA, 19 nt, Human
auucuccugccucagccuc

SEQ ID NO: 1787330 - RNA, 20 nt, Human
auucuccugccucagccucc

SEQ ID NO: 1787331 - RNA, 18 nt, Human
auucuccugccucagccu

SEQ ID NO: 1787332 - RNA, 16 nt, Human
auucuccuuguguuac

SEQ ID NO: 1787333 - RNA, 14 nt, Human
auucucaugccuca

SEQ ID NO: 1787334 - RNA, 15 nt, Human
auucucaugccucag

SEQ ID NO: 1787335 - RNA, 19 nt, Human
auucuccaccugccaggga

SEQ ID NO: 1787336 - RNA, 20 nt, Human
auucuccaccugccagggac

SEQ ID NO: 1787337 - RNA, 12 nt, Human
auugaaaucuuu

SEQ ID NO: 1787338 - RNA, 20 nt, Human
auuuccagugaaaucaguua

SEQ ID NO: 1787339 - RNA, 22 nt, Human
auuucauuugugccagaaugcu

SEQ ID NO: 1787340 - RNA, 17 nt, Human
auuuccagccaaagccu

SEQ ID NO: 1787341 - RNA, 16 nt, Human
auuucaaacggccuca

SEQ ID NO: 1787342 - RNA, 14 nt, Human
auuugaaaauuuug

SEQ ID NO: 1787343 - RNA, 15 nt, Human
auuugaaaauuuuga

SEQ ID NO: 1787344 - RNA, 16 nt, Human
auuuccguuaaaauac

SEQ ID NO: 1787345 - RNA, 15 nt, Human
auuuccguuaaaaua

SEQ ID NO: 1787346 - RNA, 13 nt, Human
auuuauucugcuc

SEQ ID NO: 1787347 - RNA, 17 nt, Human
auuuauaaaaauaaaaa

SEQ ID NO: 1787348 - RNA, 22 nt, Human
auuuauaaaaauaaaaaacacu

SEQ ID NO: 1787349 - RNA, 13 nt, Human
auuuaguguucau

SEQ ID NO: 1787350 - RNA, 20 nt, Human
auuuaguaucuuuuuauuca

SEQ ID NO: 1787351 - RNA, 12 nt, Human
auuuaacagaaa

SEQ ID NO: 1787352 - RNA, 14 nt, Human
auuuaacagaaaug

SEQ ID NO: 1787353 - RNA, 17 nt, Human
auuuacuucuuauacau

SEQ ID NO: 1787354 - RNA, 14 nt, Human
auuuacuucuuaua

SEQ ID NO: 1787355 - RNA, 16 nt, Human
auuuacuucuuauaca

SEQ ID NO: 1787356 - RNA, 15 nt, Human
auuuagaaauauaau

SEQ ID NO: 1787357 - RNA, 14 nt, Human
auuuauucugcuca

SEQ ID NO: 1787358 - RNA, 18 nt, Human
auugugucucuugguccu

SEQ ID NO: 1787359 - RNA, 14 nt, Human
auugugucucuugg

SEQ ID NO: 1787360 - RNA, 13 nt, Human
auuguauucagag

SEQ ID NO: 1787361 - RNA, 19 nt, Human
auugguguaagguacuuuc

SEQ ID NO: 1787362 - RNA, 17 nt, Human
auuguccccgacccuug

SEQ ID NO: 1787363 - RNA, 19 nt, Human
auuguccccgacccuugcc

SEQ ID NO: 1787364 - RNA, 20 nt, Human
auuguccccgacccuugccg

SEQ ID NO: 1787365 - RNA, 17 nt, Human
auucuccuuguguuacu

SEQ ID NO: 1787366 - RNA, 24 nt, Human
auucugucucuggauuauauuaug

SEQ ID NO: 1787367 - RNA, 22 nt, Human
auucuuccucccucccucuuuc

SEQ ID NO: 1787368 - RNA, 13 nt, Human
auucuucuccacu

SEQ ID NO: 1787369 - RNA, 13 nt, Human
auucuuauuuaau

SEQ ID NO: 1787370 - RNA, 14 nt, Human
auucuuauuuaaug

SEQ ID NO: 1787371 - RNA, 18 nt, Human
auucuuauuuaaugaaag

SEQ ID NO: 1787372 - RNA, 18 nt, Human
auugacccacaagaaaug

SEQ ID NO: 1787373 - RNA, 21 nt, Human
auuuuauuuuuuucugaauua

SEQ ID NO: 1787374 - RNA, 18 nt, Human
auuuucaacgcagcccug

SEQ ID NO: 1787375 - RNA, 20 nt, Human
auuuucaacgcagcccugcu

SEQ ID NO: 1787376 - RNA, 22 nt, Human
auuuucaguuauuauauuuaca

SEQ ID NO: 1787377 - RNA, 16 nt, Human
auuuuacuuuuuccug

SEQ ID NO: 1787378 - RNA, 17 nt, Human
auuuuacuuuuuccugg

SEQ ID NO: 1787379 - RNA, 17 nt, Human
auuuuaccuuugacaaa

SEQ ID NO: 1787380 - RNA, 15 nt, Human
auuuuaauucaguug

SEQ ID NO: 1787381 - RNA, 15 nt, Human
auuuuaaacagagga

SEQ ID NO: 1787382 - RNA, 23 nt, Human
auuugugaagguggaaauaaacu

SEQ ID NO: 1787383 - RNA, 14 nt, Human
auuugugauacaau

SEQ ID NO: 1787384 - RNA, 17 nt, Human
uugcugauggugcaaug

SEQ ID NO: 1787385 - RNA, 18 nt, Human
uugcugauggugcaauga

SEQ ID NO: 1787386 - RNA, 19 nt, Human
uugcugauggugcaaugac

SEQ ID NO: 1787387 - RNA, 17 nt, Human
uuggaaagaguaggaag

SEQ ID NO: 1787388 - RNA, 16 nt, Human
uugcuuuuaaaaucca

SEQ ID NO: 1787389 - RNA, 19 nt, Human
uugcugaauacagaggcaa

SEQ ID NO: 1787390 - RNA, 20 nt, Human
uugcuaagugaggaugaaaa

SEQ ID NO: 1787391 - RNA, 14 nt, Human
augaaaugagguca

SEQ ID NO: 1787392 - RNA, 19 nt, Human
augaaagauggcugugccu

SEQ ID NO: 1787393 - RNA, 20 nt, Human
augaaagauggcugugccuc

SEQ ID NO: 1787394 - RNA, 23 nt, Human
augaaagauggcugugccucugc

SEQ ID NO: 1787395 - RNA, 20 nt, Human
augaaagacuguacaaagua

SEQ ID NO: 1787396 - RNA, 22 nt, Human
uuggcgcugccccuggcagccc

SEQ ID NO: 1787397 - RNA, 16 nt, Human
uuggcugcugaaggcu

SEQ ID NO: 1787398 - RNA, 13 nt, Human
aucuuucugcaga

SEQ ID NO: 1787399 - RNA, 14 nt, Human
uuggcugcagggag

SEQ ID NO: 1787400 - RNA, 23 nt, Human
uuggcuauuagagaucaaccccu

SEQ ID NO: 1787401 - RNA, 11 nt, Human
uuggcugcuga

SEQ ID NO: 1787402 - RNA, 15 nt, Human
uuggcugcugaaggc

SEQ ID NO: 1787403 - RNA, 22 nt, Human
uuggcuaggaccccuccaugug

SEQ ID NO: 1787404 - RNA, 22 nt, Human
uuggcuagagguucaaagauau

SEQ ID NO: 1787405 - RNA, 21 nt, Human
uuggcuagagguucaaagaua

SEQ ID NO: 1787406 - RNA, 18 nt, Human
uuggaaagaguaggaaga

SEQ ID NO: 1787407 - RNA, 23 nt, Human
uuggaaagaguaggaagacuuug

SEQ ID NO: 1787408 - RNA, 15 nt, Human
augacaggccugucc

SEQ ID NO: 1787409 - RNA, 20 nt, Human
augacacgaauauugcugau

SEQ ID NO: 1787410 - RNA, 19 nt, Human
augacacgaauauugcuga

SEQ ID NO: 1787411 - RNA, 13 nt, Human
uuguaaugaaaac

SEQ ID NO: 1787412 - RNA, 20 nt, Human
uuguaaggaaugauuaauua

SEQ ID NO: 1787413 - RNA, 22 nt, Human
uugggguacccacugcucuggu

SEQ ID NO: 1787414 - RNA, 19 nt, Human
uugguuaggcauuguggga

SEQ ID NO: 1787415 - RNA, 21 nt, Human
uuguaacuaaaauaauuuugu

SEQ ID NO: 1787416 - RNA, 18 nt, Human
uuguaacuaaaauaauuu

SEQ ID NO: 1787417 - RNA, 17 nt, Human
uuguaacuaaaauaauu

SEQ ID NO: 1787418 - RNA, 23 nt, Human
uuguaacuaaaauaauuuuguaa

SEQ ID NO: 1787419 - RNA, 22 nt, Human
uuguaacuaaaauaauuuugua

SEQ ID NO: 1787420 - RNA, 14 nt, Human
uuguaaggaaugau

SEQ ID NO: 1787421 - RNA, 13 nt, Human
augaaccacaucu

SEQ ID NO: 1787422 - RNA, 20 nt, Human
augaaccacaucuugcucug

SEQ ID NO: 1787423 - RNA, 17 nt, Human
uugggguacccacugcu

SEQ ID NO: 1787424 - RNA, 19 nt, Human
uuggggaagaacgaagcca

SEQ ID NO: 1787425 - RNA, 15 nt, Human
augaucacggcucac

SEQ ID NO: 1787426 - RNA, 19 nt, Human
augaucacggcucacugca

SEQ ID NO: 1787427 - RNA, 18 nt, Human
augaucacggcucacugc

SEQ ID NO: 1787428 - RNA, 23 nt, Human
augaucacggcucacugcagccu

SEQ ID NO: 1787429 - RNA, 16 nt, Human
augauccuaggcauuu

SEQ ID NO: 1787430 - RNA, 15 nt, Human
augaucuaggaagac

SEQ ID NO: 1787431 - RNA, 15 nt, Human
augauccuaaugaau

SEQ ID NO: 1787432 - RNA, 14 nt, Human
augaucuucuuuau

SEQ ID NO: 1787433 - RNA, 17 nt, Human
uugugaagguggaaaua

SEQ ID NO: 1787434 - RNA, 18 nt, Human
uugugaagguggaaauaa

SEQ ID NO: 1787435 - RNA, 18 nt, Human
uuguuuuuuuuuuccacu

SEQ ID NO: 1787436 - RNA, 19 nt, Human
augcaccuggaauauauaa

SEQ ID NO: 1787437 - RNA, 17 nt, Human
uuuaaaaaauuaaucug

SEQ ID NO: 1787438 - RNA, 19 nt, Human
uuguuuuuuuuuuccacuu

SEQ ID NO: 1787439 - RNA, 22 nt, Human
augcaaggucauuuuuuuuaag

SEQ ID NO: 1787440 - RNA, 14 nt, Human
augcaccuggaaua

SEQ ID NO: 1787441 - RNA, 16 nt, Human
augcaccuggaauaua

SEQ ID NO: 1787442 - RNA, 22 nt, Human
augcaaacuuuauuuuguguuu

SEQ ID NO: 1787443 - RNA, 16 nt, Human
augcaaggucauuuuu

SEQ ID NO: 1787444 - RNA, 14 nt, Human
augcaaggucauuu

SEQ ID NO: 1787445 - RNA, 15 nt, Human
augaucuucuuuaua

SEQ ID NO: 1787446 - RNA, 18 nt, Human
augaucuucuuuauaauu

SEQ ID NO: 1787447 - RNA, 16 nt, Human
augcaaaccaucauug

SEQ ID NO: 1787448 - RNA, 18 nt, Human
augcaaaccaucauugaa

SEQ ID NO: 1787449 - RNA, 19 nt, Human
augcaaaccaucauugaaa

SEQ ID NO: 1787450 - RNA, 20 nt, Human
augcaaaccaucauugaaau

SEQ ID NO: 1787451 - RNA, 21 nt, Human
augcaaaccaucauugaaauc

SEQ ID NO: 1787452 - RNA, 22 nt, Human
augcaaaccaucauugaaaucu

SEQ ID NO: 1787453 - RNA, 13 nt, Human
uugugaaauuauu

SEQ ID NO: 1787454 - RNA, 18 nt, Human
uugucacacacuuuggcu

SEQ ID NO: 1787455 - RNA, 15 nt, Human
augauaaaacacaaa

SEQ ID NO: 1787456 - RNA, 19 nt, Human
augagccucagcauccugg

SEQ ID NO: 1787457 - RNA, 18 nt, Human
augagccucagcauccug

SEQ ID NO: 1787458 - RNA, 17 nt, Human
augagccucagcauccu

SEQ ID NO: 1787459 - RNA, 12 nt, Human
augagaggaaau

SEQ ID NO: 1787460 - RNA, 13 nt, Human
augagaggaaauc

SEQ ID NO: 1787461 - RNA, 16 nt, Human
augagaggaaaucacc

SEQ ID NO: 1787462 - RNA, 14 nt, Human
augagaggaaauca

SEQ ID NO: 1787463 - RNA, 15 nt, Human
augagaggaaaucac

SEQ ID NO: 1787464 - RNA, 16 nt, Human
augagccucagcaucc

SEQ ID NO: 1787465 - RNA, 15 nt, Human
augagccucagcauc

SEQ ID NO: 1787466 - RNA, 12 nt, Human
augagccucagc

SEQ ID NO: 1787467 - RNA, 21 nt, Human
augagccaccgcgcccagccu

SEQ ID NO: 1787468 - RNA, 18 nt, Human
augagccaccgcgcccag

SEQ ID NO: 1787469 - RNA, 22 nt, Human
augagcaucaggccaggcccuc

SEQ ID NO: 1787470 - RNA, 15 nt, Human
augagcaucaggcca

SEQ ID NO: 1787471 - RNA, 16 nt, Human
augagcaucaggccag

SEQ ID NO: 1787472 - RNA, 17 nt, Human
augagcaucaggccagg

SEQ ID NO: 1787473 - RNA, 18 nt, Human
augagcaucaggccaggc

SEQ ID NO: 1787474 - RNA, 19 nt, Human
augagcaucaggccaggcc

SEQ ID NO: 1787475 - RNA, 20 nt, Human
augagcaucaggccaggccc

SEQ ID NO: 1787476 - RNA, 21 nt, Human
augagcaucaggccaggcccu

SEQ ID NO: 1787477 - RNA, 22 nt, Human
uuucucauuugccaauaauaau

SEQ ID NO: 1787478 - RNA, 14 nt, Human
uuucugccgcagcc

SEQ ID NO: 1787479 - RNA, 16 nt, Human
uuucugccgcagcccu

SEQ ID NO: 1787480 - RNA, 16 nt, Human
uuucucaaagaaauuu

SEQ ID NO: 1787481 - RNA, 15 nt, Human
uuucucaaagaaauu

SEQ ID NO: 1787482 - RNA, 14 nt, Human
uuucucaaagaaau

SEQ ID NO: 1787483 - RNA, 21 nt, Human
uuucuaugacacaugcaaggu

SEQ ID NO: 1787484 - RNA, 15 nt, Human
uuucuaugacacaug

SEQ ID NO: 1787485 - RNA, 13 nt, Human
uuucuuuguggcu

SEQ ID NO: 1787486 - RNA, 21 nt, Human
uuucuuuaguuuuugugaagu

SEQ ID NO: 1787487 - RNA, 22 nt, Human
uuugaaaccccuguaggccuca

SEQ ID NO: 1787488 - RNA, 17 nt, Human
uuugaaacacuuugcau

SEQ ID NO: 1787489 - RNA, 19 nt, Human
uuugaaacacuuugcauaa

SEQ ID NO: 1787490 - RNA, 17 nt, Human
auggggaggacaaaaug

SEQ ID NO: 1787491 - RNA, 13 nt, Human
auggggaggacaa

SEQ ID NO: 1787492 - RNA, 14 nt, Human
auggggcccugccu

SEQ ID NO: 1787493 - RNA, 13 nt, Human
auggggcccugcc

SEQ ID NO: 1787494 - RNA, 16 nt, Human
uuugaaauauggucuu

SEQ ID NO: 1787495 - RNA, 23 nt, Human
augggcuggguucuacccaggug

SEQ ID NO: 1787496 - RNA, 15 nt, Human
augggccuccugugu

SEQ ID NO: 1787497 - RNA, 15 nt, Human
augggcagagcagag

SEQ ID NO: 1787498 - RNA, 13 nt, Human
augggcagagcag

SEQ ID NO: 1787499 - RNA, 14 nt, Human
augggcagagcaga

SEQ ID NO: 1787500 - RNA, 21 nt, Human
augggcaacccccagccugcu

SEQ ID NO: 1787501 - RNA, 19 nt, Human
augggcaacccccagccug

SEQ ID NO: 1787502 - RNA, 13 nt, Human
augggagcucaug

SEQ ID NO: 1787503 - RNA, 15 nt, Human
augggacuggccucu

SEQ ID NO: 1787504 - RNA, 21 nt, Human
auggacccaauauuuaccaga

SEQ ID NO: 1787505 - RNA, 18 nt, Human
auggccucuucagaucuc

SEQ ID NO: 1787506 - RNA, 18 nt, Human
uuucgcaggauucuuccu

SEQ ID NO: 1787507 - RNA, 22 nt, Human
uuucgcaggauucuuccucccu

SEQ ID NO: 1787508 - RNA, 21 nt, Human
uuuccuuuuaaaacacuucca

SEQ ID NO: 1787509 - RNA, 23 nt, Human
uuuccuucauucaacccaccugc

SEQ ID NO: 1787510 - RNA, 18 nt, Human
uuuccuucagugccuuau

SEQ ID NO: 1787511 - RNA, 21 nt, Human
uuuccuucagugccuuaugga

SEQ ID NO: 1787512 - RNA, 22 nt, Human
uuuccuucagugccuuauggaa

SEQ ID NO: 1787513 - RNA, 21 nt, Human
uuuccuucauucaacccaccu

SEQ ID NO: 1787514 - RNA, 12 nt, Human
uuuccugugucu

SEQ ID NO: 1787515 - RNA, 17 nt, Human
augggccuccugugugu

SEQ ID NO: 1787516 - RNA, 19 nt, Human
uuuccuuaaauuaucuaaa

SEQ ID NO: 1787517 - RNA, 11 nt, Human
uuuccuucagu

SEQ ID NO: 1787518 - RNA, 12 nt, Human
uuuccuucagug

SEQ ID NO: 1787519 - RNA, 15 nt, Human
uuuccuucagugccu

SEQ ID NO: 1787520 - RNA, 13 nt, Human
uuuagauaauaca

SEQ ID NO: 1787521 - RNA, 18 nt, Human
uuuagaguugauacuaca

SEQ ID NO: 1787522 - RNA, 15 nt, Human
uuuagauaauacacc

SEQ ID NO: 1787523 - RNA, 19 nt, Human
uuuauuaaauguagaaagu

SEQ ID NO: 1787524 - RNA, 19 nt, Human
uuuauuaaaugcccagccc

SEQ ID NO: 1787525 - RNA, 14 nt, Human
uuuaugugaaacau

SEQ ID NO: 1787526 - RNA, 15 nt, Human
uuuaugugaaacaug

SEQ ID NO: 1787527 - RNA, 18 nt, Human
augcuacacacugcaugu

SEQ ID NO: 1787528 - RNA, 17 nt, Human
augcuacacacugcaug

SEQ ID NO: 1787529 - RNA, 20 nt, Human
uuuaccuuuuuuauacauaa

SEQ ID NO: 1787530 - RNA, 19 nt, Human
uuuaccuuuuuuauacaua

SEQ ID NO: 1787531 - RNA, 14 nt, Human
uuuaccuuuuuuau

SEQ ID NO: 1787532 - RNA, 18 nt, Human
uuuacuaauagacaauuu

SEQ ID NO: 1787533 - RNA, 17 nt, Human
uuuacuaauagacaauu

SEQ ID NO: 1787534 - RNA, 14 nt, Human
uuuacuaauagaca

SEQ ID NO: 1787535 - RNA, 21 nt, Human
uuuaccuuuuuuauacauaaa

SEQ ID NO: 1787536 - RNA, 13 nt, Human
augcuaagugaaa

SEQ ID NO: 1787537 - RNA, 23 nt, Human
augcgcaggcuggcccugcccug

SEQ ID NO: 1787538 - RNA, 17 nt, Human
uuuaaagaaaaguuuug

SEQ ID NO: 1787539 - RNA, 15 nt, Human
uuuaaagaaaaguuu

SEQ ID NO: 1787540 - RNA, 13 nt, Human
uuuaaagaaaagu

SEQ ID NO: 1787541 - RNA, 21 nt, Human
uuuaaagaaaaguuuuguaaa

SEQ ID NO: 1787542 - RNA, 18 nt, Human
auggaacacucugagacu

SEQ ID NO: 1787543 - RNA, 17 nt, Human
auggaacacucugagac

SEQ ID NO: 1787544 - RNA, 21 nt, Human
auggaaguacuauaauuuacc

SEQ ID NO: 1787545 - RNA, 14 nt, Human
auggaauaacaugu

SEQ ID NO: 1787546 - RNA, 15 nt, Human
auggaauaacaugua

SEQ ID NO: 1787547 - RNA, 13 nt, Human
uuuauuuuuuggg

SEQ ID NO: 1787548 - RNA, 22 nt, Human
augcuggcuguuggcugggggc

SEQ ID NO: 1787549 - RNA, 19 nt, Human
augcugugcccuaaagugu

SEQ ID NO: 1787550 - RNA, 14 nt, Human
augcuguauauguu

SEQ ID NO: 1787551 - RNA, 19 nt, Human
uuuccagguuuaagcuguu

SEQ ID NO: 1787552 - RNA, 24 nt, Human
uuucacucuuauugcccacgcugg

SEQ ID NO: 1787553 - RNA, 15 nt, Human
uuucacucuccuugg

SEQ ID NO: 1787554 - RNA, 24 nt, Human
uuucacugcuggcugccuuagaac

SEQ ID NO: 1787555 - RNA, 15 nt, Human
uuucaguuuucagga

SEQ ID NO: 1787556 - RNA, 12 nt, Human
uuucauaaagca

SEQ ID NO: 1787557 - RNA, 16 nt, Human
uuuauuuuuugggaaa

SEQ ID NO: 1787558 - RNA, 17 nt, Human
uuuauuuuuuucugaau

SEQ ID NO: 1787559 - RNA, 14 nt, Human
uuucacucuccuug

SEQ ID NO: 1787560 - RNA, 20 nt, Human
uucauaucuauuuauuaaau

SEQ ID NO: 1787561 - RNA, 22 nt, Human
uucauauuuuaaacagaggaua

SEQ ID NO: 1787562 - RNA, 14 nt, Human
uucaguaagccgug

SEQ ID NO: 1787563 - RNA, 17 nt, Human
uucagguaacaggcaga

SEQ ID NO: 1787564 - RNA, 13 nt, Human
auauaugcuaagu

SEQ ID NO: 1787565 - RNA, 15 nt, Human
uucaucaaugaauga

SEQ ID NO: 1787566 - RNA, 22 nt, Human
auauauguuuuaagaggcaggg

SEQ ID NO: 1787567 - RNA, 21 nt, Human
auauauguuuuaagaggcagg

SEQ ID NO: 1787568 - RNA, 15 nt, Human
auauauuuuaagacg

SEQ ID NO: 1787569 - RNA, 16 nt, Human
uucagaaauguguuau

SEQ ID NO: 1787570 - RNA, 22 nt, Human
uucagauauaaaagacugacca

SEQ ID NO: 1787571 - RNA, 14 nt, Human
uucagccaagaauu

SEQ ID NO: 1787572 - RNA, 16 nt, Human
uucagguaacaggcag

SEQ ID NO: 1787573 - RNA, 15 nt, Human
uucagguaacaggca

SEQ ID NO: 1787574 - RNA, 22 nt, Human
uucaggguuggccccugcccgg

SEQ ID NO: 1787575 - RNA, 19 nt, Human
uucaggguuggccccugcc

SEQ ID NO: 1787576 - RNA, 17 nt, Human
uucaggguuggccccug

SEQ ID NO: 1787577 - RNA, 16 nt, Human
uucaggguuggccccu

SEQ ID NO: 1787578 - RNA, 14 nt, Human
uucaggguuggccc

SEQ ID NO: 1787579 - RNA, 22 nt, Human
uuccaauuuacauacucugcuu

SEQ ID NO: 1787580 - RNA, 22 nt, Human
uuccacagaggacacagagaag

SEQ ID NO: 1787581 - RNA, 14 nt, Human
uuccacagaggaca

SEQ ID NO: 1787582 - RNA, 21 nt, Human
uuccacaagagcccaggccuc

SEQ ID NO: 1787583 - RNA, 15 nt, Human
uuccaccuucccaug

SEQ ID NO: 1787584 - RNA, 18 nt, Human
uuccaccaucaagccacc

SEQ ID NO: 1787585 - RNA, 13 nt, Human
uuccaggcuggga

SEQ ID NO: 1787586 - RNA, 15 nt, Human
uuccaggcugggaga

SEQ ID NO: 1787587 - RNA, 17 nt, Human
uuccaggcugggagagc

SEQ ID NO: 1787588 - RNA, 18 nt, Human
uuccagguuuaagcuguu

SEQ ID NO: 1787589 - RNA, 17 nt, Human
uuccagguuuaagcugu

SEQ ID NO: 1787590 - RNA, 20 nt, Human
auauguggaguucaucuuga

SEQ ID NO: 1787591 - RNA, 21 nt, Human
auauguggaguucaucuugaa

SEQ ID NO: 1787592 - RNA, 23 nt, Human
auauguaccuaacgaaguauccu

SEQ ID NO: 1787593 - RNA, 15 nt, Human
uucccuuuuuuuaag

SEQ ID NO: 1787594 - RNA, 13 nt, Human
uucccuacuuccu

SEQ ID NO: 1787595 - RNA, 14 nt, Human
uucccgcucagccc

SEQ ID NO: 1787596 - RNA, 15 nt, Human
uucccgcucagcccu

SEQ ID NO: 1787597 - RNA, 12 nt, Human
uucccgcucagc

SEQ ID NO: 1787598 - RNA, 17 nt, Human
uuccuguugucaagaau

SEQ ID NO: 1787599 - RNA, 20 nt, Human
uuccuggcacugcuuccagu

SEQ ID NO: 1787600 - RNA, 22 nt, Human
uuccuggcacugcuuccaguga

SEQ ID NO: 1787601 - RNA, 22 nt, Human
uuccucuuuuuauuuaguuccu

SEQ ID NO: 1787602 - RNA, 19 nt, Human
uuccuggcacugcuuccag

SEQ ID NO: 1787603 - RNA, 13 nt, Human
uuccucugagccu

SEQ ID NO: 1787604 - RNA, 19 nt, Human
uuccucuccacugccuucg

SEQ ID NO: 1787605 - RNA, 18 nt, Human
uuccucuccacugccuuc

SEQ ID NO: 1787606 - RNA, 21 nt, Human
uuccuaaauauauuuuaagac

SEQ ID NO: 1787607 - RNA, 16 nt, Human
aucaauucauaucuau

SEQ ID NO: 1787608 - RNA, 13 nt, Human
aucaauuuaaaaa

SEQ ID NO: 1787609 - RNA, 17 nt, Human
aucacgccacugcacua

SEQ ID NO: 1787610 - RNA, 15 nt, Human
aucacgccacugcac

SEQ ID NO: 1787611 - RNA, 21 nt, Human
aucaacugcaucaagauguga

SEQ ID NO: 1787612 - RNA, 13 nt, Human
auauuuacaaaug

SEQ ID NO: 1787613 - RNA, 14 nt, Human
auauuguacaguuu

SEQ ID NO: 1787614 - RNA, 13 nt, Human
auauuguacaguu

SEQ ID NO: 1787615 - RNA, 13 nt, Human
auauuguuuucag

SEQ ID NO: 1787616 - RNA, 17 nt, Human
auauuguuuucagugua

SEQ ID NO: 1787617 - RNA, 15 nt, Human
auauugauaugcuua

SEQ ID NO: 1787618 - RNA, 21 nt, Human
auauuccugcauuugugaaau

SEQ ID NO: 1787619 - RNA, 19 nt, Human
auauuaccacagacauacu

SEQ ID NO: 1787620 - RNA, 12 nt, Human
auauuguacagu

SEQ ID NO: 1787621 - RNA, 22 nt, Human
auauugcugauggugcaaugac

SEQ ID NO: 1787622 - RNA, 16 nt, Human
auauguucugacauaa

SEQ ID NO: 1787623 - RNA, 22 nt, Human
uuccagugaaaucaguuacucu

SEQ ID NO: 1787624 - RNA, 15 nt, Human
uuccagugaggcucu

SEQ ID NO: 1787625 - RNA, 16 nt, Human
uuccagugaggcucug

SEQ ID NO: 1787626 - RNA, 16 nt, Human
auauuaagaaagacua

SEQ ID NO: 1787627 - RNA, 15 nt, Human
auauuaagaaagacu

SEQ ID NO: 1787628 - RNA, 17 nt, Human
auauuaagaaagacuau

SEQ ID NO: 1787629 - RNA, 22 nt, Human
auauuaagaaagacuaucuaaa

SEQ ID NO: 1787630 - RNA, 17 nt, Human
auauuaccacagacaua

SEQ ID NO: 1787631 - RNA, 12 nt, Human
aucguaaaauua

SEQ ID NO: 1787632 - RNA, 13 nt, Human
aucguaaaauuaa

SEQ ID NO: 1787633 - RNA, 14 nt, Human
aucguaaaauuaag

SEQ ID NO: 1787634 - RNA, 17 nt, Human
aucguaaaauuaagaaa

SEQ ID NO: 1787635 - RNA, 23 nt, Human
auccuggcacccggccccugcug

SEQ ID NO: 1787636 - RNA, 22 nt, Human
auccuggcacccggccccugcu

SEQ ID NO: 1787637 - RNA, 21 nt, Human
auccuggcacccggccccugc

SEQ ID NO: 1787638 - RNA, 20 nt, Human
auccuggcacccggccccug

SEQ ID NO: 1787639 - RNA, 19 nt, Human
auccuggcacccggccccu

SEQ ID NO: 1787640 - RNA, 17 nt, Human
auccuggcacccggccc

SEQ ID NO: 1787641 - RNA, 21 nt, Human
auccugcuucugauaugcagu

SEQ ID NO: 1787642 - RNA, 19 nt, Human
auccugcuucugauaugca

SEQ ID NO: 1787643 - RNA, 15 nt, Human
auccuggaguucugg

SEQ ID NO: 1787644 - RNA, 18 nt, Human
auccucuguacagagccc

SEQ ID NO: 1787645 - RNA, 20 nt, Human
auccucuguacagagcccac

SEQ ID NO: 1787646 - RNA, 20 nt, Human
uucuuuugccguuauuaaaa

SEQ ID NO: 1787647 - RNA, 17 nt, Human
auccucuuugagugaag

SEQ ID NO: 1787648 - RNA, 11 nt, Human
auccugagcca

SEQ ID NO: 1787649 - RNA, 12 nt, Human
auccugagccag

SEQ ID NO: 1787650 - RNA, 13 nt, Human
auccugagccaga

SEQ ID NO: 1787651 - RNA, 14 nt, Human
auccugagccagau

SEQ ID NO: 1787652 - RNA, 15 nt, Human
auccugagccagauu

SEQ ID NO: 1787653 - RNA, 17 nt, Human
auccugagccagauuuc

SEQ ID NO: 1787654 - RNA, 21 nt, Human
auccugagccagauuucacuc

SEQ ID NO: 1787655 - RNA, 18 nt, Human
auccugaggcuccacuug

SEQ ID NO: 1787656 - RNA, 16 nt, Human
auccugaggcuccacu

SEQ ID NO: 1787657 - RNA, 13 nt, Human
auccugaggcucc

SEQ ID NO: 1787658 - RNA, 11 nt, Human
auccugaggcu

SEQ ID NO: 1787659 - RNA, 13 nt, Human
auccugccccuga

SEQ ID NO: 1787660 - RNA, 22 nt, Human
auccugaggcuccacuuggucu

SEQ ID NO: 1787661 - RNA, 16 nt, Human
auccugcaauuccacu

SEQ ID NO: 1787662 - RNA, 17 nt, Human
uugacacuuaaaaaugg

SEQ ID NO: 1787663 - RNA, 15 nt, Human
aucuaaauguugaaa

SEQ ID NO: 1787664 - RNA, 15 nt, Human
aucuaaacugccccc

SEQ ID NO: 1787665 - RNA, 19 nt, Human
aucuaaauggaaccacucu

SEQ ID NO: 1787666 - RNA, 15 nt, Human
aucgugacaacacuu

SEQ ID NO: 1787667 - RNA, 14 nt, Human
aucgugacaacacu

SEQ ID NO: 1787668 - RNA, 14 nt, Human
aucgucacugcuua

SEQ ID NO: 1787669 - RNA, 18 nt, Human
aucgucacugcuuaacuu

SEQ ID NO: 1787670 - RNA, 12 nt, Human
uugauaaaguaa

SEQ ID NO: 1787671 - RNA, 15 nt, Human
uugaggucuguucuu

SEQ ID NO: 1787672 - RNA, 16 nt, Human
uugaggucuguucuuu

SEQ ID NO: 1787673 - RNA, 18 nt, Human
uugaccauucuccaccug

SEQ ID NO: 1787674 - RNA, 19 nt, Human
uugaccauucuccaccugc

SEQ ID NO: 1787675 - RNA, 13 nt, Human
uugacaucaacug

SEQ ID NO: 1787676 - RNA, 19 nt, Human
uugacacuuaaaaaugguu

SEQ ID NO: 1787677 - RNA, 24 nt, Human
uugaccauucuccaccugccaggg

SEQ ID NO: 1787678 - RNA, 23 nt, Human
aucauccacugugccaugugcca

SEQ ID NO: 1787679 - RNA, 21 nt, Human
aucauccacugugccaugugc

SEQ ID NO: 1787680 - RNA, 16 nt, Human
aucauuaggugugacu

SEQ ID NO: 1787681 - RNA, 15 nt, Human
aucauaaaacuugau

SEQ ID NO: 1787682 - RNA, 19 nt, Human
aucagucugauucccaagc

SEQ ID NO: 1787683 - RNA, 17 nt, Human
aucagugcccuccagga

SEQ ID NO: 1787684 - RNA, 13 nt, Human
aucagugcccucc

SEQ ID NO: 1787685 - RNA, 15 nt, Human
aucagugcccuccag

SEQ ID NO: 1787686 - RNA, 15 nt, Human
aucaggugcugccau

SEQ ID NO: 1787687 - RNA, 23 nt, Human
aucacuugaacccgggaggcaga

SEQ ID NO: 1787688 - RNA, 19 nt, Human
aucaggugcugccauccag

SEQ ID NO: 1787689 - RNA, 17 nt, Human
aucaggugcugccaucc

SEQ ID NO: 1787690 - RNA, 21 nt, Human
uucucuaguuugauuaaauuc

SEQ ID NO: 1787691 - RNA, 18 nt, Human
uucuccuuucacaaccuu

SEQ ID NO: 1787692 - RNA, 22 nt, Human
uucuccuuucacaaccuucugu

SEQ ID NO: 1787693 - RNA, 12 nt, Human
aucauugaaauc

SEQ ID NO: 1787694 - RNA, 13 nt, Human
aucauugaaaucu

SEQ ID NO: 1787695 - RNA, 13 nt, Human
aucauugugaaau

SEQ ID NO: 1787696 - RNA, 15 nt, Human
aucauugugaaauua

SEQ ID NO: 1787697 - RNA, 19 nt, Human
aucauugugaaauuauuca

SEQ ID NO: 1787698 - RNA, 18 nt, Human
auccaagcaaaugugaau

SEQ ID NO: 1787699 - RNA, 16 nt, Human
auccaagcaaauguga

SEQ ID NO: 1787700 - RNA, 16 nt, Human
uucugccugcccaggc

SEQ ID NO: 1787701 - RNA, 15 nt, Human
uucugccugcccagg

SEQ ID NO: 1787702 - RNA, 17 nt, Human
auccagguucagcuugu

SEQ ID NO: 1787703 - RNA, 13 nt, Human
auccaauuggaua

SEQ ID NO: 1787704 - RNA, 15 nt, Human
auccaguaucuugaa

SEQ ID NO: 1787705 - RNA, 14 nt, Human
auccaguaucuuga

SEQ ID NO: 1787706 - RNA, 18 nt, Human
aucccaugagccucagca

SEQ ID NO: 1787707 - RNA, 17 nt, Human
aucccaugagccucagc

SEQ ID NO: 1787708 - RNA, 22 nt, Human
aucccugaaggccccgcccagg

SEQ ID NO: 1787709 - RNA, 17 nt, Human
aucccugaaggccccgc

SEQ ID NO: 1787710 - RNA, 16 nt, Human
aucccaugagccucag

SEQ ID NO: 1787711 - RNA, 12 nt, Human
aucccagcccca

SEQ ID NO: 1787712 - RNA, 11 nt, Human
aucccagcccc

SEQ ID NO: 1787713 - RNA, 22 nt, Human
uucuuaaccagaucauugugaa

SEQ ID NO: 1787714 - RNA, 23 nt, Human
uucuuaaccagaucauugugaaa

SEQ ID NO: 1787715 - RNA, 18 nt, Human
uucuguuuagauaauaca

SEQ ID NO: 1787716 - RNA, 13 nt, Human
uucuguuuagaua

SEQ ID NO: 1787717 - RNA, 12 nt, Human
uucuuucuggcu

SEQ ID NO: 1787718 - RNA, 20 nt, Human
uucuuucuggcuaugcauuu

SEQ ID NO: 1787719 - RNA, 17 nt, Human
uucuuucuggcuaugca

SEQ ID NO: 1787720 - RNA, 22 nt, Human
uucuucuccacuuucuagccag

SEQ ID NO: 1787721 - RNA, 11 nt, Human
uucuucucccu

SEQ ID NO: 1787722 - RNA, 20 nt, Human
aggcuggcgugcaguggugc

SEQ ID NO: 1787723 - RNA, 18 nt, Human
aggcuggcgugcaguggu

SEQ ID NO: 1787724 - RNA, 22 nt, Human
uggcuagagguucaaagauauu

SEQ ID NO: 1787725 - RNA, 14 nt, Human
aggcugggagagcc

SEQ ID NO: 1787726 - RNA, 22 nt, Human
uggcuauuagagaucaaccccu

SEQ ID NO: 1787727 - RNA, 19 nt, Human
uggcuaugcauuugaaaau

SEQ ID NO: 1787728 - RNA, 14 nt, Human
uggcuaugcauuug

SEQ ID NO: 1787729 - RNA, 17 nt, Human
uggcuaugcauuugaaa

SEQ ID NO: 1787730 - RNA, 15 nt, Human
uggcuaugcauuuga

SEQ ID NO: 1787731 - RNA, 18 nt, Human
uggcucaaguccucuuuu

SEQ ID NO: 1787732 - RNA, 19 nt, Human
uggcucuuccaggcuggga

SEQ ID NO: 1787733 - RNA, 20 nt, Human
uggcucuuccaggcugggag

SEQ ID NO: 1787734 - RNA, 21 nt, Human
uggcucuuccaggcugggaga

SEQ ID NO: 1787735 - RNA, 12 nt, Human
uggcugcaaagg

SEQ ID NO: 1787736 - RNA, 14 nt, Human
uggcugcagggagu

SEQ ID NO: 1787737 - RNA, 13 nt, Human
uggcugcagggag

SEQ ID NO: 1787738 - RNA, 15 nt, Human
uggcugcagggaguc

SEQ ID NO: 1787739 - RNA, 18 nt, Human
uggcugccaaugggagcu

SEQ ID NO: 1787740 - RNA, 20 nt, Human
uggcugccaaugggagcuca

SEQ ID NO: 1787741 - RNA, 11 nt, Human
uggcugcugaa

SEQ ID NO: 1787742 - RNA, 17 nt, Human
uggcuuaaaacaacacu

SEQ ID NO: 1787743 - RNA, 15 nt, Human
uggcuguuggcuggg

SEQ ID NO: 1787744 - RNA, 13 nt, Human
uggcuguuggcug

SEQ ID NO: 1787745 - RNA, 14 nt, Human
uggcugugucuccc

SEQ ID NO: 1787746 - RNA, 23 nt, Human
uggcuucacggaagagccuugcg

SEQ ID NO: 1787747 - RNA, 13 nt, Human
ugggaacuagacu

SEQ ID NO: 1787748 - RNA, 17 nt, Human
uggcuucccgcucagcc

SEQ ID NO: 1787749 - RNA, 15 nt, Human
uggcuucccgcucag

SEQ ID NO: 1787750 - RNA, 16 nt, Human
uggcuucccgcucagc

SEQ ID NO: 1787751 - RNA, 16 nt, Human
ugggaaaggggaaguu

SEQ ID NO: 1787752 - RNA, 17 nt, Human
aggcuggcgugcagugg

SEQ ID NO: 1787753 - RNA, 13 nt, Human
aggcuggcgugca

SEQ ID NO: 1787754 - RNA, 19 nt, Human
aggcuggcccugcccuggu

SEQ ID NO: 1787755 - RNA, 15 nt, Human
aggcuggcccugccc

SEQ ID NO: 1787756 - RNA, 16 nt, Human
aggcuggcccugcccu

SEQ ID NO: 1787757 - RNA, 17 nt, Human
aggcuggcccugcccug

SEQ ID NO: 1787758 - RNA, 18 nt, Human
aggcuggcccugcccugg

SEQ ID NO: 1787759 - RNA, 12 nt, Human
aggcuggcccug

SEQ ID NO: 1787760 - RNA, 14 nt, Human
aggcuggcccugcc

SEQ ID NO: 1787761 - RNA, 18 nt, Human
aggcucuggagcccacug

SEQ ID NO: 1787762 - RNA, 19 nt, Human
aggcucuggagcccacugu

SEQ ID NO: 1787763 - RNA, 14 nt, Human
aggcucuggagccc

SEQ ID NO: 1787764 - RNA, 15 nt, Human
aggcucuggagccca

SEQ ID NO: 1787765 - RNA, 13 nt, Human
aggcucuggagcc

SEQ ID NO: 1787766 - RNA, 16 nt, Human
aggcucugcccuuggu

SEQ ID NO: 1787767 - RNA, 23 nt, Human
aggcugcucuugaacuccugacc

SEQ ID NO: 1787768 - RNA, 19 nt, Human
aggcuccuuuagcgcccag

SEQ ID NO: 1787769 - RNA, 12 nt, Human
aggcucgagcau

SEQ ID NO: 1787770 - RNA, 20 nt, Human
aggcuccugccaccacgccc

SEQ ID NO: 1787771 - RNA, 14 nt, Human
aggcuccugccacc

SEQ ID NO: 1787772 - RNA, 21 nt, Human
aggcucgagcaugccuggaug

SEQ ID NO: 1787773 - RNA, 15 nt, Human
aggcucgagcaugcc

SEQ ID NO: 1787774 - RNA, 17 nt, Human
aggcucgagcaugccug

SEQ ID NO: 1787775 - RNA, 18 nt, Human
aggcucgagcaugccugg

SEQ ID NO: 1787776 - RNA, 19 nt, Human
aggcucgagcaugccugga

SEQ ID NO: 1787777 - RNA, 21 nt, Human
aggcucucaggccagcugcuu

SEQ ID NO: 1787778 - RNA, 11 nt, Human
aggcucugccc

SEQ ID NO: 1787779 - RNA, 12 nt, Human
aggcucugcccu

SEQ ID NO: 1787780 - RNA, 13 nt, Human
aggcucugcccuu

SEQ ID NO: 1787781 - RNA, 14 nt, Human
aggcucugcccuug

SEQ ID NO: 1787782 - RNA, 15 nt, Human
aggcucugcccuugg

SEQ ID NO: 1787783 - RNA, 11 nt, Human
aggcucucagg

SEQ ID NO: 1787784 - RNA, 12 nt, Human
aggcucucaggc

SEQ ID NO: 1787785 - RNA, 14 nt, Human
aggcucucaggcca

SEQ ID NO: 1787786 - RNA, 15 nt, Human
aggcucucaggccag

SEQ ID NO: 1787787 - RNA, 16 nt, Human
aggcucucaggccagc

SEQ ID NO: 1787788 - RNA, 18 nt, Human
aggcucucaggccagcug

SEQ ID NO: 1787789 - RNA, 19 nt, Human
aggcucucaggccagcugc

SEQ ID NO: 1787790 - RNA, 20 nt, Human
aggcucucaggccagcugcu

SEQ ID NO: 1787791 - RNA, 18 nt, Human
uggacgagaaaacaauaa

SEQ ID NO: 1787792 - RNA, 13 nt, Human
aggccaaaaaaau

SEQ ID NO: 1787793 - RNA, 16 nt, Human
aggccaaacucaccug

SEQ ID NO: 1787794 - RNA, 18 nt, Human
aggcauuuguuugaacug

SEQ ID NO: 1787795 - RNA, 20 nt, Human
aggccaaacucaccugcccc

SEQ ID NO: 1787796 - RNA, 14 nt, Human
aggccaaaggaagc

SEQ ID NO: 1787797 - RNA, 15 nt, Human
aggccaaaggaagca

SEQ ID NO: 1787798 - RNA, 23 nt, Human
aggccaaaggaagcacaugccuc

SEQ ID NO: 1787799 - RNA, 22 nt, Human
aggccaacccaaaauaagcagg

SEQ ID NO: 1787800 - RNA, 18 nt, Human
aggccaaggugggaggau

SEQ ID NO: 1787801 - RNA, 19 nt, Human
uggaugccugguggcagcu

SEQ ID NO: 1787802 - RNA, 18 nt, Human
uggaugccugguggcagc

SEQ ID NO: 1787803 - RNA, 20 nt, Human
uggaugccugguggcagcug

SEQ ID NO: 1787804 - RNA, 16 nt, Human
uggaguucaucuugaa

SEQ ID NO: 1787805 - RNA, 17 nt, Human
uggaguucaucuugaau

SEQ ID NO: 1787806 - RNA, 20 nt, Human
uggaguucaucuugaauugu

SEQ ID NO: 1787807 - RNA, 19 nt, Human
uggagucagacagaugugg

SEQ ID NO: 1787808 - RNA, 15 nt, Human
aggccacaagacccu

SEQ ID NO: 1787809 - RNA, 12 nt, Human
uggauguucuga

SEQ ID NO: 1787810 - RNA, 22 nt, Human
uggauuaaacuuaaucuaaaug

SEQ ID NO: 1787811 - RNA, 20 nt, Human
uggcacaucagcacgauuuc

SEQ ID NO: 1787812 - RNA, 18 nt, Human
uggcaccagcagccugga

SEQ ID NO: 1787813 - RNA, 22 nt, Human
uggcagaguugaagacagagcu

SEQ ID NO: 1787814 - RNA, 16 nt, Human
uggcacccggccccug

SEQ ID NO: 1787815 - RNA, 21 nt, Human
uggcagaguugaagacagagc

SEQ ID NO: 1787816 - RNA, 15 nt, Human
uggcacccggccccu

SEQ ID NO: 1787817 - RNA, 21 nt, Human
uggcacaucagcacgauuucu

SEQ ID NO: 1787818 - RNA, 13 nt, Human
uggcagccuuggc

SEQ ID NO: 1787819 - RNA, 12 nt, Human
aggccagagaca

SEQ ID NO: 1787820 - RNA, 23 nt, Human
uggcagccgugccuucagcucua

SEQ ID NO: 1787821 - RNA, 15 nt, Human
uggcagccucuucaa

SEQ ID NO: 1787822 - RNA, 16 nt, Human
uggcagccucuucaaa

SEQ ID NO: 1787823 - RNA, 20 nt, Human
aggccacaagacccuugugg

SEQ ID NO: 1787824 - RNA, 16 nt, Human
uggcagccgugccuuc

SEQ ID NO: 1787825 - RNA, 12 nt, Human
uggcagccccug

SEQ ID NO: 1787826 - RNA, 21 nt, Human
uggccccugcccggcugcgga

SEQ ID NO: 1787827 - RNA, 18 nt, Human
uggcccgacagccuggca

SEQ ID NO: 1787828 - RNA, 19 nt, Human
uggcccgacagccuggcac

SEQ ID NO: 1787829 - RNA, 14 nt, Human
uggcccgacagccu

SEQ ID NO: 1787830 - RNA, 15 nt, Human
uggcccgacagccug

SEQ ID NO: 1787831 - RNA, 16 nt, Human
uggcccgacagccugg

SEQ ID NO: 1787832 - RNA, 17 nt, Human
uggcccgacagccuggc

SEQ ID NO: 1787833 - RNA, 15 nt, Human
uggccgggaccccga

SEQ ID NO: 1787834 - RNA, 17 nt, Human
uggccgggaccccgagc

SEQ ID NO: 1787835 - RNA, 23 nt, Human
uggccgggaccccgagccuggcu

SEQ ID NO: 1787836 - RNA, 15 nt, Human
uggccgggagccuga

SEQ ID NO: 1787837 - RNA, 21 nt, Human
aggccuggccagaugcaccag

SEQ ID NO: 1787838 - RNA, 17 nt, Human
aggccuggccagaugca

SEQ ID NO: 1787839 - RNA, 16 nt, Human
aggccuggccagaugc

SEQ ID NO: 1787840 - RNA, 15 nt, Human
aggccuggccagaug

SEQ ID NO: 1787841 - RNA, 23 nt, Human
aggccuggccagaugcaccagcc

SEQ ID NO: 1787842 - RNA, 22 nt, Human
aggccuggccagaugcaccagc

SEQ ID NO: 1787843 - RNA, 12 nt, Human
uggccuggcccc

SEQ ID NO: 1787844 - RNA, 23 nt, Human
aggccugggggcugggcagagga

SEQ ID NO: 1787845 - RNA, 14 nt, Human
uggccucugcacuc

SEQ ID NO: 1787846 - RNA, 15 nt, Human
uggccucugcacucc

SEQ ID NO: 1787847 - RNA, 17 nt, Human
uggccucugcacucccc

SEQ ID NO: 1787848 - RNA, 18 nt, Human
uggccucugcacuccccu

SEQ ID NO: 1787849 - RNA, 15 nt, Human
aggcccucugcccac

SEQ ID NO: 1787850 - RNA, 13 nt, Human
aggcccucugccc

SEQ ID NO: 1787851 - RNA, 14 nt, Human
aggcccucugccca

SEQ ID NO: 1787852 - RNA, 17 nt, Human
uggccaggcuggucuca

SEQ ID NO: 1787853 - RNA, 15 nt, Human
uggccaggcuggucu

SEQ ID NO: 1787854 - RNA, 16 nt, Human
uggccaaguucuuagu

SEQ ID NO: 1787855 - RNA, 20 nt, Human
uggccaggcuggucucgaac

SEQ ID NO: 1787856 - RNA, 12 nt, Human
uggcaugggaau

SEQ ID NO: 1787857 - RNA, 15 nt, Human
uggcaugggaaugaa

SEQ ID NO: 1787858 - RNA, 13 nt, Human
aggccugccuguu

SEQ ID NO: 1787859 - RNA, 13 nt, Human
ugcuuauacacuu

SEQ ID NO: 1787860 - RNA, 14 nt, Human
ugcuucagccuccc

SEQ ID NO: 1787861 - RNA, 13 nt, Human
ugcuucagccucc

SEQ ID NO: 1787862 - RNA, 16 nt, Human
ugcuucaaggauccug

SEQ ID NO: 1787863 - RNA, 18 nt, Human
ugcuucaaggauccugag

SEQ ID NO: 1787864 - RNA, 19 nt, Human
ugcuucaaggauccugagc

SEQ ID NO: 1787865 - RNA, 19 nt, Human
aggacacuaaccacgcugg

SEQ ID NO: 1787866 - RNA, 23 nt, Human
aggacacuaaccacgcuggaccu

SEQ ID NO: 1787867 - RNA, 14 nt, Human
ugcuucaucccuuu

SEQ ID NO: 1787868 - RNA, 22 nt, Human
aggacagggaggugaccccagg

SEQ ID NO: 1787869 - RNA, 18 nt, Human
ugcuggcuguuggcuggg

SEQ ID NO: 1787870 - RNA, 16 nt, Human
ugcuggcugguuagag

SEQ ID NO: 1787871 - RNA, 15 nt, Human
ugcuggcugccuuag

SEQ ID NO: 1787872 - RNA, 14 nt, Human
ugcuggcugccuua

SEQ ID NO: 1787873 - RNA, 21 nt, Human
ugcuggcugccuuagaaccuu

SEQ ID NO: 1787874 - RNA, 12 nt, Human
ugcugcccugug

SEQ ID NO: 1787875 - RNA, 13 nt, Human
ugcugcccuguga

SEQ ID NO: 1787876 - RNA, 14 nt, Human
ugcugcccugugag

SEQ ID NO: 1787877 - RNA, 20 nt, Human
aggaauuuuauuuuuuucug

SEQ ID NO: 1787878 - RNA, 15 nt, Human
ugcugcccugugagu

SEQ ID NO: 1787879 - RNA, 14 nt, Human
ugcuggagcucugc

SEQ ID NO: 1787880 - RNA, 13 nt, Human
ugcuggagcucug

SEQ ID NO: 1787881 - RNA, 11 nt, Human
aggaauuuaaa

SEQ ID NO: 1787882 - RNA, 23 nt, Human
aggaauugacccacaagaaauga

SEQ ID NO: 1787883 - RNA, 23 nt, Human
aggaauuguguuuauaauuuuaa

SEQ ID NO: 1787884 - RNA, 19 nt, Human
aggaaggaaacccagcucu

SEQ ID NO: 1787885 - RNA, 15 nt, Human
aggaaggagaggaga

SEQ ID NO: 1787886 - RNA, 18 nt, Human
aggaaggaaacccagcuc

SEQ ID NO: 1787887 - RNA, 17 nt, Human
aggaagccagcaggcuc

SEQ ID NO: 1787888 - RNA, 18 nt, Human
aggaagccagcaggcucu

SEQ ID NO: 1787889 - RNA, 14 nt, Human
aggaagccagcagg

SEQ ID NO: 1787890 - RNA, 15 nt, Human
aggaagccagcaggc

SEQ ID NO: 1787891 - RNA, 13 nt, Human
aggaagacuuugg

SEQ ID NO: 1787892 - RNA, 14 nt, Human
aggaagacuuugga

SEQ ID NO: 1787893 - RNA, 23 nt, Human
aggaagcacaugccucucucagg

SEQ ID NO: 1787894 - RNA, 24 nt, Human
aggaagcacaugccucucucaggc

SEQ ID NO: 1787895 - RNA, 16 nt, Human
ugcugagucugaaggc

SEQ ID NO: 1787896 - RNA, 17 nt, Human
ugcugagucugaaggcu

SEQ ID NO: 1787897 - RNA, 18 nt, Human
ugcugagucugaaggcug

SEQ ID NO: 1787898 - RNA, 21 nt, Human
ugcugagucugaaggcugggu

SEQ ID NO: 1787899 - RNA, 22 nt, Human
ugcugagucugaaggcuggguu

SEQ ID NO: 1787900 - RNA, 23 nt, Human
ugcugagucugaaggcuggguuc

SEQ ID NO: 1787901 - RNA, 13 nt, Human
aggaagacuucau

SEQ ID NO: 1787902 - RNA, 19 nt, Human
aggaagacuucaucccucu

SEQ ID NO: 1787903 - RNA, 18 nt, Human
agcugggacuacaggcac

SEQ ID NO: 1787904 - RNA, 16 nt, Human
agcugggacuacaggc

SEQ ID NO: 1787905 - RNA, 19 nt, Human
agcugggacuacaggcacc

SEQ ID NO: 1787906 - RNA, 16 nt, Human
ugcuccagcuguucag

SEQ ID NO: 1787907 - RNA, 19 nt, Human
ugcuccagcuguucagcug

SEQ ID NO: 1787908 - RNA, 20 nt, Human
ugcuccagcuguucagcugg

SEQ ID NO: 1787909 - RNA, 14 nt, Human
ugcugacuguacuc

SEQ ID NO: 1787910 - RNA, 15 nt, Human
ugcugagucugaagg

SEQ ID NO: 1787911 - RNA, 14 nt, Human
ugcugagucugaag

SEQ ID NO: 1787912 - RNA, 22 nt, Human
ugcucugcugacagacacaggc

SEQ ID NO: 1787913 - RNA, 21 nt, Human
ugcucugcugacagacacagg

SEQ ID NO: 1787914 - RNA, 19 nt, Human
aggauuuugauccaagcug

SEQ ID NO: 1787915 - RNA, 17 nt, Human
aggaugccccguccccc

SEQ ID NO: 1787916 - RNA, 19 nt, Human
aggaugcccaaagaugcag

SEQ ID NO: 1787917 - RNA, 20 nt, Human
aggaugaucuaggaagacuu

SEQ ID NO: 1787918 - RNA, 14 nt, Human
aggaugcccaaaga

SEQ ID NO: 1787919 - RNA, 17 nt, Human
aggcaacucaucuuagg

SEQ ID NO: 1787920 - RNA, 19 nt, Human
aggcaacugcauuggcuuu

SEQ ID NO: 1787921 - RNA, 14 nt, Human
uggacccugaggcc

SEQ ID NO: 1787922 - RNA, 12 nt, Human
uggacccugagg

SEQ ID NO: 1787923 - RNA, 13 nt, Human
uggacccugaggc

SEQ ID NO: 1787924 - RNA, 21 nt, Human
uggacacagcucuucuccagg

SEQ ID NO: 1787925 - RNA, 18 nt, Human
uggacacagcucuucucc

SEQ ID NO: 1787926 - RNA, 16 nt, Human
uggacacagcucuucu

SEQ ID NO: 1787927 - RNA, 15 nt, Human
uggacacagcucuuc

SEQ ID NO: 1787928 - RNA, 16 nt, Human
aggaugaucuaggaag

SEQ ID NO: 1787929 - RNA, 17 nt, Human
aggaugaucuaggaaga

SEQ ID NO: 1787930 - RNA, 17 nt, Human
aggauccugagccagau

SEQ ID NO: 1787931 - RNA, 18 nt, Human
aggauccugagccagauu

SEQ ID NO: 1787932 - RNA, 21 nt, Human
aggaucucuugagccugggag

SEQ ID NO: 1787933 - RNA, 22 nt, Human
aggaucucuugagccugggagg

SEQ ID NO: 1787934 - RNA, 21 nt, Human
aggauacaaaagcaugugaga

SEQ ID NO: 1787935 - RNA, 15 nt, Human
aggauccugagccag

SEQ ID NO: 1787936 - RNA, 16 nt, Human
aggauccugagccaga

SEQ ID NO: 1787937 - RNA, 14 nt, Human
aggagggaggggga

SEQ ID NO: 1787938 - RNA, 21 nt, Human
aggagggagcaucagugcccu

SEQ ID NO: 1787939 - RNA, 20 nt, Human
uggaaauauuaagaaagacu

SEQ ID NO: 1787940 - RNA, 23 nt, Human
uggaaaugggcagagcagagacc

SEQ ID NO: 1787941 - RNA, 23 nt, Human
aggacuuuucuuuguggcuuccu

SEQ ID NO: 1787942 - RNA, 11 nt, Human
aggagaaacug

SEQ ID NO: 1787943 - RNA, 17 nt, Human
aggagauuggaaggaac

SEQ ID NO: 1787944 - RNA, 17 nt, Human
aggagaaacuggaacuc

SEQ ID NO: 1787945 - RNA, 22 nt, Human
aggagccccgaggccuucucug

SEQ ID NO: 1787946 - RNA, 18 nt, Human
aggagcccugggaggcuc

SEQ ID NO: 1787947 - RNA, 14 nt, Human
aggagcagccacau

SEQ ID NO: 1787948 - RNA, 18 nt, Human
aggacauugcggacagcc

SEQ ID NO: 1787949 - RNA, 17 nt, Human
aggacauugcggacagc

SEQ ID NO: 1787950 - RNA, 15 nt, Human
aggacauugcggaca

SEQ ID NO: 1787951 - RNA, 23 nt, Human
aggacauugcggacagccacggc

SEQ ID NO: 1787952 - RNA, 19 nt, Human
aggacauugcggacagcca

SEQ ID NO: 1787953 - RNA, 19 nt, Human
aggacucugccuccucuuc

SEQ ID NO: 1787954 - RNA, 18 nt, Human
ugcuuugggcugcccugg

SEQ ID NO: 1787955 - RNA, 19 nt, Human
ugcuuugggcugcccuggu

SEQ ID NO: 1787956 - RNA, 20 nt, Human
ugcuuugggcugcccuggug

SEQ ID NO: 1787957 - RNA, 21 nt, Human
ugcuuugggcugcccuggugc

SEQ ID NO: 1787958 - RNA, 19 nt, Human
ugcuugggcuucauccucc

SEQ ID NO: 1787959 - RNA, 15 nt, Human
uggaaauauuaagaa

SEQ ID NO: 1787960 - RNA, 21 nt, Human
ugcuuggaggaaggaaaccca

SEQ ID NO: 1787961 - RNA, 12 nt, Human
ugcuugggcuuc

SEQ ID NO: 1787962 - RNA, 16 nt, Human
ugcuugggcuucaucc

SEQ ID NO: 1787963 - RNA, 19 nt, Human
aggagcccugggaggcucu

SEQ ID NO: 1787964 - RNA, 22 nt, Human
agcgcuggccgggaccccgagc

SEQ ID NO: 1787965 - RNA, 16 nt, Human
agcgcuggccgggacc

SEQ ID NO: 1787966 - RNA, 18 nt, Human
ugcauuugaggucuguuc

SEQ ID NO: 1787967 - RNA, 19 nt, Human
ugcauuugaggucuguucu

SEQ ID NO: 1787968 - RNA, 20 nt, Human
ugcauuuaaaagauacaguu

SEQ ID NO: 1787969 - RNA, 18 nt, Human
agccuuccagggguggga

SEQ ID NO: 1787970 - RNA, 15 nt, Human
agccuugaacuuuga

SEQ ID NO: 1787971 - RNA, 22 nt, Human
agcgauucuucugcuucagccu

SEQ ID NO: 1787972 - RNA, 23 nt, Human
agccuugaccauucuccaccugc

SEQ ID NO: 1787973 - RNA, 22 nt, Human
agccuugaacuuugaccucugc

SEQ ID NO: 1787974 - RNA, 16 nt, Human
agccuugaacuuugac

SEQ ID NO: 1787975 - RNA, 23 nt, Human
agccuugaacuuugaccucugca

SEQ ID NO: 1787976 - RNA, 22 nt, Human
agccuugaccauucuccaccug

SEQ ID NO: 1787977 - RNA, 20 nt, Human
agcggggacagcuccuucug

SEQ ID NO: 1787978 - RNA, 19 nt, Human
agcggggacagcuccuucu

SEQ ID NO: 1787979 - RNA, 23 nt, Human
agcggcuggcagcccaccccuca

SEQ ID NO: 1787980 - RNA, 22 nt, Human
agcggggacagcuccuucuguc

SEQ ID NO: 1787981 - RNA, 13 nt, Human
agcggcuggcagc

SEQ ID NO: 1787982 - RNA, 18 nt, Human
ugccagcuuaucucaggg

SEQ ID NO: 1787983 - RNA, 20 nt, Human
ugccagucccccugccccag

SEQ ID NO: 1787984 - RNA, 18 nt, Human
ugccacugccucuuccuc

SEQ ID NO: 1787985 - RNA, 19 nt, Human
ugccacugccucuuccucc

SEQ ID NO: 1787986 - RNA, 20 nt, Human
ugccacugccucuuccuccc

SEQ ID NO: 1787987 - RNA, 13 nt, Human
ugccacugccucu

SEQ ID NO: 1787988 - RNA, 17 nt, Human
ugccacugccucuuccu

SEQ ID NO: 1787989 - RNA, 21 nt, Human
ugcauuugaggucuguucuuu

SEQ ID NO: 1787990 - RNA, 20 nt, Human
ugcauuugaggucuguucuu

SEQ ID NO: 1787991 - RNA, 14 nt, Human
ugcccccucugccc

SEQ ID NO: 1787992 - RNA, 15 nt, Human
ugcccccucugcccu

SEQ ID NO: 1787993 - RNA, 16 nt, Human
ugcccccucugcccug

SEQ ID NO: 1787994 - RNA, 17 nt, Human
ugcccccucugcccugc

SEQ ID NO: 1787995 - RNA, 18 nt, Human
ugcccccucugcccugcg

SEQ ID NO: 1787996 - RNA, 20 nt, Human
ugcccuaaaguguauuuuuu

SEQ ID NO: 1787997 - RNA, 23 nt, Human
ugccccgaacauguuuuucuucu

SEQ ID NO: 1787998 - RNA, 18 nt, Human
ugcccaggccccugccac

SEQ ID NO: 1787999 - RNA, 17 nt, Human
ugcccaggccccugcca

SEQ ID NO: 1788000 - RNA, 15 nt, Human
ugcccaggccccugc

SEQ ID NO: 1788001 - RNA, 17 nt, Human
ugcccaaagaugcagcc

SEQ ID NO: 1788002 - RNA, 20 nt, Human
ugcccaaagaugcagccggu

SEQ ID NO: 1788003 - RNA, 13 nt, Human
ugcccagccccuu

SEQ ID NO: 1788004 - RNA, 12 nt, Human
ugcccagccccu

SEQ ID NO: 1788005 - RNA, 16 nt, Human
ugcccagccccuucug

SEQ ID NO: 1788006 - RNA, 17 nt, Human
ugcccagccccuucuga

SEQ ID NO: 1788007 - RNA, 17 nt, Human
agcucaggugucccugc

SEQ ID NO: 1788008 - RNA, 15 nt, Human
agcuccaagcuccca

SEQ ID NO: 1788009 - RNA, 16 nt, Human
agcuccaagcucccag

SEQ ID NO: 1788010 - RNA, 20 nt, Human
agcucagggccuggcucagg

SEQ ID NO: 1788011 - RNA, 14 nt, Human
agcucagggccugg

SEQ ID NO: 1788012 - RNA, 19 nt, Human
agcucagggccuggcucag

SEQ ID NO: 1788013 - RNA, 19 nt, Human
agcuauucaguaauaacuc

SEQ ID NO: 1788014 - RNA, 12 nt, Human
agcucagggccu

SEQ ID NO: 1788015 - RNA, 13 nt, Human
agcucagggccug

SEQ ID NO: 1788016 - RNA, 13 nt, Human
agcgugagccacu

SEQ ID NO: 1788017 - RNA, 21 nt, Human
agcuaggccuggccagaugca

SEQ ID NO: 1788018 - RNA, 17 nt, Human
agcuaucguaaaauuaa

SEQ ID NO: 1788019 - RNA, 19 nt, Human
agcuccagcucaccagccc

SEQ ID NO: 1788020 - RNA, 18 nt, Human
agcuccagcucaccagcc

SEQ ID NO: 1788021 - RNA, 21 nt, Human
agcuccagcucaccagcccca

SEQ ID NO: 1788022 - RNA, 21 nt, Human
agcuccaucuccacuccagau

SEQ ID NO: 1788023 - RNA, 23 nt, Human
agcuccuucuguccuacucugug

SEQ ID NO: 1788024 - RNA, 22 nt, Human
agcuccuucuguccuacucugu

SEQ ID NO: 1788025 - RNA, 21 nt, Human
agcucugcagagcaggaaaca

SEQ ID NO: 1788026 - RNA, 23 nt, Human
agcucugcccauccugccccuga

SEQ ID NO: 1788027 - RNA, 23 nt, Human
ugcccuaaugcgcaggcuggccc

SEQ ID NO: 1788028 - RNA, 20 nt, Human
ugcccuaaugcgcaggcugg

SEQ ID NO: 1788029 - RNA, 17 nt, Human
agcuccagcucaccagc

SEQ ID NO: 1788030 - RNA, 13 nt, Human
agcuccagcucac

SEQ ID NO: 1788031 - RNA, 14 nt, Human
ugcccugcccaccu

SEQ ID NO: 1788032 - RNA, 17 nt, Human
agcuccaagcucccagg

SEQ ID NO: 1788033 - RNA, 18 nt, Human
agcuccaagcucccaggc

SEQ ID NO: 1788034 - RNA, 19 nt, Human
agcuccaagcucccaggca

SEQ ID NO: 1788035 - RNA, 22 nt, Human
ugccucccaucacccgcuaaga

SEQ ID NO: 1788036 - RNA, 17 nt, Human
ugccucagccuccugag

SEQ ID NO: 1788037 - RNA, 15 nt, Human
ugccucagccuccug

SEQ ID NO: 1788038 - RNA, 15 nt, Human
ugccucagccucccg

SEQ ID NO: 1788039 - RNA, 11 nt, Human
ugccucucugc

SEQ ID NO: 1788040 - RNA, 12 nt, Human
ugccucucugca

SEQ ID NO: 1788041 - RNA, 17 nt, Human
ugccucucucaggccaa

SEQ ID NO: 1788042 - RNA, 20 nt, Human
ugccgcagcccugcagaggg

SEQ ID NO: 1788043 - RNA, 15 nt, Human
ugccucaccccuugc

SEQ ID NO: 1788044 - RNA, 17 nt, Human
agcucuucuccaggcug

SEQ ID NO: 1788045 - RNA, 16 nt, Human
agcucuucuccaggcu

SEQ ID NO: 1788046 - RNA, 15 nt, Human
agcucuucuccaggc

SEQ ID NO: 1788047 - RNA, 15 nt, Human
ugcccugugggcccc

SEQ ID NO: 1788048 - RNA, 18 nt, Human
ugcccugugggcccccaa

SEQ ID NO: 1788049 - RNA, 22 nt, Human
ugcccuuaccugccaggaagcc

SEQ ID NO: 1788050 - RNA, 22 nt, Human
agcugcuuuugucuaugggacu

SEQ ID NO: 1788051 - RNA, 13 nt, Human
agcugccuguuca

SEQ ID NO: 1788052 - RNA, 24 nt, Human
agcugcuuuugucuaugggacuca

SEQ ID NO: 1788053 - RNA, 23 nt, Human
agcugcuuuugucuaugggacuc

SEQ ID NO: 1788054 - RNA, 19 nt, Human
ugccugcccaggccccugc

SEQ ID NO: 1788055 - RNA, 18 nt, Human
ugccugcccaggccccug

SEQ ID NO: 1788056 - RNA, 17 nt, Human
ugccugcccaggccccu

SEQ ID NO: 1788057 - RNA, 12 nt, Human
ugccucugccuc

SEQ ID NO: 1788058 - RNA, 11 nt, Human
ugccucugccu

SEQ ID NO: 1788059 - RNA, 21 nt, Human
ugccucucugcaggucccuaa

SEQ ID NO: 1788060 - RNA, 16 nt, Human
ugccucugacacacag

SEQ ID NO: 1788061 - RNA, 14 nt, Human
ugccucugacacac

SEQ ID NO: 1788062 - RNA, 15 nt, Human
ugccucucugcaggu

SEQ ID NO: 1788063 - RNA, 23 nt, Human
ugccucucugcaggucccuaaua

SEQ ID NO: 1788064 - RNA, 21 nt, Human
ugcaaaccaucauugaaaucu

SEQ ID NO: 1788065 - RNA, 22 nt, Human
agccccauucugccugcccagg

SEQ ID NO: 1788066 - RNA, 21 nt, Human
agccccauucugccugcccag

SEQ ID NO: 1788067 - RNA, 18 nt, Human
agccccaaaacucuccuc

SEQ ID NO: 1788068 - RNA, 16 nt, Human
agccccaaaacucucc

SEQ ID NO: 1788069 - RNA, 17 nt, Human
agccccaaaacucuccu

SEQ ID NO: 1788070 - RNA, 23 nt, Human
agccccauucugccugcccaggc

SEQ ID NO: 1788071 - RNA, 16 nt, Human
agcccugguggcagug

SEQ ID NO: 1788072 - RNA, 15 nt, Human
agcccugguggcagu

SEQ ID NO: 1788073 - RNA, 14 nt, Human
agcccugguggcag

SEQ ID NO: 1788074 - RNA, 18 nt, Human
ugcacacaccagagccca

SEQ ID NO: 1788075 - RNA, 17 nt, Human
ugcacacaccagagccc

SEQ ID NO: 1788076 - RNA, 21 nt, Human
ugcacacaccagagcccaccu

SEQ ID NO: 1788077 - RNA, 22 nt, Human
ugcacacaccagagcccaccuu

SEQ ID NO: 1788078 - RNA, 19 nt, Human
agcccugcuuugggcugcc

SEQ ID NO: 1788079 - RNA, 20 nt, Human
agcccugcuuugggcugccc

SEQ ID NO: 1788080 - RNA, 17 nt, Human
agcccugcuuugggcug

SEQ ID NO: 1788081 - RNA, 22 nt, Human
ugcagacaggcaagcaccuccu

SEQ ID NO: 1788082 - RNA, 15 nt, Human
ugcagaagacaguau

SEQ ID NO: 1788083 - RNA, 14 nt, Human
ugcagaagacagua

SEQ ID NO: 1788084 - RNA, 19 nt, Human
ugcacuccccugcugggug

SEQ ID NO: 1788085 - RNA, 16 nt, Human
ugcacuccccugcugg

SEQ ID NO: 1788086 - RNA, 17 nt, Human
ugcacuccccugcuggg

SEQ ID NO: 1788087 - RNA, 15 nt, Human
ugcacacauuuuuua

SEQ ID NO: 1788088 - RNA, 13 nt, Human
ugcacacauuuuu

SEQ ID NO: 1788089 - RNA, 12 nt, Human
ugcacacauuuu

SEQ ID NO: 1788090 - RNA, 11 nt, Human
ugcacacauuu

SEQ ID NO: 1788091 - RNA, 17 nt, Human
agccgagaucacgccac

SEQ ID NO: 1788092 - RNA, 21 nt, Human
agccgagauagccaaggccaa

SEQ ID NO: 1788093 - RNA, 20 nt, Human
agccgagauagccaaggcca

SEQ ID NO: 1788094 - RNA, 21 nt, Human
agcccuuagcagggaaacagc

SEQ ID NO: 1788095 - RNA, 16 nt, Human
agcccuuagcagggaa

SEQ ID NO: 1788096 - RNA, 17 nt, Human
ugcagacucuacagagg

SEQ ID NO: 1788097 - RNA, 16 nt, Human
ugcagacucuacagag

SEQ ID NO: 1788098 - RNA, 18 nt, Human
ugcagacucuacagaggc

SEQ ID NO: 1788099 - RNA, 23 nt, Human
agccucugaaaaccaauguucuc

SEQ ID NO: 1788100 - RNA, 17 nt, Human
agccuccaugcugccuc

SEQ ID NO: 1788101 - RNA, 14 nt, Human
agccuccaauuuuu

SEQ ID NO: 1788102 - RNA, 21 nt, Human
agccuccaagcuccaucucca

SEQ ID NO: 1788103 - RNA, 23 nt, Human
ugcagccucaaccuccugggcua

SEQ ID NO: 1788104 - RNA, 22 nt, Human
ugcagccucaaccuccugggcu

SEQ ID NO: 1788105 - RNA, 21 nt, Human
ugcagccucaaccuccugggc

SEQ ID NO: 1788106 - RNA, 20 nt, Human
ugcagccucaaccuccuggg

SEQ ID NO: 1788107 - RNA, 18 nt, Human
agccgagaucacgccacu

SEQ ID NO: 1788108 - RNA, 19 nt, Human
agccucaaccuccugggcu

SEQ ID NO: 1788109 - RNA, 20 nt, Human
agccucaaccuccugggcua

SEQ ID NO: 1788110 - RNA, 17 nt, Human
agccucacaguccuuac

SEQ ID NO: 1788111 - RNA, 18 nt, Human
agccucacaguccuuacc

SEQ ID NO: 1788112 - RNA, 22 nt, Human
agccucagucucccucccuugg

SEQ ID NO: 1788113 - RNA, 13 nt, Human
agccucagucucc

SEQ ID NO: 1788114 - RNA, 16 nt, Human
agccucagucucccuc

SEQ ID NO: 1788115 - RNA, 19 nt, Human
agccucagucucccucccu

SEQ ID NO: 1788116 - RNA, 20 nt, Human
agccucagucucccucccuu

SEQ ID NO: 1788117 - RNA, 23 nt, Human
agcccagcuugaaaccuucacuu

SEQ ID NO: 1788118 - RNA, 14 nt, Human
agcccaggaaaggc

SEQ ID NO: 1788119 - RNA, 21 nt, Human
ugauucauaaugacuuaagca

SEQ ID NO: 1788120 - RNA, 18 nt, Human
agcccaggaaaggcucca

SEQ ID NO: 1788121 - RNA, 16 nt, Human
ugauucauaaugacuu

SEQ ID NO: 1788122 - RNA, 13 nt, Human
ugauucuccugcc

SEQ ID NO: 1788123 - RNA, 16 nt, Human
ugauucucaugccuca

SEQ ID NO: 1788124 - RNA, 13 nt, Human
ugauucucaugcc

SEQ ID NO: 1788125 - RNA, 14 nt, Human
ugauucucaugccu

SEQ ID NO: 1788126 - RNA, 15 nt, Human
ugauucucaugccuc

SEQ ID NO: 1788127 - RNA, 23 nt, Human
ugauucccaagcucugcuccucu

SEQ ID NO: 1788128 - RNA, 22 nt, Human
ugauucccaagcucugcuccuc

SEQ ID NO: 1788129 - RNA, 17 nt, Human
ugauuuggggauauuuu

SEQ ID NO: 1788130 - RNA, 21 nt, Human
ugauuucagcaccuacagugu

SEQ ID NO: 1788131 - RNA, 17 nt, Human
ugauuucagcucacugc

SEQ ID NO: 1788132 - RNA, 22 nt, Human
ugauuuccguuaaaauaccagc

SEQ ID NO: 1788133 - RNA, 21 nt, Human
agccaguaaaugggggugcau

SEQ ID NO: 1788134 - RNA, 22 nt, Human
agccaguaaaugggggugcauu

SEQ ID NO: 1788135 - RNA, 18 nt, Human
agccagguuccacagagg

SEQ ID NO: 1788136 - RNA, 13 nt, Human
agccaguaaaugg

SEQ ID NO: 1788137 - RNA, 15 nt, Human
agcccacuucugcca

SEQ ID NO: 1788138 - RNA, 14 nt, Human
agcccacuucugcc

SEQ ID NO: 1788139 - RNA, 13 nt, Human
agcccacuucugc

SEQ ID NO: 1788140 - RNA, 14 nt, Human
agcccacuguacuu

SEQ ID NO: 1788141 - RNA, 16 nt, Human
agcccacuguacuugc

SEQ ID NO: 1788142 - RNA, 21 nt, Human
ugauccucccaccucagccuc

SEQ ID NO: 1788143 - RNA, 16 nt, Human
ugauccucccaccuca

SEQ ID NO: 1788144 - RNA, 22 nt, Human
ugauccucccaccucagccucc

SEQ ID NO: 1788145 - RNA, 15 nt, Human
ugauccucccaccuc

SEQ ID NO: 1788146 - RNA, 22 nt, Human
ugauccuaaugaaugcauaaaa

SEQ ID NO: 1788147 - RNA, 16 nt, Human
ugauccuaguuccacc

SEQ ID NO: 1788148 - RNA, 13 nt, Human
ugaugagaggaaa

SEQ ID NO: 1788149 - RNA, 14 nt, Human
ugaugagaggaaau

SEQ ID NO: 1788150 - RNA, 15 nt, Human
ugaugagaggaaauc

SEQ ID NO: 1788151 - RNA, 16 nt, Human
ugaugagaggaaauca

SEQ ID NO: 1788152 - RNA, 23 nt, Human
ugaugcuucuucagagacuccug

SEQ ID NO: 1788153 - RNA, 14 nt, Human
ugauggggcccugc

SEQ ID NO: 1788154 - RNA, 15 nt, Human
ugauggggcccugcc

SEQ ID NO: 1788155 - RNA, 16 nt, Human
ugauggggcccugccu

SEQ ID NO: 1788156 - RNA, 19 nt, Human
ugauggggcccugccuccu

SEQ ID NO: 1788157 - RNA, 14 nt, Human
ugaugggauuuggu

SEQ ID NO: 1788158 - RNA, 16 nt, Human
agccacugcaccgggc

SEQ ID NO: 1788159 - RNA, 17 nt, Human
ugauuaauggaaauguu

SEQ ID NO: 1788160 - RNA, 15 nt, Human
agccacgguguucug

SEQ ID NO: 1788161 - RNA, 20 nt, Human
ugauuaaccacuucagcuga

SEQ ID NO: 1788162 - RNA, 19 nt, Human
ugauuaaauucuugcaaag

SEQ ID NO: 1788163 - RNA, 15 nt, Human
ugauggugcaaugac

SEQ ID NO: 1788164 - RNA, 15 nt, Human
ugauggugaugaaau

SEQ ID NO: 1788165 - RNA, 16 nt, Human
ugauggugaugaaaug

SEQ ID NO: 1788166 - RNA, 13 nt, Human
ugauggugcaaug

SEQ ID NO: 1788167 - RNA, 17 nt, Human
ugauggugaugaaaugu

SEQ ID NO: 1788168 - RNA, 20 nt, Human
ugauuaaauucuugcaaagu

SEQ ID NO: 1788169 - RNA, 19 nt, Human
ugauuaaccacuucagcug

SEQ ID NO: 1788170 - RNA, 10 nt, Human
agccagagga

SEQ ID NO: 1788171 - RNA, 11 nt, Human
agccagaggag

SEQ ID NO: 1788172 - RNA, 19 nt, Human
agccacugcaccgggccac

SEQ ID NO: 1788173 - RNA, 18 nt, Human
agccacugcaccgggcca

SEQ ID NO: 1788174 - RNA, 20 nt, Human
agccacugcaccgggccaca

SEQ ID NO: 1788175 - RNA, 14 nt, Human
agccagcaucggaa

SEQ ID NO: 1788176 - RNA, 22 nt, Human
aguugcauagguuuaauaauuu

SEQ ID NO: 1788177 - RNA, 20 nt, Human
aguugccagucaccccggcc

SEQ ID NO: 1788178 - RNA, 17 nt, Human
uuaaaacaacacucaca

SEQ ID NO: 1788179 - RNA, 20 nt, Human
uuaaaaaugguuuaaauggu

SEQ ID NO: 1788180 - RNA, 18 nt, Human
uuaaaaaguggaaaaaua

SEQ ID NO: 1788181 - RNA, 22 nt, Human
uuaaauaaugugaaacuggauu

SEQ ID NO: 1788182 - RNA, 19 nt, Human
uuaaauaaugugaaacugg

SEQ ID NO: 1788183 - RNA, 21 nt, Human
uuaaauaaugugaaacuggau

SEQ ID NO: 1788184 - RNA, 20 nt, Human
uuaaauaaugugaaacugga

SEQ ID NO: 1788185 - RNA, 13 nt, Human
uuaaauaaaucau

SEQ ID NO: 1788186 - RNA, 15 nt, Human
uuaaauaaaucauaa

SEQ ID NO: 1788187 - RNA, 12 nt, Human
uuaaaauauaau

SEQ ID NO: 1788188 - RNA, 16 nt, Human
uuaaaauauuccugca

SEQ ID NO: 1788189 - RNA, 19 nt, Human
uuaaaauauuccugcauuu

SEQ ID NO: 1788190 - RNA, 17 nt, Human
uuaaaccgccaaggcug

SEQ ID NO: 1788191 - RNA, 22 nt, Human
aguuuucacucuuauugcccac

SEQ ID NO: 1788192 - RNA, 15 nt, Human
aguuucguuuucaaa

SEQ ID NO: 1788193 - RNA, 16 nt, Human
aguuucguuuucaaaa

SEQ ID NO: 1788194 - RNA, 16 nt, Human
aguuucucagcuccca

SEQ ID NO: 1788195 - RNA, 21 nt, Human
aguuucuccaagcaggacaug

SEQ ID NO: 1788196 - RNA, 13 nt, Human
aguuucuccaagc

SEQ ID NO: 1788197 - RNA, 15 nt, Human
aguuucuccaagcag

SEQ ID NO: 1788198 - RNA, 16 nt, Human
uuaaauucuugcaaag

SEQ ID NO: 1788199 - RNA, 13 nt, Human
uuaaauucuugca

SEQ ID NO: 1788200 - RNA, 14 nt, Human
uguugucagcugaa

SEQ ID NO: 1788201 - RNA, 16 nt, Human
uguuugccucugccuc

SEQ ID NO: 1788202 - RNA, 14 nt, Human
uguuugccucugcc

SEQ ID NO: 1788203 - RNA, 15 nt, Human
uguuugcaucugaaa

SEQ ID NO: 1788204 - RNA, 15 nt, Human
uguuuggggaugaga

SEQ ID NO: 1788205 - RNA, 19 nt, Human
uguuuggggaugagaaagg

SEQ ID NO: 1788206 - RNA, 15 nt, Human
uguuuucaguguaca

SEQ ID NO: 1788207 - RNA, 17 nt, Human
uguuuucaguguacaug

SEQ ID NO: 1788208 - RNA, 15 nt, Human
uguuuucucuugaga

SEQ ID NO: 1788209 - RNA, 16 nt, Human
aguucucuccuucuuc

SEQ ID NO: 1788210 - RNA, 13 nt, Human
aguucucuccuuc

SEQ ID NO: 1788211 - RNA, 12 nt, Human
aguucucuccuu

SEQ ID NO: 1788212 - RNA, 22 nt, Human
aguugauagcacagacccugcc

SEQ ID NO: 1788213 - RNA, 23 nt, Human
aguugauagcacagacccugccc

SEQ ID NO: 1788214 - RNA, 13 nt, Human
aguugauucagcu

SEQ ID NO: 1788215 - RNA, 19 nt, Human
aguugcaacuuuguauaaa

SEQ ID NO: 1788216 - RNA, 23 nt, Human
aguugauucagcucugcaagaau

SEQ ID NO: 1788217 - RNA, 14 nt, Human
aguugauucagcuc

SEQ ID NO: 1788218 - RNA, 15 nt, Human
aguugauucagcucu

SEQ ID NO: 1788219 - RNA, 17 nt, Human
aguugauucagcucugc

SEQ ID NO: 1788220 - RNA, 18 nt, Human
aguugauucagcucugca

SEQ ID NO: 1788221 - RNA, 15 nt, Human
aguugauagcacaga

SEQ ID NO: 1788222 - RNA, 19 nt, Human
aguugauagcacagacccu

SEQ ID NO: 1788223 - RNA, 20 nt, Human
aguugauagcacagacccug

SEQ ID NO: 1788224 - RNA, 21 nt, Human
aguugauagcacagacccugc

SEQ ID NO: 1788225 - RNA, 16 nt, Human
uguucccauucuugca

SEQ ID NO: 1788226 - RNA, 17 nt, Human
aguguacagucuuguau

SEQ ID NO: 1788227 - RNA, 23 nt, Human
aguguacauggaauaacauguaa

SEQ ID NO: 1788228 - RNA, 13 nt, Human
uguucugggacac

SEQ ID NO: 1788229 - RNA, 15 nt, Human
uguucugggacacag

SEQ ID NO: 1788230 - RNA, 14 nt, Human
uguucugggacaca

SEQ ID NO: 1788231 - RNA, 16 nt, Human
uguucuuaauucuuag

SEQ ID NO: 1788232 - RNA, 14 nt, Human
uguucuuaauucuu

SEQ ID NO: 1788233 - RNA, 16 nt, Human
uguucuuaagacguga

SEQ ID NO: 1788234 - RNA, 18 nt, Human
uguucuugguuuguaaau

SEQ ID NO: 1788235 - RNA, 17 nt, Human
uguucuugguuuguaaa

SEQ ID NO: 1788236 - RNA, 14 nt, Human
uguucuuuccaaag

SEQ ID NO: 1788237 - RNA, 13 nt, Human
uguucuuuccaaa

SEQ ID NO: 1788238 - RNA, 19 nt, Human
uguucuugguuuguaaauu

SEQ ID NO: 1788239 - RNA, 16 nt, Human
aguggugcgaucuggg

SEQ ID NO: 1788240 - RNA, 21 nt, Human
agugguuccuaauccucuagg

SEQ ID NO: 1788241 - RNA, 19 nt, Human
agugggugaauaauacagu

SEQ ID NO: 1788242 - RNA, 16 nt, Human
aguguacagucuugua

SEQ ID NO: 1788243 - RNA, 15 nt, Human
aguguacagucuugu

SEQ ID NO: 1788244 - RNA, 13 nt, Human
aguguacagucuu

SEQ ID NO: 1788245 - RNA, 21 nt, Human
aguguacauggaauaacaugu

SEQ ID NO: 1788246 - RNA, 22 nt, Human
aguguacauggaauaacaugua

SEQ ID NO: 1788247 - RNA, 13 nt, Human
aguggcagcugcu

SEQ ID NO: 1788248 - RNA, 12 nt, Human
aguggcagcugc

SEQ ID NO: 1788249 - RNA, 20 nt, Human
aguggcagcugcuuuugucu

SEQ ID NO: 1788250 - RNA, 14 nt, Human
aguggcagcugcuu

SEQ ID NO: 1788251 - RNA, 18 nt, Human
agugggggaucacagccu

SEQ ID NO: 1788252 - RNA, 13 nt, Human
agugggugaauaa

SEQ ID NO: 1788253 - RNA, 18 nt, Human
agugggugaauaauacag

SEQ ID NO: 1788254 - RNA, 19 nt, Human
agugggggaguggccacag

SEQ ID NO: 1788255 - RNA, 20 nt, Human
agugggggaguggccacaga

SEQ ID NO: 1788256 - RNA, 20 nt, Human
aguuauuauauuuacaaaug

SEQ ID NO: 1788257 - RNA, 16 nt, Human
aguuaccagugccuua

SEQ ID NO: 1788258 - RNA, 15 nt, Human
aguuaccagugccuu

SEQ ID NO: 1788259 - RNA, 20 nt, Human
uguucuuuccaaaguacacu

SEQ ID NO: 1788260 - RNA, 18 nt, Human
uguucuuuccaaaguaca

SEQ ID NO: 1788261 - RNA, 19 nt, Human
aguuaguuccacugagacc

SEQ ID NO: 1788262 - RNA, 17 nt, Human
aguuaguuccacugaga

SEQ ID NO: 1788263 - RNA, 15 nt, Human
aguuaguuccacuga

SEQ ID NO: 1788264 - RNA, 21 nt, Human
aguuauuuuuauuuauuuaaa

SEQ ID NO: 1788265 - RNA, 17 nt, Human
aguucccuacuuccugu

SEQ ID NO: 1788266 - RNA, 13 nt, Human
uguugggccagga

SEQ ID NO: 1788267 - RNA, 16 nt, Human
uguugggccaggagcc

SEQ ID NO: 1788268 - RNA, 20 nt, Human
uguugucaagaauagcauug

SEQ ID NO: 1788269 - RNA, 16 nt, Human
uguugucaagaauagc

SEQ ID NO: 1788270 - RNA, 11 nt, Human
uguugucaaga

SEQ ID NO: 1788271 - RNA, 13 nt, Human
uguugucagcuga

SEQ ID NO: 1788272 - RNA, 14 nt, Human
uguuguauucauug

SEQ ID NO: 1788273 - RNA, 17 nt, Human
uuaucaugugaaaucau

SEQ ID NO: 1788274 - RNA, 18 nt, Human
uuaucaugugaaaucauu

SEQ ID NO: 1788275 - RNA, 20 nt, Human
uuaucaugugaaaucauuca

SEQ ID NO: 1788276 - RNA, 22 nt, Human
uuaucaugugaaaucauucauu

SEQ ID NO: 1788277 - RNA, 19 nt, Human
auaccagccaguaaauggg

SEQ ID NO: 1788278 - RNA, 21 nt, Human
auacuaaccagcagaaaugcc

SEQ ID NO: 1788279 - RNA, 20 nt, Human
auacuacaguuuguuaguau

SEQ ID NO: 1788280 - RNA, 16 nt, Human
auacuacaguuuguua

SEQ ID NO: 1788281 - RNA, 15 nt, Human
auacuacaguuuguu

SEQ ID NO: 1788282 - RNA, 13 nt, Human
auacuacaguuug

SEQ ID NO: 1788283 - RNA, 21 nt, Human
auacaguucggugagcuacaa

SEQ ID NO: 1788284 - RNA, 22 nt, Human
auacaggaaaagcugcugacag

SEQ ID NO: 1788285 - RNA, 20 nt, Human
auacaggaaaagcugcugac

SEQ ID NO: 1788286 - RNA, 19 nt, Human
auacaggaaaagcugcuga

SEQ ID NO: 1788287 - RNA, 14 nt, Human
auacaggaaaagcu

SEQ ID NO: 1788288 - RNA, 20 nt, Human
auacauaaacaagaccacgu

SEQ ID NO: 1788289 - RNA, 21 nt, Human
auacauuuaaaacauuaaaau

SEQ ID NO: 1788290 - RNA, 16 nt, Human
auacauuuaaaacauu

SEQ ID NO: 1788291 - RNA, 16 nt, Human
auacauuugauaaagu

SEQ ID NO: 1788292 - RNA, 16 nt, Human
uuagcaguuugcuuug

SEQ ID NO: 1788293 - RNA, 14 nt, Human
uuagccccauaauu

SEQ ID NO: 1788294 - RNA, 18 nt, Human
uuauacccccugcaaagc

SEQ ID NO: 1788295 - RNA, 15 nt, Human
auacaaaagcaugug

SEQ ID NO: 1788296 - RNA, 13 nt, Human
auacaaaagcaug

SEQ ID NO: 1788297 - RNA, 12 nt, Human
auacaaaagcau

SEQ ID NO: 1788298 - RNA, 22 nt, Human
auacaaaaaaaaaaaaaaauua

SEQ ID NO: 1788299 - RNA, 23 nt, Human
auaauuuuguaauguaucaaaua

SEQ ID NO: 1788300 - RNA, 13 nt, Human
auaauuuuguaau

SEQ ID NO: 1788301 - RNA, 12 nt, Human
auaauuuuguaa

SEQ ID NO: 1788302 - RNA, 16 nt, Human
auaaacuuuaccuuuu

SEQ ID NO: 1788303 - RNA, 15 nt, Human
auaaacuuuaccuuu

SEQ ID NO: 1788304 - RNA, 13 nt, Human
auaaacuuuaccu

SEQ ID NO: 1788305 - RNA, 23 nt, Human
auaaacacucuugaaaaaugcau

SEQ ID NO: 1788306 - RNA, 20 nt, Human
auaaccaaagcccaaagugg

SEQ ID NO: 1788307 - RNA, 20 nt, Human
auaaccaguguuguggauuu

SEQ ID NO: 1788308 - RNA, 19 nt, Human
auaacaugugaaaagaaua

SEQ ID NO: 1788309 - RNA, 12 nt, Human
auaaauaacuuu

SEQ ID NO: 1788310 - RNA, 13 nt, Human
auaaauaaaguuu

SEQ ID NO: 1788311 - RNA, 19 nt, Human
auaaauaaaguuuguugaa

SEQ ID NO: 1788312 - RNA, 23 nt, Human
uuaccauuuugggguacccacug

SEQ ID NO: 1788313 - RNA, 18 nt, Human
uuacaggaaguacuggag

SEQ ID NO: 1788314 - RNA, 22 nt, Human
uuacaggaaguacuggagaaaa

SEQ ID NO: 1788315 - RNA, 15 nt, Human
uuacaggaaguacug

SEQ ID NO: 1788316 - RNA, 16 nt, Human
uuacaggaaguacugg

SEQ ID NO: 1788317 - RNA, 14 nt, Human
auaaugaauacuuu

SEQ ID NO: 1788318 - RNA, 14 nt, Human
auaauucuacuuug

SEQ ID NO: 1788319 - RNA, 19 nt, Human
auaauacaguaucucaggg

SEQ ID NO: 1788320 - RNA, 16 nt, Human
uuagauguaauuuugu

SEQ ID NO: 1788321 - RNA, 22 nt, Human
auaaguuaacuuccaauuuaca

SEQ ID NO: 1788322 - RNA, 21 nt, Human
auaauacaccacuacauucug

SEQ ID NO: 1788323 - RNA, 23 nt, Human
auaauacaccacuacauucuguu

SEQ ID NO: 1788324 - RNA, 22 nt, Human
auaagaaccuuuugagugccuu

SEQ ID NO: 1788325 - RNA, 23 nt, Human
auaagaaccuuuugagugccuua

SEQ ID NO: 1788326 - RNA, 17 nt, Human
auaaguuaacuuccaau

SEQ ID NO: 1788327 - RNA, 23 nt, Human
uggguggaugccugguggcagcu

SEQ ID NO: 1788328 - RNA, 14 nt, Human
uggguggaugccug

SEQ ID NO: 1788329 - RNA, 22 nt, Human
ugggucuuguuuuuuuuuucca

SEQ ID NO: 1788330 - RNA, 15 nt, Human
ugguccauagagagc

SEQ ID NO: 1788331 - RNA, 16 nt, Human
ugguccauagagagca

SEQ ID NO: 1788332 - RNA, 22 nt, Human
ugguaauuuaagauuccagaga

SEQ ID NO: 1788333 - RNA, 23 nt, Human
uggucaccaaaucagcugcuacu

SEQ ID NO: 1788334 - RNA, 21 nt, Human
uggucaccaaaucagcugcua

SEQ ID NO: 1788335 - RNA, 16 nt, Human
aggguaucaggugcug

SEQ ID NO: 1788336 - RNA, 12 nt, Human
aggguagggugg

SEQ ID NO: 1788337 - RNA, 18 nt, Human
aggguaucaggugcugcc

SEQ ID NO: 1788338 - RNA, 19 nt, Human
aggguacuaaggaaucuuu

SEQ ID NO: 1788339 - RNA, 12 nt, Human
aggguaaguauu

SEQ ID NO: 1788340 - RNA, 16 nt, Human
aggggauagagagaga

SEQ ID NO: 1788341 - RNA, 15 nt, Human
agggggaaggcaggg

SEQ ID NO: 1788342 - RNA, 13 nt, Human
agggggcugggac

SEQ ID NO: 1788343 - RNA, 15 nt, Human
aggucagugcaaaua

SEQ ID NO: 1788344 - RNA, 21 nt, Human
aggucaaggcugcagugagcc

SEQ ID NO: 1788345 - RNA, 23 nt, Human
aggucauuuuuuuuaagaaaaag

SEQ ID NO: 1788346 - RNA, 22 nt, Human
aggucauuuuuuuuaagaaaaa

SEQ ID NO: 1788347 - RNA, 21 nt, Human
aggucuugaacuccuggccuc

SEQ ID NO: 1788348 - RNA, 20 nt, Human
aggucuugaacuccuggccu

SEQ ID NO: 1788349 - RNA, 17 nt, Human
agguccacaacacacag

SEQ ID NO: 1788350 - RNA, 22 nt, Human
aggucuugaacuccuggccuca

SEQ ID NO: 1788351 - RNA, 22 nt, Human
aggugaaacuccagaugccaca

SEQ ID NO: 1788352 - RNA, 21 nt, Human
aggugaaacuccagaugccac

SEQ ID NO: 1788353 - RNA, 20 nt, Human
aggugaaacuccagaugcca

SEQ ID NO: 1788354 - RNA, 19 nt, Human
aggugaaacuccagaugcc

SEQ ID NO: 1788355 - RNA, 17 nt, Human
agguaugcaaucaaauc

SEQ ID NO: 1788356 - RNA, 20 nt, Human
aggguuuauguuuaggaugu

SEQ ID NO: 1788357 - RNA, 17 nt, Human
aggguugggcugguguc

SEQ ID NO: 1788358 - RNA, 14 nt, Human
uggucuuuugguua

SEQ ID NO: 1788359 - RNA, 20 nt, Human
uggugaacauugcaauagaa

SEQ ID NO: 1788360 - RNA, 15 nt, Human
uggugaacauugcaa

SEQ ID NO: 1788361 - RNA, 19 nt, Human
uggugaacagaacaaaagg

SEQ ID NO: 1788362 - RNA, 21 nt, Human
aggguggugaccucugccuga

SEQ ID NO: 1788363 - RNA, 19 nt, Human
aggguggugaccucugccu

SEQ ID NO: 1788364 - RNA, 18 nt, Human
aggguggugaccucugcc

SEQ ID NO: 1788365 - RNA, 17 nt, Human
aggguggugaccucugc

SEQ ID NO: 1788366 - RNA, 15 nt, Human
aggguugggcuggug

SEQ ID NO: 1788367 - RNA, 17 nt, Human
aggguuggccccugccc

SEQ ID NO: 1788368 - RNA, 14 nt, Human
aggguuggccccug

SEQ ID NO: 1788369 - RNA, 13 nt, Human
aggguuggccccu

SEQ ID NO: 1788370 - RNA, 22 nt, Human
ugguccaugggccauaugaaaa

SEQ ID NO: 1788371 - RNA, 19 nt, Human
ugguccauagagagcaaga

SEQ ID NO: 1788372 - RNA, 20 nt, Human
uggucucgaacuccugaccu

SEQ ID NO: 1788373 - RNA, 21 nt, Human
uggucucgaacuccugaccuu

SEQ ID NO: 1788374 - RNA, 15 nt, Human
uggucucgaacuccu

SEQ ID NO: 1788375 - RNA, 19 nt, Human
uggucucgaacuccugacc

SEQ ID NO: 1788376 - RNA, 13 nt, Human
uggucccacccca

SEQ ID NO: 1788377 - RNA, 12 nt, Human
uggucuguguga

SEQ ID NO: 1788378 - RNA, 22 nt, Human
uggucugugagaugcuagaacu

SEQ ID NO: 1788379 - RNA, 16 nt, Human
uggucuuauuuguaaa

SEQ ID NO: 1788380 - RNA, 18 nt, Human
uggucugacccacugcuu

SEQ ID NO: 1788381 - RNA, 16 nt, Human
uguaaaggaauuuaaa

SEQ ID NO: 1788382 - RNA, 15 nt, Human
ugguuuucuguucuu

SEQ ID NO: 1788383 - RNA, 13 nt, Human
ugguuuucuguuc

SEQ ID NO: 1788384 - RNA, 23 nt, Human
aggugauccacccaccucagccu

SEQ ID NO: 1788385 - RNA, 21 nt, Human
aggugauccacccaccucagc

SEQ ID NO: 1788386 - RNA, 18 nt, Human
ugguuuuaguugcaacuu

SEQ ID NO: 1788387 - RNA, 12 nt, Human
ugguuuucuguu

SEQ ID NO: 1788388 - RNA, 21 nt, Human
ugguuuguaaauuaacuuuua

SEQ ID NO: 1788389 - RNA, 15 nt, Human
ugguuucagaaaugu

SEQ ID NO: 1788390 - RNA, 14 nt, Human
ugguuucagaaaug

SEQ ID NO: 1788391 - RNA, 15 nt, Human
ugguguuuccuggca

SEQ ID NO: 1788392 - RNA, 17 nt, Human
ugguguuuccuggcacu

SEQ ID NO: 1788393 - RNA, 23 nt, Human
ugguucaggguuggccccugccc

SEQ ID NO: 1788394 - RNA, 22 nt, Human
ugguucaggguuggccccugcc

SEQ ID NO: 1788395 - RNA, 20 nt, Human
ugguucaggguuggccccug

SEQ ID NO: 1788396 - RNA, 12 nt, Human
ugguggcagcug

SEQ ID NO: 1788397 - RNA, 15 nt, Human
ugguguguguaugcg

SEQ ID NO: 1788398 - RNA, 21 nt, Human
aggugaacauugguucuuuca

SEQ ID NO: 1788399 - RNA, 14 nt, Human
aggugaacauuggu

SEQ ID NO: 1788400 - RNA, 15 nt, Human
ugguggcagagugga

SEQ ID NO: 1788401 - RNA, 12 nt, Human
ugguggcagcuc

SEQ ID NO: 1788402 - RNA, 16 nt, Human
ugguggcagcucaccu

SEQ ID NO: 1788403 - RNA, 19 nt, Human
ugguggcagcucaccucuc

SEQ ID NO: 1788404 - RNA, 20 nt, Human
ugguggcagcucaccucucc

SEQ ID NO: 1788405 - RNA, 23 nt, Human
ugguggcagcucaccucucccuu

SEQ ID NO: 1788406 - RNA, 19 nt, Human
uguacuugcucuugaugcc

SEQ ID NO: 1788407 - RNA, 15 nt, Human
uguacuugcucuuga

SEQ ID NO: 1788408 - RNA, 20 nt, Human
uguacaugaaaacacauuuu

SEQ ID NO: 1788409 - RNA, 19 nt, Human
uguacaugaaaacacauuu

SEQ ID NO: 1788410 - RNA, 18 nt, Human
uguacaugaaaacacauu

SEQ ID NO: 1788411 - RNA, 17 nt, Human
uguacaugaaaacacau

SEQ ID NO: 1788412 - RNA, 15 nt, Human
uguaaggcaaucaug

SEQ ID NO: 1788413 - RNA, 16 nt, Human
uguaauuugugauaca

SEQ ID NO: 1788414 - RNA, 18 nt, Human
uguaaggaaugauuaauu

SEQ ID NO: 1788415 - RNA, 21 nt, Human
uguaauuugugauacaaugcu

SEQ ID NO: 1788416 - RNA, 17 nt, Human
uguaauuugugauacaa

SEQ ID NO: 1788417 - RNA, 19 nt, Human
uguacaaaguagaagucuu

SEQ ID NO: 1788418 - RNA, 23 nt, Human
uguacaaaguagaagucuuagau

SEQ ID NO: 1788419 - RNA, 20 nt, Human
aggugugagucaccaagccc

SEQ ID NO: 1788420 - RNA, 14 nt, Human
aggugugagucacc

SEQ ID NO: 1788421 - RNA, 20 nt, Human
aggugugagccaccacgccc

SEQ ID NO: 1788422 - RNA, 20 nt, Human
aggugugacugaauuucuuu

SEQ ID NO: 1788423 - RNA, 22 nt, Human
aggugugaaccaccacacccag

SEQ ID NO: 1788424 - RNA, 23 nt, Human
aggugugaaccaccacacccagc

SEQ ID NO: 1788425 - RNA, 18 nt, Human
aggugugacugaauuucu

SEQ ID NO: 1788426 - RNA, 13 nt, Human
agguggggcagcu

SEQ ID NO: 1788427 - RNA, 22 nt, Human
aggugauccacucgccuucauc

SEQ ID NO: 1788428 - RNA, 14 nt, Human
agguggggcagcuu

SEQ ID NO: 1788429 - RNA, 23 nt, Human
agguggggucacucuggcagcuc

SEQ ID NO: 1788430 - RNA, 16 nt, Human
agguggggcagcuuga

SEQ ID NO: 1788431 - RNA, 16 nt, Human
agguugucugaaguca

SEQ ID NO: 1788432 - RNA, 20 nt, Human
agguugucugaagucacugc

SEQ ID NO: 1788433 - RNA, 13 nt, Human
uguaaggaaugau

SEQ ID NO: 1788434 - RNA, 14 nt, Human
uguaaggaaugauu

SEQ ID NO: 1788435 - RNA, 15 nt, Human
uguaaggaaugauua

SEQ ID NO: 1788436 - RNA, 17 nt, Human
uguaagaaauacagacu

SEQ ID NO: 1788437 - RNA, 15 nt, Human
uguaagaaauacaga

SEQ ID NO: 1788438 - RNA, 22 nt, Human
uguaagcucuacugaggugcua

SEQ ID NO: 1788439 - RNA, 17 nt, Human
agugaaagaaaauaaca

SEQ ID NO: 1788440 - RNA, 14 nt, Human
agugagacagcucu

SEQ ID NO: 1788441 - RNA, 16 nt, Human
agugaaaacuuuguag

SEQ ID NO: 1788442 - RNA, 15 nt, Human
agugaaaacuuugua

SEQ ID NO: 1788443 - RNA, 14 nt, Human
agugaaaauauagc

SEQ ID NO: 1788444 - RNA, 13 nt, Human
agugagacucugu

SEQ ID NO: 1788445 - RNA, 21 nt, Human
agugagacccugucucaaaaa

SEQ ID NO: 1788446 - RNA, 13 nt, Human
agugagacagacu

SEQ ID NO: 1788447 - RNA, 17 nt, Human
agugagacccugucuca

SEQ ID NO: 1788448 - RNA, 17 nt, Human
agugagacucugucuca

SEQ ID NO: 1788449 - RNA, 16 nt, Human
agugagacucugucuc

SEQ ID NO: 1788450 - RNA, 22 nt, Human
agugagacucugucucaaaaaa

SEQ ID NO: 1788451 - RNA, 14 nt, Human
agugagagcugggu

SEQ ID NO: 1788452 - RNA, 16 nt, Human
agugagccgagauugu

SEQ ID NO: 1788453 - RNA, 15 nt, Human
ugugauggggcccug

SEQ ID NO: 1788454 - RNA, 16 nt, Human
ugugauggggcccugc

SEQ ID NO: 1788455 - RNA, 17 nt, Human
ugugauggggcccugcc

SEQ ID NO: 1788456 - RNA, 18 nt, Human
ugugauggggcccugccu

SEQ ID NO: 1788457 - RNA, 19 nt, Human
agucuccaaagucucugga

SEQ ID NO: 1788458 - RNA, 14 nt, Human
agucucccucccuu

SEQ ID NO: 1788459 - RNA, 18 nt, Human
agucucccucccuugggg

SEQ ID NO: 1788460 - RNA, 14 nt, Human
ugugaacugaacuc

SEQ ID NO: 1788461 - RNA, 23 nt, Human
ugugaacugaacucugacaacag

SEQ ID NO: 1788462 - RNA, 22 nt, Human
ugugagaugcuagaacucccuu

SEQ ID NO: 1788463 - RNA, 19 nt, Human
ugugagcacaaagguagcu

SEQ ID NO: 1788464 - RNA, 13 nt, Human
agucuuuuccaug

SEQ ID NO: 1788465 - RNA, 15 nt, Human
agucuuuuccaugaa

SEQ ID NO: 1788466 - RNA, 11 nt, Human
agugaaaaagg

SEQ ID NO: 1788467 - RNA, 17 nt, Human
agugaaaaaggaggaag

SEQ ID NO: 1788468 - RNA, 20 nt, Human
agugaaaaaggaggaagaga

SEQ ID NO: 1788469 - RNA, 23 nt, Human
agugaaaaaggaggaagagaaaa

SEQ ID NO: 1788470 - RNA, 21 nt, Human
ugucuugcaauggcagccuug

SEQ ID NO: 1788471 - RNA, 20 nt, Human
ugucuugcaauggcagccuu

SEQ ID NO: 1788472 - RNA, 18 nt, Human
ugucuugcaauggcagcc

SEQ ID NO: 1788473 - RNA, 17 nt, Human
ugucuugcaauggcagc

SEQ ID NO: 1788474 - RNA, 15 nt, Human
ugucuugcaauggca

SEQ ID NO: 1788475 - RNA, 23 nt, Human
ugugaaccaccacacccagccca

SEQ ID NO: 1788476 - RNA, 22 nt, Human
ugugaaccaccacacccagccc

SEQ ID NO: 1788477 - RNA, 17 nt, Human
ugugaaccaccacaccc

SEQ ID NO: 1788478 - RNA, 16 nt, Human
ugugaaccaccacacc

SEQ ID NO: 1788479 - RNA, 15 nt, Human
ugugaaccaccacac

SEQ ID NO: 1788480 - RNA, 23 nt, Human
aguccccuguuuguuucugaaag

SEQ ID NO: 1788481 - RNA, 13 nt, Human
agucccugccaau

SEQ ID NO: 1788482 - RNA, 14 nt, Human
agucccugccaaug

SEQ ID NO: 1788483 - RNA, 16 nt, Human
agucccugccaaugga

SEQ ID NO: 1788484 - RNA, 22 nt, Human
ugucucuggauuauauuaugaa

SEQ ID NO: 1788485 - RNA, 13 nt, Human
ugucucugagagu

SEQ ID NO: 1788486 - RNA, 20 nt, Human
ugucucgugguaggacugua

SEQ ID NO: 1788487 - RNA, 19 nt, Human
ugucucgugguaggacugu

SEQ ID NO: 1788488 - RNA, 18 nt, Human
ugucucgugguaggacug

SEQ ID NO: 1788489 - RNA, 21 nt, Human
ugucucgugguaggacuguag

SEQ ID NO: 1788490 - RNA, 17 nt, Human
ugucucuacuaaaaaua

SEQ ID NO: 1788491 - RNA, 21 nt, Human
ugucucuuuaaugucacaggc

SEQ ID NO: 1788492 - RNA, 22 nt, Human
ugucucuugguccugcugcagu

SEQ ID NO: 1788493 - RNA, 22 nt, Human
ugucucuuuaaugucacaggca

SEQ ID NO: 1788494 - RNA, 18 nt, Human
ugucuuaauuuucuuuca

SEQ ID NO: 1788495 - RNA, 18 nt, Human
ugucucuugguccugcug

SEQ ID NO: 1788496 - RNA, 19 nt, Human
ugucucuugguccugcugc

SEQ ID NO: 1788497 - RNA, 20 nt, Human
ugucucuugguccugcugca

SEQ ID NO: 1788498 - RNA, 21 nt, Human
ugucucuugguccugcugcag

SEQ ID NO: 1788499 - RNA, 15 nt, Human
uguagagccaggguc

SEQ ID NO: 1788500 - RNA, 12 nt, Human
uguagagccagg

SEQ ID NO: 1788501 - RNA, 16 nt, Human
uguaucccaugagccu

SEQ ID NO: 1788502 - RNA, 15 nt, Human
uguaucccaugagcc

SEQ ID NO: 1788503 - RNA, 14 nt, Human
uguauguguaagua

SEQ ID NO: 1788504 - RNA, 15 nt, Human
uguauuagucacaga

SEQ ID NO: 1788505 - RNA, 21 nt, Human
uguauuaaguuguuaauaaaa

SEQ ID NO: 1788506 - RNA, 11 nt, Human
uguauuaugug

SEQ ID NO: 1788507 - RNA, 14 nt, Human
ugucaaagugguga

SEQ ID NO: 1788508 - RNA, 15 nt, Human
ugucaaaguggugag

SEQ ID NO: 1788509 - RNA, 19 nt, Human
ugucaaauauuuagaugua

SEQ ID NO: 1788510 - RNA, 16 nt, Human
ugucaaaguggugaga

SEQ ID NO: 1788511 - RNA, 19 nt, Human
ugucaaaguggugagaggc

SEQ ID NO: 1788512 - RNA, 14 nt, Human
aguagcugggacua

SEQ ID NO: 1788513 - RNA, 13 nt, Human
aguagcugggacu

SEQ ID NO: 1788514 - RNA, 21 nt, Human
aguagcugggacuacaggcac

SEQ ID NO: 1788515 - RNA, 19 nt, Human
aguagcugggacuacaggc

SEQ ID NO: 1788516 - RNA, 22 nt, Human
aguagcugggacuacaggcacc

SEQ ID NO: 1788517 - RNA, 17 nt, Human
aguagcuggauuacagg

SEQ ID NO: 1788518 - RNA, 14 nt, Human
aguauuauaccuuu

SEQ ID NO: 1788519 - RNA, 15 nt, Human
aguauuauaccuuuu

SEQ ID NO: 1788520 - RNA, 22 nt, Human
agucacagagauaauucuagcu

SEQ ID NO: 1788521 - RNA, 21 nt, Human
aguauuuaauucauguugccu

SEQ ID NO: 1788522 - RNA, 15 nt, Human
agucacugagacagc

SEQ ID NO: 1788523 - RNA, 16 nt, Human
agucacugagacagcc

SEQ ID NO: 1788524 - RNA, 17 nt, Human
agucacugagacagccc

SEQ ID NO: 1788525 - RNA, 15 nt, Human
ugucagcauagaagu

SEQ ID NO: 1788526 - RNA, 20 nt, Human
agucacauuccaagccucau

SEQ ID NO: 1788527 - RNA, 23 nt, Human
agucccaccuuggcugcagggag

SEQ ID NO: 1788528 - RNA, 21 nt, Human
agucccaccuuggcugcaggg

SEQ ID NO: 1788529 - RNA, 14 nt, Human
aguccccuguuugu

SEQ ID NO: 1788530 - RNA, 19 nt, Human
aguccccuguuuguuucug

SEQ ID NO: 1788531 - RNA, 20 nt, Human
agucccaggcugagccucag

SEQ ID NO: 1788532 - RNA, 19 nt, Human
agucagggguucccuuuuu

SEQ ID NO: 1788533 - RNA, 20 nt, Human
ugucccuaccgagucucuuc

SEQ ID NO: 1788534 - RNA, 21 nt, Human
ugucccuaccgagucucuucu

SEQ ID NO: 1788535 - RNA, 22 nt, Human
ugucccuaccgagucucuucuc

SEQ ID NO: 1788536 - RNA, 20 nt, Human
uguccaggcacugcugccca

SEQ ID NO: 1788537 - RNA, 21 nt, Human
uguccaggcacugcugcccag

SEQ ID NO: 1788538 - RNA, 19 nt, Human
uguccaggcacugcugccc

SEQ ID NO: 1788539 - RNA, 16 nt, Human
ugucagccauuccugu

SEQ ID NO: 1788540 - RNA, 14 nt, Human
ugucccugcacuug

SEQ ID NO: 1788541 - RNA, 17 nt, Human
ugucccuuuuccuuuuu

SEQ ID NO: 1788542 - RNA, 12 nt, Human
ugucccuuuucc

SEQ ID NO: 1788543 - RNA, 13 nt, Human
ugaaagaaaauaa

SEQ ID NO: 1788544 - RNA, 18 nt, Human
ugaaacuggauuaaacuu

SEQ ID NO: 1788545 - RNA, 17 nt, Human
ugaaacuggauuaaacu

SEQ ID NO: 1788546 - RNA, 14 nt, Human
ugaaaauuaacaug

SEQ ID NO: 1788547 - RNA, 23 nt, Human
ucuuuuuuuuuuuuuaaagacag

SEQ ID NO: 1788548 - RNA, 14 nt, Human
ucuuuuuuugugau

SEQ ID NO: 1788549 - RNA, 16 nt, Human
ucuuuuuuugugaugu

SEQ ID NO: 1788550 - RNA, 13 nt, Human
ugaaaacacauuu

SEQ ID NO: 1788551 - RNA, 12 nt, Human
ugaaaacacauu

SEQ ID NO: 1788552 - RNA, 14 nt, Human
ugaaaacacauuuu

SEQ ID NO: 1788553 - RNA, 20 nt, Human
ugaaaacacauuuuucuuag

SEQ ID NO: 1788554 - RNA, 19 nt, Human
ugaaaacacauuuuucuua

SEQ ID NO: 1788555 - RNA, 17 nt, Human
ugaaaacacauuuuucu

SEQ ID NO: 1788556 - RNA, 15 nt, Human
ugaaaacacauuuuu

SEQ ID NO: 1788557 - RNA, 15 nt, Human
agagacuccugcagg

SEQ ID NO: 1788558 - RNA, 12 nt, Human
agagacuccugc

SEQ ID NO: 1788559 - RNA, 13 nt, Human
agagacuccugca

SEQ ID NO: 1788560 - RNA, 14 nt, Human
agagacuccugcag

SEQ ID NO: 1788561 - RNA, 17 nt, Human
agagaguggcuccuccc

SEQ ID NO: 1788562 - RNA, 22 nt, Human
agagaccaucccugaaggcccc

SEQ ID NO: 1788563 - RNA, 23 nt, Human
agagaccaucccugaaggccccg

SEQ ID NO: 1788564 - RNA, 19 nt, Human
agagaccaucccugaaggc

SEQ ID NO: 1788565 - RNA, 21 nt, Human
agagaccaucccugaaggccc

SEQ ID NO: 1788566 - RNA, 18 nt, Human
ugaaagaggaaugaagua

SEQ ID NO: 1788567 - RNA, 18 nt, Human
ugaaagacuguacaaagu

SEQ ID NO: 1788568 - RNA, 19 nt, Human
ugaaagacuguacaaagua

SEQ ID NO: 1788569 - RNA, 22 nt, Human
ugaaagacuguacaaaguagaa

SEQ ID NO: 1788570 - RNA, 17 nt, Human
ugaaagaggaaugaagu

SEQ ID NO: 1788571 - RNA, 16 nt, Human
ugaaagacuguacaaa

SEQ ID NO: 1788572 - RNA, 22 nt, Human
ugaaagaaaauaccaaggaaca

SEQ ID NO: 1788573 - RNA, 14 nt, Human
ucuuuguggcuucc

SEQ ID NO: 1788574 - RNA, 21 nt, Human
ucuuuuuucuaaaguaaaaac

SEQ ID NO: 1788575 - RNA, 22 nt, Human
ucuuuuuucuaaaguaaaaaca

SEQ ID NO: 1788576 - RNA, 16 nt, Human
ucuuuguaaugaaaac

SEQ ID NO: 1788577 - RNA, 14 nt, Human
ucuuuguacagaca

SEQ ID NO: 1788578 - RNA, 15 nt, Human
ucuuuguacagacaa

SEQ ID NO: 1788579 - RNA, 20 nt, Human
ucuuuguacagacaacaaac

SEQ ID NO: 1788580 - RNA, 15 nt, Human
agagacagaaagcag

SEQ ID NO: 1788581 - RNA, 14 nt, Human
agagacagaaagca

SEQ ID NO: 1788582 - RNA, 20 nt, Human
agacugguuccauggccucu

SEQ ID NO: 1788583 - RNA, 14 nt, Human
agacuguacaaagu

SEQ ID NO: 1788584 - RNA, 17 nt, Human
agacuuuggaaagacuu

SEQ ID NO: 1788585 - RNA, 15 nt, Human
agacuuuggaaagag

SEQ ID NO: 1788586 - RNA, 15 nt, Human
agacuuuuaugauac

SEQ ID NO: 1788587 - RNA, 15 nt, Human
agacuuuuccaaccc

SEQ ID NO: 1788588 - RNA, 12 nt, Human
agacuuuuauga

SEQ ID NO: 1788589 - RNA, 19 nt, Human
agacuuuggaaagaguagg

SEQ ID NO: 1788590 - RNA, 19 nt, Human
agacuuuucuuucagccaa

SEQ ID NO: 1788591 - RNA, 16 nt, Human
agagacacaagccuuc

SEQ ID NO: 1788592 - RNA, 19 nt, Human
agagacacaagccuucggc

SEQ ID NO: 1788593 - RNA, 13 nt, Human
agacucugucuca

SEQ ID NO: 1788594 - RNA, 16 nt, Human
agacucccaagcugga

SEQ ID NO: 1788595 - RNA, 21 nt, Human
agacuccagcuggguuggaaa

SEQ ID NO: 1788596 - RNA, 13 nt, Human
agacuccugcagg

SEQ ID NO: 1788597 - RNA, 15 nt, Human
ucuuuaaugucacag

SEQ ID NO: 1788598 - RNA, 22 nt, Human
agacaggcaagcaccuccugcc

SEQ ID NO: 1788599 - RNA, 20 nt, Human
agacaggcaagcaccuccug

SEQ ID NO: 1788600 - RNA, 19 nt, Human
ucuuuaaugucacaggcag

SEQ ID NO: 1788601 - RNA, 18 nt, Human
ucuuuaaugucacaggca

SEQ ID NO: 1788602 - RNA, 12 nt, Human
ucuuuccugagg

SEQ ID NO: 1788603 - RNA, 15 nt, Human
ugaaguaagcaaaga

SEQ ID NO: 1788604 - RNA, 17 nt, Human
ugaaguacucauacaug

SEQ ID NO: 1788605 - RNA, 13 nt, Human
ugaagucacacag

SEQ ID NO: 1788606 - RNA, 12 nt, Human
ugaauaauacag

SEQ ID NO: 1788607 - RNA, 23 nt, Human
ugaauaauguaagacaaauaugu

SEQ ID NO: 1788608 - RNA, 13 nt, Human
ugaauaauacagu

SEQ ID NO: 1788609 - RNA, 18 nt, Human
ugaauauuuaguguucau

SEQ ID NO: 1788610 - RNA, 22 nt, Human
ugaaguaauaugcacacauuuu

SEQ ID NO: 1788611 - RNA, 21 nt, Human
ugaaguaauaugcacacauuu

SEQ ID NO: 1788612 - RNA, 20 nt, Human
ugaaguaauaugcacacauu

SEQ ID NO: 1788613 - RNA, 16 nt, Human
ugaaguaauaugcaca

SEQ ID NO: 1788614 - RNA, 13 nt, Human
ugaaguaagcaaa

SEQ ID NO: 1788615 - RNA, 14 nt, Human
ugaaguaagcaaag

SEQ ID NO: 1788616 - RNA, 15 nt, Human
ugaaguaauaugcac

SEQ ID NO: 1788617 - RNA, 22 nt, Human
agaguaauccaagcaaauguga

SEQ ID NO: 1788618 - RNA, 20 nt, Human
agaguaauccaagcaaaugu

SEQ ID NO: 1788619 - RNA, 18 nt, Human
agaguaauccaagcaaau

SEQ ID NO: 1788620 - RNA, 20 nt, Human
agagguucaaagauauuuug

SEQ ID NO: 1788621 - RNA, 19 nt, Human
agagguucaaagauauuuu

SEQ ID NO: 1788622 - RNA, 16 nt, Human
agagguucaaagauau

SEQ ID NO: 1788623 - RNA, 15 nt, Human
agagggagugacaga

SEQ ID NO: 1788624 - RNA, 15 nt, Human
agagggagguaagga

SEQ ID NO: 1788625 - RNA, 20 nt, Human
agagggagugacagaggcag

SEQ ID NO: 1788626 - RNA, 13 nt, Human
agagguucaaaga

SEQ ID NO: 1788627 - RNA, 22 nt, Human
agaggcugccucucccaucacu

SEQ ID NO: 1788628 - RNA, 23 nt, Human
agaggcagccccauucugccugc

SEQ ID NO: 1788629 - RNA, 21 nt, Human
agaggcagggucucacucugu

SEQ ID NO: 1788630 - RNA, 22 nt, Human
agaggcagccccauucugccug

SEQ ID NO: 1788631 - RNA, 21 nt, Human
agaggcagccccauucugccu

SEQ ID NO: 1788632 - RNA, 24 nt, Human
agaggcagccccauucugccugcc

SEQ ID NO: 1788633 - RNA, 16 nt, Human
agagauugugguuuca

SEQ ID NO: 1788634 - RNA, 17 nt, Human
ugaaauaacauggccuu

SEQ ID NO: 1788635 - RNA, 16 nt, Human
ugaaauaacauggccu

SEQ ID NO: 1788636 - RNA, 14 nt, Human
ugaaauaagccaga

SEQ ID NO: 1788637 - RNA, 23 nt, Human
ugaaauagacccacaagaggcag

SEQ ID NO: 1788638 - RNA, 20 nt, Human
ugaaauuuuuauuaaauuau

SEQ ID NO: 1788639 - RNA, 19 nt, Human
ugaaauuuuuauuaaauua

SEQ ID NO: 1788640 - RNA, 18 nt, Human
ugaacccgggaggcagag

SEQ ID NO: 1788641 - RNA, 22 nt, Human
ugaacccauauuuguacaccaa

SEQ ID NO: 1788642 - RNA, 22 nt, Human
ugaaccaccacacccagcccac

SEQ ID NO: 1788643 - RNA, 18 nt, Human
ugaacaaauuuacagaga

SEQ ID NO: 1788644 - RNA, 21 nt, Human
ugaaccaccacacccagccca

SEQ ID NO: 1788645 - RNA, 13 nt, Human
ugaacaaauuuac

SEQ ID NO: 1788646 - RNA, 11 nt, Human
ugaacuccugg

SEQ ID NO: 1788647 - RNA, 15 nt, Human
ugaacuccugaccuc

SEQ ID NO: 1788648 - RNA, 13 nt, Human
ugaagacagagcu

SEQ ID NO: 1788649 - RNA, 23 nt, Human
ugaagacaaugacuuacuguaca

SEQ ID NO: 1788650 - RNA, 22 nt, Human
ugaagacaaugacuuacuguac

SEQ ID NO: 1788651 - RNA, 21 nt, Human
ugagacagaguuuucacucuu

SEQ ID NO: 1788652 - RNA, 13 nt, Human
ugagacagcccgg

SEQ ID NO: 1788653 - RNA, 11 nt, Human
ugagacagagu

SEQ ID NO: 1788654 - RNA, 20 nt, Human
ugagacagaaucucgcucug

SEQ ID NO: 1788655 - RNA, 20 nt, Human
ugagacucugucucaaaaaa

SEQ ID NO: 1788656 - RNA, 20 nt, Human
ugagacucugucucagucca

SEQ ID NO: 1788657 - RNA, 22 nt, Human
ugagacagcccgggcucugccu

SEQ ID NO: 1788658 - RNA, 12 nt, Human
ugagacagcucu

SEQ ID NO: 1788659 - RNA, 17 nt, Human
ugagacagcccgggcuc

SEQ ID NO: 1788660 - RNA, 18 nt, Human
ugagacagcccgggcucu

SEQ ID NO: 1788661 - RNA, 19 nt, Human
ugagacagcccgggcucug

SEQ ID NO: 1788662 - RNA, 20 nt, Human
ugagacagcccgggcucugc

SEQ ID NO: 1788663 - RNA, 14 nt, Human
ugagagcugggugu

SEQ ID NO: 1788664 - RNA, 10 nt, Human
ugagaggaaa

SEQ ID NO: 1788665 - RNA, 11 nt, Human
ugagaggaaau

SEQ ID NO: 1788666 - RNA, 12 nt, Human
ugagaggaaauc

SEQ ID NO: 1788667 - RNA, 13 nt, Human
ugagaggaaauca

SEQ ID NO: 1788668 - RNA, 14 nt, Human
ugagaggaaaucac

SEQ ID NO: 1788669 - RNA, 23 nt, Human
ugagaggacuuuucuuuguggcu

SEQ ID NO: 1788670 - RNA, 17 nt, Human
ugagaggaaaucaccga

SEQ ID NO: 1788671 - RNA, 23 nt, Human
ugagauguagccccucuccugga

SEQ ID NO: 1788672 - RNA, 14 nt, Human
ugagauguguucac

SEQ ID NO: 1788673 - RNA, 16 nt, Human
agcaagugagagcugg

SEQ ID NO: 1788674 - RNA, 15 nt, Human
agcaagugagagcug

SEQ ID NO: 1788675 - RNA, 16 nt, Human
agcaagugagacccug

SEQ ID NO: 1788676 - RNA, 15 nt, Human
agcaagucagaauag

SEQ ID NO: 1788677 - RNA, 14 nt, Human
agcaaggagauuua

SEQ ID NO: 1788678 - RNA, 19 nt, Human
agcaaggagauuuacaacu

SEQ ID NO: 1788679 - RNA, 17 nt, Human
agcaaggagauuuacaa

SEQ ID NO: 1788680 - RNA, 13 nt, Human
ugagccacugcac

SEQ ID NO: 1788681 - RNA, 12 nt, Human
ugagccacugca

SEQ ID NO: 1788682 - RNA, 16 nt, Human
ugagcauuagauuucu

SEQ ID NO: 1788683 - RNA, 14 nt, Human
ugagcauuagauuu

SEQ ID NO: 1788684 - RNA, 15 nt, Human
ugagcaaauguggcu

SEQ ID NO: 1788685 - RNA, 14 nt, Human
ugagccacugcacc

SEQ ID NO: 1788686 - RNA, 18 nt, Human
ugagccagauuucacucu

SEQ ID NO: 1788687 - RNA, 19 nt, Human
ugagccagauuucacucuc

SEQ ID NO: 1788688 - RNA, 20 nt, Human
ugagccagauuucacucucc

SEQ ID NO: 1788689 - RNA, 21 nt, Human
ugagccagauuucacucuccu

SEQ ID NO: 1788690 - RNA, 17 nt, Human
agcaagugagagcuggg

SEQ ID NO: 1788691 - RNA, 21 nt, Human
agcacagcuucauuuccugug

SEQ ID NO: 1788692 - RNA, 18 nt, Human
agcacaugccucucucag

SEQ ID NO: 1788693 - RNA, 19 nt, Human
agcacaugccucucucagg

SEQ ID NO: 1788694 - RNA, 20 nt, Human
agcacaugccucucucaggc

SEQ ID NO: 1788695 - RNA, 21 nt, Human
agcacaugccucucucaggcc

SEQ ID NO: 1788696 - RNA, 22 nt, Human
agcacaugccucucucaggcca

SEQ ID NO: 1788697 - RNA, 16 nt, Human
agcaccaucucuccuc

SEQ ID NO: 1788698 - RNA, 22 nt, Human
agcaccaaaagcuuaccaaggg

SEQ ID NO: 1788699 - RNA, 23 nt, Human
agcacaugccucucucaggccaa

SEQ ID NO: 1788700 - RNA, 16 nt, Human
agcaccuccugccucg

SEQ ID NO: 1788701 - RNA, 14 nt, Human
agcaccuccugccu

SEQ ID NO: 1788702 - RNA, 13 nt, Human
agcaccuccugcc

SEQ ID NO: 1788703 - RNA, 21 nt, Human
agcaccuacaguguacagucu

SEQ ID NO: 1788704 - RNA, 19 nt, Human
agcaccuacaguguacagu

SEQ ID NO: 1788705 - RNA, 15 nt, Human
agcaccuacagugua

SEQ ID NO: 1788706 - RNA, 14 nt, Human
agcaccuacagugu

SEQ ID NO: 1788707 - RNA, 22 nt, Human
agcaccuacaguguacagucuu

SEQ ID NO: 1788708 - RNA, 17 nt, Human
agcaccuagccucgcuc

SEQ ID NO: 1788709 - RNA, 22 nt, Human
ugacagggcacaccgggcacuc

SEQ ID NO: 1788710 - RNA, 19 nt, Human
ugacaggcaaugcuggcug

SEQ ID NO: 1788711 - RNA, 17 nt, Human
ugacaggcaaugcuggc

SEQ ID NO: 1788712 - RNA, 16 nt, Human
ugacacgaauauugcu

SEQ ID NO: 1788713 - RNA, 22 nt, Human
ugacagagugagacucugucuc

SEQ ID NO: 1788714 - RNA, 15 nt, Human
ugacacuuaaaaaug

SEQ ID NO: 1788715 - RNA, 19 nt, Human
ugacacgaauauugcugau

SEQ ID NO: 1788716 - RNA, 19 nt, Human
agaugcuagaacucccuuu

SEQ ID NO: 1788717 - RNA, 21 nt, Human
agauguagccccucuccugga

SEQ ID NO: 1788718 - RNA, 22 nt, Human
agauguagccccucuccuggaa

SEQ ID NO: 1788719 - RNA, 22 nt, Human
agaugcuagaacucccuuucaa

SEQ ID NO: 1788720 - RNA, 21 nt, Human
agaugcuagaacucccuuuca

SEQ ID NO: 1788721 - RNA, 16 nt, Human
agaucguucucugccu

SEQ ID NO: 1788722 - RNA, 18 nt, Human
agaucucuaacuucacca

SEQ ID NO: 1788723 - RNA, 18 nt, Human
agauccccaagccuggca

SEQ ID NO: 1788724 - RNA, 15 nt, Human
agauuaagaaauaga

SEQ ID NO: 1788725 - RNA, 14 nt, Human
agauuaagaaauag

SEQ ID NO: 1788726 - RNA, 17 nt, Human
ugacuuauuuauauaaa

SEQ ID NO: 1788727 - RNA, 20 nt, Human
ugacuuacuguacaugaaaa

SEQ ID NO: 1788728 - RNA, 12 nt, Human
ugacuuacugua

SEQ ID NO: 1788729 - RNA, 13 nt, Human
agauucauauuua

SEQ ID NO: 1788730 - RNA, 16 nt, Human
agauucauauuuacuu

SEQ ID NO: 1788731 - RNA, 22 nt, Human
agauuccagagaguggcuccuc

SEQ ID NO: 1788732 - RNA, 21 nt, Human
agauuccagagaguggcuccu

SEQ ID NO: 1788733 - RNA, 19 nt, Human
agauucauauuuacuucuu

SEQ ID NO: 1788734 - RNA, 19 nt, Human
agauuucacucuccuuggu

SEQ ID NO: 1788735 - RNA, 17 nt, Human
agauuucacucuccuug

SEQ ID NO: 1788736 - RNA, 16 nt, Human
ugaccugccaggcaca

SEQ ID NO: 1788737 - RNA, 19 nt, Human
ugaccugccaggcacacug

SEQ ID NO: 1788738 - RNA, 15 nt, Human
ugaccuuuaagagaa

SEQ ID NO: 1788739 - RNA, 21 nt, Human
ugacuguuuucucuugagagg

SEQ ID NO: 1788740 - RNA, 19 nt, Human
ugacuauuuuucagaaucu

SEQ ID NO: 1788741 - RNA, 21 nt, Human
ugacucguauaugucucaggu

SEQ ID NO: 1788742 - RNA, 12 nt, Human
ugaccuuucaau

SEQ ID NO: 1788743 - RNA, 13 nt, Human
ugaccuuucaaua

SEQ ID NO: 1788744 - RNA, 23 nt, Human
ucucacuauguugcccaggcagg

SEQ ID NO: 1788745 - RNA, 22 nt, Human
ucucacuauguugcccaggcag

SEQ ID NO: 1788746 - RNA, 21 nt, Human
ucucacuauguugcccaggca

SEQ ID NO: 1788747 - RNA, 20 nt, Human
ucucacuauguugcccaggc

SEQ ID NO: 1788748 - RNA, 22 nt, Human
acuugcagacucuacagaggcc

SEQ ID NO: 1788749 - RNA, 19 nt, Human
acuugcagacucuacagag

SEQ ID NO: 1788750 - RNA, 23 nt, Human
acuugcagacucuacagaggcca

SEQ ID NO: 1788751 - RNA, 16 nt, Human
acuugcucuugaugcc

SEQ ID NO: 1788752 - RNA, 17 nt, Human
acuugcucuugaugccu

SEQ ID NO: 1788753 - RNA, 18 nt, Human
acuugcucuugaugccug

SEQ ID NO: 1788754 - RNA, 20 nt, Human
acuugcucuugaugccuggc

SEQ ID NO: 1788755 - RNA, 22 nt, Human
acuuguggacacagcucuucuc

SEQ ID NO: 1788756 - RNA, 19 nt, Human
acuuguggacacagcucuu

SEQ ID NO: 1788757 - RNA, 20 nt, Human
acuugucuuuggacccugag

SEQ ID NO: 1788758 - RNA, 18 nt, Human
acuugucuuuggacccug

SEQ ID NO: 1788759 - RNA, 21 nt, Human
acuugucuuuggacccugagg

SEQ ID NO: 1788760 - RNA, 14 nt, Human
acuugcuuuuaaaa

SEQ ID NO: 1788761 - RNA, 18 nt, Human
acuuguauuauguguguu

SEQ ID NO: 1788762 - RNA, 19 nt, Human
acuuguauuauguguguuu

SEQ ID NO: 1788763 - RNA, 12 nt, Human
ucucaggccaaa

SEQ ID NO: 1788764 - RNA, 12 nt, Human
ucucaggccagc

SEQ ID NO: 1788765 - RNA, 13 nt, Human
ucucaggccagcu

SEQ ID NO: 1788766 - RNA, 10 nt, Human
ucucaggcca

SEQ ID NO: 1788767 - RNA, 14 nt, Human
ucucauuugucaca

SEQ ID NO: 1788768 - RNA, 19 nt, Human
ucucauuugccaauaauaa

SEQ ID NO: 1788769 - RNA, 16 nt, Human
ucucauuugucacaca

SEQ ID NO: 1788770 - RNA, 13 nt, Human
ucuccaaaauaaa

SEQ ID NO: 1788771 - RNA, 15 nt, Human
ucuccaagcaggaca

SEQ ID NO: 1788772 - RNA, 16 nt, Human
ucuccaagcaggacau

SEQ ID NO: 1788773 - RNA, 20 nt, Human
ucucaugccucagccuccug

SEQ ID NO: 1788774 - RNA, 21 nt, Human
ucucaggccagcugcuugggc

SEQ ID NO: 1788775 - RNA, 17 nt, Human
ucucaggccagcugcuu

SEQ ID NO: 1788776 - RNA, 18 nt, Human
ucucaggccagcugcuug

SEQ ID NO: 1788777 - RNA, 21 nt, Human
ucucaugccucagccuccuga

SEQ ID NO: 1788778 - RNA, 17 nt, Human
agaaaaaauauuuuccc

SEQ ID NO: 1788779 - RNA, 14 nt, Human
ucuccuucaccuuu

SEQ ID NO: 1788780 - RNA, 15 nt, Human
ucuccuucaccuuug

SEQ ID NO: 1788781 - RNA, 21 nt, Human
ucuccuuguguuacuaaguuu

SEQ ID NO: 1788782 - RNA, 13 nt, Human
ucuccuuguguua

SEQ ID NO: 1788783 - RNA, 16 nt, Human
ucuccuucaccuuugu

SEQ ID NO: 1788784 - RNA, 18 nt, Human
ucuccuucaccuuugucc

SEQ ID NO: 1788785 - RNA, 23 nt, Human
acuuuuguucuugguuuguaaau

SEQ ID NO: 1788786 - RNA, 15 nt, Human
acuuuuguucuuggu

SEQ ID NO: 1788787 - RNA, 13 nt, Human
acuuuuguucuug

SEQ ID NO: 1788788 - RNA, 12 nt, Human
acuuuuguucuu

SEQ ID NO: 1788789 - RNA, 21 nt, Human
acuuuguuaguuucuccaagc

SEQ ID NO: 1788790 - RNA, 14 nt, Human
acuuuguucuggcu

SEQ ID NO: 1788791 - RNA, 20 nt, Human
acuuuguuaguuucuccaag

SEQ ID NO: 1788792 - RNA, 13 nt, Human
acuuugaccucug

SEQ ID NO: 1788793 - RNA, 12 nt, Human
acuuugaccucu

SEQ ID NO: 1788794 - RNA, 23 nt, Human
ucuccgaccagacaccuugacag

SEQ ID NO: 1788795 - RNA, 17 nt, Human
ucuccgaccagacaccu

SEQ ID NO: 1788796 - RNA, 15 nt, Human
ucucccuuuuccaug

SEQ ID NO: 1788797 - RNA, 12 nt, Human
ucuccacccugc

SEQ ID NO: 1788798 - RNA, 23 nt, Human
ucuccccagcaagugagagcugg

SEQ ID NO: 1788799 - RNA, 18 nt, Human
ucuccaagcaggacaugg

SEQ ID NO: 1788800 - RNA, 19 nt, Human
ucuccaagcaggacaugga

SEQ ID NO: 1788801 - RNA, 17 nt, Human
ucuccucugcugcuggc

SEQ ID NO: 1788802 - RNA, 18 nt, Human
ucuccucugcugcuggcu

SEQ ID NO: 1788803 - RNA, 15 nt, Human
ucuccuccagaguca

SEQ ID NO: 1788804 - RNA, 15 nt, Human
ucuccucugcugcug

SEQ ID NO: 1788805 - RNA, 16 nt, Human
ucuccucugcugcugg

SEQ ID NO: 1788806 - RNA, 12 nt, Human
acuuuaccuuuu

SEQ ID NO: 1788807 - RNA, 14 nt, Human
acuuucugaaauaa

SEQ ID NO: 1788808 - RNA, 20 nt, Human
acuuucugaaauaacauggc

SEQ ID NO: 1788809 - RNA, 15 nt, Human
acuuagguguggggg

SEQ ID NO: 1788810 - RNA, 14 nt, Human
acuuagcugggaga

SEQ ID NO: 1788811 - RNA, 22 nt, Human
acuuacuguacaugaaaacaca

SEQ ID NO: 1788812 - RNA, 21 nt, Human
acuuacuguacaugaaaacac

SEQ ID NO: 1788813 - RNA, 17 nt, Human
acuuacacuuuaugcac

SEQ ID NO: 1788814 - RNA, 20 nt, Human
acuuaaauaaugugaaacug

SEQ ID NO: 1788815 - RNA, 16 nt, Human
acuuacacuuuaugca

SEQ ID NO: 1788816 - RNA, 22 nt, Human
acuuaaucuaaauggaaccacu

SEQ ID NO: 1788817 - RNA, 19 nt, Human
acuuaaucuaaauggaacc

SEQ ID NO: 1788818 - RNA, 17 nt, Human
acuuaaucuaaauggaa

SEQ ID NO: 1788819 - RNA, 13 nt, Human
acuuaagcacacu

SEQ ID NO: 1788820 - RNA, 16 nt, Human
acuguucucugcccuc

SEQ ID NO: 1788821 - RNA, 17 nt, Human
acuguucucugcccucc

SEQ ID NO: 1788822 - RNA, 19 nt, Human
acuguucucugcccuccaa

SEQ ID NO: 1788823 - RNA, 18 nt, Human
acuguucucugcccucca

SEQ ID NO: 1788824 - RNA, 21 nt, Human
ucuacccuggcacuauaaugu

SEQ ID NO: 1788825 - RNA, 20 nt, Human
ucuacccagcgagcccuggu

SEQ ID NO: 1788826 - RNA, 14 nt, Human
ucuacccaggugcu

SEQ ID NO: 1788827 - RNA, 19 nt, Human
ucuacccuggcacuauaau

SEQ ID NO: 1788828 - RNA, 14 nt, Human
ucuacccuggcacu

SEQ ID NO: 1788829 - RNA, 18 nt, Human
uccugggagugagcuggu

SEQ ID NO: 1788830 - RNA, 21 nt, Human
ucuacagaggccaugggccuc

SEQ ID NO: 1788831 - RNA, 19 nt, Human
ucuacccagcgagcccugg

SEQ ID NO: 1788832 - RNA, 23 nt, Human
ucuacagcuaaucagcauucuca

SEQ ID NO: 1788833 - RNA, 20 nt, Human
ucuacagcuaaucagcauuc

SEQ ID NO: 1788834 - RNA, 13 nt, Human
ucuagauacugua

SEQ ID NO: 1788835 - RNA, 18 nt, Human
ucuagcauggcugccaau

SEQ ID NO: 1788836 - RNA, 16 nt, Human
acuucaucccucuggg

SEQ ID NO: 1788837 - RNA, 13 nt, Human
acuuccccuuccu

SEQ ID NO: 1788838 - RNA, 19 nt, Human
acuuccccuuccuaauucc

SEQ ID NO: 1788839 - RNA, 23 nt, Human
ucuaguuguuugauucagacagc

SEQ ID NO: 1788840 - RNA, 21 nt, Human
ucuaguuugauuaaauucuug

SEQ ID NO: 1788841 - RNA, 22 nt, Human
ucuaguuugauuaaauucuugc

SEQ ID NO: 1788842 - RNA, 22 nt, Human
ucuaguuguuugauucagacag

SEQ ID NO: 1788843 - RNA, 12 nt, Human
ucuaggaagacu

SEQ ID NO: 1788844 - RNA, 13 nt, Human
ucuagccagagga

SEQ ID NO: 1788845 - RNA, 23 nt, Human
ucuaugggacucaaugcacugac

SEQ ID NO: 1788846 - RNA, 19 nt, Human
ucucacuauguugcccagg

SEQ ID NO: 1788847 - RNA, 17 nt, Human
ucucacuauguugccca

SEQ ID NO: 1788848 - RNA, 15 nt, Human
agaauuaacacauga

SEQ ID NO: 1788849 - RNA, 23 nt, Human
agaauuaacacaugauccugcaa

SEQ ID NO: 1788850 - RNA, 12 nt, Human
ucugcuuuccuc

SEQ ID NO: 1788851 - RNA, 13 nt, Human
ucugcuuuccucu

SEQ ID NO: 1788852 - RNA, 18 nt, Human
ucugcuuuccucuuccug

SEQ ID NO: 1788853 - RNA, 20 nt, Human
agaaguggggacagagcaga

SEQ ID NO: 1788854 - RNA, 21 nt, Human
agaaguuucugccgcagcccu

SEQ ID NO: 1788855 - RNA, 22 nt, Human
agaaguuucugccgcagcccug

SEQ ID NO: 1788856 - RNA, 23 nt, Human
agaaguuucugccgcagcccugc

SEQ ID NO: 1788857 - RNA, 16 nt, Human
agaauagaugcugacu

SEQ ID NO: 1788858 - RNA, 12 nt, Human
agaauaaaauuu

SEQ ID NO: 1788859 - RNA, 14 nt, Human
agaauaaaauuuuu

SEQ ID NO: 1788860 - RNA, 17 nt, Human
agaauaaaauuuuuaau

SEQ ID NO: 1788861 - RNA, 17 nt, Human
ucuguuggccaguguga

SEQ ID NO: 1788862 - RNA, 12 nt, Human
ucuguuggccag

SEQ ID NO: 1788863 - RNA, 16 nt, Human
ucuguugcccaggcug

SEQ ID NO: 1788864 - RNA, 15 nt, Human
ucuguugcugccuca

SEQ ID NO: 1788865 - RNA, 22 nt, Human
ucuguucuuuccaaaguacacu

SEQ ID NO: 1788866 - RNA, 13 nt, Human
ucuguucuuucca

SEQ ID NO: 1788867 - RNA, 16 nt, Human
ucuguuguauucauug

SEQ ID NO: 1788868 - RNA, 13 nt, Human
ucuguuuagauaa

SEQ ID NO: 1788869 - RNA, 14 nt, Human
ucugggccagaauu

SEQ ID NO: 1788870 - RNA, 15 nt, Human
ucugggccagaauuu

SEQ ID NO: 1788871 - RNA, 22 nt, Human
ucugugagaugcuagaacuccc

SEQ ID NO: 1788872 - RNA, 17 nt, Human
ucugugagaugcuagaa

SEQ ID NO: 1788873 - RNA, 23 nt, Human
ucugugagaugcuagaacucccu

SEQ ID NO: 1788874 - RNA, 14 nt, Human
ucugugagaugcua

SEQ ID NO: 1788875 - RNA, 16 nt, Human
agacacaggcccggcu

SEQ ID NO: 1788876 - RNA, 13 nt, Human
agacacaggcccg

SEQ ID NO: 1788877 - RNA, 12 nt, Human
agacacaggccc

SEQ ID NO: 1788878 - RNA, 17 nt, Human
agacaccuugacagggc

SEQ ID NO: 1788879 - RNA, 18 nt, Human
agacaccuugacagggca

SEQ ID NO: 1788880 - RNA, 16 nt, Human
agacacauguccaaga

SEQ ID NO: 1788881 - RNA, 20 nt, Human
agacacauguccaagaagcc

SEQ ID NO: 1788882 - RNA, 13 nt, Human
agacagagcuaca

SEQ ID NO: 1788883 - RNA, 21 nt, Human
ucugaucauccacugugccau

SEQ ID NO: 1788884 - RNA, 17 nt, Human
ucugaucauccacugug

SEQ ID NO: 1788885 - RNA, 16 nt, Human
ucugaugcaagcaaga

SEQ ID NO: 1788886 - RNA, 22 nt, Human
ucugagacucgcgacaaugcaa

SEQ ID NO: 1788887 - RNA, 21 nt, Human
ucugagacucgcgacaaugca

SEQ ID NO: 1788888 - RNA, 15 nt, Human
agaaauguacagcaa

SEQ ID NO: 1788889 - RNA, 14 nt, Human
agaaauguacagca

SEQ ID NO: 1788890 - RNA, 14 nt, Human
ucugcaggucccua

SEQ ID NO: 1788891 - RNA, 13 nt, Human
ucugcaggucccu

SEQ ID NO: 1788892 - RNA, 11 nt, Human
ucugcaggucc

SEQ ID NO: 1788893 - RNA, 12 nt, Human
ucugcagguccc

SEQ ID NO: 1788894 - RNA, 21 nt, Human
ucugaugcaagcaagaaacac

SEQ ID NO: 1788895 - RNA, 17 nt, Human
ucugcacuccccugcug

SEQ ID NO: 1788896 - RNA, 16 nt, Human
ucugcacuccccugcu

SEQ ID NO: 1788897 - RNA, 14 nt, Human
ucugcacuccccug

SEQ ID NO: 1788898 - RNA, 15 nt, Human
ucugcacuccccugc

SEQ ID NO: 1788899 - RNA, 17 nt, Human
ucugcagcaauaaagca

SEQ ID NO: 1788900 - RNA, 15 nt, Human
ucugcagauaaacag

SEQ ID NO: 1788901 - RNA, 18 nt, Human
ucugcagauaaacaguag

SEQ ID NO: 1788902 - RNA, 21 nt, Human
ucugaaggacauugcggacag

SEQ ID NO: 1788903 - RNA, 22 nt, Human
ucugaaggacauugcggacagc

SEQ ID NO: 1788904 - RNA, 10 nt, Human
ucugaauuau

SEQ ID NO: 1788905 - RNA, 15 nt, Human
ucugacacacagcuc

SEQ ID NO: 1788906 - RNA, 14 nt, Human
ucugacacacagcu

SEQ ID NO: 1788907 - RNA, 13 nt, Human
ucugacacacagc

SEQ ID NO: 1788908 - RNA, 15 nt, Human
ucugaauuauuuucu

SEQ ID NO: 1788909 - RNA, 16 nt, Human
ucuccuuucacaaccu

SEQ ID NO: 1788910 - RNA, 20 nt, Human
agaaagcccuuaggaagaau

SEQ ID NO: 1788911 - RNA, 22 nt, Human
agaaagcccuuaggaagaauuu

SEQ ID NO: 1788912 - RNA, 17 nt, Human
agaaauugcauuuccug

SEQ ID NO: 1788913 - RNA, 20 nt, Human
agaaauugcauuuccugaca

SEQ ID NO: 1788914 - RNA, 12 nt, Human
agaagcccagga

SEQ ID NO: 1788915 - RNA, 16 nt, Human
agaagcccaggaaagg

SEQ ID NO: 1788916 - RNA, 18 nt, Human
agaagcccaggaaaggcu

SEQ ID NO: 1788917 - RNA, 20 nt, Human
agaagcccaggaaaggcucc

SEQ ID NO: 1788918 - RNA, 21 nt, Human
agaagcccaggaaaggcucca

SEQ ID NO: 1788919 - RNA, 22 nt, Human
agaagcccaggaaaggcuccag

SEQ ID NO: 1788920 - RNA, 17 nt, Human
ucugcccacucccugca

SEQ ID NO: 1788921 - RNA, 18 nt, Human
agaagauuuugaaauuuu

SEQ ID NO: 1788922 - RNA, 13 nt, Human
ucugcuucagccu

SEQ ID NO: 1788923 - RNA, 15 nt, Human
ucugcuucagccucc

SEQ ID NO: 1788924 - RNA, 14 nt, Human
ucugcuucagccuc

SEQ ID NO: 1788925 - RNA, 20 nt, Human
ucugcucacauaucugucau

SEQ ID NO: 1788926 - RNA, 19 nt, Human
ucugcucacauaucuguca

SEQ ID NO: 1788927 - RNA, 22 nt, Human
ucugccugcccaggccccugcc

SEQ ID NO: 1788928 - RNA, 21 nt, Human
ucugccugcccaggccccugc

SEQ ID NO: 1788929 - RNA, 23 nt, Human
ucugccgcagcccugcagagggc

SEQ ID NO: 1788930 - RNA, 22 nt, Human
ucugccgcagcccugcagaggg

SEQ ID NO: 1788931 - RNA, 10 nt, Human
ucugcccugc

SEQ ID NO: 1788932 - RNA, 11 nt, Human
ucugcccugcg

SEQ ID NO: 1788933 - RNA, 12 nt, Human
ucugcccugcgg

SEQ ID NO: 1788934 - RNA, 14 nt, Human
ucugccgcagcccu

SEQ ID NO: 1788935 - RNA, 15 nt, Human
ucugccgcagcccug

SEQ ID NO: 1788936 - RNA, 18 nt, Human
ucugcccacucccugcaa

SEQ ID NO: 1788937 - RNA, 21 nt, Human
ucugcccacucccugcaaccu

SEQ ID NO: 1788938 - RNA, 19 nt, Human
ucugcccuccaagaccuuc

SEQ ID NO: 1788939 - RNA, 18 nt, Human
acuccagaccccuggcuu

SEQ ID NO: 1788940 - RNA, 19 nt, Human
acuccagaccccuggcuuu

SEQ ID NO: 1788941 - RNA, 21 nt, Human
acuccagaccccuggcuuuuc

SEQ ID NO: 1788942 - RNA, 19 nt, Human
acuccagugagacagcucu

SEQ ID NO: 1788943 - RNA, 13 nt, Human
acucaccccagcc

SEQ ID NO: 1788944 - RNA, 13 nt, Human
acuccagaccccu

SEQ ID NO: 1788945 - RNA, 15 nt, Human
acuccagaccccugg

SEQ ID NO: 1788946 - RNA, 16 nt, Human
acucaccccagcccca

SEQ ID NO: 1788947 - RNA, 14 nt, Human
acucaccccagccc

SEQ ID NO: 1788948 - RNA, 15 nt, Human
acucaccccagcccc

SEQ ID NO: 1788949 - RNA, 11 nt, Human
acuccuggccu

SEQ ID NO: 1788950 - RNA, 16 nt, Human
ucccugguggcagcuc

SEQ ID NO: 1788951 - RNA, 17 nt, Human
ucccugguggcagcuca

SEQ ID NO: 1788952 - RNA, 18 nt, Human
ucccugguggcagcucac

SEQ ID NO: 1788953 - RNA, 19 nt, Human
ucccugguggcagcucacc

SEQ ID NO: 1788954 - RNA, 20 nt, Human
ucccugguggcagcucaccu

SEQ ID NO: 1788955 - RNA, 21 nt, Human
ucccugguggcagcucaccuc

SEQ ID NO: 1788956 - RNA, 22 nt, Human
acuccugcaggcagccaggcca

SEQ ID NO: 1788957 - RNA, 15 nt, Human
acuccugcaggcagc

SEQ ID NO: 1788958 - RNA, 16 nt, Human
acuccugcaggcagcc

SEQ ID NO: 1788959 - RNA, 12 nt, Human
acuccucccagg

SEQ ID NO: 1788960 - RNA, 12 nt, Human
acuccugcaggc

SEQ ID NO: 1788961 - RNA, 14 nt, Human
acuccugcaggcag

SEQ ID NO: 1788962 - RNA, 14 nt, Human
acuccuggccucaa

SEQ ID NO: 1788963 - RNA, 13 nt, Human
acuccuggccuca

SEQ ID NO: 1788964 - RNA, 12 nt, Human
acuccuggccuc

SEQ ID NO: 1788965 - RNA, 13 nt, Human
uccuaggcauuug

SEQ ID NO: 1788966 - RNA, 15 nt, Human
uccuacucuguguca

SEQ ID NO: 1788967 - RNA, 14 nt, Human
uccuacucuguguc

SEQ ID NO: 1788968 - RNA, 13 nt, Human
uccuacucugugu

SEQ ID NO: 1788969 - RNA, 18 nt, Human
uccgguguuuaagacauu

SEQ ID NO: 1788970 - RNA, 16 nt, Human
ucccuuuuuuuaagua

SEQ ID NO: 1788971 - RNA, 21 nt, Human
ucccuuuuuuuaaguaaggaa

SEQ ID NO: 1788972 - RNA, 16 nt, Human
ucccuuugacgccauc

SEQ ID NO: 1788973 - RNA, 18 nt, Human
ucccuuugacgccauccc

SEQ ID NO: 1788974 - RNA, 22 nt, Human
ucccugguggcagcucaccucu

SEQ ID NO: 1788975 - RNA, 23 nt, Human
ucccugguggcagcucaccucuc

SEQ ID NO: 1788976 - RNA, 19 nt, Human
ucccuuggauuguccccga

SEQ ID NO: 1788977 - RNA, 20 nt, Human
ucccuuggauuguccccgac

SEQ ID NO: 1788978 - RNA, 13 nt, Human
ucccuuuuuuuaa

SEQ ID NO: 1788979 - RNA, 23 nt, Human
ucccuuuuuuggcugcugaaggc

SEQ ID NO: 1788980 - RNA, 20 nt, Human
ucccuuuuuuggcugcugaa

SEQ ID NO: 1788981 - RNA, 22 nt, Human
ucccuuuuuuggcugcugaagg

SEQ ID NO: 1788982 - RNA, 21 nt, Human
ucccuuugacgccaucccagc

SEQ ID NO: 1788983 - RNA, 19 nt, Human
ucccuuugacgccauccca

SEQ ID NO: 1788984 - RNA, 17 nt, Human
ucccuuuuuuggcugcu

SEQ ID NO: 1788985 - RNA, 19 nt, Human
ucccuuuuuuggcugcuga

SEQ ID NO: 1788986 - RNA, 14 nt, Human
acucuugaccucag

SEQ ID NO: 1788987 - RNA, 16 nt, Human
acucuugaccucaggu

SEQ ID NO: 1788988 - RNA, 15 nt, Human
acucuugaccucagg

SEQ ID NO: 1788989 - RNA, 22 nt, Human
uccucauaguaugguggcuggg

SEQ ID NO: 1788990 - RNA, 13 nt, Human
uccucccaggcgc

SEQ ID NO: 1788991 - RNA, 19 nt, Human
uccucccaggcgccccuuc

SEQ ID NO: 1788992 - RNA, 21 nt, Human
uccucccaggcgccccuuccc

SEQ ID NO: 1788993 - RNA, 23 nt, Human
uccucauacccacccccacccaa

SEQ ID NO: 1788994 - RNA, 23 nt, Human
acuccuugaaaacacuguucucu

SEQ ID NO: 1788995 - RNA, 24 nt, Human
acuccuugaaaacacuguucucug

SEQ ID NO: 1788996 - RNA, 14 nt, Human
acucuccuccagag

SEQ ID NO: 1788997 - RNA, 17 nt, Human
acucuccuccagaguca

SEQ ID NO: 1788998 - RNA, 12 nt, Human
acucuccucugc

SEQ ID NO: 1788999 - RNA, 13 nt, Human
acucuccucugcu

SEQ ID NO: 1789000 - RNA, 14 nt, Human
acucuccucugcug

SEQ ID NO: 1789001 - RNA, 16 nt, Human
acucuccucugcugcu

SEQ ID NO: 1789002 - RNA, 18 nt, Human
acucuccuggaaauauua

SEQ ID NO: 1789003 - RNA, 15 nt, Human
acucuccuugguguc

SEQ ID NO: 1789004 - RNA, 12 nt, Human
acucugccuccu

SEQ ID NO: 1789005 - RNA, 16 nt, Human
acucugccuccucuuc

SEQ ID NO: 1789006 - RNA, 13 nt, Human
acucuggcagcuc

SEQ ID NO: 1789007 - RNA, 15 nt, Human
acucuggcagcucag

SEQ ID NO: 1789008 - RNA, 16 nt, Human
acucuccuuggugucg

SEQ ID NO: 1789009 - RNA, 23 nt, Human
acucuccuuggugucgggcauga

SEQ ID NO: 1789010 - RNA, 11 nt, Human
acucugagacu

SEQ ID NO: 1789011 - RNA, 22 nt, Human
acucugagacucgcgacaaugc

SEQ ID NO: 1789012 - RNA, 22 nt, Human
acugagacagcccgggcucugc

SEQ ID NO: 1789013 - RNA, 23 nt, Human
acugagacagcccgggcucugcc

SEQ ID NO: 1789014 - RNA, 18 nt, Human
acugagagugaacaaauu

SEQ ID NO: 1789015 - RNA, 12 nt, Human
acugagaaauuu

SEQ ID NO: 1789016 - RNA, 17 nt, Human
acugagaaauuuauaaa

SEQ ID NO: 1789017 - RNA, 21 nt, Human
acugagaaauuuauaaacuuu

SEQ ID NO: 1789018 - RNA, 15 nt, Human
acugagacagcccgg

SEQ ID NO: 1789019 - RNA, 18 nt, Human
acugagacagcccgggcu

SEQ ID NO: 1789020 - RNA, 21 nt, Human
acugagacagcccgggcucug

SEQ ID NO: 1789021 - RNA, 22 nt, Human
uccucuuuggucuacacugugc

SEQ ID NO: 1789022 - RNA, 21 nt, Human
uccugaauuuuauuuuuuggg

SEQ ID NO: 1789023 - RNA, 19 nt, Human
uccucuuuccaucuacccu

SEQ ID NO: 1789024 - RNA, 19 nt, Human
uccucuuuggucuacacug

SEQ ID NO: 1789025 - RNA, 21 nt, Human
uccucuuuggucuacacugug

SEQ ID NO: 1789026 - RNA, 11 nt, Human
uccucccuccc

SEQ ID NO: 1789027 - RNA, 14 nt, Human
uccucccucccucu

SEQ ID NO: 1789028 - RNA, 11 nt, Human
uccucuuucca

SEQ ID NO: 1789029 - RNA, 12 nt, Human
uccucuuuccau

SEQ ID NO: 1789030 - RNA, 19 nt, Human
acucuuucuauuguuucuu

SEQ ID NO: 1789031 - RNA, 15 nt, Human
acucuuguuuccuua

SEQ ID NO: 1789032 - RNA, 16 nt, Human
acugaacauuccagag

SEQ ID NO: 1789033 - RNA, 13 nt, Human
acugaacauucca

SEQ ID NO: 1789034 - RNA, 20 nt, Human
acugaacucugacaacagac

SEQ ID NO: 1789035 - RNA, 14 nt, Human
acugcaccgggcca

SEQ ID NO: 1789036 - RNA, 20 nt, Human
acugcacuauagccuaggug

SEQ ID NO: 1789037 - RNA, 16 nt, Human
acugcaccgggccaca

SEQ ID NO: 1789038 - RNA, 23 nt, Human
acugcacagugcaucucagccca

SEQ ID NO: 1789039 - RNA, 22 nt, Human
acugcacagugcaucucagccc

SEQ ID NO: 1789040 - RNA, 14 nt, Human
acugcaacuucugc

SEQ ID NO: 1789041 - RNA, 16 nt, Human
acugcaacuucugccu

SEQ ID NO: 1789042 - RNA, 20 nt, Human
acugcaacuuguaaaugugg

SEQ ID NO: 1789043 - RNA, 21 nt, Human
acugauaaagaugagugagca

SEQ ID NO: 1789044 - RNA, 13 nt, Human
acugauaaagaug

SEQ ID NO: 1789045 - RNA, 14 nt, Human
uccugcacacgcuc

SEQ ID NO: 1789046 - RNA, 21 nt, Human
uccugcacacgcuccuuccuc

SEQ ID NO: 1789047 - RNA, 22 nt, Human
uccugcacacgcuccuuccucu

SEQ ID NO: 1789048 - RNA, 19 nt, Human
uccugaugcuucuucagag

SEQ ID NO: 1789049 - RNA, 20 nt, Human
uccugaugcuucuucagaga

SEQ ID NO: 1789050 - RNA, 21 nt, Human
uccugaugcuucuucagagac

SEQ ID NO: 1789051 - RNA, 21 nt, Human
acugcacuauagccuagguga

SEQ ID NO: 1789052 - RNA, 14 nt, Human
acugcacuccagcc

SEQ ID NO: 1789053 - RNA, 17 nt, Human
acugcacuccagccugg

SEQ ID NO: 1789054 - RNA, 18 nt, Human
acugcacuccagccuggg

SEQ ID NO: 1789055 - RNA, 19 nt, Human
acugcacuccagccugggu

SEQ ID NO: 1789056 - RNA, 20 nt, Human
acugcacuccagccugggug

SEQ ID NO: 1789057 - RNA, 15 nt, Human
uccuggaaauauuaa

SEQ ID NO: 1789058 - RNA, 23 nt, Human
uccuggaagugcuaauuuugaaa

SEQ ID NO: 1789059 - RNA, 17 nt, Human
uccugggagugagcugg

SEQ ID NO: 1789060 - RNA, 14 nt, Human
uccugggagugagc

SEQ ID NO: 1789061 - RNA, 12 nt, Human
uccugggaguga

SEQ ID NO: 1789062 - RNA, 21 nt, Human
uccugcugcaguugccaguca

SEQ ID NO: 1789063 - RNA, 12 nt, Human
uccugcaggcag

SEQ ID NO: 1789064 - RNA, 13 nt, Human
uccugcaggcagc

SEQ ID NO: 1789065 - RNA, 14 nt, Human
uccugcaggcagcc

SEQ ID NO: 1789066 - RNA, 15 nt, Human
uccugcaggcagcca

SEQ ID NO: 1789067 - RNA, 15 nt, Human
acuaauuuuaaaaug

SEQ ID NO: 1789068 - RNA, 22 nt, Human
acguuucuaaaggcuaccuuug

SEQ ID NO: 1789069 - RNA, 18 nt, Human
ucccagauacuugggggg

SEQ ID NO: 1789070 - RNA, 16 nt, Human
ucccagauacuugggg

SEQ ID NO: 1789071 - RNA, 19 nt, Human
uccauccugaggcuccacu

SEQ ID NO: 1789072 - RNA, 15 nt, Human
uccauccugaggcuc

SEQ ID NO: 1789073 - RNA, 12 nt, Human
uccauccugagg

SEQ ID NO: 1789074 - RNA, 18 nt, Human
acguaaagcuagaaauga

SEQ ID NO: 1789075 - RNA, 17 nt, Human
acguaaagcuagaaaug

SEQ ID NO: 1789076 - RNA, 15 nt, Human
acguuaccaggcagg

SEQ ID NO: 1789077 - RNA, 13 nt, Human
acguugugcauuu

SEQ ID NO: 1789078 - RNA, 15 nt, Human
acguugugcauuugg

SEQ ID NO: 1789079 - RNA, 14 nt, Human
acguugugcauuug

SEQ ID NO: 1789080 - RNA, 16 nt, Human
acguuucuaaaggcua

SEQ ID NO: 1789081 - RNA, 15 nt, Human
acguuucuaaaggcu

SEQ ID NO: 1789082 - RNA, 19 nt, Human
acguggcugcuucaaggau

SEQ ID NO: 1789083 - RNA, 21 nt, Human
acguggcugcuucaaggaucc

SEQ ID NO: 1789084 - RNA, 18 nt, Human
acguggcugcuucaagga

SEQ ID NO: 1789085 - RNA, 16 nt, Human
acucaaugcacugaca

SEQ ID NO: 1789086 - RNA, 14 nt, Human
acuauguugcccag

SEQ ID NO: 1789087 - RNA, 22 nt, Human
acuauggcccuggccuagcaua

SEQ ID NO: 1789088 - RNA, 16 nt, Human
acuauguugcccaggc

SEQ ID NO: 1789089 - RNA, 15 nt, Human
acuauguugcccagg

SEQ ID NO: 1789090 - RNA, 17 nt, Human
acuauguugcccaggca

SEQ ID NO: 1789091 - RNA, 16 nt, Human
acuaucuaaauguuga

SEQ ID NO: 1789092 - RNA, 21 nt, Human
acuaucuaaauguugaaagau

SEQ ID NO: 1789093 - RNA, 22 nt, Human
acuauagccuaggugacagagu

SEQ ID NO: 1789094 - RNA, 20 nt, Human
acuauagccuaggugacaga

SEQ ID NO: 1789095 - RNA, 23 nt, Human
uccccacccugaaagcccugagc

SEQ ID NO: 1789096 - RNA, 15 nt, Human
uccccaccgcagaca

SEQ ID NO: 1789097 - RNA, 16 nt, Human
uccccaccgcagacag

SEQ ID NO: 1789098 - RNA, 18 nt, Human
uccccaggaggccagccu

SEQ ID NO: 1789099 - RNA, 12 nt, Human
uccccacccuga

SEQ ID NO: 1789100 - RNA, 19 nt, Human
acuagacucccaagcugga

SEQ ID NO: 1789101 - RNA, 16 nt, Human
ucccccagccccaucc

SEQ ID NO: 1789102 - RNA, 13 nt, Human
ucccccagcccca

SEQ ID NO: 1789103 - RNA, 15 nt, Human
ucccccagccccauc

SEQ ID NO: 1789104 - RNA, 11 nt, Human
ucccccagccc

SEQ ID NO: 1789105 - RNA, 20 nt, Human
uccccaggaggccagccuug

SEQ ID NO: 1789106 - RNA, 21 nt, Human
uccccaggaggccagccuuga

SEQ ID NO: 1789107 - RNA, 12 nt, Human
acggccaggcca

SEQ ID NO: 1789108 - RNA, 18 nt, Human
acggcucacugcagccuc

SEQ ID NO: 1789109 - RNA, 17 nt, Human
acggcucacugcagccu

SEQ ID NO: 1789110 - RNA, 16 nt, Human
acggcucacugcagcc

SEQ ID NO: 1789111 - RNA, 13 nt, Human
acggccaggccag

SEQ ID NO: 1789112 - RNA, 18 nt, Human
acggcuuuuacuuaaacc

SEQ ID NO: 1789113 - RNA, 14 nt, Human
uccaguaucuugaa

SEQ ID NO: 1789114 - RNA, 15 nt, Human
uccaguaucuugaag

SEQ ID NO: 1789115 - RNA, 22 nt, Human
uccagugaggcucugcccuugg

SEQ ID NO: 1789116 - RNA, 23 nt, Human
uccagugaggcucugcccuuggu

SEQ ID NO: 1789117 - RNA, 16 nt, Human
uccagugaggcucugc

SEQ ID NO: 1789118 - RNA, 15 nt, Human
uccagugaggcucug

SEQ ID NO: 1789119 - RNA, 18 nt, Human
uccagugagacagcucug

SEQ ID NO: 1789120 - RNA, 16 nt, Human
uccaguaucuugaaga

SEQ ID NO: 1789121 - RNA, 18 nt, Human
uccaguaucuugaagacu

SEQ ID NO: 1789122 - RNA, 13 nt, Human
acgcuggaccuug

SEQ ID NO: 1789123 - RNA, 14 nt, Human
acgcucucuggccu

SEQ ID NO: 1789124 - RNA, 11 nt, Human
acgcucucugg

SEQ ID NO: 1789125 - RNA, 14 nt, Human
acgcuccuuccucu

SEQ ID NO: 1789126 - RNA, 15 nt, Human
acgcuccuuccucug

SEQ ID NO: 1789127 - RNA, 16 nt, Human
acgcuggagugcagug

SEQ ID NO: 1789128 - RNA, 15 nt, Human
acgcuggagugcagu

SEQ ID NO: 1789129 - RNA, 23 nt, Human
acgcuggaccuugaacuggguac

SEQ ID NO: 1789130 - RNA, 20 nt, Human
acgcuggaccuugaacuggg

SEQ ID NO: 1789131 - RNA, 18 nt, Human
acgcuggagugcagugag

SEQ ID NO: 1789132 - RNA, 17 nt, Human
acgcuggagugcaguga

SEQ ID NO: 1789133 - RNA, 23 nt, Human
acggagucccaccuuggcugcag

SEQ ID NO: 1789134 - RNA, 21 nt, Human
acgaauauugcugauggugca

SEQ ID NO: 1789135 - RNA, 20 nt, Human
acgcgugcacacaccagagc

SEQ ID NO: 1789136 - RNA, 21 nt, Human
acgcuacccgggaagggggcu

SEQ ID NO: 1789137 - RNA, 21 nt, Human
uccacugugccaugugccagg

SEQ ID NO: 1789138 - RNA, 18 nt, Human
uccagaauggucuuucua

SEQ ID NO: 1789139 - RNA, 22 nt, Human
uccacugguucuucuuggucuc

SEQ ID NO: 1789140 - RNA, 13 nt, Human
accuuuuuuauac

SEQ ID NO: 1789141 - RNA, 20 nt, Human
accuugaacuggguacuugu

SEQ ID NO: 1789142 - RNA, 19 nt, Human
accuugaaaacuuuaugcu

SEQ ID NO: 1789143 - RNA, 22 nt, Human
accuuuguuugcaucugaaaau

SEQ ID NO: 1789144 - RNA, 18 nt, Human
accuuuguccccaccgca

SEQ ID NO: 1789145 - RNA, 17 nt, Human
accuuugacaaagguaa

SEQ ID NO: 1789146 - RNA, 18 nt, Human
accuuugacaaagguaaa

SEQ ID NO: 1789147 - RNA, 17 nt, Human
accuuuguccccaccgc

SEQ ID NO: 1789148 - RNA, 22 nt, Human
uccaggcuccuuuagcgcccag

SEQ ID NO: 1789149 - RNA, 12 nt, Human
uccaggcuccuu

SEQ ID NO: 1789150 - RNA, 20 nt, Human
uccaggcugggagagccuuc

SEQ ID NO: 1789151 - RNA, 21 nt, Human
uccaggcugggagagccuucc

SEQ ID NO: 1789152 - RNA, 10 nt, Human
uccaggcucc

SEQ ID NO: 1789153 - RNA, 23 nt, Human
uccaggcugggagagccuuccag

SEQ ID NO: 1789154 - RNA, 15 nt, Human
acgaauauugcugau

SEQ ID NO: 1789155 - RNA, 18 nt, Human
acgaauauugcugauggu

SEQ ID NO: 1789156 - RNA, 14 nt, Human
uccagaauuuccca

SEQ ID NO: 1789157 - RNA, 15 nt, Human
uccagaauuucccaa

SEQ ID NO: 1789158 - RNA, 13 nt, Human
uccagaccccugg

SEQ ID NO: 1789159 - RNA, 20 nt, Human
uccagccugcugccugcuuu

SEQ ID NO: 1789160 - RNA, 11 nt, Human
uccagccuggg

SEQ ID NO: 1789161 - RNA, 15 nt, Human
ucauauuuacuucuu

SEQ ID NO: 1789162 - RNA, 23 nt, Human
ucauauuuacuucuuauacauuu

SEQ ID NO: 1789163 - RNA, 16 nt, Human
accgagucucuucucc

SEQ ID NO: 1789164 - RNA, 17 nt, Human
accgagucucuucucca

SEQ ID NO: 1789165 - RNA, 16 nt, Human
ucauauuuacuucuua

SEQ ID NO: 1789166 - RNA, 20 nt, Human
ucauauuuuaaacagaggau

SEQ ID NO: 1789167 - RNA, 21 nt, Human
ucauaguaugguggcuggguu

SEQ ID NO: 1789168 - RNA, 18 nt, Human
ucauauaagauucauauu

SEQ ID NO: 1789169 - RNA, 19 nt, Human
ucauaguaugguggcuggg

SEQ ID NO: 1789170 - RNA, 18 nt, Human
ucauaguaugguggcugg

SEQ ID NO: 1789171 - RNA, 15 nt, Human
ucauaguaugguggc

SEQ ID NO: 1789172 - RNA, 14 nt, Human
ucauaaccuagccu

SEQ ID NO: 1789173 - RNA, 17 nt, Human
ucaguuuuugugaaaag

SEQ ID NO: 1789174 - RNA, 16 nt, Human
ucaguuuucaggagug

SEQ ID NO: 1789175 - RNA, 15 nt, Human
ucaguuuuugugaaa

SEQ ID NO: 1789176 - RNA, 11 nt, Human
ucaguggcagc

SEQ ID NO: 1789177 - RNA, 16 nt, Human
ucagugccuuauggaa

SEQ ID NO: 1789178 - RNA, 18 nt, Human
ucagugccuuauggaaca

SEQ ID NO: 1789179 - RNA, 13 nt, Human
ucaguggcagcug

SEQ ID NO: 1789180 - RNA, 12 nt, Human
ucaguggcagcu

SEQ ID NO: 1789181 - RNA, 16 nt, Human
ucaguggggaggggcu

SEQ ID NO: 1789182 - RNA, 12 nt, Human
ucagugccacua

SEQ ID NO: 1789183 - RNA, 16 nt, Human
ucagugccaaaaacaa

SEQ ID NO: 1789184 - RNA, 17 nt, Human
accgaaaacguggcugc

SEQ ID NO: 1789185 - RNA, 19 nt, Human
accgaaaacguggcugcuu

SEQ ID NO: 1789186 - RNA, 20 nt, Human
ucagugcccuccaggauaga

SEQ ID NO: 1789187 - RNA, 9 nt, Human
ucagugccu

SEQ ID NO: 1789188 - RNA, 10 nt, Human
ucagugccuu

SEQ ID NO: 1789189 - RNA, 11 nt, Human
ucagugccuua

SEQ ID NO: 1789190 - RNA, 12 nt, Human
ucagugccuuau

SEQ ID NO: 1789191 - RNA, 14 nt, Human
ucagugccuuaugg

SEQ ID NO: 1789192 - RNA, 15 nt, Human
ucagugccuuaugga

SEQ ID NO: 1789193 - RNA, 17 nt, Human
accgcagacaggaccag

SEQ ID NO: 1789194 - RNA, 12 nt, Human
accgcagacagg

SEQ ID NO: 1789195 - RNA, 16 nt, Human
accgcagacaggacca

SEQ ID NO: 1789196 - RNA, 20 nt, Human
accucccacaaaggagagcu

SEQ ID NO: 1789197 - RNA, 11 nt, Human
ucaugauuuuu

SEQ ID NO: 1789198 - RNA, 14 nt, Human
ucaugcaaacuuua

SEQ ID NO: 1789199 - RNA, 13 nt, Human
ucaucuaggauuu

SEQ ID NO: 1789200 - RNA, 13 nt, Human
ucauccauccagg

SEQ ID NO: 1789201 - RNA, 17 nt, Human
ucaugugaaaucauuca

SEQ ID NO: 1789202 - RNA, 16 nt, Human
ucaugugaaaucauuc

SEQ ID NO: 1789203 - RNA, 23 nt, Human
ucaugcaaacuuuauuuuguguu

SEQ ID NO: 1789204 - RNA, 15 nt, Human
ucagcaaaagaugcu

SEQ ID NO: 1789205 - RNA, 18 nt, Human
accaguguuguggauuua

SEQ ID NO: 1789206 - RNA, 21 nt, Human
ucagauuugaacucuucaauc

SEQ ID NO: 1789207 - RNA, 12 nt, Human
ucagauuugaac

SEQ ID NO: 1789208 - RNA, 22 nt, Human
accccagccccaaaacucuccu

SEQ ID NO: 1789209 - RNA, 13 nt, Human
accccagccccaa

SEQ ID NO: 1789210 - RNA, 17 nt, Human
accccacacacgccaga

SEQ ID NO: 1789211 - RNA, 23 nt, Human
acccaggagccccgaggccuucu

SEQ ID NO: 1789212 - RNA, 19 nt, Human
acccaggagccccgaggcc

SEQ ID NO: 1789213 - RNA, 17 nt, Human
ucagcccucccugcccc

SEQ ID NO: 1789214 - RNA, 13 nt, Human
ucagcccucccug

SEQ ID NO: 1789215 - RNA, 14 nt, Human
ucagcccucccugc

SEQ ID NO: 1789216 - RNA, 15 nt, Human
ucagcccucccugcc

SEQ ID NO: 1789217 - RNA, 16 nt, Human
ucagcccucccugccc

SEQ ID NO: 1789218 - RNA, 15 nt, Human
accccugagcuugca

SEQ ID NO: 1789219 - RNA, 18 nt, Human
accccaucucuacaaaaa

SEQ ID NO: 1789220 - RNA, 23 nt, Human
ucagcggggacagcuccuucugu

SEQ ID NO: 1789221 - RNA, 21 nt, Human
ucagcggggacagcuccuucu

SEQ ID NO: 1789222 - RNA, 20 nt, Human
ucagcggggacagcuccuuc

SEQ ID NO: 1789223 - RNA, 19 nt, Human
ucagcggggacagcuccuu

SEQ ID NO: 1789224 - RNA, 12 nt, Human
ucagcuccagcu

SEQ ID NO: 1789225 - RNA, 18 nt, Human
accccuggcuuuucacug

SEQ ID NO: 1789226 - RNA, 19 nt, Human
accccuggcuuuucacugc

SEQ ID NO: 1789227 - RNA, 20 nt, Human
accccuggcuuuucacugcu

SEQ ID NO: 1789228 - RNA, 21 nt, Human
accccuggcuuuucacugcug

SEQ ID NO: 1789229 - RNA, 17 nt, Human
acccgggaggcagaggu

SEQ ID NO: 1789230 - RNA, 12 nt, Human
acccgggaaggg

SEQ ID NO: 1789231 - RNA, 13 nt, Human
acccgggaagggg

SEQ ID NO: 1789232 - RNA, 20 nt, Human
acccggccccugcugguuca

SEQ ID NO: 1789233 - RNA, 17 nt, Human
acccggccccugcuggu

SEQ ID NO: 1789234 - RNA, 22 nt, Human
acccggccccugcugguucagg

SEQ ID NO: 1789235 - RNA, 16 nt, Human
acccggccccugcugg

SEQ ID NO: 1789236 - RNA, 15 nt, Human
acccggccccugcug

SEQ ID NO: 1789237 - RNA, 14 nt, Human
acccggccccugcu

SEQ ID NO: 1789238 - RNA, 18 nt, Human
acccggaggggccuggca

SEQ ID NO: 1789239 - RNA, 21 nt, Human
acccggaggggccuggcagcc

SEQ ID NO: 1789240 - RNA, 22 nt, Human
ucagguaacaggcagauacagg

SEQ ID NO: 1789241 - RNA, 21 nt, Human
ucagguaacaggcagauacag

SEQ ID NO: 1789242 - RNA, 23 nt, Human
ucagguaacaggcagauacagga

SEQ ID NO: 1789243 - RNA, 16 nt, Human
ucaggguuggccccug

SEQ ID NO: 1789244 - RNA, 19 nt, Human
ucagggucccugguggcag

SEQ ID NO: 1789245 - RNA, 23 nt, Human
ucaggccaggcccucugcccacu

SEQ ID NO: 1789246 - RNA, 22 nt, Human
ucagcuuguaaauagcucaggu

SEQ ID NO: 1789247 - RNA, 21 nt, Human
ucagcuuguaaauagcucagg

SEQ ID NO: 1789248 - RNA, 15 nt, Human
ucagcuccagcucac

SEQ ID NO: 1789249 - RNA, 14 nt, Human
ucagcuccagcuca

SEQ ID NO: 1789250 - RNA, 21 nt, Human
ucaggccaggcccucugccca

SEQ ID NO: 1789251 - RNA, 22 nt, Human
ucaggccaggcccucugcccac

SEQ ID NO: 1789252 - RNA, 20 nt, Human
ucaggccaggcccucugccc

SEQ ID NO: 1789253 - RNA, 12 nt, Human
acccuucuuuuc

SEQ ID NO: 1789254 - RNA, 17 nt, Human
acccugcccugugggcc

SEQ ID NO: 1789255 - RNA, 22 nt, Human
acccugcccugugggcccccaa

SEQ ID NO: 1789256 - RNA, 15 nt, Human
acccugaggcccaga

SEQ ID NO: 1789257 - RNA, 16 nt, Human
acccugaggcccagag

SEQ ID NO: 1789258 - RNA, 17 nt, Human
acccugaggcccagagg

SEQ ID NO: 1789259 - RNA, 15 nt, Human
acccugcccuguggg

SEQ ID NO: 1789260 - RNA, 15 nt, Human
accgaaaacguggcu

SEQ ID NO: 1789261 - RNA, 17 nt, Human
acccuugccgucuaccu

SEQ ID NO: 1789262 - RNA, 20 nt, Human
acccuuguggucccacccca

SEQ ID NO: 1789263 - RNA, 23 nt, Human
acccuuguggucccaccccacac

SEQ ID NO: 1789264 - RNA, 19 nt, Human
acccucgaggcggaucuuu

SEQ ID NO: 1789265 - RNA, 16 nt, Human
acccugaaagcccuga

SEQ ID NO: 1789266 - RNA, 18 nt, Human
acccugaaagcccugagc

SEQ ID NO: 1789267 - RNA, 14 nt, Human
acccugaggcccag

SEQ ID NO: 1789268 - RNA, 14 nt, Human
ucaaauuucuaaau

SEQ ID NO: 1789269 - RNA, 13 nt, Human
ucaaauuucuaaa

SEQ ID NO: 1789270 - RNA, 20 nt, Human
ucaacugcaucaagauguga

SEQ ID NO: 1789271 - RNA, 15 nt, Human
ucaaccauuccccau

SEQ ID NO: 1789272 - RNA, 18 nt, Human
ucaaccauuccccauggg

SEQ ID NO: 1789273 - RNA, 14 nt, Human
ucaaccagcagaug

SEQ ID NO: 1789274 - RNA, 14 nt, Human
acauuccugaugcu

SEQ ID NO: 1789275 - RNA, 23 nt, Human
acauguaauuaaguacuauguau

SEQ ID NO: 1789276 - RNA, 15 nt, Human
acauguccaagaagc

SEQ ID NO: 1789277 - RNA, 19 nt, Human
acauguccaagaagcccag

SEQ ID NO: 1789278 - RNA, 14 nt, Human
acauggaaguacua

SEQ ID NO: 1789279 - RNA, 15 nt, Human
acauguaauuaagua

SEQ ID NO: 1789280 - RNA, 17 nt, Human
acauguaauuaaguacu

SEQ ID NO: 1789281 - RNA, 19 nt, Human
acauguaauuaaguacuau

SEQ ID NO: 1789282 - RNA, 21 nt, Human
acauguaauuaaguacuaugu

SEQ ID NO: 1789283 - RNA, 22 nt, Human
acauguaauuaaguacuaugua

SEQ ID NO: 1789284 - RNA, 20 nt, Human
acaugaauauuuaguguuca

SEQ ID NO: 1789285 - RNA, 12 nt, Human
acagucccugcc

SEQ ID NO: 1789286 - RNA, 20 nt, Human
acaugagguacugagaguga

SEQ ID NO: 1789287 - RNA, 21 nt, Human
acaugcuacacacugcauguu

SEQ ID NO: 1789288 - RNA, 15 nt, Human
acaugcuacacacug

SEQ ID NO: 1789289 - RNA, 23 nt, Human
acaugagguacugagagugaaca

SEQ ID NO: 1789290 - RNA, 22 nt, Human
ucaaguccucuuuucugagagg

SEQ ID NO: 1789291 - RNA, 22 nt, Human
ucaauaucuuuuuuuuaauaaa

SEQ ID NO: 1789292 - RNA, 23 nt, Human
ucaaugaaugaaugaauggcuaa

SEQ ID NO: 1789293 - RNA, 21 nt, Human
acauuuuuuaaaugcaccugg

SEQ ID NO: 1789294 - RNA, 17 nt, Human
acauuuuuuaaaugcac

SEQ ID NO: 1789295 - RNA, 16 nt, Human
acauuuuuuaaaugca

SEQ ID NO: 1789296 - RNA, 14 nt, Human
acauuuuuuaaaug

SEQ ID NO: 1789297 - RNA, 11 nt, Human
acauuuuguau

SEQ ID NO: 1789298 - RNA, 23 nt, Human
acauuuuuaagugcugcauuuaa

SEQ ID NO: 1789299 - RNA, 22 nt, Human
acauuuuuaagugcugcauuua

SEQ ID NO: 1789300 - RNA, 21 nt, Human
acauuuuuaagugcugcauuu

SEQ ID NO: 1789301 - RNA, 14 nt, Human
acauugcaauagaa

SEQ ID NO: 1789302 - RNA, 16 nt, Human
acauugcaauagaaau

SEQ ID NO: 1789303 - RNA, 15 nt, Human
acauugcaauagaaa

SEQ ID NO: 1789304 - RNA, 20 nt, Human
acauuuuauuuuauuaugca

SEQ ID NO: 1789305 - RNA, 19 nt, Human
acauuuuauuuuauuaugc

SEQ ID NO: 1789306 - RNA, 14 nt, Human
acauuuuauuuuau

SEQ ID NO: 1789307 - RNA, 18 nt, Human
acauuuuauuuuauuaug

SEQ ID NO: 1789308 - RNA, 23 nt, Human
ucacuguugcccaggcuggcgug

SEQ ID NO: 1789309 - RNA, 13 nt, Human
ucacugcauccuc

SEQ ID NO: 1789310 - RNA, 15 nt, Human
ucacugcagccucaa

SEQ ID NO: 1789311 - RNA, 14 nt, Human
ucacugcagccuca

SEQ ID NO: 1789312 - RNA, 22 nt, Human
ucacugagacagcccgggcucu

SEQ ID NO: 1789313 - RNA, 17 nt, Human
ucacugagacagcccgg

SEQ ID NO: 1789314 - RNA, 21 nt, Human
ucacugagacagcccgggcuc

SEQ ID NO: 1789315 - RNA, 17 nt, Human
ucacuauguugcccagg

SEQ ID NO: 1789316 - RNA, 16 nt, Human
ucacugagacagcccg

SEQ ID NO: 1789317 - RNA, 19 nt, Human
ucacuaucccggcugcccu

SEQ ID NO: 1789318 - RNA, 20 nt, Human
ucacuaucccggcugcccuu

SEQ ID NO: 1789319 - RNA, 17 nt, Human
accaguguuguggauuu

SEQ ID NO: 1789320 - RNA, 15 nt, Human
accaguguuguggau

SEQ ID NO: 1789321 - RNA, 10 nt, Human
ucacuugagu

SEQ ID NO: 1789322 - RNA, 23 nt, Human
ucacuugaacccgggaggcagag

SEQ ID NO: 1789323 - RNA, 18 nt, Human
ucacguaaagcuagaaau

SEQ ID NO: 1789324 - RNA, 16 nt, Human
ucacuaggcuucuggu

SEQ ID NO: 1789325 - RNA, 20 nt, Human
ucacguaaagcuagaaauga

SEQ ID NO: 1789326 - RNA, 19 nt, Human
ucacguaaagcuagaaaug

SEQ ID NO: 1789327 - RNA, 22 nt, Human
accagcgugugacuacuccccc

SEQ ID NO: 1789328 - RNA, 15 nt, Human
accacuacauucugu

SEQ ID NO: 1789329 - RNA, 16 nt, Human
accacuacauucuguu

SEQ ID NO: 1789330 - RNA, 17 nt, Human
accacuacauucuguua

SEQ ID NO: 1789331 - RNA, 17 nt, Human
ucacaaaggaugcccaa

SEQ ID NO: 1789332 - RNA, 16 nt, Human
ucaauucuugccaaau

SEQ ID NO: 1789333 - RNA, 14 nt, Human
ucacaaccuucugu

SEQ ID NO: 1789334 - RNA, 20 nt, Human
ucacagaugggugcuuggag

SEQ ID NO: 1789335 - RNA, 23 nt, Human
ucacagaugugugauucacagug

SEQ ID NO: 1789336 - RNA, 21 nt, Human
ucacagaugugugauucacag

SEQ ID NO: 1789337 - RNA, 13 nt, Human
ucacagccucuga

SEQ ID NO: 1789338 - RNA, 16 nt, Human
ucacaguucucuccuu

SEQ ID NO: 1789339 - RNA, 20 nt, Human
ucacaguucucuccuucuuc

SEQ ID NO: 1789340 - RNA, 21 nt, Human
ucaccauguuggccaggcugg

SEQ ID NO: 1789341 - RNA, 22 nt, Human
ucaccauguuggccaggcuggu

SEQ ID NO: 1789342 - RNA, 15 nt, Human
ucaccauguuggcca

SEQ ID NO: 1789343 - RNA, 19 nt, Human
accacaucuugcucugcug

SEQ ID NO: 1789344 - RNA, 18 nt, Human
accacaucuugcucugcu

SEQ ID NO: 1789345 - RNA, 17 nt, Human
accacaucuugcucugc

SEQ ID NO: 1789346 - RNA, 18 nt, Human
accacaugugcacaugca

SEQ ID NO: 1789347 - RNA, 19 nt, Human
accaccaacuacuaccugu

SEQ ID NO: 1789348 - RNA, 24 nt, Human
accacauuggagauguuuaguaau

SEQ ID NO: 1789349 - RNA, 20 nt, Human
accaccacacccagcccacu

SEQ ID NO: 1789350 - RNA, 15 nt, Human
accaccacacccagc

SEQ ID NO: 1789351 - RNA, 20 nt, Human
uaacgauaaaagacagugaa

SEQ ID NO: 1789352 - RNA, 18 nt, Human
uaacauggugugcuucuu

SEQ ID NO: 1789353 - RNA, 20 nt, Human
uaacuagaacugaauuuugu

SEQ ID NO: 1789354 - RNA, 17 nt, Human
uaacuagaacugaauuu

SEQ ID NO: 1789355 - RNA, 14 nt, Human
uaacuagaacugaa

SEQ ID NO: 1789356 - RNA, 12 nt, Human
uaacuagaacug

SEQ ID NO: 1789357 - RNA, 14 nt, Human
uaacuucaccauau

SEQ ID NO: 1789358 - RNA, 17 nt, Human
uaacuuccaauuuacau

SEQ ID NO: 1789359 - RNA, 21 nt, Human
uaacuucacauauugauuucc

SEQ ID NO: 1789360 - RNA, 18 nt, Human
uaagaagugaaaaucuac

SEQ ID NO: 1789361 - RNA, 13 nt, Human
uaagacaaauaug

SEQ ID NO: 1789362 - RNA, 16 nt, Human
uaacuuucugaaauaa

SEQ ID NO: 1789363 - RNA, 23 nt, Human
uaacauggacaugaucuucuuua

SEQ ID NO: 1789364 - RNA, 17 nt, Human
uaacauguaauuaagua

SEQ ID NO: 1789365 - RNA, 18 nt, Human
uaacauggacaugaucuu

SEQ ID NO: 1789366 - RNA, 18 nt, Human
aauauauuuuaagacgaa

SEQ ID NO: 1789367 - RNA, 17 nt, Human
uaacaguggacaaaguu

SEQ ID NO: 1789368 - RNA, 13 nt, Human
aauaguuggcuag

SEQ ID NO: 1789369 - RNA, 14 nt, Human
aauaguuguugauu

SEQ ID NO: 1789370 - RNA, 14 nt, Human
aauauauuuuaaga

SEQ ID NO: 1789371 - RNA, 15 nt, Human
aauauauuuuaagac

SEQ ID NO: 1789372 - RNA, 22 nt, Human
aauaguggugugauuuggggau

SEQ ID NO: 1789373 - RNA, 16 nt, Human
aauaguggugugauuu

SEQ ID NO: 1789374 - RNA, 14 nt, Human
uaagauuccagaga

SEQ ID NO: 1789375 - RNA, 21 nt, Human
uaagauuccagagaguggcuc

SEQ ID NO: 1789376 - RNA, 22 nt, Human
uaagcuguuacugucuucagua

SEQ ID NO: 1789377 - RNA, 18 nt, Human
uaagcacacuugacauca

SEQ ID NO: 1789378 - RNA, 12 nt, Human
aauauuccagag

SEQ ID NO: 1789379 - RNA, 15 nt, Human
aauauuccugcauuu

SEQ ID NO: 1789380 - RNA, 15 nt, Human
uaagagaaaugagcu

SEQ ID NO: 1789381 - RNA, 17 nt, Human
aauaugcacacauuuuu

SEQ ID NO: 1789382 - RNA, 16 nt, Human
aauaugcacacauuuu

SEQ ID NO: 1789383 - RNA, 22 nt, Human
aauaugcacacauuuuuuaaau

SEQ ID NO: 1789384 - RNA, 12 nt, Human
aauauuuagugu

SEQ ID NO: 1789385 - RNA, 17 nt, Human
aauauugauaugcuuau

SEQ ID NO: 1789386 - RNA, 23 nt, Human
aauauuguacaguuuuuauugcu

SEQ ID NO: 1789387 - RNA, 17 nt, Human
aauauuguacaguuuuu

SEQ ID NO: 1789388 - RNA, 15 nt, Human
aauauuguacaguuu

SEQ ID NO: 1789389 - RNA, 14 nt, Human
aauccuggggaaca

SEQ ID NO: 1789390 - RNA, 21 nt, Human
aauccuggggaacauagaacu

SEQ ID NO: 1789391 - RNA, 15 nt, Human
aaucgaccugccucg

SEQ ID NO: 1789392 - RNA, 12 nt, Human
aauccgcccauc

SEQ ID NO: 1789393 - RNA, 23 nt, Human
aaucauuaggugugacugaauuu

SEQ ID NO: 1789394 - RNA, 17 nt, Human
aaucauuaggugugacu

SEQ ID NO: 1789395 - RNA, 15 nt, Human
aaucauuagguguga

SEQ ID NO: 1789396 - RNA, 19 nt, Human
aaucuuauaauuuaaaaua

SEQ ID NO: 1789397 - RNA, 19 nt, Human
aaucuacacuccagugaga

SEQ ID NO: 1789398 - RNA, 16 nt, Human
aaucugggccagaauu

SEQ ID NO: 1789399 - RNA, 17 nt, Human
aaucugggccagaauuu

SEQ ID NO: 1789400 - RNA, 12 nt, Human
uaauaaacacuc

SEQ ID NO: 1789401 - RNA, 18 nt, Human
uaauaaacacucuugaaa

SEQ ID NO: 1789402 - RNA, 13 nt, Human
uaaguacuaugua

SEQ ID NO: 1789403 - RNA, 16 nt, Human
uaaguacuauguauca

SEQ ID NO: 1789404 - RNA, 17 nt, Human
uaaguacuauguaucaa

SEQ ID NO: 1789405 - RNA, 19 nt, Human
uaaguacuauguaucaaug

SEQ ID NO: 1789406 - RNA, 20 nt, Human
uaaguauucuuauuuaauga

SEQ ID NO: 1789407 - RNA, 19 nt, Human
uaaguauucuuauuuaaug

SEQ ID NO: 1789408 - RNA, 18 nt, Human
uaaugucacaggcagguc

SEQ ID NO: 1789409 - RNA, 19 nt, Human
uaauguaucaaauacauuu

SEQ ID NO: 1789410 - RNA, 13 nt, Human
uaauguacugcau

SEQ ID NO: 1789411 - RNA, 15 nt, Human
uaaugaaugcauaaa

SEQ ID NO: 1789412 - RNA, 15 nt, Human
aaucuuuaauuuuac

SEQ ID NO: 1789413 - RNA, 16 nt, Human
aaucuuuaauuuuaca

SEQ ID NO: 1789414 - RNA, 22 nt, Human
aaugaaugucagugugacugau

SEQ ID NO: 1789415 - RNA, 13 nt, Human
aaugacacagucu

SEQ ID NO: 1789416 - RNA, 17 nt, Human
aaugaaugcauaaaaug

SEQ ID NO: 1789417 - RNA, 22 nt, Human
aaugaauggcuaagcaaaaugu

SEQ ID NO: 1789418 - RNA, 13 nt, Human
aaugaaugucagu

SEQ ID NO: 1789419 - RNA, 13 nt, Human
aaucuuucugcag

SEQ ID NO: 1789420 - RNA, 17 nt, Human
aaugaaacauuuuguca

SEQ ID NO: 1789421 - RNA, 16 nt, Human
aaugaaagacuguaca

SEQ ID NO: 1789422 - RNA, 17 nt, Human
aaugaaagacuguacaa

SEQ ID NO: 1789423 - RNA, 17 nt, Human
aaugaaaccugugucuc

SEQ ID NO: 1789424 - RNA, 17 nt, Human
uaaugaaugaaacauuu

SEQ ID NO: 1789425 - RNA, 16 nt, Human
uaauagacaauuuauu

SEQ ID NO: 1789426 - RNA, 14 nt, Human
uaauagacaauuua

SEQ ID NO: 1789427 - RNA, 19 nt, Human
uaauacaccacuacauucu

SEQ ID NO: 1789428 - RNA, 18 nt, Human
uaauacaccacuacauuc

SEQ ID NO: 1789429 - RNA, 16 nt, Human
uaauacaccacuacau

SEQ ID NO: 1789430 - RNA, 19 nt, Human
uaauagcgucauaacuaga

SEQ ID NO: 1789431 - RNA, 22 nt, Human
uaauagacaauuuauuauggca

SEQ ID NO: 1789432 - RNA, 18 nt, Human
uaauagacaauuuauuau

SEQ ID NO: 1789433 - RNA, 15 nt, Human
aauuagccaagugug

SEQ ID NO: 1789434 - RNA, 11 nt, Human
aauuacaggaa

SEQ ID NO: 1789435 - RNA, 23 nt, Human
uaccugccaggaagccagcaggc

SEQ ID NO: 1789436 - RNA, 18 nt, Human
uaccugccaggaagccag

SEQ ID NO: 1789437 - RNA, 20 nt, Human
uaccugccaggaagccagca

SEQ ID NO: 1789438 - RNA, 10 nt, Human
uaccuguccc

SEQ ID NO: 1789439 - RNA, 13 nt, Human
uaccugucccccu

SEQ ID NO: 1789440 - RNA, 14 nt, Human
uaccugucccccug

SEQ ID NO: 1789441 - RNA, 16 nt, Human
uaccugucccccugac

SEQ ID NO: 1789442 - RNA, 17 nt, Human
uaccugucccccugaca

SEQ ID NO: 1789443 - RNA, 18 nt, Human
aauuccaagugauugaaa

SEQ ID NO: 1789444 - RNA, 22 nt, Human
aauuccacuuauaggaauugac

SEQ ID NO: 1789445 - RNA, 12 nt, Human
aauuccccagau

SEQ ID NO: 1789446 - RNA, 14 nt, Human
aauuccccacccug

SEQ ID NO: 1789447 - RNA, 16 nt, Human
aauuauuauuuggccc

SEQ ID NO: 1789448 - RNA, 12 nt, Human
uacucuguguca

SEQ ID NO: 1789449 - RNA, 21 nt, Human
uacucugugucagguggggca

SEQ ID NO: 1789450 - RNA, 16 nt, Human
uacuggagaaaaugga

SEQ ID NO: 1789451 - RNA, 19 nt, Human
uacuguaaggcaaucaugg

SEQ ID NO: 1789452 - RNA, 18 nt, Human
uacuguaauuugugauac

SEQ ID NO: 1789453 - RNA, 20 nt, Human
uacuguaauuugugauacaa

SEQ ID NO: 1789454 - RNA, 19 nt, Human
uacuguaauuugugauaca

SEQ ID NO: 1789455 - RNA, 18 nt, Human
uacuguaaggcaaucaug

SEQ ID NO: 1789456 - RNA, 23 nt, Human
uacuguaauuugugauacaaugc

SEQ ID NO: 1789457 - RNA, 21 nt, Human
uacuguacaugaaaacacauu

SEQ ID NO: 1789458 - RNA, 22 nt, Human
uacuguacaugaaaacacauuu

SEQ ID NO: 1789459 - RNA, 21 nt, Human
aauugacccacaagaaaugaa

SEQ ID NO: 1789460 - RNA, 14 nt, Human
aauugacuuauuua

SEQ ID NO: 1789461 - RNA, 22 nt, Human
aauugacccacaagaaaugaaa

SEQ ID NO: 1789462 - RNA, 19 nt, Human
aauugaugggauuugguca

SEQ ID NO: 1789463 - RNA, 12 nt, Human
aauugcauuucc

SEQ ID NO: 1789464 - RNA, 22 nt, Human
uacgccaggggaaaaucagccu

SEQ ID NO: 1789465 - RNA, 18 nt, Human
uacgggaggguaaggcug

SEQ ID NO: 1789466 - RNA, 12 nt, Human
uacguacacauu

SEQ ID NO: 1789467 - RNA, 16 nt, Human
uacguugugcauuugg

SEQ ID NO: 1789468 - RNA, 15 nt, Human
uacguugugcauuug

SEQ ID NO: 1789469 - RNA, 14 nt, Human
uacguacacauuuu

SEQ ID NO: 1789470 - RNA, 13 nt, Human
uacguacacauuu

SEQ ID NO: 1789471 - RNA, 14 nt, Human
uacuauguaucaau

SEQ ID NO: 1789472 - RNA, 22 nt, Human
uacucuccuggaaauauuaaga

SEQ ID NO: 1789473 - RNA, 23 nt, Human
uacucuccuggaaauauuaagaa

SEQ ID NO: 1789474 - RNA, 23 nt, Human
uacuauggcccuggccuagcaua

SEQ ID NO: 1789475 - RNA, 12 nt, Human
uacuauguauca

SEQ ID NO: 1789476 - RNA, 13 nt, Human
uacuauguaucaa

SEQ ID NO: 1789477 - RNA, 13 nt, Human
uacuacuccugua

SEQ ID NO: 1789478 - RNA, 17 nt, Human
uacuacuccuguaggaa

SEQ ID NO: 1789479 - RNA, 20 nt, Human
uacuaucaugucaaacguga

SEQ ID NO: 1789480 - RNA, 12 nt, Human
aauggcagccuu

SEQ ID NO: 1789481 - RNA, 16 nt, Human
aauggcagccuuggca

SEQ ID NO: 1789482 - RNA, 23 nt, Human
aauggcacaaucucggcucacug

SEQ ID NO: 1789483 - RNA, 20 nt, Human
uacagauccccaagccuggc

SEQ ID NO: 1789484 - RNA, 22 nt, Human
uacagacaacaaaccuguuucu

SEQ ID NO: 1789485 - RNA, 19 nt, Human
uacacauuuuauuuuauua

SEQ ID NO: 1789486 - RNA, 22 nt, Human
uacacauuuuauuuuauuaugc

SEQ ID NO: 1789487 - RNA, 21 nt, Human
uacacauuuuauuuuauuaug

SEQ ID NO: 1789488 - RNA, 23 nt, Human
uacacauuuuauuuuauuaugca

SEQ ID NO: 1789489 - RNA, 15 nt, Human
uacacuaaaagguga

SEQ ID NO: 1789490 - RNA, 22 nt, Human
aaugcuguauuagucacagaga

SEQ ID NO: 1789491 - RNA, 13 nt, Human
aaugcccagcccc

SEQ ID NO: 1789492 - RNA, 11 nt, Human
aaugcccagcc

SEQ ID NO: 1789493 - RNA, 12 nt, Human
aaugcccagccc

SEQ ID NO: 1789494 - RNA, 16 nt, Human
aaugcuucaucccuuu

SEQ ID NO: 1789495 - RNA, 20 nt, Human
aauggaaaugggcagagcag

SEQ ID NO: 1789496 - RNA, 21 nt, Human
aauggaaaugggcagagcaga

SEQ ID NO: 1789497 - RNA, 14 nt, Human
aauggaaccacucu

SEQ ID NO: 1789498 - RNA, 23 nt, Human
aauggacguguuaugacuccaga

SEQ ID NO: 1789499 - RNA, 20 nt, Human
aauggacuaacuugucuuug

SEQ ID NO: 1789500 - RNA, 22 nt, Human
aaugcacuuuguucuggcucuu

SEQ ID NO: 1789501 - RNA, 21 nt, Human
uacaaugcugugcccuaaagu

SEQ ID NO: 1789502 - RNA, 18 nt, Human
aaugaccuuucaauagga

SEQ ID NO: 1789503 - RNA, 16 nt, Human
aaugaccuuucaauag

SEQ ID NO: 1789504 - RNA, 17 nt, Human
aaugaccuuucaauagg

SEQ ID NO: 1789505 - RNA, 20 nt, Human
aaugaccuuucaauaggaaa

SEQ ID NO: 1789506 - RNA, 21 nt, Human
aaugcacuuuguucuggcucu

SEQ ID NO: 1789507 - RNA, 21 nt, Human
aauuaagaaaggauaaaguug

SEQ ID NO: 1789508 - RNA, 22 nt, Human
aauuaaucugggccagaauuuc

SEQ ID NO: 1789509 - RNA, 13 nt, Human
uacauucuguuaa

SEQ ID NO: 1789510 - RNA, 11 nt, Human
aauuaacuuuu

SEQ ID NO: 1789511 - RNA, 16 nt, Human
uacaggugugagucac

SEQ ID NO: 1789512 - RNA, 24 nt, Human
uacauaaugcgugcauaccacuuu

SEQ ID NO: 1789513 - RNA, 23 nt, Human
uacauaaugcgugcauaccacuu

SEQ ID NO: 1789514 - RNA, 22 nt, Human
uacauauaagugauugcugguu

SEQ ID NO: 1789515 - RNA, 15 nt, Human
aaugugaaacuggau

SEQ ID NO: 1789516 - RNA, 14 nt, Human
aaugugaaacugga

SEQ ID NO: 1789517 - RNA, 19 nt, Human
aaugugaaaagaaaaauga

SEQ ID NO: 1789518 - RNA, 11 nt, Human
aaugugugugu

SEQ ID NO: 1789519 - RNA, 19 nt, Human
aauguauguguaaguauuc

SEQ ID NO: 1789520 - RNA, 18 nt, Human
aauguaucaaauacauuu

SEQ ID NO: 1789521 - RNA, 20 nt, Human
aauguauguguaaguauucu

SEQ ID NO: 1789522 - RNA, 23 nt, Human
acaggcugggcuucaguggcagc

SEQ ID NO: 1789523 - RNA, 22 nt, Human
acaggcugggcuucaguggcag

SEQ ID NO: 1789524 - RNA, 12 nt, Human
acaggcugggcu

SEQ ID NO: 1789525 - RNA, 13 nt, Human
acaggcuccugcc

SEQ ID NO: 1789526 - RNA, 15 nt, Human
acaggcuccugccac

SEQ ID NO: 1789527 - RNA, 21 nt, Human
acaggcuccugccaccacgcc

SEQ ID NO: 1789528 - RNA, 22 nt, Human
acaggcuccugccaccacgccc

SEQ ID NO: 1789529 - RNA, 21 nt, Human
acagggaggacgcucucuggc

SEQ ID NO: 1789530 - RNA, 20 nt, Human
acagggaggacgcucucugg

SEQ ID NO: 1789531 - RNA, 20 nt, Human
acagggcacaccgggcacuc

SEQ ID NO: 1789532 - RNA, 12 nt, Human
acagggcacacc

SEQ ID NO: 1789533 - RNA, 21 nt, Human
uauucagcucauggacuucug

SEQ ID NO: 1789534 - RNA, 22 nt, Human
acaggcgugagccaccgugccu

SEQ ID NO: 1789535 - RNA, 14 nt, Human
uauucauaauuauu

SEQ ID NO: 1789536 - RNA, 12 nt, Human
acaggcuccugc

SEQ ID NO: 1789537 - RNA, 16 nt, Human
uauucaggaagcucag

SEQ ID NO: 1789538 - RNA, 14 nt, Human
uauucaggaagcuc

SEQ ID NO: 1789539 - RNA, 20 nt, Human
uauucaguaauaacucuacc

SEQ ID NO: 1789540 - RNA, 13 nt, Human
uauuacuucugcu

SEQ ID NO: 1789541 - RNA, 14 nt, Human
uauuacuucugcua

SEQ ID NO: 1789542 - RNA, 21 nt, Human
uauuagugaccucagcuuuga

SEQ ID NO: 1789543 - RNA, 19 nt, Human
uauuagugaccucagcuuu

SEQ ID NO: 1789544 - RNA, 20 nt, Human
acaggcauguucucugagga

SEQ ID NO: 1789545 - RNA, 19 nt, Human
acaggcauguucucugagg

SEQ ID NO: 1789546 - RNA, 18 nt, Human
acaggcauguucucugag

SEQ ID NO: 1789547 - RNA, 15 nt, Human
acaggcauguucucu

SEQ ID NO: 1789548 - RNA, 22 nt, Human
acaggcauguucucugaggaca

SEQ ID NO: 1789549 - RNA, 14 nt, Human
uaugugaaacaugu

SEQ ID NO: 1789550 - RNA, 17 nt, Human
uaugugaaacauguuuc

SEQ ID NO: 1789551 - RNA, 23 nt, Human
uaugugccagauuuaugcauauu

SEQ ID NO: 1789552 - RNA, 20 nt, Human
uauguggaguucaucuugaa

SEQ ID NO: 1789553 - RNA, 18 nt, Human
acaggaaaagcugcugac

SEQ ID NO: 1789554 - RNA, 17 nt, Human
acaggaaaagcugcuga

SEQ ID NO: 1789555 - RNA, 16 nt, Human
acaggaaaagcugcug

SEQ ID NO: 1789556 - RNA, 15 nt, Human
acaggaaaagcugcu

SEQ ID NO: 1789557 - RNA, 13 nt, Human
acaggaaguacug

SEQ ID NO: 1789558 - RNA, 17 nt, Human
acaggaaguagaggagg

SEQ ID NO: 1789559 - RNA, 11 nt, Human
acagccuggca

SEQ ID NO: 1789560 - RNA, 13 nt, Human
acagcuaacaugg

SEQ ID NO: 1789561 - RNA, 14 nt, Human
acaggaucagucug

SEQ ID NO: 1789562 - RNA, 16 nt, Human
acaggagugagcacua

SEQ ID NO: 1789563 - RNA, 16 nt, Human
acaggcagguccaggg

SEQ ID NO: 1789564 - RNA, 14 nt, Human
acaggcagguccag

SEQ ID NO: 1789565 - RNA, 14 nt, Human
acaggcauguucuc

SEQ ID NO: 1789566 - RNA, 14 nt, Human
acaggacucugccu

SEQ ID NO: 1789567 - RNA, 23 nt, Human
acaggaccagggauuuccaugau

SEQ ID NO: 1789568 - RNA, 13 nt, Human
acagacccugccc

SEQ ID NO: 1789569 - RNA, 14 nt, Human
acagacccugcccu

SEQ ID NO: 1789570 - RNA, 15 nt, Human
acagacccugcccug

SEQ ID NO: 1789571 - RNA, 16 nt, Human
uauauuuaguaucuuu

SEQ ID NO: 1789572 - RNA, 17 nt, Human
uauaaguguguguuuuu

SEQ ID NO: 1789573 - RNA, 23 nt, Human
uauaaguguguguuuuucauaaa

SEQ ID NO: 1789574 - RNA, 17 nt, Human
acagaaauguacagcaa

SEQ ID NO: 1789575 - RNA, 16 nt, Human
acagaaauguacagca

SEQ ID NO: 1789576 - RNA, 14 nt, Human
acagaaauguacag

SEQ ID NO: 1789577 - RNA, 20 nt, Human
acagaaaauggaagacagcu

SEQ ID NO: 1789578 - RNA, 17 nt, Human
acagaaaauucuucucc

SEQ ID NO: 1789579 - RNA, 18 nt, Human
acagaaaauucuucucca

SEQ ID NO: 1789580 - RNA, 18 nt, Human
uaucaaguauuauaccuu

SEQ ID NO: 1789581 - RNA, 18 nt, Human
acagagaaaguacuucuc

SEQ ID NO: 1789582 - RNA, 11 nt, Human
acagagaaagu

SEQ ID NO: 1789583 - RNA, 13 nt, Human
uaucucccccagc

SEQ ID NO: 1789584 - RNA, 16 nt, Human
uaucucccccagcccc

SEQ ID NO: 1789585 - RNA, 14 nt, Human
uaucucccccagcc

SEQ ID NO: 1789586 - RNA, 12 nt, Human
acagccuggcac

SEQ ID NO: 1789587 - RNA, 23 nt, Human
uauggcuuuugugcauuaucuag

SEQ ID NO: 1789588 - RNA, 15 nt, Human
uaugcuuauacacuu

SEQ ID NO: 1789589 - RNA, 17 nt, Human
uauggcuuuugugcauu

SEQ ID NO: 1789590 - RNA, 21 nt, Human
uauggcuuuugugcauuaucu

SEQ ID NO: 1789591 - RNA, 18 nt, Human
uauggcuuuugugcauua

SEQ ID NO: 1789592 - RNA, 17 nt, Human
uaugccugggcagaagg

SEQ ID NO: 1789593 - RNA, 24 nt, Human
uaugcauuugaaaauuuugauguu

SEQ ID NO: 1789594 - RNA, 23 nt, Human
uaugcauuugaaaauuuugaugu

SEQ ID NO: 1789595 - RNA, 11 nt, Human
uaugcauuuga

SEQ ID NO: 1789596 - RNA, 18 nt, Human
acagccguuuguucccca

SEQ ID NO: 1789597 - RNA, 18 nt, Human
acagcccgggcucugccu

SEQ ID NO: 1789598 - RNA, 19 nt, Human
acagcccgggcucugccuc

SEQ ID NO: 1789599 - RNA, 20 nt, Human
acagcccgggcucugccucc

SEQ ID NO: 1789600 - RNA, 21 nt, Human
acagcaaggagauuuacaacu

SEQ ID NO: 1789601 - RNA, 17 nt, Human
acagcccgggcucugcc

SEQ ID NO: 1789602 - RNA, 22 nt, Human
acagaucucugcuuuggaaauc

SEQ ID NO: 1789603 - RNA, 18 nt, Human
acagauccccaagccugg

SEQ ID NO: 1789604 - RNA, 17 nt, Human
acagauccccaagccug

SEQ ID NO: 1789605 - RNA, 15 nt, Human
acagagcccacgccc

SEQ ID NO: 1789606 - RNA, 18 nt, Human
acagagcccacgccccca

SEQ ID NO: 1789607 - RNA, 19 nt, Human
acagagcccacgcccccac

SEQ ID NO: 1789608 - RNA, 14 nt, Human
acagauuugagcuc

SEQ ID NO: 1789609 - RNA, 15 nt, Human
acagauuugagcuca

SEQ ID NO: 1789610 - RNA, 17 nt, Human
acagcaaggagauuuac

SEQ ID NO: 1789611 - RNA, 21 nt, Human
uagugaaucacguaaagcuag

SEQ ID NO: 1789612 - RNA, 18 nt, Human
acacaguauuacuucugc

SEQ ID NO: 1789613 - RNA, 22 nt, Human
acacaguauuacuucugcuaca

SEQ ID NO: 1789614 - RNA, 19 nt, Human
acacaguauuacuucugcu

SEQ ID NO: 1789615 - RNA, 19 nt, Human
acaaugugaaaagaaaaau

SEQ ID NO: 1789616 - RNA, 17 nt, Human
acaaugugaaaagaaaa

SEQ ID NO: 1789617 - RNA, 19 nt, Human
acaauggauaggcacagga

SEQ ID NO: 1789618 - RNA, 24 nt, Human
acaaugcugugcccuaaaguguau

SEQ ID NO: 1789619 - RNA, 23 nt, Human
acaaugcugugcccuaaagugua

SEQ ID NO: 1789620 - RNA, 22 nt, Human
acaaugcugugcccuaaagugu

SEQ ID NO: 1789621 - RNA, 21 nt, Human
acaaugcugugcccuaaagug

SEQ ID NO: 1789622 - RNA, 21 nt, Human
acacacgcgugcacacaccag

SEQ ID NO: 1789623 - RNA, 20 nt, Human
acacaccagagcccaccuug

SEQ ID NO: 1789624 - RNA, 15 nt, Human
acacaccagagccca

SEQ ID NO: 1789625 - RNA, 14 nt, Human
acacaccagagccc

SEQ ID NO: 1789626 - RNA, 21 nt, Human
acacacugcauguuugugauu

SEQ ID NO: 1789627 - RNA, 22 nt, Human
acacacacgcgugcacacacca

SEQ ID NO: 1789628 - RNA, 14 nt, Human
acacacagcucugu

SEQ ID NO: 1789629 - RNA, 13 nt, Human
acacacagcucug

SEQ ID NO: 1789630 - RNA, 17 nt, Human
acacacagcucuguccu

SEQ ID NO: 1789631 - RNA, 19 nt, Human
acacacagcucuguccugg

SEQ ID NO: 1789632 - RNA, 15 nt, Human
uaguuccacugagac

SEQ ID NO: 1789633 - RNA, 14 nt, Human
uaguuccacugaga

SEQ ID NO: 1789634 - RNA, 20 nt, Human
uaguuccaccaucaagccac

SEQ ID NO: 1789635 - RNA, 19 nt, Human
uauaaaagccuguuuaaga

SEQ ID NO: 1789636 - RNA, 22 nt, Human
uauaaaagggacugagaaauuu

SEQ ID NO: 1789637 - RNA, 19 nt, Human
uauaaaaauaaaaaacacu

SEQ ID NO: 1789638 - RNA, 20 nt, Human
uauaaaagccuguuuaagag

SEQ ID NO: 1789639 - RNA, 20 nt, Human
acacauuuuauuuuauuaug

SEQ ID NO: 1789640 - RNA, 19 nt, Human
acacauuuuauuuuauuau

SEQ ID NO: 1789641 - RNA, 14 nt, Human
acacauuuuauuuu

SEQ ID NO: 1789642 - RNA, 21 nt, Human
acacaugagcaucaggccagg

SEQ ID NO: 1789643 - RNA, 18 nt, Human
acacaugauccugcaauu

SEQ ID NO: 1789644 - RNA, 22 nt, Human
acacucacauuuauucugcuca

SEQ ID NO: 1789645 - RNA, 20 nt, Human
acacucacauuuauucugcu

SEQ ID NO: 1789646 - RNA, 15 nt, Human
uauaaguguguguuu

SEQ ID NO: 1789647 - RNA, 15 nt, Human
acacucaaaagcugg

SEQ ID NO: 1789648 - RNA, 16 nt, Human
acaccgggcacucaga

SEQ ID NO: 1789649 - RNA, 14 nt, Human
acaccgggccugga

SEQ ID NO: 1789650 - RNA, 21 nt, Human
acaccucugcacaagcugcac

SEQ ID NO: 1789651 - RNA, 20 nt, Human
acacuaaccacgcuggaccu

SEQ ID NO: 1789652 - RNA, 21 nt, Human
acaccuuagccugcccuccuu

SEQ ID NO: 1789653 - RNA, 22 nt, Human
acaaggacagccccuccuccau

SEQ ID NO: 1789654 - RNA, 21 nt, Human
acaaggacagccccuccucca

SEQ ID NO: 1789655 - RNA, 18 nt, Human
acaaggacuaggguccug

SEQ ID NO: 1789656 - RNA, 19 nt, Human
acaaggacuaggguccugg

SEQ ID NO: 1789657 - RNA, 12 nt, Human
acaaugacuuac

SEQ ID NO: 1789658 - RNA, 19 nt, Human
acaaugacuuacuguacau

SEQ ID NO: 1789659 - RNA, 19 nt, Human
uagcuaauaacaugugaaa

SEQ ID NO: 1789660 - RNA, 18 nt, Human
acaaugacuuacuguaca

SEQ ID NO: 1789661 - RNA, 17 nt, Human
acaaugacuuacuguac

SEQ ID NO: 1789662 - RNA, 14 nt, Human
uaggcauuguggga

SEQ ID NO: 1789663 - RNA, 16 nt, Human
uaggcauuugcugaau

SEQ ID NO: 1789664 - RNA, 20 nt, Human
uaggcauuugcugaauacag

SEQ ID NO: 1789665 - RNA, 14 nt, Human
uaggacuguagaaa

SEQ ID NO: 1789666 - RNA, 13 nt, Human
uaggacuguagaa

SEQ ID NO: 1789667 - RNA, 21 nt, Human
uagcuuacaagccagcuggag

SEQ ID NO: 1789668 - RNA, 16 nt, Human
uaggaaauccagggug

SEQ ID NO: 1789669 - RNA, 19 nt, Human
uagcauggcugccaauggg

SEQ ID NO: 1789670 - RNA, 23 nt, Human
uagaugcugacuguacuccuccc

SEQ ID NO: 1789671 - RNA, 14 nt, Human
uagaugcugacugu

SEQ ID NO: 1789672 - RNA, 21 nt, Human
uagccaaggccaaaggaagca

SEQ ID NO: 1789673 - RNA, 22 nt, Human
uagcauuuugcuaaaugugaau

SEQ ID NO: 1789674 - RNA, 16 nt, Human
uagcauuuugcuaaau

SEQ ID NO: 1789675 - RNA, 18 nt, Human
acaaauuuacagagacag

SEQ ID NO: 1789676 - RNA, 19 nt, Human
acaaauuuacagagacaga

SEQ ID NO: 1789677 - RNA, 11 nt, Human
uagccagagga

SEQ ID NO: 1789678 - RNA, 15 nt, Human
uagccagaggagaga

SEQ ID NO: 1789679 - RNA, 23 nt, Human
acaacacucauugaccugaggcc

SEQ ID NO: 1789680 - RNA, 21 nt, Human
acaacacucauugaccugagg

SEQ ID NO: 1789681 - RNA, 19 nt, Human
acaagaccacguuucuaaa

SEQ ID NO: 1789682 - RNA, 19 nt, Human
acaagacccuugugguccc

SEQ ID NO: 1789683 - RNA, 20 nt, Human
acaagacccaaaaggcagaa

SEQ ID NO: 1789684 - RNA, 18 nt, Human
acaaaaggauaaugaaua

SEQ ID NO: 1789685 - RNA, 22 nt, Human
acaaaagcaugugagacugguu

SEQ ID NO: 1789686 - RNA, 11 nt, Human
acaaaagcaug

SEQ ID NO: 1789687 - RNA, 21 nt, Human
aauuguguuuauaauuuuaaa

SEQ ID NO: 1789688 - RNA, 20 nt, Human
aauuguguuuauaauuuuaa

SEQ ID NO: 1789689 - RNA, 16 nt, Human
aauuguuacaaauugu

SEQ ID NO: 1789690 - RNA, 22 nt, Human
acaaaggaugcccaaagaugca

SEQ ID NO: 1789691 - RNA, 19 nt, Human
uagaggagaaacuggaacu

SEQ ID NO: 1789692 - RNA, 15 nt, Human
uagauauaugcucug

SEQ ID NO: 1789693 - RNA, 22 nt, Human
uagaggagaaacuggaacucuc

SEQ ID NO: 1789694 - RNA, 19 nt, Human
uagauauaugcucugcaug

SEQ ID NO: 1789695 - RNA, 21 nt, Human
gugcauuuggugguuucagaa

SEQ ID NO: 1789696 - RNA, 23 nt, Human
gugccaaaaacaacaacaaaaug

SEQ ID NO: 1789697 - RNA, 19 nt, Human
gugcauuugaggucuguuc

SEQ ID NO: 1789698 - RNA, 17 nt, Human
gugcauuugaggucugu

SEQ ID NO: 1789699 - RNA, 21 nt, Human
gugcacaugcacgugugugca

SEQ ID NO: 1789700 - RNA, 23 nt, Human
gugcacaagcuccaagcucccag

SEQ ID NO: 1789701 - RNA, 22 nt, Human
gugcaaugaccuuucaauagga

SEQ ID NO: 1789702 - RNA, 18 nt, Human
gugcaaugaccuuucaau

SEQ ID NO: 1789703 - RNA, 13 nt, Human
gugcacaagcucc

SEQ ID NO: 1789704 - RNA, 16 nt, Human
gugcacaagcuccaag

SEQ ID NO: 1789705 - RNA, 21 nt, Human
gugcacaagcuccaagcuccc

SEQ ID NO: 1789706 - RNA, 23 nt, Human
gugaugguuccccuguucacucu

SEQ ID NO: 1789707 - RNA, 17 nt, Human
gugauuaccagggacug

SEQ ID NO: 1789708 - RNA, 16 nt, Human
gugauuaccagggacu

SEQ ID NO: 1789709 - RNA, 11 nt, Human
gugauuaccag

SEQ ID NO: 1789710 - RNA, 22 nt, Human
aacuucaccauauuaccacaga

SEQ ID NO: 1789711 - RNA, 22 nt, Human
aacuucacauauugauuuccgu

SEQ ID NO: 1789712 - RNA, 14 nt, Human
aacuucacauauug

SEQ ID NO: 1789713 - RNA, 18 nt, Human
aacugcccccucugcccu

SEQ ID NO: 1789714 - RNA, 19 nt, Human
aacugcccccucugcccug

SEQ ID NO: 1789715 - RNA, 20 nt, Human
aacugcccccucugcccugc

SEQ ID NO: 1789716 - RNA, 21 nt, Human
aacugcccccucugcccugcg

SEQ ID NO: 1789717 - RNA, 16 nt, Human
aacugcccccucugcc

SEQ ID NO: 1789718 - RNA, 17 nt, Human
aacugcccccucugccc

SEQ ID NO: 1789719 - RNA, 22 nt, Human
aacuucuccccugguagaaaga

SEQ ID NO: 1789720 - RNA, 13 nt, Human
aacuucagacaua

SEQ ID NO: 1789721 - RNA, 22 nt, Human
aagaaaauaguggugugauuug

SEQ ID NO: 1789722 - RNA, 21 nt, Human
aagaaaauaguggugugauuu

SEQ ID NO: 1789723 - RNA, 15 nt, Human
aagaaaauaguggug

SEQ ID NO: 1789724 - RNA, 19 nt, Human
aagaaagcccuuaggaaga

SEQ ID NO: 1789725 - RNA, 16 nt, Human
aagaaagaaaaucagg

SEQ ID NO: 1789726 - RNA, 14 nt, Human
aagaaagaaaauca

SEQ ID NO: 1789727 - RNA, 17 nt, Human
aagaaaaaugagccugg

SEQ ID NO: 1789728 - RNA, 18 nt, Human
aagaaaaaugagccuggc

SEQ ID NO: 1789729 - RNA, 19 nt, Human
aagaaaaaauauuuucccu

SEQ ID NO: 1789730 - RNA, 13 nt, Human
aagaaaaagaaaa

SEQ ID NO: 1789731 - RNA, 18 nt, Human
aagaaaaagaaaaagaaa

SEQ ID NO: 1789732 - RNA, 19 nt, Human
gugccagauuuaugcauau

SEQ ID NO: 1789733 - RNA, 23 nt, Human
aacuuuaccuuuuuuauacauaa

SEQ ID NO: 1789734 - RNA, 22 nt, Human
aacuuuaccuuuuuuauacaua

SEQ ID NO: 1789735 - RNA, 21 nt, Human
aacuuuaccuuuuuuauacau

SEQ ID NO: 1789736 - RNA, 17 nt, Human
gugcuaggaacacuccu

SEQ ID NO: 1789737 - RNA, 15 nt, Human
gugcuaucuccccca

SEQ ID NO: 1789738 - RNA, 18 nt, Human
gugcuaucucccccagcc

SEQ ID NO: 1789739 - RNA, 14 nt, Human
gugcucuggacagg

SEQ ID NO: 1789740 - RNA, 13 nt, Human
gugcucuggacag

SEQ ID NO: 1789741 - RNA, 16 nt, Human
gugcucugaucaucca

SEQ ID NO: 1789742 - RNA, 12 nt, Human
gugcugcccugc

SEQ ID NO: 1789743 - RNA, 13 nt, Human
gugcugcccugcc

SEQ ID NO: 1789744 - RNA, 14 nt, Human
gugcugcccugccc

SEQ ID NO: 1789745 - RNA, 15 nt, Human
gugcugcccugccca

SEQ ID NO: 1789746 - RNA, 19 nt, Human
gugcucaggagcccuggga

SEQ ID NO: 1789747 - RNA, 18 nt, Human
gugcucaggagcccuggg

SEQ ID NO: 1789748 - RNA, 19 nt, Human
gugcuaucucccccagccc

SEQ ID NO: 1789749 - RNA, 16 nt, Human
gugcucaggagcccug

SEQ ID NO: 1789750 - RNA, 12 nt, Human
aacuauggccug

SEQ ID NO: 1789751 - RNA, 15 nt, Human
aacuauguugauaaa

SEQ ID NO: 1789752 - RNA, 12 nt, Human
aacguggcugcu

SEQ ID NO: 1789753 - RNA, 13 nt, Human
aacguggcugcuu

SEQ ID NO: 1789754 - RNA, 17 nt, Human
aacguuuuuccuguucu

SEQ ID NO: 1789755 - RNA, 21 nt, Human
aacuaggugcauauuuauaaa

SEQ ID NO: 1789756 - RNA, 17 nt, Human
aacuagggaagauaaua

SEQ ID NO: 1789757 - RNA, 17 nt, Human
aacuaaaauaauuuugu

SEQ ID NO: 1789758 - RNA, 19 nt, Human
aacuaaaauaauuuuguaa

SEQ ID NO: 1789759 - RNA, 15 nt, Human
aacuaaaauaauuuu

SEQ ID NO: 1789760 - RNA, 23 nt, Human
aaccuggucacaggacucugccu

SEQ ID NO: 1789761 - RNA, 12 nt, Human
aacgugaaaaug

SEQ ID NO: 1789762 - RNA, 21 nt, Human
aaccuucgccaccuggguucc

SEQ ID NO: 1789763 - RNA, 20 nt, Human
gucuuguguuucuuuaguuu

SEQ ID NO: 1789764 - RNA, 22 nt, Human
gucuuguuuuuuuuuuccacuu

SEQ ID NO: 1789765 - RNA, 16 nt, Human
gucuggaaugcagugg

SEQ ID NO: 1789766 - RNA, 15 nt, Human
gucuggaaugcagug

SEQ ID NO: 1789767 - RNA, 18 nt, Human
gucuggaaugcaguggua

SEQ ID NO: 1789768 - RNA, 14 nt, Human
gucugacaggcaau

SEQ ID NO: 1789769 - RNA, 13 nt, Human
gucugacaggcaa

SEQ ID NO: 1789770 - RNA, 12 nt, Human
gucugacaggca

SEQ ID NO: 1789771 - RNA, 18 nt, Human
gucugacaggcaaugcug

SEQ ID NO: 1789772 - RNA, 15 nt, Human
gucugacaggcaaug

SEQ ID NO: 1789773 - RNA, 20 nt, Human
gucugacaggcaaugcuggc

SEQ ID NO: 1789774 - RNA, 14 nt, Human
gucucaaaaaaaca

SEQ ID NO: 1789775 - RNA, 17 nt, Human
gucucaaaaaaagaaaa

SEQ ID NO: 1789776 - RNA, 19 nt, Human
gucucaaaaaaagaaaaag

SEQ ID NO: 1789777 - RNA, 16 nt, Human
gugagacucugucuca

SEQ ID NO: 1789778 - RNA, 14 nt, Human
gugagacucugucu

SEQ ID NO: 1789779 - RNA, 16 nt, Human
gugagaccugccccuc

SEQ ID NO: 1789780 - RNA, 23 nt, Human
gugagaccugccccuccucucug

SEQ ID NO: 1789781 - RNA, 22 nt, Human
gugagacccugucucaaaaaaa

SEQ ID NO: 1789782 - RNA, 13 nt, Human
gugagaccugccc

SEQ ID NO: 1789783 - RNA, 14 nt, Human
gugagaccugcccc

SEQ ID NO: 1789784 - RNA, 15 nt, Human
gugagaccugccccu

SEQ ID NO: 1789785 - RNA, 22 nt, Human
gugacauguguuggcagccucu

SEQ ID NO: 1789786 - RNA, 19 nt, Human
gugacaugucuuuucuugc

SEQ ID NO: 1789787 - RNA, 16 nt, Human
gugacuucagcucugu

SEQ ID NO: 1789788 - RNA, 12 nt, Human
aacuccugaccu

SEQ ID NO: 1789789 - RNA, 14 nt, Human
aacuccugaccuca

SEQ ID NO: 1789790 - RNA, 19 nt, Human
gugaaguuuaauugacuua

SEQ ID NO: 1789791 - RNA, 23 nt, Human
gugaauaauacaguaucucaggg

SEQ ID NO: 1789792 - RNA, 22 nt, Human
gugacagagugagacucugucu

SEQ ID NO: 1789793 - RNA, 20 nt, Human
gugacagagugagacucugu

SEQ ID NO: 1789794 - RNA, 23 nt, Human
gugacagaggcagccccauucug

SEQ ID NO: 1789795 - RNA, 20 nt, Human
aacugauuuuuuuuuccuuc

SEQ ID NO: 1789796 - RNA, 21 nt, Human
aacugauuuuuuuuuccuuca

SEQ ID NO: 1789797 - RNA, 22 nt, Human
aacugauuuuuuuuuccuucag

SEQ ID NO: 1789798 - RNA, 23 nt, Human
aacugauuuuuuuuuccuucagu

SEQ ID NO: 1789799 - RNA, 16 nt, Human
aacugcauuggcuuug

SEQ ID NO: 1789800 - RNA, 16 nt, Human
aacucugacaacagac

SEQ ID NO: 1789801 - RNA, 22 nt, Human
aacucuccucugcugcuggcug

SEQ ID NO: 1789802 - RNA, 23 nt, Human
aacucuccucugcugcuggcugg

SEQ ID NO: 1789803 - RNA, 18 nt, Human
gugagacucugucucaaa

SEQ ID NO: 1789804 - RNA, 12 nt, Human
gugaggcucugc

SEQ ID NO: 1789805 - RNA, 13 nt, Human
gugaggcucugcc

SEQ ID NO: 1789806 - RNA, 14 nt, Human
gugaggcucugccc

SEQ ID NO: 1789807 - RNA, 15 nt, Human
gugaggcucugcccu

SEQ ID NO: 1789808 - RNA, 16 nt, Human
gugaggcucugcccuu

SEQ ID NO: 1789809 - RNA, 17 nt, Human
gugaggcucugcccuug

SEQ ID NO: 1789810 - RNA, 19 nt, Human
gugagucaccaagcccagu

SEQ ID NO: 1789811 - RNA, 19 nt, Human
aacucuccucugcugcugg

SEQ ID NO: 1789812 - RNA, 21 nt, Human
aacucuccucugcugcuggcu

SEQ ID NO: 1789813 - RNA, 17 nt, Human
gugagucaccaagccca

SEQ ID NO: 1789814 - RNA, 23 nt, Human
gugaguacuacaguccucccauc

SEQ ID NO: 1789815 - RNA, 18 nt, Human
gugaggcucugcccuugg

SEQ ID NO: 1789816 - RNA, 17 nt, Human
aaauuccaagugauuga

SEQ ID NO: 1789817 - RNA, 16 nt, Human
aaauuccccacccuga

SEQ ID NO: 1789818 - RNA, 17 nt, Human
aaauuguauuacaaauc

SEQ ID NO: 1789819 - RNA, 18 nt, Human
aaauugucagaugcugug

SEQ ID NO: 1789820 - RNA, 18 nt, Human
aaauuaggauuucaugau

SEQ ID NO: 1789821 - RNA, 19 nt, Human
aaauuaggauuucaugauu

SEQ ID NO: 1789822 - RNA, 23 nt, Human
aaauuaugugccagauuuaugca

SEQ ID NO: 1789823 - RNA, 15 nt, Human
aaauguggcuccugg

SEQ ID NO: 1789824 - RNA, 14 nt, Human
aaauuaaucugggc

SEQ ID NO: 1789825 - RNA, 21 nt, Human
aaaugucucuuuaaugucaca

SEQ ID NO: 1789826 - RNA, 14 nt, Human
aaaugucuuccugg

SEQ ID NO: 1789827 - RNA, 11 nt, Human
guauuuauuca

SEQ ID NO: 1789828 - RNA, 16 nt, Human
aaaucauucauuuucu

SEQ ID NO: 1789829 - RNA, 21 nt, Human
guauucucuccuguaccucuu

SEQ ID NO: 1789830 - RNA, 18 nt, Human
guauucucuccuguaccu

SEQ ID NO: 1789831 - RNA, 12 nt, Human
gucacaggcagg

SEQ ID NO: 1789832 - RNA, 19 nt, Human
gucacaggacucugccucc

SEQ ID NO: 1789833 - RNA, 16 nt, Human
gucacaggagggaggg

SEQ ID NO: 1789834 - RNA, 17 nt, Human
gucacaggacucugccu

SEQ ID NO: 1789835 - RNA, 18 nt, Human
gucacaggacucugccuc

SEQ ID NO: 1789836 - RNA, 20 nt, Human
gucacaggaaguagaggagg

SEQ ID NO: 1789837 - RNA, 22 nt, Human
gucaccaaaucagcugcuacua

SEQ ID NO: 1789838 - RNA, 21 nt, Human
gucaauuuuguuauguauauu

SEQ ID NO: 1789839 - RNA, 15 nt, Human
gucacaggaaguaga

SEQ ID NO: 1789840 - RNA, 13 nt, Human
gucacaggaagua

SEQ ID NO: 1789841 - RNA, 22 nt, Human
gucaauuacaggaaguacugga

SEQ ID NO: 1789842 - RNA, 23 nt, Human
gucacucuggcagcucagagagg

SEQ ID NO: 1789843 - RNA, 15 nt, Human
gucaccaagcccagu

SEQ ID NO: 1789844 - RNA, 12 nt, Human
gucaccaagccc

SEQ ID NO: 1789845 - RNA, 14 nt, Human
gucacugagacagc

SEQ ID NO: 1789846 - RNA, 15 nt, Human
gucacugagacagcc

SEQ ID NO: 1789847 - RNA, 16 nt, Human
gucacugagacagccc

SEQ ID NO: 1789848 - RNA, 20 nt, Human
gucacugcacagugcaucuc

SEQ ID NO: 1789849 - RNA, 23 nt, Human
gucacugcacagugcaucucagc

SEQ ID NO: 1789850 - RNA, 10 nt, Human
gucacugcuu

SEQ ID NO: 1789851 - RNA, 17 nt, Human
gucacugagacagcccg

SEQ ID NO: 1789852 - RNA, 18 nt, Human
gucacugagacagcccgg

SEQ ID NO: 1789853 - RNA, 21 nt, Human
gucacugagacagcccgggcu

SEQ ID NO: 1789854 - RNA, 23 nt, Human
gucacugagacagcccgggcucu

SEQ ID NO: 1789855 - RNA, 23 nt, Human
gucagaaguuucugccgcagccc

SEQ ID NO: 1789856 - RNA, 21 nt, Human
gucagaaguuucugccgcagc

SEQ ID NO: 1789857 - RNA, 17 nt, Human
gucacuuuguuuuacug

SEQ ID NO: 1789858 - RNA, 21 nt, Human
gucacugcuuaacuucacaua

SEQ ID NO: 1789859 - RNA, 15 nt, Human
gucacugcuuaacuu

SEQ ID NO: 1789860 - RNA, 22 nt, Human
gucagguggggcagcuugaggg

SEQ ID NO: 1789861 - RNA, 18 nt, Human
gucagguggggcagcuug

SEQ ID NO: 1789862 - RNA, 17 nt, Human
gucagguggggcagcuu

SEQ ID NO: 1789863 - RNA, 16 nt, Human
gucagguggggcagcu

SEQ ID NO: 1789864 - RNA, 15 nt, Human
gucagugugacugau

SEQ ID NO: 1789865 - RNA, 12 nt, Human
aaauuucuaaau

SEQ ID NO: 1789866 - RNA, 15 nt, Human
aaauuucuaaaucuc

SEQ ID NO: 1789867 - RNA, 13 nt, Human
aaauuucuaaauc

SEQ ID NO: 1789868 - RNA, 16 nt, Human
aacacuguucucugcc

SEQ ID NO: 1789869 - RNA, 17 nt, Human
aacacuguucucugccc

SEQ ID NO: 1789870 - RNA, 18 nt, Human
aacacuguucucugcccu

SEQ ID NO: 1789871 - RNA, 17 nt, Human
gucauuugagcagggcu

SEQ ID NO: 1789872 - RNA, 19 nt, Human
aacacuguucucugcccuc

SEQ ID NO: 1789873 - RNA, 21 nt, Human
aacacucacauuuauucugcu

SEQ ID NO: 1789874 - RNA, 21 nt, Human
aacacugggagaaaugaaaaa

SEQ ID NO: 1789875 - RNA, 17 nt, Human
aacacucauugaccuga

SEQ ID NO: 1789876 - RNA, 19 nt, Human
aacacaaacgggcucagca

SEQ ID NO: 1789877 - RNA, 17 nt, Human
aaauuucucuacugucu

SEQ ID NO: 1789878 - RNA, 19 nt, Human
aaauuucuaaaucuccaaa

SEQ ID NO: 1789879 - RNA, 23 nt, Human
guccaugaagauguagaggagaa

SEQ ID NO: 1789880 - RNA, 22 nt, Human
guccaugaagauguagaggaga

SEQ ID NO: 1789881 - RNA, 19 nt, Human
gucauuugagcagggcuca

SEQ ID NO: 1789882 - RNA, 15 nt, Human
gucccaccccacaca

SEQ ID NO: 1789883 - RNA, 22 nt, Human
guccccaccgcagacaggacca

SEQ ID NO: 1789884 - RNA, 20 nt, Human
gucccaccccacacacgcca

SEQ ID NO: 1789885 - RNA, 18 nt, Human
guccccaccgcagacagg

SEQ ID NO: 1789886 - RNA, 19 nt, Human
gucccugguggcagcucac

SEQ ID NO: 1789887 - RNA, 15 nt, Human
gucccuaauaaagcu

SEQ ID NO: 1789888 - RNA, 18 nt, Human
gucccugguggcagcuca

SEQ ID NO: 1789889 - RNA, 18 nt, Human
gucccuuacgugaguccu

SEQ ID NO: 1789890 - RNA, 19 nt, Human
gucccuuacgugaguccug

SEQ ID NO: 1789891 - RNA, 12 nt, Human
gucccuaauaaa

SEQ ID NO: 1789892 - RNA, 22 nt, Human
guccccuguuuguuucugaaag

SEQ ID NO: 1789893 - RNA, 18 nt, Human
guccccuguuuguuucug

SEQ ID NO: 1789894 - RNA, 14 nt, Human
aacauuguagccuc

SEQ ID NO: 1789895 - RNA, 17 nt, Human
aacaugugaaaagaaua

SEQ ID NO: 1789896 - RNA, 18 nt, Human
aacaguccauugaaaggg

SEQ ID NO: 1789897 - RNA, 22 nt, Human
gucuaugggacucaaugcacug

SEQ ID NO: 1789898 - RNA, 23 nt, Human
gucuaggcaggaccuguggccaa

SEQ ID NO: 1789899 - RNA, 12 nt, Human
gucgccucugca

SEQ ID NO: 1789900 - RNA, 14 nt, Human
gucuaccugagggg

SEQ ID NO: 1789901 - RNA, 13 nt, Human
gucuaccugaggg

SEQ ID NO: 1789902 - RNA, 15 nt, Human
gucuaccugaggggc

SEQ ID NO: 1789903 - RNA, 16 nt, Human
gucuaccugaggggcc

SEQ ID NO: 1789904 - RNA, 14 nt, Human
guccucuuuucuga

SEQ ID NO: 1789905 - RNA, 19 nt, Human
guccugcugcaguugccag

SEQ ID NO: 1789906 - RNA, 16 nt, Human
guccuggcaugggaau

SEQ ID NO: 1789907 - RNA, 12 nt, Human
gucgaggcagga

SEQ ID NO: 1789908 - RNA, 16 nt, Human
gucgaggacagggagg

SEQ ID NO: 1789909 - RNA, 22 nt, Human
uaaaaagcuccaaaugcagcuu

SEQ ID NO: 1789910 - RNA, 21 nt, Human
uaaaaaaaaaccugagcccca

SEQ ID NO: 1789911 - RNA, 22 nt, Human
uaaaaaugagguacucuccugg

SEQ ID NO: 1789912 - RNA, 15 nt, Human
uaaaaaugagguacu

SEQ ID NO: 1789913 - RNA, 23 nt, Human
uaaaaaucucaaauuucuaaauc

SEQ ID NO: 1789914 - RNA, 13 nt, Human
uaaaacccaagug

SEQ ID NO: 1789915 - RNA, 15 nt, Human
uaaaacuuuuuaaaa

SEQ ID NO: 1789916 - RNA, 12 nt, Human
uaaaacuuuuua

SEQ ID NO: 1789917 - RNA, 23 nt, Human
aagugauccucccaccucagccu

SEQ ID NO: 1789918 - RNA, 13 nt, Human
aagugauucucau

SEQ ID NO: 1789919 - RNA, 16 nt, Human
aagugauucucaugcc

SEQ ID NO: 1789920 - RNA, 19 nt, Human
aagugauucucaugccuca

SEQ ID NO: 1789921 - RNA, 21 nt, Human
aagugauucuccugccucagc

SEQ ID NO: 1789922 - RNA, 17 nt, Human
aagugauucucaugccu

SEQ ID NO: 1789923 - RNA, 20 nt, Human
aagugauccucccaccucag

SEQ ID NO: 1789924 - RNA, 19 nt, Human
aagugauccucccaccuca

SEQ ID NO: 1789925 - RNA, 13 nt, Human
aagugauccuccc

SEQ ID NO: 1789926 - RNA, 21 nt, Human
uaaaauaccagccaguaaaug

SEQ ID NO: 1789927 - RNA, 13 nt, Human
uaaaagucuugug

SEQ ID NO: 1789928 - RNA, 20 nt, Human
uaaaaguacauguuaaacuu

SEQ ID NO: 1789929 - RNA, 20 nt, Human
aaguuugagaucagccuggg

SEQ ID NO: 1789930 - RNA, 9 nt, Human
uaaaauggu

SEQ ID NO: 1789931 - RNA, 19 nt, Human
aaguuucugccgcagcccu

SEQ ID NO: 1789932 - RNA, 21 nt, Human
aaguuucugccgcagcccugc

SEQ ID NO: 1789933 - RNA, 14 nt, Human
aaguucccuacuuc

SEQ ID NO: 1789934 - RNA, 17 nt, Human
aaguucccuacuuccug

SEQ ID NO: 1789935 - RNA, 20 nt, Human
aaguucccuacuuccuguga

SEQ ID NO: 1789936 - RNA, 23 nt, Human
aaguguauuuuuuuacuaauaga

SEQ ID NO: 1789937 - RNA, 12 nt, Human
aaguguguguuu

SEQ ID NO: 1789938 - RNA, 13 nt, Human
aagugugguagag

SEQ ID NO: 1789939 - RNA, 14 nt, Human
aaguuacacauuuu

SEQ ID NO: 1789940 - RNA, 23 nt, Human
aaguuaagaauguucuuauguug

SEQ ID NO: 1789941 - RNA, 11 nt, Human
aaguuaagaau

SEQ ID NO: 1789942 - RNA, 16 nt, Human
aaguguguguuuuuca

SEQ ID NO: 1789943 - RNA, 21 nt, Human
aaguguguguuuuucauaaag

SEQ ID NO: 1789944 - RNA, 19 nt, Human
aaguuaguuccacugagac

SEQ ID NO: 1789945 - RNA, 18 nt, Human
aaguuaguuccacugaga

SEQ ID NO: 1789946 - RNA, 16 nt, Human
aaggcugggggaagaa

SEQ ID NO: 1789947 - RNA, 14 nt, Human
aaggcugggggaag

SEQ ID NO: 1789948 - RNA, 13 nt, Human
guuucagaaaugu

SEQ ID NO: 1789949 - RNA, 11 nt, Human
guuucagaaau

SEQ ID NO: 1789950 - RNA, 19 nt, Human
aaggcugggggaagaagcu

SEQ ID NO: 1789951 - RNA, 22 nt, Human
aaggcugggggaagaagcucuc

SEQ ID NO: 1789952 - RNA, 20 nt, Human
aaggcugucaauuacaggaa

SEQ ID NO: 1789953 - RNA, 13 nt, Human
aaggggagaguaa

SEQ ID NO: 1789954 - RNA, 12 nt, Human
aagggggcuggg

SEQ ID NO: 1789955 - RNA, 23 nt, Human
aagggggcugggacaugggaaag

SEQ ID NO: 1789956 - RNA, 23 nt, Human
aagguuucagaaagaagugggga

SEQ ID NO: 1789957 - RNA, 14 nt, Human
guuuaugauuccac

SEQ ID NO: 1789958 - RNA, 21 nt, Human
guuuaagugacugauggcuaa

SEQ ID NO: 1789959 - RNA, 17 nt, Human
aaggaaacccagcucug

SEQ ID NO: 1789960 - RNA, 22 nt, Human
aaggaaacccagcucuggucca

SEQ ID NO: 1789961 - RNA, 23 nt, Human
guuguuugauucagacagcugcc

SEQ ID NO: 1789962 - RNA, 22 nt, Human
aagucacugcacagugcaucuc

SEQ ID NO: 1789963 - RNA, 21 nt, Human
aaguauucuuauuuaaugaaa

SEQ ID NO: 1789964 - RNA, 19 nt, Human
aaguauuauaccuuuuuua

SEQ ID NO: 1789965 - RNA, 16 nt, Human
aaguauuauaccuuuu

SEQ ID NO: 1789966 - RNA, 15 nt, Human
aaguauuuuccuguu

SEQ ID NO: 1789967 - RNA, 23 nt, Human
aaguauucuuauuuaaugaaaga

SEQ ID NO: 1789968 - RNA, 20 nt, Human
aaguacuucuccacccugcu

SEQ ID NO: 1789969 - RNA, 19 nt, Human
aaguacuucuccacccugc

SEQ ID NO: 1789970 - RNA, 18 nt, Human
aaguacuucuccacccug

SEQ ID NO: 1789971 - RNA, 15 nt, Human
aaguauuauaccuuu

SEQ ID NO: 1789972 - RNA, 14 nt, Human
aaguacuauaauuu

SEQ ID NO: 1789973 - RNA, 17 nt, Human
aaguacuauaauuuacc

SEQ ID NO: 1789974 - RNA, 13 nt, Human
aaguacuauguau

SEQ ID NO: 1789975 - RNA, 22 nt, Human
guuuuaaggaugcuuguacaua

SEQ ID NO: 1789976 - RNA, 19 nt, Human
guuuucuguucuuucuggc

SEQ ID NO: 1789977 - RNA, 16 nt, Human
guuuucuguucuuucu

SEQ ID NO: 1789978 - RNA, 15 nt, Human
guuuucuguucuuuc

SEQ ID NO: 1789979 - RNA, 14 nt, Human
guuuucuguucuuu

SEQ ID NO: 1789980 - RNA, 20 nt, Human
aaguaauaugcacacauuuu

SEQ ID NO: 1789981 - RNA, 18 nt, Human
aaguaauaugcacacauu

SEQ ID NO: 1789982 - RNA, 17 nt, Human
aaguaauaugcacacau

SEQ ID NO: 1789983 - RNA, 21 nt, Human
aaguaauaugcacacauuuuu

SEQ ID NO: 1789984 - RNA, 20 nt, Human
guuugcuuuguaugcacuuu

SEQ ID NO: 1789985 - RNA, 13 nt, Human
guuuggagacaga

SEQ ID NO: 1789986 - RNA, 14 nt, Human
guucuugguuugua

SEQ ID NO: 1789987 - RNA, 18 nt, Human
guucuugguuuguaaauu

SEQ ID NO: 1789988 - RNA, 15 nt, Human
guucuugguuuguaa

SEQ ID NO: 1789989 - RNA, 14 nt, Human
guugauagcacaga

SEQ ID NO: 1789990 - RNA, 19 nt, Human
guugauagcacagacccug

SEQ ID NO: 1789991 - RNA, 16 nt, Human
guucuuaagacgugau

SEQ ID NO: 1789992 - RNA, 13 nt, Human
guucuuaauucuu

SEQ ID NO: 1789993 - RNA, 17 nt, Human
guucucugcccuccaag

SEQ ID NO: 1789994 - RNA, 18 nt, Human
guucucugcccuccaaga

SEQ ID NO: 1789995 - RNA, 17 nt, Human
guucuuaauucuuagcu

SEQ ID NO: 1789996 - RNA, 14 nt, Human
guucuuaauucuua

SEQ ID NO: 1789997 - RNA, 14 nt, Human
guucucugaggaca

SEQ ID NO: 1789998 - RNA, 15 nt, Human
guucucugcccucca

SEQ ID NO: 1789999 - RNA, 12 nt, Human
guucucugagga

SEQ ID NO: 1790000 - RNA, 15 nt, Human
guucucucuucucca

SEQ ID NO: 1790001 - RNA, 19 nt, Human
guucuagcauggcugccaa

SEQ ID NO: 1790002 - RNA, 17 nt, Human
aagcucugcuccucucc

SEQ ID NO: 1790003 - RNA, 18 nt, Human
guucccccuguuucagag

SEQ ID NO: 1790004 - RNA, 15 nt, Human
guuccccaagacauu

SEQ ID NO: 1790005 - RNA, 19 nt, Human
aagcuuuuaugugaaacau

SEQ ID NO: 1790006 - RNA, 21 nt, Human
aagcuuuuaugugaaacaugu

SEQ ID NO: 1790007 - RNA, 21 nt, Human
guucccuuuuuuggcugcuga

SEQ ID NO: 1790008 - RNA, 22 nt, Human
guucccuuuuuuggcugcugaa

SEQ ID NO: 1790009 - RNA, 20 nt, Human
guuauuauauuuacaaaugg

SEQ ID NO: 1790010 - RNA, 22 nt, Human
guuauugguguaagguacuuuc

SEQ ID NO: 1790011 - RNA, 19 nt, Human
guuauuauauuuacaaaug

SEQ ID NO: 1790012 - RNA, 19 nt, Human
guuagagguucccuuugac

SEQ ID NO: 1790013 - RNA, 13 nt, Human
aagcccagcuuga

SEQ ID NO: 1790014 - RNA, 23 nt, Human
guuacucuucaguuaagccuuug

SEQ ID NO: 1790015 - RNA, 19 nt, Human
guuaauauuuauaggucac

SEQ ID NO: 1790016 - RNA, 18 nt, Human
guuaaucauuagguguga

SEQ ID NO: 1790017 - RNA, 16 nt, Human
aagccucccacgacug

SEQ ID NO: 1790018 - RNA, 15 nt, Human
aagccuccuccagcc

SEQ ID NO: 1790019 - RNA, 15 nt, Human
aagccuguuuaagag

SEQ ID NO: 1790020 - RNA, 18 nt, Human
aagccuguuuaagagaca

SEQ ID NO: 1790021 - RNA, 23 nt, Human
guucagcuuguaaauagcucagg

SEQ ID NO: 1790022 - RNA, 18 nt, Human
guuauuuugauguaaaga

SEQ ID NO: 1790023 - RNA, 22 nt, Human
guucaggguuggccccugcccg

SEQ ID NO: 1790024 - RNA, 21 nt, Human
guucaggguuggccccugccc

SEQ ID NO: 1790025 - RNA, 20 nt, Human
guucaggguuggccccugcc

SEQ ID NO: 1790026 - RNA, 21 nt, Human
aagccgugauuuucauugcug

SEQ ID NO: 1790027 - RNA, 13 nt, Human
aagccguggcuuc

SEQ ID NO: 1790028 - RNA, 14 nt, Human
aagccguggcuucc

SEQ ID NO: 1790029 - RNA, 15 nt, Human
aagccguggcuuccc

SEQ ID NO: 1790030 - RNA, 18 nt, Human
guucagguaacaggcaga

SEQ ID NO: 1790031 - RNA, 17 nt, Human
guucagguaacaggcag

SEQ ID NO: 1790032 - RNA, 16 nt, Human
aagcacuaaacaaaga

SEQ ID NO: 1790033 - RNA, 17 nt, Human
aagcaccuccugccucg

SEQ ID NO: 1790034 - RNA, 16 nt, Human
aagcaccuccugccuc

SEQ ID NO: 1790035 - RNA, 15 nt, Human
aagcaccuccugccu

SEQ ID NO: 1790036 - RNA, 14 nt, Human
aagcaccuccugcc

SEQ ID NO: 1790037 - RNA, 13 nt, Human
aagcaccuccugc

SEQ ID NO: 1790038 - RNA, 21 nt, Human
aagcacaugccucucucaggc

SEQ ID NO: 1790039 - RNA, 16 nt, Human
guguuucuuuaguuuu

SEQ ID NO: 1790040 - RNA, 13 nt, Human
guguuucuuuagu

SEQ ID NO: 1790041 - RNA, 16 nt, Human
aagcacacuugacauc

SEQ ID NO: 1790042 - RNA, 14 nt, Human
aagcacaugccucu

SEQ ID NO: 1790043 - RNA, 15 nt, Human
aagcacaugccucuc

SEQ ID NO: 1790044 - RNA, 16 nt, Human
aagcacaugccucucu

SEQ ID NO: 1790045 - RNA, 19 nt, Human
aagcacaugccucucucag

SEQ ID NO: 1790046 - RNA, 20 nt, Human
aagcacaugccucucucagg

SEQ ID NO: 1790047 - RNA, 13 nt, Human
aagcauuuuguaa

SEQ ID NO: 1790048 - RNA, 12 nt, Human
aagcauuuugua

SEQ ID NO: 1790049 - RNA, 20 nt, Human
aagccaaagcuaggccuggc

SEQ ID NO: 1790050 - RNA, 18 nt, Human
aagccaaagcuaggccug

SEQ ID NO: 1790051 - RNA, 17 nt, Human
aagccaaagcuaggccu

SEQ ID NO: 1790052 - RNA, 23 nt, Human
aagcaugcacaaauucugucucu

SEQ ID NO: 1790053 - RNA, 12 nt, Human
aagcaugugaga

SEQ ID NO: 1790054 - RNA, 23 nt, Human
gugcugcccugcccaccuggccu

SEQ ID NO: 1790055 - RNA, 15 nt, Human
gugguuucagaaaug

SEQ ID NO: 1790056 - RNA, 21 nt, Human
aagagggagggagggcuccag

SEQ ID NO: 1790057 - RNA, 22 nt, Human
aagagggagggagggcuccaga

SEQ ID NO: 1790058 - RNA, 14 nt, Human
aagaggcagggucu

SEQ ID NO: 1790059 - RNA, 11 nt, Human
aagaggcaggg

SEQ ID NO: 1790060 - RNA, 18 nt, Human
guguaagaaauacagacu

SEQ ID NO: 1790061 - RNA, 20 nt, Human
aagcaaaugugaaucauuuu

SEQ ID NO: 1790062 - RNA, 17 nt, Human
aagcaacccaaauguuc

SEQ ID NO: 1790063 - RNA, 23 nt, Human
aagauggcacuuauaaccaaagc

SEQ ID NO: 1790064 - RNA, 16 nt, Human
aagauggcugugccuc

SEQ ID NO: 1790065 - RNA, 23 nt, Human
aagaucaaaagguuaauaaagua

SEQ ID NO: 1790066 - RNA, 20 nt, Human
aagaucaaaagguuaauaaa

SEQ ID NO: 1790067 - RNA, 19 nt, Human
gugucagguggggcagcuu

SEQ ID NO: 1790068 - RNA, 20 nt, Human
gugucagguggggcagcuug

SEQ ID NO: 1790069 - RNA, 23 nt, Human
gugugaaccaccacacccagccc

SEQ ID NO: 1790070 - RNA, 18 nt, Human
gugucagguggggcagcu

SEQ ID NO: 1790071 - RNA, 14 nt, Human
gugucagguggggc

SEQ ID NO: 1790072 - RNA, 22 nt, Human
gugucaccugaagacucauucu

SEQ ID NO: 1790073 - RNA, 14 nt, Human
gugucaccugaaga

SEQ ID NO: 1790074 - RNA, 21 nt, Human
gcccugugggcccccaaaugg

SEQ ID NO: 1790075 - RNA, 23 nt, Human
gcccuuaccugccaggaagccag

SEQ ID NO: 1790076 - RNA, 19 nt, Human
gcccuuagcagggaaacag

SEQ ID NO: 1790077 - RNA, 16 nt, Human
gcccugugggccccca

SEQ ID NO: 1790078 - RNA, 17 nt, Human
gcccugugggcccccaa

SEQ ID NO: 1790079 - RNA, 21 nt, Human
gcccuuaccugccaggaagcc

SEQ ID NO: 1790080 - RNA, 22 nt, Human
gcccuuaccugccaggaagcca

SEQ ID NO: 1790081 - RNA, 20 nt, Human
gcccugcgggucacaggagg

SEQ ID NO: 1790082 - RNA, 14 nt, Human
gcccugcccaccug

SEQ ID NO: 1790083 - RNA, 15 nt, Human
gcccugcccaccugg

SEQ ID NO: 1790084 - RNA, 16 nt, Human
gccuacaggagugagc

SEQ ID NO: 1790085 - RNA, 14 nt, Human
gcccuuccucucca

SEQ ID NO: 1790086 - RNA, 15 nt, Human
gcccuuccucuccac

SEQ ID NO: 1790087 - RNA, 22 nt, Human
gcccuuccaugucgccucugca

SEQ ID NO: 1790088 - RNA, 12 nt, Human
gcccuuccucuc

SEQ ID NO: 1790089 - RNA, 12 nt, Human
gcccuuccaugu

SEQ ID NO: 1790090 - RNA, 21 nt, Human
gcccuuccaugucgccucugc

SEQ ID NO: 1790091 - RNA, 21 nt, Human
gccccugcugguucaggguug

SEQ ID NO: 1790092 - RNA, 16 nt, Human
gccccuggcagccccu

SEQ ID NO: 1790093 - RNA, 17 nt, Human
gccccuggcagccccug

SEQ ID NO: 1790094 - RNA, 17 nt, Human
gccuacaggagugagca

SEQ ID NO: 1790095 - RNA, 19 nt, Human
gccuagcauacguacacau

SEQ ID NO: 1790096 - RNA, 12 nt, Human
gccuagcauacg

SEQ ID NO: 1790097 - RNA, 13 nt, Human
gccucgaacuggc

SEQ ID NO: 1790098 - RNA, 22 nt, Human
gccuccuuugugaggaagccgc

SEQ ID NO: 1790099 - RNA, 16 nt, Human
gccucgaacuggcugc

SEQ ID NO: 1790100 - RNA, 19 nt, Human
gccuccugaguagcuggga

SEQ ID NO: 1790101 - RNA, 18 nt, Human
gccuccugcccuuaccug

SEQ ID NO: 1790102 - RNA, 15 nt, Human
gccuccauccugagg

SEQ ID NO: 1790103 - RNA, 14 nt, Human
gccuccauccugag

SEQ ID NO: 1790104 - RNA, 13 nt, Human
gccuccauccuga

SEQ ID NO: 1790105 - RNA, 19 nt, Human
gccucaugcuaagacucag

SEQ ID NO: 1790106 - RNA, 19 nt, Human
gccucaugucaaauauuua

SEQ ID NO: 1790107 - RNA, 22 nt, Human
gccucauguccacugguucuuc

SEQ ID NO: 1790108 - RNA, 16 nt, Human
gccccugcugguucag

SEQ ID NO: 1790109 - RNA, 15 nt, Human
gccccugcugguuca

SEQ ID NO: 1790110 - RNA, 12 nt, Human
gccccuggcagc

SEQ ID NO: 1790111 - RNA, 15 nt, Human
gccccuggcagcccc

SEQ ID NO: 1790112 - RNA, 12 nt, Human
gccccugcuggu

SEQ ID NO: 1790113 - RNA, 17 nt, Human
gcccccucugcccugcg

SEQ ID NO: 1790114 - RNA, 15 nt, Human
gcccccucugcccug

SEQ ID NO: 1790115 - RNA, 16 nt, Human
gcccccucugcccugc

SEQ ID NO: 1790116 - RNA, 21 nt, Human
gccccaaaacucuccucugcu

SEQ ID NO: 1790117 - RNA, 11 nt, Human
gccccaaaagg

SEQ ID NO: 1790118 - RNA, 20 nt, Human
gccccaaaacucuccucugc

SEQ ID NO: 1790119 - RNA, 18 nt, Human
gcauuuacuuuguguuca

SEQ ID NO: 1790120 - RNA, 19 nt, Human
gcauuuaggccaugggaca

SEQ ID NO: 1790121 - RNA, 17 nt, Human
gccauugacuucuuccc

SEQ ID NO: 1790122 - RNA, 15 nt, Human
gcccacgcccccacu

SEQ ID NO: 1790123 - RNA, 16 nt, Human
gcccacgcccccacug

SEQ ID NO: 1790124 - RNA, 17 nt, Human
gcccacgcccccacugg

SEQ ID NO: 1790125 - RNA, 21 nt, Human
gcccacgcccccacuggugac

SEQ ID NO: 1790126 - RNA, 13 nt, Human
gcccacuucugcc

SEQ ID NO: 1790127 - RNA, 24 nt, Human
gcccaggaaaggcuccaggagcag

SEQ ID NO: 1790128 - RNA, 22 nt, Human
gcccaggaaaggcuccaggagc

SEQ ID NO: 1790129 - RNA, 23 nt, Human
gcccaggaaaggcuccaggagca

SEQ ID NO: 1790130 - RNA, 21 nt, Human
gcccacgcuggagugcaguga

SEQ ID NO: 1790131 - RNA, 19 nt, Human
gcccacgcuggagugcagu

SEQ ID NO: 1790132 - RNA, 23 nt, Human
gcccacgcuggagugcagugagc

SEQ ID NO: 1790133 - RNA, 15 nt, Human
gcccacuguacuugc

SEQ ID NO: 1790134 - RNA, 20 nt, Human
gcccacuguacuugcucuug

SEQ ID NO: 1790135 - RNA, 22 nt, Human
gcccacuguacuugcucuugau

SEQ ID NO: 1790136 - RNA, 22 nt, Human
gcccaggccccugccacccugg

SEQ ID NO: 1790137 - RNA, 21 nt, Human
gcccaggccccugccacccug

SEQ ID NO: 1790138 - RNA, 20 nt, Human
gcccaggccccugccacccu

SEQ ID NO: 1790139 - RNA, 12 nt, Human
gcccaggccccu

SEQ ID NO: 1790140 - RNA, 11 nt, Human
gcccaggcccc

SEQ ID NO: 1790141 - RNA, 11 nt, Human
gcccaggcagg

SEQ ID NO: 1790142 - RNA, 12 nt, Human
gcccaggcaggu

SEQ ID NO: 1790143 - RNA, 23 nt, Human
gccugggaucccucauccucaua

SEQ ID NO: 1790144 - RNA, 11 nt, Human
gccugggcaga

SEQ ID NO: 1790145 - RNA, 19 nt, Human
gccugugccucugggacug

SEQ ID NO: 1790146 - RNA, 17 nt, Human
gccuguucagcuccagc

SEQ ID NO: 1790147 - RNA, 16 nt, Human
gccuguucagcuccag

SEQ ID NO: 1790148 - RNA, 15 nt, Human
gccuguucagcucca

SEQ ID NO: 1790149 - RNA, 16 nt, Human
gccuucucugaaggac

SEQ ID NO: 1790150 - RNA, 15 nt, Human
gccuucucugaagga

SEQ ID NO: 1790151 - RNA, 14 nt, Human
gccuugaacuuuga

SEQ ID NO: 1790152 - RNA, 22 nt, Human
gcgauucuucugcuucagccuc

SEQ ID NO: 1790153 - RNA, 23 nt, Human
gccuugaccauucuccaccugcc

SEQ ID NO: 1790154 - RNA, 23 nt, Human
gccuugaacuuugaccucugcag

SEQ ID NO: 1790155 - RNA, 16 nt, Human
gccuugaccauucucc

SEQ ID NO: 1790156 - RNA, 22 nt, Human
gccuugaccauucuccaccugc

SEQ ID NO: 1790157 - RNA, 23 nt, Human
gcgauucuucugcuucagccucc

SEQ ID NO: 1790158 - RNA, 14 nt, Human
gcgcaggcuggccc

SEQ ID NO: 1790159 - RNA, 21 nt, Human
gcgcagcauauucaggaagcu

SEQ ID NO: 1790160 - RNA, 15 nt, Human
gcgcaggcuggcccu

SEQ ID NO: 1790161 - RNA, 16 nt, Human
gcgcaggcuggcccug

SEQ ID NO: 1790162 - RNA, 15 nt, Human
gcggcuggcagccca

SEQ ID NO: 1790163 - RNA, 16 nt, Human
gcggccuuuggcuuca

SEQ ID NO: 1790164 - RNA, 22 nt, Human
gcuaagugauccucccaccuca

SEQ ID NO: 1790165 - RNA, 18 nt, Human
gcuaagugauccucccac

SEQ ID NO: 1790166 - RNA, 16 nt, Human
gcuaguugggcuuccu

SEQ ID NO: 1790167 - RNA, 14 nt, Human
gcuaguugggcuuc

SEQ ID NO: 1790168 - RNA, 18 nt, Human
gcuauucaguaauaacuc

SEQ ID NO: 1790169 - RNA, 20 nt, Human
gcuaggaccccuccaugugg

SEQ ID NO: 1790170 - RNA, 22 nt, Human
gcuaggaccccuccaugugggc

SEQ ID NO: 1790171 - RNA, 21 nt, Human
gcuaggaauuguguuuauaau

SEQ ID NO: 1790172 - RNA, 16 nt, Human
gcucagagcaguguuu

SEQ ID NO: 1790173 - RNA, 22 nt, Human
gcucaggagcccugggaggcuc

SEQ ID NO: 1790174 - RNA, 23 nt, Human
gcucaggagcccugggaggcucu

SEQ ID NO: 1790175 - RNA, 13 nt, Human
gcucaggaguuug

SEQ ID NO: 1790176 - RNA, 18 nt, Human
gcucagggccuggcucag

SEQ ID NO: 1790177 - RNA, 19 nt, Human
gcucagggccuggcucagg

SEQ ID NO: 1790178 - RNA, 20 nt, Human
gcucagggccuggcucaggu

SEQ ID NO: 1790179 - RNA, 18 nt, Human
ggaagccgcuggggccag

SEQ ID NO: 1790180 - RNA, 22 nt, Human
ggaagccagcaggcucucaggc

SEQ ID NO: 1790181 - RNA, 23 nt, Human
ggaagccagcaggcucucaggcc

SEQ ID NO: 1790182 - RNA, 21 nt, Human
ggaagccagcaggcucucagg

SEQ ID NO: 1790183 - RNA, 16 nt, Human
ggaaauccaggguggu

SEQ ID NO: 1790184 - RNA, 23 nt, Human
ggaaaucaccgaaaacguggcug

SEQ ID NO: 1790185 - RNA, 16 nt, Human
ggaauauauaaccagu

SEQ ID NO: 1790186 - RNA, 16 nt, Human
ggaauaccuguccccc

SEQ ID NO: 1790187 - RNA, 19 nt, Human
ggaauaccugucccccuga

SEQ ID NO: 1790188 - RNA, 22 nt, Human
ggaagcucagggccuggcucag

SEQ ID NO: 1790189 - RNA, 21 nt, Human
ggaagcucagggccuggcuca

SEQ ID NO: 1790190 - RNA, 15 nt, Human
ggaauaccugucccc

SEQ ID NO: 1790191 - RNA, 16 nt, Human
ggaagcucagggccug

SEQ ID NO: 1790192 - RNA, 17 nt, Human
ggaagcucagggccugg

SEQ ID NO: 1790193 - RNA, 12 nt, Human
ggacacagcucu

SEQ ID NO: 1790194 - RNA, 14 nt, Human
ggaaugauuaauua

SEQ ID NO: 1790195 - RNA, 19 nt, Human
ggaaugaaugucaguguga

SEQ ID NO: 1790196 - RNA, 13 nt, Human
ggacacagcucuu

SEQ ID NO: 1790197 - RNA, 14 nt, Human
ggacacagcucuuc

SEQ ID NO: 1790198 - RNA, 12 nt, Human
ggacacccugug

SEQ ID NO: 1790199 - RNA, 17 nt, Human
ggacagggaggugaccc

SEQ ID NO: 1790200 - RNA, 13 nt, Human
ggacacccuguga

SEQ ID NO: 1790201 - RNA, 23 nt, Human
ggacacccugugauggggcccug

SEQ ID NO: 1790202 - RNA, 22 nt, Human
ggacagggcauggccagguggc

SEQ ID NO: 1790203 - RNA, 15 nt, Human
ggacagggcauggcc

SEQ ID NO: 1790204 - RNA, 13 nt, Human
ggacauggacaag

SEQ ID NO: 1790205 - RNA, 14 nt, Human
ggacauggacaagg

SEQ ID NO: 1790206 - RNA, 16 nt, Human
gcuuaacuucacauau

SEQ ID NO: 1790207 - RNA, 16 nt, Human
gcuucuucagagacuc

SEQ ID NO: 1790208 - RNA, 17 nt, Human
gcuuaacuucacauauu

SEQ ID NO: 1790209 - RNA, 19 nt, Human
gcuucuucagagacuccug

SEQ ID NO: 1790210 - RNA, 21 nt, Human
gcuucuucagagacuccugca

SEQ ID NO: 1790211 - RNA, 23 nt, Human
gcuucuucagagacuccugcagg

SEQ ID NO: 1790212 - RNA, 17 nt, Human
gcuugaccgugaggcca

SEQ ID NO: 1790213 - RNA, 18 nt, Human
gcuugaccgugaggccag

SEQ ID NO: 1790214 - RNA, 19 nt, Human
gcuugaccgugaggccaga

SEQ ID NO: 1790215 - RNA, 23 nt, Human
gcuugggcuucauccuccucaga

SEQ ID NO: 1790216 - RNA, 16 nt, Human
gcuuggggaccagagc

SEQ ID NO: 1790217 - RNA, 23 nt, Human
gcuuucuacccagcgagcccugg

SEQ ID NO: 1790218 - RNA, 22 nt, Human
gcuuucuacccagcgagcccug

SEQ ID NO: 1790219 - RNA, 19 nt, Human
gcuuucuacccagcgagcc

SEQ ID NO: 1790220 - RNA, 13 nt, Human
gcuuucuacccag

SEQ ID NO: 1790221 - RNA, 22 nt, Human
gcuuggggaccagagcugccac

SEQ ID NO: 1790222 - RNA, 17 nt, Human
gcuuggggaccagagcu

SEQ ID NO: 1790223 - RNA, 18 nt, Human
gcuuggggaccagagcug

SEQ ID NO: 1790224 - RNA, 20 nt, Human
gcuuggggaccagagcugcc

SEQ ID NO: 1790225 - RNA, 21 nt, Human
gcuuggggaccagagcugcca

SEQ ID NO: 1790226 - RNA, 14 nt, Human
gcuuuggaaguuuu

SEQ ID NO: 1790227 - RNA, 16 nt, Human
ggaaaaaauaacaaug

SEQ ID NO: 1790228 - RNA, 19 nt, Human
gcuuuugugcauuaucuag

SEQ ID NO: 1790229 - RNA, 13 nt, Human
gcuuuugugcauu

SEQ ID NO: 1790230 - RNA, 15 nt, Human
gcuuuuuaauauuga

SEQ ID NO: 1790231 - RNA, 20 nt, Human
ggaaacagcuaaugggacac

SEQ ID NO: 1790232 - RNA, 15 nt, Human
ggaaacccagcucug

SEQ ID NO: 1790233 - RNA, 21 nt, Human
ggaaacuaggugcauauuuau

SEQ ID NO: 1790234 - RNA, 19 nt, Human
ggaaagcaaaggagauugg

SEQ ID NO: 1790235 - RNA, 16 nt, Human
ggaaagaguaggaaga

SEQ ID NO: 1790236 - RNA, 17 nt, Human
ggaaagaguaggaagac

SEQ ID NO: 1790237 - RNA, 20 nt, Human
ggaaagacuuuuccaacccu

SEQ ID NO: 1790238 - RNA, 14 nt, Human
ggaaagaggcucug

SEQ ID NO: 1790239 - RNA, 20 nt, Human
gcuuuucccuuuuuuuaagu

SEQ ID NO: 1790240 - RNA, 21 nt, Human
gcuuuucccuuuuuuuaagua

SEQ ID NO: 1790241 - RNA, 13 nt, Human
gcugccucaugcu

SEQ ID NO: 1790242 - RNA, 16 nt, Human
gcugccucucccauca

SEQ ID NO: 1790243 - RNA, 20 nt, Human
gcugccugggaucccucauc

SEQ ID NO: 1790244 - RNA, 13 nt, Human
gcugccuguucag

SEQ ID NO: 1790245 - RNA, 12 nt, Human
gcugccuguuca

SEQ ID NO: 1790246 - RNA, 17 nt, Human
gcugccuguucagcucc

SEQ ID NO: 1790247 - RNA, 23 nt, Human
gcugcucuugaacuccugaccuc

SEQ ID NO: 1790248 - RNA, 21 nt, Human
gcugccugggaucccucaucc

SEQ ID NO: 1790249 - RNA, 20 nt, Human
gcugccccuggcagccccug

SEQ ID NO: 1790250 - RNA, 18 nt, Human
gcugccccuggcagcccc

SEQ ID NO: 1790251 - RNA, 19 nt, Human
gcugccccuggcagccccu

SEQ ID NO: 1790252 - RNA, 18 nt, Human
gcugcacccucaggcagg

SEQ ID NO: 1790253 - RNA, 19 nt, Human
gcugcacccucaggcaggu

SEQ ID NO: 1790254 - RNA, 13 nt, Human
gcugcaccggcug

SEQ ID NO: 1790255 - RNA, 14 nt, Human
gcugcaccggcugg

SEQ ID NO: 1790256 - RNA, 23 nt, Human
gcugagggugagugggugaauaa

SEQ ID NO: 1790257 - RNA, 14 nt, Human
gcugaggugggagg

SEQ ID NO: 1790258 - RNA, 16 nt, Human
gcugagaggagagaga

SEQ ID NO: 1790259 - RNA, 15 nt, Human
gcugaggugggagga

SEQ ID NO: 1790260 - RNA, 23 nt, Human
gcuggcuguuggcugggggccuc

SEQ ID NO: 1790261 - RNA, 20 nt, Human
gcuggcuguuggcugggggc

SEQ ID NO: 1790262 - RNA, 12 nt, Human
gcugggccccug

SEQ ID NO: 1790263 - RNA, 13 nt, Human
gcugggccccugc

SEQ ID NO: 1790264 - RNA, 14 nt, Human
gcugggccccugcc

SEQ ID NO: 1790265 - RNA, 18 nt, Human
gcugggccccugccucuc

SEQ ID NO: 1790266 - RNA, 20 nt, Human
gcugggccccugccucucug

SEQ ID NO: 1790267 - RNA, 17 nt, Human
gcugggguggggaccuc

SEQ ID NO: 1790268 - RNA, 19 nt, Human
gcugggguggggaccucag

SEQ ID NO: 1790269 - RNA, 22 nt, Human
gcugggguggggaccucaggcc

SEQ ID NO: 1790270 - RNA, 23 nt, Human
gcugggguggggaccucaggccu

SEQ ID NO: 1790271 - RNA, 18 nt, Human
gcuggguucuacccaggu

SEQ ID NO: 1790272 - RNA, 17 nt, Human
gcuggguucuacccagg

SEQ ID NO: 1790273 - RNA, 20 nt, Human
gcuggguucuacccaggugc

SEQ ID NO: 1790274 - RNA, 21 nt, Human
gcuggguucuacccaggugcu

SEQ ID NO: 1790275 - RNA, 14 nt, Human
gcuggcgugcagug

SEQ ID NO: 1790276 - RNA, 19 nt, Human
gcuggcuguuggcuggggg

SEQ ID NO: 1790277 - RNA, 18 nt, Human
gcuggcuguuggcugggg

SEQ ID NO: 1790278 - RNA, 14 nt, Human
gcuggcugccuuag

SEQ ID NO: 1790279 - RNA, 20 nt, Human
gcuggcugccuuagaaccuu

SEQ ID NO: 1790280 - RNA, 11 nt, Human
gcuggcugccu

SEQ ID NO: 1790281 - RNA, 18 nt, Human
gcuggcgugcaguggugc

SEQ ID NO: 1790282 - RNA, 15 nt, Human
gcuggcgugcagugg

SEQ ID NO: 1790283 - RNA, 12 nt, Human
gcugcugaaggc

SEQ ID NO: 1790284 - RNA, 20 nt, Human
gcuguuggcugggggccuca

SEQ ID NO: 1790285 - RNA, 16 nt, Human
gcuguuggcugggggc

SEQ ID NO: 1790286 - RNA, 15 nt, Human
gcuguuggcuggggg

SEQ ID NO: 1790287 - RNA, 17 nt, Human
gcugugcugcccugccc

SEQ ID NO: 1790288 - RNA, 15 nt, Human
gcugugcugcccugc

SEQ ID NO: 1790289 - RNA, 16 nt, Human
gcugugcugcccugcc

SEQ ID NO: 1790290 - RNA, 13 nt, Human
gcugugcucugga

SEQ ID NO: 1790291 - RNA, 14 nt, Human
gcugugccucugcc

SEQ ID NO: 1790292 - RNA, 15 nt, Human
gcugugccucugccu

SEQ ID NO: 1790293 - RNA, 16 nt, Human
gcugugccucugccug

SEQ ID NO: 1790294 - RNA, 16 nt, Human
gcugugcucuggacag

SEQ ID NO: 1790295 - RNA, 15 nt, Human
gcugugcucuggaca

SEQ ID NO: 1790296 - RNA, 18 nt, Human
gcugugcucuggacaggc

SEQ ID NO: 1790297 - RNA, 14 nt, Human
gcugugcugcccug

SEQ ID NO: 1790298 - RNA, 19 nt, Human
gcuguaucccaugagccuc

SEQ ID NO: 1790299 - RNA, 17 nt, Human
gcuguaucccaugagcc

SEQ ID NO: 1790300 - RNA, 15 nt, Human
aaagcagcguuucua

SEQ ID NO: 1790301 - RNA, 16 nt, Human
aaagcuaggccuggcc

SEQ ID NO: 1790302 - RNA, 14 nt, Human
aaagcuaggccugg

SEQ ID NO: 1790303 - RNA, 13 nt, Human
aaagcagugcaug

SEQ ID NO: 1790304 - RNA, 14 nt, Human
aaagcuagaaauga

SEQ ID NO: 1790305 - RNA, 16 nt, Human
aaagcagugcaugcug

SEQ ID NO: 1790306 - RNA, 17 nt, Human
aaagcuaggccuggcca

SEQ ID NO: 1790307 - RNA, 12 nt, Human
aaagcugccagc

SEQ ID NO: 1790308 - RNA, 13 nt, Human
aaagcugccagcc

SEQ ID NO: 1790309 - RNA, 22 nt, Human
aaagcugccagccgagauagcc

SEQ ID NO: 1790310 - RNA, 14 nt, Human
aaagcuguguggca

SEQ ID NO: 1790311 - RNA, 14 nt, Human
gguggcaccagcag

SEQ ID NO: 1790312 - RNA, 20 nt, Human
gguggcaccagcagccugga

SEQ ID NO: 1790313 - RNA, 16 nt, Human
aaagcagaacagugau

SEQ ID NO: 1790314 - RNA, 19 nt, Human
aaacuuuaugcuaagugaa

SEQ ID NO: 1790315 - RNA, 12 nt, Human
aaacuuuaugcu

SEQ ID NO: 1790316 - RNA, 20 nt, Human
aaagggcccagagagggugg

SEQ ID NO: 1790317 - RNA, 18 nt, Human
aaagguucaugcaaacuu

SEQ ID NO: 1790318 - RNA, 12 nt, Human
gguggcuggguu

SEQ ID NO: 1790319 - RNA, 18 nt, Human
gguggcuggguuggaggg

SEQ ID NO: 1790320 - RNA, 21 nt, Human
aaaguaaaaacaaagaaauua

SEQ ID NO: 1790321 - RNA, 19 nt, Human
gguggggaccucaggccug

SEQ ID NO: 1790322 - RNA, 13 nt, Human
ggugggacacccu

SEQ ID NO: 1790323 - RNA, 16 nt, Human
ggugggacacccugug

SEQ ID NO: 1790324 - RNA, 17 nt, Human
ggugggacacccuguga

SEQ ID NO: 1790325 - RNA, 20 nt, Human
ggugggaggaucucuugagc

SEQ ID NO: 1790326 - RNA, 22 nt, Human
gguucccuuuuuuggcugcuga

SEQ ID NO: 1790327 - RNA, 23 nt, Human
gguucccuuugacgccaucccag

SEQ ID NO: 1790328 - RNA, 17 nt, Human
gguucccauuugcuccu

SEQ ID NO: 1790329 - RNA, 19 nt, Human
gguguuuccuggcacugcu

SEQ ID NO: 1790330 - RNA, 17 nt, Human
gguguuuccuggcacug

SEQ ID NO: 1790331 - RNA, 11 nt, Human
gguguggggga

SEQ ID NO: 1790332 - RNA, 13 nt, Human
ggugugggggaag

SEQ ID NO: 1790333 - RNA, 13 nt, Human
ggugggggccucg

SEQ ID NO: 1790334 - RNA, 14 nt, Human
gguguggagaagcg

SEQ ID NO: 1790335 - RNA, 23 nt, Human
gguguggagaagcggcuggcagc

SEQ ID NO: 1790336 - RNA, 12 nt, Human
gguguggagaag

SEQ ID NO: 1790337 - RNA, 20 nt, Human
gguuuguaaauuaacuuuua

SEQ ID NO: 1790338 - RNA, 22 nt, Human
gguuucuaaagcugccagccga

SEQ ID NO: 1790339 - RNA, 16 nt, Human
gguuuccugcccuggg

SEQ ID NO: 1790340 - RNA, 19 nt, Human
gguuuccugcccugggagg

SEQ ID NO: 1790341 - RNA, 16 nt, Human
gguuucuaaagcugcc

SEQ ID NO: 1790342 - RNA, 12 nt, Human
gguuuccugccc

SEQ ID NO: 1790343 - RNA, 13 nt, Human
gguuuccugcccu

SEQ ID NO: 1790344 - RNA, 15 nt, Human
gguuuccugcccugg

SEQ ID NO: 1790345 - RNA, 21 nt, Human
aaaguaucccuacuguaauuu

SEQ ID NO: 1790346 - RNA, 20 nt, Human
aaaguagaagucuuagaugu

SEQ ID NO: 1790347 - RNA, 22 nt, Human
aaaguagaagucuuagauguau

SEQ ID NO: 1790348 - RNA, 18 nt, Human
aaaguacacuguuucaaa

SEQ ID NO: 1790349 - RNA, 19 nt, Human
aaaguacacuguuucaaac

SEQ ID NO: 1790350 - RNA, 20 nt, Human
aaagugguauagaaaugcug

SEQ ID NO: 1790351 - RNA, 17 nt, Human
aaagugguauagaaaug

SEQ ID NO: 1790352 - RNA, 16 nt, Human
aaagugguauagaaau

SEQ ID NO: 1790353 - RNA, 21 nt, Human
aaaguguauuuuuuuacuaau

SEQ ID NO: 1790354 - RNA, 14 nt, Human
aaaguguauuuuuu

SEQ ID NO: 1790355 - RNA, 21 nt, Human
aaaguauccugcuucugauau

SEQ ID NO: 1790356 - RNA, 16 nt, Human
guacacacacauacac

SEQ ID NO: 1790357 - RNA, 19 nt, Human
aaauaccagccaguaaaug

SEQ ID NO: 1790358 - RNA, 21 nt, Human
aaauaccagccaguaaauggg

SEQ ID NO: 1790359 - RNA, 20 nt, Human
aaauaccagccaguaaaugg

SEQ ID NO: 1790360 - RNA, 15 nt, Human
aaauauaggaacuua

SEQ ID NO: 1790361 - RNA, 18 nt, Human
aaauauaugcuaagucuu

SEQ ID NO: 1790362 - RNA, 14 nt, Human
aaauauauaucaaa

SEQ ID NO: 1790363 - RNA, 16 nt, Human
aaauauauuuuaagac

SEQ ID NO: 1790364 - RNA, 22 nt, Human
aaauauauuuuaagacgaaaca

SEQ ID NO: 1790365 - RNA, 20 nt, Human
aaauauuccugcauuuguga

SEQ ID NO: 1790366 - RNA, 19 nt, Human
aaauauuaagaaagacuau

SEQ ID NO: 1790367 - RNA, 19 nt, Human
aaaucagccugcuccagcu

SEQ ID NO: 1790368 - RNA, 21 nt, Human
aaaucagccugcuccagcugu

SEQ ID NO: 1790369 - RNA, 23 nt, Human
aaaucagccugcuccagcuguuc

SEQ ID NO: 1790370 - RNA, 19 nt, Human
aaauauggucuuuugguua

SEQ ID NO: 1790371 - RNA, 12 nt, Human
aaauaucugaaa

SEQ ID NO: 1790372 - RNA, 14 nt, Human
aaauaucugaaaau

SEQ ID NO: 1790373 - RNA, 17 nt, Human
aaauaucugaaaaugua

SEQ ID NO: 1790374 - RNA, 18 nt, Human
aaauaucugaaaauguau

SEQ ID NO: 1790375 - RNA, 19 nt, Human
aaauaucugaaaauguaug

SEQ ID NO: 1790376 - RNA, 21 nt, Human
aaauaucugaaaauguaugug

SEQ ID NO: 1790377 - RNA, 22 nt, Human
aaauaucugaaaauguaugugu

SEQ ID NO: 1790378 - RNA, 23 nt, Human
aaauaucugaaaauguaugugua

SEQ ID NO: 1790379 - RNA, 22 nt, Human
guaacuaaaauaauuuuguaau

SEQ ID NO: 1790380 - RNA, 20 nt, Human
guaacuaaaauaauuuugua

SEQ ID NO: 1790381 - RNA, 15 nt, Human
guaacuaaaauaauu

SEQ ID NO: 1790382 - RNA, 13 nt, Human
guaacuaaaauaa

SEQ ID NO: 1790383 - RNA, 16 nt, Human
guaauaauaaagaaua

SEQ ID NO: 1790384 - RNA, 12 nt, Human
guaauaauaaag

SEQ ID NO: 1790385 - RNA, 22 nt, Human
guacaaccuguucugcuuuccu

SEQ ID NO: 1790386 - RNA, 21 nt, Human
guaauuuuuuuaucgucacug

SEQ ID NO: 1790387 - RNA, 22 nt, Human
guaauuugugauacaaugcugu

SEQ ID NO: 1790388 - RNA, 20 nt, Human
guaauuugugauacaaugcu

SEQ ID NO: 1790389 - RNA, 17 nt, Human
guaauuugugauacaau

SEQ ID NO: 1790390 - RNA, 17 nt, Human
guaaucgaccugccucg

SEQ ID NO: 1790391 - RNA, 15 nt, Human
guaauuugugauaca

SEQ ID NO: 1790392 - RNA, 23 nt, Human
guaauccuagcacuuugggaggc

SEQ ID NO: 1790393 - RNA, 15 nt, Human
guaaucgaccugccu

SEQ ID NO: 1790394 - RNA, 14 nt, Human
aaauaaugugaaac

SEQ ID NO: 1790395 - RNA, 22 nt, Human
aaauaaugugaaacuggauuaa

SEQ ID NO: 1790396 - RNA, 22 nt, Human
aaaguguauuuuuuuacuaaua

SEQ ID NO: 1790397 - RNA, 13 nt, Human
guaaaccuuuuau

SEQ ID NO: 1790398 - RNA, 20 nt, Human
guaacaggaaaauuuuaaaa

SEQ ID NO: 1790399 - RNA, 16 nt, Human
guaacaagccacccca

SEQ ID NO: 1790400 - RNA, 19 nt, Human
guaacaggaaaauuuuaaa

SEQ ID NO: 1790401 - RNA, 15 nt, Human
guaaagcuagaaaug

SEQ ID NO: 1790402 - RNA, 16 nt, Human
guaaagcuagaaauga

SEQ ID NO: 1790403 - RNA, 23 nt, Human
ggguuuugccauguuggccaggc

SEQ ID NO: 1790404 - RNA, 20 nt, Human
ggguuuugccauguuggcca

SEQ ID NO: 1790405 - RNA, 15 nt, Human
gggugguggugauag

SEQ ID NO: 1790406 - RNA, 19 nt, Human
gggugggacacccugugau

SEQ ID NO: 1790407 - RNA, 13 nt, Human
gguaacaggcaga

SEQ ID NO: 1790408 - RNA, 22 nt, Human
gguaaaucagacuaugaaguuu

SEQ ID NO: 1790409 - RNA, 14 nt, Human
aaacuuaaucuaaa

SEQ ID NO: 1790410 - RNA, 19 nt, Human
aaacuuaaucuaaauggaa

SEQ ID NO: 1790411 - RNA, 15 nt, Human
gggugggacacccug

SEQ ID NO: 1790412 - RNA, 18 nt, Human
gggugggacacccuguga

SEQ ID NO: 1790413 - RNA, 21 nt, Human
aaacguggcugcuucaaggau

SEQ ID NO: 1790414 - RNA, 14 nt, Human
gguaucaggugcug

SEQ ID NO: 1790415 - RNA, 13 nt, Human
gguauagaaaugc

SEQ ID NO: 1790416 - RNA, 11 nt, Human
gguaggguggg

SEQ ID NO: 1790417 - RNA, 23 nt, Human
gguagggugggccuucagggagu

SEQ ID NO: 1790418 - RNA, 20 nt, Human
gguaggguaagugagagagg

SEQ ID NO: 1790419 - RNA, 20 nt, Human
gguaaggaauaccugucccc

SEQ ID NO: 1790420 - RNA, 22 nt, Human
aaacuugauguguuaucucuua

SEQ ID NO: 1790421 - RNA, 14 nt, Human
ggucagugcaaaua

SEQ ID NO: 1790422 - RNA, 19 nt, Human
gguaucaggugcugccauc

SEQ ID NO: 1790423 - RNA, 19 nt, Human
aaacauuuugucauauaag

SEQ ID NO: 1790424 - RNA, 22 nt, Human
gggucacucuggcagcucagag

SEQ ID NO: 1790425 - RNA, 14 nt, Human
gggucacucuggca

SEQ ID NO: 1790426 - RNA, 20 nt, Human
gggucacucuggcagcucag

SEQ ID NO: 1790427 - RNA, 17 nt, Human
aaaccuucacuuaggaa

SEQ ID NO: 1790428 - RNA, 22 nt, Human
aaaccugugucucugagaguag

SEQ ID NO: 1790429 - RNA, 14 nt, Human
ggggaccagagcug

SEQ ID NO: 1790430 - RNA, 15 nt, Human
ggggaccagagcugc

SEQ ID NO: 1790431 - RNA, 18 nt, Human
aaaauguauguguaagua

SEQ ID NO: 1790432 - RNA, 12 nt, Human
ggggaccagagc

SEQ ID NO: 1790433 - RNA, 13 nt, Human
ggggaccagagcu

SEQ ID NO: 1790434 - RNA, 21 nt, Human
ggggucacucuggcagcucag

SEQ ID NO: 1790435 - RNA, 13 nt, Human
ggggguggccucc

SEQ ID NO: 1790436 - RNA, 15 nt, Human
gggggcugggcagag

SEQ ID NO: 1790437 - RNA, 11 nt, Human
gggggcuggga

SEQ ID NO: 1790438 - RNA, 17 nt, Human
gggggaucacagccucu

SEQ ID NO: 1790439 - RNA, 15 nt, Human
ggggcccugccuccu

SEQ ID NO: 1790440 - RNA, 20 nt, Human
aaaauggaagacagcucuua

SEQ ID NO: 1790441 - RNA, 23 nt, Human
aaaaugcuguauuagucacagag

SEQ ID NO: 1790442 - RNA, 21 nt, Human
aaaaugcuguauuagucacag

SEQ ID NO: 1790443 - RNA, 11 nt, Human
aaaaugagaaa

SEQ ID NO: 1790444 - RNA, 12 nt, Human
aaaaugagaaau

SEQ ID NO: 1790445 - RNA, 15 nt, Human
aaaaucugcuaggga

SEQ ID NO: 1790446 - RNA, 16 nt, Human
aaaauauuuuccugcc

SEQ ID NO: 1790447 - RNA, 22 nt, Human
aaaauaugaccacacuccagcu

SEQ ID NO: 1790448 - RNA, 15 nt, Human
aaaauauuccugcau

SEQ ID NO: 1790449 - RNA, 13 nt, Human
aaaauaccaagga

SEQ ID NO: 1790450 - RNA, 14 nt, Human
aaaauaauuuugua

SEQ ID NO: 1790451 - RNA, 13 nt, Human
aaaauaauuuugu

SEQ ID NO: 1790452 - RNA, 11 nt, Human
aaaaggcagga

SEQ ID NO: 1790453 - RNA, 17 nt, Human
aaaagguuaauaaagua

SEQ ID NO: 1790454 - RNA, 16 nt, Human
aaaagguuaauaaagu

SEQ ID NO: 1790455 - RNA, 22 nt, Human
aaaaggagccaauuuaaagaaa

SEQ ID NO: 1790456 - RNA, 13 nt, Human
aaaaggaugcaca

SEQ ID NO: 1790457 - RNA, 22 nt, Human
aaaaggaugcacagaguuguua

SEQ ID NO: 1790458 - RNA, 19 nt, Human
aaaaggaugcacagaguug

SEQ ID NO: 1790459 - RNA, 15 nt, Human
aaaaggaugcacaga

SEQ ID NO: 1790460 - RNA, 14 nt, Human
aaaaggaugcacag

SEQ ID NO: 1790461 - RNA, 17 nt, Human
gggcuggguucuaccca

SEQ ID NO: 1790462 - RNA, 18 nt, Human
aaaaugguuuaaaugguc

SEQ ID NO: 1790463 - RNA, 16 nt, Human
aaaaugguuuaaaugg

SEQ ID NO: 1790464 - RNA, 20 nt, Human
gggcugcaccggcuggccug

SEQ ID NO: 1790465 - RNA, 21 nt, Human
gggcugcaccggcuggccugg

SEQ ID NO: 1790466 - RNA, 15 nt, Human
gggcugggcagagga

SEQ ID NO: 1790467 - RNA, 19 nt, Human
gggcucagcggggacagcu

SEQ ID NO: 1790468 - RNA, 17 nt, Human
gggcucagcggggacag

SEQ ID NO: 1790469 - RNA, 18 nt, Human
gggcuaguugggcuuccu

SEQ ID NO: 1790470 - RNA, 22 nt, Human
gggcucagcaaaagaugcuucu

SEQ ID NO: 1790471 - RNA, 15 nt, Human
gggcuaguugggcuu

SEQ ID NO: 1790472 - RNA, 20 nt, Human
gggcuaggaaauccagggug

SEQ ID NO: 1790473 - RNA, 21 nt, Human
gggcucagcggggacagcucc

SEQ ID NO: 1790474 - RNA, 10 nt, Human
gggcuccaga

SEQ ID NO: 1790475 - RNA, 13 nt, Human
gggcuccagacac

SEQ ID NO: 1790476 - RNA, 17 nt, Human
gggcugcaccggcuggc

SEQ ID NO: 1790477 - RNA, 19 nt, Human
gggcugcaccggcuggccu

SEQ ID NO: 1790478 - RNA, 15 nt, Human
gggcgugguggugag

SEQ ID NO: 1790479 - RNA, 21 nt, Human
gggcggugagaggggaacaga

SEQ ID NO: 1790480 - RNA, 18 nt, Human
gggcgugagaccugcccc

SEQ ID NO: 1790481 - RNA, 19 nt, Human
gggcgugagaccugccccu

SEQ ID NO: 1790482 - RNA, 19 nt, Human
gggccucuuaugggcuggg

SEQ ID NO: 1790483 - RNA, 18 nt, Human
gggccucuuaugggcugg

SEQ ID NO: 1790484 - RNA, 22 nt, Human
gggccucgguguggagaagcgg

SEQ ID NO: 1790485 - RNA, 14 nt, Human
gggccucagugcca

SEQ ID NO: 1790486 - RNA, 13 nt, Human
gggccucagugcc

SEQ ID NO: 1790487 - RNA, 15 nt, Human
gggccucagugccac

SEQ ID NO: 1790488 - RNA, 12 nt, Human
gggccaggagcc

SEQ ID NO: 1790489 - RNA, 13 nt, Human
gggccaggagccu

SEQ ID NO: 1790490 - RNA, 14 nt, Human
gggccaggagccuc

SEQ ID NO: 1790491 - RNA, 13 nt, Human
ggcucccuuccca

SEQ ID NO: 1790492 - RNA, 15 nt, Human
ggcucuuccaggcug

SEQ ID NO: 1790493 - RNA, 17 nt, Human
ggcucuuccaggcuggg

SEQ ID NO: 1790494 - RNA, 18 nt, Human
ggcucuuccaggcuggga

SEQ ID NO: 1790495 - RNA, 12 nt, Human
ggcugcccuggu

SEQ ID NO: 1790496 - RNA, 10 nt, Human
ggcugcccuu

SEQ ID NO: 1790497 - RNA, 11 nt, Human
ggcugcccuuu

SEQ ID NO: 1790498 - RNA, 14 nt, Human
ggcugcccuuucug

SEQ ID NO: 1790499 - RNA, 18 nt, Human
ggcugcccuuucugggca

SEQ ID NO: 1790500 - RNA, 15 nt, Human
ggcucacugcagccu

SEQ ID NO: 1790501 - RNA, 14 nt, Human
ggcucacugcagcc

SEQ ID NO: 1790502 - RNA, 13 nt, Human
ggcucacugcagc

SEQ ID NO: 1790503 - RNA, 13 nt, Human
aaaaauacaaaaa

SEQ ID NO: 1790504 - RNA, 14 nt, Human
ggcuggguuggagg

SEQ ID NO: 1790505 - RNA, 22 nt, Human
ggcuggguucuacccaggugcu

SEQ ID NO: 1790506 - RNA, 14 nt, Human
aaaaauaaaaaaca

SEQ ID NO: 1790507 - RNA, 21 nt, Human
aaaaaggaugcacagaguugu

SEQ ID NO: 1790508 - RNA, 12 nt, Human
aaaaaggcagga

SEQ ID NO: 1790509 - RNA, 14 nt, Human
aaaaaggaggaaga

SEQ ID NO: 1790510 - RNA, 22 nt, Human
aaaaaacugcugacuguuuucu

SEQ ID NO: 1790511 - RNA, 17 nt, Human
ggcuggcccugcccugg

SEQ ID NO: 1790512 - RNA, 13 nt, Human
ggcuggccuggcc

SEQ ID NO: 1790513 - RNA, 14 nt, Human
ggcuggccuggccc

SEQ ID NO: 1790514 - RNA, 15 nt, Human
ggcuggccuggcccc

SEQ ID NO: 1790515 - RNA, 13 nt, Human
ggccucagugcca

SEQ ID NO: 1790516 - RNA, 17 nt, Human
ggccucccaacucaccc

SEQ ID NO: 1790517 - RNA, 18 nt, Human
ggccucccaacucacccc

SEQ ID NO: 1790518 - RNA, 19 nt, Human
ggccucccaacucacccca

SEQ ID NO: 1790519 - RNA, 23 nt, Human
ggccucccaacucaccccagccc

SEQ ID NO: 1790520 - RNA, 20 nt, Human
ggccucccaacucaccccag

SEQ ID NO: 1790521 - RNA, 22 nt, Human
ggccucccaacucaccccagcc

SEQ ID NO: 1790522 - RNA, 16 nt, Human
ggccagaugcaccagc

SEQ ID NO: 1790523 - RNA, 15 nt, Human
ggccagaugcaccag

SEQ ID NO: 1790524 - RNA, 22 nt, Human
ggccagagggagugacagaggc

SEQ ID NO: 1790525 - RNA, 17 nt, Human
ggccagaugcaccagcc

SEQ ID NO: 1790526 - RNA, 21 nt, Human
ggccccugccucucugcaggu

SEQ ID NO: 1790527 - RNA, 13 nt, Human
ggccccugccucu

SEQ ID NO: 1790528 - RNA, 17 nt, Human
ggccccugccucucugc

SEQ ID NO: 1790529 - RNA, 18 nt, Human
ggccccugccucucugca

SEQ ID NO: 1790530 - RNA, 19 nt, Human
ggccccugccucucugcag

SEQ ID NO: 1790531 - RNA, 20 nt, Human
ggcuaagcuucacuguaaaa

SEQ ID NO: 1790532 - RNA, 14 nt, Human
ggcgugagaccugc

SEQ ID NO: 1790533 - RNA, 16 nt, Human
ggcgugagaccugccc

SEQ ID NO: 1790534 - RNA, 17 nt, Human
ggcgugagaccugcccc

SEQ ID NO: 1790535 - RNA, 18 nt, Human
ggcgugagaccugccccu

SEQ ID NO: 1790536 - RNA, 16 nt, Human
ggccuucggccuccau

SEQ ID NO: 1790537 - RNA, 22 nt, Human
ggccuucggccuccauccugag

SEQ ID NO: 1790538 - RNA, 18 nt, Human
ggccuucggccuccaucc

SEQ ID NO: 1790539 - RNA, 20 nt, Human
ggcuaagugauccucccacc

SEQ ID NO: 1790540 - RNA, 16 nt, Human
ggcuaauguacugcau

SEQ ID NO: 1790541 - RNA, 18 nt, Human
ggcuaauuuuuguuuugu

SEQ ID NO: 1790542 - RNA, 23 nt, Human
ggcuacaccuuagccugcccucc

SEQ ID NO: 1790543 - RNA, 22 nt, Human
ggcuacaccuuagccugcccuc

SEQ ID NO: 1790544 - RNA, 13 nt, Human
ggcuaccuuugua

SEQ ID NO: 1790545 - RNA, 14 nt, Human
ggcuaccuuuguau

SEQ ID NO: 1790546 - RNA, 16 nt, Human
ggcuagagguucaaag

SEQ ID NO: 1790547 - RNA, 11 nt, Human
ggccugccugu

SEQ ID NO: 1790548 - RNA, 15 nt, Human
ggccuggccagaugc

SEQ ID NO: 1790549 - RNA, 12 nt, Human
ggccuggccaga

SEQ ID NO: 1790550 - RNA, 14 nt, Human
ggccuggcagccgu

SEQ ID NO: 1790551 - RNA, 15 nt, Human
ggccuggcagccgug

SEQ ID NO: 1790552 - RNA, 16 nt, Human
ggccuggccagaugca

SEQ ID NO: 1790553 - RNA, 17 nt, Human
ggccuucagggagugag

SEQ ID NO: 1790554 - RNA, 16 nt, Human
ggccugcaagggagug

SEQ ID NO: 1790555 - RNA, 21 nt, Human
ggcagccccauucugccugcc

SEQ ID NO: 1790556 - RNA, 20 nt, Human
ggcagccccauucugccugc

SEQ ID NO: 1790557 - RNA, 16 nt, Human
ggcagccccauucugc

SEQ ID NO: 1790558 - RNA, 22 nt, Human
ggcagccccauucugccugccc

SEQ ID NO: 1790559 - RNA, 16 nt, Human
ggcagccucuucaaaa

SEQ ID NO: 1790560 - RNA, 22 nt, Human
ggcacugcuuccagugaggcuc

SEQ ID NO: 1790561 - RNA, 20 nt, Human
ggcacugcuuccagugaggc

SEQ ID NO: 1790562 - RNA, 14 nt, Human
ggcagccaggccac

SEQ ID NO: 1790563 - RNA, 13 nt, Human
ggcagccaggcca

SEQ ID NO: 1790564 - RNA, 19 nt, Human
ggcagggagggccugggcc

SEQ ID NO: 1790565 - RNA, 20 nt, Human
ggcagggagggccugggccc

SEQ ID NO: 1790566 - RNA, 17 nt, Human
ggcagggagggccuggg

SEQ ID NO: 1790567 - RNA, 18 nt, Human
ggcagggagggccugggc

SEQ ID NO: 1790568 - RNA, 10 nt, Human
ggcagggagg

SEQ ID NO: 1790569 - RNA, 18 nt, Human
ggcaggaggaucacuuga

SEQ ID NO: 1790570 - RNA, 18 nt, Human
ggcacaccgggcacucag

SEQ ID NO: 1790571 - RNA, 18 nt, Human
ggcacaucagcacgauuu

SEQ ID NO: 1790572 - RNA, 16 nt, Human
ggcacugcuuccagug

SEQ ID NO: 1790573 - RNA, 16 nt, Human
ggauuuuugucuugug

SEQ ID NO: 1790574 - RNA, 14 nt, Human
ggauuuuugucuug

SEQ ID NO: 1790575 - RNA, 15 nt, Human
ggcaaaaaggcagga

SEQ ID NO: 1790576 - RNA, 19 nt, Human
ggccagagggagugacaga

SEQ ID NO: 1790577 - RNA, 17 nt, Human
ggccagagggagugaca

SEQ ID NO: 1790578 - RNA, 18 nt, Human
ggccagagacacaagccu

SEQ ID NO: 1790579 - RNA, 17 nt, Human
ggccagagacacaagcc

SEQ ID NO: 1790580 - RNA, 17 nt, Human
ggcauuuguuugaacug

SEQ ID NO: 1790581 - RNA, 14 nt, Human
ggccaaaggaagca

SEQ ID NO: 1790582 - RNA, 16 nt, Human
ggccaaaggaagcaca

SEQ ID NO: 1790583 - RNA, 23 nt, Human
ggcauuuguuucuuucucugagg

SEQ ID NO: 1790584 - RNA, 17 nt, Human
ggcauuuguuucuuucu

SEQ ID NO: 1790585 - RNA, 19 nt, Human
ggccaaaggaagcacaugc

SEQ ID NO: 1790586 - RNA, 20 nt, Human
ggcaucgcaauguaagacuc

SEQ ID NO: 1790587 - RNA, 14 nt, Human
ggcauuugcugaau

SEQ ID NO: 1790588 - RNA, 13 nt, Human
ggaggggggaggu

SEQ ID NO: 1790589 - RNA, 14 nt, Human
ggaggggggaggug

SEQ ID NO: 1790590 - RNA, 15 nt, Human
ggaggcucuggagcc

SEQ ID NO: 1790591 - RNA, 22 nt, Human
ggaggugggauccuccaggugc

SEQ ID NO: 1790592 - RNA, 23 nt, Human
ggaggugggauccuccaggugca

SEQ ID NO: 1790593 - RNA, 22 nt, Human
ggagguaaggaauaccuguccc

SEQ ID NO: 1790594 - RNA, 21 nt, Human
ggagggugacgggggugaacu

SEQ ID NO: 1790595 - RNA, 18 nt, Human
ggaucucuugagccuggg

SEQ ID NO: 1790596 - RNA, 21 nt, Human
ggaucuuuggacagaagcagc

SEQ ID NO: 1790597 - RNA, 16 nt, Human
ggaguucaucuugaau

SEQ ID NO: 1790598 - RNA, 15 nt, Human
ggauccugagccaga

SEQ ID NO: 1790599 - RNA, 16 nt, Human
ggauccugagccagau

SEQ ID NO: 1790600 - RNA, 18 nt, Human
ggauccugagccagauuu

SEQ ID NO: 1790601 - RNA, 19 nt, Human
ggauccugagccagauuuc

SEQ ID NO: 1790602 - RNA, 20 nt, Human
ggauccugagccagauuuca

SEQ ID NO: 1790603 - RNA, 23 nt, Human
ggauccugagccagauuucacuc

SEQ ID NO: 1790604 - RNA, 12 nt, Human
ggauuuaacaga

SEQ ID NO: 1790605 - RNA, 16 nt, Human
ggauuguccccgaccc

SEQ ID NO: 1790606 - RNA, 20 nt, Human
ggauuguccccgacccuugc

SEQ ID NO: 1790607 - RNA, 17 nt, Human
ggauuuaacagaaaugu

SEQ ID NO: 1790608 - RNA, 16 nt, Human
ggauuuaacagaaaug

SEQ ID NO: 1790609 - RNA, 22 nt, Human
ggauuuaacagaaauguacagc

SEQ ID NO: 1790610 - RNA, 14 nt, Human
ggauuguaguccca

SEQ ID NO: 1790611 - RNA, 13 nt, Human
ggauuguccccga

SEQ ID NO: 1790612 - RNA, 22 nt, Human
ggaucuuuggacagaagcagcu

SEQ ID NO: 1790613 - RNA, 14 nt, Human
ggaugaaaaaauaa

SEQ ID NO: 1790614 - RNA, 15 nt, Human
ggaguggccacagaa

SEQ ID NO: 1790615 - RNA, 16 nt, Human
ggaguggccacagaaa

SEQ ID NO: 1790616 - RNA, 12 nt, Human
ggagugggccca

SEQ ID NO: 1790617 - RNA, 22 nt, Human
ggagugggcccaaugcacuuug

SEQ ID NO: 1790618 - RNA, 19 nt, Human
gauccaagcuggucccacu

SEQ ID NO: 1790619 - RNA, 17 nt, Human
gauccaagcugguccca

SEQ ID NO: 1790620 - RNA, 16 nt, Human
gauccaagcugguccc

SEQ ID NO: 1790621 - RNA, 12 nt, Human
gauccaagcugg

SEQ ID NO: 1790622 - RNA, 19 nt, Human
gauccacccaccucagccu

SEQ ID NO: 1790623 - RNA, 18 nt, Human
gauccacccaccucagcc

SEQ ID NO: 1790624 - RNA, 21 nt, Human
gauccaagcuggucccacuca

SEQ ID NO: 1790625 - RNA, 21 nt, Human
gauccacccaccucagccucc

SEQ ID NO: 1790626 - RNA, 20 nt, Human
gauccacccaccucagccuc

SEQ ID NO: 1790627 - RNA, 22 nt, Human
gauccacccaccucagccuccc

SEQ ID NO: 1790628 - RNA, 18 nt, Human
gauacuuugauauuuuca

SEQ ID NO: 1790629 - RNA, 19 nt, Human
gauauuuucaacgcagccc

SEQ ID NO: 1790630 - RNA, 21 nt, Human
gauauuuucaacgcagcccug

SEQ ID NO: 1790631 - RNA, 22 nt, Human
gauauuuucaacgcagcccugc

SEQ ID NO: 1790632 - RNA, 23 nt, Human
gauauuuucaacgcagcccugcu

SEQ ID NO: 1790633 - RNA, 15 nt, Human
gauauuuugcuuugu

SEQ ID NO: 1790634 - RNA, 17 nt, Human
gauauuuuuuucuuuuc

SEQ ID NO: 1790635 - RNA, 20 nt, Human
gaucaaaagguuaauaaagu

SEQ ID NO: 1790636 - RNA, 23 nt, Human
gaucaaaagguuaauaaaguaau

SEQ ID NO: 1790637 - RNA, 22 nt, Human
gaucaaaccccgaccaccugcc

SEQ ID NO: 1790638 - RNA, 23 nt, Human
gauacaguuacucagaauucucu

SEQ ID NO: 1790639 - RNA, 19 nt, Human
gauacaguuacucagaauu

SEQ ID NO: 1790640 - RNA, 16 nt, Human
gauacaguuacucaga

SEQ ID NO: 1790641 - RNA, 21 nt, Human
gauacuguaucaugacaaaga

SEQ ID NO: 1790642 - RNA, 17 nt, Human
gauacuguaucaugaca

SEQ ID NO: 1790643 - RNA, 18 nt, Human
gaucucuugagccuggga

SEQ ID NO: 1790644 - RNA, 19 nt, Human
gaucucuugagccugggag

SEQ ID NO: 1790645 - RNA, 17 nt, Human
gaucugaugcaagcaag

SEQ ID NO: 1790646 - RNA, 22 nt, Human
gaugauuggaggggggaggugg

SEQ ID NO: 1790647 - RNA, 13 nt, Human
gaugauccuaggc

SEQ ID NO: 1790648 - RNA, 14 nt, Human
gaugauccuaggca

SEQ ID NO: 1790649 - RNA, 21 nt, Human
gaugcuucuucagagacuccu

SEQ ID NO: 1790650 - RNA, 17 nt, Human
gaugcuucuucagagac

SEQ ID NO: 1790651 - RNA, 20 nt, Human
gaugcuucuucagagacucc

SEQ ID NO: 1790652 - RNA, 11 nt, Human
gauuucacucu

SEQ ID NO: 1790653 - RNA, 16 nt, Human
gauuuaauuugaaaua

SEQ ID NO: 1790654 - RNA, 16 nt, Human
gauuuuuuuuuccuuc

SEQ ID NO: 1790655 - RNA, 12 nt, Human
gauuucacucuc

SEQ ID NO: 1790656 - RNA, 17 nt, Human
gauuuuuuuuuccuuca

SEQ ID NO: 1790657 - RNA, 18 nt, Human
gauuuuuuuuuccuucag

SEQ ID NO: 1790658 - RNA, 17 nt, Human
gcaaaagaugcuucuca

SEQ ID NO: 1790659 - RNA, 22 nt, Human
gcaaaagaugcuucucacugcc

SEQ ID NO: 1790660 - RNA, 14 nt, Human
gcaaaaaggcagga

SEQ ID NO: 1790661 - RNA, 21 nt, Human
gauuuuuuuuuccuucagugc

SEQ ID NO: 1790662 - RNA, 20 nt, Human
gauucuucugcuucagccuc

SEQ ID NO: 1790663 - RNA, 16 nt, Human
gauuuaacagaaaugu

SEQ ID NO: 1790664 - RNA, 18 nt, Human
gauuuaacagaaauguac

SEQ ID NO: 1790665 - RNA, 17 nt, Human
gauuuaacagaaaugua

SEQ ID NO: 1790666 - RNA, 19 nt, Human
gauuuaacagaaauguaca

SEQ ID NO: 1790667 - RNA, 15 nt, Human
gauucuucugcuuca

SEQ ID NO: 1790668 - RNA, 13 nt, Human
gauucuucugcuu

SEQ ID NO: 1790669 - RNA, 15 nt, Human
gcaagugagagcugg

SEQ ID NO: 1790670 - RNA, 16 nt, Human
gcaagugagagcuggg

SEQ ID NO: 1790671 - RNA, 13 nt, Human
gcaacaggcuggg

SEQ ID NO: 1790672 - RNA, 15 nt, Human
gcaacaggcugggcu

SEQ ID NO: 1790673 - RNA, 14 nt, Human
gcaacaggcugggc

SEQ ID NO: 1790674 - RNA, 19 nt, Human
gcaacaggcugggcuucag

SEQ ID NO: 1790675 - RNA, 16 nt, Human
gcaacaggcugggcuu

SEQ ID NO: 1790676 - RNA, 13 nt, Human
gcaaccaccacca

SEQ ID NO: 1790677 - RNA, 16 nt, Human
gcaaccaccaccaacc

SEQ ID NO: 1790678 - RNA, 18 nt, Human
gcaaccaccaccaaccac

SEQ ID NO: 1790679 - RNA, 19 nt, Human
gcaaccuccgccucuuggg

SEQ ID NO: 1790680 - RNA, 17 nt, Human
gcaacccccagccugcu

SEQ ID NO: 1790681 - RNA, 16 nt, Human
gcaacccccagccugc

SEQ ID NO: 1790682 - RNA, 15 nt, Human
gcaacccccagccug

SEQ ID NO: 1790683 - RNA, 14 nt, Human
gcaacccccagccu

SEQ ID NO: 1790684 - RNA, 14 nt, Human
gcaaccauuugaaa

SEQ ID NO: 1790685 - RNA, 20 nt, Human
gcaaccuccgccucuugggu

SEQ ID NO: 1790686 - RNA, 20 nt, Human
gcaaccuucgccaccugggu

SEQ ID NO: 1790687 - RNA, 18 nt, Human
gcagcccaccccucaaca

SEQ ID NO: 1790688 - RNA, 15 nt, Human
gcagccacauuccug

SEQ ID NO: 1790689 - RNA, 22 nt, Human
gcagaacagugauuaccaggga

SEQ ID NO: 1790690 - RNA, 18 nt, Human
gcagaacagugauuacca

SEQ ID NO: 1790691 - RNA, 21 nt, Human
gcagaggaaagcaaaggagau

SEQ ID NO: 1790692 - RNA, 13 nt, Human
gcagaggaaagca

SEQ ID NO: 1790693 - RNA, 14 nt, Human
gcagaggaaagcaa

SEQ ID NO: 1790694 - RNA, 18 nt, Human
gcagaggaaagcaaagga

SEQ ID NO: 1790695 - RNA, 20 nt, Human
gcagaggaaagcaaaggaga

SEQ ID NO: 1790696 - RNA, 17 nt, Human
gcagcauauucaggaag

SEQ ID NO: 1790697 - RNA, 18 nt, Human
gcagcauauucaggaagc

SEQ ID NO: 1790698 - RNA, 19 nt, Human
gcagcauauucaggaagcu

SEQ ID NO: 1790699 - RNA, 23 nt, Human
gcagcauauucaggaagcucagg

SEQ ID NO: 1790700 - RNA, 14 nt, Human
gcagagggcacaga

SEQ ID NO: 1790701 - RNA, 13 nt, Human
gcagaacagugau

SEQ ID NO: 1790702 - RNA, 12 nt, Human
gcagaacaguga

SEQ ID NO: 1790703 - RNA, 22 nt, Human
gcacuuuguucuggcucuucca

SEQ ID NO: 1790704 - RNA, 15 nt, Human
gcacuccccugcugg

SEQ ID NO: 1790705 - RNA, 16 nt, Human
gcacuccccugcuggg

SEQ ID NO: 1790706 - RNA, 18 nt, Human
gcacuuuguucuggcucu

SEQ ID NO: 1790707 - RNA, 19 nt, Human
gcacuuuguucuggcucuu

SEQ ID NO: 1790708 - RNA, 13 nt, Human
gcacuccccugcu

SEQ ID NO: 1790709 - RNA, 14 nt, Human
gcacuccccugcug

SEQ ID NO: 1790710 - RNA, 14 nt, Human
gcacuccagccugg

SEQ ID NO: 1790711 - RNA, 15 nt, Human
gcacuccagccuggg

SEQ ID NO: 1790712 - RNA, 20 nt, Human
gcacucagaagacacugaug

SEQ ID NO: 1790713 - RNA, 19 nt, Human
gcaagugagagcugggugu

SEQ ID NO: 1790714 - RNA, 18 nt, Human
gcaagugagagcugggug

SEQ ID NO: 1790715 - RNA, 18 nt, Human
gcauacguacacauuuua

SEQ ID NO: 1790716 - RNA, 17 nt, Human
gcauacguacacauuuu

SEQ ID NO: 1790717 - RNA, 16 nt, Human
gcauacguacacauuu

SEQ ID NO: 1790718 - RNA, 15 nt, Human
gcauacguacacauu

SEQ ID NO: 1790719 - RNA, 20 nt, Human
gcaucuagcaugucgucaaa

SEQ ID NO: 1790720 - RNA, 13 nt, Human
gcauccuggcacc

SEQ ID NO: 1790721 - RNA, 17 nt, Human
gcauccuccgccucccg

SEQ ID NO: 1790722 - RNA, 14 nt, Human
gcauccuggcaccc

SEQ ID NO: 1790723 - RNA, 21 nt, Human
gcauggcugccaaugggagcu

SEQ ID NO: 1790724 - RNA, 15 nt, Human
gcauuuacuuugugu

SEQ ID NO: 1790725 - RNA, 22 nt, Human
gcauuuaaaagauacaguuacu

SEQ ID NO: 1790726 - RNA, 18 nt, Human
gcauuuaaaagauacagu

SEQ ID NO: 1790727 - RNA, 17 nt, Human
gcauuuaaaagauacag

SEQ ID NO: 1790728 - RNA, 16 nt, Human
gcauuuaaaagauaca

SEQ ID NO: 1790729 - RNA, 16 nt, Human
gcauugugggaagggg

SEQ ID NO: 1790730 - RNA, 18 nt, Human
gcauugugggaaggggag

SEQ ID NO: 1790731 - RNA, 19 nt, Human
gcaugugaugagaggaaau

SEQ ID NO: 1790732 - RNA, 18 nt, Human
gcaugugaugagaggaaa

SEQ ID NO: 1790733 - RNA, 21 nt, Human
gcaugugaugagaggaaauca

SEQ ID NO: 1790734 - RNA, 13 nt, Human
gcauugugggaag

SEQ ID NO: 1790735 - RNA, 15 nt, Human
gcauugugggaaggg

SEQ ID NO: 1790736 - RNA, 18 nt, Human
gcauccaguaucuugaag

SEQ ID NO: 1790737 - RNA, 14 nt, Human
gcauccaguaucuu

SEQ ID NO: 1790738 - RNA, 17 nt, Human
gcauccaguaucuugaa

SEQ ID NO: 1790739 - RNA, 23 nt, Human
gacauugcggacagccacggcca

SEQ ID NO: 1790740 - RNA, 17 nt, Human
gacauugcggacagcca

SEQ ID NO: 1790741 - RNA, 19 nt, Human
gacauuguagagcuucugg

SEQ ID NO: 1790742 - RNA, 19 nt, Human
gacagcuccuucuguccua

SEQ ID NO: 1790743 - RNA, 12 nt, Human
gacagcucugca

SEQ ID NO: 1790744 - RNA, 10 nt, Human
gacagcucuu

SEQ ID NO: 1790745 - RNA, 12 nt, Human
gacagucccugc

SEQ ID NO: 1790746 - RNA, 11 nt, Human
gacagcucuua

SEQ ID NO: 1790747 - RNA, 14 nt, Human
gacagucccugcca

SEQ ID NO: 1790748 - RNA, 15 nt, Human
gacagucccugccaa

SEQ ID NO: 1790749 - RNA, 16 nt, Human
gacagucccugccaau

SEQ ID NO: 1790750 - RNA, 20 nt, Human
gacagucccugccaauggac

SEQ ID NO: 1790751 - RNA, 18 nt, Human
gacagcuccuucuguccu

SEQ ID NO: 1790752 - RNA, 17 nt, Human
gacagcuccuucugucc

SEQ ID NO: 1790753 - RNA, 16 nt, Human
gacagcccgggcucug

SEQ ID NO: 1790754 - RNA, 14 nt, Human
gacagcccgggcuc

SEQ ID NO: 1790755 - RNA, 21 nt, Human
gaccucaggugauccacccac

SEQ ID NO: 1790756 - RNA, 20 nt, Human
gaccucaggugauccaccca

SEQ ID NO: 1790757 - RNA, 19 nt, Human
gaccucaggugauccaccc

SEQ ID NO: 1790758 - RNA, 21 nt, Human
gaccucaggugagaagcagag

SEQ ID NO: 1790759 - RNA, 22 nt, Human
gaccucagguaaucgaccugcc

SEQ ID NO: 1790760 - RNA, 23 nt, Human
gaccucagguaaucgaccugccu

SEQ ID NO: 1790761 - RNA, 19 nt, Human
gaccucaggccugggggcu

SEQ ID NO: 1790762 - RNA, 18 nt, Human
gaccucaggugagaagca

SEQ ID NO: 1790763 - RNA, 19 nt, Human
gaccucaggugagaagcag

SEQ ID NO: 1790764 - RNA, 10 nt, Human
gacccugagg

SEQ ID NO: 1790765 - RNA, 14 nt, Human
gaccucaggccugg

SEQ ID NO: 1790766 - RNA, 18 nt, Human
gacccggaggggccuggc

SEQ ID NO: 1790767 - RNA, 19 nt, Human
gacccggaggggccuggca

SEQ ID NO: 1790768 - RNA, 20 nt, Human
gacccggaggggccuggcag

SEQ ID NO: 1790769 - RNA, 16 nt, Human
gaccccugagcuugca

SEQ ID NO: 1790770 - RNA, 17 nt, Human
gacccggaggggccugg

SEQ ID NO: 1790771 - RNA, 13 nt, Human
gaccucugccuga

SEQ ID NO: 1790772 - RNA, 12 nt, Human
gacgccauccca

SEQ ID NO: 1790773 - RNA, 13 nt, Human
gacgccaucccag

SEQ ID NO: 1790774 - RNA, 15 nt, Human
gacgccaucccagcc

SEQ ID NO: 1790775 - RNA, 21 nt, Human
gacgccaucccagccccaaug

SEQ ID NO: 1790776 - RNA, 22 nt, Human
gaccucugcagcaauaaagcag

SEQ ID NO: 1790777 - RNA, 18 nt, Human
gaccucugcagcaauaaa

SEQ ID NO: 1790778 - RNA, 16 nt, Human
gaccucugcagcaaua

SEQ ID NO: 1790779 - RNA, 18 nt, Human
gacgcugugcugcccugc

SEQ ID NO: 1790780 - RNA, 16 nt, Human
gacgcugugcugcccu

SEQ ID NO: 1790781 - RNA, 17 nt, Human
gacgcugugcugcccug

SEQ ID NO: 1790782 - RNA, 22 nt, Human
gacgcuacccgggaagggggcu

SEQ ID NO: 1790783 - RNA, 23 nt, Human
gacgcuacccgggaagggggcug

SEQ ID NO: 1790784 - RNA, 14 nt, Human
gacgcucucuggcc

SEQ ID NO: 1790785 - RNA, 11 nt, Human
gaauauugcug

SEQ ID NO: 1790786 - RNA, 12 nt, Human
gaauauugcuga

SEQ ID NO: 1790787 - RNA, 13 nt, Human
gaauauugcugau

SEQ ID NO: 1790788 - RNA, 15 nt, Human
gaauauauaaccagu

SEQ ID NO: 1790789 - RNA, 22 nt, Human
gaauauugcugauggugcaaug

SEQ ID NO: 1790790 - RNA, 23 nt, Human
gaauauugcugauggugcaauga

SEQ ID NO: 1790791 - RNA, 19 nt, Human
gaauauugccauuaugcuu

SEQ ID NO: 1790792 - RNA, 24 nt, Human
gaauauugcugauggugcaaugac

SEQ ID NO: 1790793 - RNA, 14 nt, Human
gaaugaauggcuaa

SEQ ID NO: 1790794 - RNA, 18 nt, Human
gaaugcacaaacagaggc

SEQ ID NO: 1790795 - RNA, 17 nt, Human
gaauguuugccucugcc

SEQ ID NO: 1790796 - RNA, 16 nt, Human
gaauguuugccucugc

SEQ ID NO: 1790797 - RNA, 19 nt, Human
gaaugcacaaacagaggcc

SEQ ID NO: 1790798 - RNA, 20 nt, Human
gaaugaauggcuaagcaaaa

SEQ ID NO: 1790799 - RNA, 15 nt, Human
gaaugaauggcuaag

SEQ ID NO: 1790800 - RNA, 20 nt, Human
gaaugaugauccuaggcauu

SEQ ID NO: 1790801 - RNA, 14 nt, Human
gaaugaugccauga

SEQ ID NO: 1790802 - RNA, 14 nt, Human
gaaugauuaauuaa

SEQ ID NO: 1790803 - RNA, 19 nt, Human
gaauguuugccucugccuc

SEQ ID NO: 1790804 - RNA, 18 nt, Human
gaauguuugccucugccu

SEQ ID NO: 1790805 - RNA, 15 nt, Human
gaauuaacacaugau

SEQ ID NO: 1790806 - RNA, 14 nt, Human
gaauuaacacauga

SEQ ID NO: 1790807 - RNA, 20 nt, Human
gacacagcucuucuccaggc

SEQ ID NO: 1790808 - RNA, 19 nt, Human
gacacagcucuucuccagg

SEQ ID NO: 1790809 - RNA, 12 nt, Human
gacacagcucuu

SEQ ID NO: 1790810 - RNA, 21 nt, Human
gacacagcucuucuccaggcu

SEQ ID NO: 1790811 - RNA, 23 nt, Human
gaggacuuuucuuuguggcuucc

SEQ ID NO: 1790812 - RNA, 20 nt, Human
gaggacuuuucuuuguggcu

SEQ ID NO: 1790813 - RNA, 16 nt, Human
gaggacuuuucuuugu

SEQ ID NO: 1790814 - RNA, 20 nt, Human
gaggacgcucucuggccuuc

SEQ ID NO: 1790815 - RNA, 21 nt, Human
gaggacgcucucuggccuucg

SEQ ID NO: 1790816 - RNA, 14 nt, Human
gaggagaaacugga

SEQ ID NO: 1790817 - RNA, 12 nt, Human
gaggagaaacug

SEQ ID NO: 1790818 - RNA, 12 nt, Human
gaggagagagga

SEQ ID NO: 1790819 - RNA, 14 nt, Human
gaggagagaggacc

SEQ ID NO: 1790820 - RNA, 15 nt, Human
gaggagagaggaccc

SEQ ID NO: 1790821 - RNA, 18 nt, Human
gaggcagggucucacucu

SEQ ID NO: 1790822 - RNA, 20 nt, Human
gaggcagggucucacucugu

SEQ ID NO: 1790823 - RNA, 19 nt, Human
gaggcagggucucacucug

SEQ ID NO: 1790824 - RNA, 22 nt, Human
gaggcagggucucacucugucg

SEQ ID NO: 1790825 - RNA, 12 nt, Human
gagggccugggc

SEQ ID NO: 1790826 - RNA, 14 nt, Human
gagggccugcaagg

SEQ ID NO: 1790827 - RNA, 17 nt, Human
gagggccugcaagggag

SEQ ID NO: 1790828 - RNA, 21 nt, Human
gagggccugcaagggagugag

SEQ ID NO: 1790829 - RNA, 19 nt, Human
gaggcauuuguuugaacug

SEQ ID NO: 1790830 - RNA, 22 nt, Human
gaggcaugugaugagaggaaau

SEQ ID NO: 1790831 - RNA, 20 nt, Human
gaggcaugugaugagaggaa

SEQ ID NO: 1790832 - RNA, 21 nt, Human
gaggcaugugaugagaggaaa

SEQ ID NO: 1790833 - RNA, 21 nt, Human
gaggcauuuguuugaacugau

SEQ ID NO: 1790834 - RNA, 15 nt, Human
gaggcuccacuuggu

SEQ ID NO: 1790835 - RNA, 18 nt, Human
gaggcuccacuuggucug

SEQ ID NO: 1790836 - RNA, 17 nt, Human
gaggcuccacuuggucu

SEQ ID NO: 1790837 - RNA, 20 nt, Human
gaggcucuggagcccacugu

SEQ ID NO: 1790838 - RNA, 18 nt, Human
gaggcugagaugggagaa

SEQ ID NO: 1790839 - RNA, 14 nt, Human
gagcccugguggca

SEQ ID NO: 1790840 - RNA, 13 nt, Human
gagcccugguggc

SEQ ID NO: 1790841 - RNA, 17 nt, Human
gagccccgaggccuucu

SEQ ID NO: 1790842 - RNA, 14 nt, Human
gagccccgaggccu

SEQ ID NO: 1790843 - RNA, 13 nt, Human
gagccccgaggcc

SEQ ID NO: 1790844 - RNA, 12 nt, Human
gagcccugggag

SEQ ID NO: 1790845 - RNA, 16 nt, Human
gagcccugggaggcuc

SEQ ID NO: 1790846 - RNA, 18 nt, Human
gagcccugggaggcucug

SEQ ID NO: 1790847 - RNA, 19 nt, Human
gagcccugggaggcucugg

SEQ ID NO: 1790848 - RNA, 20 nt, Human
gagcccugggaggcucugga

SEQ ID NO: 1790849 - RNA, 21 nt, Human
gagcaugccuggauggggcug

SEQ ID NO: 1790850 - RNA, 13 nt, Human
gagcaugccugga

SEQ ID NO: 1790851 - RNA, 15 nt, Human
gagcaucaggccagg

SEQ ID NO: 1790852 - RNA, 16 nt, Human
gagcaucaggccaggc

SEQ ID NO: 1790853 - RNA, 14 nt, Human
gagcaucaggccag

SEQ ID NO: 1790854 - RNA, 20 nt, Human
gagagcugggugucaagagg

SEQ ID NO: 1790855 - RNA, 22 nt, Human
gagagcuucuguugcugccuca

SEQ ID NO: 1790856 - RNA, 12 nt, Human
gagaggaaauca

SEQ ID NO: 1790857 - RNA, 15 nt, Human
gagaggacccccuga

SEQ ID NO: 1790858 - RNA, 13 nt, Human
gagagcugggugu

SEQ ID NO: 1790859 - RNA, 15 nt, Human
gagagcuagcagcag

SEQ ID NO: 1790860 - RNA, 21 nt, Human
gagagcuagcagcagggaggg

SEQ ID NO: 1790861 - RNA, 18 nt, Human
gagagccuuccaggggug

SEQ ID NO: 1790862 - RNA, 20 nt, Human
gagagccuuccagggguggg

SEQ ID NO: 1790863 - RNA, 13 nt, Human
gagacuccugcag

SEQ ID NO: 1790864 - RNA, 14 nt, Human
gagacuccugcagg

SEQ ID NO: 1790865 - RNA, 15 nt, Human
gagagccuuccaggg

SEQ ID NO: 1790866 - RNA, 16 nt, Human
gagagccuuccagggg

SEQ ID NO: 1790867 - RNA, 15 nt, Human
gagauuauguucuuu

SEQ ID NO: 1790868 - RNA, 16 nt, Human
gagaugcuagaacucc

SEQ ID NO: 1790869 - RNA, 20 nt, Human
gagaugcuagaacucccuuu

SEQ ID NO: 1790870 - RNA, 14 nt, Human
gagauuggaaggaa

SEQ ID NO: 1790871 - RNA, 21 nt, Human
gagauugugccccugcacucc

SEQ ID NO: 1790872 - RNA, 23 nt, Human
gagaaugaaagggcccagagagg

SEQ ID NO: 1790873 - RNA, 15 nt, Human
gagaaugaaagggcc

SEQ ID NO: 1790874 - RNA, 14 nt, Human
gagacggaguccca

SEQ ID NO: 1790875 - RNA, 19 nt, Human
gagacggagucccaccuug

SEQ ID NO: 1790876 - RNA, 16 nt, Human
gagacggagucccacc

SEQ ID NO: 1790877 - RNA, 18 nt, Human
gagacgggggcagagagg

SEQ ID NO: 1790878 - RNA, 20 nt, Human
gacuuuuccaacccucauca

SEQ ID NO: 1790879 - RNA, 18 nt, Human
gacuuuuauuuccaguga

SEQ ID NO: 1790880 - RNA, 14 nt, Human
gacuuuuccaaccc

SEQ ID NO: 1790881 - RNA, 19 nt, Human
gacuuuuccaacccucauc

SEQ ID NO: 1790882 - RNA, 14 nt, Human
gaaaauuaacauga

SEQ ID NO: 1790883 - RNA, 18 nt, Human
gaaaauuaggauuucaug

SEQ ID NO: 1790884 - RNA, 22 nt, Human
gaaaauuaggauuucaugauuu

SEQ ID NO: 1790885 - RNA, 19 nt, Human
gaaaacugcaacuuguaaa

SEQ ID NO: 1790886 - RNA, 18 nt, Human
gaaaacuuguauuaugug

SEQ ID NO: 1790887 - RNA, 18 nt, Human
gaaaauuuugauguuuua

SEQ ID NO: 1790888 - RNA, 14 nt, Human
gaaaauuuuaaaaa

SEQ ID NO: 1790889 - RNA, 18 nt, Human
cuuuugugcauuaucuag

SEQ ID NO: 1790890 - RNA, 14 nt, Human
cuuuugugcauuau

SEQ ID NO: 1790891 - RNA, 14 nt, Human
cuuuuuuuuaaguu

SEQ ID NO: 1790892 - RNA, 14 nt, Human
gaaaaaauauauau

SEQ ID NO: 1790893 - RNA, 19 nt, Human
gaaaaaauauuuuccugcc

SEQ ID NO: 1790894 - RNA, 21 nt, Human
cuuuuuuuuuuuuuuugacaa

SEQ ID NO: 1790895 - RNA, 17 nt, Human
cuuuugucuaugggacu

SEQ ID NO: 1790896 - RNA, 16 nt, Human
cuuuuggucuguguga

SEQ ID NO: 1790897 - RNA, 15 nt, Human
cuuuuggucugugug

SEQ ID NO: 1790898 - RNA, 18 nt, Human
cuuuugccguuauuaaaa

SEQ ID NO: 1790899 - RNA, 19 nt, Human
cuuuuaugugaaacauguu

SEQ ID NO: 1790900 - RNA, 23 nt, Human
gaacaaauuuacagagacagaaa

SEQ ID NO: 1790901 - RNA, 19 nt, Human
gaaauuuuuauuaaauuau

SEQ ID NO: 1790902 - RNA, 18 nt, Human
gaacaaauuuacagagac

SEQ ID NO: 1790903 - RNA, 17 nt, Human
gaacaaauuuacagaga

SEQ ID NO: 1790904 - RNA, 17 nt, Human
gaaaucaccgaaaacgu

SEQ ID NO: 1790905 - RNA, 18 nt, Human
gaaauuuuuauuaaauua

SEQ ID NO: 1790906 - RNA, 18 nt, Human
gaaaugaaagcagggacu

SEQ ID NO: 1790907 - RNA, 21 nt, Human
gaaaguacuucuccacccugc

SEQ ID NO: 1790908 - RNA, 22 nt, Human
gaaaguacuucuccacccugcu

SEQ ID NO: 1790909 - RNA, 20 nt, Human
gaaaggcuccaggagcagcc

SEQ ID NO: 1790910 - RNA, 19 nt, Human
gaaaggcuccaggagcagc

SEQ ID NO: 1790911 - RNA, 17 nt, Human
gaaaggcuccaggagca

SEQ ID NO: 1790912 - RNA, 18 nt, Human
gaaaggcuccaggagcag

SEQ ID NO: 1790913 - RNA, 18 nt, Human
gaaagacuaucuaaaugu

SEQ ID NO: 1790914 - RNA, 18 nt, Human
gaaagaaguggggacaga

SEQ ID NO: 1790915 - RNA, 21 nt, Human
gaacaaggcaaggcugucaau

SEQ ID NO: 1790916 - RNA, 14 nt, Human
gaacaaggcaaggc

SEQ ID NO: 1790917 - RNA, 15 nt, Human
gaacaaggcaaggcu

SEQ ID NO: 1790918 - RNA, 17 nt, Human
gaacaaggcaaggcugu

SEQ ID NO: 1790919 - RNA, 18 nt, Human
gaacaaggcaaggcuguc

SEQ ID NO: 1790920 - RNA, 19 nt, Human
cuugauucauaaugacuua

SEQ ID NO: 1790921 - RNA, 19 nt, Human
cuugccgucuaccugaggg

SEQ ID NO: 1790922 - RNA, 18 nt, Human
cuugccgucuaccugagg

SEQ ID NO: 1790923 - RNA, 15 nt, Human
cuugauguguuaucu

SEQ ID NO: 1790924 - RNA, 21 nt, Human
cuuggcgcugccccuggcagc

SEQ ID NO: 1790925 - RNA, 22 nt, Human
cuuggcgcugccccuggcagcc

SEQ ID NO: 1790926 - RNA, 23 nt, Human
cuuggcgcugccccuggcagccc

SEQ ID NO: 1790927 - RNA, 22 nt, Human
cuuggauuguccccgacccuug

SEQ ID NO: 1790928 - RNA, 18 nt, Human
cuuggauuguccccgacc

SEQ ID NO: 1790929 - RNA, 20 nt, Human
cuuggauuguccccgacccu

SEQ ID NO: 1790930 - RNA, 15 nt, Human
cuuggauuguccccg

SEQ ID NO: 1790931 - RNA, 20 nt, Human
cuuuaaugucacaggcaggu

SEQ ID NO: 1790932 - RNA, 19 nt, Human
cuuuaaugucacaggcagg

SEQ ID NO: 1790933 - RNA, 18 nt, Human
cuuuaaugucacaggcag

SEQ ID NO: 1790934 - RNA, 17 nt, Human
cuuuaaugucacaggca

SEQ ID NO: 1790935 - RNA, 22 nt, Human
cuuuaaugucacaggcaggucc

SEQ ID NO: 1790936 - RNA, 14 nt, Human
cuuucaauaggaaa

SEQ ID NO: 1790937 - RNA, 15 nt, Human
cuuucaauaggaaaa

SEQ ID NO: 1790938 - RNA, 22 nt, Human
cuuuaaugauaugcuuguaacu

SEQ ID NO: 1790939 - RNA, 21 nt, Human
cuuuaaugauaugcuuguaac

SEQ ID NO: 1790940 - RNA, 16 nt, Human
cuuuaaugauaugcuu

SEQ ID NO: 1790941 - RNA, 21 nt, Human
cuugucuuuggacccugaggc

SEQ ID NO: 1790942 - RNA, 22 nt, Human
cuugucuuuggacccugaggcc

SEQ ID NO: 1790943 - RNA, 17 nt, Human
cuuucaauaggaaaaac

SEQ ID NO: 1790944 - RNA, 18 nt, Human
cuuucaauaggaaaaacu

SEQ ID NO: 1790945 - RNA, 13 nt, Human
cuugucuguagau

SEQ ID NO: 1790946 - RNA, 20 nt, Human
cuugucuuuggacccugagg

SEQ ID NO: 1790947 - RNA, 22 nt, Human
cuugguccugcugcaguugcca

SEQ ID NO: 1790948 - RNA, 23 nt, Human
cuuggucucagugucaaugcagc

SEQ ID NO: 1790949 - RNA, 20 nt, Human
cuugguucccauuugcuccu

SEQ ID NO: 1790950 - RNA, 16 nt, Human
cuugguucccauuugc

SEQ ID NO: 1790951 - RNA, 15 nt, Human
cuugguccugcugca

SEQ ID NO: 1790952 - RNA, 16 nt, Human
cuugguccugcugcag

SEQ ID NO: 1790953 - RNA, 17 nt, Human
cuugguccugcugcagu

SEQ ID NO: 1790954 - RNA, 18 nt, Human
cuugguccugcugcaguu

SEQ ID NO: 1790955 - RNA, 20 nt, Human
cuugguccugcugcaguugc

SEQ ID NO: 1790956 - RNA, 20 nt, Human
cuuacauuagcaguuugcuu

SEQ ID NO: 1790957 - RNA, 23 nt, Human
cuucugaacuuggcgcugccccu

SEQ ID NO: 1790958 - RNA, 18 nt, Human
cuucugacccaugcugcc

SEQ ID NO: 1790959 - RNA, 16 nt, Human
cuucugacccaugcug

SEQ ID NO: 1790960 - RNA, 17 nt, Human
cuucugacccaugcugc

SEQ ID NO: 1790961 - RNA, 13 nt, Human
cuucuuauacauu

SEQ ID NO: 1790962 - RNA, 16 nt, Human
cuucuuauacauuuga

SEQ ID NO: 1790963 - RNA, 12 nt, Human
cuuccucccucc

SEQ ID NO: 1790964 - RNA, 13 nt, Human
cuuccucccuccc

SEQ ID NO: 1790965 - RNA, 14 nt, Human
cuuccucccucccu

SEQ ID NO: 1790966 - RNA, 18 nt, Human
cuuccucccucccucuuu

SEQ ID NO: 1790967 - RNA, 16 nt, Human
cuuccucuccacugcc

SEQ ID NO: 1790968 - RNA, 17 nt, Human
cuuccucuccacugccu

SEQ ID NO: 1790969 - RNA, 19 nt, Human
cuuccucuccacugccuuc

SEQ ID NO: 1790970 - RNA, 21 nt, Human
cuuccucuccacugccuucga

SEQ ID NO: 1790971 - RNA, 11 nt, Human
cuuccucugcu

SEQ ID NO: 1790972 - RNA, 12 nt, Human
cuuccucugcug

SEQ ID NO: 1790973 - RNA, 13 nt, Human
cuuccucugcuga

SEQ ID NO: 1790974 - RNA, 19 nt, Human
cuucugaacuuggcgcugc

SEQ ID NO: 1790975 - RNA, 15 nt, Human
cuucugacccaugcu

SEQ ID NO: 1790976 - RNA, 22 nt, Human
cuucugaacuuggcgcugcccc

SEQ ID NO: 1790977 - RNA, 21 nt, Human
cuggucucgaacuccugaccu

SEQ ID NO: 1790978 - RNA, 18 nt, Human
cuggucuuauuuguaaag

SEQ ID NO: 1790979 - RNA, 12 nt, Human
cuggugccucac

SEQ ID NO: 1790980 - RNA, 16 nt, Human
cuguacuugcucuuga

SEQ ID NO: 1790981 - RNA, 19 nt, Human
cuguacuugcucuugaugc

SEQ ID NO: 1790982 - RNA, 20 nt, Human
cuguacuugcucuugaugcc

SEQ ID NO: 1790983 - RNA, 21 nt, Human
cuguacuugcucuugaugccu

SEQ ID NO: 1790984 - RNA, 15 nt, Human
cuguagagugggagc

SEQ ID NO: 1790985 - RNA, 16 nt, Human
cugguuuuucaguuuu

SEQ ID NO: 1790986 - RNA, 15 nt, Human
cugguuuuucaguuu

SEQ ID NO: 1790987 - RNA, 14 nt, Human
cugguuuuucaguu

SEQ ID NO: 1790988 - RNA, 18 nt, Human
cuguaggaagguuaaugu

SEQ ID NO: 1790989 - RNA, 20 nt, Human
cuguccugggagugagcugg

SEQ ID NO: 1790990 - RNA, 14 nt, Human
cuguccugggagug

SEQ ID NO: 1790991 - RNA, 13 nt, Human
cuguccugggagu

SEQ ID NO: 1790992 - RNA, 14 nt, Human
cugucauuugagca

SEQ ID NO: 1790993 - RNA, 15 nt, Human
cugucguuaaaaaca

SEQ ID NO: 1790994 - RNA, 22 nt, Human
cugucuaaugaaaccugugucu

SEQ ID NO: 1790995 - RNA, 19 nt, Human
cugugcucuggacaggcau

SEQ ID NO: 1790996 - RNA, 18 nt, Human
cugugcucuggacaggca

SEQ ID NO: 1790997 - RNA, 22 nt, Human
cugugucagguggggcagcuug

SEQ ID NO: 1790998 - RNA, 17 nt, Human
cuguuacugucuucagu

SEQ ID NO: 1790999 - RNA, 15 nt, Human
cuguucagcuccagc

SEQ ID NO: 1791000 - RNA, 13 nt, Human
cuguucacucuac

SEQ ID NO: 1791001 - RNA, 22 nt, Human
cuguucagcuccagcucaccag

SEQ ID NO: 1791002 - RNA, 19 nt, Human
cuguucagcuccagcucac

SEQ ID NO: 1791003 - RNA, 18 nt, Human
cuguucagcuccagcuca

SEQ ID NO: 1791004 - RNA, 16 nt, Human
cuguucagcuccagcu

SEQ ID NO: 1791005 - RNA, 12 nt, Human
cuguucagcugg

SEQ ID NO: 1791006 - RNA, 18 nt, Human
cuguucagcugguugagg

SEQ ID NO: 1791007 - RNA, 17 nt, Human
cugugcucuggacaggc

SEQ ID NO: 1791008 - RNA, 23 nt, Human
cugugagaugcuagaacucccuu

SEQ ID NO: 1791009 - RNA, 13 nt, Human
cugugaacugaac

SEQ ID NO: 1791010 - RNA, 15 nt, Human
cugugaacugaacuc

SEQ ID NO: 1791011 - RNA, 16 nt, Human
cugugaacugaacucu

SEQ ID NO: 1791012 - RNA, 15 nt, Human
cuguuggccagugug

SEQ ID NO: 1791013 - RNA, 12 nt, Human
cuguuggccagu

SEQ ID NO: 1791014 - RNA, 20 nt, Human
cuuaaaaaugguuuaaaugg

SEQ ID NO: 1791015 - RNA, 13 nt, Human
cuuaaaaaugguu

SEQ ID NO: 1791016 - RNA, 19 nt, Human
cuuaaauaaugugaaacug

SEQ ID NO: 1791017 - RNA, 16 nt, Human
cuuaaauaaugugaaa

SEQ ID NO: 1791018 - RNA, 14 nt, Human
cuuaaauaauguga

SEQ ID NO: 1791019 - RNA, 13 nt, Human
cuuaaauaaugug

SEQ ID NO: 1791020 - RNA, 17 nt, Human
cuggcagccgugccuuc

SEQ ID NO: 1791021 - RNA, 18 nt, Human
cuggcagccgugccuuca

SEQ ID NO: 1791022 - RNA, 16 nt, Human
cuggcagcucagagag

SEQ ID NO: 1791023 - RNA, 17 nt, Human
cuggcagcucagagagg

SEQ ID NO: 1791024 - RNA, 19 nt, Human
cuggcagcucagagagggu

SEQ ID NO: 1791025 - RNA, 19 nt, Human
cuggcucccacaggcccuu

SEQ ID NO: 1791026 - RNA, 18 nt, Human
cuggcucccacaggcccu

SEQ ID NO: 1791027 - RNA, 22 nt, Human
cuggcucccacaggcccuuccu

SEQ ID NO: 1791028 - RNA, 17 nt, Human
cugggacuacaggugug

SEQ ID NO: 1791029 - RNA, 21 nt, Human
cugggacuacaggcacccacc

SEQ ID NO: 1791030 - RNA, 17 nt, Human
cugggacuacaggcacc

SEQ ID NO: 1791031 - RNA, 13 nt, Human
cuggcucuuccag

SEQ ID NO: 1791032 - RNA, 14 nt, Human
cuggcucuuccagg

SEQ ID NO: 1791033 - RNA, 15 nt, Human
cuggcucuuccaggc

SEQ ID NO: 1791034 - RNA, 20 nt, Human
cuggcagaguugaagacaga

SEQ ID NO: 1791035 - RNA, 21 nt, Human
cuggcagaguugaagacagag

SEQ ID NO: 1791036 - RNA, 13 nt, Human
cuggcagccgugc

SEQ ID NO: 1791037 - RNA, 23 nt, Human
cuggcagccccuguucuggcaga

SEQ ID NO: 1791038 - RNA, 22 nt, Human
cuggcagaguugaagacagagc

SEQ ID NO: 1791039 - RNA, 14 nt, Human
cuggagaacuagag

SEQ ID NO: 1791040 - RNA, 15 nt, Human
cuggagaacuagaga

SEQ ID NO: 1791041 - RNA, 17 nt, Human
cuggauccaucaggcca

SEQ ID NO: 1791042 - RNA, 21 nt, Human
cuggagaaaauggacguguua

SEQ ID NO: 1791043 - RNA, 23 nt, Human
cuggacucuaaagucuguugauu

SEQ ID NO: 1791044 - RNA, 22 nt, Human
cuggacuccucuguccaggcac

SEQ ID NO: 1791045 - RNA, 23 nt, Human
cuggacuccucuguccaggcacu

SEQ ID NO: 1791046 - RNA, 14 nt, Human
cugcuuccagugag

SEQ ID NO: 1791047 - RNA, 14 nt, Human
cugcuucaaggauc

SEQ ID NO: 1791048 - RNA, 16 nt, Human
cugcuucaaggauccu

SEQ ID NO: 1791049 - RNA, 19 nt, Human
cugcuucaaggauccugag

SEQ ID NO: 1791050 - RNA, 20 nt, Human
cugcuucaaggauccugagc

SEQ ID NO: 1791051 - RNA, 18 nt, Human
cuggaugcagccucacag

SEQ ID NO: 1791052 - RNA, 19 nt, Human
cuggauccaucaggccacu

SEQ ID NO: 1791053 - RNA, 20 nt, Human
cuggaucuccauucucucag

SEQ ID NO: 1791054 - RNA, 16 nt, Human
cuggaugcagccucac

SEQ ID NO: 1791055 - RNA, 17 nt, Human
cuggaugcagccucaca

SEQ ID NO: 1791056 - RNA, 14 nt, Human
cugccuccuuugug

SEQ ID NO: 1791057 - RNA, 14 nt, Human
cugccucgaacugg

SEQ ID NO: 1791058 - RNA, 23 nt, Human
cugccuccuuugugaggaagccg

SEQ ID NO: 1791059 - RNA, 17 nt, Human
cugccuccuuugugagg

SEQ ID NO: 1791060 - RNA, 21 nt, Human
cugccuccuuugugaggaagc

SEQ ID NO: 1791061 - RNA, 20 nt, Human
cugccucgaacuggcugcaa

SEQ ID NO: 1791062 - RNA, 17 nt, Human
cugcuaucaaagagguu

SEQ ID NO: 1791063 - RNA, 24 nt, Human
cugcugaaggcucgagcaugccug

SEQ ID NO: 1791064 - RNA, 23 nt, Human
cugcugaaggcucgagcaugccu

SEQ ID NO: 1791065 - RNA, 18 nt, Human
cugcugaaggcucgagca

SEQ ID NO: 1791066 - RNA, 23 nt, Human
cugccuguucagcuccagcucac

SEQ ID NO: 1791067 - RNA, 20 nt, Human
cugccuguucagcuccagcu

SEQ ID NO: 1791068 - RNA, 15 nt, Human
cugccuguucccauu

SEQ ID NO: 1791069 - RNA, 19 nt, Human
cugccuguucccauucuug

SEQ ID NO: 1791070 - RNA, 11 nt, Human
cugcccugugg

SEQ ID NO: 1791071 - RNA, 12 nt, Human
cugcccuguggg

SEQ ID NO: 1791072 - RNA, 20 nt, Human
cugcccugguuuccugcccu

SEQ ID NO: 1791073 - RNA, 14 nt, Human
cugcccugugggcc

SEQ ID NO: 1791074 - RNA, 19 nt, Human
cugcccuuaccugccagga

SEQ ID NO: 1791075 - RNA, 22 nt, Human
cugcccuuaccugccaggaagc

SEQ ID NO: 1791076 - RNA, 23 nt, Human
cugcccuuaccugccaggaagcc

SEQ ID NO: 1791077 - RNA, 12 nt, Human
cugcccuggugc

SEQ ID NO: 1791078 - RNA, 13 nt, Human
cugcccuggugcu

SEQ ID NO: 1791079 - RNA, 14 nt, Human
cugcccuggugcug

SEQ ID NO: 1791080 - RNA, 15 nt, Human
cugcccuggugcugc

SEQ ID NO: 1791081 - RNA, 23 nt, Human
cugcccuggugcugccacacuuc

SEQ ID NO: 1791082 - RNA, 17 nt, Human
cugcccugguuuccugc

SEQ ID NO: 1791083 - RNA, 18 nt, Human
cugcccugguuuccugcc

SEQ ID NO: 1791084 - RNA, 19 nt, Human
cugcccugguuuccugccc

SEQ ID NO: 1791085 - RNA, 21 nt, Human
cugcccugguuuccugcccug

SEQ ID NO: 1791086 - RNA, 24 nt, Human
cugcccugugaguacuacaguccu

SEQ ID NO: 1791087 - RNA, 16 nt, Human
ccaacucaccccagcc

SEQ ID NO: 1791088 - RNA, 17 nt, Human
ccaacucaccccagccc

SEQ ID NO: 1791089 - RNA, 18 nt, Human
ccaacucaccccagcccc

SEQ ID NO: 1791090 - RNA, 18 nt, Human
ccaaauguucaucaauga

SEQ ID NO: 1791091 - RNA, 23 nt, Human
ccaaauggaaaugggcagagcag

SEQ ID NO: 1791092 - RNA, 14 nt, Human
ccaacucaccccag

SEQ ID NO: 1791093 - RNA, 17 nt, Human
ccaaauguucaucaaug

SEQ ID NO: 1791094 - RNA, 13 nt, Human
ccaagcucugcuc

SEQ ID NO: 1791095 - RNA, 17 nt, Human
ccaagcucugcuccucu

SEQ ID NO: 1791096 - RNA, 12 nt, Human
ccaagcucugcu

SEQ ID NO: 1791097 - RNA, 18 nt, Human
ccaagcucugcuccucuc

SEQ ID NO: 1791098 - RNA, 14 nt, Human
ccaaugcacuuugu

SEQ ID NO: 1791099 - RNA, 15 nt, Human
ccaaugauggucacc

SEQ ID NO: 1791100 - RNA, 17 nt, Human
ccaauauuuaccagacc

SEQ ID NO: 1791101 - RNA, 17 nt, Human
ccaaugggagcucaugg

SEQ ID NO: 1791102 - RNA, 22 nt, Human
cauuuuuuuuaagaaaaaggau

SEQ ID NO: 1791103 - RNA, 20 nt, Human
ccaaaacucuccucugcugc

SEQ ID NO: 1791104 - RNA, 21 nt, Human
ccaaaacucuccucugcugcu

SEQ ID NO: 1791105 - RNA, 21 nt, Human
ccaccuuugaagaaguaagga

SEQ ID NO: 1791106 - RNA, 13 nt, Human
ccaccgcagacag

SEQ ID NO: 1791107 - RNA, 22 nt, Human
ccaccgcagacaggaccaggga

SEQ ID NO: 1791108 - RNA, 16 nt, Human
ccacgcccccacuggu

SEQ ID NO: 1791109 - RNA, 17 nt, Human
ccacgcccccacuggug

SEQ ID NO: 1791110 - RNA, 13 nt, Human
ccacgcccggcua

SEQ ID NO: 1791111 - RNA, 18 nt, Human
ccacgcccccacugguga

SEQ ID NO: 1791112 - RNA, 19 nt, Human
ccacgcccccacuggugac

SEQ ID NO: 1791113 - RNA, 23 nt, Human
ccacagcgcuggccgggaccccg

SEQ ID NO: 1791114 - RNA, 15 nt, Human
ccaccaucaagccac

SEQ ID NO: 1791115 - RNA, 17 nt, Human
ccaccacacccagccca

SEQ ID NO: 1791116 - RNA, 14 nt, Human
ccacagcugcucaa

SEQ ID NO: 1791117 - RNA, 13 nt, Human
ccaccaucaagcc

SEQ ID NO: 1791118 - RNA, 14 nt, Human
ccaccaucaagcca

SEQ ID NO: 1791119 - RNA, 17 nt, Human
ccacucccugcaaccug

SEQ ID NO: 1791120 - RNA, 18 nt, Human
cauauucuguuggccagu

SEQ ID NO: 1791121 - RNA, 17 nt, Human
cauauucuguuggccag

SEQ ID NO: 1791122 - RNA, 16 nt, Human
cauauuaccacagaca

SEQ ID NO: 1791123 - RNA, 22 nt, Human
caguggugguuuucuguucuuu

SEQ ID NO: 1791124 - RNA, 21 nt, Human
caguggugguuuucuguucuu

SEQ ID NO: 1791125 - RNA, 20 nt, Human
caguggugguuuucuguucu

SEQ ID NO: 1791126 - RNA, 19 nt, Human
caguggugguuuucuguuc

SEQ ID NO: 1791127 - RNA, 15 nt, Human
cauccuggcacccgg

SEQ ID NO: 1791128 - RNA, 12 nt, Human
caucacuucccu

SEQ ID NO: 1791129 - RNA, 14 nt, Human
caucacuucccuac

SEQ ID NO: 1791130 - RNA, 22 nt, Human
cauccuggcacccggccccugc

SEQ ID NO: 1791131 - RNA, 23 nt, Human
cauccuggcacccggccccugcu

SEQ ID NO: 1791132 - RNA, 13 nt, Human
caugauguuuucc

SEQ ID NO: 1791133 - RNA, 23 nt, Human
caugcuacacacugcauguuugu

SEQ ID NO: 1791134 - RNA, 20 nt, Human
caugcuacacacugcauguu

SEQ ID NO: 1791135 - RNA, 14 nt, Human
caugcuacacacug

SEQ ID NO: 1791136 - RNA, 17 nt, Human
cauggcugccaauggga

SEQ ID NO: 1791137 - RNA, 14 nt, Human
caugggaaugaaug

SEQ ID NO: 1791138 - RNA, 15 nt, Human
caugggaaugaaugu

SEQ ID NO: 1791139 - RNA, 16 nt, Human
caugggaaugaauguc

SEQ ID NO: 1791140 - RNA, 17 nt, Human
caugggaaugaauguca

SEQ ID NO: 1791141 - RNA, 13 nt, Human
cauucuccaccug

SEQ ID NO: 1791142 - RNA, 14 nt, Human
cauucuccaccugc

SEQ ID NO: 1791143 - RNA, 16 nt, Human
cauucuccaccugcca

SEQ ID NO: 1791144 - RNA, 16 nt, Human
caugucccuaccgagu

SEQ ID NO: 1791145 - RNA, 22 nt, Human
caugucccuaccgagucucuuc

SEQ ID NO: 1791146 - RNA, 14 nt, Human
caugucaaacguga

SEQ ID NO: 1791147 - RNA, 19 nt, Human
caugucaaacgugaaaaug

SEQ ID NO: 1791148 - RNA, 23 nt, Human
caugucccuaccgagucucuucu

SEQ ID NO: 1791149 - RNA, 15 nt, Human
cauguuggccaggcu

SEQ ID NO: 1791150 - RNA, 14 nt, Human
cauguuggccaggc

SEQ ID NO: 1791151 - RNA, 16 nt, Human
cauguuggccaggcug

SEQ ID NO: 1791152 - RNA, 19 nt, Human
cagauccccaagccuggca

SEQ ID NO: 1791153 - RNA, 15 nt, Human
cagauccccaagccu

SEQ ID NO: 1791154 - RNA, 22 nt, Human
cagaggggguggccucccaacu

SEQ ID NO: 1791155 - RNA, 23 nt, Human
cagaggggguggccucccaacuc

SEQ ID NO: 1791156 - RNA, 21 nt, Human
cagaguaauccaagcaaaugu

SEQ ID NO: 1791157 - RNA, 15 nt, Human
cagagguccacaaca

SEQ ID NO: 1791158 - RNA, 20 nt, Human
cagagguccacaacacacag

SEQ ID NO: 1791159 - RNA, 16 nt, Human
cagagguugcagugag

SEQ ID NO: 1791160 - RNA, 17 nt, Human
cagagguugcagugagc

SEQ ID NO: 1791161 - RNA, 15 nt, Human
cagauucuuuccuga

SEQ ID NO: 1791162 - RNA, 17 nt, Human
cagauucuuuccugagg

SEQ ID NO: 1791163 - RNA, 18 nt, Human
cagauucuuuccugaggc

SEQ ID NO: 1791164 - RNA, 19 nt, Human
cagauucuuuccugaggcu

SEQ ID NO: 1791165 - RNA, 13 nt, Human
cagcauaauacuu

SEQ ID NO: 1791166 - RNA, 17 nt, Human
cagcauagaaguaacuu

SEQ ID NO: 1791167 - RNA, 17 nt, Human
cagauugcaacaggcug

SEQ ID NO: 1791168 - RNA, 20 nt, Human
cagauucuuuccugaggcug

SEQ ID NO: 1791169 - RNA, 22 nt, Human
cagauucuuuccugaggcuggg

SEQ ID NO: 1791170 - RNA, 20 nt, Human
cagcacgauuucuguuuaga

SEQ ID NO: 1791171 - RNA, 19 nt, Human
cagcacgauuucuguuuag

SEQ ID NO: 1791172 - RNA, 18 nt, Human
cagcacgauuucuguuua

SEQ ID NO: 1791173 - RNA, 16 nt, Human
cagcacgauuucuguu

SEQ ID NO: 1791174 - RNA, 20 nt, Human
cagcaucauggagguuugaa

SEQ ID NO: 1791175 - RNA, 13 nt, Human
cagccaguaaaug

SEQ ID NO: 1791176 - RNA, 20 nt, Human
cagcugugcucuggacaggc

SEQ ID NO: 1791177 - RNA, 15 nt, Human
cagcugccugggauc

SEQ ID NO: 1791178 - RNA, 24 nt, Human
cagcugugcucuggacaggcaugu

SEQ ID NO: 1791179 - RNA, 21 nt, Human
cagcuguuuaugcauagauaa

SEQ ID NO: 1791180 - RNA, 19 nt, Human
cagcugagggugagugggu

SEQ ID NO: 1791181 - RNA, 12 nt, Human
cagcugccuggg

SEQ ID NO: 1791182 - RNA, 12 nt, Human
cagcugccugca

SEQ ID NO: 1791183 - RNA, 13 nt, Human
cagcugccuggga

SEQ ID NO: 1791184 - RNA, 14 nt, Human
cagcugccugggau

SEQ ID NO: 1791185 - RNA, 16 nt, Human
caggaaaagcugcuga

SEQ ID NO: 1791186 - RNA, 15 nt, Human
caggaaaagcugcug

SEQ ID NO: 1791187 - RNA, 18 nt, Human
caggaaaagcugcugaca

SEQ ID NO: 1791188 - RNA, 21 nt, Human
cagcggggacagcuccuucug

SEQ ID NO: 1791189 - RNA, 19 nt, Human
cagcggggacagcuccuuc

SEQ ID NO: 1791190 - RNA, 18 nt, Human
cagcggggacagcuccuu

SEQ ID NO: 1791191 - RNA, 12 nt, Human
cagccugcucca

SEQ ID NO: 1791192 - RNA, 15 nt, Human
cagccugcuccagcu

SEQ ID NO: 1791193 - RNA, 19 nt, Human
cagccugcuaauuccccag

SEQ ID NO: 1791194 - RNA, 17 nt, Human
cagccucugaaaaccaa

SEQ ID NO: 1791195 - RNA, 19 nt, Human
cagccgagauagccaaggc

SEQ ID NO: 1791196 - RNA, 20 nt, Human
cagccgagauagccaaggcc

SEQ ID NO: 1791197 - RNA, 22 nt, Human
caggugcacaagcuccaagcuc

SEQ ID NO: 1791198 - RNA, 21 nt, Human
caggugcacaagcuccaagcu

SEQ ID NO: 1791199 - RNA, 22 nt, Human
cagguugucugaagucacugca

SEQ ID NO: 1791200 - RNA, 23 nt, Human
cagguugucugaagucacugcac

SEQ ID NO: 1791201 - RNA, 23 nt, Human
caguaaagaacaucccuccuggg

SEQ ID NO: 1791202 - RNA, 14 nt, Human
cagguuuaagcugu

SEQ ID NO: 1791203 - RNA, 12 nt, Human
cagguuuuccug

SEQ ID NO: 1791204 - RNA, 16 nt, Human
cagguuuuccugaaga

SEQ ID NO: 1791205 - RNA, 23 nt, Human
caggugauccacccaccucagcc

SEQ ID NO: 1791206 - RNA, 22 nt, Human
caggugauccacccaccucagc

SEQ ID NO: 1791207 - RNA, 15 nt, Human
caggugcacaagcuc

SEQ ID NO: 1791208 - RNA, 17 nt, Human
caggugcacaagcucca

SEQ ID NO: 1791209 - RNA, 18 nt, Human
caggugcacaagcuccaa

SEQ ID NO: 1791210 - RNA, 19 nt, Human
caggugcacaagcuccaag

SEQ ID NO: 1791211 - RNA, 20 nt, Human
caggugcacaagcuccaagc

SEQ ID NO: 1791212 - RNA, 21 nt, Human
caggugauccacccaccucag

SEQ ID NO: 1791213 - RNA, 15 nt, Human
cagucacauuccaag

SEQ ID NO: 1791214 - RNA, 12 nt, Human
cagugcaucuca

SEQ ID NO: 1791215 - RNA, 17 nt, Human
cagucuggaaugcagug

SEQ ID NO: 1791216 - RNA, 15 nt, Human
cagucuggaaugcag

SEQ ID NO: 1791217 - RNA, 15 nt, Human
cagugcaucucagcc

SEQ ID NO: 1791218 - RNA, 16 nt, Human
cagugcaucucagccc

SEQ ID NO: 1791219 - RNA, 17 nt, Human
cagugcaucucagccca

SEQ ID NO: 1791220 - RNA, 18 nt, Human
cagugcaucucagcccac

SEQ ID NO: 1791221 - RNA, 13 nt, Human
cagugcaugcugu

SEQ ID NO: 1791222 - RNA, 14 nt, Human
cagugcaugcuguc

SEQ ID NO: 1791223 - RNA, 18 nt, Human
cagugcccacaggaucag

SEQ ID NO: 1791224 - RNA, 23 nt, Human
cagugggagcugccuguucagcu

SEQ ID NO: 1791225 - RNA, 20 nt, Human
cagugggagcugccuguuca

SEQ ID NO: 1791226 - RNA, 17 nt, Human
cagugcccacaggauca

SEQ ID NO: 1791227 - RNA, 15 nt, Human
cagugcccacaggau

SEQ ID NO: 1791228 - RNA, 13 nt, Human
cagugcccacagg

SEQ ID NO: 1791229 - RNA, 16 nt, Human
cagugcaugcuguccc

SEQ ID NO: 1791230 - RNA, 17 nt, Human
cagugcaugcugucccu

SEQ ID NO: 1791231 - RNA, 21 nt, Human
caguggugcgaucuggguuca

SEQ ID NO: 1791232 - RNA, 18 nt, Human
caguggugguuuucuguu

SEQ ID NO: 1791233 - RNA, 20 nt, Human
caguggggaggggcuguggg

SEQ ID NO: 1791234 - RNA, 20 nt, Human
caggcugggcuucaguggca

SEQ ID NO: 1791235 - RNA, 15 nt, Human
caggcugggagagcc

SEQ ID NO: 1791236 - RNA, 12 nt, Human
caggcugggaga

SEQ ID NO: 1791237 - RNA, 14 nt, Human
caggcugggagagc

SEQ ID NO: 1791238 - RNA, 22 nt, Human
caggcugggcuucaguggcagc

SEQ ID NO: 1791239 - RNA, 21 nt, Human
caggcugggcuucaguggcag

SEQ ID NO: 1791240 - RNA, 23 nt, Human
cagggcucagcggggacagcucc

SEQ ID NO: 1791241 - RNA, 21 nt, Human
cagggcucagcggggacagcu

SEQ ID NO: 1791242 - RNA, 20 nt, Human
caggggaaaaucagccugcu

SEQ ID NO: 1791243 - RNA, 19 nt, Human
caggggaaaaucagccugc

SEQ ID NO: 1791244 - RNA, 16 nt, Human
caggccagagggagug

SEQ ID NO: 1791245 - RNA, 20 nt, Human
caggccaggcccucugccca

SEQ ID NO: 1791246 - RNA, 19 nt, Human
caggccaggcccucugccc

SEQ ID NO: 1791247 - RNA, 17 nt, Human
caggccaggcccucugc

SEQ ID NO: 1791248 - RNA, 18 nt, Human
caggccaggcccucugcc

SEQ ID NO: 1791249 - RNA, 17 nt, Human
caggccagcugcuuggg

SEQ ID NO: 1791250 - RNA, 19 nt, Human
caggccagcugcuugggcu

SEQ ID NO: 1791251 - RNA, 21 nt, Human
caggccagcugcuugggcuuc

SEQ ID NO: 1791252 - RNA, 23 nt, Human
caggccagcugcuugggcuucau

SEQ ID NO: 1791253 - RNA, 15 nt, Human
caggccagagggagu

SEQ ID NO: 1791254 - RNA, 13 nt, Human
caggccagaggga

SEQ ID NO: 1791255 - RNA, 18 nt, Human
caggcagauacaggaaaa

SEQ ID NO: 1791256 - RNA, 15 nt, Human
caggccacuugauga

SEQ ID NO: 1791257 - RNA, 17 nt, Human
cacuguugcccaggcug

SEQ ID NO: 1791258 - RNA, 19 nt, Human
cacuguuucaaacuuuacu

SEQ ID NO: 1791259 - RNA, 17 nt, Human
cacuuagaaauugcauu

SEQ ID NO: 1791260 - RNA, 19 nt, Human
cacuuagaaauugcauuuc

SEQ ID NO: 1791261 - RNA, 20 nt, Human
cacuuagaaauugcauuucc

SEQ ID NO: 1791262 - RNA, 20 nt, Human
cacuuggucugugagaugcu

SEQ ID NO: 1791263 - RNA, 17 nt, Human
cacuuggucugugagau

SEQ ID NO: 1791264 - RNA, 16 nt, Human
cacuguugcccaggcu

SEQ ID NO: 1791265 - RNA, 15 nt, Human
cacuguugcccaggc

SEQ ID NO: 1791266 - RNA, 13 nt, Human
cacugguggcccg

SEQ ID NO: 1791267 - RNA, 21 nt, Human
cacugguggcccgacagccug

SEQ ID NO: 1791268 - RNA, 22 nt, Human
cacugguggcccgacagccugg

SEQ ID NO: 1791269 - RNA, 17 nt, Human
cacuggugacaugucuu

SEQ ID NO: 1791270 - RNA, 23 nt, Human
cacugggcuuggggaccagagcu

SEQ ID NO: 1791271 - RNA, 22 nt, Human
cacugggcuuggggaccagagc

SEQ ID NO: 1791272 - RNA, 23 nt, Human
cagaaguuucugccgcagcccug

SEQ ID NO: 1791273 - RNA, 22 nt, Human
cagaaguuucugccgcagcccu

SEQ ID NO: 1791274 - RNA, 20 nt, Human
cagaaguuucugccgcagcc

SEQ ID NO: 1791275 - RNA, 21 nt, Human
cagaaguuucugccgcagccc

SEQ ID NO: 1791276 - RNA, 22 nt, Human
cagaauauuagugaccucagcu

SEQ ID NO: 1791277 - RNA, 17 nt, Human
cagaaauguguuaucac

SEQ ID NO: 1791278 - RNA, 15 nt, Human
cagaacacauaauuc

SEQ ID NO: 1791279 - RNA, 23 nt, Human
cacuacggaauaguuggcuagga

SEQ ID NO: 1791280 - RNA, 20 nt, Human
cacggagggugacgggggug

SEQ ID NO: 1791281 - RNA, 16 nt, Human
cacggccaggccagag

SEQ ID NO: 1791282 - RNA, 15 nt, Human
cacggccaggccaga

SEQ ID NO: 1791283 - RNA, 14 nt, Human
cacggccaggccag

SEQ ID NO: 1791284 - RNA, 19 nt, Human
cacucuuauugcccacgcu

SEQ ID NO: 1791285 - RNA, 18 nt, Human
cacucuuauugcccacgc

SEQ ID NO: 1791286 - RNA, 17 nt, Human
cacucuuauugcccacg

SEQ ID NO: 1791287 - RNA, 17 nt, Human
cacucuugaaaaaugca

SEQ ID NO: 1791288 - RNA, 21 nt, Human
caccuacaugagguacugaga

SEQ ID NO: 1791289 - RNA, 14 nt, Human
caccugccagggac

SEQ ID NO: 1791290 - RNA, 16 nt, Human
caccugccagggacag

SEQ ID NO: 1791291 - RNA, 20 nt, Human
caccuaccaccacgcccggc

SEQ ID NO: 1791292 - RNA, 13 nt, Human
caccuuggcucaa

SEQ ID NO: 1791293 - RNA, 14 nt, Human
caccuuggcucaag

SEQ ID NO: 1791294 - RNA, 19 nt, Human
caccuugacagggcacacc

SEQ ID NO: 1791295 - RNA, 17 nt, Human
caccugccagggacaga

SEQ ID NO: 1791296 - RNA, 14 nt, Human
caccuuuauucugg

SEQ ID NO: 1791297 - RNA, 14 nt, Human
caccuuugaagaag

SEQ ID NO: 1791298 - RNA, 17 nt, Human
caccuuuguccccaccg

SEQ ID NO: 1791299 - RNA, 14 nt, Human
caccuuugucccca

SEQ ID NO: 1791300 - RNA, 15 nt, Human
caccuuuguccccac

SEQ ID NO: 1791301 - RNA, 13 nt, Human
caaguauuauacc

SEQ ID NO: 1791302 - RNA, 22 nt, Human
caaguaauccaccugccucggc

SEQ ID NO: 1791303 - RNA, 12 nt, Human
caauuuaaaaaa

SEQ ID NO: 1791304 - RNA, 14 nt, Human
cacaagacccuugu

SEQ ID NO: 1791305 - RNA, 16 nt, Human
cacaagacccuugugg

SEQ ID NO: 1791306 - RNA, 14 nt, Human
cacaagccuucggc

SEQ ID NO: 1791307 - RNA, 23 nt, Human
caaugcuggcuguuggcuggggg

SEQ ID NO: 1791308 - RNA, 22 nt, Human
caaugcuggcuguuggcugggg

SEQ ID NO: 1791309 - RNA, 19 nt, Human
caauucuccugccucagcc

SEQ ID NO: 1791310 - RNA, 17 nt, Human
caauucuccugccucag

SEQ ID NO: 1791311 - RNA, 22 nt, Human
caaugcugugcccuaaagugua

SEQ ID NO: 1791312 - RNA, 17 nt, Human
cacaucuugcucugcug

SEQ ID NO: 1791313 - RNA, 16 nt, Human
cacaucuugcucugcu

SEQ ID NO: 1791314 - RNA, 22 nt, Human
cacaucagcacgauuucuguuu

SEQ ID NO: 1791315 - RNA, 21 nt, Human
cacaucagcacgauuucuguu

SEQ ID NO: 1791316 - RNA, 20 nt, Human
cacaucagcacgauuucugu

SEQ ID NO: 1791317 - RNA, 18 nt, Human
cacaucuugcucugcuga

SEQ ID NO: 1791318 - RNA, 19 nt, Human
cacaucuugcucugcugac

SEQ ID NO: 1791319 - RNA, 14 nt, Human
cacauuuuucagau

SEQ ID NO: 1791320 - RNA, 15 nt, Human
cacauuuuauuuuau

SEQ ID NO: 1791321 - RNA, 21 nt, Human
cacauuuuuuaaaugcaccug

SEQ ID NO: 1791322 - RNA, 17 nt, Human
cacauuuuuuaaaugca

SEQ ID NO: 1791323 - RNA, 14 nt, Human
cacauuuuucuuag

SEQ ID NO: 1791324 - RNA, 13 nt, Human
cacauuuuucuua

SEQ ID NO: 1791325 - RNA, 18 nt, Human
cacauuuuucagauauaa

SEQ ID NO: 1791326 - RNA, 20 nt, Human
caccaacauacucccaucug

SEQ ID NO: 1791327 - RNA, 21 nt, Human
caccaacauacucccaucugu

SEQ ID NO: 1791328 - RNA, 23 nt, Human
cacccaggagccccgaggccuuc

SEQ ID NO: 1791329 - RNA, 20 nt, Human
cacccaggagccccgaggcc

SEQ ID NO: 1791330 - RNA, 19 nt, Human
cacccagcccacuucugcc

SEQ ID NO: 1791331 - RNA, 24 nt, Human
cacccaggagccccgaggccuucu

SEQ ID NO: 1791332 - RNA, 21 nt, Human
caccagcccuuagcagggaaa

SEQ ID NO: 1791333 - RNA, 15 nt, Human
caccagcagccugga

SEQ ID NO: 1791334 - RNA, 23 nt, Human
caccaacauacucccaucuguga

SEQ ID NO: 1791335 - RNA, 14 nt, Human
caccagcagccugg

SEQ ID NO: 1791336 - RNA, 12 nt, Human
caccagcagccu

SEQ ID NO: 1791337 - RNA, 17 nt, Human
cacccagcccacuucug

SEQ ID NO: 1791338 - RNA, 16 nt, Human
cacccagcccacuucu

SEQ ID NO: 1791339 - RNA, 19 nt, Human
cacaguauuacuucugcua

SEQ ID NO: 1791340 - RNA, 18 nt, Human
cacaguauuacuucugcu

SEQ ID NO: 1791341 - RNA, 16 nt, Human
cacaguauuacuucug

SEQ ID NO: 1791342 - RNA, 10 nt, Human
cacagcucuu

SEQ ID NO: 1791343 - RNA, 23 nt, Human
cacagcucuguccugggagugag

SEQ ID NO: 1791344 - RNA, 20 nt, Human
cacagcucuguccugggagu

SEQ ID NO: 1791345 - RNA, 22 nt, Human
cacagcuaacauggaaguacua

SEQ ID NO: 1791346 - RNA, 19 nt, Human
cacagacccugcccugugg

SEQ ID NO: 1791347 - RNA, 20 nt, Human
cacagacccugcccuguggg

SEQ ID NO: 1791348 - RNA, 21 nt, Human
cacagacccugcccugugggc

SEQ ID NO: 1791349 - RNA, 18 nt, Human
cacagacauacuaaccag

SEQ ID NO: 1791350 - RNA, 22 nt, Human
cacagacccugcccugugggcc

SEQ ID NO: 1791351 - RNA, 15 nt, Human
cacagcuaacaugga

SEQ ID NO: 1791352 - RNA, 16 nt, Human
cacagcuaacauggaa

SEQ ID NO: 1791353 - RNA, 18 nt, Human
auuuugauccaagcuggu

SEQ ID NO: 1791354 - RNA, 16 nt, Human
auuuguuugaacugau

SEQ ID NO: 1791355 - RNA, 14 nt, Human
auuuguuugaacug

SEQ ID NO: 1791356 - RNA, 20 nt, Human
auuuguuugaacugauaaag

SEQ ID NO: 1791357 - RNA, 20 nt, Human
auuuguuucuuucucugagg

SEQ ID NO: 1791358 - RNA, 13 nt, Human
auuuguuugaacu

SEQ ID NO: 1791359 - RNA, 20 nt, Human
auuuuuaaagaaaaguuuug

SEQ ID NO: 1791360 - RNA, 17 nt, Human
auuuuuuuuuccuucag

SEQ ID NO: 1791361 - RNA, 12 nt, Human
auuuuuuuuucc

SEQ ID NO: 1791362 - RNA, 13 nt, Human
auuuuuuuuuccu

SEQ ID NO: 1791363 - RNA, 16 nt, Human
auuuuuuuuuccuuca

SEQ ID NO: 1791364 - RNA, 13 nt, Human
auuuuuaagugcu

SEQ ID NO: 1791365 - RNA, 19 nt, Human
caaaagcugggcagguugg

SEQ ID NO: 1791366 - RNA, 15 nt, Human
caaaagcugggcagg

SEQ ID NO: 1791367 - RNA, 17 nt, Human
caacccccagccugcua

SEQ ID NO: 1791368 - RNA, 16 nt, Human
caacccccagccugcu

SEQ ID NO: 1791369 - RNA, 15 nt, Human
caacccccagccugc

SEQ ID NO: 1791370 - RNA, 18 nt, Human
caacuaugauuuggaaaa

SEQ ID NO: 1791371 - RNA, 19 nt, Human
caacuaugauuuggaaaau

SEQ ID NO: 1791372 - RNA, 22 nt, Human
caacuaugauuuggaaaauaaa

SEQ ID NO: 1791373 - RNA, 17 nt, Human
caacuaugauuuggaaa

SEQ ID NO: 1791374 - RNA, 14 nt, Human
caaccauuugaaac

SEQ ID NO: 1791375 - RNA, 14 nt, Human
caaccauuccccau

SEQ ID NO: 1791376 - RNA, 19 nt, Human
caacccaaauguucaucaa

SEQ ID NO: 1791377 - RNA, 17 nt, Human
caacucaccccagcccc

SEQ ID NO: 1791378 - RNA, 16 nt, Human
caacucaccccagccc

SEQ ID NO: 1791379 - RNA, 13 nt, Human
caacucaccccag

SEQ ID NO: 1791380 - RNA, 15 nt, Human
caacucaccccagcc

SEQ ID NO: 1791381 - RNA, 22 nt, Human
caagacccuuguggucccaccc

SEQ ID NO: 1791382 - RNA, 18 nt, Human
caagacccuugugguccc

SEQ ID NO: 1791383 - RNA, 19 nt, Human
caagacccuugugguccca

SEQ ID NO: 1791384 - RNA, 13 nt, Human
caagacacaguga

SEQ ID NO: 1791385 - RNA, 18 nt, Human
caaccacugcgaccacaa

SEQ ID NO: 1791386 - RNA, 23 nt, Human
caacaaaccuguuucugcagcca

SEQ ID NO: 1791387 - RNA, 13 nt, Human
caaaugcagcuuu

SEQ ID NO: 1791388 - RNA, 21 nt, Human
caaaucugcuuuuuaaagaau

SEQ ID NO: 1791389 - RNA, 22 nt, Human
caaauccagccugcugccugcu

SEQ ID NO: 1791390 - RNA, 17 nt, Human
caaaucagcugcuacua

SEQ ID NO: 1791391 - RNA, 13 nt, Human
caaagaugcagcc

SEQ ID NO: 1791392 - RNA, 14 nt, Human
caaagaugcagccg

SEQ ID NO: 1791393 - RNA, 20 nt, Human
caaaguacacuguuucaaac

SEQ ID NO: 1791394 - RNA, 16 nt, Human
caaaguacacuguuuc

SEQ ID NO: 1791395 - RNA, 21 nt, Human
caaaguacacuguuucaaacu

SEQ ID NO: 1791396 - RNA, 13 nt, Human
caacacaaagauu

SEQ ID NO: 1791397 - RNA, 22 nt, Human
caacaccucugcacaagcugca

SEQ ID NO: 1791398 - RNA, 20 nt, Human
caacaccuuguuucccucuc

SEQ ID NO: 1791399 - RNA, 18 nt, Human
auucacaagacccaaaag

SEQ ID NO: 1791400 - RNA, 18 nt, Human
auuaaauucuugcaaagu

SEQ ID NO: 1791401 - RNA, 14 nt, Human
auuaaauucuugca

SEQ ID NO: 1791402 - RNA, 20 nt, Human
auuaaauucuugcaaaguau

SEQ ID NO: 1791403 - RNA, 20 nt, Human
auuauguguguuuuaaaaug

SEQ ID NO: 1791404 - RNA, 21 nt, Human
auuauguguguuuuaaaauga

SEQ ID NO: 1791405 - RNA, 15 nt, Human
auuauguguguuuua

SEQ ID NO: 1791406 - RNA, 20 nt, Human
auucauauuuacuucuuaua

SEQ ID NO: 1791407 - RNA, 18 nt, Human
auucauauuuacuucuua

SEQ ID NO: 1791408 - RNA, 19 nt, Human
auucauauuuacuucuuau

SEQ ID NO: 1791409 - RNA, 17 nt, Human
auucuugccaaauauaa

SEQ ID NO: 1791410 - RNA, 18 nt, Human
auucugaccuuaaaugca

SEQ ID NO: 1791411 - RNA, 21 nt, Human
auucucuccuguaccucuuga

SEQ ID NO: 1791412 - RNA, 19 nt, Human
auucucuccuguaccucuu

SEQ ID NO: 1791413 - RNA, 21 nt, Human
auuccugaugcuucuucagag

SEQ ID NO: 1791414 - RNA, 17 nt, Human
auucuuuccugaggcug

SEQ ID NO: 1791415 - RNA, 22 nt, Human
auucuuuccugaggcugggcuc

SEQ ID NO: 1791416 - RNA, 16 nt, Human
auugauccagaaagaa

SEQ ID NO: 1791417 - RNA, 17 nt, Human
auugauccagaaagaaa

SEQ ID NO: 1791418 - RNA, 23 nt, Human
auuguaauaggcguaacuaauuu

SEQ ID NO: 1791419 - RNA, 16 nt, Human
auuguaaggaaugauu

SEQ ID NO: 1791420 - RNA, 18 nt, Human
auuguaagcaugcacaaa

SEQ ID NO: 1791421 - RNA, 15 nt, Human
auuguaaggaaugau

SEQ ID NO: 1791422 - RNA, 18 nt, Human
auugauccagaaagaaaa

SEQ ID NO: 1791423 - RNA, 19 nt, Human
auugauccagaaagaaaac

SEQ ID NO: 1791424 - RNA, 22 nt, Human
auugauccagaaagaaaacuug

SEQ ID NO: 1791425 - RNA, 23 nt, Human
auuguaaaagcauuuuguaauaa

SEQ ID NO: 1791426 - RNA, 21 nt, Human
auuguaaaagcauuuuguaau

SEQ ID NO: 1791427 - RNA, 20 nt, Human
auuguaaaagcauuuuguaa

SEQ ID NO: 1791428 - RNA, 19 nt, Human
auuguaaaagcauuuugua

SEQ ID NO: 1791429 - RNA, 13 nt, Human
auuguaaaauggu

SEQ ID NO: 1791430 - RNA, 13 nt, Human
auuguaaaagcau

SEQ ID NO: 1791431 - RNA, 18 nt, Human
auugaugggauuugguca

SEQ ID NO: 1791432 - RNA, 19 nt, Human
auuguucuuaguuugcagu

SEQ ID NO: 1791433 - RNA, 13 nt, Human
auuguacaguuuu

SEQ ID NO: 1791434 - RNA, 16 nt, Human
auuucagcagcugcag

SEQ ID NO: 1791435 - RNA, 15 nt, Human
auuucagauuuguga

SEQ ID NO: 1791436 - RNA, 17 nt, Human
auuuaauggggaggaca

SEQ ID NO: 1791437 - RNA, 14 nt, Human
auuuaaugaaagac

SEQ ID NO: 1791438 - RNA, 16 nt, Human
auuucuguuuagauaa

SEQ ID NO: 1791439 - RNA, 14 nt, Human
auuucuguuuagau

SEQ ID NO: 1791440 - RNA, 12 nt, Human
auuucuguuuag

SEQ ID NO: 1791441 - RNA, 20 nt, Human
ccauaauuuuuuuuuuccuu

SEQ ID NO: 1791442 - RNA, 23 nt, Human
ccaucccaaacccuucagugcca

SEQ ID NO: 1791443 - RNA, 12 nt, Human
ccaucccagccc

SEQ ID NO: 1791444 - RNA, 13 nt, Human
ccaugggccuccu

SEQ ID NO: 1791445 - RNA, 16 nt, Human
ccaugaguccccuguu

SEQ ID NO: 1791446 - RNA, 14 nt, Human
ccaugaguccccug

SEQ ID NO: 1791447 - RNA, 15 nt, Human
ccaugaguccccugu

SEQ ID NO: 1791448 - RNA, 19 nt, Human
ccaugagccucagcauccu

SEQ ID NO: 1791449 - RNA, 13 nt, Human
ccaugaguccccu

SEQ ID NO: 1791450 - RNA, 18 nt, Human
ccaugagccucagcaucc

SEQ ID NO: 1791451 - RNA, 14 nt, Human
ccaugagccucagc

SEQ ID NO: 1791452 - RNA, 16 nt, Human
ccauccccuguagagu

SEQ ID NO: 1791453 - RNA, 22 nt, Human
ccauccccuguagagugggagc

SEQ ID NO: 1791454 - RNA, 20 nt, Human
ccauuuaauggggaggacaa

SEQ ID NO: 1791455 - RNA, 15 nt, Human
ccaugggccuccugu

SEQ ID NO: 1791456 - RNA, 14 nt, Human
ccaugggccuccug

SEQ ID NO: 1791457 - RNA, 17 nt, Human
ccaugggccuccugugu

SEQ ID NO: 1791458 - RNA, 12 nt, Human
ccagucaccccg

SEQ ID NO: 1791459 - RNA, 13 nt, Human
ccagucaccccgg

SEQ ID NO: 1791460 - RNA, 20 nt, Human
ccagucaccccggccaccug

SEQ ID NO: 1791461 - RNA, 21 nt, Human
ccagucaccccggccaccugc

SEQ ID NO: 1791462 - RNA, 14 nt, Human
ccagucccccugcc

SEQ ID NO: 1791463 - RNA, 17 nt, Human
ccaggcaacuugggaac

SEQ ID NO: 1791464 - RNA, 13 nt, Human
ccaggcugggaga

SEQ ID NO: 1791465 - RNA, 14 nt, Human
ccaggcugggagag

SEQ ID NO: 1791466 - RNA, 22 nt, Human
ccaggauguacaaggacagccc

SEQ ID NO: 1791467 - RNA, 15 nt, Human
ccaggcugggagagc

SEQ ID NO: 1791468 - RNA, 17 nt, Human
ccaggcugggagagccu

SEQ ID NO: 1791469 - RNA, 18 nt, Human
ccaggcugggagagccuu

SEQ ID NO: 1791470 - RNA, 21 nt, Human
ccaggcugggagagccuucca

SEQ ID NO: 1791471 - RNA, 22 nt, Human
ccaggcugggagagccuuccag

SEQ ID NO: 1791472 - RNA, 18 nt, Human
ccagcuugaaaccuucac

SEQ ID NO: 1791473 - RNA, 20 nt, Human
ccagcuugaaaccuucacuu

SEQ ID NO: 1791474 - RNA, 21 nt, Human
ccaggaaaggcuccaggagca

SEQ ID NO: 1791475 - RNA, 22 nt, Human
ccaggaaaggcuccaggagcag

SEQ ID NO: 1791476 - RNA, 23 nt, Human
ccaggaaaggcuccaggagcagc

SEQ ID NO: 1791477 - RNA, 19 nt, Human
ccagcagccuggacccugu

SEQ ID NO: 1791478 - RNA, 20 nt, Human
ccagcagccuggacccugug

SEQ ID NO: 1791479 - RNA, 15 nt, Human
ccagcagccuggacc

SEQ ID NO: 1791480 - RNA, 14 nt, Human
ccagcagccuggac

SEQ ID NO: 1791481 - RNA, 10 nt, Human
ccagccccuu

SEQ ID NO: 1791482 - RNA, 21 nt, Human
ccagccccuggaugcagccuc

SEQ ID NO: 1791483 - RNA, 23 nt, Human
ccagcagagcaccuuagacaguc

SEQ ID NO: 1791484 - RNA, 19 nt, Human
ccagcagagcaccuuagac

SEQ ID NO: 1791485 - RNA, 23 nt, Human
cccagcugugcucuggacaggca

SEQ ID NO: 1791486 - RNA, 21 nt, Human
cccagcugugcucuggacagg

SEQ ID NO: 1791487 - RNA, 11 nt, Human
cccagcuguuu

SEQ ID NO: 1791488 - RNA, 22 nt, Human
cccagcuuaaaggggcuagagu

SEQ ID NO: 1791489 - RNA, 19 nt, Human
cccaggaaaggcuccagga

SEQ ID NO: 1791490 - RNA, 23 nt, Human
cccaggaaaggcuccaggagcag

SEQ ID NO: 1791491 - RNA, 21 nt, Human
cccaggaaaggcuccaggagc

SEQ ID NO: 1791492 - RNA, 22 nt, Human
cccaggaaaggcuccaggagca

SEQ ID NO: 1791493 - RNA, 15 nt, Human
cccaggcuuagucac

SEQ ID NO: 1791494 - RNA, 20 nt, Human
cccaggcuuagucacugaga

SEQ ID NO: 1791495 - RNA, 21 nt, Human
cccaggcuggcgugcaguggu

SEQ ID NO: 1791496 - RNA, 14 nt, Human
cccagcccacuucu

SEQ ID NO: 1791497 - RNA, 17 nt, Human
cccagcccacuucugcc

SEQ ID NO: 1791498 - RNA, 22 nt, Human
cccauucugccugcccaggccc

SEQ ID NO: 1791499 - RNA, 21 nt, Human
cccauucugccugcccaggcc

SEQ ID NO: 1791500 - RNA, 20 nt, Human
cccauucugccugcccaggc

SEQ ID NO: 1791501 - RNA, 21 nt, Human
ccccagcaagugagagcuggg

SEQ ID NO: 1791502 - RNA, 17 nt, Human
ccccauccucuguacag

SEQ ID NO: 1791503 - RNA, 20 nt, Human
ccccagcaagugagagcugg

SEQ ID NO: 1791504 - RNA, 19 nt, Human
ccccagcaagugagagcug

SEQ ID NO: 1791505 - RNA, 22 nt, Human
ccccauccucuguacagagccc

SEQ ID NO: 1791506 - RNA, 19 nt, Human
ccccauccucuguacagag

SEQ ID NO: 1791507 - RNA, 21 nt, Human
ccccauccucuguacagagcc

SEQ ID NO: 1791508 - RNA, 17 nt, Human
ccccagcaagugagagc

SEQ ID NO: 1791509 - RNA, 23 nt, Human
ccccagauugcaacaggcugggc

SEQ ID NO: 1791510 - RNA, 22 nt, Human
ccccagauugcaacaggcuggg

SEQ ID NO: 1791511 - RNA, 21 nt, Human
ccccagauugcaacaggcugg

SEQ ID NO: 1791512 - RNA, 23 nt, Human
cccauucugccugcccaggcccc

SEQ ID NO: 1791513 - RNA, 22 nt, Human
cccauaauuuuuuuuuuccuuu

SEQ ID NO: 1791514 - RNA, 23 nt, Human
cccauaauuuuuuuuuuccuuuu

SEQ ID NO: 1791515 - RNA, 13 nt, Human
cccaguuguauuu

SEQ ID NO: 1791516 - RNA, 17 nt, Human
ccccuucgcuccugugu

SEQ ID NO: 1791517 - RNA, 15 nt, Human
ccccuucgcuccugu

SEQ ID NO: 1791518 - RNA, 14 nt, Human
ccccuucgcuccug

SEQ ID NO: 1791519 - RNA, 19 nt, Human
ccccuucgcuccugugucu

SEQ ID NO: 1791520 - RNA, 15 nt, Human
ccccugcaaagccca

SEQ ID NO: 1791521 - RNA, 16 nt, Human
ccccugcaaagcccag

SEQ ID NO: 1791522 - RNA, 17 nt, Human
ccccugcaaagcccagc

SEQ ID NO: 1791523 - RNA, 18 nt, Human
ccccugcacuccagccug

SEQ ID NO: 1791524 - RNA, 14 nt, Human
ccccauucugccug

SEQ ID NO: 1791525 - RNA, 13 nt, Human
ccccauucugccu

SEQ ID NO: 1791526 - RNA, 15 nt, Human
ccccauucugccugc

SEQ ID NO: 1791527 - RNA, 12 nt, Human
cccggcugcgga

SEQ ID NO: 1791528 - RNA, 12 nt, Human
cccggcugcccu

SEQ ID NO: 1791529 - RNA, 13 nt, Human
cccggcugcccuu

SEQ ID NO: 1791530 - RNA, 12 nt, Human
cccgggaagggg

SEQ ID NO: 1791531 - RNA, 22 nt, Human
cccuauccuacuuccccuuccu

SEQ ID NO: 1791532 - RNA, 17 nt, Human
ccccuucugacccaugc

SEQ ID NO: 1791533 - RNA, 13 nt, Human
cccucagagccac

SEQ ID NO: 1791534 - RNA, 14 nt, Human
ccucaaaacaaagg

SEQ ID NO: 1791535 - RNA, 17 nt, Human
ccucccaccucagccuc

SEQ ID NO: 1791536 - RNA, 15 nt, Human
ccucccaccucagcc

SEQ ID NO: 1791537 - RNA, 23 nt, Human
ccucauuuuugaauacaggcaua

SEQ ID NO: 1791538 - RNA, 16 nt, Human
ccucccaucucacaca

SEQ ID NO: 1791539 - RNA, 13 nt, Human
ccucccaucucac

SEQ ID NO: 1791540 - RNA, 14 nt, Human
ccggccccugcugg

SEQ ID NO: 1791541 - RNA, 15 nt, Human
cccuucgcuccugug

SEQ ID NO: 1791542 - RNA, 14 nt, Human
cccuucgcuccugu

SEQ ID NO: 1791543 - RNA, 21 nt, Human
cccuucucuccagccccugga

SEQ ID NO: 1791544 - RNA, 22 nt, Human
cccuucucuccagccccuggau

SEQ ID NO: 1791545 - RNA, 23 nt, Human
ccgcaggauuugggcucuuggaa

SEQ ID NO: 1791546 - RNA, 13 nt, Human
ccggccccugcug

SEQ ID NO: 1791547 - RNA, 13 nt, Human
cccuucgcuccug

SEQ ID NO: 1791548 - RNA, 20 nt, Human
cccugugauggggcccugcc

SEQ ID NO: 1791549 - RNA, 18 nt, Human
cccugugauggggcccug

SEQ ID NO: 1791550 - RNA, 19 nt, Human
cccugugauggggcccugc

SEQ ID NO: 1791551 - RNA, 17 nt, Human
cccugugauggggcccu

SEQ ID NO: 1791552 - RNA, 16 nt, Human
cccugucuaaugaaac

SEQ ID NO: 1791553 - RNA, 20 nt, Human
cccugucucaaaaaaagaaa

SEQ ID NO: 1791554 - RNA, 23 nt, Human
cccugucucaaaaaaagaaaaag

SEQ ID NO: 1791555 - RNA, 15 nt, Human
ccugucuaaugaaac

SEQ ID NO: 1791556 - RNA, 22 nt, Human
ccugucuaaugaaaccuguguc

SEQ ID NO: 1791557 - RNA, 16 nt, Human
ccugugaacugaacuc

SEQ ID NO: 1791558 - RNA, 17 nt, Human
ccugugaacugaacucu

SEQ ID NO: 1791559 - RNA, 18 nt, Human
ccugugacuucagcucug

SEQ ID NO: 1791560 - RNA, 21 nt, Human
ccugguggcagugggagcugc

SEQ ID NO: 1791561 - RNA, 18 nt, Human
ccugggggcugggcagag

SEQ ID NO: 1791562 - RNA, 13 nt, Human
ccugguuuccugc

SEQ ID NO: 1791563 - RNA, 14 nt, Human
ccugguuuccugcc

SEQ ID NO: 1791564 - RNA, 15 nt, Human
ccugguuuccugccc

SEQ ID NO: 1791565 - RNA, 19 nt, Human
ccuguccugccuaaggcug

SEQ ID NO: 1791566 - RNA, 17 nt, Human
ccuguccugccuaaggc

SEQ ID NO: 1791567 - RNA, 15 nt, Human
ccuguaaucacagcu

SEQ ID NO: 1791568 - RNA, 20 nt, Human
ccugggccccaguuguauuu

SEQ ID NO: 1791569 - RNA, 22 nt, Human
ccuggccucugcacuccccugc

SEQ ID NO: 1791570 - RNA, 22 nt, Human
ccuggccucaagugauucuccu

SEQ ID NO: 1791571 - RNA, 22 nt, Human
ccuggccuagcauacguacaca

SEQ ID NO: 1791572 - RNA, 20 nt, Human
ccuggccucugcacuccccu

SEQ ID NO: 1791573 - RNA, 21 nt, Human
ccuggccucugcacuccccug

SEQ ID NO: 1791574 - RNA, 19 nt, Human
ccugcacuugcagacucua

SEQ ID NO: 1791575 - RNA, 18 nt, Human
ccugcacuugcagacucu

SEQ ID NO: 1791576 - RNA, 17 nt, Human
ccugcacuugcagacuc

SEQ ID NO: 1791577 - RNA, 16 nt, Human
ccugcacuugcagacu

SEQ ID NO: 1791578 - RNA, 21 nt, Human
ccugaguagcugggauuacag

SEQ ID NO: 1791579 - RNA, 16 nt, Human
ccucuuucccucccuu

SEQ ID NO: 1791580 - RNA, 13 nt, Human
ccucuuucccucc

SEQ ID NO: 1791581 - RNA, 17 nt, Human
ccugccccagggcuccc

SEQ ID NO: 1791582 - RNA, 13 nt, Human
ccugcccaggccc

SEQ ID NO: 1791583 - RNA, 12 nt, Human
ccugcccaccug

SEQ ID NO: 1791584 - RNA, 13 nt, Human
ccugcccaccugg

SEQ ID NO: 1791585 - RNA, 14 nt, Human
ccugcccaccuggc

SEQ ID NO: 1791586 - RNA, 20 nt, Human
ccugcccaccuggccucugc

SEQ ID NO: 1791587 - RNA, 21 nt, Human
ccugcugcaguugccagucac

SEQ ID NO: 1791588 - RNA, 20 nt, Human
ccugcugcaguugccaguca

SEQ ID NO: 1791589 - RNA, 23 nt, Human
ccugccucgaacuggcugcaaag

SEQ ID NO: 1791590 - RNA, 21 nt, Human
ccugccucgaacuggcugcaa

SEQ ID NO: 1791591 - RNA, 17 nt, Human
ccugcugcaguugccag

SEQ ID NO: 1791592 - RNA, 19 nt, Human
ccugcugcaguugccaguc

SEQ ID NO: 1791593 - RNA, 19 nt, Human
ccugccucgaacuggcugc

SEQ ID NO: 1791594 - RNA, 11 nt, Human
ccucuuucccu

SEQ ID NO: 1791595 - RNA, 23 nt, Human
cuagcauacguacacauuuuauu

SEQ ID NO: 1791596 - RNA, 21 nt, Human
cuagcauacguacacauuuua

SEQ ID NO: 1791597 - RNA, 22 nt, Human
cuagaagauuuugaaauuuuua

SEQ ID NO: 1791598 - RNA, 13 nt, Human
cuagaacucccuu

SEQ ID NO: 1791599 - RNA, 12 nt, Human
cuagaacucccu

SEQ ID NO: 1791600 - RNA, 17 nt, Human
cuaccuuuguauucucu

SEQ ID NO: 1791601 - RNA, 17 nt, Human
cuacguuaccaggcagg

SEQ ID NO: 1791602 - RNA, 18 nt, Human
cuacaugagguacugaga

SEQ ID NO: 1791603 - RNA, 20 nt, Human
cuacaugagguacugagagu

SEQ ID NO: 1791604 - RNA, 20 nt, Human
cuacaguccucccaucucac

SEQ ID NO: 1791605 - RNA, 21 nt, Human
cuacaguugaaaaacagcuga

SEQ ID NO: 1791606 - RNA, 14 nt, Human
cuacaguguacagu

SEQ ID NO: 1791607 - RNA, 13 nt, Human
cuacaguguacag

SEQ ID NO: 1791608 - RNA, 22 nt, Human
cuacaguugaaaaacagcugag

SEQ ID NO: 1791609 - RNA, 19 nt, Human
cuacaguccucccaucuca

SEQ ID NO: 1791610 - RNA, 23 nt, Human
cuaagugauccucccaccucagc

SEQ ID NO: 1791611 - RNA, 20 nt, Human
cuaaguuuuuauggcuuuug

SEQ ID NO: 1791612 - RNA, 21 nt, Human
cuaagugguacuaacuuuccu

SEQ ID NO: 1791613 - RNA, 15 nt, Human
cuaauucuaugccug

SEQ ID NO: 1791614 - RNA, 23 nt, Human
cuaaguuuuuauggcuuuugugc

SEQ ID NO: 1791615 - RNA, 11 nt, Human
cgugugugugu

SEQ ID NO: 1791616 - RNA, 20 nt, Human
cucaaacucuugaccucagg

SEQ ID NO: 1791617 - RNA, 13 nt, Human
cucaaacuccuga

SEQ ID NO: 1791618 - RNA, 14 nt, Human
cucaaacuccugac

SEQ ID NO: 1791619 - RNA, 14 nt, Human
cucaauaaaguaca

SEQ ID NO: 1791620 - RNA, 15 nt, Human
cucaaugcacugaca

SEQ ID NO: 1791621 - RNA, 13 nt, Human
cucaaugcacuga

SEQ ID NO: 1791622 - RNA, 11 nt, Human
cucacaaaaga

SEQ ID NO: 1791623 - RNA, 18 nt, Human
cuaucucccccagcccca

SEQ ID NO: 1791624 - RNA, 16 nt, Human
cuaucucccccagccc

SEQ ID NO: 1791625 - RNA, 17 nt, Human
cuaucucccccagcccc

SEQ ID NO: 1791626 - RNA, 18 nt, Human
cucaaaagcugggcaggu

SEQ ID NO: 1791627 - RNA, 17 nt, Human
cucaaaaaaagaaaaag

SEQ ID NO: 1791628 - RNA, 18 nt, Human
cuaucguaaaauuaagaa

SEQ ID NO: 1791629 - RNA, 17 nt, Human
cuaucguaaaauuaaga

SEQ ID NO: 1791630 - RNA, 14 nt, Human
cuaucuaaauguug

SEQ ID NO: 1791631 - RNA, 15 nt, Human
cuaucucccccagcc

SEQ ID NO: 1791632 - RNA, 18 nt, Human
cuaucaugucaaacguga

SEQ ID NO: 1791633 - RNA, 21 nt, Human
cuaguuugauuaaauucuugc

SEQ ID NO: 1791634 - RNA, 22 nt, Human
cuaguuugauuaaauucuugca

SEQ ID NO: 1791635 - RNA, 15 nt, Human
cuaguuugauuaaau

SEQ ID NO: 1791636 - RNA, 13 nt, Human
cuaguuugauuaa

SEQ ID NO: 1791637 - RNA, 22 nt, Human
cuaguuguuugauucagacagc

SEQ ID NO: 1791638 - RNA, 23 nt, Human
cuaguuguuugauucagacagcu

SEQ ID NO: 1791639 - RNA, 12 nt, Human
cuagccagagga

SEQ ID NO: 1791640 - RNA, 13 nt, Human
cuagccagaggag

SEQ ID NO: 1791641 - RNA, 15 nt, Human
cuagccagaggagag

SEQ ID NO: 1791642 - RNA, 21 nt, Human
ccuuucaauaggaaaaacuga

SEQ ID NO: 1791643 - RNA, 15 nt, Human
ccuuucacaaccuuc

SEQ ID NO: 1791644 - RNA, 15 nt, Human
ccuuuugagugccuu

SEQ ID NO: 1791645 - RNA, 17 nt, Human
ccuuuugagugccuuac

SEQ ID NO: 1791646 - RNA, 16 nt, Human
ccuugccgucuaccug

SEQ ID NO: 1791647 - RNA, 21 nt, Human
ccuuuuuuagaguugauacua

SEQ ID NO: 1791648 - RNA, 12 nt, Human
cgacagccuggc

SEQ ID NO: 1791649 - RNA, 13 nt, Human
cgacagccuggca

SEQ ID NO: 1791650 - RNA, 14 nt, Human
cgacagccuggcac

SEQ ID NO: 1791651 - RNA, 13 nt, Human
cgacaaugcaaac

SEQ ID NO: 1791652 - RNA, 12 nt, Human
cgacaaugcaaa

SEQ ID NO: 1791653 - RNA, 19 nt, Human
cgacccuugccgucuaccu

SEQ ID NO: 1791654 - RNA, 20 nt, Human
cgacccuugccgucuaccug

SEQ ID NO: 1791655 - RNA, 17 nt, Human
cgacugccaucuuggac

SEQ ID NO: 1791656 - RNA, 17 nt, Human
cgacugcccggcagggu

SEQ ID NO: 1791657 - RNA, 17 nt, Human
cgccagauucuuuccug

SEQ ID NO: 1791658 - RNA, 13 nt, Human
cgccucugcauuc

SEQ ID NO: 1791659 - RNA, 22 nt, Human
cgcaggauucuuccucccuccc

SEQ ID NO: 1791660 - RNA, 13 nt, Human
cgcaggcuggccc

SEQ ID NO: 1791661 - RNA, 14 nt, Human
cgauagugguggug

SEQ ID NO: 1791662 - RNA, 14 nt, Human
cgugcacacaccag

SEQ ID NO: 1791663 - RNA, 18 nt, Human
cgugauuuugcuguagaa

SEQ ID NO: 1791664 - RNA, 20 nt, Human
cguguaaccauggacccaau

SEQ ID NO: 1791665 - RNA, 17 nt, Human
cgugaguccuggcaugg

SEQ ID NO: 1791666 - RNA, 17 nt, Human
cgugaggccagagacac

SEQ ID NO: 1791667 - RNA, 16 nt, Human
cgugaguccuggcaug

SEQ ID NO: 1791668 - RNA, 16 nt, Human
cguaaagcuagaaaug

SEQ ID NO: 1791669 - RNA, 14 nt, Human
cguaaaauuaagaa

SEQ ID NO: 1791670 - RNA, 23 nt, Human
cgguguuuaagacauuuuuggaa

SEQ ID NO: 1791671 - RNA, 16 nt, Human
cgguuuuacugcagcu

SEQ ID NO: 1791672 - RNA, 12 nt, Human
cggcuccaggcu

SEQ ID NO: 1791673 - RNA, 17 nt, Human
cggcucacugcagccuc

SEQ ID NO: 1791674 - RNA, 16 nt, Human
cggcucacugcagccu

SEQ ID NO: 1791675 - RNA, 14 nt, Human
cggcucacugcagc

SEQ ID NO: 1791676 - RNA, 15 nt, Human
cggcucacugcagcc

SEQ ID NO: 1791677 - RNA, 20 nt, Human
cggagucccaccuuggcugc

SEQ ID NO: 1791678 - RNA, 18 nt, Human
cggagucccaccuuggcu

SEQ ID NO: 1791679 - RNA, 16 nt, Human
cggcuccaggcuccuu

SEQ ID NO: 1791680 - RNA, 15 nt, Human
cggcuccaggcuccu

SEQ ID NO: 1791681 - RNA, 14 nt, Human
cggcuccaggcucc

SEQ ID NO: 1791682 - RNA, 13 nt, Human
cggcuccaggcuc

SEQ ID NO: 1791683 - RNA, 14 nt, Human
cgggccacagagaa

SEQ ID NO: 1791684 - RNA, 12 nt, Human
cgggccacagag

SEQ ID NO: 1791685 - RNA, 17 nt, Human
cgggccacagagaaagu

SEQ ID NO: 1791686 - RNA, 11 nt, Human
cgggcucagca

SEQ ID NO: 1791687 - RNA, 15 nt, Human
cgggcucagcaaaag

SEQ ID NO: 1791688 - RNA, 14 nt, Human
cgggcucugccucc

SEQ ID NO: 1791689 - RNA, 16 nt, Human
cgggcucugccuccca

SEQ ID NO: 1791690 - RNA, 15 nt, Human
cggggacagcuccuu

SEQ ID NO: 1791691 - RNA, 18 nt, Human
cgguguggagaagcggcu

SEQ ID NO: 1791692 - RNA, 17 nt, Human
cgggcucugccucccau

SEQ ID NO: 1791693 - RNA, 14 nt, Human
cggggacagcuccu

SEQ ID NO: 1791694 - RNA, 16 nt, Human
cggagucccaccuugg

SEQ ID NO: 1791695 - RNA, 15 nt, Human
cucugguuaucuaau

SEQ ID NO: 1791696 - RNA, 12 nt, Human
cucuguccaggc

SEQ ID NO: 1791697 - RNA, 16 nt, Human
cucugcugacagacac

SEQ ID NO: 1791698 - RNA, 14 nt, Human
cucugcugacagac

SEQ ID NO: 1791699 - RNA, 13 nt, Human
cucugcugacaga

SEQ ID NO: 1791700 - RNA, 14 nt, Human
cucugguccauaga

SEQ ID NO: 1791701 - RNA, 20 nt, Human
cucugcuccucuccccagca

SEQ ID NO: 1791702 - RNA, 18 nt, Human
cucugcuccucuccccag

SEQ ID NO: 1791703 - RNA, 13 nt, Human
cucugcuccucuc

SEQ ID NO: 1791704 - RNA, 14 nt, Human
cucugcaggucccu

SEQ ID NO: 1791705 - RNA, 15 nt, Human
cucugcaggucccua

SEQ ID NO: 1791706 - RNA, 16 nt, Human
cucugcaggucccuaa

SEQ ID NO: 1791707 - RNA, 17 nt, Human
cucugcaggucccuaau

SEQ ID NO: 1791708 - RNA, 13 nt, Human
cucugcagcaaua

SEQ ID NO: 1791709 - RNA, 21 nt, Human
cucugcacuccccugcugggu

SEQ ID NO: 1791710 - RNA, 20 nt, Human
cucugcacuccccugcuggg

SEQ ID NO: 1791711 - RNA, 13 nt, Human
cucuuauugccca

SEQ ID NO: 1791712 - RNA, 20 nt, Human
cucuuauugcccacgcugga

SEQ ID NO: 1791713 - RNA, 19 nt, Human
cucuuauugcccacgcugg

SEQ ID NO: 1791714 - RNA, 15 nt, Human
cucuuauugcccacg

SEQ ID NO: 1791715 - RNA, 14 nt, Human
cucuuauugcccac

SEQ ID NO: 1791716 - RNA, 14 nt, Human
cucuucaaucucuu

SEQ ID NO: 1791717 - RNA, 19 nt, Human
cucuucagaucucuaacuu

SEQ ID NO: 1791718 - RNA, 18 nt, Human
cucuucagaucucuaacu

SEQ ID NO: 1791719 - RNA, 16 nt, Human
cucuucaacugaccag

SEQ ID NO: 1791720 - RNA, 17 nt, Human
cucuucaacugaccagc

SEQ ID NO: 1791721 - RNA, 20 nt, Human
cucuucaacugaccagccuc

SEQ ID NO: 1791722 - RNA, 22 nt, Human
cugacaacacucauugaccuga

SEQ ID NO: 1791723 - RNA, 23 nt, Human
cugacaacacucauugaccugag

SEQ ID NO: 1791724 - RNA, 19 nt, Human
cugaaggccccgcccaggc

SEQ ID NO: 1791725 - RNA, 17 nt, Human
cugaaggcuggguucug

SEQ ID NO: 1791726 - RNA, 21 nt, Human
cugaaggccccgcccaggcuu

SEQ ID NO: 1791727 - RNA, 23 nt, Human
cugaaggacauugcggacagcca

SEQ ID NO: 1791728 - RNA, 21 nt, Human
cugaagcuaucguaaaauuaa

SEQ ID NO: 1791729 - RNA, 22 nt, Human
cugaagcuaucguaaaauuaag

SEQ ID NO: 1791730 - RNA, 22 nt, Human
cugaaaauugaugggauuuggu

SEQ ID NO: 1791731 - RNA, 13 nt, Human
cucuugaugccug

SEQ ID NO: 1791732 - RNA, 15 nt, Human
cucuugaugccuggc

SEQ ID NO: 1791733 - RNA, 16 nt, Human
cucuugaugccuggcg

SEQ ID NO: 1791734 - RNA, 21 nt, Human
cucuugaugccuggcggggug

SEQ ID NO: 1791735 - RNA, 23 nt, Human
cucuugagccuugaacuuugacc

SEQ ID NO: 1791736 - RNA, 18 nt, Human
cucuugagccuugaacuu

SEQ ID NO: 1791737 - RNA, 17 nt, Human
cucuugagccuugaacu

SEQ ID NO: 1791738 - RNA, 16 nt, Human
cucuugagccuugaac

SEQ ID NO: 1791739 - RNA, 20 nt, Human
cugaggaauccagacccggc

SEQ ID NO: 1791740 - RNA, 17 nt, Human
cugaggaauccagaccc

SEQ ID NO: 1791741 - RNA, 20 nt, Human
cugaggacacuaaccacgcu

SEQ ID NO: 1791742 - RNA, 21 nt, Human
cugaggaauccagacccggcu

SEQ ID NO: 1791743 - RNA, 23 nt, Human
cugaggacacuaaccacgcugga

SEQ ID NO: 1791744 - RNA, 23 nt, Human
cugaggacaagagaaaaaagcca

SEQ ID NO: 1791745 - RNA, 21 nt, Human
cugagaucaaaacgguuuuac

SEQ ID NO: 1791746 - RNA, 14 nt, Human
cugagcuuucugcu

SEQ ID NO: 1791747 - RNA, 15 nt, Human
cugagcuuucugcua

SEQ ID NO: 1791748 - RNA, 19 nt, Human
cugaguagcuggauuacag

SEQ ID NO: 1791749 - RNA, 21 nt, Human
cugaguacguugugcauuugg

SEQ ID NO: 1791750 - RNA, 12 nt, Human
cugaggugggag

SEQ ID NO: 1791751 - RNA, 20 nt, Human
cugaguacguugugcauuug

SEQ ID NO: 1791752 - RNA, 19 nt, Human
cugaguacguugugcauuu

SEQ ID NO: 1791753 - RNA, 17 nt, Human
cugaguacguugugcau

SEQ ID NO: 1791754 - RNA, 18 nt, Human
cugaguacguugugcauu

SEQ ID NO: 1791755 - RNA, 22 nt, Human
cugaggacuuaaaauauuccug

SEQ ID NO: 1791756 - RNA, 14 nt, Human
cugaggaccagcca

SEQ ID NO: 1791757 - RNA, 20 nt, Human
cugaguagcuggauuacagg

SEQ ID NO: 1791758 - RNA, 14 nt, Human
cugaguagcuggga

SEQ ID NO: 1791759 - RNA, 15 nt, Human
cugaguagcugggau

SEQ ID NO: 1791760 - RNA, 20 nt, Human
cugaguagcugggauuacag

SEQ ID NO: 1791761 - RNA, 22 nt, Human
cugagaggacuuuucuuugugg

SEQ ID NO: 1791762 - RNA, 21 nt, Human
cugagaggacuuuucuuugug

SEQ ID NO: 1791763 - RNA, 14 nt, Human
cugagaggcugucu

SEQ ID NO: 1791764 - RNA, 17 nt, Human
cugagaguagagucacu

SEQ ID NO: 1791765 - RNA, 22 nt, Human
cugagacucgcgacaaugcaaa

SEQ ID NO: 1791766 - RNA, 23 nt, Human
cugagacagcccgggcucugccu

SEQ ID NO: 1791767 - RNA, 21 nt, Human
cugagacucgcgacaaugcaa

SEQ ID NO: 1791768 - RNA, 21 nt, Human
cugacccaugcugcccuguga

SEQ ID NO: 1791769 - RNA, 22 nt, Human
cugacccaugcugcccugugag

SEQ ID NO: 1791770 - RNA, 15 nt, Human
cugacaacagacuuc

SEQ ID NO: 1791771 - RNA, 18 nt, Human
cugacaacagacuucuga

SEQ ID NO: 1791772 - RNA, 19 nt, Human
cugacaacagacuucugaa

SEQ ID NO: 1791773 - RNA, 20 nt, Human
cuccacuuucuagccagagg

SEQ ID NO: 1791774 - RNA, 16 nt, Human
cuccacuuucuagcca

SEQ ID NO: 1791775 - RNA, 19 nt, Human
cuccacuuucuagccagag

SEQ ID NO: 1791776 - RNA, 23 nt, Human
cuccacuuggucugugagaugcu

SEQ ID NO: 1791777 - RNA, 16 nt, Human
cucaugccucagccuc

SEQ ID NO: 1791778 - RNA, 12 nt, Human
cucaugccucag

SEQ ID NO: 1791779 - RNA, 15 nt, Human
cuccaagaccuucuc

SEQ ID NO: 1791780 - RNA, 22 nt, Human
cuccaagaccuucuccuucacc

SEQ ID NO: 1791781 - RNA, 13 nt, Human
cuccaagcaggac

SEQ ID NO: 1791782 - RNA, 14 nt, Human
cuccaagcaggaca

SEQ ID NO: 1791783 - RNA, 22 nt, Human
cuccaagcaggacauggacaag

SEQ ID NO: 1791784 - RNA, 24 nt, Human
cuccaagcaggacauggacaagga

SEQ ID NO: 1791785 - RNA, 18 nt, Human
cuccaagcuccaucucca

SEQ ID NO: 1791786 - RNA, 19 nt, Human
cuccaagcuccaucuccac

SEQ ID NO: 1791787 - RNA, 14 nt, Human
cuccaagcuccauc

SEQ ID NO: 1791788 - RNA, 13 nt, Human
cuccaagcuccca

SEQ ID NO: 1791789 - RNA, 14 nt, Human
cuccaagcucccag

SEQ ID NO: 1791790 - RNA, 15 nt, Human
cuccaagcucccagg

SEQ ID NO: 1791791 - RNA, 16 nt, Human
cuccaagcucccaggc

SEQ ID NO: 1791792 - RNA, 22 nt, Human
cuccacuuggucugugagaugc

SEQ ID NO: 1791793 - RNA, 21 nt, Human
cuccacuuggucugugagaug

SEQ ID NO: 1791794 - RNA, 17 nt, Human
cuccacuuggucuguga

SEQ ID NO: 1791795 - RNA, 16 nt, Human
cuccacuuggucugug

SEQ ID NO: 1791796 - RNA, 16 nt, Human
cuccacuggauggagg

SEQ ID NO: 1791797 - RNA, 17 nt, Human
cuccaagcucccaggca

SEQ ID NO: 1791798 - RNA, 15 nt, Human
cuccacuuggucugu

SEQ ID NO: 1791799 - RNA, 13 nt, Human
cuccacuuggucu

SEQ ID NO: 1791800 - RNA, 15 nt, Human
cucagucucccuccc

SEQ ID NO: 1791801 - RNA, 16 nt, Human
cucagucucccucccu

SEQ ID NO: 1791802 - RNA, 17 nt, Human
cucagucucccucccuu

SEQ ID NO: 1791803 - RNA, 13 nt, Human
cucagucucccuc

SEQ ID NO: 1791804 - RNA, 18 nt, Human
cuccucuucaacugacca

SEQ ID NO: 1791805 - RNA, 23 nt, Human
cuccucuucaacugaccagccuc

SEQ ID NO: 1791806 - RNA, 15 nt, Human
cuccuggacuccugc

SEQ ID NO: 1791807 - RNA, 16 nt, Human
cuccuggcccacugca

SEQ ID NO: 1791808 - RNA, 18 nt, Human
cuccuggcccacugcauc

SEQ ID NO: 1791809 - RNA, 19 nt, Human
cuccucucugcccuaaugc

SEQ ID NO: 1791810 - RNA, 16 nt, Human
cuccucugcugcuggc

SEQ ID NO: 1791811 - RNA, 18 nt, Human
cuccucugcugcuggcug

SEQ ID NO: 1791812 - RNA, 13 nt, Human
cuccucucugccc

SEQ ID NO: 1791813 - RNA, 14 nt, Human
cuccucucugcccu

SEQ ID NO: 1791814 - RNA, 15 nt, Human
cuccucucugcccua

SEQ ID NO: 1791815 - RNA, 13 nt, Human
cucccccaucucu

SEQ ID NO: 1791816 - RNA, 22 nt, Human
cucccccagccccauccucugu

SEQ ID NO: 1791817 - RNA, 15 nt, Human
cucccccagccccau

SEQ ID NO: 1791818 - RNA, 20 nt, Human
cucccccagccccauccucu

SEQ ID NO: 1791819 - RNA, 16 nt, Human
cucgaacuggcugcaa

SEQ ID NO: 1791820 - RNA, 15 nt, Human
cucgaacuggcugca

SEQ ID NO: 1791821 - RNA, 14 nt, Human
cucgaacuggcugc

SEQ ID NO: 1791822 - RNA, 13 nt, Human
cucgaacuggcug

SEQ ID NO: 1791823 - RNA, 23 nt, Human
cuccuggggguucuuucuuccuc

SEQ ID NO: 1791824 - RNA, 18 nt, Human
cuccuggggguucuuucu

SEQ ID NO: 1791825 - RNA, 20 nt, Human
cuccuggggguucuuucuuc

SEQ ID NO: 1791826 - RNA, 22 nt, Human
cuccuggggguucuuucuuccu

SEQ ID NO: 1791827 - RNA, 15 nt, Human
cucuaucaccaagga

SEQ ID NO: 1791828 - RNA, 21 nt, Human
cucgugguaggacuguagaaa

SEQ ID NO: 1791829 - RNA, 21 nt, Human
agcuggucccacucaguccau

SEQ ID NO: 1791830 - RNA, 22 nt, Human
agcugggugucaagagggucug

SEQ ID NO: 1791831 - RNA, 17 nt, Human
agcugggugucaagagg

SEQ ID NO: 1791832 - RNA, 20 nt, Human
agcuucuguugcugccucau

SEQ ID NO: 1791833 - RNA, 21 nt, Human
agcuucuguugcugccucaug

SEQ ID NO: 1791834 - RNA, 22 nt, Human
agcuucuguugcugccucaugc

SEQ ID NO: 1791835 - RNA, 15 nt, Human
aggaaauccagggug

SEQ ID NO: 1791836 - RNA, 17 nt, Human
aggaaauccaggguggu

SEQ ID NO: 1791837 - RNA, 22 nt, Human
aggaacguaaucguguccccua

SEQ ID NO: 1791838 - RNA, 23 nt, Human
agcuucuguugcugccucaugcu

SEQ ID NO: 1791839 - RNA, 13 nt, Human
agcuuuucccuuc

SEQ ID NO: 1791840 - RNA, 21 nt, Human
agcuuuuaugugaaacauguu

SEQ ID NO: 1791841 - RNA, 16 nt, Human
agcuuuucccuucuuu

SEQ ID NO: 1791842 - RNA, 15 nt, Human
agcuuuucccuuuuu

SEQ ID NO: 1791843 - RNA, 13 nt, Human
aggaaaaacugau

SEQ ID NO: 1791844 - RNA, 15 nt, Human
aggaaaaacugauuu

SEQ ID NO: 1791845 - RNA, 20 nt, Human
aggauguucugggacacagu

SEQ ID NO: 1791846 - RNA, 14 nt, Human
aggauguugaaaaa

SEQ ID NO: 1791847 - RNA, 17 nt, Human
aggauguugaaaaaguu

SEQ ID NO: 1791848 - RNA, 17 nt, Human
aggaggggauagagaga

SEQ ID NO: 1791849 - RNA, 16 nt, Human
aggauucuuccucccu

SEQ ID NO: 1791850 - RNA, 12 nt, Human
aggauucuuccu

SEQ ID NO: 1791851 - RNA, 14 nt, Human
aggcacugcugccc

SEQ ID NO: 1791852 - RNA, 16 nt, Human
aggcacugcugcccag

SEQ ID NO: 1791853 - RNA, 22 nt, Human
aggcacugcugcccagccucca

SEQ ID NO: 1791854 - RNA, 17 nt, Human
aggacccggaggggccu

SEQ ID NO: 1791855 - RNA, 14 nt, Human
aggaccucagguga

SEQ ID NO: 1791856 - RNA, 20 nt, Human
aggaccucaggugagaagca

SEQ ID NO: 1791857 - RNA, 15 nt, Human
aggagagcuagcagc

SEQ ID NO: 1791858 - RNA, 15 nt, Human
aggagaggagagggg

SEQ ID NO: 1791859 - RNA, 16 nt, Human
aggagaggggcacagg

SEQ ID NO: 1791860 - RNA, 18 nt, Human
aggagaggggcacagggu

SEQ ID NO: 1791861 - RNA, 20 nt, Human
aggaccccuccaugugggcu

SEQ ID NO: 1791862 - RNA, 15 nt, Human
aggaacuacugagga

SEQ ID NO: 1791863 - RNA, 18 nt, Human
aggcugccucucccauca

SEQ ID NO: 1791864 - RNA, 16 nt, Human
aggcugucuguuguau

SEQ ID NO: 1791865 - RNA, 20 nt, Human
agggacucaucauuuccauu

SEQ ID NO: 1791866 - RNA, 21 nt, Human
agggacgcuacccgggaaggg

SEQ ID NO: 1791867 - RNA, 12 nt, Human
agggacagaggg

SEQ ID NO: 1791868 - RNA, 13 nt, Human
agggacagagggg

SEQ ID NO: 1791869 - RNA, 20 nt, Human
agggacagaggggguggccu

SEQ ID NO: 1791870 - RNA, 23 nt, Human
aggcuagugugguguuuccuggc

SEQ ID NO: 1791871 - RNA, 20 nt, Human
aggcugaacuuguuuucugg

SEQ ID NO: 1791872 - RNA, 21 nt, Human
aggcugaacuuguuuucuggg

SEQ ID NO: 1791873 - RNA, 14 nt, Human
aggcucuucuccuu

SEQ ID NO: 1791874 - RNA, 21 nt, Human
agggcacaccgggcacucaga

SEQ ID NO: 1791875 - RNA, 20 nt, Human
agggcacaccgggcacucag

SEQ ID NO: 1791876 - RNA, 22 nt, Human
agggcacagaaaauggaagaca

SEQ ID NO: 1791877 - RNA, 15 nt, Human
agggccuggccugag

SEQ ID NO: 1791878 - RNA, 16 nt, Human
agggccuggccugagc

SEQ ID NO: 1791879 - RNA, 17 nt, Human
agggccuggccugagcu

SEQ ID NO: 1791880 - RNA, 17 nt, Human
agggcacaccgggcacu

SEQ ID NO: 1791881 - RNA, 19 nt, Human
agggcgggaggauguucug

SEQ ID NO: 1791882 - RNA, 18 nt, Human
agggccuggccugagcug

SEQ ID NO: 1791883 - RNA, 21 nt, Human
aggggauagagagagaccacu

SEQ ID NO: 1791884 - RNA, 15 nt, Human
aggggcacagggucu

SEQ ID NO: 1791885 - RNA, 13 nt, Human
agguucagcuugu

SEQ ID NO: 1791886 - RNA, 17 nt, Human
agguucaugcaaacuuu

SEQ ID NO: 1791887 - RNA, 18 nt, Human
agguuccacagaggacac

SEQ ID NO: 1791888 - RNA, 17 nt, Human
agguucaaagauauuuu

SEQ ID NO: 1791889 - RNA, 14 nt, Human
agguuaauguucau

SEQ ID NO: 1791890 - RNA, 15 nt, Human
agguuaauaaaguaa

SEQ ID NO: 1791891 - RNA, 17 nt, Human
aggugcugccauccagg

SEQ ID NO: 1791892 - RNA, 16 nt, Human
aggugcugccauccag

SEQ ID NO: 1791893 - RNA, 20 nt, Human
aggucgcuugggaauuuuau

SEQ ID NO: 1791894 - RNA, 14 nt, Human
aggucgaggcagga

SEQ ID NO: 1791895 - RNA, 15 nt, Human
agguggaaauaaacu

SEQ ID NO: 1791896 - RNA, 17 nt, Human
aggucccuaauaaagcu

SEQ ID NO: 1791897 - RNA, 18 nt, Human
aggucccuaauaaagcug

SEQ ID NO: 1791898 - RNA, 19 nt, Human
aggucccuaauaaagcugu

SEQ ID NO: 1791899 - RNA, 20 nt, Human
aggucccuaauaaagcugug

SEQ ID NO: 1791900 - RNA, 22 nt, Human
agguacgaaaagaggggaagag

SEQ ID NO: 1791901 - RNA, 18 nt, Human
agguaaucgaccugccuc

SEQ ID NO: 1791902 - RNA, 17 nt, Human
agguaaucgaccugccu

SEQ ID NO: 1791903 - RNA, 17 nt, Human
agguaaggaauaccugu

SEQ ID NO: 1791904 - RNA, 19 nt, Human
agcacuaaggugugcucug

SEQ ID NO: 1791905 - RNA, 20 nt, Human
agcacuaaggugugcucuga

SEQ ID NO: 1791906 - RNA, 21 nt, Human
agcagccacauuccugaugcu

SEQ ID NO: 1791907 - RNA, 19 nt, Human
agauguaauuuuguguaag

SEQ ID NO: 1791908 - RNA, 17 nt, Human
agauguaauuuugugua

SEQ ID NO: 1791909 - RNA, 15 nt, Human
agauguaauuuugug

SEQ ID NO: 1791910 - RNA, 14 nt, Human
agauguaauuuugu

SEQ ID NO: 1791911 - RNA, 14 nt, Human
agauguagaggaga

SEQ ID NO: 1791912 - RNA, 21 nt, Human
agaugggagaaucacuugaac

SEQ ID NO: 1791913 - RNA, 13 nt, Human
agauguaauuuug

SEQ ID NO: 1791914 - RNA, 23 nt, Human
agccaaagcuaggccuggccaga

SEQ ID NO: 1791915 - RNA, 20 nt, Human
agccaaagcuaggccuggcc

SEQ ID NO: 1791916 - RNA, 19 nt, Human
agccaaagcuaggccuggc

SEQ ID NO: 1791917 - RNA, 20 nt, Human
agcaugccuggauggggcug

SEQ ID NO: 1791918 - RNA, 20 nt, Human
agcaugagagggaugaggca

SEQ ID NO: 1791919 - RNA, 14 nt, Human
agcaugcacaaauu

SEQ ID NO: 1791920 - RNA, 12 nt, Human
agcaugccugga

SEQ ID NO: 1791921 - RNA, 20 nt, Human
agccagaggagagaggaccc

SEQ ID NO: 1791922 - RNA, 22 nt, Human
agccaaggccaaaggaagcaca

SEQ ID NO: 1791923 - RNA, 23 nt, Human
agccaaggccaaaggaagcacau

SEQ ID NO: 1791924 - RNA, 22 nt, Human
agccucccgaguagcugggacu

SEQ ID NO: 1791925 - RNA, 11 nt, Human
agccuccugag

SEQ ID NO: 1791926 - RNA, 17 nt, Human
agccucccgaguagcug

SEQ ID NO: 1791927 - RNA, 22 nt, Human
agccucccgaauagcugggacu

SEQ ID NO: 1791928 - RNA, 20 nt, Human
agccucccgaauagcuggga

SEQ ID NO: 1791929 - RNA, 19 nt, Human
agccucccgaauagcuggg

SEQ ID NO: 1791930 - RNA, 18 nt, Human
agccucccgaauagcugg

SEQ ID NO: 1791931 - RNA, 20 nt, Human
agccucccaaagugcuggga

SEQ ID NO: 1791932 - RNA, 21 nt, Human
agccgagaucacgccacugca

SEQ ID NO: 1791933 - RNA, 19 nt, Human
agccgagauugcaccacug

SEQ ID NO: 1791934 - RNA, 20 nt, Human
agccgagauugcaccacugc

SEQ ID NO: 1791935 - RNA, 14 nt, Human
agccgcuggggcca

SEQ ID NO: 1791936 - RNA, 22 nt, Human
agccgcuggggccaguuggucc

SEQ ID NO: 1791937 - RNA, 19 nt, Human
agccucccaaagugcuggg

SEQ ID NO: 1791938 - RNA, 18 nt, Human
agccucccaaagugcugg

SEQ ID NO: 1791939 - RNA, 19 nt, Human
agccuccugaguagcugga

SEQ ID NO: 1791940 - RNA, 20 nt, Human
agccgagaucacgccacugc

SEQ ID NO: 1791941 - RNA, 19 nt, Human
agccgagaucacgccacug

SEQ ID NO: 1791942 - RNA, 15 nt, Human
agcccugagcuuucu

SEQ ID NO: 1791943 - RNA, 16 nt, Human
agccccagugcccaca

SEQ ID NO: 1791944 - RNA, 23 nt, Human
agccccauaauuuuuuuuuuccu

SEQ ID NO: 1791945 - RNA, 20 nt, Human
agccccaucccaaacccuuc

SEQ ID NO: 1791946 - RNA, 11 nt, Human
agccccauccu

SEQ ID NO: 1791947 - RNA, 23 nt, Human
agcccaaagugguauagaaaugc

SEQ ID NO: 1791948 - RNA, 20 nt, Human
agcccaaagugguauagaaa

SEQ ID NO: 1791949 - RNA, 21 nt, Human
agauaggucagugcaaauacu

SEQ ID NO: 1791950 - RNA, 15 nt, Human
agauagccaaggcca

SEQ ID NO: 1791951 - RNA, 16 nt, Human
agauagccaaggccaa

SEQ ID NO: 1791952 - RNA, 14 nt, Human
agaucuucuguggg

SEQ ID NO: 1791953 - RNA, 23 nt, Human
agauggcugugccucugccuguc

SEQ ID NO: 1791954 - RNA, 13 nt, Human
agauagccaaggc

SEQ ID NO: 1791955 - RNA, 22 nt, Human
agauacuuggggggcugaggug

SEQ ID NO: 1791956 - RNA, 22 nt, Human
agaggggaacagacuggaagca

SEQ ID NO: 1791957 - RNA, 16 nt, Human
agaggggaagagacuu

SEQ ID NO: 1791958 - RNA, 13 nt, Human
agaggagaggggc

SEQ ID NO: 1791959 - RNA, 18 nt, Human
agagaaaguacuucucca

SEQ ID NO: 1791960 - RNA, 10 nt, Human
agagaagaga

SEQ ID NO: 1791961 - RNA, 21 nt, Human
agagaagagauugugguuuca

SEQ ID NO: 1791962 - RNA, 20 nt, Human
agagagcuucuguugcugcc

SEQ ID NO: 1791963 - RNA, 23 nt, Human
agagagcuucuguugcugccuca

SEQ ID NO: 1791964 - RNA, 16 nt, Human
agagagcuucuguugc

SEQ ID NO: 1791965 - RNA, 23 nt, Human
agagaggguggugaccucugccu

SEQ ID NO: 1791966 - RNA, 14 nt, Human
agagaguggcuccu

SEQ ID NO: 1791967 - RNA, 16 nt, Human
agagaguggcuccucc

SEQ ID NO: 1791968 - RNA, 23 nt, Human
agacugaguacguugugcauuug

SEQ ID NO: 1791969 - RNA, 13 nt, Human
agaccaucccuga

SEQ ID NO: 1791970 - RNA, 14 nt, Human
agaccaucccugaa

SEQ ID NO: 1791971 - RNA, 17 nt, Human
agaccaucccugaaggc

SEQ ID NO: 1791972 - RNA, 18 nt, Human
agaccaucccugaaggcc

SEQ ID NO: 1791973 - RNA, 21 nt, Human
agaccaucccugaaggccccg

SEQ ID NO: 1791974 - RNA, 18 nt, Human
agacagcccgggcucugc

SEQ ID NO: 1791975 - RNA, 20 nt, Human
agacagcccgggcucugccu

SEQ ID NO: 1791976 - RNA, 17 nt, Human
agacagcccgggcucug

SEQ ID NO: 1791977 - RNA, 19 nt, Human
agacggagucccaccuugg

SEQ ID NO: 1791978 - RNA, 18 nt, Human
agacgggggcagagaggg

SEQ ID NO: 1791979 - RNA, 21 nt, Human
agacaauuuauuauggcacau

SEQ ID NO: 1791980 - RNA, 15 nt, Human
agacaauuuauuaug

SEQ ID NO: 1791981 - RNA, 19 nt, Human
agacaaugacuuacuguac

SEQ ID NO: 1791982 - RNA, 17 nt, Human
agacaaugacuuacugu

SEQ ID NO: 1791983 - RNA, 13 nt, Human
agacaaugacuua

SEQ ID NO: 1791984 - RNA, 14 nt, Human
auccuccucagauc

SEQ ID NO: 1791985 - RNA, 13 nt, Human
aucgaugcagugc

SEQ ID NO: 1791986 - RNA, 23 nt, Human
auccucauacccacccccaccca

SEQ ID NO: 1791987 - RNA, 11 nt, Human
auccuccucag

SEQ ID NO: 1791988 - RNA, 13 nt, Human
auccuccaggugc

SEQ ID NO: 1791989 - RNA, 14 nt, Human
auccuccaggugca

SEQ ID NO: 1791990 - RNA, 19 nt, Human
auccuccaggugcacaagc

SEQ ID NO: 1791991 - RNA, 22 nt, Human
auccuccaggugcacaagcucc

SEQ ID NO: 1791992 - RNA, 20 nt, Human
auccacccaccucagccucc

SEQ ID NO: 1791993 - RNA, 18 nt, Human
auccacccaccucagccu

SEQ ID NO: 1791994 - RNA, 14 nt, Human
aucccggcugcccu

SEQ ID NO: 1791995 - RNA, 15 nt, Human
aucccuacuguaauu

SEQ ID NO: 1791996 - RNA, 18 nt, Human
auccucauacccaccccc

SEQ ID NO: 1791997 - RNA, 19 nt, Human
auccucauacccaccccca

SEQ ID NO: 1791998 - RNA, 22 nt, Human
auccucauacccacccccaccc

SEQ ID NO: 1791999 - RNA, 12 nt, Human
aucaccugcccu

SEQ ID NO: 1792000 - RNA, 13 nt, Human
aucaccugcccug

SEQ ID NO: 1792001 - RNA, 11 nt, Human
aucagccuggg

SEQ ID NO: 1792002 - RNA, 20 nt, Human
aucagccugggcaaugugau

SEQ ID NO: 1792003 - RNA, 21 nt, Human
aucagccugggcaaugugaua

SEQ ID NO: 1792004 - RNA, 12 nt, Human
aucagcugcuac

SEQ ID NO: 1792005 - RNA, 13 nt, Human
aucagcugcuacu

SEQ ID NO: 1792006 - RNA, 23 nt, Human
aucagcugcuacuacuccuguag

SEQ ID NO: 1792007 - RNA, 23 nt, Human
augaaaaaauauauaucaaauau

SEQ ID NO: 1792008 - RNA, 22 nt, Human
augaaaaaauauauaucaaaua

SEQ ID NO: 1792009 - RNA, 14 nt, Human
augaaaaaauauau

SEQ ID NO: 1792010 - RNA, 17 nt, Human
augaaaaaauauauauc

SEQ ID NO: 1792011 - RNA, 17 nt, Human
augacuccagaauuucc

SEQ ID NO: 1792012 - RNA, 12 nt, Human
augacuccagaa

SEQ ID NO: 1792013 - RNA, 16 nt, Human
augacuccagaauuuc

SEQ ID NO: 1792014 - RNA, 18 nt, Human
augaagcuuuuaugugaa

SEQ ID NO: 1792015 - RNA, 19 nt, Human
augaagcuuuuaugugaaa

SEQ ID NO: 1792016 - RNA, 20 nt, Human
augaagcuuuuaugugaaac

SEQ ID NO: 1792017 - RNA, 21 nt, Human
augaagcuuuuaugugaaaca

SEQ ID NO: 1792018 - RNA, 12 nt, Human
augacccagugg

SEQ ID NO: 1792019 - RNA, 13 nt, Human
augagccuggcaa

SEQ ID NO: 1792020 - RNA, 14 nt, Human
augagccuggcaag

SEQ ID NO: 1792021 - RNA, 22 nt, Human
aucuuauaauuuaaaauaugcu

SEQ ID NO: 1792022 - RNA, 17 nt, Human
aucugggccagaauuuc

SEQ ID NO: 1792023 - RNA, 15 nt, Human
aucugggccagaauu

SEQ ID NO: 1792024 - RNA, 19 nt, Human
aucuuccaacucaaacucu

SEQ ID NO: 1792025 - RNA, 15 nt, Human
aucucucuucuuuuc

SEQ ID NO: 1792026 - RNA, 22 nt, Human
aucucucgugauugauaagaac

SEQ ID NO: 1792027 - RNA, 17 nt, Human
aucuugaagacuuuucu

SEQ ID NO: 1792028 - RNA, 22 nt, Human
aucuucugaacuuggcgcugcc

SEQ ID NO: 1792029 - RNA, 17 nt, Human
aucuucuuuauaauucu

SEQ ID NO: 1792030 - RNA, 18 nt, Human
auguuuuaagaggcaggg

SEQ ID NO: 1792031 - RNA, 16 nt, Human
auguuuuaagaggcag

SEQ ID NO: 1792032 - RNA, 14 nt, Human
auuaaaugcccagc

SEQ ID NO: 1792033 - RNA, 15 nt, Human
auuaaaugcccagcc

SEQ ID NO: 1792034 - RNA, 16 nt, Human
auuaaaugcccagccc

SEQ ID NO: 1792035 - RNA, 13 nt, Human
auuaaauucuugc

SEQ ID NO: 1792036 - RNA, 18 nt, Human
auguucucugaggacacu

SEQ ID NO: 1792037 - RNA, 18 nt, Human
auguuucuuuguaaugaa

SEQ ID NO: 1792038 - RNA, 20 nt, Human
auguucuuucacccuuuucu

SEQ ID NO: 1792039 - RNA, 15 nt, Human
auguucuuaauucuu

SEQ ID NO: 1792040 - RNA, 20 nt, Human
auguucuuaguggauguucu

SEQ ID NO: 1792041 - RNA, 22 nt, Human
auguucugacccugcuucaaau

SEQ ID NO: 1792042 - RNA, 14 nt, Human
auguguaaguauuc

SEQ ID NO: 1792043 - RNA, 17 nt, Human
auguacauguacugauu

SEQ ID NO: 1792044 - RNA, 23 nt, Human
augucaaauauuuagauguaauu

SEQ ID NO: 1792045 - RNA, 19 nt, Human
augucaaauauuuagaugu

SEQ ID NO: 1792046 - RNA, 17 nt, Human
augucacaggcaggucc

SEQ ID NO: 1792047 - RNA, 16 nt, Human
augucacaggcagguc

SEQ ID NO: 1792048 - RNA, 14 nt, Human
augucacaggcagg

SEQ ID NO: 1792049 - RNA, 15 nt, Human
augucacaggcaggu

SEQ ID NO: 1792050 - RNA, 17 nt, Human
auguaagcucuacugag

SEQ ID NO: 1792051 - RNA, 17 nt, Human
augccugguggcagcug

SEQ ID NO: 1792052 - RNA, 16 nt, Human
augccugguggcagcu

SEQ ID NO: 1792053 - RNA, 15 nt, Human
augccugguggcagc

SEQ ID NO: 1792054 - RNA, 21 nt, Human
augccuggauggggcugcacc

SEQ ID NO: 1792055 - RNA, 23 nt, Human
augccuggauggggcugcaccgg

SEQ ID NO: 1792056 - RNA, 17 nt, Human
augccugggcagaagga

SEQ ID NO: 1792057 - RNA, 20 nt, Human
augcaugaaguaauaugcac

SEQ ID NO: 1792058 - RNA, 23 nt, Human
augcaugaaguaauaugcacaca

SEQ ID NO: 1792059 - RNA, 18 nt, Human
augcauuugaaaauuuug

SEQ ID NO: 1792060 - RNA, 12 nt, Human
augcauuugaaa

SEQ ID NO: 1792061 - RNA, 10 nt, Human
augcauuuga

SEQ ID NO: 1792062 - RNA, 21 nt, Human
augcacagcuaacauggaagu

SEQ ID NO: 1792063 - RNA, 23 nt, Human
augcacacauuuuuuaaaugcac

SEQ ID NO: 1792064 - RNA, 14 nt, Human
augcacagcuaaca

SEQ ID NO: 1792065 - RNA, 22 nt, Human
augcacacauuuuuuaaaugca

SEQ ID NO: 1792066 - RNA, 19 nt, Human
augcacacauuuuuuaaau

SEQ ID NO: 1792067 - RNA, 17 nt, Human
augcacacauuuuuuaa

SEQ ID NO: 1792068 - RNA, 16 nt, Human
augaugugugaaaacu

SEQ ID NO: 1792069 - RNA, 23 nt, Human
augauguauguugaagccuuugu

SEQ ID NO: 1792070 - RNA, 21 nt, Human
augccuuuguacuuuagggaa

SEQ ID NO: 1792071 - RNA, 23 nt, Human
auggcugccaaugggagcucaug

SEQ ID NO: 1792072 - RNA, 21 nt, Human
augggaaugaaugucagugug

SEQ ID NO: 1792073 - RNA, 15 nt, Human
augggaaugaauguc

SEQ ID NO: 1792074 - RNA, 13 nt, Human
auggaaauguuua

SEQ ID NO: 1792075 - RNA, 19 nt, Human
auggaaaugggcagagcag

SEQ ID NO: 1792076 - RNA, 20 nt, Human
auggaaaugggcagagcaga

SEQ ID NO: 1792077 - RNA, 18 nt, Human
auaaugugaaacuggauu

SEQ ID NO: 1792078 - RNA, 19 nt, Human
auaaguguguguuuuucau

SEQ ID NO: 1792079 - RNA, 22 nt, Human
auaaguguguguuuuucauaaa

SEQ ID NO: 1792080 - RNA, 21 nt, Human
auaaugugaaacuggauuaaa

SEQ ID NO: 1792081 - RNA, 19 nt, Human
auaaugugaaacuggauua

SEQ ID NO: 1792082 - RNA, 19 nt, Human
auaaguauuuaauucaugu

SEQ ID NO: 1792083 - RNA, 15 nt, Human
auaaguggugugugu

SEQ ID NO: 1792084 - RNA, 22 nt, Human
auacccccugcaaagcccagcu

SEQ ID NO: 1792085 - RNA, 14 nt, Human
auaauuacuauguc

SEQ ID NO: 1792086 - RNA, 13 nt, Human
auaccuguccccc

SEQ ID NO: 1792087 - RNA, 12 nt, Human
auaccugucccc

SEQ ID NO: 1792088 - RNA, 16 nt, Human
auauaggaacuuaaau

SEQ ID NO: 1792089 - RNA, 15 nt, Human
auaguaugguggcug

SEQ ID NO: 1792090 - RNA, 19 nt, Human
auacuugaaaauuaacaug

SEQ ID NO: 1792091 - RNA, 15 nt, Human
auacuugaaaauuaa

SEQ ID NO: 1792092 - RNA, 16 nt, Human
auacuugaaaauuaac

SEQ ID NO: 1792093 - RNA, 16 nt, Human
auaguaugguggcugg

SEQ ID NO: 1792094 - RNA, 15 nt, Human
auauaagugauugcu

SEQ ID NO: 1792095 - RNA, 15 nt, Human
auauaaguguguguu

SEQ ID NO: 1792096 - RNA, 17 nt, Human
auaugcaguuuuccuua

SEQ ID NO: 1792097 - RNA, 22 nt, Human
auaugccugggcagaaggaaga

SEQ ID NO: 1792098 - RNA, 19 nt, Human
auaugcuuguaacuaaaau

SEQ ID NO: 1792099 - RNA, 21 nt, Human
auaugcuuauacacuuacacu

SEQ ID NO: 1792100 - RNA, 14 nt, Human
auaugcuuauacac

SEQ ID NO: 1792101 - RNA, 16 nt, Human
auaugcuuauacacuu

SEQ ID NO: 1792102 - RNA, 19 nt, Human
auaugcuuauacacuuaca

SEQ ID NO: 1792103 - RNA, 20 nt, Human
auauuuagauguaauuuugu

SEQ ID NO: 1792104 - RNA, 22 nt, Human
auauuuagauguaauuuugugu

SEQ ID NO: 1792105 - RNA, 17 nt, Human
auauucaggaagcucag

SEQ ID NO: 1792106 - RNA, 14 nt, Human
auauucaggaagcu

SEQ ID NO: 1792107 - RNA, 16 nt, Human
auauucaggaagcuca

SEQ ID NO: 1792108 - RNA, 13 nt, Human
auauucaggaagc

SEQ ID NO: 1792109 - RNA, 18 nt, Human
auauuuaguguucauaaa

SEQ ID NO: 1792110 - RNA, 16 nt, Human
auauuuauaaaaauaa

SEQ ID NO: 1792111 - RNA, 18 nt, Human
agugauucucaugccuca

SEQ ID NO: 1792112 - RNA, 19 nt, Human
agugauucucaugccucag

SEQ ID NO: 1792113 - RNA, 15 nt, Human
agugauuaccaggga

SEQ ID NO: 1792114 - RNA, 18 nt, Human
agugauuaccagggacug

SEQ ID NO: 1792115 - RNA, 23 nt, Human
agugugacaaggauugcuacugu

SEQ ID NO: 1792116 - RNA, 15 nt, Human
aguuguuacauuuuu

SEQ ID NO: 1792117 - RNA, 13 nt, Human
aguuguuacauuu

SEQ ID NO: 1792118 - RNA, 23 nt, Human
aguuguuaauaaaaguacauguu

SEQ ID NO: 1792119 - RNA, 16 nt, Human
aguuguuacauuuuua

SEQ ID NO: 1792120 - RNA, 18 nt, Human
aguuacagacaaagcgug

SEQ ID NO: 1792121 - RNA, 19 nt, Human
aguuguaccgcaaugugac

SEQ ID NO: 1792122 - RNA, 18 nt, Human
aguuguaccgcaauguga

SEQ ID NO: 1792123 - RNA, 18 nt, Human
agucaaggguaggguggg

SEQ ID NO: 1792124 - RNA, 16 nt, Human
agucaagugaaaaagg

SEQ ID NO: 1792125 - RNA, 20 nt, Human
agucaagugaaaaaggagga

SEQ ID NO: 1792126 - RNA, 13 nt, Human
agugauccuccca

SEQ ID NO: 1792127 - RNA, 16 nt, Human
aguccacaguggaacc

SEQ ID NO: 1792128 - RNA, 22 nt, Human
accccuaaagagauacuuugau

SEQ ID NO: 1792129 - RNA, 15 nt, Human
accccggccaccugc

SEQ ID NO: 1792130 - RNA, 18 nt, Human
accccgaccaccugccca

SEQ ID NO: 1792131 - RNA, 13 nt, Human
acccaagggccug

SEQ ID NO: 1792132 - RNA, 16 nt, Human
acccaagggccuggcc

SEQ ID NO: 1792133 - RNA, 15 nt, Human
acccacaagaaauga

SEQ ID NO: 1792134 - RNA, 17 nt, Human
acccaugcugcccugug

SEQ ID NO: 1792135 - RNA, 18 nt, Human
acccaugcugcccuguga

SEQ ID NO: 1792136 - RNA, 19 nt, Human
acccaugcugcccugugag

SEQ ID NO: 1792137 - RNA, 17 nt, Human
accaucaugucuggcua

SEQ ID NO: 1792138 - RNA, 16 nt, Human
accaucaugucuggcu

SEQ ID NO: 1792139 - RNA, 12 nt, Human
accaucauugaa

SEQ ID NO: 1792140 - RNA, 18 nt, Human
accaucccugaaggcccc

SEQ ID NO: 1792141 - RNA, 21 nt, Human
accaucccugaaggccccgcc

SEQ ID NO: 1792142 - RNA, 22 nt, Human
accaucccugaaggccccgccc

SEQ ID NO: 1792143 - RNA, 14 nt, Human
accaucaugucugg

SEQ ID NO: 1792144 - RNA, 20 nt, Human
accccucaacaccucugcac

SEQ ID NO: 1792145 - RNA, 22 nt, Human
acaucagcacgauuucuguuua

SEQ ID NO: 1792146 - RNA, 21 nt, Human
acaucagcacgauuucuguuu

SEQ ID NO: 1792147 - RNA, 20 nt, Human
acaucagcacgauuucuguu

SEQ ID NO: 1792148 - RNA, 23 nt, Human
acauaaacaagaccacguuucua

SEQ ID NO: 1792149 - RNA, 19 nt, Human
acaugcaaggucauuuuuu

SEQ ID NO: 1792150 - RNA, 20 nt, Human
acaugcacagcuaacaugga

SEQ ID NO: 1792151 - RNA, 23 nt, Human
acaugcacagcuaacauggaagu

SEQ ID NO: 1792152 - RNA, 21 nt, Human
acauguuuuucuucucccuca

SEQ ID NO: 1792153 - RNA, 13 nt, Human
acauguuacaaca

SEQ ID NO: 1792154 - RNA, 20 nt, Human
accacgcccggcuaauuuuu

SEQ ID NO: 1792155 - RNA, 14 nt, Human
accacgcccggcua

SEQ ID NO: 1792156 - RNA, 14 nt, Human
accacuacauucug

SEQ ID NO: 1792157 - RNA, 19 nt, Human
accacguuucuaaaggcua

SEQ ID NO: 1792158 - RNA, 15 nt, Human
accacguuucuaaag

SEQ ID NO: 1792159 - RNA, 14 nt, Human
accagcagccugga

SEQ ID NO: 1792160 - RNA, 17 nt, Human
accagcagccuggaccc

SEQ ID NO: 1792161 - RNA, 23 nt, Human
acagagucucacuguugcccagg

SEQ ID NO: 1792162 - RNA, 19 nt, Human
acagagucucacuguugcc

SEQ ID NO: 1792163 - RNA, 17 nt, Human
acagagucucacuguug

SEQ ID NO: 1792164 - RNA, 14 nt, Human
acagagucucacug

SEQ ID NO: 1792165 - RNA, 12 nt, Human
acagagucucac

SEQ ID NO: 1792166 - RNA, 22 nt, Human
acagaggggguggccucccaac

SEQ ID NO: 1792167 - RNA, 19 nt, Human
acagccacggccaggccag

SEQ ID NO: 1792168 - RNA, 15 nt, Human
acagccaugauucuu

SEQ ID NO: 1792169 - RNA, 12 nt, Human
acagaagcagcu

SEQ ID NO: 1792170 - RNA, 13 nt, Human
acagaagcagcuc

SEQ ID NO: 1792171 - RNA, 14 nt, Human
acagaagcagcucu

SEQ ID NO: 1792172 - RNA, 15 nt, Human
acagaagcagcucuu

SEQ ID NO: 1792173 - RNA, 21 nt, Human
acagaacacauaauucaggaa

SEQ ID NO: 1792174 - RNA, 16 nt, Human
acaggcaagcaccucc

SEQ ID NO: 1792175 - RNA, 15 nt, Human
acaggcaagcaccuc

SEQ ID NO: 1792176 - RNA, 18 nt, Human
acaggcaagcaccuccug

SEQ ID NO: 1792177 - RNA, 19 nt, Human
acaggcaagcaccuccugc

SEQ ID NO: 1792178 - RNA, 21 nt, Human
acagcugcucaauaaaguaca

SEQ ID NO: 1792179 - RNA, 23 nt, Human
acaggugugaaccaccacaccca

SEQ ID NO: 1792180 - RNA, 20 nt, Human
acaggugugaaccaccacac

SEQ ID NO: 1792181 - RNA, 22 nt, Human
acaggugugagccaccacgccc

SEQ ID NO: 1792182 - RNA, 21 nt, Human
acaggugugagccaccacgcc

SEQ ID NO: 1792183 - RNA, 15 nt, Human
acagcuccuucuguc

SEQ ID NO: 1792184 - RNA, 20 nt, Human
acagcucugcauacucauua

SEQ ID NO: 1792185 - RNA, 13 nt, Human
acagcucuguccu

SEQ ID NO: 1792186 - RNA, 14 nt, Human
acagcugccuggga

SEQ ID NO: 1792187 - RNA, 23 nt, Human
acagcugccugggaucccucauc

SEQ ID NO: 1792188 - RNA, 14 nt, Human
acagcuccuucugu

SEQ ID NO: 1792189 - RNA, 13 nt, Human
acagcuccuucug

SEQ ID NO: 1792190 - RNA, 12 nt, Human
acagcuccuucu

SEQ ID NO: 1792191 - RNA, 13 nt, Human
acaaagacugagu

SEQ ID NO: 1792192 - RNA, 18 nt, Human
acaacuaugauuuggaaa

SEQ ID NO: 1792193 - RNA, 21 nt, Human
acaaaccuguuucugcagcca

SEQ ID NO: 1792194 - RNA, 15 nt, Human
acaaacgggcucagc

SEQ ID NO: 1792195 - RNA, 20 nt, Human
acaaaauguaggguuauaau

SEQ ID NO: 1792196 - RNA, 12 nt, Human
aauuuucuuuca

SEQ ID NO: 1792197 - RNA, 13 nt, Human
aauuuugaaaaac

SEQ ID NO: 1792198 - RNA, 24 nt, Human
acaacuugcacguauuuuaauagc

SEQ ID NO: 1792199 - RNA, 21 nt, Human
acaaguaugaauaaagacacc

SEQ ID NO: 1792200 - RNA, 23 nt, Human
acaaguaugaauaaagacaccua

SEQ ID NO: 1792201 - RNA, 12 nt, Human
acaccagagccc

SEQ ID NO: 1792202 - RNA, 17 nt, Human
acacgcuccuuccucug

SEQ ID NO: 1792203 - RNA, 19 nt, Human
acacgcuccuuccucugag

SEQ ID NO: 1792204 - RNA, 14 nt, Human
acaccacuacauuc

SEQ ID NO: 1792205 - RNA, 12 nt, Human
acacagcucugu

SEQ ID NO: 1792206 - RNA, 11 nt, Human
acacagcucug

SEQ ID NO: 1792207 - RNA, 14 nt, Human
acacagcucugucc

SEQ ID NO: 1792208 - RNA, 15 nt, Human
acacuaaccacgcug

SEQ ID NO: 1792209 - RNA, 14 nt, Human
acacuaaccacgcu

SEQ ID NO: 1792210 - RNA, 15 nt, Human
acacggacacucaaa

SEQ ID NO: 1792211 - RNA, 15 nt, Human
acaauuuauuauggc

SEQ ID NO: 1792212 - RNA, 16 nt, Human
acaauuuauuauggca

SEQ ID NO: 1792213 - RNA, 18 nt, Human
acacaaacgggcucagca

SEQ ID NO: 1792214 - RNA, 14 nt, Human
agaaaauaacaaua

SEQ ID NO: 1792215 - RNA, 23 nt, Human
agaaaauggaagacagcucuuau

SEQ ID NO: 1792216 - RNA, 15 nt, Human
agaaaauggacgugu

SEQ ID NO: 1792217 - RNA, 20 nt, Human
agaaaauggacguguuauga

SEQ ID NO: 1792218 - RNA, 22 nt, Human
agaaaauggacguguuaugacu

SEQ ID NO: 1792219 - RNA, 23 nt, Human
agaaaauggacguguuaugacuc

SEQ ID NO: 1792220 - RNA, 20 nt, Human
agaaaagggaacugaacauu

SEQ ID NO: 1792221 - RNA, 22 nt, Human
acuuuuauaaacuuuaccuuuu

SEQ ID NO: 1792222 - RNA, 19 nt, Human
acuuuuauaaacuuuaccu

SEQ ID NO: 1792223 - RNA, 15 nt, Human
acuuuuauaaacuuu

SEQ ID NO: 1792224 - RNA, 16 nt, Human
acuuucuagccagagg

SEQ ID NO: 1792225 - RNA, 23 nt, Human
acuuuguucuggcucuuccaggc

SEQ ID NO: 1792226 - RNA, 23 nt, Human
acuuuccuucauucaacccaccu

SEQ ID NO: 1792227 - RNA, 22 nt, Human
acuuucauauuuuaaacagagg

SEQ ID NO: 1792228 - RNA, 23 nt, Human
acuuuagggaaguacuuuuggca

SEQ ID NO: 1792229 - RNA, 23 nt, Human
agaaaggaggggauagagagaga

SEQ ID NO: 1792230 - RNA, 20 nt, Human
agaaaggaggggauagagag

SEQ ID NO: 1792231 - RNA, 15 nt, Human
agaaauaaaguuucu

SEQ ID NO: 1792232 - RNA, 18 nt, Human
agaaauaaaguuucuguu

SEQ ID NO: 1792233 - RNA, 14 nt, Human
acuggagaaaaugg

SEQ ID NO: 1792234 - RNA, 14 nt, Human
acuggaagcacagc

SEQ ID NO: 1792235 - RNA, 15 nt, Human
acuggaagcacagcu

SEQ ID NO: 1792236 - RNA, 16 nt, Human
acuggaagcacagcuu

SEQ ID NO: 1792237 - RNA, 19 nt, Human
acugcccccucugcccugc

SEQ ID NO: 1792238 - RNA, 18 nt, Human
acugcccccucugcccug

SEQ ID NO: 1792239 - RNA, 20 nt, Human
acugcccccucugcccugcg

SEQ ID NO: 1792240 - RNA, 16 nt, Human
acugugccaugugcca

SEQ ID NO: 1792241 - RNA, 12 nt, Human
acugucuucagu

SEQ ID NO: 1792242 - RNA, 23 nt, Human
acugguggcccgacagccuggca

SEQ ID NO: 1792243 - RNA, 21 nt, Human
acugguggcccgacagccugg

SEQ ID NO: 1792244 - RNA, 22 nt, Human
acugguggcccgacagccuggc

SEQ ID NO: 1792245 - RNA, 20 nt, Human
acugguggcccgacagccug

SEQ ID NO: 1792246 - RNA, 19 nt, Human
acugucucaagagggcacu

SEQ ID NO: 1792247 - RNA, 13 nt, Human
acuguuucaaacu

SEQ ID NO: 1792248 - RNA, 15 nt, Human
acuuauuuauauaaa

SEQ ID NO: 1792249 - RNA, 19 nt, Human
acuucacauauugauuucc

SEQ ID NO: 1792250 - RNA, 19 nt, Human
acuuguaaaggaauuuaaa

SEQ ID NO: 1792251 - RNA, 20 nt, Human
acuuguaaaggaauuuaaaa

SEQ ID NO: 1792252 - RNA, 15 nt, Human
acuuggucugugaga

SEQ ID NO: 1792253 - RNA, 14 nt, Human
acuuggucugugag

SEQ ID NO: 1792254 - RNA, 19 nt, Human
acuucugccauauucuguu

SEQ ID NO: 1792255 - RNA, 18 nt, Human
acuucugccauauucugu

SEQ ID NO: 1792256 - RNA, 22 nt, Human
acuucugccagcauaauacuug

SEQ ID NO: 1792257 - RNA, 23 nt, Human
acuucacauauugauuuccguua

SEQ ID NO: 1792258 - RNA, 20 nt, Human
acuuguaaaugugguaaaga

SEQ ID NO: 1792259 - RNA, 18 nt, Human
acuuguaaaugugguaaa

SEQ ID NO: 1792260 - RNA, 21 nt, Human
acuuggucugugagaugcuag

SEQ ID NO: 1792261 - RNA, 14 nt, Human
acuagcuauggugu

SEQ ID NO: 1792262 - RNA, 15 nt, Human
acuaggguccugggg

SEQ ID NO: 1792263 - RNA, 16 nt, Human
acuaggguccugggga

SEQ ID NO: 1792264 - RNA, 14 nt, Human
acucaguggggagg

SEQ ID NO: 1792265 - RNA, 12 nt, Human
acuccccuccuu

SEQ ID NO: 1792266 - RNA, 13 nt, Human
acuccccugcugg

SEQ ID NO: 1792267 - RNA, 17 nt, Human
acuccccugcugggugu

SEQ ID NO: 1792268 - RNA, 14 nt, Human
acucccccaggugg

SEQ ID NO: 1792269 - RNA, 11 nt, Human
acuauaaugua

SEQ ID NO: 1792270 - RNA, 17 nt, Human
acucaaacucuuaaaac

SEQ ID NO: 1792271 - RNA, 16 nt, Human
acucaaacucuuaaaa

SEQ ID NO: 1792272 - RNA, 13 nt, Human
acucccuuucaac

SEQ ID NO: 1792273 - RNA, 12 nt, Human
acucccuuucaa

SEQ ID NO: 1792274 - RNA, 14 nt, Human
acucuaucaaguau

SEQ ID NO: 1792275 - RNA, 21 nt, Human
acucuaucaaguauuauaccu

SEQ ID NO: 1792276 - RNA, 16 nt, Human
acucuaucaaguauua

SEQ ID NO: 1792277 - RNA, 16 nt, Human
acucugugucaggugg

SEQ ID NO: 1792278 - RNA, 11 nt, Human
acucuuaaaac

SEQ ID NO: 1792279 - RNA, 18 nt, Human
acucuuaaaacccaagug

SEQ ID NO: 1792280 - RNA, 21 nt, Human
acucuacccucuuagaaaaac

SEQ ID NO: 1792281 - RNA, 13 nt, Human
acucuacccucuu

SEQ ID NO: 1792282 - RNA, 18 nt, Human
acucuacccucuuagaaa

SEQ ID NO: 1792283 - RNA, 17 nt, Human
acguggcugcuucaagg

SEQ ID NO: 1792284 - RNA, 13 nt, Human
acguggcugcuuc

SEQ ID NO: 1792285 - RNA, 14 nt, Human
acguggcugcuuca

SEQ ID NO: 1792286 - RNA, 15 nt, Human
acguggcugcuucaa

SEQ ID NO: 1792287 - RNA, 15 nt, Human
acgcugugcugcccu

SEQ ID NO: 1792288 - RNA, 16 nt, Human
acgcugugcugcccug

SEQ ID NO: 1792289 - RNA, 17 nt, Human
acgcugugcugcccugc

SEQ ID NO: 1792290 - RNA, 18 nt, Human
acgcugugcugcccugcc

SEQ ID NO: 1792291 - RNA, 19 nt, Human
acgugauuuugcuguagaa

SEQ ID NO: 1792292 - RNA, 22 nt, Human
acuaaguuuuuauggcuuuugu

SEQ ID NO: 1792293 - RNA, 15 nt, Human
acuaaguuuuuaugg

SEQ ID NO: 1792294 - RNA, 18 nt, Human
acgccacugcacuauagc

SEQ ID NO: 1792295 - RNA, 17 nt, Human
acgauuucuguuuagau

SEQ ID NO: 1792296 - RNA, 14 nt, Human
acgauuucuguuua

SEQ ID NO: 1792297 - RNA, 13 nt, Human
acgauuucuguuu

SEQ ID NO: 1792298 - RNA, 12 nt, Human
acgauuucuguu

SEQ ID NO: 1792299 - RNA, 14 nt, Human
accuuggcugcagg

SEQ ID NO: 1792300 - RNA, 12 nt, Human
accuuuauucug

SEQ ID NO: 1792301 - RNA, 13 nt, Human
accuuuauucugg

SEQ ID NO: 1792302 - RNA, 16 nt, Human
accuuucaauaggaaa

SEQ ID NO: 1792303 - RNA, 12 nt, Human
accuuggcugca

SEQ ID NO: 1792304 - RNA, 14 nt, Human
accuuggcucaagu

SEQ ID NO: 1792305 - RNA, 20 nt, Human
accuguaaugacaggccugu

SEQ ID NO: 1792306 - RNA, 15 nt, Human
accuguaaugacagg

SEQ ID NO: 1792307 - RNA, 20 nt, Human
accugccccuccucucugcc

SEQ ID NO: 1792308 - RNA, 22 nt, Human
accugccccuccucucugcccu

SEQ ID NO: 1792309 - RNA, 17 nt, Human
accuuucaauaggaaaa

SEQ ID NO: 1792310 - RNA, 21 nt, Human
accuuucaauaggaaaaacug

SEQ ID NO: 1792311 - RNA, 23 nt, Human
accuuucaauaggaaaaacugau

SEQ ID NO: 1792312 - RNA, 21 nt, Human
accucugcacaagcugcaccc

SEQ ID NO: 1792313 - RNA, 16 nt, Human
accucugcacaagcug

SEQ ID NO: 1792314 - RNA, 18 nt, Human
accucugcacaagcugca

SEQ ID NO: 1792315 - RNA, 14 nt, Human
accugccccuccuc

SEQ ID NO: 1792316 - RNA, 18 nt, Human
accugccccuccucucug

SEQ ID NO: 1792317 - RNA, 23 nt, Human
accugccccucaacucuccucca

SEQ ID NO: 1792318 - RNA, 21 nt, Human
accugcccaaccugcucuccu

SEQ ID NO: 1792319 - RNA, 13 nt, Human
aacaugauuuggg

SEQ ID NO: 1792320 - RNA, 13 nt, Human
aacagcucgacuu

SEQ ID NO: 1792321 - RNA, 17 nt, Human
aaccaguguuguggauu

SEQ ID NO: 1792322 - RNA, 22 nt, Human
aaccacucuaucaaguauuaua

SEQ ID NO: 1792323 - RNA, 23 nt, Human
aacauguaauuaaguacuaugua

SEQ ID NO: 1792324 - RNA, 14 nt, Human
aacauguaauuaag

SEQ ID NO: 1792325 - RNA, 21 nt, Human
aacauguaauuaaguacuaug

SEQ ID NO: 1792326 - RNA, 14 nt, Human
aaccagaucauugu

SEQ ID NO: 1792327 - RNA, 12 nt, Human
aaccagaucauu

SEQ ID NO: 1792328 - RNA, 14 nt, Human
aacccuggugacca

SEQ ID NO: 1792329 - RNA, 19 nt, Human
aacacauuuuucuuaggga

SEQ ID NO: 1792330 - RNA, 18 nt, Human
aaauugcauuuccugaca

SEQ ID NO: 1792331 - RNA, 15 nt, Human
aacaaagaaauuaug

SEQ ID NO: 1792332 - RNA, 17 nt, Human
aacaaagaaauuaugug

SEQ ID NO: 1792333 - RNA, 19 nt, Human
aacugauuuuuuuuuccuu

SEQ ID NO: 1792334 - RNA, 17 nt, Human
aacugauuuuuuuuucc

SEQ ID NO: 1792335 - RNA, 14 nt, Human
aacugaccagccuc

SEQ ID NO: 1792336 - RNA, 19 nt, Human
aacugaccagccuccaugc

SEQ ID NO: 1792337 - RNA, 15 nt, Human
aacugaauuuugucu

SEQ ID NO: 1792338 - RNA, 19 nt, Human
aacuuaaauaaugugaaac

SEQ ID NO: 1792339 - RNA, 17 nt, Human
aacuuaaauaaugugaa

SEQ ID NO: 1792340 - RNA, 23 nt, Human
aacugaacucugacaacagacuu

SEQ ID NO: 1792341 - RNA, 14 nt, Human
aacugaauuuuguc

SEQ ID NO: 1792342 - RNA, 19 nt, Human
aacugaacucugacaacag

SEQ ID NO: 1792343 - RNA, 20 nt, Human
aacugaacucugacaacaga

SEQ ID NO: 1792344 - RNA, 16 nt, Human
aacugaacucugacaa

SEQ ID NO: 1792345 - RNA, 12 nt, Human
aacucaccccag

SEQ ID NO: 1792346 - RNA, 15 nt, Human
aacucaccccagccc

SEQ ID NO: 1792347 - RNA, 15 nt, Human
aacucaccugccccu

SEQ ID NO: 1792348 - RNA, 16 nt, Human
aacucaccugccccuc

SEQ ID NO: 1792349 - RNA, 13 nt, Human
aacuucacauauu

SEQ ID NO: 1792350 - RNA, 14 nt, Human
aacuuuuuuuuaag

SEQ ID NO: 1792351 - RNA, 20 nt, Human
aacuuuuuuuuaaguuacac

SEQ ID NO: 1792352 - RNA, 19 nt, Human
aacuuuuauaaacuuuacc

SEQ ID NO: 1792353 - RNA, 16 nt, Human
aacuuuuauaaacuuu

SEQ ID NO: 1792354 - RNA, 20 nt, Human
aacuuugaccucugcagcaa

SEQ ID NO: 1792355 - RNA, 19 nt, Human
aacuuugaccucugcagca

SEQ ID NO: 1792356 - RNA, 15 nt, Human
aacuuuuauaaacuu

SEQ ID NO: 1792357 - RNA, 12 nt, Human
aacuuuuauaaa

SEQ ID NO: 1792358 - RNA, 17 nt, Human
aacuuugaccucugcag

SEQ ID NO: 1792359 - RNA, 14 nt, Human
aacuuugaccucug

SEQ ID NO: 1792360 - RNA, 13 nt, Human
aacuuugaccucu

SEQ ID NO: 1792361 - RNA, 17 nt, Human
aaacagauuuggaaaga

SEQ ID NO: 1792362 - RNA, 19 nt, Human
aaacacuguucucugcccu

SEQ ID NO: 1792363 - RNA, 22 nt, Human
aaacacuguucucugcccucca

SEQ ID NO: 1792364 - RNA, 13 nt, Human
aaacacucuugaa

SEQ ID NO: 1792365 - RNA, 14 nt, Human
aaacacucuugaaa

SEQ ID NO: 1792366 - RNA, 17 nt, Human
aaacacucuugaaaaau

SEQ ID NO: 1792367 - RNA, 18 nt, Human
aaacacuguucucugccc

SEQ ID NO: 1792368 - RNA, 13 nt, Human
aaaauucagugga

SEQ ID NO: 1792369 - RNA, 15 nt, Human
aaaacacauuuuucu

SEQ ID NO: 1792370 - RNA, 13 nt, Human
aaaacacauuuuu

SEQ ID NO: 1792371 - RNA, 17 nt, Human
aaagaguacucuuguuu

SEQ ID NO: 1792372 - RNA, 12 nt, Human
aaagaguacucu

SEQ ID NO: 1792373 - RNA, 11 nt, Human
aaagaacaucc

SEQ ID NO: 1792374 - RNA, 15 nt, Human
aaagaaauuaugugc

SEQ ID NO: 1792375 - RNA, 13 nt, Human
aaagaaauuaugu

SEQ ID NO: 1792376 - RNA, 12 nt, Human
aaagaaaacuug

SEQ ID NO: 1792377 - RNA, 20 nt, Human
aaagaaaacuuguauuaugu

SEQ ID NO: 1792378 - RNA, 12 nt, Human
aaauaacaauga

SEQ ID NO: 1792379 - RNA, 22 nt, Human
aaauaaaauuaaagcugaaaac

SEQ ID NO: 1792380 - RNA, 14 nt, Human
aaagugcugggauu

SEQ ID NO: 1792381 - RNA, 12 nt, Human
aaagugcuggga

SEQ ID NO: 1792382 - RNA, 11 nt, Human
aaagugcuggg

SEQ ID NO: 1792383 - RNA, 23 nt, Human
aaagugagacuuugaggguguau

SEQ ID NO: 1792384 - RNA, 20 nt, Human
aaagucuguugauuaaagau

SEQ ID NO: 1792385 - RNA, 19 nt, Human
aaagucuguugauuaaaga

SEQ ID NO: 1792386 - RNA, 18 nt, Human
aaagucuguugauuaaag

SEQ ID NO: 1792387 - RNA, 20 nt, Human
aaagucucuggaauuugaaa

SEQ ID NO: 1792388 - RNA, 22 nt, Human
aaagucucuggaauuugaaaca

SEQ ID NO: 1792389 - RNA, 19 nt, Human
aaagucucuggaauuugaa

SEQ ID NO: 1792390 - RNA, 16 nt, Human
aaagggacugagaaau

SEQ ID NO: 1792391 - RNA, 21 nt, Human
aaagggaacugaacauuccag

SEQ ID NO: 1792392 - RNA, 16 nt, Human
aaagggaacugaacau

SEQ ID NO: 1792393 - RNA, 16 nt, Human
aaauggaaaugggcag

SEQ ID NO: 1792394 - RNA, 18 nt, Human
aaauggaagacagcucuu

SEQ ID NO: 1792395 - RNA, 20 nt, Human
aaauggacguguuaugacuc

SEQ ID NO: 1792396 - RNA, 21 nt, Human
aaauggacguguuaugacucc

SEQ ID NO: 1792397 - RNA, 22 nt, Human
aaauggacguguuaugacucca

SEQ ID NO: 1792398 - RNA, 22 nt, Human
aaauacuguuuuuaacaacuau

SEQ ID NO: 1792399 - RNA, 14 nt, Human
aaauauaauugaca

SEQ ID NO: 1792400 - RNA, 13 nt, Human
aaauaguaaaaau

SEQ ID NO: 1792401 - RNA, 16 nt, Human
aaauaguaaaaauaaa

SEQ ID NO: 1792402 - RNA, 17 nt, Human
aaauagacagcaugaga

SEQ ID NO: 1792403 - RNA, 11 nt, Human
aagcugggcag

SEQ ID NO: 1792404 - RNA, 18 nt, Human
aaggacauugcggacagc

SEQ ID NO: 1792405 - RNA, 15 nt, Human
aagcugggcagguug

SEQ ID NO: 1792406 - RNA, 13 nt, Human
aagcugggcaggu

SEQ ID NO: 1792407 - RNA, 18 nt, Human
aaggacccggaggggccu

SEQ ID NO: 1792408 - RNA, 15 nt, Human
aaggacuaggguccu

SEQ ID NO: 1792409 - RNA, 21 nt, Human
aaggacccggaggggccuggc

SEQ ID NO: 1792410 - RNA, 18 nt, Human
aaggacuaggguccuggg

SEQ ID NO: 1792411 - RNA, 20 nt, Human
aaggacuaggguccugggga

SEQ ID NO: 1792412 - RNA, 22 nt, Human
aagcugcacccucaggcaggug

SEQ ID NO: 1792413 - RNA, 17 nt, Human
aagcuaagguuuagaua

SEQ ID NO: 1792414 - RNA, 21 nt, Human
aagcugcacccucaggcaggu

SEQ ID NO: 1792415 - RNA, 20 nt, Human
aagcugcacccucaggcagg

SEQ ID NO: 1792416 - RNA, 12 nt, Human
aagcguggugga

SEQ ID NO: 1792417 - RNA, 17 nt, Human
aaggcaaggcugucaau

SEQ ID NO: 1792418 - RNA, 18 nt, Human
aaggcaaggcugucaauu

SEQ ID NO: 1792419 - RNA, 21 nt, Human
aagaaauuuccacucaggucu

SEQ ID NO: 1792420 - RNA, 13 nt, Human
aagaaauuaugug

SEQ ID NO: 1792421 - RNA, 22 nt, Human
aagaaauuaugugccagauuua

SEQ ID NO: 1792422 - RNA, 11 nt, Human
aagcagcucuu

SEQ ID NO: 1792423 - RNA, 21 nt, Human
aagcagaggaaggagaggaga

SEQ ID NO: 1792424 - RNA, 14 nt, Human
aagcagaggaagga

SEQ ID NO: 1792425 - RNA, 18 nt, Human
aagccauaauuguucuua

SEQ ID NO: 1792426 - RNA, 21 nt, Human
aauaauccuaaacauaugaau

SEQ ID NO: 1792427 - RNA, 20 nt, Human
aauaauaaagaauagcuuua

SEQ ID NO: 1792428 - RNA, 12 nt, Human
aauaauaaagaa

SEQ ID NO: 1792429 - RNA, 12 nt, Human
aauaauguaaga

SEQ ID NO: 1792430 - RNA, 19 nt, Human
aauaauguaagacaaauau

SEQ ID NO: 1792431 - RNA, 16 nt, Human
aauaaugugaaacugg

SEQ ID NO: 1792432 - RNA, 17 nt, Human
aagugguauagaaaugc

SEQ ID NO: 1792433 - RNA, 13 nt, Human
aagugguauagaa

SEQ ID NO: 1792434 - RNA, 15 nt, Human
aaguuguuaauaaaa

SEQ ID NO: 1792435 - RNA, 19 nt, Human
aauaaacuauuuguaaagu

SEQ ID NO: 1792436 - RNA, 23 nt, Human
aauaaaauuaaagcugaaaacug

SEQ ID NO: 1792437 - RNA, 11 nt, Human
aaguacuucuu

SEQ ID NO: 1792438 - RNA, 14 nt, Human
aaguacuuuuggca

SEQ ID NO: 1792439 - RNA, 15 nt, Human
aaguacuuuuggcau

SEQ ID NO: 1792440 - RNA, 23 nt, Human
aaguccaggcuuuuuuaucaugu

SEQ ID NO: 1792441 - RNA, 16 nt, Human
aaguaucccuacugua

SEQ ID NO: 1792442 - RNA, 20 nt, Human
aagguuaauguucaucaucc

SEQ ID NO: 1792443 - RNA, 15 nt, Human
aagguuaauaaagua

SEQ ID NO: 1792444 - RNA, 16 nt, Human
aagguuaauaaaguaa

SEQ ID NO: 1792445 - RNA, 11 nt, Human
aaggugggagg

SEQ ID NO: 1792446 - RNA, 19 nt, Human
aagucucuggaauuugaaa

SEQ ID NO: 1792447 - RNA, 16 nt, Human
aagucuuagauguaua

SEQ ID NO: 1792448 - RNA, 21 nt, Human
aaugaugauccuaggcauuug

SEQ ID NO: 1792449 - RNA, 22 nt, Human
aaucugcuuuuuaaagaaugcu

SEQ ID NO: 1792450 - RNA, 23 nt, Human
aaugaaccacaucuugcucugcu

SEQ ID NO: 1792451 - RNA, 17 nt, Human
aaugaaccacaucuugc

SEQ ID NO: 1792452 - RNA, 16 nt, Human
aaugaaccacaucuug

SEQ ID NO: 1792453 - RNA, 18 nt, Human
aauccaggguggugguga

SEQ ID NO: 1792454 - RNA, 18 nt, Human
aaucuccaaaauaaaacu

SEQ ID NO: 1792455 - RNA, 14 nt, Human
aaucuccaaaauaa

SEQ ID NO: 1792456 - RNA, 13 nt, Human
aaucuccaaaaua

SEQ ID NO: 1792457 - RNA, 19 nt, Human
aaugaugccaugaggaaca

SEQ ID NO: 1792458 - RNA, 18 nt, Human
aauauggucuuuugguua

SEQ ID NO: 1792459 - RNA, 18 nt, Human
aauauaggaacuuaaaua

SEQ ID NO: 1792460 - RNA, 21 nt, Human
aauauaggaacuuaaauaaug

SEQ ID NO: 1792461 - RNA, 20 nt, Human
aauauaggaacuuaaauaau

SEQ ID NO: 1792462 - RNA, 20 nt, Human
aaugucucuuuaaugucaca

SEQ ID NO: 1792463 - RNA, 22 nt, Human
aaugucuaguuguaacaccaug

SEQ ID NO: 1792464 - RNA, 17 nt, Human
aaugucagugugacuga

SEQ ID NO: 1792465 - RNA, 21 nt, Human
aaugucagugugacugaucuc

SEQ ID NO: 1792466 - RNA, 22 nt, Human
aauggucuuucuaaugugugaa

SEQ ID NO: 1792467 - RNA, 15 nt, Human
aaugucagugugacu

SEQ ID NO: 1792468 - RNA, 16 nt, Human
aaugucagugugacug

SEQ ID NO: 1792469 - RNA, 13 nt, Human
aaugucaguguga

SEQ ID NO: 1792470 - RNA, 20 nt, Human
aaugguacuccacauauuuc

SEQ ID NO: 1792471 - RNA, 15 nt, Human
aaugggcagagcaga

SEQ ID NO: 1792472 - RNA, 13 nt, Human
aaugggcagagca

SEQ ID NO: 1792473 - RNA, 19 nt, Human
aauguuugccucugccucu

SEQ ID NO: 1792474 - RNA, 18 nt, Human
aauguuugccucugccuc

SEQ ID NO: 1792475 - RNA, 18 nt, Human
aauuaaaacacaacaucu

SEQ ID NO: 1792476 - RNA, 18 nt, Human
aauuaguggcacuugcuu

SEQ ID NO: 1792477 - RNA, 12 nt, Human
aaaacacauuuu

SEQ ID NO: 1792478 - RNA, 15 nt, Human
aaaaacugauuuuuu

SEQ ID NO: 1792479 - RNA, 14 nt, Human
aaaaacauggccuu

SEQ ID NO: 1792480 - RNA, 13 nt, Human
aaaaacugauuuu

SEQ ID NO: 1792481 - RNA, 12 nt, Human
aaaaagaggcua

SEQ ID NO: 1792482 - RNA, 14 nt, Human
aaaaacacaaaagu

SEQ ID NO: 1792483 - RNA, 14 nt, Human
uuaucuugaauaau

SEQ ID NO: 1792484 - RNA, 16 nt, Human
uuaucuugaauaaugu

SEQ ID NO: 1792485 - RNA, 14 nt, Human
uuaucuagauacug

SEQ ID NO: 1792486 - RNA, 16 nt, Human
uuauauuuacaaaugg

SEQ ID NO: 1792487 - RNA, 23 nt, Human
uuauuaaaaaucucaaauuucua

SEQ ID NO: 1792488 - RNA, 19 nt, Human
uuauuaaaugcccagcccc

SEQ ID NO: 1792489 - RNA, 21 nt, Human
uuauuaaaugcccagccccuu

SEQ ID NO: 1792490 - RNA, 19 nt, Human
uuaugauuuuuaaagaaaa

SEQ ID NO: 1792491 - RNA, 16 nt, Human
uuaugauuuuuaaaga

SEQ ID NO: 1792492 - RNA, 17 nt, Human
uuauggaacacucugag

SEQ ID NO: 1792493 - RNA, 21 nt, Human
uuauggacaaugacccagugg

SEQ ID NO: 1792494 - RNA, 18 nt, Human
uuauggaacacucugaga

SEQ ID NO: 1792495 - RNA, 20 nt, Human
uuauggaacacucugagacu

SEQ ID NO: 1792496 - RNA, 17 nt, Human
uuauggcuuuugugcau

SEQ ID NO: 1792497 - RNA, 18 nt, Human
uuauggcuuuugugcauu

SEQ ID NO: 1792498 - RNA, 17 nt, Human
uuauguugcauagaaua

SEQ ID NO: 1792499 - RNA, 14 nt, Human
uuauggcacaucag

SEQ ID NO: 1792500 - RNA, 16 nt, Human
uuauggcuuuugugca

SEQ ID NO: 1792501 - RNA, 19 nt, Human
uuagugaccucagcuuuga

SEQ ID NO: 1792502 - RNA, 21 nt, Human
ugugaaaagaaaaaugagccu

SEQ ID NO: 1792503 - RNA, 17 nt, Human
ugugaaaagaaaaauga

SEQ ID NO: 1792504 - RNA, 13 nt, Human
ugugaaaagaaaa

SEQ ID NO: 1792505 - RNA, 15 nt, Human
ugugaaaagaaaaau

SEQ ID NO: 1792506 - RNA, 12 nt, Human
uuauaauuuaaa

SEQ ID NO: 1792507 - RNA, 12 nt, Human
uuauaauuuuaa

SEQ ID NO: 1792508 - RNA, 17 nt, Human
uuauaauuuuaaauguu

SEQ ID NO: 1792509 - RNA, 21 nt, Human
uuauaauuuuaaauguuuuuu

SEQ ID NO: 1792510 - RNA, 15 nt, Human
uuauaaugaaugaaa

SEQ ID NO: 1792511 - RNA, 18 nt, Human
uuauaauaauguuaacau

SEQ ID NO: 1792512 - RNA, 15 nt, Human
uuauaauaauguuaa

SEQ ID NO: 1792513 - RNA, 16 nt, Human
uuauauuaugaagcuu

SEQ ID NO: 1792514 - RNA, 13 nt, Human
uuauacauaaaca

SEQ ID NO: 1792515 - RNA, 11 nt, Human
uuauacauaaa

SEQ ID NO: 1792516 - RNA, 13 nt, Human
uuccaaaguacac

SEQ ID NO: 1792517 - RNA, 16 nt, Human
uuccaaaguacacugu

SEQ ID NO: 1792518 - RNA, 14 nt, Human
uuccauggacuuug

SEQ ID NO: 1792519 - RNA, 15 nt, Human
uuccauggacuuugu

SEQ ID NO: 1792520 - RNA, 13 nt, Human
uuccagagccuca

SEQ ID NO: 1792521 - RNA, 19 nt, Human
uuccaacccucaucaccaa

SEQ ID NO: 1792522 - RNA, 23 nt, Human
uucaguuauuauauuuacaaaug

SEQ ID NO: 1792523 - RNA, 20 nt, Human
uucauaaauaaaguuuguug

SEQ ID NO: 1792524 - RNA, 15 nt, Human
uucauaaccuagccu

SEQ ID NO: 1792525 - RNA, 15 nt, Human
uucauccuccucaga

SEQ ID NO: 1792526 - RNA, 19 nt, Human
uucauccuccucagaucuu

SEQ ID NO: 1792527 - RNA, 16 nt, Human
uucaguggcagcugcu

SEQ ID NO: 1792528 - RNA, 15 nt, Human
uucaguggcagcugc

SEQ ID NO: 1792529 - RNA, 17 nt, Human
uucaguggcagcugcuu

SEQ ID NO: 1792530 - RNA, 12 nt, Human
uucaguguacau

SEQ ID NO: 1792531 - RNA, 13 nt, Human
uucaguguacaug

SEQ ID NO: 1792532 - RNA, 15 nt, Human
uucagcuccagcuca

SEQ ID NO: 1792533 - RNA, 12 nt, Human
uucagcuccagc

SEQ ID NO: 1792534 - RNA, 22 nt, Human
uucagcuccagcucaccagccc

SEQ ID NO: 1792535 - RNA, 14 nt, Human
uucaguggcagcug

SEQ ID NO: 1792536 - RNA, 22 nt, Human
uucagcuuguaaauagcucagg

SEQ ID NO: 1792537 - RNA, 18 nt, Human
uuauuuuauuaugcauga

SEQ ID NO: 1792538 - RNA, 17 nt, Human
uuauuuuaauucaguug

SEQ ID NO: 1792539 - RNA, 22 nt, Human
uuauuuuggaaaauaaauuauu

SEQ ID NO: 1792540 - RNA, 18 nt, Human
uucaaaugcuguaacuuu

SEQ ID NO: 1792541 - RNA, 15 nt, Human
uucaaccauucccca

SEQ ID NO: 1792542 - RNA, 21 nt, Human
uucaauaggaaaaacugauuu

SEQ ID NO: 1792543 - RNA, 22 nt, Human
uucaauaggaaaaacugauuuu

SEQ ID NO: 1792544 - RNA, 14 nt, Human
uucaccuuuguccc

SEQ ID NO: 1792545 - RNA, 19 nt, Human
uucaccuuuguccccaccg

SEQ ID NO: 1792546 - RNA, 20 nt, Human
uucaccuuuguccccaccgc

SEQ ID NO: 1792547 - RNA, 13 nt, Human
uucacccuuuucu

SEQ ID NO: 1792548 - RNA, 21 nt, Human
uucacaaccuucuguggcuca

SEQ ID NO: 1792549 - RNA, 22 nt, Human
uucacaagacccaaaaggcaga

SEQ ID NO: 1792550 - RNA, 13 nt, Human
uucacggaagagc

SEQ ID NO: 1792551 - RNA, 22 nt, Human
uucaccuuuguccccaccgcag

SEQ ID NO: 1792552 - RNA, 17 nt, Human
uucacggaagagccuug

SEQ ID NO: 1792553 - RNA, 14 nt, Human
uucagacagcugcc

SEQ ID NO: 1792554 - RNA, 15 nt, Human
uucagacagcugccu

SEQ ID NO: 1792555 - RNA, 16 nt, Human
uucagacagcugccug

SEQ ID NO: 1792556 - RNA, 17 nt, Human
uucagacagcugccugg

SEQ ID NO: 1792557 - RNA, 15 nt, Human
uucagauauaaaaga

SEQ ID NO: 1792558 - RNA, 14 nt, Human
uucagauauaaaag

SEQ ID NO: 1792559 - RNA, 19 nt, Human
uucagauauaaaagacuga

SEQ ID NO: 1792560 - RNA, 14 nt, Human
uucagcucacugca

SEQ ID NO: 1792561 - RNA, 12 nt, Human
uucagauauaaa

SEQ ID NO: 1792562 - RNA, 18 nt, Human
uugaacuggguacuugug

SEQ ID NO: 1792563 - RNA, 17 nt, Human
uugaacuccugaccuca

SEQ ID NO: 1792564 - RNA, 13 nt, Human
uugaacuuugacc

SEQ ID NO: 1792565 - RNA, 14 nt, Human
uugaauuguaagga

SEQ ID NO: 1792566 - RNA, 14 nt, Human
uugacccacaagaa

SEQ ID NO: 1792567 - RNA, 17 nt, Human
uugaccgugaggccaga

SEQ ID NO: 1792568 - RNA, 17 nt, Human
uugacccacaagaaaug

SEQ ID NO: 1792569 - RNA, 21 nt, Human
uugaccucaggugauccaccc

SEQ ID NO: 1792570 - RNA, 15 nt, Human
uugaccucugcagca

SEQ ID NO: 1792571 - RNA, 14 nt, Human
uugaccucugcagc

SEQ ID NO: 1792572 - RNA, 20 nt, Human
uugacgccaucccagcccca

SEQ ID NO: 1792573 - RNA, 16 nt, Human
uugaccucugcagcaa

SEQ ID NO: 1792574 - RNA, 17 nt, Human
uugacgccaucccagcc

SEQ ID NO: 1792575 - RNA, 18 nt, Human
uugacgccaucccagccc

SEQ ID NO: 1792576 - RNA, 19 nt, Human
uugacgccaucccagcccc

SEQ ID NO: 1792577 - RNA, 23 nt, Human
uugauauccucuuugagugaagc

SEQ ID NO: 1792578 - RNA, 11 nt, Human
uugagccuggg

SEQ ID NO: 1792579 - RNA, 13 nt, Human
uugaggguugggc

SEQ ID NO: 1792580 - RNA, 14 nt, Human
uugagccugggagg

SEQ ID NO: 1792581 - RNA, 16 nt, Human
uugaggguugggcugg

SEQ ID NO: 1792582 - RNA, 16 nt, Human
uugaugaucuuugcag

SEQ ID NO: 1792583 - RNA, 17 nt, Human
uugaugacccccaacca

SEQ ID NO: 1792584 - RNA, 21 nt, Human
uugcaaaguaucccuacugua

SEQ ID NO: 1792585 - RNA, 21 nt, Human
uucuuccacaagagcccaggc

SEQ ID NO: 1792586 - RNA, 21 nt, Human
uucuuauacauuugauaaagu

SEQ ID NO: 1792587 - RNA, 21 nt, Human
uucuuguguguuuauugucaa

SEQ ID NO: 1792588 - RNA, 13 nt, Human
uucuuccucccuc

SEQ ID NO: 1792589 - RNA, 14 nt, Human
uucuuuccaaagua

SEQ ID NO: 1792590 - RNA, 12 nt, Human
uucuuucagcca

SEQ ID NO: 1792591 - RNA, 16 nt, Human
uugaacuccuggccuc

SEQ ID NO: 1792592 - RNA, 15 nt, Human
uugaacuccuggccu

SEQ ID NO: 1792593 - RNA, 20 nt, Human
uugaaaaaccauuuugcugu

SEQ ID NO: 1792594 - RNA, 21 nt, Human
uucuuuccaaaguacacuguu

SEQ ID NO: 1792595 - RNA, 23 nt, Human
uugaaaacacuguucucugcccu

SEQ ID NO: 1792596 - RNA, 19 nt, Human
uucugcuucagccucccga

SEQ ID NO: 1792597 - RNA, 16 nt, Human
uucugcuucagccucc

SEQ ID NO: 1792598 - RNA, 15 nt, Human
uucugcuucagccuc

SEQ ID NO: 1792599 - RNA, 14 nt, Human
uucugcuucagccu

SEQ ID NO: 1792600 - RNA, 18 nt, Human
uucugcuuuccucuuccu

SEQ ID NO: 1792601 - RNA, 18 nt, Human
uucuguauuuuguuuuug

SEQ ID NO: 1792602 - RNA, 23 nt, Human
uucuuaguugcuguaugucucgu

SEQ ID NO: 1792603 - RNA, 15 nt, Human
uucuuaguugcugua

SEQ ID NO: 1792604 - RNA, 14 nt, Human
uucuuaguugcugu

SEQ ID NO: 1792605 - RNA, 18 nt, Human
uucggugagcuacaaaug

SEQ ID NO: 1792606 - RNA, 21 nt, Human
uuccuugaguugauucagcuc

SEQ ID NO: 1792607 - RNA, 16 nt, Human
uuccaugucgccucug

SEQ ID NO: 1792608 - RNA, 12 nt, Human
uuccauggccuc

SEQ ID NO: 1792609 - RNA, 16 nt, Human
uuccauggccucuuca

SEQ ID NO: 1792610 - RNA, 20 nt, Human
uuccugaggcugggcucccu

SEQ ID NO: 1792611 - RNA, 15 nt, Human
uuccugaggcugggc

SEQ ID NO: 1792612 - RNA, 19 nt, Human
uucuacccagcgagcccug

SEQ ID NO: 1792613 - RNA, 12 nt, Human
uucuacccagcg

SEQ ID NO: 1792614 - RNA, 23 nt, Human
uucuaaugugugaaucagagcac

SEQ ID NO: 1792615 - RNA, 21 nt, Human
uucuacccagcgagcccuggu

SEQ ID NO: 1792616 - RNA, 20 nt, Human
uucuacccagcgagcccugg

SEQ ID NO: 1792617 - RNA, 14 nt, Human
uucuacccaggugc

SEQ ID NO: 1792618 - RNA, 13 nt, Human
uucuacuauuuau

SEQ ID NO: 1792619 - RNA, 13 nt, Human
uucuacgccaggg

SEQ ID NO: 1792620 - RNA, 14 nt, Human
uucuauagcuuuuc

SEQ ID NO: 1792621 - RNA, 22 nt, Human
uucuacucgaguuacagacaaa

SEQ ID NO: 1792622 - RNA, 16 nt, Human
uucucugcccuccaag

SEQ ID NO: 1792623 - RNA, 17 nt, Human
uucucugcccuccaaga

SEQ ID NO: 1792624 - RNA, 23 nt, Human
uucugacccaugcugcccuguga

SEQ ID NO: 1792625 - RNA, 22 nt, Human
uucugacccaugcugcccugug

SEQ ID NO: 1792626 - RNA, 18 nt, Human
uucugacccugcuucaaa

SEQ ID NO: 1792627 - RNA, 21 nt, Human
uucugacccugcuucaaauau

SEQ ID NO: 1792628 - RNA, 19 nt, Human
uucugcucacauaucuguc

SEQ ID NO: 1792629 - RNA, 22 nt, Human
uucugauaugcaguuuuccuua

SEQ ID NO: 1792630 - RNA, 19 nt, Human
uucugauccuaguuccacc

SEQ ID NO: 1792631 - RNA, 16 nt, Human
uucuccacccugcucu

SEQ ID NO: 1792632 - RNA, 20 nt, Human
uucucauuugccaauaauaa

SEQ ID NO: 1792633 - RNA, 12 nt, Human
uucuccacugga

SEQ ID NO: 1792634 - RNA, 20 nt, Human
uucuccaccugccagggaca

SEQ ID NO: 1792635 - RNA, 16 nt, Human
uucuccaccugccagg

SEQ ID NO: 1792636 - RNA, 18 nt, Human
uucuccaccugccaggga

SEQ ID NO: 1792637 - RNA, 21 nt, Human
uucuccaccucccacaaagga

SEQ ID NO: 1792638 - RNA, 12 nt, Human
uucuccaccugc

SEQ ID NO: 1792639 - RNA, 14 nt, Human
uucuccaccugcca

SEQ ID NO: 1792640 - RNA, 15 nt, Human
uucuccaccugccag

SEQ ID NO: 1792641 - RNA, 20 nt, Human
uucucugaggacacuaacca

SEQ ID NO: 1792642 - RNA, 14 nt, Human
uucucugaggacac

SEQ ID NO: 1792643 - RNA, 11 nt, Human
uucucugcccu

SEQ ID NO: 1792644 - RNA, 12 nt, Human
uucucugcccuc

SEQ ID NO: 1792645 - RNA, 13 nt, Human
uucucugaggaca

SEQ ID NO: 1792646 - RNA, 20 nt, Human
uucucugaggacaagagaaa

SEQ ID NO: 1792647 - RNA, 16 nt, Human
uucucugaggacaaga

SEQ ID NO: 1792648 - RNA, 19 nt, Human
uucucuccuguaccucuug

SEQ ID NO: 1792649 - RNA, 22 nt, Human
uucucuccuguaccucuugagc

SEQ ID NO: 1792650 - RNA, 13 nt, Human
uucucuccagccc

SEQ ID NO: 1792651 - RNA, 14 nt, Human
uucucuccagcccc

SEQ ID NO: 1792652 - RNA, 18 nt, Human
uucucuccuguaccucuu

SEQ ID NO: 1792653 - RNA, 14 nt, Human
uucucuccuguacc

SEQ ID NO: 1792654 - RNA, 15 nt, Human
uucucuccagccccu

SEQ ID NO: 1792655 - RNA, 16 nt, Human
uucucuccagccccug

SEQ ID NO: 1792656 - RNA, 13 nt, Human
uuuauuauggcac

SEQ ID NO: 1792657 - RNA, 13 nt, Human
uuuauuaugcaug

SEQ ID NO: 1792658 - RNA, 16 nt, Human
uuuauggcuuuugugc

SEQ ID NO: 1792659 - RNA, 14 nt, Human
uuuauggcuuuugu

SEQ ID NO: 1792660 - RNA, 21 nt, Human
uuucaacgcagcccugcuuug

SEQ ID NO: 1792661 - RNA, 15 nt, Human
uuucaacgcagcccu

SEQ ID NO: 1792662 - RNA, 16 nt, Human
uuucaacgcagcccug

SEQ ID NO: 1792663 - RNA, 20 nt, Human
uuucaacgcagcccugcuuu

SEQ ID NO: 1792664 - RNA, 19 nt, Human
uuuauuuaguuccuugagu

SEQ ID NO: 1792665 - RNA, 11 nt, Human
uuucagugagg

SEQ ID NO: 1792666 - RNA, 13 nt, Human
uuucaguguacau

SEQ ID NO: 1792667 - RNA, 14 nt, Human
uuucaguguacaug

SEQ ID NO: 1792668 - RNA, 23 nt, Human
uuucagcaccuacaguguacagu

SEQ ID NO: 1792669 - RNA, 14 nt, Human
uuucauuuagguga

SEQ ID NO: 1792670 - RNA, 18 nt, Human
uuucauuuaggugaggaa

SEQ ID NO: 1792671 - RNA, 12 nt, Human
uuucaauaggaa

SEQ ID NO: 1792672 - RNA, 14 nt, Human
uuucaauaggaaaa

SEQ ID NO: 1792673 - RNA, 17 nt, Human
uuucaauaggaaaaacu

SEQ ID NO: 1792674 - RNA, 19 nt, Human
uuucaauaggaaaaacuga

SEQ ID NO: 1792675 - RNA, 22 nt, Human
uuucacaaccuucuguggcuca

SEQ ID NO: 1792676 - RNA, 16 nt, Human
uuucacaaccuucugu

SEQ ID NO: 1792677 - RNA, 18 nt, Human
uuucagauauaaaagacu

SEQ ID NO: 1792678 - RNA, 16 nt, Human
uuucagauauaaaaga

SEQ ID NO: 1792679 - RNA, 14 nt, Human
uuucagauauaaaa

SEQ ID NO: 1792680 - RNA, 15 nt, Human
uuuacagcugccugc

SEQ ID NO: 1792681 - RNA, 16 nt, Human
uuuacagcugccugca

SEQ ID NO: 1792682 - RNA, 21 nt, Human
uuuaauagcgucauaacuaga

SEQ ID NO: 1792683 - RNA, 22 nt, Human
uuuaauagcgucauaacuagaa

SEQ ID NO: 1792684 - RNA, 14 nt, Human
uuuagaaauauaau

SEQ ID NO: 1792685 - RNA, 19 nt, Human
uuuacuucuuauacauuug

SEQ ID NO: 1792686 - RNA, 22 nt, Human
uuuacuucuuauacauuugaua

SEQ ID NO: 1792687 - RNA, 12 nt, Human
uuuagacagagu

SEQ ID NO: 1792688 - RNA, 21 nt, Human
uuuauaaaaauaaaaaacacu

SEQ ID NO: 1792689 - RNA, 23 nt, Human
uuuauaaaaauaaaaaacacugg

SEQ ID NO: 1792690 - RNA, 19 nt, Human
uuuaacucuauaauguguu

SEQ ID NO: 1792691 - RNA, 23 nt, Human
uuuaacaacuaugauuuggaaaa

SEQ ID NO: 1792692 - RNA, 18 nt, Human
uuguuuggagacagaguc

SEQ ID NO: 1792693 - RNA, 18 nt, Human
uuuaacagaaauguacag

SEQ ID NO: 1792694 - RNA, 18 nt, Human
uuuaaguuacacauuuuu

SEQ ID NO: 1792695 - RNA, 20 nt, Human
uuuaagacgaaacauuuguu

SEQ ID NO: 1792696 - RNA, 19 nt, Human
uuuaagacauuuuuggaag

SEQ ID NO: 1792697 - RNA, 22 nt, Human
uuuaagaaaaaggaugcacaga

SEQ ID NO: 1792698 - RNA, 18 nt, Human
uuuaagaaaaaggaugca

SEQ ID NO: 1792699 - RNA, 20 nt, Human
uuguuucuuucucugaggac

SEQ ID NO: 1792700 - RNA, 22 nt, Human
uuguuaguaugaggcauuuguu

SEQ ID NO: 1792701 - RNA, 20 nt, Human
uuguuagugugucuuagugu

SEQ ID NO: 1792702 - RNA, 19 nt, Human
uuguguuucuuuaguuuuu

SEQ ID NO: 1792703 - RNA, 19 nt, Human
uuguuaauaaaaguacaug

SEQ ID NO: 1792704 - RNA, 14 nt, Human
uuguuaauaaaagu

SEQ ID NO: 1792705 - RNA, 21 nt, Human
uuguuaauaaaaguacauguu

SEQ ID NO: 1792706 - RNA, 14 nt, Human
uuguuacauuuuua

SEQ ID NO: 1792707 - RNA, 21 nt, Human
uuguuaguaugaggcauuugu

SEQ ID NO: 1792708 - RNA, 19 nt, Human
uuguuaguaugaggcauuu

SEQ ID NO: 1792709 - RNA, 21 nt, Human
uuguguuuauauauaagccaa

SEQ ID NO: 1792710 - RNA, 23 nt, Human
uuguggauuuaacagaaauguac

SEQ ID NO: 1792711 - RNA, 22 nt, Human
uuguggauuuaacagaaaugua

SEQ ID NO: 1792712 - RNA, 21 nt, Human
uuguggauuuaacagaaaugu

SEQ ID NO: 1792713 - RNA, 20 nt, Human
uuguggauuuaacagaaaug

SEQ ID NO: 1792714 - RNA, 16 nt, Human
uuguggacacagcucu

SEQ ID NO: 1792715 - RNA, 21 nt, Human
uuguggaaaaugaaaauuagg

SEQ ID NO: 1792716 - RNA, 17 nt, Human
uuguggacacagcucuu

SEQ ID NO: 1792717 - RNA, 16 nt, Human
uugugccagaaugcuu

SEQ ID NO: 1792718 - RNA, 21 nt, Human
uugugccagaaugcuuuagga

SEQ ID NO: 1792719 - RNA, 12 nt, Human
uugugccccugc

SEQ ID NO: 1792720 - RNA, 12 nt, Human
uugugcauuugg

SEQ ID NO: 1792721 - RNA, 23 nt, Human
uugugcauuaucuagauacugua

SEQ ID NO: 1792722 - RNA, 22 nt, Human
uugugcauuaucuagauacugu

SEQ ID NO: 1792723 - RNA, 17 nt, Human
uugugcauuaucuagau

SEQ ID NO: 1792724 - RNA, 19 nt, Human
uuguauucucuccuguacc

SEQ ID NO: 1792725 - RNA, 16 nt, Human
uuguauucucuccugu

SEQ ID NO: 1792726 - RNA, 15 nt, Human
uuguauucucuccug

SEQ ID NO: 1792727 - RNA, 21 nt, Human
uuguauucagaguugaugguu

SEQ ID NO: 1792728 - RNA, 21 nt, Human
uugucugaagucacugcacag

SEQ ID NO: 1792729 - RNA, 15 nt, Human
uugucuuaaaaagug

SEQ ID NO: 1792730 - RNA, 20 nt, Human
uugucugaagucacugcaca

SEQ ID NO: 1792731 - RNA, 14 nt, Human
uugugaaaugaugg

SEQ ID NO: 1792732 - RNA, 12 nt, Human
uugugauuuuug

SEQ ID NO: 1792733 - RNA, 17 nt, Human
uugugauuuuuguaauu

SEQ ID NO: 1792734 - RNA, 16 nt, Human
uugugauuuuuguaau

SEQ ID NO: 1792735 - RNA, 20 nt, Human
uugugaaaggaaagaggcuc

SEQ ID NO: 1792736 - RNA, 22 nt, Human
uugucuuaaaaaguggaaaaau

SEQ ID NO: 1792737 - RNA, 22 nt, Human
uuggguucaagcgauucuucug

SEQ ID NO: 1792738 - RNA, 19 nt, Human
uugcacguauuuuaauagc

SEQ ID NO: 1792739 - RNA, 13 nt, Human
uuggucuguguga

SEQ ID NO: 1792740 - RNA, 16 nt, Human
uuggucugugagaugc

SEQ ID NO: 1792741 - RNA, 22 nt, Human
uuguaaaaauuaaaaguuaugg

SEQ ID NO: 1792742 - RNA, 21 nt, Human
uuggugaacauugcaauagaa

SEQ ID NO: 1792743 - RNA, 17 nt, Human
uuguaaauagcucaggu

SEQ ID NO: 1792744 - RNA, 16 nt, Human
uuguaaaugugguaaa

SEQ ID NO: 1792745 - RNA, 21 nt, Human
uuguaaaugugguaaagaguu

SEQ ID NO: 1792746 - RNA, 20 nt, Human
uuguaaaagcauuuuguaau

SEQ ID NO: 1792747 - RNA, 19 nt, Human
uuguaaaagcauuuuguaa

SEQ ID NO: 1792748 - RNA, 18 nt, Human
uuguaaaagcauuuugua

SEQ ID NO: 1792749 - RNA, 17 nt, Human
uuguaaaagcauuuugu

SEQ ID NO: 1792750 - RNA, 18 nt, Human
uuguacauaaugcgugca

SEQ ID NO: 1792751 - RNA, 23 nt, Human
uuguaaauuaacuuuuauaaacu

SEQ ID NO: 1792752 - RNA, 18 nt, Human
uuguaaauuaacuuuuau

SEQ ID NO: 1792753 - RNA, 16 nt, Human
uuguaaauuaacuuuu

SEQ ID NO: 1792754 - RNA, 15 nt, Human
uuguaaauuaacuuu

SEQ ID NO: 1792755 - RNA, 13 nt, Human
uuuuuuuugacaa

SEQ ID NO: 1792756 - RNA, 11 nt, Human
uuuuuuuacua

SEQ ID NO: 1792757 - RNA, 13 nt, Human
uuuuuuccacuua

SEQ ID NO: 1792758 - RNA, 12 nt, Human
uuuuuuuuaaga

SEQ ID NO: 1792759 - RNA, 15 nt, Human
uuuuucaguuuucag

SEQ ID NO: 1792760 - RNA, 12 nt, Human
uuuuucaguuuu

SEQ ID NO: 1792761 - RNA, 20 nt, Human
uuuuuaauaaagacaggguu

SEQ ID NO: 1792762 - RNA, 17 nt, Human
uuuuuaauaaagacagg

SEQ ID NO: 1792763 - RNA, 18 nt, Human
uuuuuaaguuacacauuu

SEQ ID NO: 1792764 - RNA, 13 nt, Human
uuuuuaaucuuua

SEQ ID NO: 1792765 - RNA, 23 nt, Human
uuuuuaagugcugcauuuaaaag

SEQ ID NO: 1792766 - RNA, 22 nt, Human
uuuuuaagugcugcauuuaaaa

SEQ ID NO: 1792767 - RNA, 19 nt, Human
uuuuuaagugcugcauuua

SEQ ID NO: 1792768 - RNA, 18 nt, Human
uuuuuaagugcugcauuu

SEQ ID NO: 1792769 - RNA, 17 nt, Human
uuuuuaagugcugcauu

SEQ ID NO: 1792770 - RNA, 16 nt, Human
uuuuuaagugcugcau

SEQ ID NO: 1792771 - RNA, 23 nt, Human
uuuuuaagaaaaaggaugcacag

SEQ ID NO: 1792772 - RNA, 12 nt, Human
uuuuuaagaaaa

SEQ ID NO: 1792773 - RNA, 21 nt, Human
uuuuaaaguaacccuacaaaa

SEQ ID NO: 1792774 - RNA, 19 nt, Human
uuuuacaaaaaagaaaaga

SEQ ID NO: 1792775 - RNA, 17 nt, Human
uuuuacaauaaaaucuu

SEQ ID NO: 1792776 - RNA, 19 nt, Human
uuuuacguccaucucuugu

SEQ ID NO: 1792777 - RNA, 15 nt, Human
uuuuacuaauagaca

SEQ ID NO: 1792778 - RNA, 18 nt, Human
uuuuauuuuuagacagag

SEQ ID NO: 1792779 - RNA, 17 nt, Human
uuuucaaaauaaaaaug

SEQ ID NO: 1792780 - RNA, 21 nt, Human
uuuuauacauaaacaagacca

SEQ ID NO: 1792781 - RNA, 13 nt, Human
uuuuauacauaaa

SEQ ID NO: 1792782 - RNA, 21 nt, Human
uuuucaaaauuguuacaaauu

SEQ ID NO: 1792783 - RNA, 18 nt, Human
uuuucccuauuagagaag

SEQ ID NO: 1792784 - RNA, 22 nt, Human
uuuucccuauuagagaagagau

SEQ ID NO: 1792785 - RNA, 17 nt, Human
uuuucagauauaaaaga

SEQ ID NO: 1792786 - RNA, 15 nt, Human
uuuucagauauaaaa

SEQ ID NO: 1792787 - RNA, 13 nt, Human
uuuucuacucgag

SEQ ID NO: 1792788 - RNA, 20 nt, Human
uuuucuacucgaguuacaga

SEQ ID NO: 1792789 - RNA, 22 nt, Human
uuuucuacucgaguuacagaca

SEQ ID NO: 1792790 - RNA, 23 nt, Human
uuuucuacucgaguuacagacaa

SEQ ID NO: 1792791 - RNA, 16 nt, Human
uuuucuuucagccaag

SEQ ID NO: 1792792 - RNA, 22 nt, Human
uuuucuuguguguuuauuguca

SEQ ID NO: 1792793 - RNA, 13 nt, Human
uuuucuucucccu

SEQ ID NO: 1792794 - RNA, 21 nt, Human
uuugagugccuuacacaaugg

SEQ ID NO: 1792795 - RNA, 17 nt, Human
uuuccguuaaaauacca

SEQ ID NO: 1792796 - RNA, 15 nt, Human
uuuccguuaaaauac

SEQ ID NO: 1792797 - RNA, 12 nt, Human
uuuggaaaauaa

SEQ ID NO: 1792798 - RNA, 16 nt, Human
uuuggaaagacuggac

SEQ ID NO: 1792799 - RNA, 13 nt, Human
uuuggacccugag

SEQ ID NO: 1792800 - RNA, 18 nt, Human
uuugcauaacguauaaaa

SEQ ID NO: 1792801 - RNA, 15 nt, Human
uuuggucaacacuaa

SEQ ID NO: 1792802 - RNA, 17 nt, Human
uuuggucuacacugugc

SEQ ID NO: 1792803 - RNA, 14 nt, Human
uuuguauuuuuagu

SEQ ID NO: 1792804 - RNA, 15 nt, Human
uuuguugucagcuga

SEQ ID NO: 1792805 - RNA, 22 nt, Human
uuuguuaguaugaggcauuugu

SEQ ID NO: 1792806 - RNA, 20 nt, Human
uuuuaaacccuauugguaaa

SEQ ID NO: 1792807 - RNA, 23 nt, Human
uuuuaaaauccacuuuaucuuga

SEQ ID NO: 1792808 - RNA, 14 nt, Human
uuuuaaaauccacu

SEQ ID NO: 1792809 - RNA, 16 nt, Human
uuuguugucagcugaa

SEQ ID NO: 1792810 - RNA, 15 nt, Human
ugcauguuugugauu

SEQ ID NO: 1792811 - RNA, 17 nt, Human
ugcaugguuuagaaagc

SEQ ID NO: 1792812 - RNA, 15 nt, Human
ugcauccuccgccuc

SEQ ID NO: 1792813 - RNA, 19 nt, Human
ugcagauaaacaguaguga

SEQ ID NO: 1792814 - RNA, 14 nt, Human
ugcauccuccgccu

SEQ ID NO: 1792815 - RNA, 15 nt, Human
ugccaccacgcccgg

SEQ ID NO: 1792816 - RNA, 18 nt, Human
ugcauuaucuagauacug

SEQ ID NO: 1792817 - RNA, 17 nt, Human
ugcauuaucuagauacu

SEQ ID NO: 1792818 - RNA, 12 nt, Human
ugcauuaucuag

SEQ ID NO: 1792819 - RNA, 12 nt, Human
ugccauccaggu

SEQ ID NO: 1792820 - RNA, 20 nt, Human
ugccauccagguucagcuug

SEQ ID NO: 1792821 - RNA, 15 nt, Human
ugccauccagguuca

SEQ ID NO: 1792822 - RNA, 17 nt, Human
ugccagguuuuuggucu

SEQ ID NO: 1792823 - RNA, 12 nt, Human
ugccaggaagcc

SEQ ID NO: 1792824 - RNA, 16 nt, Human
ugccaggaagccagca

SEQ ID NO: 1792825 - RNA, 18 nt, Human
ugccaggaagccagcagg

SEQ ID NO: 1792826 - RNA, 19 nt, Human
ugccaggaagccagcaggc

SEQ ID NO: 1792827 - RNA, 16 nt, Human
ugccauguuggccagg

SEQ ID NO: 1792828 - RNA, 20 nt, Human
ugcccaccuggccucugcac

SEQ ID NO: 1792829 - RNA, 15 nt, Human
ugccauguuggccag

SEQ ID NO: 1792830 - RNA, 12 nt, Human
ugccauguuggc

SEQ ID NO: 1792831 - RNA, 18 nt, Human
ugcccacgcuggagugca

SEQ ID NO: 1792832 - RNA, 13 nt, Human
ugcccacucccug

SEQ ID NO: 1792833 - RNA, 15 nt, Human
ugccaugugccaggu

SEQ ID NO: 1792834 - RNA, 14 nt, Human
ugccaugugccagg

SEQ ID NO: 1792835 - RNA, 23 nt, Human
ugccaugaggaacaaggcaaggc

SEQ ID NO: 1792836 - RNA, 20 nt, Human
ugccaugaggaacaaggcaa

SEQ ID NO: 1792837 - RNA, 18 nt, Human
ugcccuggauccaucagg

SEQ ID NO: 1792838 - RNA, 21 nt, Human
ugcccuggugcugccacacuu

SEQ ID NO: 1792839 - RNA, 20 nt, Human
ugcccuggugcugccacacu

SEQ ID NO: 1792840 - RNA, 18 nt, Human
ugcccuggugcugccaca

SEQ ID NO: 1792841 - RNA, 15 nt, Human
ugcccugguuuccug

SEQ ID NO: 1792842 - RNA, 15 nt, Human
ugccgucuaccugag

SEQ ID NO: 1792843 - RNA, 16 nt, Human
ugccgucuaccugagg

SEQ ID NO: 1792844 - RNA, 17 nt, Human
ugccgucuaccugaggg

SEQ ID NO: 1792845 - RNA, 19 nt, Human
ugccgucuaccugaggggc

SEQ ID NO: 1792846 - RNA, 19 nt, Human
ugcccugcgggucacagga

SEQ ID NO: 1792847 - RNA, 18 nt, Human
ugcccugcugagucccag

SEQ ID NO: 1792848 - RNA, 22 nt, Human
ugcccugcugagucccaggcug

SEQ ID NO: 1792849 - RNA, 23 nt, Human
ugcccugcugagucccaggcuga

SEQ ID NO: 1792850 - RNA, 21 nt, Human
ugcccugcccaccuggccucu

SEQ ID NO: 1792851 - RNA, 19 nt, Human
ugcccuaaaguguauuuuu

SEQ ID NO: 1792852 - RNA, 17 nt, Human
ugcccuaaaguguauuu

SEQ ID NO: 1792853 - RNA, 22 nt, Human
ugcccugcccaccuggccucug

SEQ ID NO: 1792854 - RNA, 23 nt, Human
ugcccugcccaccuggccucugc

SEQ ID NO: 1792855 - RNA, 22 nt, Human
ugccuccuuugugaggaagccg

SEQ ID NO: 1792856 - RNA, 21 nt, Human
ugccuccuuugugaggaagcc

SEQ ID NO: 1792857 - RNA, 20 nt, Human
ugccuccuuugugaggaagc

SEQ ID NO: 1792858 - RNA, 13 nt, Human
ugccucugccugu

SEQ ID NO: 1792859 - RNA, 14 nt, Human
ugccucugccuguc

SEQ ID NO: 1792860 - RNA, 18 nt, Human
ugccucugccugucuccc

SEQ ID NO: 1792861 - RNA, 13 nt, Human
ugccucugggacu

SEQ ID NO: 1792862 - RNA, 19 nt, Human
ugccugguggcagcugcgg

SEQ ID NO: 1792863 - RNA, 18 nt, Human
ugccugguggcagcugcg

SEQ ID NO: 1792864 - RNA, 17 nt, Human
ugccugguggcagcugc

SEQ ID NO: 1792865 - RNA, 13 nt, Human
ugccugcccaggc

SEQ ID NO: 1792866 - RNA, 21 nt, Human
ugccucuucucuacucuaggg

SEQ ID NO: 1792867 - RNA, 13 nt, Human
ugccucuuccucc

SEQ ID NO: 1792868 - RNA, 22 nt, Human
ugauuuuuuuuuccuucagugc

SEQ ID NO: 1792869 - RNA, 23 nt, Human
ugauuuuuuuuuccuucagugcc

SEQ ID NO: 1792870 - RNA, 16 nt, Human
ugauuuuuuuuuuuca

SEQ ID NO: 1792871 - RNA, 13 nt, Human
ugauuuuuuucca

SEQ ID NO: 1792872 - RNA, 16 nt, Human
ugauuuuuuuuuccuu

SEQ ID NO: 1792873 - RNA, 17 nt, Human
ugauuuuuuuuuccuuc

SEQ ID NO: 1792874 - RNA, 19 nt, Human
ugauuuuuuuuuccuucag

SEQ ID NO: 1792875 - RNA, 20 nt, Human
ugauuuuuuuuuccuucagu

SEQ ID NO: 1792876 - RNA, 16 nt, Human
ugauuuugcuguagaa

SEQ ID NO: 1792877 - RNA, 14 nt, Human
ugauuuugcuguag

SEQ ID NO: 1792878 - RNA, 19 nt, Human
ugauuuugcuguagaagau

SEQ ID NO: 1792879 - RNA, 17 nt, Human
ugauuuugcuguagaag

SEQ ID NO: 1792880 - RNA, 19 nt, Human
ugauuuuuaaagaaaaguu

SEQ ID NO: 1792881 - RNA, 15 nt, Human
ugauuuucauugcug

SEQ ID NO: 1792882 - RNA, 13 nt, Human
ugauuuucauugc

SEQ ID NO: 1792883 - RNA, 17 nt, Human
ugcaacaggcugggcuu

SEQ ID NO: 1792884 - RNA, 16 nt, Human
ugcaacaggcugggcu

SEQ ID NO: 1792885 - RNA, 15 nt, Human
ugcaacaggcugggc

SEQ ID NO: 1792886 - RNA, 14 nt, Human
ugcaacaggcuggg

SEQ ID NO: 1792887 - RNA, 20 nt, Human
ugcaacaggcugggcuucag

SEQ ID NO: 1792888 - RNA, 19 nt, Human
ugcaacaggcugggcuuca

SEQ ID NO: 1792889 - RNA, 14 nt, Human
ugcaaccuccgccu

SEQ ID NO: 1792890 - RNA, 13 nt, Human
ugcaaccuccgcc

SEQ ID NO: 1792891 - RNA, 16 nt, Human
ugcaaccauuugaaac

SEQ ID NO: 1792892 - RNA, 21 nt, Human
ugcaaccuccgccucuugggu

SEQ ID NO: 1792893 - RNA, 20 nt, Human
ugcaaccuccgccucuuggg

SEQ ID NO: 1792894 - RNA, 18 nt, Human
ugcaaccuccgccucuug

SEQ ID NO: 1792895 - RNA, 19 nt, Human
ugcaaccugauugugucuc

SEQ ID NO: 1792896 - RNA, 20 nt, Human
ugcaaccugauugugucucu

SEQ ID NO: 1792897 - RNA, 14 nt, Human
ugcaacuucugccu

SEQ ID NO: 1792898 - RNA, 13 nt, Human
ugcaacuucugcc

SEQ ID NO: 1792899 - RNA, 16 nt, Human
ugcaacuuguaaaugu

SEQ ID NO: 1792900 - RNA, 18 nt, Human
ugcaacuuguaaaugugg

SEQ ID NO: 1792901 - RNA, 18 nt, Human
ugcaacuuuguauaaaag

SEQ ID NO: 1792902 - RNA, 18 nt, Human
ugcaaccuucgccaccug

SEQ ID NO: 1792903 - RNA, 21 nt, Human
ugcaaccuucgccaccugggu

SEQ ID NO: 1792904 - RNA, 22 nt, Human
ugcaaccugauugugucucuug

SEQ ID NO: 1792905 - RNA, 21 nt, Human
ugcaaugacacagucuuggcu

SEQ ID NO: 1792906 - RNA, 13 nt, Human
ugcaaugaccuuu

SEQ ID NO: 1792907 - RNA, 16 nt, Human
ugcaaugaccuuucaa

SEQ ID NO: 1792908 - RNA, 17 nt, Human
ugcaaugaccuuucaau

SEQ ID NO: 1792909 - RNA, 19 nt, Human
ugcaaugaccuuucaauag

SEQ ID NO: 1792910 - RNA, 22 nt, Human
ugcaaugaccuuucaauaggaa

SEQ ID NO: 1792911 - RNA, 23 nt, Human
ugcaaugaccuuucaauaggaaa

SEQ ID NO: 1792912 - RNA, 16 nt, Human
ugcaauggcagccuug

SEQ ID NO: 1792913 - RNA, 15 nt, Human
ugcaauggcagccuu

SEQ ID NO: 1792914 - RNA, 14 nt, Human
ugcaauggcagccu

SEQ ID NO: 1792915 - RNA, 13 nt, Human
ugcaauggcagcc

SEQ ID NO: 1792916 - RNA, 15 nt, Human
ugcacaaacagaggc

SEQ ID NO: 1792917 - RNA, 16 nt, Human
ugcacaaacagaggcc

SEQ ID NO: 1792918 - RNA, 19 nt, Human
ugcacagaguuguuacauu

SEQ ID NO: 1792919 - RNA, 18 nt, Human
ugcacagaguuguuacau

SEQ ID NO: 1792920 - RNA, 15 nt, Human
ugcacaaagcccuuc

SEQ ID NO: 1792921 - RNA, 17 nt, Human
ugcacaaagcccuucca

SEQ ID NO: 1792922 - RNA, 17 nt, Human
ugcacagaguuguuaca

SEQ ID NO: 1792923 - RNA, 20 nt, Human
ugcacaaacagaggccgcca

SEQ ID NO: 1792924 - RNA, 17 nt, Human
ugcacaaacagaggccg

SEQ ID NO: 1792925 - RNA, 19 nt, Human
ugcacaaacagaggccgcc

SEQ ID NO: 1792926 - RNA, 19 nt, Human
ugcagagguccacaacaca

SEQ ID NO: 1792927 - RNA, 21 nt, Human
ugcacugacauuguuggccaa

SEQ ID NO: 1792928 - RNA, 18 nt, Human
ugcacugacauuguuggc

SEQ ID NO: 1792929 - RNA, 15 nt, Human
ugcacagugcaucuc

SEQ ID NO: 1792930 - RNA, 20 nt, Human
ugcacagaguuguuacauuu

SEQ ID NO: 1792931 - RNA, 16 nt, Human
ugcacagugcaucuca

SEQ ID NO: 1792932 - RNA, 17 nt, Human
ugcacagugcaucucag

SEQ ID NO: 1792933 - RNA, 18 nt, Human
ugcaccggcuggccuggc

SEQ ID NO: 1792934 - RNA, 19 nt, Human
ugcaccggcuggccuggcc

SEQ ID NO: 1792935 - RNA, 20 nt, Human
ugcaccggcuggccuggccc

SEQ ID NO: 1792936 - RNA, 22 nt, Human
ugcaccuggaauauauaaccag

SEQ ID NO: 1792937 - RNA, 20 nt, Human
ugcaccuggaauauauaacc

SEQ ID NO: 1792938 - RNA, 17 nt, Human
ugcaccuggaauauaua

SEQ ID NO: 1792939 - RNA, 21 nt, Human
ugcaccggcuggccuggcccc

SEQ ID NO: 1792940 - RNA, 15 nt, Human
ucuugaacuccuggc

SEQ ID NO: 1792941 - RNA, 16 nt, Human
ucuugaauaauguaag

SEQ ID NO: 1792942 - RNA, 17 nt, Human
ucuugaauuguaaggaa

SEQ ID NO: 1792943 - RNA, 20 nt, Human
ugaccauucuccaccugcca

SEQ ID NO: 1792944 - RNA, 21 nt, Human
ugaccauucuccaccugccag

SEQ ID NO: 1792945 - RNA, 22 nt, Human
ugaccauucuccaccugccagg

SEQ ID NO: 1792946 - RNA, 23 nt, Human
ugaccauucuccaccugccaggg

SEQ ID NO: 1792947 - RNA, 12 nt, Human
ugaccucugccu

SEQ ID NO: 1792948 - RNA, 23 nt, Human
ugaccucugcagcaauaaagcag

SEQ ID NO: 1792949 - RNA, 21 nt, Human
ugaccucugcagcaauaaagc

SEQ ID NO: 1792950 - RNA, 18 nt, Human
ugaccucugcagcaauaa

SEQ ID NO: 1792951 - RNA, 14 nt, Human
ugaccuuucaauag

SEQ ID NO: 1792952 - RNA, 15 nt, Human
ugaccuuucaauagg

SEQ ID NO: 1792953 - RNA, 16 nt, Human
ugaccuuucaauagga

SEQ ID NO: 1792954 - RNA, 22 nt, Human
ugaccucaggugauccacccac

SEQ ID NO: 1792955 - RNA, 16 nt, Human
ugaccucugcagcaau

SEQ ID NO: 1792956 - RNA, 13 nt, Human
ugaccucugcagc

SEQ ID NO: 1792957 - RNA, 15 nt, Human
ugacugaauuucuuu

SEQ ID NO: 1792958 - RNA, 14 nt, Human
ugacugaauuucuu

SEQ ID NO: 1792959 - RNA, 13 nt, Human
ugacugaauuucu

SEQ ID NO: 1792960 - RNA, 17 nt, Human
ugacgccaucccagccc

SEQ ID NO: 1792961 - RNA, 18 nt, Human
ugacgccaucccagcccc

SEQ ID NO: 1792962 - RNA, 19 nt, Human
ugacgccaucccagcccca

SEQ ID NO: 1792963 - RNA, 20 nt, Human
ugacgccaucccagccccaa

SEQ ID NO: 1792964 - RNA, 18 nt, Human
ugaccuuucaauaggaaa

SEQ ID NO: 1792965 - RNA, 22 nt, Human
ugaccuuucaauaggaaaaacu

SEQ ID NO: 1792966 - RNA, 13 nt, Human
ugacgccauccca

SEQ ID NO: 1792967 - RNA, 14 nt, Human
ugacgccaucccag

SEQ ID NO: 1792968 - RNA, 15 nt, Human
ugacgccaucccagc

SEQ ID NO: 1792969 - RNA, 16 nt, Human
ugacgccaucccagcc

SEQ ID NO: 1792970 - RNA, 17 nt, Human
ugagaguagagucacug

SEQ ID NO: 1792971 - RNA, 14 nt, Human
ugagacucugucuc

SEQ ID NO: 1792972 - RNA, 13 nt, Human
ugagacucugucu

SEQ ID NO: 1792973 - RNA, 12 nt, Human
ugagacucuguc

SEQ ID NO: 1792974 - RNA, 23 nt, Human
ugagaggcauccaguaucuugaa

SEQ ID NO: 1792975 - RNA, 22 nt, Human
ugagaggcauccaguaucuuga

SEQ ID NO: 1792976 - RNA, 17 nt, Human
ugagaaaucuaaaaaac

SEQ ID NO: 1792977 - RNA, 13 nt, Human
ugagaaaucuaaa

SEQ ID NO: 1792978 - RNA, 16 nt, Human
ugacuguacuccuccc

SEQ ID NO: 1792979 - RNA, 17 nt, Human
ugacuguacuccuccca

SEQ ID NO: 1792980 - RNA, 18 nt, Human
ugacuguacuccucccag

SEQ ID NO: 1792981 - RNA, 22 nt, Human
ugacuguacuccucccaggcgc

SEQ ID NO: 1792982 - RNA, 12 nt, Human
ugagacccuguc

SEQ ID NO: 1792983 - RNA, 16 nt, Human
ugagacagcucugcau

SEQ ID NO: 1792984 - RNA, 14 nt, Human
ugagacagcucugc

SEQ ID NO: 1792985 - RNA, 15 nt, Human
ugagccucagcaucc

SEQ ID NO: 1792986 - RNA, 13 nt, Human
ugagccucagcau

SEQ ID NO: 1792987 - RNA, 20 nt, Human
ugagaugcuagaacucccuu

SEQ ID NO: 1792988 - RNA, 16 nt, Human
ugagaugcuagaacuc

SEQ ID NO: 1792989 - RNA, 14 nt, Human
ugagaugcuagaac

SEQ ID NO: 1792990 - RNA, 13 nt, Human
ugagcaucaggcc

SEQ ID NO: 1792991 - RNA, 13 nt, Human
ugagccccaaaag

SEQ ID NO: 1792992 - RNA, 14 nt, Human
ugagcaucaggcca

SEQ ID NO: 1792993 - RNA, 15 nt, Human
ugagcaucaggccag

SEQ ID NO: 1792994 - RNA, 16 nt, Human
ugagcaucaggccagg

SEQ ID NO: 1792995 - RNA, 15 nt, Human
ugauagcacagaccc

SEQ ID NO: 1792996 - RNA, 16 nt, Human
ugauagcacagacccu

SEQ ID NO: 1792997 - RNA, 17 nt, Human
ugauagcacagacccug

SEQ ID NO: 1792998 - RNA, 18 nt, Human
ugauagcacagacccugc

SEQ ID NO: 1792999 - RNA, 20 nt, Human
ugauagcacagacccugccc

SEQ ID NO: 1793000 - RNA, 21 nt, Human
ugauagcacagacccugcccu

SEQ ID NO: 1793001 - RNA, 22 nt, Human
ugauagguuauuuugauguaaa

SEQ ID NO: 1793002 - RNA, 18 nt, Human
ugauagguauaaguggug

SEQ ID NO: 1793003 - RNA, 22 nt, Human
ugauagcacagacccugcccug

SEQ ID NO: 1793004 - RNA, 23 nt, Human
ugauagcacagacccugcccugu

SEQ ID NO: 1793005 - RNA, 18 nt, Human
ugagucgaggacagggag

SEQ ID NO: 1793006 - RNA, 16 nt, Human
ugaguugauucagcuc

SEQ ID NO: 1793007 - RNA, 19 nt, Human
ugaguugauucagcucugc

SEQ ID NO: 1793008 - RNA, 16 nt, Human
ugagucgaggacaggg

SEQ ID NO: 1793009 - RNA, 15 nt, Human
ugagucgaggacagg

SEQ ID NO: 1793010 - RNA, 21 nt, Human
ugaguugauagcacagacccu

SEQ ID NO: 1793011 - RNA, 23 nt, Human
ugaguugauagcacagacccugc

SEQ ID NO: 1793012 - RNA, 11 nt, Human
ugaguccuggc

SEQ ID NO: 1793013 - RNA, 18 nt, Human
ugaguccuggcaugggaa

SEQ ID NO: 1793014 - RNA, 14 nt, Human
ugagucgaggacag

SEQ ID NO: 1793015 - RNA, 19 nt, Human
ugaguccuggcaugggaau

SEQ ID NO: 1793016 - RNA, 22 nt, Human
ugaguccuggcaugggaaugaa

SEQ ID NO: 1793017 - RNA, 19 nt, Human
ugagguuucaaaccucccu

SEQ ID NO: 1793018 - RNA, 21 nt, Human
ugaguccccuguuuguuucug

SEQ ID NO: 1793019 - RNA, 16 nt, Human
ugaggugcuauguucu

SEQ ID NO: 1793020 - RNA, 15 nt, Human
ugaggugcuauguuc

SEQ ID NO: 1793021 - RNA, 23 nt, Human
ugaggacuuaaaauauuccugca

SEQ ID NO: 1793022 - RNA, 11 nt, Human
ugaggcugggc

SEQ ID NO: 1793023 - RNA, 15 nt, Human
ugaggucuguucuuu

SEQ ID NO: 1793024 - RNA, 14 nt, Human
ugaggucuguucuu

SEQ ID NO: 1793025 - RNA, 20 nt, Human
ugaggucuguucuuuccaaa

SEQ ID NO: 1793026 - RNA, 20 nt, Human
ugaugaugaaaugaggucag

SEQ ID NO: 1793027 - RNA, 23 nt, Human
ugaugaucuuugcagacaggcaa

SEQ ID NO: 1793028 - RNA, 22 nt, Human
ugaugaucuuugcagacaggca

SEQ ID NO: 1793029 - RNA, 14 nt, Human
ugaugccaugagga

SEQ ID NO: 1793030 - RNA, 20 nt, Human
ugaucuuugcagacaggcaa

SEQ ID NO: 1793031 - RNA, 19 nt, Human
ugaucuuugcagacaggca

SEQ ID NO: 1793032 - RNA, 21 nt, Human
ugaucugaugcaagcaagaaa

SEQ ID NO: 1793033 - RNA, 23 nt, Human
ugaucuuugcagacaggcaagca

SEQ ID NO: 1793034 - RNA, 21 nt, Human
ugaucuuugcagacaggcaag

SEQ ID NO: 1793035 - RNA, 13 nt, Human
ugauguacaugua

SEQ ID NO: 1793036 - RNA, 19 nt, Human
ugaugcuucuucagagacu

SEQ ID NO: 1793037 - RNA, 21 nt, Human
ugaugcuucuucagagacucc

SEQ ID NO: 1793038 - RNA, 22 nt, Human
ugaugcuucuucagagacuccu

SEQ ID NO: 1793039 - RNA, 17 nt, Human
ugauauaaguguguguu

SEQ ID NO: 1793040 - RNA, 23 nt, Human
ugauauaaguguguguuuuucau

SEQ ID NO: 1793041 - RNA, 24 nt, Human
ugauaguuguaccgcaaugugacu

SEQ ID NO: 1793042 - RNA, 22 nt, Human
ugaucacggcucacugcagccu

SEQ ID NO: 1793043 - RNA, 19 nt, Human
ugauaugcaguuuuccuua

SEQ ID NO: 1793044 - RNA, 20 nt, Human
ugauccacccaccucagccu

SEQ ID NO: 1793045 - RNA, 16 nt, Human
ugauccacccaccuca

SEQ ID NO: 1793046 - RNA, 15 nt, Human
ugauccacccaccuc

SEQ ID NO: 1793047 - RNA, 21 nt, Human
ugauccaagcuggucccacuc

SEQ ID NO: 1793048 - RNA, 24 nt, Human
ugaucauccacugugccaugugcc

SEQ ID NO: 1793049 - RNA, 13 nt, Human
ugaucauccacug

SEQ ID NO: 1793050 - RNA, 22 nt, Human
ugauccacccaccucagccucc

SEQ ID NO: 1793051 - RNA, 21 nt, Human
ugauccacccaccucagccuc

SEQ ID NO: 1793052 - RNA, 19 nt, Human
ugaucuaggaagacuuugg

SEQ ID NO: 1793053 - RNA, 21 nt, Human
ugaucuaggaagacuuuggaa

SEQ ID NO: 1793054 - RNA, 20 nt, Human
ugaucugaugcaagcaagaa

SEQ ID NO: 1793055 - RNA, 22 nt, Human
ugcuuccagugaggcucugccc

SEQ ID NO: 1793056 - RNA, 23 nt, Human
ugcuuccagugaggcucugcccu

SEQ ID NO: 1793057 - RNA, 18 nt, Human
ugcuuaacuucacauauu

SEQ ID NO: 1793058 - RNA, 17 nt, Human
ugcuuaacuucacauau

SEQ ID NO: 1793059 - RNA, 14 nt, Human
ugcuuaacuucaca

SEQ ID NO: 1793060 - RNA, 13 nt, Human
ugcuuaacuucac

SEQ ID NO: 1793061 - RNA, 19 nt, Human
ugcuuaacuucacauauug

SEQ ID NO: 1793062 - RNA, 13 nt, Human
ugcuuuggaaauc

SEQ ID NO: 1793063 - RNA, 17 nt, Human
ugcuuuggaaaacccag

SEQ ID NO: 1793064 - RNA, 18 nt, Human
ugcuugugaaaggaaaga

SEQ ID NO: 1793065 - RNA, 13 nt, Human
ugcuucuucagag

SEQ ID NO: 1793066 - RNA, 16 nt, Human
ugcuuguuaacugagu

SEQ ID NO: 1793067 - RNA, 14 nt, Human
ugcuuguuaacuga

SEQ ID NO: 1793068 - RNA, 15 nt, Human
uggaacacucugaga

SEQ ID NO: 1793069 - RNA, 17 nt, Human
uggaacacucugagacu

SEQ ID NO: 1793070 - RNA, 23 nt, Human
uggacaggcauguucucugagga

SEQ ID NO: 1793071 - RNA, 22 nt, Human
uggacaggcauguucucugagg

SEQ ID NO: 1793072 - RNA, 18 nt, Human
uggacaggcauguucucu

SEQ ID NO: 1793073 - RNA, 19 nt, Human
uggacuaacuugucuuugg

SEQ ID NO: 1793074 - RNA, 20 nt, Human
uggacuaacuugucuuugga

SEQ ID NO: 1793075 - RNA, 19 nt, Human
uggacguguuaugacucca

SEQ ID NO: 1793076 - RNA, 23 nt, Human
uggacguguuaugacuccagaau

SEQ ID NO: 1793077 - RNA, 22 nt, Human
uggcacugcuuccagugaggcu

SEQ ID NO: 1793078 - RNA, 19 nt, Human
uggcacugcuuccagugag

SEQ ID NO: 1793079 - RNA, 22 nt, Human
uggcacuauaauguaagcucua

SEQ ID NO: 1793080 - RNA, 15 nt, Human
uggauuuaacagaaa

SEQ ID NO: 1793081 - RNA, 17 nt, Human
uggauuuaacagaaaug

SEQ ID NO: 1793082 - RNA, 21 nt, Human
uggcacuauaauguaagcucu

SEQ ID NO: 1793083 - RNA, 22 nt, Human
uggaugcagccucacaguccuu

SEQ ID NO: 1793084 - RNA, 13 nt, Human
uggaugcagccuc

SEQ ID NO: 1793085 - RNA, 21 nt, Human
uggaugcagccucacaguccu

SEQ ID NO: 1793086 - RNA, 19 nt, Human
uggaucaaauccagccugc

SEQ ID NO: 1793087 - RNA, 23 nt, Human
uggaggggggaggugggauccuc

SEQ ID NO: 1793088 - RNA, 18 nt, Human
ugggaggaucucuugagc

SEQ ID NO: 1793089 - RNA, 18 nt, Human
ugggaugauuggaggggg

SEQ ID NO: 1793090 - RNA, 16 nt, Human
ugggaaugaaugucag

SEQ ID NO: 1793091 - RNA, 21 nt, Human
ugggaaugaaugucaguguga

SEQ ID NO: 1793092 - RNA, 14 nt, Human
ugggacacccugug

SEQ ID NO: 1793093 - RNA, 15 nt, Human
ugggacacccuguga

SEQ ID NO: 1793094 - RNA, 16 nt, Human
ugggaggaucucuuga

SEQ ID NO: 1793095 - RNA, 14 nt, Human
ugggacagggagga

SEQ ID NO: 1793096 - RNA, 14 nt, Human
ugggcagagcagag

SEQ ID NO: 1793097 - RNA, 15 nt, Human
ugggcagagcagaga

SEQ ID NO: 1793098 - RNA, 17 nt, Human
ugggcagagcagagacc

SEQ ID NO: 1793099 - RNA, 18 nt, Human
ugggcagagcagagacca

SEQ ID NO: 1793100 - RNA, 19 nt, Human
uggggggcugaggugggag

SEQ ID NO: 1793101 - RNA, 16 nt, Human
ugggggccucagugcc

SEQ ID NO: 1793102 - RNA, 17 nt, Human
uggggccaggcuggguc

SEQ ID NO: 1793103 - RNA, 13 nt, Human
uggggcagcuuga

SEQ ID NO: 1793104 - RNA, 23 nt, Human
ugggcuuggggaccagagcugcc

SEQ ID NO: 1793105 - RNA, 17 nt, Human
ugggcuugucuguagau

SEQ ID NO: 1793106 - RNA, 21 nt, Human
ugggcuugucuguagauuuua

SEQ ID NO: 1793107 - RNA, 21 nt, Human
ugggcuucaguggcagcugcu

SEQ ID NO: 1793108 - RNA, 22 nt, Human
ugggcuucaguggcagcugcuu

SEQ ID NO: 1793109 - RNA, 22 nt, Human
ugggcuucauccuccucagauc

SEQ ID NO: 1793110 - RNA, 15 nt, Human
ugggcuucauccucc

SEQ ID NO: 1793111 - RNA, 13 nt, Human
uggcugcugaagg

SEQ ID NO: 1793112 - RNA, 14 nt, Human
uggcugcugaaggc

SEQ ID NO: 1793113 - RNA, 16 nt, Human
uggcugcugaaggcuc

SEQ ID NO: 1793114 - RNA, 17 nt, Human
uggcuccagcuggccgg

SEQ ID NO: 1793115 - RNA, 22 nt, Human
uggccuucggccuccauccuga

SEQ ID NO: 1793116 - RNA, 13 nt, Human
uggccucugcacu

SEQ ID NO: 1793117 - RNA, 23 nt, Human
uggccuucggccuccauccugag

SEQ ID NO: 1793118 - RNA, 22 nt, Human
uggcuuccuaaaauucagugga

SEQ ID NO: 1793119 - RNA, 22 nt, Human
uggcuucccgcucagcccuccc

SEQ ID NO: 1793120 - RNA, 18 nt, Human
uggcuucccgcucagccc

SEQ ID NO: 1793121 - RNA, 19 nt, Human
uggcuucccgcucagcccu

SEQ ID NO: 1793122 - RNA, 20 nt, Human
uggcuucccgcucagcccuc

SEQ ID NO: 1793123 - RNA, 21 nt, Human
uggcuucccgcucagcccucc

SEQ ID NO: 1793124 - RNA, 16 nt, Human
uggcuuuucacugcug

SEQ ID NO: 1793125 - RNA, 18 nt, Human
uggcuuuucacugcuggc

SEQ ID NO: 1793126 - RNA, 19 nt, Human
uggcuuuucacugcuggcu

SEQ ID NO: 1793127 - RNA, 21 nt, Human
uggcuuuucacugcuggcugc

SEQ ID NO: 1793128 - RNA, 22 nt, Human
uggcuuuucacugcuggcugcc

SEQ ID NO: 1793129 - RNA, 14 nt, Human
ugggaaugaagcaa

SEQ ID NO: 1793130 - RNA, 23 nt, Human
uggccucaagugauucuccugcc

SEQ ID NO: 1793131 - RNA, 18 nt, Human
uggccucaagugauucuc

SEQ ID NO: 1793132 - RNA, 23 nt, Human
uggccuagcauacguacacauuu

SEQ ID NO: 1793133 - RNA, 23 nt, Human
uggccuccaaguccacaguggaa

SEQ ID NO: 1793134 - RNA, 13 nt, Human
uggccuccaaguc

SEQ ID NO: 1793135 - RNA, 11 nt, Human
uggccucccaa

SEQ ID NO: 1793136 - RNA, 14 nt, Human
uggccucccaacuc

SEQ ID NO: 1793137 - RNA, 19 nt, Human
uggccucccaacucacccc

SEQ ID NO: 1793138 - RNA, 20 nt, Human
uggccucccaacucacccca

SEQ ID NO: 1793139 - RNA, 21 nt, Human
uggccucccaacucaccccag

SEQ ID NO: 1793140 - RNA, 22 nt, Human
uggccucccaacucaccccagc

SEQ ID NO: 1793141 - RNA, 19 nt, Human
uggcagcugcgguccaccc

SEQ ID NO: 1793142 - RNA, 17 nt, Human
uggcagcugcgguccac

SEQ ID NO: 1793143 - RNA, 13 nt, Human
uggccccucaggg

SEQ ID NO: 1793144 - RNA, 20 nt, Human
uggccccucagggucccugg

SEQ ID NO: 1793145 - RNA, 20 nt, Human
uggccuagcauacguacaca

SEQ ID NO: 1793146 - RNA, 21 nt, Human
uggccccucagggucccuggu

SEQ ID NO: 1793147 - RNA, 22 nt, Human
uggccccucagggucccuggug

SEQ ID NO: 1793148 - RNA, 16 nt, Human
ugucuguuguauucau

SEQ ID NO: 1793149 - RNA, 16 nt, Human
ugucuuuucuugcaug

SEQ ID NO: 1793150 - RNA, 23 nt, Human
ugucuuuggacccugaggcccag

SEQ ID NO: 1793151 - RNA, 16 nt, Human
ugucuaugggacucaa

SEQ ID NO: 1793152 - RNA, 15 nt, Human
ugucuaugggacuca

SEQ ID NO: 1793153 - RNA, 14 nt, Human
ugucuaugggacuc

SEQ ID NO: 1793154 - RNA, 19 nt, Human
ugucuaggcaggaccugug

SEQ ID NO: 1793155 - RNA, 17 nt, Human
ugucuaggcaggaccug

SEQ ID NO: 1793156 - RNA, 15 nt, Human
ugucuaguuguuuga

SEQ ID NO: 1793157 - RNA, 23 nt, Human
ugucuaguuguuugauucagaca

SEQ ID NO: 1793158 - RNA, 17 nt, Human
ugucucaagagggcacu

SEQ ID NO: 1793159 - RNA, 18 nt, Human
ugucucaagagggcacug

SEQ ID NO: 1793160 - RNA, 21 nt, Human
ugucucaaaaaaagaaaaaga

SEQ ID NO: 1793161 - RNA, 19 nt, Human
ugucucaagagggcacugg

SEQ ID NO: 1793162 - RNA, 20 nt, Human
uguccugggagugagcuggu

SEQ ID NO: 1793163 - RNA, 19 nt, Human
uguccugggagugagcugg

SEQ ID NO: 1793164 - RNA, 12 nt, Human
uguccugggagu

SEQ ID NO: 1793165 - RNA, 22 nt, Human
uguccugccuaaggcugaacuu

SEQ ID NO: 1793166 - RNA, 14 nt, Human
ugucuaaugaaacc

SEQ ID NO: 1793167 - RNA, 13 nt, Human
uguccccuauccu

SEQ ID NO: 1793168 - RNA, 13 nt, Human
ugucaucucagcu

SEQ ID NO: 1793169 - RNA, 17 nt, Human
uguccccgcacugggcu

SEQ ID NO: 1793170 - RNA, 19 nt, Human
uguccccgcacugggcuug

SEQ ID NO: 1793171 - RNA, 22 nt, Human
uguacagcaaggagauuuacaa

SEQ ID NO: 1793172 - RNA, 13 nt, Human
uguacagagccca

SEQ ID NO: 1793173 - RNA, 21 nt, Human
uguacagagcccacgccccca

SEQ ID NO: 1793174 - RNA, 12 nt, Human
uguacagagccc

SEQ ID NO: 1793175 - RNA, 23 nt, Human
uguacagcaaggagauuuacaac

SEQ ID NO: 1793176 - RNA, 22 nt, Human
uguaugaaagauggcugugccu

SEQ ID NO: 1793177 - RNA, 13 nt, Human
uguaucugagcag

SEQ ID NO: 1793178 - RNA, 19 nt, Human
uguauuuuacuaauaaaau

SEQ ID NO: 1793179 - RNA, 14 nt, Human
ugucacaggcaggu

SEQ ID NO: 1793180 - RNA, 13 nt, Human
ugucacacacuuu

SEQ ID NO: 1793181 - RNA, 21 nt, Human
ugucaauuacaggaaguacug

SEQ ID NO: 1793182 - RNA, 13 nt, Human
uguaugcgugugu

SEQ ID NO: 1793183 - RNA, 21 nt, Human
ugucacaggcagguccagggu

SEQ ID NO: 1793184 - RNA, 17 nt, Human
ugucacaggcaggucca

SEQ ID NO: 1793185 - RNA, 16 nt, Human
ugucacaggcaggucc

SEQ ID NO: 1793186 - RNA, 15 nt, Human
ugucacaggcagguc

SEQ ID NO: 1793187 - RNA, 16 nt, Human
ugucagugugacugau

SEQ ID NO: 1793188 - RNA, 19 nt, Human
ugucagugugacugaucuc

SEQ ID NO: 1793189 - RNA, 15 nt, Human
ugucagugugacuga

SEQ ID NO: 1793190 - RNA, 14 nt, Human
ugucagugugacug

SEQ ID NO: 1793191 - RNA, 14 nt, Human
uguacagacaacaa

SEQ ID NO: 1793192 - RNA, 11 nt, Human
uguacagagcc

SEQ ID NO: 1793193 - RNA, 19 nt, Human
uguaauaauaaagaauagc

SEQ ID NO: 1793194 - RNA, 11 nt, Human
uguaaugaaaa

SEQ ID NO: 1793195 - RNA, 12 nt, Human
uguaaugaaaac

SEQ ID NO: 1793196 - RNA, 13 nt, Human
uguaaugaaaacc

SEQ ID NO: 1793197 - RNA, 17 nt, Human
uguaaugaaaaccacau

SEQ ID NO: 1793198 - RNA, 17 nt, Human
uguaacaagccacccca

SEQ ID NO: 1793199 - RNA, 14 nt, Human
uguaacaagccacc

SEQ ID NO: 1793200 - RNA, 13 nt, Human
ugguugcauccua

SEQ ID NO: 1793201 - RNA, 16 nt, Human
ugguuuucuguucuuu

SEQ ID NO: 1793202 - RNA, 20 nt, Human
ugguuguacauauaagugau

SEQ ID NO: 1793203 - RNA, 23 nt, Human
ugguuuuuaaaaaacugcugacu

SEQ ID NO: 1793204 - RNA, 16 nt, Human
ugguuuuucaguuuuc

SEQ ID NO: 1793205 - RNA, 19 nt, Human
ugguuuucuuguguguuua

SEQ ID NO: 1793206 - RNA, 21 nt, Human
ugguuuuuaaaaaacugcuga

SEQ ID NO: 1793207 - RNA, 11 nt, Human
uguaaaauggu

SEQ ID NO: 1793208 - RNA, 12 nt, Human
uguaaaauggug

SEQ ID NO: 1793209 - RNA, 19 nt, Human
uguaaaagcauuuuguaau

SEQ ID NO: 1793210 - RNA, 18 nt, Human
uguaaaagcauuuuguaa

SEQ ID NO: 1793211 - RNA, 17 nt, Human
uguaaaagcauuuugua

SEQ ID NO: 1793212 - RNA, 23 nt, Human
uggguacuuguggacacagcucu

SEQ ID NO: 1793213 - RNA, 20 nt, Human
uggguacuuguggacacagc

SEQ ID NO: 1793214 - RNA, 14 nt, Human
uggugagaggcauc

SEQ ID NO: 1793215 - RNA, 18 nt, Human
ugguggcagugggagcug

SEQ ID NO: 1793216 - RNA, 13 nt, Human
ugguggcaguggg

SEQ ID NO: 1793217 - RNA, 20 nt, Human
ugguggcagugggagcugcc

SEQ ID NO: 1793218 - RNA, 19 nt, Human
ugguggcccgacagccugg

SEQ ID NO: 1793219 - RNA, 14 nt, Human
uggugcaaugaccu

SEQ ID NO: 1793220 - RNA, 19 nt, Human
uggugcaaugaccuuucaa

SEQ ID NO: 1793221 - RNA, 20 nt, Human
uggugcaaugaccuuucaau

SEQ ID NO: 1793222 - RNA, 13 nt, Human
ugguggcuggguu

SEQ ID NO: 1793223 - RNA, 21 nt, Human
ugguggcccgacagccuggca

SEQ ID NO: 1793224 - RNA, 16 nt, Human
uggugggggccucggu

SEQ ID NO: 1793225 - RNA, 18 nt, Human
uggugggggccucggugu

SEQ ID NO: 1793226 - RNA, 20 nt, Human
ugguggggcugccaggggag

SEQ ID NO: 1793227 - RNA, 18 nt, Human
uggugguuucagaaaugu

SEQ ID NO: 1793228 - RNA, 17 nt, Human
uggugguuucagaaaug

SEQ ID NO: 1793229 - RNA, 18 nt, Human
ugguguaagguacuuuca

SEQ ID NO: 1793230 - RNA, 19 nt, Human
uggugguuuucuguucuuu

SEQ ID NO: 1793231 - RNA, 18 nt, Human
ugguugaugaucuuugca

SEQ ID NO: 1793232 - RNA, 12 nt, Human
ugguuccucccc

SEQ ID NO: 1793233 - RNA, 18 nt, Human
ugguuccuccccuccucc

SEQ ID NO: 1793234 - RNA, 23 nt, Human
ugguuccuccccuccuccuggac

SEQ ID NO: 1793235 - RNA, 23 nt, Human
ugguuccccuguucacucuacuu

SEQ ID NO: 1793236 - RNA, 16 nt, Human
uggugucaccugaaga

SEQ ID NO: 1793237 - RNA, 15 nt, Human
uggugucgggcauga

SEQ ID NO: 1793238 - RNA, 11 nt, Human
ugguuccccug

SEQ ID NO: 1793239 - RNA, 18 nt, Human
ugguuccccuguucacuc

SEQ ID NO: 1793240 - RNA, 19 nt, Human
ugguuccccuguucacucu

SEQ ID NO: 1793241 - RNA, 20 nt, Human
ugguuccccuguucacucua

SEQ ID NO: 1793242 - RNA, 18 nt, Human
uggugucgggcaugacac

SEQ ID NO: 1793243 - RNA, 19 nt, Human
uggugucgggcaugacacg

SEQ ID NO: 1793244 - RNA, 11 nt, Human
ucccuccuggg

SEQ ID NO: 1793245 - RNA, 19 nt, Human
ucccuccugggaaugaagc

SEQ ID NO: 1793246 - RNA, 16 nt, Human
ucccuauuagagaaga

SEQ ID NO: 1793247 - RNA, 16 nt, Human
ucccuaauaaagcugu

SEQ ID NO: 1793248 - RNA, 13 nt, Human
uccccuucacucc

SEQ ID NO: 1793249 - RNA, 21 nt, Human
uccccuguuuguuucugaaag

SEQ ID NO: 1793250 - RNA, 17 nt, Human
uccagguuuaagcuguu

SEQ ID NO: 1793251 - RNA, 18 nt, Human
uccagguuuaagcuguua

SEQ ID NO: 1793252 - RNA, 20 nt, Human
uccccuguuuguuucugaaa

SEQ ID NO: 1793253 - RNA, 23 nt, Human
ucccguggaacguuuuuccuguu

SEQ ID NO: 1793254 - RNA, 22 nt, Human
ucccguggaacguuuuuccugu

SEQ ID NO: 1793255 - RNA, 16 nt, Human
ucccguggaacguuuu

SEQ ID NO: 1793256 - RNA, 14 nt, Human
ucccuaauaaagcu

SEQ ID NO: 1793257 - RNA, 15 nt, Human
ucccuaauaaagcug

SEQ ID NO: 1793258 - RNA, 14 nt, Human
ucccuucccaccuc

SEQ ID NO: 1793259 - RNA, 13 nt, Human
ucccuucccaccu

SEQ ID NO: 1793260 - RNA, 14 nt, Human
ucccugcacuugca

SEQ ID NO: 1793261 - RNA, 19 nt, Human
ucccugccccucccuucaa

SEQ ID NO: 1793262 - RNA, 13 nt, Human
ucccugcacuugc

SEQ ID NO: 1793263 - RNA, 20 nt, Human
ucccugccccucccuucaac

SEQ ID NO: 1793264 - RNA, 14 nt, Human
uccucuaggagguc

SEQ ID NO: 1793265 - RNA, 19 nt, Human
uccuccuuuucacaguucu

SEQ ID NO: 1793266 - RNA, 21 nt, Human
uccucuuccugaauuuuauuu

SEQ ID NO: 1793267 - RNA, 16 nt, Human
uccucuguacagagcc

SEQ ID NO: 1793268 - RNA, 17 nt, Human
uccucuguacagagccc

SEQ ID NO: 1793269 - RNA, 18 nt, Human
uccucuguacagagccca

SEQ ID NO: 1793270 - RNA, 19 nt, Human
uccucuguacagagcccac

SEQ ID NO: 1793271 - RNA, 17 nt, Human
uccucuaggaggucucu

SEQ ID NO: 1793272 - RNA, 14 nt, Human
uccucugcugcugg

SEQ ID NO: 1793273 - RNA, 15 nt, Human
uccucugcugcuggc

SEQ ID NO: 1793274 - RNA, 16 nt, Human
uccucugcugcuggcu

SEQ ID NO: 1793275 - RNA, 17 nt, Human
uccucugcugcuggcug

SEQ ID NO: 1793276 - RNA, 18 nt, Human
uccuauauuguuuucagu

SEQ ID NO: 1793277 - RNA, 21 nt, Human
uccuauauuguuuucagugua

SEQ ID NO: 1793278 - RNA, 17 nt, Human
uccucauuagcauuuug

SEQ ID NO: 1793279 - RNA, 18 nt, Human
uccuacccacccuccuuu

SEQ ID NO: 1793280 - RNA, 15 nt, Human
uccuacaagacacag

SEQ ID NO: 1793281 - RNA, 22 nt, Human
uccuaaugaaugcauaaaaugu

SEQ ID NO: 1793282 - RNA, 15 nt, Human
uccuaauuccacagc

SEQ ID NO: 1793283 - RNA, 16 nt, Human
uccuaauuccacagcu

SEQ ID NO: 1793284 - RNA, 17 nt, Human
uccuaauuccacagcug

SEQ ID NO: 1793285 - RNA, 18 nt, Human
uccuaauuccacagcugc

SEQ ID NO: 1793286 - RNA, 17 nt, Human
uccgaccagacaccuug

SEQ ID NO: 1793287 - RNA, 13 nt, Human
uccgaccagacac

SEQ ID NO: 1793288 - RNA, 16 nt, Human
uccuaaucuucugaac

SEQ ID NO: 1793289 - RNA, 21 nt, Human
uccuucaccuuuguccccacc

SEQ ID NO: 1793290 - RNA, 22 nt, Human
uccuucaccuuuguccccaccg

SEQ ID NO: 1793291 - RNA, 16 nt, Human
uccuuaccagcagagc

SEQ ID NO: 1793292 - RNA, 17 nt, Human
uccuuaccagcagagca

SEQ ID NO: 1793293 - RNA, 18 nt, Human
uccuuaccagcagagcac

SEQ ID NO: 1793294 - RNA, 18 nt, Human
uccuucacagaugggugc

SEQ ID NO: 1793295 - RNA, 19 nt, Human
uccuucacagaugggugcu

SEQ ID NO: 1793296 - RNA, 20 nt, Human
uccuuaccagcagagcaccu

SEQ ID NO: 1793297 - RNA, 18 nt, Human
uccuucaccuuugucccc

SEQ ID NO: 1793298 - RNA, 20 nt, Human
uccuucaccuuuguccccac

SEQ ID NO: 1793299 - RNA, 19 nt, Human
uccuuuuaaaacacuucca

SEQ ID NO: 1793300 - RNA, 23 nt, Human
uccuuuucacaguucucuccuuc

SEQ ID NO: 1793301 - RNA, 17 nt, Human
ucgaggcggaucuuugg

SEQ ID NO: 1793302 - RNA, 22 nt, Human
ucgaggcggaucuuuggacaga

SEQ ID NO: 1793303 - RNA, 15 nt, Human
ucgaacuccugaccu

SEQ ID NO: 1793304 - RNA, 18 nt, Human
uccuuuucgcaggauucu

SEQ ID NO: 1793305 - RNA, 14 nt, Human
uccugccucagccu

SEQ ID NO: 1793306 - RNA, 14 nt, Human
uccugagccagauu

SEQ ID NO: 1793307 - RNA, 20 nt, Human
uccugccuaagugcagcccc

SEQ ID NO: 1793308 - RNA, 13 nt, Human
uccugagccagau

SEQ ID NO: 1793309 - RNA, 19 nt, Human
uccuggcacccggccccug

SEQ ID NO: 1793310 - RNA, 16 nt, Human
uccuggcacccggccc

SEQ ID NO: 1793311 - RNA, 14 nt, Human
uccuggcacccggc

SEQ ID NO: 1793312 - RNA, 15 nt, Human
uccugccucagccuc

SEQ ID NO: 1793313 - RNA, 13 nt, Human
uccugccucagcc

SEQ ID NO: 1793314 - RNA, 16 nt, Human
uccugccucagccucc

SEQ ID NO: 1793315 - RNA, 17 nt, Human
uccugccucagccuccc

SEQ ID NO: 1793316 - RNA, 22 nt, Human
uccuggcacccggccccugcug

SEQ ID NO: 1793317 - RNA, 17 nt, Human
uccuggcacugcuucca

SEQ ID NO: 1793318 - RNA, 21 nt, Human
uccuggcacccggccccugcu

SEQ ID NO: 1793319 - RNA, 20 nt, Human
uccuggcacccggccccugc

SEQ ID NO: 1793320 - RNA, 18 nt, Human
uccuggcacugcuuccag

SEQ ID NO: 1793321 - RNA, 22 nt, Human
uccuggcacugcuuccagugag

SEQ ID NO: 1793322 - RNA, 20 nt, Human
uccuguaccucuugagccuu

SEQ ID NO: 1793323 - RNA, 22 nt, Human
uccuguaccucuugagccuuga

SEQ ID NO: 1793324 - RNA, 18 nt, Human
ucggccuccauccugagg

SEQ ID NO: 1793325 - RNA, 22 nt, Human
ucgagguuucucaaagaaauuu

SEQ ID NO: 1793326 - RNA, 16 nt, Human
ucgagguuucucaaag

SEQ ID NO: 1793327 - RNA, 16 nt, Human
ucgugauugauaagaa

SEQ ID NO: 1793328 - RNA, 22 nt, Human
ucggccucccaaagugcuggga

SEQ ID NO: 1793329 - RNA, 21 nt, Human
ucuaaaucuccaaaauaaaac

SEQ ID NO: 1793330 - RNA, 22 nt, Human
ucuaaaucuccaaaauaaaacu

SEQ ID NO: 1793331 - RNA, 14 nt, Human
ucuaauauguaaca

SEQ ID NO: 1793332 - RNA, 14 nt, Human
ucuaaugugugaau

SEQ ID NO: 1793333 - RNA, 18 nt, Human
ucuaggaggucucuaaga

SEQ ID NO: 1793334 - RNA, 13 nt, Human
ucuaugccugucu

SEQ ID NO: 1793335 - RNA, 22 nt, Human
ucucaaagaaauuuccacucag

SEQ ID NO: 1793336 - RNA, 21 nt, Human
ucucaaagaaauuuccacuca

SEQ ID NO: 1793337 - RNA, 17 nt, Human
ucucaaauaacuaaaag

SEQ ID NO: 1793338 - RNA, 15 nt, Human
ucuaucaaguauuau

SEQ ID NO: 1793339 - RNA, 22 nt, Human
ucuaucaaguauuauaccuuuu

SEQ ID NO: 1793340 - RNA, 21 nt, Human
ucuaucaaguauuauaccuuu

SEQ ID NO: 1793341 - RNA, 12 nt, Human
ucuccugccuca

SEQ ID NO: 1793342 - RNA, 19 nt, Human
ucucaagagggcacuggug

SEQ ID NO: 1793343 - RNA, 17 nt, Human
ucucaagagggcacugg

SEQ ID NO: 1793344 - RNA, 18 nt, Human
ucucaagagggcacuggu

SEQ ID NO: 1793345 - RNA, 15 nt, Human
ucuccugccucagcc

SEQ ID NO: 1793346 - RNA, 17 nt, Human
ucuccugccucagccuc

SEQ ID NO: 1793347 - RNA, 19 nt, Human
ucuccugccucagccuccc

SEQ ID NO: 1793348 - RNA, 21 nt, Human
ucuccuggaagugcuaauuuu

SEQ ID NO: 1793349 - RNA, 21 nt, Human
ucuccuggaaauauuaagaaa

SEQ ID NO: 1793350 - RNA, 15 nt, Human
ucuccuguaccucuu

SEQ ID NO: 1793351 - RNA, 17 nt, Human
ucuccuguaccucuuga

SEQ ID NO: 1793352 - RNA, 16 nt, Human
ucuccuguaccucuug

SEQ ID NO: 1793353 - RNA, 19 nt, Human
ucuccuguaccucuugagc

SEQ ID NO: 1793354 - RNA, 21 nt, Human
ucucgugguaggacuguagaa

SEQ ID NO: 1793355 - RNA, 19 nt, Human
ucucgugguaggacuguag

SEQ ID NO: 1793356 - RNA, 14 nt, Human
ucucgugauugaua

SEQ ID NO: 1793357 - RNA, 22 nt, Human
ucucgugauugauaagaaccuu

SEQ ID NO: 1793358 - RNA, 14 nt, Human
ucucuaacagugga

SEQ ID NO: 1793359 - RNA, 20 nt, Human
ucucuaacaguggacaaagu

SEQ ID NO: 1793360 - RNA, 12 nt, Human
ucucuaacuuca

SEQ ID NO: 1793361 - RNA, 19 nt, Human
ucucuaacuucaccauauu

SEQ ID NO: 1793362 - RNA, 15 nt, Human
ucucugcaggucccu

SEQ ID NO: 1793363 - RNA, 16 nt, Human
ucucugcaggucccua

SEQ ID NO: 1793364 - RNA, 18 nt, Human
ucucugcaggucccuaau

SEQ ID NO: 1793365 - RNA, 17 nt, Human
ucucugaggacacuaac

SEQ ID NO: 1793366 - RNA, 13 nt, Human
ucucugcaggucc

SEQ ID NO: 1793367 - RNA, 14 nt, Human
ucucugcagguccc

SEQ ID NO: 1793368 - RNA, 15 nt, Human
ucucuaguuugauua

SEQ ID NO: 1793369 - RNA, 16 nt, Human
ucucuaguuugauuaa

SEQ ID NO: 1793370 - RNA, 17 nt, Human
ucugcauucaggaucaa

SEQ ID NO: 1793371 - RNA, 23 nt, Human
ucugaggaauccagacccggcug

SEQ ID NO: 1793372 - RNA, 15 nt, Human
ucugacccacugcuu

SEQ ID NO: 1793373 - RNA, 14 nt, Human
ucugacccacugcu

SEQ ID NO: 1793374 - RNA, 11 nt, Human
ucugaggcuga

SEQ ID NO: 1793375 - RNA, 23 nt, Human
ucugaggcugaaauucagaauau

SEQ ID NO: 1793376 - RNA, 14 nt, Human
ucugcacacagcac

SEQ ID NO: 1793377 - RNA, 20 nt, Human
ucugcaagaauugaagcagg

SEQ ID NO: 1793378 - RNA, 21 nt, Human
ucugcaagaauugaagcagga

SEQ ID NO: 1793379 - RNA, 13 nt, Human
ucugacccacugc

SEQ ID NO: 1793380 - RNA, 15 nt, Human
ucugacauaaguauu

SEQ ID NO: 1793381 - RNA, 22 nt, Human
ucugacaggcaaugcuggcugu

SEQ ID NO: 1793382 - RNA, 21 nt, Human
ucugacaggcaaugcuggcug

SEQ ID NO: 1793383 - RNA, 12 nt, Human
ucugacaggcaa

SEQ ID NO: 1793384 - RNA, 19 nt, Human
ucugacacacagcucuguc

SEQ ID NO: 1793385 - RNA, 18 nt, Human
ucugacacacagcucugu

SEQ ID NO: 1793386 - RNA, 17 nt, Human
ucugacacacagcucug

SEQ ID NO: 1793387 - RNA, 16 nt, Human
ucugacacacagcucu

SEQ ID NO: 1793388 - RNA, 14 nt, Human
ucugaaaauguaug

SEQ ID NO: 1793389 - RNA, 22 nt, Human
ucugaaaauugaugggauuugg

SEQ ID NO: 1793390 - RNA, 14 nt, Human
ucugaaaauugaug

SEQ ID NO: 1793391 - RNA, 13 nt, Human
ucugaaaauguau

SEQ ID NO: 1793392 - RNA, 17 nt, Human
ucuuccuggauuauuca

SEQ ID NO: 1793393 - RNA, 23 nt, Human
ucuucagaucucuaacuucacca

SEQ ID NO: 1793394 - RNA, 18 nt, Human
ucuucagaucucuaacuu

SEQ ID NO: 1793395 - RNA, 12 nt, Human
ucuugaacuccu

SEQ ID NO: 1793396 - RNA, 17 nt, Human
ucuugaacuccugaccu

SEQ ID NO: 1793397 - RNA, 19 nt, Human
ucuugaacuccugaccuca

SEQ ID NO: 1793398 - RNA, 13 nt, Human
ucuugaaaaaugc

SEQ ID NO: 1793399 - RNA, 19 nt, Human
ucuucuuuuugcuucaaaa

SEQ ID NO: 1793400 - RNA, 16 nt, Human
ucuucuuuuuuuguga

SEQ ID NO: 1793401 - RNA, 17 nt, Human
ucuucuuuuuuugugau

SEQ ID NO: 1793402 - RNA, 18 nt, Human
ucuucuuuuuuugugaug

SEQ ID NO: 1793403 - RNA, 14 nt, Human
ucuucuccuuucac

SEQ ID NO: 1793404 - RNA, 13 nt, Human
ucuucuccuuuca

SEQ ID NO: 1793405 - RNA, 12 nt, Human
ucuucuccacug

SEQ ID NO: 1793406 - RNA, 13 nt, Human
ucuuaaaaagugg

SEQ ID NO: 1793407 - RNA, 22 nt, Human
ucuuaaccagaucauugugaaa

SEQ ID NO: 1793408 - RNA, 16 nt, Human
ucuuaaccagaucauu

SEQ ID NO: 1793409 - RNA, 17 nt, Human
ucuuaaccagaucauug

SEQ ID NO: 1793410 - RNA, 22 nt, Human
ucuuaaauauguggaguucauc

SEQ ID NO: 1793411 - RNA, 14 nt, Human
ucugggacacaguu

SEQ ID NO: 1793412 - RNA, 23 nt, Human
ucuggugacuuuccucuuugguc

SEQ ID NO: 1793413 - RNA, 18 nt, Human
ucuggcucuuccaggcug

SEQ ID NO: 1793414 - RNA, 23 nt, Human
ucuggcucuuccaggcugggaga

SEQ ID NO: 1793415 - RNA, 15 nt, Human
ucuggcuccagcugg

SEQ ID NO: 1793416 - RNA, 22 nt, Human
ucuggcuaugcauuugaaaauu

SEQ ID NO: 1793417 - RNA, 19 nt, Human
ucuggcuaugcauuugaaa

SEQ ID NO: 1793418 - RNA, 23 nt, Human
ucuggccuucggccuccauccug

SEQ ID NO: 1793419 - RNA, 18 nt, Human
ucuggccuucggccucca

SEQ ID NO: 1793420 - RNA, 17 nt, Human
ucuggccuucggccucc

SEQ ID NO: 1793421 - RNA, 19 nt, Human
ucuguccuacucuguguca

SEQ ID NO: 1793422 - RNA, 15 nt, Human
ucuguccuacucugu

SEQ ID NO: 1793423 - RNA, 20 nt, Human
ucuguccuacucugugucag

SEQ ID NO: 1793424 - RNA, 21 nt, Human
ucuguccugggagugagcugg

SEQ ID NO: 1793425 - RNA, 14 nt, Human
ucugucgcccaguc

SEQ ID NO: 1793426 - RNA, 16 nt, Human
ucugucgcccagucug

SEQ ID NO: 1793427 - RNA, 22 nt, Human
ucugucucuggauuauauuaug

SEQ ID NO: 1793428 - RNA, 13 nt, Human
ucugguuccuccc

SEQ ID NO: 1793429 - RNA, 14 nt, Human
ucuguccuacucug

SEQ ID NO: 1793430 - RNA, 20 nt, Human
ucugguuccuccccuccucc

SEQ ID NO: 1793431 - RNA, 21 nt, Human
ucugguuccuccccuccuccu

SEQ ID NO: 1793432 - RNA, 22 nt, Human
ucugcugacagacacaggcccg

SEQ ID NO: 1793433 - RNA, 21 nt, Human
ucugcugacagacacaggccc

SEQ ID NO: 1793434 - RNA, 20 nt, Human
ucugcugacagacacaggcc

SEQ ID NO: 1793435 - RNA, 19 nt, Human
ucugcugacagacacaggc

SEQ ID NO: 1793436 - RNA, 22 nt, Human
ucugcugauccucccaggcuuc

SEQ ID NO: 1793437 - RNA, 15 nt, Human
ucuggaaugcagugg

SEQ ID NO: 1793438 - RNA, 19 nt, Human
ucuggaauaaggagaauga

SEQ ID NO: 1793439 - RNA, 14 nt, Human
ucuggacaggcaug

SEQ ID NO: 1793440 - RNA, 16 nt, Human
ucuggaaugcaguggu

SEQ ID NO: 1793441 - RNA, 21 nt, Human
ucuggacaggcauguucucug

SEQ ID NO: 1793442 - RNA, 17 nt, Human
ucugcugacagacacag

SEQ ID NO: 1793443 - RNA, 18 nt, Human
ucugcugacagacacagg

SEQ ID NO: 1793444 - RNA, 21 nt, Human
ucugcuccucuccccagcaag

SEQ ID NO: 1793445 - RNA, 18 nt, Human
ucugcuccucuccccagc

SEQ ID NO: 1793446 - RNA, 16 nt, Human
ucugccugcccaggcc

SEQ ID NO: 1793447 - RNA, 15 nt, Human
ucugccugcccaggc

SEQ ID NO: 1793448 - RNA, 22 nt, Human
ucugcuccccuaaagccucaaa

SEQ ID NO: 1793449 - RNA, 13 nt, Human
ucugccugcccag

SEQ ID NO: 1793450 - RNA, 14 nt, Human
ucugccugcccagg

SEQ ID NO: 1793451 - RNA, 18 nt, Human
ucugccauauucuguugg

SEQ ID NO: 1793452 - RNA, 17 nt, Human
ucaaauuguaagcaugc

SEQ ID NO: 1793453 - RNA, 20 nt, Human
ucaaauuguaagcaugcaca

SEQ ID NO: 1793454 - RNA, 23 nt, Human
ucaaccccuucgcuccugugucu

SEQ ID NO: 1793455 - RNA, 15 nt, Human
ucaaaugagaaaaug

SEQ ID NO: 1793456 - RNA, 20 nt, Human
ucaaagaaauuuccacucag

SEQ ID NO: 1793457 - RNA, 19 nt, Human
ucaaagaaauuuccacuca

SEQ ID NO: 1793458 - RNA, 13 nt, Human
ucaaagaaauuuc

SEQ ID NO: 1793459 - RNA, 12 nt, Human
ucaaagaaauuu

SEQ ID NO: 1793460 - RNA, 16 nt, Human
ucaaaacaaaggccua

SEQ ID NO: 1793461 - RNA, 21 nt, Human
ucaaauauauucagccuggcu

SEQ ID NO: 1793462 - RNA, 22 nt, Human
ucaaauauauucagccuggcuu

SEQ ID NO: 1793463 - RNA, 23 nt, Human
ucaaauauauucagccuggcuuc

SEQ ID NO: 1793464 - RNA, 19 nt, Human
uauuuucaacgcagcccug

SEQ ID NO: 1793465 - RNA, 17 nt, Human
uauuuuauuaugcauga

SEQ ID NO: 1793466 - RNA, 14 nt, Human
uauuuuauuaugca

SEQ ID NO: 1793467 - RNA, 17 nt, Human
uauuuuauguugcauag

SEQ ID NO: 1793468 - RNA, 13 nt, Human
uauuuauauaaau

SEQ ID NO: 1793469 - RNA, 22 nt, Human
uauuuucccuauuagagaagag

SEQ ID NO: 1793470 - RNA, 17 nt, Human
uauuuuuuucuuuucuu

SEQ ID NO: 1793471 - RNA, 14 nt, Human
uauuuuuuuacuaa

SEQ ID NO: 1793472 - RNA, 14 nt, Human
ucaaaaaaagaaaa

SEQ ID NO: 1793473 - RNA, 15 nt, Human
ucaaaaaaagaaaaa

SEQ ID NO: 1793474 - RNA, 21 nt, Human
ucaagugauucuccugccuca

SEQ ID NO: 1793475 - RNA, 19 nt, Human
ucaagugauucuccugccu

SEQ ID NO: 1793476 - RNA, 18 nt, Human
ucaagugauucuccugcc

SEQ ID NO: 1793477 - RNA, 20 nt, Human
ucaagugauucuccugccuc

SEQ ID NO: 1793478 - RNA, 14 nt, Human
ucaacgcagcccug

SEQ ID NO: 1793479 - RNA, 15 nt, Human
ucaacgcagcccugc

SEQ ID NO: 1793480 - RNA, 18 nt, Human
ucaacgcagcccugcuuu

SEQ ID NO: 1793481 - RNA, 13 nt, Human
ucaaugcagcccc

SEQ ID NO: 1793482 - RNA, 21 nt, Human
ucaauuacaggaaguacugga

SEQ ID NO: 1793483 - RNA, 23 nt, Human
ucaauuacaggaaguacuggaga

SEQ ID NO: 1793484 - RNA, 19 nt, Human
ucacaggcagguccagggu

SEQ ID NO: 1793485 - RNA, 18 nt, Human
ucacaggcagguccaggg

SEQ ID NO: 1793486 - RNA, 17 nt, Human
ucacaggcagguccagg

SEQ ID NO: 1793487 - RNA, 16 nt, Human
ucacaggcagguccag

SEQ ID NO: 1793488 - RNA, 22 nt, Human
ucacaguccuuaccagcagagc

SEQ ID NO: 1793489 - RNA, 23 nt, Human
ucacaguccuuaccagcagagca

SEQ ID NO: 1793490 - RNA, 19 nt, Human
ucacaguccuuaccagcag

SEQ ID NO: 1793491 - RNA, 16 nt, Human
ucacagucacauucca

SEQ ID NO: 1793492 - RNA, 18 nt, Human
ucacaagacccaaaaggc

SEQ ID NO: 1793493 - RNA, 17 nt, Human
ucacaagacccaaaagg

SEQ ID NO: 1793494 - RNA, 13 nt, Human
ucacaagacccaa

SEQ ID NO: 1793495 - RNA, 14 nt, Human
ucaccaaggcugau

SEQ ID NO: 1793496 - RNA, 19 nt, Human
ucaccaaaucagcugcuac

SEQ ID NO: 1793497 - RNA, 20 nt, Human
ucaccaaaucagcugcuacu

SEQ ID NO: 1793498 - RNA, 16 nt, Human
ucaccacaugugcaca

SEQ ID NO: 1793499 - RNA, 17 nt, Human
ucacauuuauucugcuc

SEQ ID NO: 1793500 - RNA, 19 nt, Human
ucacauuuauucugcucac

SEQ ID NO: 1793501 - RNA, 18 nt, Human
ucacauuuauucugcuca

SEQ ID NO: 1793502 - RNA, 19 nt, Human
uauugcuuguuggauuuuu

SEQ ID NO: 1793503 - RNA, 22 nt, Human
uauuggaaauuuguuauaauga

SEQ ID NO: 1793504 - RNA, 17 nt, Human
uauugcugauggugcaa

SEQ ID NO: 1793505 - RNA, 17 nt, Human
uauucucuccuguaccu

SEQ ID NO: 1793506 - RNA, 18 nt, Human
uauucucuccuguaccuc

SEQ ID NO: 1793507 - RNA, 21 nt, Human
uauugauaugcuuauacacuu

SEQ ID NO: 1793508 - RNA, 24 nt, Human
uauuuauaaaaauaaaaaacacug

SEQ ID NO: 1793509 - RNA, 22 nt, Human
uauuguuuucaguguacaugga

SEQ ID NO: 1793510 - RNA, 18 nt, Human
uauuguuuucaguguaca

SEQ ID NO: 1793511 - RNA, 20 nt, Human
uauuguuuucaguguacaug

SEQ ID NO: 1793512 - RNA, 12 nt, Human
uauuguuuucag

SEQ ID NO: 1793513 - RNA, 17 nt, Human
uauuccugcauuuguga

SEQ ID NO: 1793514 - RNA, 19 nt, Human
uauuccugcauuugugaaa

SEQ ID NO: 1793515 - RNA, 20 nt, Human
uauuccugcauuugugaaau

SEQ ID NO: 1793516 - RNA, 21 nt, Human
uauuccugcauuugugaaaug

SEQ ID NO: 1793517 - RNA, 21 nt, Human
uauguaaaugguaugucauuc

SEQ ID NO: 1793518 - RNA, 20 nt, Human
uauguaaaugguaugucauu

SEQ ID NO: 1793519 - RNA, 13 nt, Human
gggaguggccaca

SEQ ID NO: 1793520 - RNA, 15 nt, Human
gggaguggccacaga

SEQ ID NO: 1793521 - RNA, 14 nt, Human
uauguugauaaaag

SEQ ID NO: 1793522 - RNA, 12 nt, Human
uauguugcauag

SEQ ID NO: 1793523 - RNA, 20 nt, Human
uauguugcccaggcaggucu

SEQ ID NO: 1793524 - RNA, 19 nt, Human
uauguugcccaggcagguc

SEQ ID NO: 1793525 - RNA, 16 nt, Human
uauguugcccaggcag

SEQ ID NO: 1793526 - RNA, 13 nt, Human
uauguugcccagg

SEQ ID NO: 1793527 - RNA, 16 nt, Human
uauguugcauagaaua

SEQ ID NO: 1793528 - RNA, 12 nt, Human
uauuaaauuaug

SEQ ID NO: 1793529 - RNA, 17 nt, Human
uccaauuuacauacucu

SEQ ID NO: 1793530 - RNA, 18 nt, Human
uccaauuuacauacucug

SEQ ID NO: 1793531 - RNA, 18 nt, Human
uccaaaauaaaacuuuuu

SEQ ID NO: 1793532 - RNA, 20 nt, Human
uccaaaauaaaacuuuuuaa

SEQ ID NO: 1793533 - RNA, 17 nt, Human
uccacaaguuaaauaaa

SEQ ID NO: 1793534 - RNA, 18 nt, Human
uccacaaguuaaauaaau

SEQ ID NO: 1793535 - RNA, 16 nt, Human
uccacaagagcccagg

SEQ ID NO: 1793536 - RNA, 17 nt, Human
uccacaagagcccaggc

SEQ ID NO: 1793537 - RNA, 18 nt, Human
uccacaagagcccaggcc

SEQ ID NO: 1793538 - RNA, 12 nt, Human
uccacccugcuc

SEQ ID NO: 1793539 - RNA, 19 nt, Human
uccacagaggacacagaga

SEQ ID NO: 1793540 - RNA, 17 nt, Human
uccacagaggacacaga

SEQ ID NO: 1793541 - RNA, 15 nt, Human
uccacagaggacaca

SEQ ID NO: 1793542 - RNA, 18 nt, Human
uccaccugccagggacag

SEQ ID NO: 1793543 - RNA, 21 nt, Human
uccaccugccagggacagagg

SEQ ID NO: 1793544 - RNA, 17 nt, Human
uccaccugccagggaca

SEQ ID NO: 1793545 - RNA, 15 nt, Human
uccaccugccaggga

SEQ ID NO: 1793546 - RNA, 17 nt, Human
uccacuuggucugugag

SEQ ID NO: 1793547 - RNA, 15 nt, Human
uccaccuucccaugc

SEQ ID NO: 1793548 - RNA, 16 nt, Human
uccacuuggucuguga

SEQ ID NO: 1793549 - RNA, 15 nt, Human
uccacuuggucugug

SEQ ID NO: 1793550 - RNA, 17 nt, Human
uccagcuguucagcugg

SEQ ID NO: 1793551 - RNA, 16 nt, Human
uccaggagcagccaca

SEQ ID NO: 1793552 - RNA, 17 nt, Human
uccagcucaccagcccc

SEQ ID NO: 1793553 - RNA, 16 nt, Human
uccagcucaccagccc

SEQ ID NO: 1793554 - RNA, 18 nt, Human
uccagcucaccagcccca

SEQ ID NO: 1793555 - RNA, 16 nt, Human
uccagguucagcuugu

SEQ ID NO: 1793556 - RNA, 15 nt, Human
uccagguucagcuug

SEQ ID NO: 1793557 - RNA, 11 nt, Human
uccaggguggu

SEQ ID NO: 1793558 - RNA, 18 nt, Human
uccaggugcacaagcucc

SEQ ID NO: 1793559 - RNA, 20 nt, Human
uccaggugcacaagcuccaa

SEQ ID NO: 1793560 - RNA, 21 nt, Human
uccaggugcacaagcuccaag

SEQ ID NO: 1793561 - RNA, 22 nt, Human
uccaggugcacaagcuccaagc

SEQ ID NO: 1793562 - RNA, 15 nt, Human
uccaggugcacaagc

SEQ ID NO: 1793563 - RNA, 23 nt, Human
uccaggggugggacacccuguga

SEQ ID NO: 1793564 - RNA, 22 nt, Human
uccaggagcagccacauuccug

SEQ ID NO: 1793565 - RNA, 17 nt, Human
uccaggagcagccacau

SEQ ID NO: 1793566 - RNA, 18 nt, Human
uccaggagcagccacauu

SEQ ID NO: 1793567 - RNA, 23 nt, Human
ucaucuuagguuggcaaaaaggc

SEQ ID NO: 1793568 - RNA, 19 nt, Human
ucaucuugaauuguaagga

SEQ ID NO: 1793569 - RNA, 15 nt, Human
ucaggugcugccauc

SEQ ID NO: 1793570 - RNA, 14 nt, Human
ucaggugcugccau

SEQ ID NO: 1793571 - RNA, 13 nt, Human
ucaggugcugcca

SEQ ID NO: 1793572 - RNA, 23 nt, Human
ucaggugccucaagagaaggcaa

SEQ ID NO: 1793573 - RNA, 21 nt, Human
ucaggugagaagcagaggaag

SEQ ID NO: 1793574 - RNA, 21 nt, Human
ucauagcccucacccuggggc

SEQ ID NO: 1793575 - RNA, 15 nt, Human
ucauacucaccucac

SEQ ID NO: 1793576 - RNA, 19 nt, Human
ucaucaccaacgucugugc

SEQ ID NO: 1793577 - RNA, 20 nt, Human
ucaucaccaacgucugugcc

SEQ ID NO: 1793578 - RNA, 21 nt, Human
ucaucaccaacgucugugcca

SEQ ID NO: 1793579 - RNA, 23 nt, Human
ucauuccaccuucccaugcccug

SEQ ID NO: 1793580 - RNA, 21 nt, Human
ucauucaacccaccugcgucu

SEQ ID NO: 1793581 - RNA, 16 nt, Human
ucauuuccugugucuu

SEQ ID NO: 1793582 - RNA, 13 nt, Human
ucauuuccugugu

SEQ ID NO: 1793583 - RNA, 12 nt, Human
ucauugugaaau

SEQ ID NO: 1793584 - RNA, 15 nt, Human
ucauugugaaauuau

SEQ ID NO: 1793585 - RNA, 17 nt, Human
ucauugugaaauuauuc

SEQ ID NO: 1793586 - RNA, 18 nt, Human
ucauugugaaauuauuca

SEQ ID NO: 1793587 - RNA, 19 nt, Human
ucaggagcccugggaggcu

SEQ ID NO: 1793588 - RNA, 18 nt, Human
ucaggagcccugggaggc

SEQ ID NO: 1793589 - RNA, 20 nt, Human
ucaggagcccugggaggcuc

SEQ ID NO: 1793590 - RNA, 23 nt, Human
ucaggagcccugggaggcucugg

SEQ ID NO: 1793591 - RNA, 21 nt, Human
ucagggagugggcuaagcacg

SEQ ID NO: 1793592 - RNA, 14 nt, Human
ucagggccuggcuc

SEQ ID NO: 1793593 - RNA, 16 nt, Human
ucagggccuggcucag

SEQ ID NO: 1793594 - RNA, 15 nt, Human
ucaggugagaagcag

SEQ ID NO: 1793595 - RNA, 16 nt, Human
ucaggugagaagcaga

SEQ ID NO: 1793596 - RNA, 22 nt, Human
ucagccucccgaguagcuggga

SEQ ID NO: 1793597 - RNA, 21 nt, Human
ucagccucccgaguagcuggg

SEQ ID NO: 1793598 - RNA, 20 nt, Human
ucagccuccugaguagcugg

SEQ ID NO: 1793599 - RNA, 21 nt, Human
ucagccuccugaguagcugga

SEQ ID NO: 1793600 - RNA, 13 nt, Human
ucagccuccugag

SEQ ID NO: 1793601 - RNA, 22 nt, Human
ucagccuccugaguagcuggga

SEQ ID NO: 1793602 - RNA, 18 nt, Human
ucagccugcuccagcugu

SEQ ID NO: 1793603 - RNA, 19 nt, Human
ucagccugcuccagcuguu

SEQ ID NO: 1793604 - RNA, 15 nt, Human
ucagcugaaccuggg

SEQ ID NO: 1793605 - RNA, 16 nt, Human
ucagcugaaccugggu

SEQ ID NO: 1793606 - RNA, 21 nt, Human
ucagccucccaaagugcuggg

SEQ ID NO: 1793607 - RNA, 19 nt, Human
ucagccucccaaagugcug

SEQ ID NO: 1793608 - RNA, 14 nt, Human
ucagccucccaaag

SEQ ID NO: 1793609 - RNA, 23 nt, Human
ucagcauucucacuccuaccugg

SEQ ID NO: 1793610 - RNA, 22 nt, Human
ucagccucccgaauagcuggga

SEQ ID NO: 1793611 - RNA, 21 nt, Human
ucagccucccgaauagcuggg

SEQ ID NO: 1793612 - RNA, 18 nt, Human
ucagccucccgaguagcu

SEQ ID NO: 1793613 - RNA, 20 nt, Human
ucagccucccgaguagcugg

SEQ ID NO: 1793614 - RNA, 17 nt, Human
ucagauauaaaagacug

SEQ ID NO: 1793615 - RNA, 14 nt, Human
ucagauauaaaaga

SEQ ID NO: 1793616 - RNA, 20 nt, Human
ucagauauaaaagacugacc

SEQ ID NO: 1793617 - RNA, 18 nt, Human
ucagauauaaaagacuga

SEQ ID NO: 1793618 - RNA, 17 nt, Human
ucagcauucucacuccu

SEQ ID NO: 1793619 - RNA, 20 nt, Human
ucagcauucucacuccuacc

SEQ ID NO: 1793620 - RNA, 21 nt, Human
ucagaguaauccaagcaaaug

SEQ ID NO: 1793621 - RNA, 22 nt, Human
ucagaguaauccaagcaaaugu

SEQ ID NO: 1793622 - RNA, 13 nt, Human
ucagacagcugcc

SEQ ID NO: 1793623 - RNA, 14 nt, Human
ucagacagcugccu

SEQ ID NO: 1793624 - RNA, 16 nt, Human
ucagaauucucuaguu

SEQ ID NO: 1793625 - RNA, 23 nt, Human
ucagaauucucuaguuugauuaa

SEQ ID NO: 1793626 - RNA, 15 nt, Human
ucagaaauguguuau

SEQ ID NO: 1793627 - RNA, 10 nt, Human
ucagaaaugu

SEQ ID NO: 1793628 - RNA, 16 nt, Human
ucaccagccccagugc

SEQ ID NO: 1793629 - RNA, 13 nt, Human
ucaccagccccag

SEQ ID NO: 1793630 - RNA, 17 nt, Human
ucacucuuauugcccac

SEQ ID NO: 1793631 - RNA, 20 nt, Human
ucacucuuauugcccacgcu

SEQ ID NO: 1793632 - RNA, 18 nt, Human
ucacugcauccuccgccu

SEQ ID NO: 1793633 - RNA, 19 nt, Human
ucacugcauccuccgccuc

SEQ ID NO: 1793634 - RNA, 18 nt, Human
ucacugccaugccagcuu

SEQ ID NO: 1793635 - RNA, 13 nt, Human
ucacugcuggcug

SEQ ID NO: 1793636 - RNA, 14 nt, Human
ucacugcuggcugc

SEQ ID NO: 1793637 - RNA, 15 nt, Human
ucacugcuggcugcc

SEQ ID NO: 1793638 - RNA, 16 nt, Human
ucacugcuggcugccu

SEQ ID NO: 1793639 - RNA, 12 nt, Human
ucacugcuggcu

SEQ ID NO: 1793640 - RNA, 17 nt, Human
ucacugcuggcugccuu

SEQ ID NO: 1793641 - RNA, 18 nt, Human
ucacugcuggcugccuua

SEQ ID NO: 1793642 - RNA, 22 nt, Human
ucacugcuggcugccuuagaac

SEQ ID NO: 1793643 - RNA, 14 nt, Human
ucacugcuuaacuu

SEQ ID NO: 1793644 - RNA, 18 nt, Human
gcucauggacuucugcca

SEQ ID NO: 1793645 - RNA, 19 nt, Human
gcucagcugucaaggcuca

SEQ ID NO: 1793646 - RNA, 23 nt, Human
gcucagcggggacagcuccuucu

SEQ ID NO: 1793647 - RNA, 19 nt, Human
gcucagcggggacagcucc

SEQ ID NO: 1793648 - RNA, 18 nt, Human
gcucagcggggacagcuc

SEQ ID NO: 1793649 - RNA, 17 nt, Human
gcucagcggggacagcu

SEQ ID NO: 1793650 - RNA, 17 nt, Human
gcucagcccucccugcc

SEQ ID NO: 1793651 - RNA, 18 nt, Human
gcucagcccucccugccc

SEQ ID NO: 1793652 - RNA, 19 nt, Human
gcucagcccucccugcccc

SEQ ID NO: 1793653 - RNA, 21 nt, Human
gcucagcccucccugccccuc

SEQ ID NO: 1793654 - RNA, 18 nt, Human
gcucaccagccccagugc

SEQ ID NO: 1793655 - RNA, 15 nt, Human
gcucaccagccccag

SEQ ID NO: 1793656 - RNA, 14 nt, Human
gcucaccagcccca

SEQ ID NO: 1793657 - RNA, 13 nt, Human
gcucaccagcccc

SEQ ID NO: 1793658 - RNA, 12 nt, Human
gcucaccagccc

SEQ ID NO: 1793659 - RNA, 16 nt, Human
gcucacauaucuguca

SEQ ID NO: 1793660 - RNA, 22 nt, Human
gcucacagaacccuuggagcca

SEQ ID NO: 1793661 - RNA, 15 nt, Human
gcucagcccucccug

SEQ ID NO: 1793662 - RNA, 16 nt, Human
gcucagcccucccugc

SEQ ID NO: 1793663 - RNA, 12 nt, Human
gcucagcccucc

SEQ ID NO: 1793664 - RNA, 14 nt, Human
gcucaccucucccu

SEQ ID NO: 1793665 - RNA, 16 nt, Human
gcucaccucucccuug

SEQ ID NO: 1793666 - RNA, 17 nt, Human
gcucaccucucccuugg

SEQ ID NO: 1793667 - RNA, 18 nt, Human
gcucaccucucccuugga

SEQ ID NO: 1793668 - RNA, 21 nt, Human
gcuaguugggcuuccucauag

SEQ ID NO: 1793669 - RNA, 19 nt, Human
gcggugcuaucucccccag

SEQ ID NO: 1793670 - RNA, 22 nt, Human
gcggugcuaucucccccagccc

SEQ ID NO: 1793671 - RNA, 20 nt, Human
gcuauaacuauguugauaaa

SEQ ID NO: 1793672 - RNA, 22 nt, Human
gcucaaguccucuuuucugaga

SEQ ID NO: 1793673 - RNA, 19 nt, Human
gcucaaguccucuuuucug

SEQ ID NO: 1793674 - RNA, 18 nt, Human
gcucaaguccucuuuucu

SEQ ID NO: 1793675 - RNA, 14 nt, Human
gcuaucucccccag

SEQ ID NO: 1793676 - RNA, 15 nt, Human
gcuaucucccccagc

SEQ ID NO: 1793677 - RNA, 15 nt, Human
gcuaucguaaaauua

SEQ ID NO: 1793678 - RNA, 16 nt, Human
gcuaucguaaaauuaa

SEQ ID NO: 1793679 - RNA, 17 nt, Human
gcuaucguaaaauuaag

SEQ ID NO: 1793680 - RNA, 13 nt, Human
gcuaucuccccca

SEQ ID NO: 1793681 - RNA, 23 nt, Human
gcuccgcuuucuacccagcgagc

SEQ ID NO: 1793682 - RNA, 22 nt, Human
gcuccgcuuucuacccagcgag

SEQ ID NO: 1793683 - RNA, 21 nt, Human
gcuccgcuuucuacccagcga

SEQ ID NO: 1793684 - RNA, 18 nt, Human
gcuccgcuuucuacccag

SEQ ID NO: 1793685 - RNA, 20 nt, Human
gcucccuucccaccucucuc

SEQ ID NO: 1793686 - RNA, 15 nt, Human
gcucccacaggcccu

SEQ ID NO: 1793687 - RNA, 12 nt, Human
gcuccaggcucc

SEQ ID NO: 1793688 - RNA, 15 nt, Human
gcuccaggagcagcc

SEQ ID NO: 1793689 - RNA, 16 nt, Human
gcuccaggagcagcca

SEQ ID NO: 1793690 - RNA, 17 nt, Human
gcuccaggagcagccac

SEQ ID NO: 1793691 - RNA, 18 nt, Human
gcuccaggagcagccaca

SEQ ID NO: 1793692 - RNA, 11 nt, Human
gcuccaggagc

SEQ ID NO: 1793693 - RNA, 12 nt, Human
gcuccaggagca

SEQ ID NO: 1793694 - RNA, 14 nt, Human
gcuccaggagcagc

SEQ ID NO: 1793695 - RNA, 13 nt, Human
gcuccaaacccuc

SEQ ID NO: 1793696 - RNA, 21 nt, Human
gcuccagcuguucagcugguu

SEQ ID NO: 1793697 - RNA, 21 nt, Human
gcucgagcaugccuggauggg

SEQ ID NO: 1793698 - RNA, 19 nt, Human
gcucgagcaugccuggaug

SEQ ID NO: 1793699 - RNA, 17 nt, Human
gcuccuuuagcgcccag

SEQ ID NO: 1793700 - RNA, 13 nt, Human
gcuccuucugucc

SEQ ID NO: 1793701 - RNA, 13 nt, Human
gcuccugugucuu

SEQ ID NO: 1793702 - RNA, 12 nt, Human
gcuccugugucu

SEQ ID NO: 1793703 - RNA, 20 nt, Human
gcuccuuccucugaggcuga

SEQ ID NO: 1793704 - RNA, 22 nt, Human
gcuccuuccucugaggcugaaa

SEQ ID NO: 1793705 - RNA, 18 nt, Human
gcuccuuccucugaggcu

SEQ ID NO: 1793706 - RNA, 24 nt, Human
gcuccgcuuucuacccagcgagcc

SEQ ID NO: 1793707 - RNA, 23 nt, Human
gcuccuggggguucuuucuuccu

SEQ ID NO: 1793708 - RNA, 14 nt, Human
gcuccucccggugc

SEQ ID NO: 1793709 - RNA, 18 nt, Human
gccugaagucacacagug

SEQ ID NO: 1793710 - RNA, 17 nt, Human
gccugaagucacacagu

SEQ ID NO: 1793711 - RNA, 20 nt, Human
gccugagcgacagugagacu

SEQ ID NO: 1793712 - RNA, 17 nt, Human
gccugagcgacagugag

SEQ ID NO: 1793713 - RNA, 16 nt, Human
gccugaagucacacag

SEQ ID NO: 1793714 - RNA, 22 nt, Human
gcccaguuggguggaugccugg

SEQ ID NO: 1793715 - RNA, 21 nt, Human
gcccaguuggguggaugccug

SEQ ID NO: 1793716 - RNA, 19 nt, Human
gcccaguuggguggaugcc

SEQ ID NO: 1793717 - RNA, 12 nt, Human
gccugagcuggg

SEQ ID NO: 1793718 - RNA, 16 nt, Human
gccuggauggggcugc

SEQ ID NO: 1793719 - RNA, 18 nt, Human
gccuggauggggcugcac

SEQ ID NO: 1793720 - RNA, 13 nt, Human
gccuggcacaggg

SEQ ID NO: 1793721 - RNA, 14 nt, Human
gccuggcacagggc

SEQ ID NO: 1793722 - RNA, 20 nt, Human
gccuggauggggcugcaccg

SEQ ID NO: 1793723 - RNA, 20 nt, Human
gccuguaauccuagcacuuu

SEQ ID NO: 1793724 - RNA, 15 nt, Human
gccuguaauccuagc

SEQ ID NO: 1793725 - RNA, 22 nt, Human
gccuggccagaugcaccagccc

SEQ ID NO: 1793726 - RNA, 21 nt, Human
gccuggccagaugcaccagcc

SEQ ID NO: 1793727 - RNA, 20 nt, Human
gccuggccagaugcaccagc

SEQ ID NO: 1793728 - RNA, 22 nt, Human
gccuggcagccgugccuucagc

SEQ ID NO: 1793729 - RNA, 18 nt, Human
gccuggcacagggcagug

SEQ ID NO: 1793730 - RNA, 19 nt, Human
gccuggcacagggcagugg

SEQ ID NO: 1793731 - RNA, 12 nt, Human
gccuggcagccg

SEQ ID NO: 1793732 - RNA, 20 nt, Human
gccuggcagccgugccuuca

SEQ ID NO: 1793733 - RNA, 21 nt, Human
gccuggcagccgugccuucag

SEQ ID NO: 1793734 - RNA, 13 nt, Human
gccuggccccuca

SEQ ID NO: 1793735 - RNA, 14 nt, Human
gccuggccccucag

SEQ ID NO: 1793736 - RNA, 18 nt, Human
gcgcaggcuggcccugcc

SEQ ID NO: 1793737 - RNA, 19 nt, Human
gcgcaggcuggcccugccc

SEQ ID NO: 1793738 - RNA, 17 nt, Human
gcgcaggcuggcccugc

SEQ ID NO: 1793739 - RNA, 20 nt, Human
gcgcaggcuggcccugcccu

SEQ ID NO: 1793740 - RNA, 21 nt, Human
gcgcaggcuggcccugcccug

SEQ ID NO: 1793741 - RNA, 22 nt, Human
gcgcaggcuggcccugcccugg

SEQ ID NO: 1793742 - RNA, 12 nt, Human
gcgacaaugcaa

SEQ ID NO: 1793743 - RNA, 13 nt, Human
gcgacaaugcaaa

SEQ ID NO: 1793744 - RNA, 20 nt, Human
gcgacaaugcaaaccaucau

SEQ ID NO: 1793745 - RNA, 21 nt, Human
gcgacaaugcaaaccaucauu

SEQ ID NO: 1793746 - RNA, 16 nt, Human
gccuuacacaaugguu

SEQ ID NO: 1793747 - RNA, 15 nt, Human
gccuuacacaauggu

SEQ ID NO: 1793748 - RNA, 17 nt, Human
gccugucuuaauuuucu

SEQ ID NO: 1793749 - RNA, 16 nt, Human
gccugucuuaauuuuc

SEQ ID NO: 1793750 - RNA, 14 nt, Human
gcgguccacccagg

SEQ ID NO: 1793751 - RNA, 13 nt, Human
gcgguccacccag

SEQ ID NO: 1793752 - RNA, 19 nt, Human
gcggugagaggggaacaga

SEQ ID NO: 1793753 - RNA, 17 nt, Human
gcggggacagcuccuuc

SEQ ID NO: 1793754 - RNA, 15 nt, Human
gcggggacagcuccu

SEQ ID NO: 1793755 - RNA, 18 nt, Human
gcggggacagcuccuucu

SEQ ID NO: 1793756 - RNA, 14 nt, Human
gcggggacagcucc

SEQ ID NO: 1793757 - RNA, 19 nt, Human
gcggagacggagucccacc

SEQ ID NO: 1793758 - RNA, 16 nt, Human
gcggagaaaggaaggg

SEQ ID NO: 1793759 - RNA, 18 nt, Human
gcgcugccccuggcagcc

SEQ ID NO: 1793760 - RNA, 21 nt, Human
gcgcugccccuggcagccccu

SEQ ID NO: 1793761 - RNA, 23 nt, Human
gcgcccaguuggguggaugccug

SEQ ID NO: 1793762 - RNA, 13 nt, Human
gcgccccuucccc

SEQ ID NO: 1793763 - RNA, 21 nt, Human
gcgccuuaaggauguucuagc

SEQ ID NO: 1793764 - RNA, 15 nt, Human
gcuggaccuugaacu

SEQ ID NO: 1793765 - RNA, 16 nt, Human
gcuggaccuugaacug

SEQ ID NO: 1793766 - RNA, 14 nt, Human
gcuggcccugcccu

SEQ ID NO: 1793767 - RNA, 15 nt, Human
gcuggcccugcccug

SEQ ID NO: 1793768 - RNA, 16 nt, Human
gcuggcccugcccugg

SEQ ID NO: 1793769 - RNA, 19 nt, Human
gcuggcccuggcucccaca

SEQ ID NO: 1793770 - RNA, 23 nt, Human
gcuggaaugauuucagcucacug

SEQ ID NO: 1793771 - RNA, 22 nt, Human
gcugcuuuugucuaugggacuc

SEQ ID NO: 1793772 - RNA, 21 nt, Human
gcugcgguccacccaggagcc

SEQ ID NO: 1793773 - RNA, 16 nt, Human
gcugcgguccacccag

SEQ ID NO: 1793774 - RNA, 22 nt, Human
gcugcgguccacccaggagccc

SEQ ID NO: 1793775 - RNA, 15 nt, Human
gcugcgguccaccca

SEQ ID NO: 1793776 - RNA, 14 nt, Human
gcugcgguccaccc

SEQ ID NO: 1793777 - RNA, 19 nt, Human
gcugccuguucagcuccag

SEQ ID NO: 1793778 - RNA, 18 nt, Human
gcugccuguucagcucca

SEQ ID NO: 1793779 - RNA, 12 nt, Human
gcugcccuggug

SEQ ID NO: 1793780 - RNA, 13 nt, Human
gcugcccuggugc

SEQ ID NO: 1793781 - RNA, 14 nt, Human
gcugcccuggugcu

SEQ ID NO: 1793782 - RNA, 15 nt, Human
gcugcccuggugcug

SEQ ID NO: 1793783 - RNA, 22 nt, Human
gcugccuguucagcuccagcuc

SEQ ID NO: 1793784 - RNA, 20 nt, Human
gcugccuguucagcuccagc

SEQ ID NO: 1793785 - RNA, 20 nt, Human
gcugccuuagaaccuuucuu

SEQ ID NO: 1793786 - RNA, 17 nt, Human
gcugcccuggugcugcc

SEQ ID NO: 1793787 - RNA, 15 nt, Human
gcugccuuagaaccu

SEQ ID NO: 1793788 - RNA, 16 nt, Human
gcugcccugcccaccu

SEQ ID NO: 1793789 - RNA, 18 nt, Human
gcugcccugcccaccugg

SEQ ID NO: 1793790 - RNA, 20 nt, Human
gcugcccugcccaccuggcc

SEQ ID NO: 1793791 - RNA, 21 nt, Human
gcugcccugcccaccuggccu

SEQ ID NO: 1793792 - RNA, 22 nt, Human
gcugcccugcccaccuggccuc

SEQ ID NO: 1793793 - RNA, 23 nt, Human
gcugcccugcccaccuggccucu

SEQ ID NO: 1793794 - RNA, 24 nt, Human
gcugcccugcccaccuggccucug

SEQ ID NO: 1793795 - RNA, 13 nt, Human
gcugcccugccca

SEQ ID NO: 1793796 - RNA, 14 nt, Human
gcugcccugcccac

SEQ ID NO: 1793797 - RNA, 12 nt, Human
gcugcccugccc

SEQ ID NO: 1793798 - RNA, 23 nt, Human
gcugcaaaggguaucaggugcug

SEQ ID NO: 1793799 - RNA, 22 nt, Human
gcugcaaaggguaucaggugcu

SEQ ID NO: 1793800 - RNA, 21 nt, Human
gcugauuaaaccaaggcuaga

SEQ ID NO: 1793801 - RNA, 19 nt, Human
gcugcauuuaaaagauaca

SEQ ID NO: 1793802 - RNA, 18 nt, Human
gcugcauuuaaaagauac

SEQ ID NO: 1793803 - RNA, 17 nt, Human
gcugcaguugccaguca

SEQ ID NO: 1793804 - RNA, 13 nt, Human
gcugcaguugcca

SEQ ID NO: 1793805 - RNA, 14 nt, Human
gcugcaguugccag

SEQ ID NO: 1793806 - RNA, 15 nt, Human
gcugccacacuucag

SEQ ID NO: 1793807 - RNA, 17 nt, Human
gcugccacacuucaggc

SEQ ID NO: 1793808 - RNA, 18 nt, Human
gcugccacacuucaggcu

SEQ ID NO: 1793809 - RNA, 21 nt, Human
gcugccacacuucaggcucuu

SEQ ID NO: 1793810 - RNA, 22 nt, Human
gcugccacacuucaggcucuuc

SEQ ID NO: 1793811 - RNA, 23 nt, Human
gcugccacacuucaggcucuucu

SEQ ID NO: 1793812 - RNA, 12 nt, Human
gcugccaccugc

SEQ ID NO: 1793813 - RNA, 13 nt, Human
gcugccaccugcc

SEQ ID NO: 1793814 - RNA, 19 nt, Human
gcugacagacacaggcccg

SEQ ID NO: 1793815 - RNA, 18 nt, Human
gcugacagacacaggccc

SEQ ID NO: 1793816 - RNA, 17 nt, Human
gcugacagacacaggcc

SEQ ID NO: 1793817 - RNA, 20 nt, Human
gcugacagacacaggcccgg

SEQ ID NO: 1793818 - RNA, 22 nt, Human
gcugacuguuuucucuugagag

SEQ ID NO: 1793819 - RNA, 19 nt, Human
gcucuuggcagguacucag

SEQ ID NO: 1793820 - RNA, 19 nt, Human
gcucuugaugccuggcggg

SEQ ID NO: 1793821 - RNA, 14 nt, Human
gcucuugaacuccu

SEQ ID NO: 1793822 - RNA, 16 nt, Human
gcucuugaacuccuga

SEQ ID NO: 1793823 - RNA, 19 nt, Human
gcucuugaacuccugaccu

SEQ ID NO: 1793824 - RNA, 21 nt, Human
gcucuugaacuccugaccuca

SEQ ID NO: 1793825 - RNA, 21 nt, Human
gcucucaggccagcugcuugg

SEQ ID NO: 1793826 - RNA, 20 nt, Human
gcuucaguggcagcugcuuu

SEQ ID NO: 1793827 - RNA, 13 nt, Human
gcuuaucucaggg

SEQ ID NO: 1793828 - RNA, 19 nt, Human
gcuucaguggcagcugcuu

SEQ ID NO: 1793829 - RNA, 22 nt, Human
gcuucucacugccaugccagcu

SEQ ID NO: 1793830 - RNA, 18 nt, Human
gcuucauuuccugugucu

SEQ ID NO: 1793831 - RNA, 17 nt, Human
gcuucuguugcugccuc

SEQ ID NO: 1793832 - RNA, 18 nt, Human
gcuucuguugcugccuca

SEQ ID NO: 1793833 - RNA, 19 nt, Human
gcuucuguugcugccucau

SEQ ID NO: 1793834 - RNA, 18 nt, Human
gcuuugggcugcccuggu

SEQ ID NO: 1793835 - RNA, 19 nt, Human
gcuuugggcugcccuggug

SEQ ID NO: 1793836 - RNA, 13 nt, Human
gcuuuuaugugaa

SEQ ID NO: 1793837 - RNA, 15 nt, Human
gcuuuuaugugaaac

SEQ ID NO: 1793838 - RNA, 14 nt, Human
gcuuguuggauuuu

SEQ ID NO: 1793839 - RNA, 15 nt, Human
gcuggugucaccuga

SEQ ID NO: 1793840 - RNA, 14 nt, Human
gcuggugucaccug

SEQ ID NO: 1793841 - RNA, 13 nt, Human
gcugucaucucag

SEQ ID NO: 1793842 - RNA, 17 nt, Human
gcugucagccauuccug

SEQ ID NO: 1793843 - RNA, 23 nt, Human
gcugucccuuacgugaguccugg

SEQ ID NO: 1793844 - RNA, 16 nt, Human
gcugucccuuuuccuu

SEQ ID NO: 1793845 - RNA, 23 nt, Human
gcuguuagggguuauugguguaa

SEQ ID NO: 1793846 - RNA, 16 nt, Human
gcuguguggcagucug

SEQ ID NO: 1793847 - RNA, 15 nt, Human
gcugugucucccuuc

SEQ ID NO: 1793848 - RNA, 14 nt, Human
gcuggucccacuca

SEQ ID NO: 1793849 - RNA, 19 nt, Human
gcuggucucaaacuccuga

SEQ ID NO: 1793850 - RNA, 20 nt, Human
gcuggucucaaacuccugac

SEQ ID NO: 1793851 - RNA, 19 nt, Human
gcuggucucgaacuccuga

SEQ ID NO: 1793852 - RNA, 22 nt, Human
gcuggucucgaacuccugaccu

SEQ ID NO: 1793853 - RNA, 23 nt, Human
gcuggucucgaacuccugaccuu

SEQ ID NO: 1793854 - RNA, 18 nt, Human
gcugggggccucagugcc

SEQ ID NO: 1793855 - RNA, 15 nt, Human
gcugggggccucagu

SEQ ID NO: 1793856 - RNA, 14 nt, Human
gcugggggccucag

SEQ ID NO: 1793857 - RNA, 20 nt, Human
gcugggcuucaguggcagcu

SEQ ID NO: 1793858 - RNA, 22 nt, Human
gcugggcuucaguggcagcugc

SEQ ID NO: 1793859 - RNA, 21 nt, Human
gcugggcuucaguggcagcug

SEQ ID NO: 1793860 - RNA, 19 nt, Human
gcugggaugauuggagggg

SEQ ID NO: 1793861 - RNA, 21 nt, Human
gcugggcucccuucccaccuc

SEQ ID NO: 1793862 - RNA, 13 nt, Human
gcuggccuggccc

SEQ ID NO: 1793863 - RNA, 12 nt, Human
gcuggccuggcc

SEQ ID NO: 1793864 - RNA, 14 nt, Human
gcuggccuggcccc

SEQ ID NO: 1793865 - RNA, 15 nt, Human
gcuggccuggccccu

SEQ ID NO: 1793866 - RNA, 13 nt, Human
ggcuuuucacugc

SEQ ID NO: 1793867 - RNA, 21 nt, Human
gggaauguuugccucugccuc

SEQ ID NO: 1793868 - RNA, 19 nt, Human
gggaauguuugccucugcc

SEQ ID NO: 1793869 - RNA, 14 nt, Human
gggacacccuguga

SEQ ID NO: 1793870 - RNA, 23 nt, Human
gggacucaaugcacugacauugu

SEQ ID NO: 1793871 - RNA, 15 nt, Human
gggacugagaaauuu

SEQ ID NO: 1793872 - RNA, 21 nt, Human
gggacugaggggaggggagca

SEQ ID NO: 1793873 - RNA, 23 nt, Human
gggacugccagucccccugcccc

SEQ ID NO: 1793874 - RNA, 19 nt, Human
gggacucaaugcacugaca

SEQ ID NO: 1793875 - RNA, 17 nt, Human
gggacucaaugcacuga

SEQ ID NO: 1793876 - RNA, 16 nt, Human
gggaccccgagccugg

SEQ ID NO: 1793877 - RNA, 22 nt, Human
gggaggauguucugggacacag

SEQ ID NO: 1793878 - RNA, 21 nt, Human
gggaggauugcuugagcucag

SEQ ID NO: 1793879 - RNA, 23 nt, Human
gggaggaucucuugagccuggga

SEQ ID NO: 1793880 - RNA, 20 nt, Human
gggaggacgcucucuggccu

SEQ ID NO: 1793881 - RNA, 17 nt, Human
gggaggacgcucucugg

SEQ ID NO: 1793882 - RNA, 17 nt, Human
gggagugacagaggcag

SEQ ID NO: 1793883 - RNA, 21 nt, Human
gggagugaguugauagcacag

SEQ ID NO: 1793884 - RNA, 23 nt, Human
gggaggauugcuugagcucagga

SEQ ID NO: 1793885 - RNA, 20 nt, Human
gggaggugggauccuccagg

SEQ ID NO: 1793886 - RNA, 22 nt, Human
gggagcugccuguucagcucca

SEQ ID NO: 1793887 - RNA, 21 nt, Human
gggagcugccuguucagcucc

SEQ ID NO: 1793888 - RNA, 13 nt, Human
gggagcugccugu

SEQ ID NO: 1793889 - RNA, 12 nt, Human
gggagcucugca

SEQ ID NO: 1793890 - RNA, 21 nt, Human
gggagccugaucaccugcccu

SEQ ID NO: 1793891 - RNA, 15 nt, Human
ggcuuaaaacaacac

SEQ ID NO: 1793892 - RNA, 20 nt, Human
ggcuguuggcugggggccuc

SEQ ID NO: 1793893 - RNA, 16 nt, Human
ggcuguuggcuggggg

SEQ ID NO: 1793894 - RNA, 15 nt, Human
ggcuguuggcugggg

SEQ ID NO: 1793895 - RNA, 14 nt, Human
ggcuguuggcuggg

SEQ ID NO: 1793896 - RNA, 17 nt, Human
ggcugucuguuguauuc

SEQ ID NO: 1793897 - RNA, 13 nt, Human
ggcugugccucug

SEQ ID NO: 1793898 - RNA, 16 nt, Human
ggcugugccucugccu

SEQ ID NO: 1793899 - RNA, 11 nt, Human
ggcuugcugcc

SEQ ID NO: 1793900 - RNA, 17 nt, Human
ggcuuggggaccagagc

SEQ ID NO: 1793901 - RNA, 18 nt, Human
ggcuuggggaccagagcu

SEQ ID NO: 1793902 - RNA, 19 nt, Human
ggcuuggggaccagagcug

SEQ ID NO: 1793903 - RNA, 14 nt, Human
ggcuuagucacuga

SEQ ID NO: 1793904 - RNA, 15 nt, Human
ggcuuagucacugag

SEQ ID NO: 1793905 - RNA, 20 nt, Human
ggcuucacggaagagccuug

SEQ ID NO: 1793906 - RNA, 21 nt, Human
ggcuucacggaagagccuugc

SEQ ID NO: 1793907 - RNA, 12 nt, Human
ggcuucacagau

SEQ ID NO: 1793908 - RNA, 21 nt, Human
ggcugcuucaaggauccugag

SEQ ID NO: 1793909 - RNA, 20 nt, Human
ggcugcuucaaggauccuga

SEQ ID NO: 1793910 - RNA, 23 nt, Human
ggcucuggagcccacuguacuug

SEQ ID NO: 1793911 - RNA, 15 nt, Human
ggcugcuucaaggau

SEQ ID NO: 1793912 - RNA, 19 nt, Human
ggcugcuucaaggauccug

SEQ ID NO: 1793913 - RNA, 14 nt, Human
ggcugggggccuca

SEQ ID NO: 1793914 - RNA, 16 nt, Human
ggcugggggaagaagc

SEQ ID NO: 1793915 - RNA, 22 nt, Human
ggcugggcuucaguggcagcug

SEQ ID NO: 1793916 - RNA, 21 nt, Human
ggcugggcuucaguggcagcu

SEQ ID NO: 1793917 - RNA, 11 nt, Human
ggcugggcuuc

SEQ ID NO: 1793918 - RNA, 20 nt, Human
ggcugggcucccuucccacc

SEQ ID NO: 1793919 - RNA, 21 nt, Human
ggcugggcucccuucccaccu

SEQ ID NO: 1793920 - RNA, 15 nt, Human
ggcugggagcucugc

SEQ ID NO: 1793921 - RNA, 9 nt, Human
ggcuccaga

SEQ ID NO: 1793922 - RNA, 16 nt, Human
ggcuccacuuggucug

SEQ ID NO: 1793923 - RNA, 14 nt, Human
ggcuaugcauuuga

SEQ ID NO: 1793924 - RNA, 13 nt, Human
ggcuaugcauuug

SEQ ID NO: 1793925 - RNA, 12 nt, Human
ggcuaugcauuu

SEQ ID NO: 1793926 - RNA, 13 nt, Human
ggcuccaggcucc

SEQ ID NO: 1793927 - RNA, 12 nt, Human
ggcuccaggcuc

SEQ ID NO: 1793928 - RNA, 18 nt, Human
ggcuccaggagcagccac

SEQ ID NO: 1793929 - RNA, 17 nt, Human
ggcuccaggagcagcca

SEQ ID NO: 1793930 - RNA, 10 nt, Human
ggcuccagac

SEQ ID NO: 1793931 - RNA, 14 nt, Human
ggcuccaggagcag

SEQ ID NO: 1793932 - RNA, 16 nt, Human
ggcuccaggagcagcc

SEQ ID NO: 1793933 - RNA, 17 nt, Human
ggcgcugccccuggcag

SEQ ID NO: 1793934 - RNA, 11 nt, Human
ggcgcugcccc

SEQ ID NO: 1793935 - RNA, 15 nt, Human
ggcgcgguggcucac

SEQ ID NO: 1793936 - RNA, 20 nt, Human
ggcuaguaucaaaagaaaga

SEQ ID NO: 1793937 - RNA, 14 nt, Human
ggcuccaggcuccu

SEQ ID NO: 1793938 - RNA, 15 nt, Human
ggcuccaggcuccuu

SEQ ID NO: 1793939 - RNA, 15 nt, Human
ggcucucaggccagc

SEQ ID NO: 1793940 - RNA, 16 nt, Human
ggcucucaggccagcu

SEQ ID NO: 1793941 - RNA, 17 nt, Human
ggcucucaggccagcug

SEQ ID NO: 1793942 - RNA, 18 nt, Human
ggcucucaggccagcugc

SEQ ID NO: 1793943 - RNA, 19 nt, Human
ggcucucaggccagcugcu

SEQ ID NO: 1793944 - RNA, 20 nt, Human
ggcucucaggccagcugcuu

SEQ ID NO: 1793945 - RNA, 17 nt, Human
ggcucuggagcccacug

SEQ ID NO: 1793946 - RNA, 19 nt, Human
ggcucuggagcccacugua

SEQ ID NO: 1793947 - RNA, 16 nt, Human
ggcucuggagcccacu

SEQ ID NO: 1793948 - RNA, 16 nt, Human
ggcucugccucccauc

SEQ ID NO: 1793949 - RNA, 14 nt, Human
ggcucugcccuugg

SEQ ID NO: 1793950 - RNA, 15 nt, Human
ggcucugcccuuggu

SEQ ID NO: 1793951 - RNA, 13 nt, Human
ggcucugccuccc

SEQ ID NO: 1793952 - RNA, 15 nt, Human
ggcucugccucccau

SEQ ID NO: 1793953 - RNA, 12 nt, Human
ggcucugcccuu

SEQ ID NO: 1793954 - RNA, 11 nt, Human
ggccugggccc

SEQ ID NO: 1793955 - RNA, 23 nt, Human
ggccugggggcugggcagaggaa

SEQ ID NO: 1793956 - RNA, 15 nt, Human
ggccuggccugagcu

SEQ ID NO: 1793957 - RNA, 16 nt, Human
ggccuggccugagcug

SEQ ID NO: 1793958 - RNA, 23 nt, Human
ggcgcagcauauucaggaagcuc

SEQ ID NO: 1793959 - RNA, 24 nt, Human
ggcgcagcauauucaggaagcuca

SEQ ID NO: 1793960 - RNA, 12 nt, Human
ggccugagcugg

SEQ ID NO: 1793961 - RNA, 13 nt, Human
ggccuggccccuc

SEQ ID NO: 1793962 - RNA, 22 nt, Human
ggccucugcacuccccugcugg

SEQ ID NO: 1793963 - RNA, 18 nt, Human
ggccucugcacuccccug

SEQ ID NO: 1793964 - RNA, 19 nt, Human
ggccucugcacuccccugc

SEQ ID NO: 1793965 - RNA, 14 nt, Human
ggccuggccccuca

SEQ ID NO: 1793966 - RNA, 15 nt, Human
ggccuggccccucag

SEQ ID NO: 1793967 - RNA, 17 nt, Human
ggccuggccccucaggg

SEQ ID NO: 1793968 - RNA, 18 nt, Human
ggccuggccccucagggu

SEQ ID NO: 1793969 - RNA, 23 nt, Human
ggccuggccccucagggucccug

SEQ ID NO: 1793970 - RNA, 10 nt, Human
ggccuggccu

SEQ ID NO: 1793971 - RNA, 13 nt, Human
ggccuggccugag

SEQ ID NO: 1793972 - RNA, 14 nt, Human
ggccuggccugagc

SEQ ID NO: 1793973 - RNA, 14 nt, Human
ggccuccugugugu

SEQ ID NO: 1793974 - RNA, 23 nt, Human
ggccucaagugauucuccugccu

SEQ ID NO: 1793975 - RNA, 22 nt, Human
ggccucaagugauucuccugcc

SEQ ID NO: 1793976 - RNA, 14 nt, Human
ggccucaagugauu

SEQ ID NO: 1793977 - RNA, 22 nt, Human
ggccuagcauacguacacauuu

SEQ ID NO: 1793978 - RNA, 20 nt, Human
ggccuagcauacguacacau

SEQ ID NO: 1793979 - RNA, 20 nt, Human
ggcccagagggccugcaagg

SEQ ID NO: 1793980 - RNA, 17 nt, Human
ggcccagagggccugca

SEQ ID NO: 1793981 - RNA, 19 nt, Human
ggcccagagggccugcaag

SEQ ID NO: 1793982 - RNA, 14 nt, Human
ggcccagagggccu

SEQ ID NO: 1793983 - RNA, 22 nt, Human
ggccgggaccccgagccuggcu

SEQ ID NO: 1793984 - RNA, 23 nt, Human
ggccgggaccccgagccuggcuc

SEQ ID NO: 1793985 - RNA, 15 nt, Human
ggccgggagccugau

SEQ ID NO: 1793986 - RNA, 17 nt, Human
ggcaagcaccuccugcc

SEQ ID NO: 1793987 - RNA, 21 nt, Human
ggauucuuccucccucccucu

SEQ ID NO: 1793988 - RNA, 19 nt, Human
ggcaagcaccuccugccuc

SEQ ID NO: 1793989 - RNA, 18 nt, Human
ggcaagcaccuccugccu

SEQ ID NO: 1793990 - RNA, 17 nt, Human
ggcaccagcagccugga

SEQ ID NO: 1793991 - RNA, 21 nt, Human
ggcagagguugcagugagccg

SEQ ID NO: 1793992 - RNA, 22 nt, Human
ggcagagcagagaccaucccug

SEQ ID NO: 1793993 - RNA, 20 nt, Human
ggcacucagaagacacugau

SEQ ID NO: 1793994 - RNA, 19 nt, Human
ggcacucagaagacacuga

SEQ ID NO: 1793995 - RNA, 18 nt, Human
ggcacucagaagacacug

SEQ ID NO: 1793996 - RNA, 20 nt, Human
ggcacccggccccugcuggu

SEQ ID NO: 1793997 - RNA, 19 nt, Human
ggcacccggccccugcugg

SEQ ID NO: 1793998 - RNA, 18 nt, Human
ggcacccggccccugcug

SEQ ID NO: 1793999 - RNA, 20 nt, Human
ggcacccaccaucaugucug

SEQ ID NO: 1794000 - RNA, 23 nt, Human
ggagucccaccuuggcugcaggg

SEQ ID NO: 1794001 - RNA, 16 nt, Human
ggaugaucuaggaaga

SEQ ID NO: 1794002 - RNA, 18 nt, Human
ggaugaucuaggaagacu

SEQ ID NO: 1794003 - RNA, 22 nt, Human
ggaugaucuaggaagacuuugg

SEQ ID NO: 1794004 - RNA, 17 nt, Human
ggaugccugguggcagc

SEQ ID NO: 1794005 - RNA, 13 nt, Human
ggaugccuggugg

SEQ ID NO: 1794006 - RNA, 17 nt, Human
ggaugccccgucccccu

SEQ ID NO: 1794007 - RNA, 19 nt, Human
ggaugcccaaagaugcagc

SEQ ID NO: 1794008 - RNA, 18 nt, Human
ggaugaugacuauggaaa

SEQ ID NO: 1794009 - RNA, 18 nt, Human
ggaugcccaaagaugcag

SEQ ID NO: 1794010 - RNA, 21 nt, Human
ggaugccugguggcagcugcg

SEQ ID NO: 1794011 - RNA, 20 nt, Human
ggaugccugguggcagcugc

SEQ ID NO: 1794012 - RNA, 19 nt, Human
ggaugccugguggcagcug

SEQ ID NO: 1794013 - RNA, 18 nt, Human
ggaugccugguggcagcu

SEQ ID NO: 1794014 - RNA, 12 nt, Human
ggauuauauuau

SEQ ID NO: 1794015 - RNA, 21 nt, Human
ggcagcugcgguccacccagg

SEQ ID NO: 1794016 - RNA, 17 nt, Human
ggcagaguugaagacag

SEQ ID NO: 1794017 - RNA, 19 nt, Human
ggcagaguugaagacagag

SEQ ID NO: 1794018 - RNA, 21 nt, Human
ggcagaguugaagacagagcu

SEQ ID NO: 1794019 - RNA, 24 nt, Human
ggcagcugcgguccacccaggagc

SEQ ID NO: 1794020 - RNA, 23 nt, Human
ggcagcugcgguccacccaggag

SEQ ID NO: 1794021 - RNA, 12 nt, Human
ggcaggguccua

SEQ ID NO: 1794022 - RNA, 18 nt, Human
ggcagggucucacucugu

SEQ ID NO: 1794023 - RNA, 17 nt, Human
ggcagggucucacucug

SEQ ID NO: 1794024 - RNA, 17 nt, Human
ggcagguuggugggggc

SEQ ID NO: 1794025 - RNA, 18 nt, Human
ggcaugugaugagaggaa

SEQ ID NO: 1794026 - RNA, 23 nt, Human
ggcaugugaugagaggaaaucac

SEQ ID NO: 1794027 - RNA, 22 nt, Human
ggcaugacacgaauauugcuga

SEQ ID NO: 1794028 - RNA, 20 nt, Human
ggcauguucucugaggacac

SEQ ID NO: 1794029 - RNA, 22 nt, Human
ggccacagaaaauucuucucca

SEQ ID NO: 1794030 - RNA, 20 nt, Human
ggccacugugaagagaacca

SEQ ID NO: 1794031 - RNA, 11 nt, Human
ggccaggagcc

SEQ ID NO: 1794032 - RNA, 13 nt, Human
ggccaggagccuc

SEQ ID NO: 1794033 - RNA, 14 nt, Human
ggccaggcccucug

SEQ ID NO: 1794034 - RNA, 17 nt, Human
ggccaggcccucugccc

SEQ ID NO: 1794035 - RNA, 15 nt, Human
ggccaggcccucugc

SEQ ID NO: 1794036 - RNA, 16 nt, Human
ggccaggcccucugcc

SEQ ID NO: 1794037 - RNA, 21 nt, Human
ggaggauguucugggacacag

SEQ ID NO: 1794038 - RNA, 18 nt, Human
ggaggauguucugggaca

SEQ ID NO: 1794039 - RNA, 16 nt, Human
ggaggacgcucucugg

SEQ ID NO: 1794040 - RNA, 17 nt, Human
ggaggcaggaguuucgu

SEQ ID NO: 1794041 - RNA, 17 nt, Human
ggagggagggcuccaga

SEQ ID NO: 1794042 - RNA, 13 nt, Human
ggagggagggcuc

SEQ ID NO: 1794043 - RNA, 16 nt, Human
ggagggagggcuccag

SEQ ID NO: 1794044 - RNA, 13 nt, Human
ggagggccugggc

SEQ ID NO: 1794045 - RNA, 19 nt, Human
ggaggggagcaugggaagu

SEQ ID NO: 1794046 - RNA, 13 nt, Human
ggaggggccuggc

SEQ ID NO: 1794047 - RNA, 22 nt, Human
ggagucccaccuuggcugcagg

SEQ ID NO: 1794048 - RNA, 14 nt, Human
ggaggggccuggca

SEQ ID NO: 1794049 - RNA, 18 nt, Human
ggaggggccuggcagccg

SEQ ID NO: 1794050 - RNA, 21 nt, Human
ggaggggccuggcagccgugc

SEQ ID NO: 1794051 - RNA, 16 nt, Human
ggagcccugggaggcu

SEQ ID NO: 1794052 - RNA, 19 nt, Human
ggagcccugggaggcucug

SEQ ID NO: 1794053 - RNA, 14 nt, Human
ggagccuccugccc

SEQ ID NO: 1794054 - RNA, 20 nt, Human
ggagcccugggaggcucugg

SEQ ID NO: 1794055 - RNA, 15 nt, Human
ggagccuccugcccu

SEQ ID NO: 1794056 - RNA, 18 nt, Human
ggacugagaaauuuauaa

SEQ ID NO: 1794057 - RNA, 19 nt, Human
ggacgcucucuggccuucg

SEQ ID NO: 1794058 - RNA, 16 nt, Human
ggacgcucucuggccu

SEQ ID NO: 1794059 - RNA, 14 nt, Human
ggacugagaaauuu

SEQ ID NO: 1794060 - RNA, 18 nt, Human
ggaccuugaacuggguac

SEQ ID NO: 1794061 - RNA, 19 nt, Human
ggaccagagcugccaccug

SEQ ID NO: 1794062 - RNA, 14 nt, Human
ggaccagagcugcc

SEQ ID NO: 1794063 - RNA, 17 nt, Human
ggacagcuccuucuguc

SEQ ID NO: 1794064 - RNA, 16 nt, Human
ggacagcuccuucugu

SEQ ID NO: 1794065 - RNA, 15 nt, Human
ggacagcuccuucug

SEQ ID NO: 1794066 - RNA, 11 nt, Human
ggacagcuccu

SEQ ID NO: 1794067 - RNA, 15 nt, Human
ggacagccccuccuc

SEQ ID NO: 1794068 - RNA, 16 nt, Human
ggacagccccuccucc

SEQ ID NO: 1794069 - RNA, 20 nt, Human
ggacagaggggguggccucc

SEQ ID NO: 1794070 - RNA, 12 nt, Human
gcuuuucacugc

SEQ ID NO: 1794071 - RNA, 19 nt, Human
gcuuuuaugugaaacaugu

SEQ ID NO: 1794072 - RNA, 20 nt, Human
gcuuuuaugugaaacauguu

SEQ ID NO: 1794073 - RNA, 21 nt, Human
gcuuuuaugugaaacauguuu

SEQ ID NO: 1794074 - RNA, 15 nt, Human
ggacagaagcagcuc

SEQ ID NO: 1794075 - RNA, 16 nt, Human
ggacagaagcagcucu

SEQ ID NO: 1794076 - RNA, 17 nt, Human
ggacagaagcagcucuu

SEQ ID NO: 1794077 - RNA, 14 nt, Human
ggacagaagcagcu

SEQ ID NO: 1794078 - RNA, 16 nt, Human
ggacagaggggguggc

SEQ ID NO: 1794079 - RNA, 20 nt, Human
gccacagagaaaguacuucu

SEQ ID NO: 1794080 - RNA, 14 nt, Human
gccacagagaaagu

SEQ ID NO: 1794081 - RNA, 13 nt, Human
gccacagagaaag

SEQ ID NO: 1794082 - RNA, 23 nt, Human
gccacacuucaggcucuucuccu

SEQ ID NO: 1794083 - RNA, 20 nt, Human
gccacacuucaggcucuucu

SEQ ID NO: 1794084 - RNA, 22 nt, Human
gccacacuucaggcucuucucc

SEQ ID NO: 1794085 - RNA, 23 nt, Human
gccacagagaaaguacuucucca

SEQ ID NO: 1794086 - RNA, 16 nt, Human
gccacaagacccuugu

SEQ ID NO: 1794087 - RNA, 22 nt, Human
gccacaagacccuugugguccc

SEQ ID NO: 1794088 - RNA, 14 nt, Human
gccaaggugggagg

SEQ ID NO: 1794089 - RNA, 15 nt, Human
gccaaggugggagga

SEQ ID NO: 1794090 - RNA, 23 nt, Human
gccaaggugggaggauugcuuga

SEQ ID NO: 1794091 - RNA, 23 nt, Human
gcauuuggugguuucagaaaugu

SEQ ID NO: 1794092 - RNA, 22 nt, Human
gcauuuggugguuucagaaaug

SEQ ID NO: 1794093 - RNA, 20 nt, Human
gcauuugaggucuguucuuu

SEQ ID NO: 1794094 - RNA, 19 nt, Human
gcauuugaggucuguucuu

SEQ ID NO: 1794095 - RNA, 21 nt, Human
gcauuugaggucuguucuuuc

SEQ ID NO: 1794096 - RNA, 12 nt, Human
gcauuugugaaa

SEQ ID NO: 1794097 - RNA, 21 nt, Human
gccaaggcugggggaagaagc

SEQ ID NO: 1794098 - RNA, 16 nt, Human
gccaauggagacuguc

SEQ ID NO: 1794099 - RNA, 19 nt, Human
gccaauggagacugucuca

SEQ ID NO: 1794100 - RNA, 21 nt, Human
gccaauggagacugucucaag

SEQ ID NO: 1794101 - RNA, 12 nt, Human
gccaaguucuua

SEQ ID NO: 1794102 - RNA, 20 nt, Human
gccaauaauaauaccucccu

SEQ ID NO: 1794103 - RNA, 20 nt, Human
gccacuauuguuagucucuu

SEQ ID NO: 1794104 - RNA, 20 nt, Human
gccagagacacaagccuucg

SEQ ID NO: 1794105 - RNA, 10 nt, Human
gccagaggag

SEQ ID NO: 1794106 - RNA, 17 nt, Human
gccagagacacaagccu

SEQ ID NO: 1794107 - RNA, 19 nt, Human
gccagagacacaagccuuc

SEQ ID NO: 1794108 - RNA, 16 nt, Human
gccagagacacaagcc

SEQ ID NO: 1794109 - RNA, 18 nt, Human
gccagaugcaccagcccu

SEQ ID NO: 1794110 - RNA, 17 nt, Human
gccagaugcaccagccc

SEQ ID NO: 1794111 - RNA, 16 nt, Human
gccagaugcaccagcc

SEQ ID NO: 1794112 - RNA, 23 nt, Human
gccagagggagugacagaggcag

SEQ ID NO: 1794113 - RNA, 22 nt, Human
gccagagggagugacagaggca

SEQ ID NO: 1794114 - RNA, 21 nt, Human
gccagagggagugacagaggc

SEQ ID NO: 1794115 - RNA, 19 nt, Human
gccagaggagagaggaccc

SEQ ID NO: 1794116 - RNA, 22 nt, Human
gccagaggagagaggacccccu

SEQ ID NO: 1794117 - RNA, 12 nt, Human
gccagaggagag

SEQ ID NO: 1794118 - RNA, 13 nt, Human
gccagaggagaga

SEQ ID NO: 1794119 - RNA, 15 nt, Human
gccagaggagagagg

SEQ ID NO: 1794120 - RNA, 17 nt, Human
gccagaggagagaggac

SEQ ID NO: 1794121 - RNA, 17 nt, Human
gccaccugccuguuggg

SEQ ID NO: 1794122 - RNA, 17 nt, Human
gccaccgcgcccagccu

SEQ ID NO: 1794123 - RNA, 17 nt, Human
gccaccgugccuggcca

SEQ ID NO: 1794124 - RNA, 22 nt, Human
gccaccgugccuggccacgccc

SEQ ID NO: 1794125 - RNA, 17 nt, Human
gccacggccaggccaga

SEQ ID NO: 1794126 - RNA, 18 nt, Human
gccacggccaggccagag

SEQ ID NO: 1794127 - RNA, 20 nt, Human
gccacgcccaacuaauuuuu

SEQ ID NO: 1794128 - RNA, 19 nt, Human
gccacggccaggccagagg

SEQ ID NO: 1794129 - RNA, 11 nt, Human
gccaccugggu

SEQ ID NO: 1794130 - RNA, 22 nt, Human
gccaccugcggugcuaucuccc

SEQ ID NO: 1794131 - RNA, 14 nt, Human
gccaccugcggugc

SEQ ID NO: 1794132 - RNA, 20 nt, Human
gccaccugcggugcuaucuc

SEQ ID NO: 1794133 - RNA, 22 nt, Human
gccaugggacagggaggacgcu

SEQ ID NO: 1794134 - RNA, 23 nt, Human
gccaugggacagggaggacgcuc

SEQ ID NO: 1794135 - RNA, 14 nt, Human
gcccaaccugcucu

SEQ ID NO: 1794136 - RNA, 19 nt, Human
gccaugccagcuuaucuca

SEQ ID NO: 1794137 - RNA, 13 nt, Human
gccaugccagcuu

SEQ ID NO: 1794138 - RNA, 18 nt, Human
gccaugccagcuuaucuc

SEQ ID NO: 1794139 - RNA, 18 nt, Human
gccaugaggaacaaggca

SEQ ID NO: 1794140 - RNA, 20 nt, Human
gccaugaggaacaaggcaag

SEQ ID NO: 1794141 - RNA, 23 nt, Human
gccagggacagaggggguggccu

SEQ ID NO: 1794142 - RNA, 22 nt, Human
gccaggcuggucucgaacuccu

SEQ ID NO: 1794143 - RNA, 13 nt, Human
gccagggacagag

SEQ ID NO: 1794144 - RNA, 16 nt, Human
gccagggacagagggg

SEQ ID NO: 1794145 - RNA, 18 nt, Human
gccagggacagagggggu

SEQ ID NO: 1794146 - RNA, 16 nt, Human
gccagauuucacucuc

SEQ ID NO: 1794147 - RNA, 18 nt, Human
gccagauuucacucuccu

SEQ ID NO: 1794148 - RNA, 21 nt, Human
gccagauuucacucuccuugg

SEQ ID NO: 1794149 - RNA, 22 nt, Human
gccaggcugcucuugaacuccu

SEQ ID NO: 1794150 - RNA, 13 nt, Human
gccaggcuggguc

SEQ ID NO: 1794151 - RNA, 13 nt, Human
gccaggcugcucu

SEQ ID NO: 1794152 - RNA, 14 nt, Human
gccaggcugcucuu

SEQ ID NO: 1794153 - RNA, 17 nt, Human
gccagguuuuuggucug

SEQ ID NO: 1794154 - RNA, 12 nt, Human
gccaguaaaugg

SEQ ID NO: 1794155 - RNA, 21 nt, Human
gccagucaccccggccaccug

SEQ ID NO: 1794156 - RNA, 20 nt, Human
gccagucaccccggccaccu

SEQ ID NO: 1794157 - RNA, 17 nt, Human
gccagucaccccggcca

SEQ ID NO: 1794158 - RNA, 18 nt, Human
gccagucaccccggccac

SEQ ID NO: 1794159 - RNA, 15 nt, Human
gcccaguugggugga

SEQ ID NO: 1794160 - RNA, 20 nt, Human
gcccagucuggaaugcagug

SEQ ID NO: 1794161 - RNA, 19 nt, Human
gcccagucuggaaugcagu

SEQ ID NO: 1794162 - RNA, 23 nt, Human
gcccaggcuuagucacugagaca

SEQ ID NO: 1794163 - RNA, 19 nt, Human
gcccaggcuuagucacuga

SEQ ID NO: 1794164 - RNA, 21 nt, Human
gcccaggcuuagucacugaga

SEQ ID NO: 1794165 - RNA, 20 nt, Human
gcccaggcuggcgugcagug

SEQ ID NO: 1794166 - RNA, 19 nt, Human
gcccaggcuggcgugcagu

SEQ ID NO: 1794167 - RNA, 22 nt, Human
gcccaggcuggcgugcaguggu

SEQ ID NO: 1794168 - RNA, 18 nt, Human
gcccaggaaaggcuccag

SEQ ID NO: 1794169 - RNA, 19 nt, Human
gcccaggaaaggcuccagg

SEQ ID NO: 1794170 - RNA, 20 nt, Human
gcccaggaaaggcuccagga

SEQ ID NO: 1794171 - RNA, 21 nt, Human
gcccaggaaaggcuccaggag

SEQ ID NO: 1794172 - RNA, 21 nt, Human
gcccagcuugaaaccuucacu

SEQ ID NO: 1794173 - RNA, 20 nt, Human
gcccagccccuucugaccca

SEQ ID NO: 1794174 - RNA, 24 nt, Human
gcccagccccuucugacccaugcu

SEQ ID NO: 1794175 - RNA, 13 nt, Human
gcccagccccuuc

SEQ ID NO: 1794176 - RNA, 14 nt, Human
gcccagccccuucu

SEQ ID NO: 1794177 - RNA, 16 nt, Human
gcccagccccuucuga

SEQ ID NO: 1794178 - RNA, 17 nt, Human
gcccagccccuucugac

SEQ ID NO: 1794179 - RNA, 12 nt, Human
gcccagccccuu

SEQ ID NO: 1794180 - RNA, 11 nt, Human
gcccagccccu

SEQ ID NO: 1794181 - RNA, 9 nt, Human
gcccagccc

SEQ ID NO: 1794182 - RNA, 22 nt, Human
gcccagagggccugcaagggag

SEQ ID NO: 1794183 - RNA, 20 nt, Human
gcccagagggccugcaaggg

SEQ ID NO: 1794184 - RNA, 21 nt, Human
gcccagagggccugcaaggga

SEQ ID NO: 1794185 - RNA, 15 nt, Human
gcccagagagggugg

SEQ ID NO: 1794186 - RNA, 21 nt, Human
gcccaaugcacuuuguucugg

SEQ ID NO: 1794187 - RNA, 12 nt, Human
gcccagagggcc

SEQ ID NO: 1794188 - RNA, 14 nt, Human
gcccagagggccug

SEQ ID NO: 1794189 - RNA, 15 nt, Human
gcccagagggccugc

SEQ ID NO: 1794190 - RNA, 18 nt, Human
gcccagagggccugcaag

SEQ ID NO: 1794191 - RNA, 19 nt, Human
gcccagagggccugcaagg

SEQ ID NO: 1794192 - RNA, 15 nt, Human
gcaucucagcccaca

SEQ ID NO: 1794193 - RNA, 20 nt, Human
gcaugaaguaauaugcacac

SEQ ID NO: 1794194 - RNA, 22 nt, Human
gcaugaaguaauaugcacacau

SEQ ID NO: 1794195 - RNA, 21 nt, Human
gcaugaaguaauaugcacaca

SEQ ID NO: 1794196 - RNA, 23 nt, Human
gcaugaaguaauaugcacacauu

SEQ ID NO: 1794197 - RNA, 21 nt, Human
gcaugacacgaauauugcuga

SEQ ID NO: 1794198 - RNA, 22 nt, Human
gcaugacacgaauauugcugau

SEQ ID NO: 1794199 - RNA, 13 nt, Human
gcaucucagccca

SEQ ID NO: 1794200 - RNA, 14 nt, Human
gcaucucagcccac

SEQ ID NO: 1794201 - RNA, 12 nt, Human
gcaucucagccc

SEQ ID NO: 1794202 - RNA, 23 nt, Human
gcaucagugcccuccaggauaga

SEQ ID NO: 1794203 - RNA, 15 nt, Human
gcaucagugcccucc

SEQ ID NO: 1794204 - RNA, 23 nt, Human
gcaucaggccaggcccucugccc

SEQ ID NO: 1794205 - RNA, 18 nt, Human
gcaucaggccaggcccuc

SEQ ID NO: 1794206 - RNA, 12 nt, Human
gcaucaggccag

SEQ ID NO: 1794207 - RNA, 14 nt, Human
gcaugccuggaugg

SEQ ID NO: 1794208 - RNA, 14 nt, Human
gcauguucucugag

SEQ ID NO: 1794209 - RNA, 13 nt, Human
gcauguuacauaa

SEQ ID NO: 1794210 - RNA, 15 nt, Human
gcaugccuggauggg

SEQ ID NO: 1794211 - RNA, 24 nt, Human
gcauuaucuagauacuguaucaug

SEQ ID NO: 1794212 - RNA, 22 nt, Human
gcauuaucuagauacuguauca

SEQ ID NO: 1794213 - RNA, 19 nt, Human
gcauuaucuagauacugua

SEQ ID NO: 1794214 - RNA, 18 nt, Human
gcauuugaggucuguucu

SEQ ID NO: 1794215 - RNA, 22 nt, Human
gcauuccccaggaggccagccu

SEQ ID NO: 1794216 - RNA, 14 nt, Human
gcauuccccaggag

SEQ ID NO: 1794217 - RNA, 15 nt, Human
gcauuccccaggagg

SEQ ID NO: 1794218 - RNA, 16 nt, Human
gcauuccccaggaggc

SEQ ID NO: 1794219 - RNA, 17 nt, Human
gcauuccccaggaggcc

SEQ ID NO: 1794220 - RNA, 18 nt, Human
gcauuccccaggaggcca

SEQ ID NO: 1794221 - RNA, 19 nt, Human
gcauuccccaggaggccag

SEQ ID NO: 1794222 - RNA, 20 nt, Human
gcauuccccaggaggccagc

SEQ ID NO: 1794223 - RNA, 21 nt, Human
gcauuccccaggaggccagcc

SEQ ID NO: 1794224 - RNA, 21 nt, Human
gcaguggugcgaucuggguuc

SEQ ID NO: 1794225 - RNA, 20 nt, Human
gcaguggugcgaucuggguu

SEQ ID NO: 1794226 - RNA, 22 nt, Human
gcaguggugcgaucuggguuca

SEQ ID NO: 1794227 - RNA, 19 nt, Human
gcaguggugguuuucuguu

SEQ ID NO: 1794228 - RNA, 21 nt, Human
gcaguggugguuuucuguucu

SEQ ID NO: 1794229 - RNA, 20 nt, Human
gcaguggugguuuucuguuc

SEQ ID NO: 1794230 - RNA, 19 nt, Human
gcauacguacacauuuuau

SEQ ID NO: 1794231 - RNA, 19 nt, Human
gcaguggugcgaucugggu

SEQ ID NO: 1794232 - RNA, 18 nt, Human
gcaguggugcgaucuggg

SEQ ID NO: 1794233 - RNA, 12 nt, Human
gcagugggagcu

SEQ ID NO: 1794234 - RNA, 11 nt, Human
gcagugggagc

SEQ ID NO: 1794235 - RNA, 21 nt, Human
gcagugggacagggcauggcc

SEQ ID NO: 1794236 - RNA, 16 nt, Human
gcaggucccuaauaaa

SEQ ID NO: 1794237 - RNA, 17 nt, Human
gcaggucccuaauaaag

SEQ ID NO: 1794238 - RNA, 18 nt, Human
gcaggucccuaauaaagc

SEQ ID NO: 1794239 - RNA, 19 nt, Human
gcaggucccuaauaaagcu

SEQ ID NO: 1794240 - RNA, 20 nt, Human
gcaggucccuaauaaagcug

SEQ ID NO: 1794241 - RNA, 21 nt, Human
gcaggucccuaauaaagcugu

SEQ ID NO: 1794242 - RNA, 23 nt, Human
gcaggucccuaauaaagcugugu

SEQ ID NO: 1794243 - RNA, 22 nt, Human
gcaggggaggguagagcggaga

SEQ ID NO: 1794244 - RNA, 16 nt, Human
gcagggucucacucug

SEQ ID NO: 1794245 - RNA, 19 nt, Human
gcaggguccuagaaauucc

SEQ ID NO: 1794246 - RNA, 14 nt, Human
gcaggucccuaaua

SEQ ID NO: 1794247 - RNA, 15 nt, Human
gcaggucccuaauaa

SEQ ID NO: 1794248 - RNA, 18 nt, Human
gcaggcagccaggccaca

SEQ ID NO: 1794249 - RNA, 17 nt, Human
gcaggcagccaggccac

SEQ ID NO: 1794250 - RNA, 19 nt, Human
gcacuguuuuauuuuaauu

SEQ ID NO: 1794251 - RNA, 14 nt, Human
gcacugggcuuggg

SEQ ID NO: 1794252 - RNA, 12 nt, Human
gcacugggcuug

SEQ ID NO: 1794253 - RNA, 22 nt, Human
gcacuauaauguaagcucuacu

SEQ ID NO: 1794254 - RNA, 20 nt, Human
gcacuauaauguaagcucua

SEQ ID NO: 1794255 - RNA, 14 nt, Human
gcacuauaauguaa

SEQ ID NO: 1794256 - RNA, 15 nt, Human
gcacuauaauguaag

SEQ ID NO: 1794257 - RNA, 12 nt, Human
gcacugcuucca

SEQ ID NO: 1794258 - RNA, 13 nt, Human
gcacugcuuccag

SEQ ID NO: 1794259 - RNA, 14 nt, Human
gcacugcuuccagu

SEQ ID NO: 1794260 - RNA, 15 nt, Human
gcacugcuuccagug

SEQ ID NO: 1794261 - RNA, 20 nt, Human
gcacuaaggugugcucugau

SEQ ID NO: 1794262 - RNA, 14 nt, Human
gcacgugugugcac

SEQ ID NO: 1794263 - RNA, 16 nt, Human
gcacccucaggcaggu

SEQ ID NO: 1794264 - RNA, 19 nt, Human
gcacccucaggcagguggg

SEQ ID NO: 1794265 - RNA, 21 nt, Human
gcacagcuucauuuccugugu

SEQ ID NO: 1794266 - RNA, 23 nt, Human
gcacagcuucauuuccugugucu

SEQ ID NO: 1794267 - RNA, 16 nt, Human
gcacagggcaguggga

SEQ ID NO: 1794268 - RNA, 20 nt, Human
gauugugucucuugguccug

SEQ ID NO: 1794269 - RNA, 17 nt, Human
gcaccaucucuccuccu

SEQ ID NO: 1794270 - RNA, 14 nt, Human
gcaccagcagccug

SEQ ID NO: 1794271 - RNA, 13 nt, Human
gcaccagcagccu

SEQ ID NO: 1794272 - RNA, 14 nt, Human
gcaccaucucuccu

SEQ ID NO: 1794273 - RNA, 15 nt, Human
gcaccaucucuccuc

SEQ ID NO: 1794274 - RNA, 16 nt, Human
gcacuugcagacucua

SEQ ID NO: 1794275 - RNA, 14 nt, Human
gcacuugcagacuc

SEQ ID NO: 1794276 - RNA, 22 nt, Human
gcacuucgggaggucgaggcag

SEQ ID NO: 1794277 - RNA, 22 nt, Human
gcagacucuacagaggccaugg

SEQ ID NO: 1794278 - RNA, 19 nt, Human
gcagacucuacagaggcca

SEQ ID NO: 1794279 - RNA, 18 nt, Human
gcagacucuacagaggcc

SEQ ID NO: 1794280 - RNA, 17 nt, Human
gcagacucuacagaggc

SEQ ID NO: 1794281 - RNA, 22 nt, Human
gcagagaccaucccugaaggcc

SEQ ID NO: 1794282 - RNA, 20 nt, Human
gcagagaccaucccugaagg

SEQ ID NO: 1794283 - RNA, 21 nt, Human
gcagagaccaucccugaaggc

SEQ ID NO: 1794284 - RNA, 18 nt, Human
gcagauggagaccccuug

SEQ ID NO: 1794285 - RNA, 18 nt, Human
gcagauguccuugaugcu

SEQ ID NO: 1794286 - RNA, 21 nt, Human
gcagagguccacaacacacag

SEQ ID NO: 1794287 - RNA, 18 nt, Human
gcagagguugcagugagc

SEQ ID NO: 1794288 - RNA, 23 nt, Human
gcagagguugcagugagccgaga

SEQ ID NO: 1794289 - RNA, 15 nt, Human
gcagccucacagucc

SEQ ID NO: 1794290 - RNA, 17 nt, Human
gcagccucacaguccuu

SEQ ID NO: 1794291 - RNA, 19 nt, Human
gcagccucacaguccuuac

SEQ ID NO: 1794292 - RNA, 24 nt, Human
gcagcccugcuuugggcugcccug

SEQ ID NO: 1794293 - RNA, 14 nt, Human
gcagcccugcuuug

SEQ ID NO: 1794294 - RNA, 20 nt, Human
gcagcagggagggcuucugc

SEQ ID NO: 1794295 - RNA, 18 nt, Human
gcagcagggagggcuucu

SEQ ID NO: 1794296 - RNA, 19 nt, Human
gcagcagggagggcuucug

SEQ ID NO: 1794297 - RNA, 18 nt, Human
gcagcucagagagggugg

SEQ ID NO: 1794298 - RNA, 19 nt, Human
gcagcucagagaggguggg

SEQ ID NO: 1794299 - RNA, 16 nt, Human
gcagcucaccucuccc

SEQ ID NO: 1794300 - RNA, 17 nt, Human
gcagcucaccucucccu

SEQ ID NO: 1794301 - RNA, 20 nt, Human
gcagcucaccucucccuugg

SEQ ID NO: 1794302 - RNA, 21 nt, Human
gcagcucaccucucccuugga

SEQ ID NO: 1794303 - RNA, 14 nt, Human
gcagcucagagagg

SEQ ID NO: 1794304 - RNA, 22 nt, Human
gaugggcaacccccagccugcu

SEQ ID NO: 1794305 - RNA, 21 nt, Human
gauggcacuuauaaccaaagc

SEQ ID NO: 1794306 - RNA, 21 nt, Human
gaugccuggcgggguggggug

SEQ ID NO: 1794307 - RNA, 22 nt, Human
gaugagaaagguugaagcacca

SEQ ID NO: 1794308 - RNA, 11 nt, Human
gaugagaaagg

SEQ ID NO: 1794309 - RNA, 14 nt, Human
gaugacuauggaaa

SEQ ID NO: 1794310 - RNA, 16 nt, Human
gaucuuugcagacagg

SEQ ID NO: 1794311 - RNA, 17 nt, Human
gaucuuugcagacaggc

SEQ ID NO: 1794312 - RNA, 15 nt, Human
gaugaaaaaauaaca

SEQ ID NO: 1794313 - RNA, 15 nt, Human
gauccuuuuggaguc

SEQ ID NO: 1794314 - RNA, 17 nt, Human
gauccuuuuggagucag

SEQ ID NO: 1794315 - RNA, 21 nt, Human
gauccucccaccucagccucc

SEQ ID NO: 1794316 - RNA, 20 nt, Human
gauccucccaccucagccuc

SEQ ID NO: 1794317 - RNA, 19 nt, Human
gauccucccaccucagccu

SEQ ID NO: 1794318 - RNA, 12 nt, Human
gauccuccaggu

SEQ ID NO: 1794319 - RNA, 13 nt, Human
gauccugagccag

SEQ ID NO: 1794320 - RNA, 14 nt, Human
gauccugagccaga

SEQ ID NO: 1794321 - RNA, 15 nt, Human
gauccugagccagau

SEQ ID NO: 1794322 - RNA, 19 nt, Human
gauccugagccagauuuca

SEQ ID NO: 1794323 - RNA, 14 nt, Human
gaucacgccacugc

SEQ ID NO: 1794324 - RNA, 13 nt, Human
gaucacgccacug

SEQ ID NO: 1794325 - RNA, 23 nt, Human
gaucaaccccuucgcuccugugu

SEQ ID NO: 1794326 - RNA, 15 nt, Human
gaucacgccacugca

SEQ ID NO: 1794327 - RNA, 18 nt, Human
gauccuaguuccaccauc

SEQ ID NO: 1794328 - RNA, 11 nt, Human
gauccuccagg

SEQ ID NO: 1794329 - RNA, 13 nt, Human
gauugugccccug

SEQ ID NO: 1794330 - RNA, 20 nt, Human
gauuguccccgacccuugcc

SEQ ID NO: 1794331 - RNA, 23 nt, Human
gauuguaauauguaaaugguaug

SEQ ID NO: 1794332 - RNA, 15 nt, Human
gauuguccccgaccc

SEQ ID NO: 1794333 - RNA, 23 nt, Human
gauugacgggacuguugguauug

SEQ ID NO: 1794334 - RNA, 22 nt, Human
gauucccaagcucugcuccucu

SEQ ID NO: 1794335 - RNA, 12 nt, Human
gauucagacagc

SEQ ID NO: 1794336 - RNA, 16 nt, Human
gauguucugggacaca

SEQ ID NO: 1794337 - RNA, 20 nt, Human
gaugugcuuguuaacugagu

SEQ ID NO: 1794338 - RNA, 23 nt, Human
gauggugcaaugaccuuucaaua

SEQ ID NO: 1794339 - RNA, 19 nt, Human
gaugugcuuguuaacugag

SEQ ID NO: 1794340 - RNA, 20 nt, Human
gauggugcaaugaccuuuca

SEQ ID NO: 1794341 - RNA, 19 nt, Human
gauucaacagguuuuccug

SEQ ID NO: 1794342 - RNA, 18 nt, Human
gauuaaccacuucagcug

SEQ ID NO: 1794343 - RNA, 19 nt, Human
gauuaaccacuucagcuga

SEQ ID NO: 1794344 - RNA, 21 nt, Human
gauuaaccacuucagcugacu

SEQ ID NO: 1794345 - RNA, 19 nt, Human
gauuaaauucuugcaaagu

SEQ ID NO: 1794346 - RNA, 12 nt, Human
gauuaaauucuu

SEQ ID NO: 1794347 - RNA, 15 nt, Human
gauguuuuccaugag

SEQ ID NO: 1794348 - RNA, 23 nt, Human
gauguuuuccaugaguccccugu

SEQ ID NO: 1794349 - RNA, 14 nt, Human
gauguuuuccauga

SEQ ID NO: 1794350 - RNA, 21 nt, Human
gauguucuuucacccuuuucu

SEQ ID NO: 1794351 - RNA, 19 nt, Human
gauguugaaaaaguucugc

SEQ ID NO: 1794352 - RNA, 21 nt, Human
gaguugaaaaucuuauaauuu

SEQ ID NO: 1794353 - RNA, 14 nt, Human
gaguugaagacaga

SEQ ID NO: 1794354 - RNA, 17 nt, Human
gagugugccugaagucc

SEQ ID NO: 1794355 - RNA, 23 nt, Human
gaguucaucuugaauuguaagga

SEQ ID NO: 1794356 - RNA, 23 nt, Human
gagugaacaaauuuacagagaca

SEQ ID NO: 1794357 - RNA, 22 nt, Human
gagugaacaaauuuacagagac

SEQ ID NO: 1794358 - RNA, 19 nt, Human
gagugaacaaauuuacaga

SEQ ID NO: 1794359 - RNA, 12 nt, Human
gagugggcccaa

SEQ ID NO: 1794360 - RNA, 23 nt, Human
gagugggggaucacagccucuga

SEQ ID NO: 1794361 - RNA, 13 nt, Human
gaguggcuccucc

SEQ ID NO: 1794362 - RNA, 15 nt, Human
gaguggcuccucccg

SEQ ID NO: 1794363 - RNA, 17 nt, Human
gauagcacagacccugc

SEQ ID NO: 1794364 - RNA, 18 nt, Human
gauagcacagacccugcc

SEQ ID NO: 1794365 - RNA, 18 nt, Human
gauacaaugcugugcccu

SEQ ID NO: 1794366 - RNA, 13 nt, Human
gauacaaugcugu

SEQ ID NO: 1794367 - RNA, 22 nt, Human
gaucaaccccuucgcuccugug

SEQ ID NO: 1794368 - RNA, 21 nt, Human
gaucaaccccuucgcuccugu

SEQ ID NO: 1794369 - RNA, 23 nt, Human
gauauaugcucugcauguuacau

SEQ ID NO: 1794370 - RNA, 17 nt, Human
gauauaaguguguguuu

SEQ ID NO: 1794371 - RNA, 21 nt, Human
gauauaaguguguguuuuuca

SEQ ID NO: 1794372 - RNA, 13 nt, Human
gauagccaaggcc

SEQ ID NO: 1794373 - RNA, 14 nt, Human
gauagccaaggcca

SEQ ID NO: 1794374 - RNA, 12 nt, Human
gauagccaaggc

SEQ ID NO: 1794375 - RNA, 19 nt, Human
gauagcacagacccugccc

SEQ ID NO: 1794376 - RNA, 20 nt, Human
gauagcacagacccugcccu

SEQ ID NO: 1794377 - RNA, 14 nt, Human
gaguagcugggacu

SEQ ID NO: 1794378 - RNA, 12 nt, Human
gaguagcuggga

SEQ ID NO: 1794379 - RNA, 14 nt, Human
gaguccccuguuug

SEQ ID NO: 1794380 - RNA, 23 nt, Human
gaguccccuguuuguuucugaaa

SEQ ID NO: 1794381 - RNA, 18 nt, Human
gagucccaggcugagccu

SEQ ID NO: 1794382 - RNA, 19 nt, Human
gagucccaggcugagccuc

SEQ ID NO: 1794383 - RNA, 12 nt, Human
gaguccccuguu

SEQ ID NO: 1794384 - RNA, 17 nt, Human
gagucgaggacagggag

SEQ ID NO: 1794385 - RNA, 21 nt, Human
gagucucacuguugcccaggc

SEQ ID NO: 1794386 - RNA, 20 nt, Human
gagucucacuguugcccagg

SEQ ID NO: 1794387 - RNA, 19 nt, Human
gagucucacuguugcccag

SEQ ID NO: 1794388 - RNA, 23 nt, Human
gagucucacuguugcccaggcug

SEQ ID NO: 1794389 - RNA, 22 nt, Human
gagucucacuguugcccaggcu

SEQ ID NO: 1794390 - RNA, 23 nt, Human
gagucucgcuauugucaccaggg

SEQ ID NO: 1794391 - RNA, 12 nt, Human
gagucucuucuc

SEQ ID NO: 1794392 - RNA, 14 nt, Human
gagucucuucucca

SEQ ID NO: 1794393 - RNA, 15 nt, Human
gagucucuucuccac

SEQ ID NO: 1794394 - RNA, 16 nt, Human
gagucucuucuccacu

SEQ ID NO: 1794395 - RNA, 17 nt, Human
gagucucuucuccacug

SEQ ID NO: 1794396 - RNA, 18 nt, Human
gagucucuucuccacugg

SEQ ID NO: 1794397 - RNA, 21 nt, Human
gagucugaaggcuggguucug

SEQ ID NO: 1794398 - RNA, 16 nt, Human
gaguacguugugcauu

SEQ ID NO: 1794399 - RNA, 19 nt, Human
gagguuuuaaaaaaauccc

SEQ ID NO: 1794400 - RNA, 19 nt, Human
gagguucaaagauauuuug

SEQ ID NO: 1794401 - RNA, 14 nt, Human
gagguucccuuuga

SEQ ID NO: 1794402 - RNA, 20 nt, Human
gaguacguugugcauuuggu

SEQ ID NO: 1794403 - RNA, 15 nt, Human
gaguacuacaguccu

SEQ ID NO: 1794404 - RNA, 18 nt, Human
gaguacguugugcauuug

SEQ ID NO: 1794405 - RNA, 17 nt, Human
gaguacguugugcauuu

SEQ ID NO: 1794406 - RNA, 12 nt, Human
gaguagcuggau

SEQ ID NO: 1794407 - RNA, 18 nt, Human
gaguacuacaguccuccc

SEQ ID NO: 1794408 - RNA, 19 nt, Human
gaguacuacaguccuccca

SEQ ID NO: 1794409 - RNA, 22 nt, Human
gaggggggaggugggauccucc

SEQ ID NO: 1794410 - RNA, 18 nt, Human
gagguccacaacacacag

SEQ ID NO: 1794411 - RNA, 15 nt, Human
gaggggguggccucc

SEQ ID NO: 1794412 - RNA, 15 nt, Human
gaggggggagguggg

SEQ ID NO: 1794413 - RNA, 21 nt, Human
gaggugggauccuccaggugc

SEQ ID NO: 1794414 - RNA, 22 nt, Human
gaggugggauccuccaggugca

SEQ ID NO: 1794415 - RNA, 18 nt, Human
gaggugggauccuccagg

SEQ ID NO: 1794416 - RNA, 18 nt, Human
gagcagccacauuccuga

SEQ ID NO: 1794417 - RNA, 13 nt, Human
gagccacugcacc

SEQ ID NO: 1794418 - RNA, 20 nt, Human
gagccaccgugccuggccac

SEQ ID NO: 1794419 - RNA, 18 nt, Human
gagccaccgcgcccagcc

SEQ ID NO: 1794420 - RNA, 14 nt, Human
gagccaccgugccu

SEQ ID NO: 1794421 - RNA, 13 nt, Human
gagcccaggccuc

SEQ ID NO: 1794422 - RNA, 14 nt, Human
gagcccaggccucc

SEQ ID NO: 1794423 - RNA, 12 nt, Human
gagcccacgccc

SEQ ID NO: 1794424 - RNA, 15 nt, Human
gagcccacgccccca

SEQ ID NO: 1794425 - RNA, 16 nt, Human
gagcccacgcccccac

SEQ ID NO: 1794426 - RNA, 12 nt, Human
gagcccaggccu

SEQ ID NO: 1794427 - RNA, 22 nt, Human
gagccacugcaccgggccacag

SEQ ID NO: 1794428 - RNA, 13 nt, Human
gagccagauuuca

SEQ ID NO: 1794429 - RNA, 11 nt, Human
gagcccacgcc

SEQ ID NO: 1794430 - RNA, 19 nt, Human
gagcaccuuagacaguccc

SEQ ID NO: 1794431 - RNA, 17 nt, Human
gagcaccuuagacaguc

SEQ ID NO: 1794432 - RNA, 21 nt, Human
gagcaagacgcugugcugccc

SEQ ID NO: 1794433 - RNA, 18 nt, Human
gagcaagacgcugugcug

SEQ ID NO: 1794434 - RNA, 22 nt, Human
gagcaagacgcugugcugcccu

SEQ ID NO: 1794435 - RNA, 23 nt, Human
gagcaagacgcugugcugcccug

SEQ ID NO: 1794436 - RNA, 19 nt, Human
gagcaaaaucgaugcagug

SEQ ID NO: 1794437 - RNA, 20 nt, Human
gagaucaaccccuucgcucc

SEQ ID NO: 1794438 - RNA, 13 nt, Human
gagaucagccugg

SEQ ID NO: 1794439 - RNA, 14 nt, Human
gagaucagccuggg

SEQ ID NO: 1794440 - RNA, 16 nt, Human
gagaucagccugggca

SEQ ID NO: 1794441 - RNA, 14 nt, Human
gagcuacaaaugca

SEQ ID NO: 1794442 - RNA, 23 nt, Human
gagcuacacaggggaaaagagga

SEQ ID NO: 1794443 - RNA, 14 nt, Human
gagcuucuggcacu

SEQ ID NO: 1794444 - RNA, 18 nt, Human
gagcuucuguugcugccu

SEQ ID NO: 1794445 - RNA, 15 nt, Human
gagcuuaacagugug

SEQ ID NO: 1794446 - RNA, 16 nt, Human
gagcucugcagagcag

SEQ ID NO: 1794447 - RNA, 13 nt, Human
gagcugccaccug

SEQ ID NO: 1794448 - RNA, 15 nt, Human
gagcugccaccugcc

SEQ ID NO: 1794449 - RNA, 16 nt, Human
gagcugccaccugccu

SEQ ID NO: 1794450 - RNA, 12 nt, Human
gagcuacaaaug

SEQ ID NO: 1794451 - RNA, 13 nt, Human
gagcuacaaaugc

SEQ ID NO: 1794452 - RNA, 15 nt, Human
gagccuggcaagaau

SEQ ID NO: 1794453 - RNA, 10 nt, Human
gagccuggca

SEQ ID NO: 1794454 - RNA, 13 nt, Human
gagccugggaggu

SEQ ID NO: 1794455 - RNA, 21 nt, Human
gagccugggaggucaaggcug

SEQ ID NO: 1794456 - RNA, 20 nt, Human
gagccuccugcccuuaccug

SEQ ID NO: 1794457 - RNA, 22 nt, Human
gagccuccugcccuuaccugcc

SEQ ID NO: 1794458 - RNA, 17 nt, Human
gagcccugguggcagug

SEQ ID NO: 1794459 - RNA, 19 nt, Human
gagccucagcauccuggca

SEQ ID NO: 1794460 - RNA, 16 nt, Human
gagcccugguggcagu

SEQ ID NO: 1794461 - RNA, 15 nt, Human
gagcccugguggcag

SEQ ID NO: 1794462 - RNA, 21 nt, Human
gagccucagcauccuggcacc

SEQ ID NO: 1794463 - RNA, 20 nt, Human
gagccucagcauccuggcac

SEQ ID NO: 1794464 - RNA, 18 nt, Human
gagccucagucucccucc

SEQ ID NO: 1794465 - RNA, 14 nt, Human
gagccuccugcccu

SEQ ID NO: 1794466 - RNA, 15 nt, Human
gaggaauccagaccc

SEQ ID NO: 1794467 - RNA, 13 nt, Human
gaggacacagaga

SEQ ID NO: 1794468 - RNA, 18 nt, Human
gaggacaagagaaaaaag

SEQ ID NO: 1794469 - RNA, 14 nt, Human
gaggaauccagacc

SEQ ID NO: 1794470 - RNA, 21 nt, Human
gagcuucuguugcugccucau

SEQ ID NO: 1794471 - RNA, 22 nt, Human
gaggaaggaaacccagcucugg

SEQ ID NO: 1794472 - RNA, 23 nt, Human
gaggacagggaggugaccccagg

SEQ ID NO: 1794473 - RNA, 22 nt, Human
gaggacagggaggugaccccag

SEQ ID NO: 1794474 - RNA, 13 nt, Human
gaggacagggagg

SEQ ID NO: 1794475 - RNA, 13 nt, Human
gaggccagccuug

SEQ ID NO: 1794476 - RNA, 12 nt, Human
gaggccagccuu

SEQ ID NO: 1794477 - RNA, 22 nt, Human
gaggcagccccauucugccugc

SEQ ID NO: 1794478 - RNA, 18 nt, Human
gaggcagccccauucugc

SEQ ID NO: 1794479 - RNA, 23 nt, Human
gaggcagccccauucugccugcc

SEQ ID NO: 1794480 - RNA, 13 nt, Human
gaggcagccccau

SEQ ID NO: 1794481 - RNA, 23 nt, Human
gaggaguuugggguaugggagag

SEQ ID NO: 1794482 - RNA, 16 nt, Human
gaggauugcuugagcu

SEQ ID NO: 1794483 - RNA, 20 nt, Human
gaggauguucugggacacag

SEQ ID NO: 1794484 - RNA, 17 nt, Human
gaggauguucugggaca

SEQ ID NO: 1794485 - RNA, 12 nt, Human
gaggauguucug

SEQ ID NO: 1794486 - RNA, 13 nt, Human
gaggcccggccuc

SEQ ID NO: 1794487 - RNA, 24 nt, Human
gaggcccuucucuccagccccugg

SEQ ID NO: 1794488 - RNA, 14 nt, Human
gaggcccuucucuc

SEQ ID NO: 1794489 - RNA, 23 nt, Human
gaggcccuucucuccagccccug

SEQ ID NO: 1794490 - RNA, 14 nt, Human
gaggccuucucuga

SEQ ID NO: 1794491 - RNA, 19 nt, Human
gaggcggaucuuuggacag

SEQ ID NO: 1794492 - RNA, 20 nt, Human
gaggcggccccggccggggu

SEQ ID NO: 1794493 - RNA, 13 nt, Human
gaggcugggcucc

SEQ ID NO: 1794494 - RNA, 14 nt, Human
gaggcugggcuccc

SEQ ID NO: 1794495 - RNA, 15 nt, Human
gaggcugggcucccu

SEQ ID NO: 1794496 - RNA, 16 nt, Human
gagggagugacagagg

SEQ ID NO: 1794497 - RNA, 16 nt, Human
gagggagggcuccaga

SEQ ID NO: 1794498 - RNA, 14 nt, Human
gagggagugacaga

SEQ ID NO: 1794499 - RNA, 13 nt, Human
gagggagugacag

SEQ ID NO: 1794500 - RNA, 14 nt, Human
gagggagguaagga

SEQ ID NO: 1794501 - RNA, 12 nt, Human
gagggcacuggu

SEQ ID NO: 1794502 - RNA, 23 nt, Human
gagggcacagaaaauggaagaca

SEQ ID NO: 1794503 - RNA, 14 nt, Human
gagggcacagaaaa

SEQ ID NO: 1794504 - RNA, 22 nt, Human
gagggcacagaaaauggaagac

SEQ ID NO: 1794505 - RNA, 13 nt, Human
gaggggccuggca

SEQ ID NO: 1794506 - RNA, 14 nt, Human
gaggggccuggcag

SEQ ID NO: 1794507 - RNA, 18 nt, Human
gaggggccuggcagccgu

SEQ ID NO: 1794508 - RNA, 20 nt, Human
gaggggccuggcagccgugc

SEQ ID NO: 1794509 - RNA, 22 nt, Human
gaggggccucuuaugggcuggg

SEQ ID NO: 1794510 - RNA, 16 nt, Human
gagggcacugguggcc

SEQ ID NO: 1794511 - RNA, 18 nt, Human
gagggcacugguggcccg

SEQ ID NO: 1794512 - RNA, 14 nt, Human
gagggagggagggc

SEQ ID NO: 1794513 - RNA, 15 nt, Human
gagggagggagggcu

SEQ ID NO: 1794514 - RNA, 15 nt, Human
gagggagggcuccag

SEQ ID NO: 1794515 - RNA, 14 nt, Human
cucacugcagccuc

SEQ ID NO: 1794516 - RNA, 13 nt, Human
cucacugcagccu

SEQ ID NO: 1794517 - RNA, 12 nt, Human
cucacugcagcc

SEQ ID NO: 1794518 - RNA, 21 nt, Human
cucacucugucgcccagucug

SEQ ID NO: 1794519 - RNA, 13 nt, Human
cucacucugucgc

SEQ ID NO: 1794520 - RNA, 22 nt, Human
cucacucugucgcccagucugg

SEQ ID NO: 1794521 - RNA, 12 nt, Human
cucacucugucg

SEQ ID NO: 1794522 - RNA, 11 nt, Human
cucacucuguc

SEQ ID NO: 1794523 - RNA, 16 nt, Human
cucacuccuaccuggu

SEQ ID NO: 1794524 - RNA, 17 nt, Human
cucacuccuaccuggua

SEQ ID NO: 1794525 - RNA, 19 nt, Human
cucacuccuaccugguaau

SEQ ID NO: 1794526 - RNA, 13 nt, Human
cucacuccuugaa

SEQ ID NO: 1794527 - RNA, 22 nt, Human
cucacuauguugcccaggcagg

SEQ ID NO: 1794528 - RNA, 21 nt, Human
cucacuauguugcccaggcag

SEQ ID NO: 1794529 - RNA, 23 nt, Human
cucacuauguugcccaggcaggu

SEQ ID NO: 1794530 - RNA, 13 nt, Human
cucacuccuaccu

SEQ ID NO: 1794531 - RNA, 15 nt, Human
cucacuccuaccugg

SEQ ID NO: 1794532 - RNA, 20 nt, Human
cucacuauguugcccaggca

SEQ ID NO: 1794533 - RNA, 19 nt, Human
cucacuauguugcccaggc

SEQ ID NO: 1794534 - RNA, 15 nt, Human
cucaccccagcccca

SEQ ID NO: 1794535 - RNA, 17 nt, Human
cucagcauccuggcacc

SEQ ID NO: 1794536 - RNA, 16 nt, Human
cucagcauccuggcac

SEQ ID NO: 1794537 - RNA, 15 nt, Human
cucagaucuucugug

SEQ ID NO: 1794538 - RNA, 22 nt, Human
cucagauuguaauauguaaaug

SEQ ID NO: 1794539 - RNA, 15 nt, Human
cucagauuguaauau

SEQ ID NO: 1794540 - RNA, 20 nt, Human
cucacuguugcccaggcugg

SEQ ID NO: 1794541 - RNA, 19 nt, Human
cucacugccaugccagcuu

SEQ ID NO: 1794542 - RNA, 22 nt, Human
cucacugccaugccagcuuauc

SEQ ID NO: 1794543 - RNA, 22 nt, Human
cucacuguugcccaggcuggcg

SEQ ID NO: 1794544 - RNA, 21 nt, Human
cucacuguugcccaggcuggc

SEQ ID NO: 1794545 - RNA, 18 nt, Human
cucagagagggugggagu

SEQ ID NO: 1794546 - RNA, 14 nt, Human
cucagagagggugg

SEQ ID NO: 1794547 - RNA, 17 nt, Human
cucaaccuccugggcua

SEQ ID NO: 1794548 - RNA, 15 nt, Human
cucaaccuccugggc

SEQ ID NO: 1794549 - RNA, 13 nt, Human
cucaaccuccugg

SEQ ID NO: 1794550 - RNA, 21 nt, Human
cucaacaccucugcacaagcu

SEQ ID NO: 1794551 - RNA, 22 nt, Human
cuauuuaugugauccuuuugga

SEQ ID NO: 1794552 - RNA, 19 nt, Human
cuauugucaccagggcugg

SEQ ID NO: 1794553 - RNA, 18 nt, Human
cuauuguuagucucuuga

SEQ ID NO: 1794554 - RNA, 19 nt, Human
cucacauuuauucugcuca

SEQ ID NO: 1794555 - RNA, 15 nt, Human
cucacauuuauucug

SEQ ID NO: 1794556 - RNA, 22 nt, Human
cucacauuuauucugcucacau

SEQ ID NO: 1794557 - RNA, 17 nt, Human
cucacaguccuuaccag

SEQ ID NO: 1794558 - RNA, 19 nt, Human
cucacaguccuuaccagca

SEQ ID NO: 1794559 - RNA, 22 nt, Human
cucacaguccuuaccagcagag

SEQ ID NO: 1794560 - RNA, 23 nt, Human
cucacaguccuuaccagcagagc

SEQ ID NO: 1794561 - RNA, 15 nt, Human
cucaccagccccagu

SEQ ID NO: 1794562 - RNA, 14 nt, Human
cucaccagccccag

SEQ ID NO: 1794563 - RNA, 13 nt, Human
cucaccagcccca

SEQ ID NO: 1794564 - RNA, 18 nt, Human
cucaccagccccagugcc

SEQ ID NO: 1794565 - RNA, 17 nt, Human
cucaccagccccagugc

SEQ ID NO: 1794566 - RNA, 21 nt, Human
cucaaguccucuuuucugaga

SEQ ID NO: 1794567 - RNA, 16 nt, Human
cucaagacuuccagag

SEQ ID NO: 1794568 - RNA, 17 nt, Human
cucaagugauucuccug

SEQ ID NO: 1794569 - RNA, 14 nt, Human
cucaagacuuccag

SEQ ID NO: 1794570 - RNA, 22 nt, Human
cucacacaugagcaucaggcca

SEQ ID NO: 1794571 - RNA, 24 nt, Human
cucacacaugagcaucaggccagg

SEQ ID NO: 1794572 - RNA, 15 nt, Human
cucacaguccuuacc

SEQ ID NO: 1794573 - RNA, 24 nt, Human
cuaggugacagagugagacucugu

SEQ ID NO: 1794574 - RNA, 18 nt, Human
cuaggugacagagugaga

SEQ ID NO: 1794575 - RNA, 14 nt, Human
cuaggugacagagu

SEQ ID NO: 1794576 - RNA, 22 nt, Human
cgcccaguuggguggaugccug

SEQ ID NO: 1794577 - RNA, 20 nt, Human
cgccaucccagccccaauga

SEQ ID NO: 1794578 - RNA, 15 nt, Human
cgccaugcuccuggc

SEQ ID NO: 1794579 - RNA, 23 nt, Human
cgcccaguuggguggaugccugg

SEQ ID NO: 1794580 - RNA, 22 nt, Human
cuagguaaauuacaguuccuag

SEQ ID NO: 1794581 - RNA, 17 nt, Human
cuauagccuaggugaca

SEQ ID NO: 1794582 - RNA, 16 nt, Human
cuauaauguaagcucu

SEQ ID NO: 1794583 - RNA, 21 nt, Human
cuauaauguaagcucuacuga

SEQ ID NO: 1794584 - RNA, 22 nt, Human
cuauaauuuaccugaagucuuu

SEQ ID NO: 1794585 - RNA, 13 nt, Human
cuauggccugugg

SEQ ID NO: 1794586 - RNA, 20 nt, Human
cuaugcagagguccacaaca

SEQ ID NO: 1794587 - RNA, 15 nt, Human
cuauuagagaagaga

SEQ ID NO: 1794588 - RNA, 23 nt, Human
cuaugggacucaaugcacugaca

SEQ ID NO: 1794589 - RNA, 22 nt, Human
cuaugggacucaaugcacugac

SEQ ID NO: 1794590 - RNA, 18 nt, Human
cuaugggacucaaugcac

SEQ ID NO: 1794591 - RNA, 18 nt, Human
cucauuugucacacacuu

SEQ ID NO: 1794592 - RNA, 16 nt, Human
cuccaaaauaaaacuu

SEQ ID NO: 1794593 - RNA, 15 nt, Human
cuccaaaauaaaacu

SEQ ID NO: 1794594 - RNA, 18 nt, Human
cuccaaaauaaaacuuuu

SEQ ID NO: 1794595 - RNA, 17 nt, Human
cucauuugucacacacu

SEQ ID NO: 1794596 - RNA, 13 nt, Human
cucauuaaaaaaa

SEQ ID NO: 1794597 - RNA, 23 nt, Human
cuccaauuuuuuaagugaaaaua

SEQ ID NO: 1794598 - RNA, 15 nt, Human
cuccaauuuuuuaag

SEQ ID NO: 1794599 - RNA, 22 nt, Human
cuccaaucccaccaacccucag

SEQ ID NO: 1794600 - RNA, 23 nt, Human
cuccaaguccacaguggaaccag

SEQ ID NO: 1794601 - RNA, 13 nt, Human
cuccacccugcuc

SEQ ID NO: 1794602 - RNA, 15 nt, Human
cuccacccugcucuc

SEQ ID NO: 1794603 - RNA, 12 nt, Human
cuccauccugag

SEQ ID NO: 1794604 - RNA, 18 nt, Human
cuccaggagcagccacau

SEQ ID NO: 1794605 - RNA, 23 nt, Human
cuccaggagcagccacauuccug

SEQ ID NO: 1794606 - RNA, 11 nt, Human
cuccaggagca

SEQ ID NO: 1794607 - RNA, 13 nt, Human
cuccaggagcagc

SEQ ID NO: 1794608 - RNA, 14 nt, Human
cuccaggagcagcc

SEQ ID NO: 1794609 - RNA, 15 nt, Human
cuccaggagcagcca

SEQ ID NO: 1794610 - RNA, 16 nt, Human
cuccaggagcagccac

SEQ ID NO: 1794611 - RNA, 17 nt, Human
cuccaggagcagccaca

SEQ ID NO: 1794612 - RNA, 14 nt, Human
cuccagcucaccag

SEQ ID NO: 1794613 - RNA, 12 nt, Human
cuccagccuggg

SEQ ID NO: 1794614 - RNA, 20 nt, Human
cuccagccccuggaugcagc

SEQ ID NO: 1794615 - RNA, 16 nt, Human
cuccagccccuggaug

SEQ ID NO: 1794616 - RNA, 17 nt, Human
cuccagccccuggaugc

SEQ ID NO: 1794617 - RNA, 15 nt, Human
cuccagccccuggau

SEQ ID NO: 1794618 - RNA, 14 nt, Human
cuccaccugccagg

SEQ ID NO: 1794619 - RNA, 12 nt, Human
cuccaccugcca

SEQ ID NO: 1794620 - RNA, 13 nt, Human
cuccaccugccag

SEQ ID NO: 1794621 - RNA, 15 nt, Human
cucagggucccuggu

SEQ ID NO: 1794622 - RNA, 16 nt, Human
cucagggucccuggug

SEQ ID NO: 1794623 - RNA, 17 nt, Human
cucagggucccuggugg

SEQ ID NO: 1794624 - RNA, 18 nt, Human
cucagggucccugguggc

SEQ ID NO: 1794625 - RNA, 16 nt, Human
cucaggugagaagcag

SEQ ID NO: 1794626 - RNA, 19 nt, Human
cucaggugagaagcagagg

SEQ ID NO: 1794627 - RNA, 20 nt, Human
cucaggugagaagcagagga

SEQ ID NO: 1794628 - RNA, 16 nt, Human
cucagggccuggcuca

SEQ ID NO: 1794629 - RNA, 15 nt, Human
cucagggccuggucg

SEQ ID NO: 1794630 - RNA, 14 nt, Human
cucagggccuggcu

SEQ ID NO: 1794631 - RNA, 15 nt, Human
cucagggccuggcuc

SEQ ID NO: 1794632 - RNA, 13 nt, Human
cucagggccuggc

SEQ ID NO: 1794633 - RNA, 18 nt, Human
cucagcauccuggcaccc

SEQ ID NO: 1794634 - RNA, 19 nt, Human
cucagcccacauagugaug

SEQ ID NO: 1794635 - RNA, 21 nt, Human
cucagcccacauagugauggu

SEQ ID NO: 1794636 - RNA, 18 nt, Human
cucaggaguuugagacca

SEQ ID NO: 1794637 - RNA, 23 nt, Human
cucaggaguuugagaccaaccug

SEQ ID NO: 1794638 - RNA, 15 nt, Human
cucauccucauaccc

SEQ ID NO: 1794639 - RNA, 23 nt, Human
cucauaguaugguggcuggguug

SEQ ID NO: 1794640 - RNA, 21 nt, Human
cucaucaccaacgucugugcc

SEQ ID NO: 1794641 - RNA, 22 nt, Human
cucaucaccaacgucugugcca

SEQ ID NO: 1794642 - RNA, 19 nt, Human
cucaggugauccacccacc

SEQ ID NO: 1794643 - RNA, 18 nt, Human
cucaggugauccacccac

SEQ ID NO: 1794644 - RNA, 20 nt, Human
cucaggugauccacccaccu

SEQ ID NO: 1794645 - RNA, 22 nt, Human
cucaggugauccacccaccuca

SEQ ID NO: 1794646 - RNA, 16 nt, Human
cucauacccaccccca

SEQ ID NO: 1794647 - RNA, 18 nt, Human
cucauacccacccccacc

SEQ ID NO: 1794648 - RNA, 19 nt, Human
cucauacccacccccaccc

SEQ ID NO: 1794649 - RNA, 21 nt, Human
cucauacccacccccacccaa

SEQ ID NO: 1794650 - RNA, 21 nt, Human
cucauaguaugguggcugggu

SEQ ID NO: 1794651 - RNA, 20 nt, Human
cucauagcccucacccuggg

SEQ ID NO: 1794652 - RNA, 21 nt, Human
cucauagcccucacccugggg

SEQ ID NO: 1794653 - RNA, 13 nt, Human
cucauagcccuca

SEQ ID NO: 1794654 - RNA, 17 nt, Human
cucauagcccucacccu

SEQ ID NO: 1794655 - RNA, 22 nt, Human
cucauacucaccucaccccacu

SEQ ID NO: 1794656 - RNA, 14 nt, Human
cucauacucaccuc

SEQ ID NO: 1794657 - RNA, 15 nt, Human
cucauacccaccccc

SEQ ID NO: 1794658 - RNA, 23 nt, Human
cuccccagcaagugagagcuggg

SEQ ID NO: 1794659 - RNA, 22 nt, Human
cuccccagcaagugagagcugg

SEQ ID NO: 1794660 - RNA, 13 nt, Human
cuccauccugagg

SEQ ID NO: 1794661 - RNA, 14 nt, Human
cuccauccugaggc

SEQ ID NO: 1794662 - RNA, 12 nt, Human
cuccccuccucc

SEQ ID NO: 1794663 - RNA, 20 nt, Human
cuccccuccuccuggacucc

SEQ ID NO: 1794664 - RNA, 20 nt, Human
cucccgaguagcugggacua

SEQ ID NO: 1794665 - RNA, 19 nt, Human
cucccgaguagcugggacu

SEQ ID NO: 1794666 - RNA, 15 nt, Human
cucccggugcccaag

SEQ ID NO: 1794667 - RNA, 21 nt, Human
cucccggugcccaagaauaga

SEQ ID NO: 1794668 - RNA, 17 nt, Human
cucccugccccccagcc

SEQ ID NO: 1794669 - RNA, 23 nt, Human
cucccugccccccagcccuccuu

SEQ ID NO: 1794670 - RNA, 13 nt, Human
cucccugccccuc

SEQ ID NO: 1794671 - RNA, 14 nt, Human
cucccugccccucc

SEQ ID NO: 1794672 - RNA, 17 nt, Human
cucccugccccucccuu

SEQ ID NO: 1794673 - RNA, 18 nt, Human
cucccugccccucccuuc

SEQ ID NO: 1794674 - RNA, 20 nt, Human
cucccugccccucccuucaa

SEQ ID NO: 1794675 - RNA, 21 nt, Human
cucccugccccucccuucaac

SEQ ID NO: 1794676 - RNA, 19 nt, Human
cucccuuggggccuaugca

SEQ ID NO: 1794677 - RNA, 12 nt, Human
cucccuuucaac

SEQ ID NO: 1794678 - RNA, 18 nt, Human
cuccucagaucuucugug

SEQ ID NO: 1794679 - RNA, 17 nt, Human
cuccucccaggcgcccc

SEQ ID NO: 1794680 - RNA, 22 nt, Human
cuccucccaggcgccccuuccc

SEQ ID NO: 1794681 - RNA, 23 nt, Human
cuccucccaggcgccccuucccc

SEQ ID NO: 1794682 - RNA, 14 nt, Human
cuccuccuggacuc

SEQ ID NO: 1794683 - RNA, 15 nt, Human
cuccuccuggacucc

SEQ ID NO: 1794684 - RNA, 19 nt, Human
cuccuccuggacuccugca

SEQ ID NO: 1794685 - RNA, 22 nt, Human
cuccuccagccgccaugcuccu

SEQ ID NO: 1794686 - RNA, 15 nt, Human
cuccuccagccgcca

SEQ ID NO: 1794687 - RNA, 13 nt, Human
cuccuccagaguc

SEQ ID NO: 1794688 - RNA, 15 nt, Human
cuccuccagagucag

SEQ ID NO: 1794689 - RNA, 21 nt, Human
cuccugccucgaacuggcugc

SEQ ID NO: 1794690 - RNA, 20 nt, Human
cuccugccucgaacuggcug

SEQ ID NO: 1794691 - RNA, 18 nt, Human
cuccugccucgaacuggc

SEQ ID NO: 1794692 - RNA, 21 nt, Human
cuccugccucagccuccugag

SEQ ID NO: 1794693 - RNA, 19 nt, Human
cuccugccucagccucccg

SEQ ID NO: 1794694 - RNA, 22 nt, Human
cuccugccucgaacuggcugca

SEQ ID NO: 1794695 - RNA, 15 nt, Human
cuccucuccccagca

SEQ ID NO: 1794696 - RNA, 13 nt, Human
cuccucuccccag

SEQ ID NO: 1794697 - RNA, 11 nt, Human
cuccugccuca

SEQ ID NO: 1794698 - RNA, 12 nt, Human
cuccugccucag

SEQ ID NO: 1794699 - RNA, 17 nt, Human
cuccugccucagccucc

SEQ ID NO: 1794700 - RNA, 24 nt, Human
cuccugugugugcgccuacaggag

SEQ ID NO: 1794701 - RNA, 23 nt, Human
cuccugugugugcgccuacagga

SEQ ID NO: 1794702 - RNA, 21 nt, Human
cuccugugugugcgccuacag

SEQ ID NO: 1794703 - RNA, 11 nt, Human
cuccuggacuc

SEQ ID NO: 1794704 - RNA, 14 nt, Human
cuccuggaaauauu

SEQ ID NO: 1794705 - RNA, 20 nt, Human
cuccuuagaaguggaaguag

SEQ ID NO: 1794706 - RNA, 17 nt, Human
cuccuuagaaguggaag

SEQ ID NO: 1794707 - RNA, 13 nt, Human
cuccuuagaagug

SEQ ID NO: 1794708 - RNA, 12 nt, Human
cuccuggacucc

SEQ ID NO: 1794709 - RNA, 17 nt, Human
cuccuuaucaaaggaca

SEQ ID NO: 1794710 - RNA, 22 nt, Human
cuccuuaucaaaggacaccauu

SEQ ID NO: 1794711 - RNA, 23 nt, Human
cuccuuggugucgggcaugacac

SEQ ID NO: 1794712 - RNA, 13 nt, Human
cucgagcaugccu

SEQ ID NO: 1794713 - RNA, 15 nt, Human
cucgagcaugccugg

SEQ ID NO: 1794714 - RNA, 16 nt, Human
cucgagcaugccugga

SEQ ID NO: 1794715 - RNA, 19 nt, Human
cucgagcaugccuggaugg

SEQ ID NO: 1794716 - RNA, 23 nt, Human
cucgcucugucgcccaggcugga

SEQ ID NO: 1794717 - RNA, 15 nt, Human
cucgccuucaucucc

SEQ ID NO: 1794718 - RNA, 22 nt, Human
cucgagcaugccuggauggggc

SEQ ID NO: 1794719 - RNA, 15 nt, Human
cugagccagauuuca

SEQ ID NO: 1794720 - RNA, 13 nt, Human
cugagccagauuu

SEQ ID NO: 1794721 - RNA, 14 nt, Human
cugagccagauuuc

SEQ ID NO: 1794722 - RNA, 23 nt, Human
cugagauuauaggcaccuaccac

SEQ ID NO: 1794723 - RNA, 15 nt, Human
cugagcaaauguggc

SEQ ID NO: 1794724 - RNA, 17 nt, Human
cugagcaaauguggcuc

SEQ ID NO: 1794725 - RNA, 20 nt, Human
cugagcaaauguggcuccug

SEQ ID NO: 1794726 - RNA, 21 nt, Human
cugagcaaauguggcuccugg

SEQ ID NO: 1794727 - RNA, 20 nt, Human
cugagacagcccgggcucug

SEQ ID NO: 1794728 - RNA, 19 nt, Human
cugagacagcccgggcucu

SEQ ID NO: 1794729 - RNA, 21 nt, Human
cugagacagcccgggcucugc

SEQ ID NO: 1794730 - RNA, 22 nt, Human
cugagacagcccgggcucugcc

SEQ ID NO: 1794731 - RNA, 17 nt, Human
cugacuguacuccuccc

SEQ ID NO: 1794732 - RNA, 18 nt, Human
cugacagacacaggcccg

SEQ ID NO: 1794733 - RNA, 17 nt, Human
cugacagacacaggccc

SEQ ID NO: 1794734 - RNA, 17 nt, Human
cugaccagccuccaugc

SEQ ID NO: 1794735 - RNA, 16 nt, Human
cugacagacacaggcc

SEQ ID NO: 1794736 - RNA, 14 nt, Human
cugaauuucuuuug

SEQ ID NO: 1794737 - RNA, 21 nt, Human
cugaccagccuccaugcugcc

SEQ ID NO: 1794738 - RNA, 23 nt, Human
cugaccagccuccaugcugccuc

SEQ ID NO: 1794739 - RNA, 19 nt, Human
cugaaugguuuucaaaaua

SEQ ID NO: 1794740 - RNA, 20 nt, Human
cugaaugguuuucaaaauaa

SEQ ID NO: 1794741 - RNA, 12 nt, Human
cugaauuauuuu

SEQ ID NO: 1794742 - RNA, 12 nt, Human
cugaauuucuuu

SEQ ID NO: 1794743 - RNA, 17 nt, Human
cugaagucacacaguga

SEQ ID NO: 1794744 - RNA, 19 nt, Human
cugaagucacacagugagu

SEQ ID NO: 1794745 - RNA, 18 nt, Human
cugaagucacacagugag

SEQ ID NO: 1794746 - RNA, 21 nt, Human
cugaagucacacagugagucg

SEQ ID NO: 1794747 - RNA, 13 nt, Human
cugaagucacugc

SEQ ID NO: 1794748 - RNA, 14 nt, Human
cugaagucacugca

SEQ ID NO: 1794749 - RNA, 15 nt, Human
cugaagucacugcac

SEQ ID NO: 1794750 - RNA, 17 nt, Human
cugaaguucagcugcau

SEQ ID NO: 1794751 - RNA, 22 nt, Human
cugaagucccagauacuugggg

SEQ ID NO: 1794752 - RNA, 17 nt, Human
cugaagucuuuguacag

SEQ ID NO: 1794753 - RNA, 20 nt, Human
cugaagucuuuguacagaca

SEQ ID NO: 1794754 - RNA, 20 nt, Human
cucuuuguucuaaagaugga

SEQ ID NO: 1794755 - RNA, 14 nt, Human
cucuuuucaaaaca

SEQ ID NO: 1794756 - RNA, 23 nt, Human
cugaaagggacgcuacccgggaa

SEQ ID NO: 1794757 - RNA, 16 nt, Human
cucuucuccaggcugu

SEQ ID NO: 1794758 - RNA, 22 nt, Human
cucuuuggucuacacugugcug

SEQ ID NO: 1794759 - RNA, 23 nt, Human
cucuuuggucuacacugugcuga

SEQ ID NO: 1794760 - RNA, 15 nt, Human
cugaacauuccagag

SEQ ID NO: 1794761 - RNA, 22 nt, Human
cucugaaggacauugcggacag

SEQ ID NO: 1794762 - RNA, 16 nt, Human
cucugacaacagacuu

SEQ ID NO: 1794763 - RNA, 19 nt, Human
cucugacacacagcucugu

SEQ ID NO: 1794764 - RNA, 23 nt, Human
cucugacagaagaaccccagggu

SEQ ID NO: 1794765 - RNA, 18 nt, Human
cucugacacacagcucug

SEQ ID NO: 1794766 - RNA, 17 nt, Human
cucugacacacagcucu

SEQ ID NO: 1794767 - RNA, 16 nt, Human
cucugacacacagcuc

SEQ ID NO: 1794768 - RNA, 15 nt, Human
cucugacacacagcu

SEQ ID NO: 1794769 - RNA, 14 nt, Human
cucugacacacagc

SEQ ID NO: 1794770 - RNA, 21 nt, Human
cucugacaacagacuucugaa

SEQ ID NO: 1794771 - RNA, 22 nt, Human
cucugacaacagacuucugaaa

SEQ ID NO: 1794772 - RNA, 21 nt, Human
cucugagacucgcgacaaugc

SEQ ID NO: 1794773 - RNA, 14 nt, Human
cucugaggacacua

SEQ ID NO: 1794774 - RNA, 12 nt, Human
cucugaggacac

SEQ ID NO: 1794775 - RNA, 16 nt, Human
cucugaggacacuaac

SEQ ID NO: 1794776 - RNA, 12 nt, Human
cucugaggacaa

SEQ ID NO: 1794777 - RNA, 23 nt, Human
cucugagacucgcgacaaugcaa

SEQ ID NO: 1794778 - RNA, 13 nt, Human
cucugcacaagcu

SEQ ID NO: 1794779 - RNA, 19 nt, Human
cucugcaggucccuaauaa

SEQ ID NO: 1794780 - RNA, 20 nt, Human
cucugcaggucccuaauaaa

SEQ ID NO: 1794781 - RNA, 14 nt, Human
cucugcacaagcug

SEQ ID NO: 1794782 - RNA, 15 nt, Human
cucugcacaagcugc

SEQ ID NO: 1794783 - RNA, 21 nt, Human
cucugcaggucccuaauaaag

SEQ ID NO: 1794784 - RNA, 22 nt, Human
cucugcaggucccuaauaaagc

SEQ ID NO: 1794785 - RNA, 18 nt, Human
cucugcaggucccuaaua

SEQ ID NO: 1794786 - RNA, 18 nt, Human
cucugcccacucccugca

SEQ ID NO: 1794787 - RNA, 20 nt, Human
cucugcccacucccugcaac

SEQ ID NO: 1794788 - RNA, 13 nt, Human
cucugcccacucc

SEQ ID NO: 1794789 - RNA, 15 nt, Human
cucugcccacucccu

SEQ ID NO: 1794790 - RNA, 16 nt, Human
cucugcccacucccug

SEQ ID NO: 1794791 - RNA, 17 nt, Human
cucugcccacucccugc

SEQ ID NO: 1794792 - RNA, 22 nt, Human
cucugcccuaaugcgcaggcug

SEQ ID NO: 1794793 - RNA, 20 nt, Human
cucugcccuaaugcgcaggc

SEQ ID NO: 1794794 - RNA, 13 nt, Human
cucugccucccau

SEQ ID NO: 1794795 - RNA, 14 nt, Human
cucugccucccauc

SEQ ID NO: 1794796 - RNA, 16 nt, Human
cucugccucccaucac

SEQ ID NO: 1794797 - RNA, 17 nt, Human
cucugccucccaucacc

SEQ ID NO: 1794798 - RNA, 22 nt, Human
cucuguugcccaggcuggagug

SEQ ID NO: 1794799 - RNA, 20 nt, Human
cucuguugcccaggcuggag

SEQ ID NO: 1794800 - RNA, 23 nt, Human
cucugugucagguggggcagcuu

SEQ ID NO: 1794801 - RNA, 22 nt, Human
cucugugucagguggggcagcu

SEQ ID NO: 1794802 - RNA, 21 nt, Human
cucugugucagguggggcagc

SEQ ID NO: 1794803 - RNA, 20 nt, Human
cucugugucagguggggcag

SEQ ID NO: 1794804 - RNA, 13 nt, Human
cucuucuccaggc

SEQ ID NO: 1794805 - RNA, 15 nt, Human
cucuucuccaggcug

SEQ ID NO: 1794806 - RNA, 12 nt, Human
cucuucuccacu

SEQ ID NO: 1794807 - RNA, 13 nt, Human
cucuucuccacug

SEQ ID NO: 1794808 - RNA, 20 nt, Human
cucugccucugacacacagc

SEQ ID NO: 1794809 - RNA, 19 nt, Human
cucugccucugacacacag

SEQ ID NO: 1794810 - RNA, 21 nt, Human
cucugccucccaucacccgcu

SEQ ID NO: 1794811 - RNA, 10 nt, Human
cucugccuga

SEQ ID NO: 1794812 - RNA, 19 nt, Human
cucuggauuauauuaugaa

SEQ ID NO: 1794813 - RNA, 20 nt, Human
cucuggauuauauuaugaag

SEQ ID NO: 1794814 - RNA, 23 nt, Human
cucuggcagcucagagagggugg

SEQ ID NO: 1794815 - RNA, 22 nt, Human
cucuggccuucggccuccaucc

SEQ ID NO: 1794816 - RNA, 21 nt, Human
cucuggccuucggccuccauc

SEQ ID NO: 1794817 - RNA, 22 nt, Human
cucuguccugggagugagcugg

SEQ ID NO: 1794818 - RNA, 15 nt, Human
cucuguccugggagu

SEQ ID NO: 1794819 - RNA, 14 nt, Human
cucuguccugggag

SEQ ID NO: 1794820 - RNA, 13 nt, Human
cucugucgcccag

SEQ ID NO: 1794821 - RNA, 15 nt, Human
cucugucgcccaggc

SEQ ID NO: 1794822 - RNA, 17 nt, Human
cucugucgcccagucug

SEQ ID NO: 1794823 - RNA, 18 nt, Human
cucugucgcccaggcugg

SEQ ID NO: 1794824 - RNA, 22 nt, Human
cucugucgcccaggcuggagug

SEQ ID NO: 1794825 - RNA, 19 nt, Human
cucugucgcccagucugga

SEQ ID NO: 1794826 - RNA, 18 nt, Human
cucugucgcccagucugg

SEQ ID NO: 1794827 - RNA, 18 nt, Human
cugcgguccacccaggag

SEQ ID NO: 1794828 - RNA, 20 nt, Human
cugcgguccacccaggagcc

SEQ ID NO: 1794829 - RNA, 19 nt, Human
cugcgguccacccaggagc

SEQ ID NO: 1794830 - RNA, 22 nt, Human
cugccugcccaggccccugcca

SEQ ID NO: 1794831 - RNA, 21 nt, Human
cugccugcccaggccccugcc

SEQ ID NO: 1794832 - RNA, 21 nt, Human
cugccucugacacacagcucu

SEQ ID NO: 1794833 - RNA, 18 nt, Human
cugccucugacacacagc

SEQ ID NO: 1794834 - RNA, 17 nt, Human
cugccucugacacacag

SEQ ID NO: 1794835 - RNA, 19 nt, Human
cugccucucugcagguccc

SEQ ID NO: 1794836 - RNA, 20 nt, Human
cugccccuccucucugcccu

SEQ ID NO: 1794837 - RNA, 21 nt, Human
cugccccuccucucugcccua

SEQ ID NO: 1794838 - RNA, 12 nt, Human
cugccgcagccc

SEQ ID NO: 1794839 - RNA, 13 nt, Human
cugccgcagcccu

SEQ ID NO: 1794840 - RNA, 23 nt, Human
cugccgcagcccugcagagggca

SEQ ID NO: 1794841 - RNA, 19 nt, Human
cugccgcagcccugcagag

SEQ ID NO: 1794842 - RNA, 20 nt, Human
cugccgcagcccugcagagg

SEQ ID NO: 1794843 - RNA, 21 nt, Human
cugccgcagcccugcagaggg

SEQ ID NO: 1794844 - RNA, 22 nt, Human
cugccgcagcccugcagagggc

SEQ ID NO: 1794845 - RNA, 19 nt, Human
cugccucagccucccaaag

SEQ ID NO: 1794846 - RNA, 17 nt, Human
cugccucagccucccga

SEQ ID NO: 1794847 - RNA, 15 nt, Human
cugccucagccuccc

SEQ ID NO: 1794848 - RNA, 15 nt, Human
cugccucucugcagg

SEQ ID NO: 1794849 - RNA, 16 nt, Human
cugccucucugcaggu

SEQ ID NO: 1794850 - RNA, 17 nt, Human
cugccucucugcagguc

SEQ ID NO: 1794851 - RNA, 18 nt, Human
cugccucucugcaggucc

SEQ ID NO: 1794852 - RNA, 14 nt, Human
cugccuccagaaug

SEQ ID NO: 1794853 - RNA, 22 nt, Human
cugccuccagaauggucuuucu

SEQ ID NO: 1794854 - RNA, 23 nt, Human
cugcacuugcagacucuacagag

SEQ ID NO: 1794855 - RNA, 19 nt, Human
cugcaguugccagucaccc

SEQ ID NO: 1794856 - RNA, 17 nt, Human
cugcaguugccagucac

SEQ ID NO: 1794857 - RNA, 21 nt, Human
cugcaguugccagucaccccg

SEQ ID NO: 1794858 - RNA, 22 nt, Human
cugcaguugccagucaccccgg

SEQ ID NO: 1794859 - RNA, 22 nt, Human
cugcaucguuucaucuuccaac

SEQ ID NO: 1794860 - RNA, 19 nt, Human
cugcauccuccgccucccg

SEQ ID NO: 1794861 - RNA, 20 nt, Human
cugcauccuccgccucccgg

SEQ ID NO: 1794862 - RNA, 16 nt, Human
cugcaucguuucaucu

SEQ ID NO: 1794863 - RNA, 18 nt, Human
cugcaugcgggcuuccuc

SEQ ID NO: 1794864 - RNA, 22 nt, Human
cugcaugcgggcuuccuccugg

SEQ ID NO: 1794865 - RNA, 18 nt, Human
cugccaaugggagcucau

SEQ ID NO: 1794866 - RNA, 19 nt, Human
cugccaaugggagcucaug

SEQ ID NO: 1794867 - RNA, 17 nt, Human
cugcccagccuccaagc

SEQ ID NO: 1794868 - RNA, 18 nt, Human
cugcccacucccugcaac

SEQ ID NO: 1794869 - RNA, 17 nt, Human
cugcccaccuggccucu

SEQ ID NO: 1794870 - RNA, 18 nt, Human
cugcccaccuggccucug

SEQ ID NO: 1794871 - RNA, 19 nt, Human
cugcccaccuggccucugc

SEQ ID NO: 1794872 - RNA, 20 nt, Human
cugcccaccuggccucugca

SEQ ID NO: 1794873 - RNA, 22 nt, Human
cugcccaccuggccucugcacu

SEQ ID NO: 1794874 - RNA, 14 nt, Human
cugcccacucccug

SEQ ID NO: 1794875 - RNA, 15 nt, Human
cugcccacucccugc

SEQ ID NO: 1794876 - RNA, 16 nt, Human
cugcccacucccugca

SEQ ID NO: 1794877 - RNA, 11 nt, Human
cugccaggcau

SEQ ID NO: 1794878 - RNA, 13 nt, Human
cugccaggcaugg

SEQ ID NO: 1794879 - RNA, 14 nt, Human
cugccaugccagcu

SEQ ID NO: 1794880 - RNA, 15 nt, Human
cugccaugccagcuu

SEQ ID NO: 1794881 - RNA, 13 nt, Human
cugcccaccuggc

SEQ ID NO: 1794882 - RNA, 14 nt, Human
cugcccaccuggcc

SEQ ID NO: 1794883 - RNA, 15 nt, Human
cugcccaccuggccu

SEQ ID NO: 1794884 - RNA, 12 nt, Human
cugcaccgggcc

SEQ ID NO: 1794885 - RNA, 23 nt, Human
cugcaccggcuggccuggccccu

SEQ ID NO: 1794886 - RNA, 15 nt, Human
cugcacuccccugcu

SEQ ID NO: 1794887 - RNA, 13 nt, Human
cugcacccucagg

SEQ ID NO: 1794888 - RNA, 14 nt, Human
cugcacccucaggc

SEQ ID NO: 1794889 - RNA, 16 nt, Human
cugcacccucaggcag

SEQ ID NO: 1794890 - RNA, 22 nt, Human
cugcaccggcuggccuggcccc

SEQ ID NO: 1794891 - RNA, 18 nt, Human
cugcacuugcagacucua

SEQ ID NO: 1794892 - RNA, 16 nt, Human
cugcacuccccugcug

SEQ ID NO: 1794893 - RNA, 17 nt, Human
cugcacuccccugcugg

SEQ ID NO: 1794894 - RNA, 18 nt, Human
cugcacuccccugcuggg

SEQ ID NO: 1794895 - RNA, 14 nt, Human
cugcacacagcacg

SEQ ID NO: 1794896 - RNA, 20 nt, Human
cugcacacgcuccuuccucu

SEQ ID NO: 1794897 - RNA, 22 nt, Human
cugcacacgcuccuuccucuga

SEQ ID NO: 1794898 - RNA, 17 nt, Human
cugcaaagcccagcuug

SEQ ID NO: 1794899 - RNA, 18 nt, Human
cugcaauaaggggagagu

SEQ ID NO: 1794900 - RNA, 13 nt, Human
cugcacacagcac

SEQ ID NO: 1794901 - RNA, 22 nt, Human
cugcacaagcugcacccucagg

SEQ ID NO: 1794902 - RNA, 21 nt, Human
cugauugugucucuugguccu

SEQ ID NO: 1794903 - RNA, 17 nt, Human
cugauugugucucuugg

SEQ ID NO: 1794904 - RNA, 17 nt, Human
cugauggugcaaugacc

SEQ ID NO: 1794905 - RNA, 19 nt, Human
cugauggugcaaugaccuu

SEQ ID NO: 1794906 - RNA, 20 nt, Human
cugauggugcaaugaccuuu

SEQ ID NO: 1794907 - RNA, 21 nt, Human
cugauggugcaaugaccuuuc

SEQ ID NO: 1794908 - RNA, 13 nt, Human
cugcaaagcccag

SEQ ID NO: 1794909 - RNA, 15 nt, Human
cugcaaagcccagcu

SEQ ID NO: 1794910 - RNA, 23 nt, Human
cugauuuuuuuuuccuucagugc

SEQ ID NO: 1794911 - RNA, 21 nt, Human
cugauuuuuuuuuccuucagu

SEQ ID NO: 1794912 - RNA, 22 nt, Human
cugauuuuuuuuuccuucagug

SEQ ID NO: 1794913 - RNA, 16 nt, Human
cugauuuuuuuuuccu

SEQ ID NO: 1794914 - RNA, 18 nt, Human
cugauuuuuuuuuccuuc

SEQ ID NO: 1794915 - RNA, 19 nt, Human
cugauuuuuuuuuccuuca

SEQ ID NO: 1794916 - RNA, 20 nt, Human
cugauuuuuuuuuccuucag

SEQ ID NO: 1794917 - RNA, 20 nt, Human
cugauccuaguuccaccauc

SEQ ID NO: 1794918 - RNA, 21 nt, Human
cugauccuaguuccaccauca

SEQ ID NO: 1794919 - RNA, 14 nt, Human
cugauggugcaaug

SEQ ID NO: 1794920 - RNA, 15 nt, Human
cugauggugcaauga

SEQ ID NO: 1794921 - RNA, 16 nt, Human
cugauggugcaaugac

SEQ ID NO: 1794922 - RNA, 15 nt, Human
cugaucaccugcccu

SEQ ID NO: 1794923 - RNA, 20 nt, Human
cugagucccaggcugagccu

SEQ ID NO: 1794924 - RNA, 18 nt, Human
cugagucugaaggcuggg

SEQ ID NO: 1794925 - RNA, 19 nt, Human
cugagucugaaggcugggu

SEQ ID NO: 1794926 - RNA, 13 nt, Human
cugaggcugggcu

SEQ ID NO: 1794927 - RNA, 15 nt, Human
cugaggcugggcucc

SEQ ID NO: 1794928 - RNA, 16 nt, Human
cugaggcugggcuccc

SEQ ID NO: 1794929 - RNA, 17 nt, Human
cugaggcugggcucccu

SEQ ID NO: 1794930 - RNA, 22 nt, Human
cugaggcugggcucccuuccca

SEQ ID NO: 1794931 - RNA, 24 nt, Human
cugaggcccuucucuccagccccu

SEQ ID NO: 1794932 - RNA, 21 nt, Human
cugaggcuccacuuggucugu

SEQ ID NO: 1794933 - RNA, 15 nt, Human
cugaggcuccacuug

SEQ ID NO: 1794934 - RNA, 21 nt, Human
gaacuuguaaaggaauuuaaa

SEQ ID NO: 1794935 - RNA, 23 nt, Human
gaacuugguucccauuugcuccu

SEQ ID NO: 1794936 - RNA, 13 nt, Human
gaacuuggcgcug

SEQ ID NO: 1794937 - RNA, 15 nt, Human
gaacuuggcgcugcc

SEQ ID NO: 1794938 - RNA, 16 nt, Human
gaacuuggcgcugccc

SEQ ID NO: 1794939 - RNA, 22 nt, Human
gaacuggguacuuguggacaca

SEQ ID NO: 1794940 - RNA, 15 nt, Human
gaacucccuuucaac

SEQ ID NO: 1794941 - RNA, 14 nt, Human
gaacucccuuucaa

SEQ ID NO: 1794942 - RNA, 17 nt, Human
gaaccaccacacccagc

SEQ ID NO: 1794943 - RNA, 16 nt, Human
gaaccaccacacccag

SEQ ID NO: 1794944 - RNA, 12 nt, Human
gaaccugacccc

SEQ ID NO: 1794945 - RNA, 11 nt, Human
gaaccugaccc

SEQ ID NO: 1794946 - RNA, 21 nt, Human
gaaccacaucuugcucugcug

SEQ ID NO: 1794947 - RNA, 19 nt, Human
gaacagacuggaagcacag

SEQ ID NO: 1794948 - RNA, 16 nt, Human
gaacagacuggaagca

SEQ ID NO: 1794949 - RNA, 15 nt, Human
gaacagacuggaagc

SEQ ID NO: 1794950 - RNA, 18 nt, Human
gaaauagacagcaugaga

SEQ ID NO: 1794951 - RNA, 17 nt, Human
gaaauacagacuggaug

SEQ ID NO: 1794952 - RNA, 21 nt, Human
gaaauaucugaaaauguaugu

SEQ ID NO: 1794953 - RNA, 13 nt, Human
gaaauauaauuga

SEQ ID NO: 1794954 - RNA, 20 nt, Human
gaaacaugacucguauaugu

SEQ ID NO: 1794955 - RNA, 23 nt, Human
gaaaugcugguuuuucaguuuuc

SEQ ID NO: 1794956 - RNA, 14 nt, Human
gaaaugggcagagc

SEQ ID NO: 1794957 - RNA, 20 nt, Human
gaaaugggcagagcagagac

SEQ ID NO: 1794958 - RNA, 19 nt, Human
gaaauugcauuuccugaca

SEQ ID NO: 1794959 - RNA, 17 nt, Human
gaaauuuguuauaauga

SEQ ID NO: 1794960 - RNA, 20 nt, Human
gaauaauccuaaacauauga

SEQ ID NO: 1794961 - RNA, 15 nt, Human
gaauaaauugcuccu

SEQ ID NO: 1794962 - RNA, 14 nt, Human
gaauaacauguaau

SEQ ID NO: 1794963 - RNA, 14 nt, Human
gaauacuuuauaaa

SEQ ID NO: 1794964 - RNA, 24 nt, Human
gaauacuuugcagcacagcugaga

SEQ ID NO: 1794965 - RNA, 17 nt, Human
gaauagaagcuaagguu

SEQ ID NO: 1794966 - RNA, 14 nt, Human
gaauaaagacaccu

SEQ ID NO: 1794967 - RNA, 12 nt, Human
gaauaaaauuuu

SEQ ID NO: 1794968 - RNA, 12 nt, Human
gaaguuucugcc

SEQ ID NO: 1794969 - RNA, 16 nt, Human
gaaucucaaauaacua

SEQ ID NO: 1794970 - RNA, 19 nt, Human
gaaugaaagggcccagaga

SEQ ID NO: 1794971 - RNA, 14 nt, Human
gaaugaaagggccc

SEQ ID NO: 1794972 - RNA, 14 nt, Human
gaauagcugggacu

SEQ ID NO: 1794973 - RNA, 18 nt, Human
gaauagaagcuaagguuu

SEQ ID NO: 1794974 - RNA, 15 nt, Human
gaauagaugcugacu

SEQ ID NO: 1794975 - RNA, 15 nt, Human
gaauagcugggacua

SEQ ID NO: 1794976 - RNA, 19 nt, Human
gaaggauacaaaagcaugu

SEQ ID NO: 1794977 - RNA, 12 nt, Human
gaaggauacaaa

SEQ ID NO: 1794978 - RNA, 21 nt, Human
gaaggauacaaaagcauguga

SEQ ID NO: 1794979 - RNA, 14 nt, Human
gaaggaaacccagc

SEQ ID NO: 1794980 - RNA, 17 nt, Human
gaaggaaacccagcucu

SEQ ID NO: 1794981 - RNA, 23 nt, Human
gaaggacccggaggggccuggca

SEQ ID NO: 1794982 - RNA, 18 nt, Human
gaaggaaacccagcucug

SEQ ID NO: 1794983 - RNA, 13 nt, Human
gaaggcagggagg

SEQ ID NO: 1794984 - RNA, 14 nt, Human
gaaggcagggaggg

SEQ ID NO: 1794985 - RNA, 16 nt, Human
gaaggccccgcccagg

SEQ ID NO: 1794986 - RNA, 14 nt, Human
gaaggccccgccca

SEQ ID NO: 1794987 - RNA, 15 nt, Human
gaaggccccgcccag

SEQ ID NO: 1794988 - RNA, 21 nt, Human
gaagacucauucuucuguacg

SEQ ID NO: 1794989 - RNA, 19 nt, Human
gaagacucauucuucugua

SEQ ID NO: 1794990 - RNA, 14 nt, Human
gaagaagcucucuc

SEQ ID NO: 1794991 - RNA, 22 nt, Human
gaagccacgguguucugugaua

SEQ ID NO: 1794992 - RNA, 15 nt, Human
gaagccagcaggcuc

SEQ ID NO: 1794993 - RNA, 16 nt, Human
gaagccagcaggcucu

SEQ ID NO: 1794994 - RNA, 19 nt, Human
gaagccagcaggcucucag

SEQ ID NO: 1794995 - RNA, 23 nt, Human
gaagccagcaggcucucaggcca

SEQ ID NO: 1794996 - RNA, 18 nt, Human
gaagcuuuuaugugaaac

SEQ ID NO: 1794997 - RNA, 10 nt, Human
gaagccuuug

SEQ ID NO: 1794998 - RNA, 11 nt, Human
gaagccuuugu

SEQ ID NO: 1794999 - RNA, 14 nt, Human
gaagcggcuggcag

SEQ ID NO: 1795000 - RNA, 20 nt, Human
gaagcccaggaaaggcucca

SEQ ID NO: 1795001 - RNA, 21 nt, Human
gaagcccaggaaaggcuccag

SEQ ID NO: 1795002 - RNA, 22 nt, Human
gaagcccaggaaaggcuccagg

SEQ ID NO: 1795003 - RNA, 23 nt, Human
gaagcccaggaaaggcuccagga

SEQ ID NO: 1795004 - RNA, 22 nt, Human
gaaaacaauaacgauaaaagac

SEQ ID NO: 1795005 - RNA, 13 nt, Human
gaaaacacauuuu

SEQ ID NO: 1795006 - RNA, 14 nt, Human
gaaaacacauuuuu

SEQ ID NO: 1795007 - RNA, 12 nt, Human
gaaaacaugcua

SEQ ID NO: 1795008 - RNA, 15 nt, Human
gaaaacaugcuacac

SEQ ID NO: 1795009 - RNA, 14 nt, Human
gaaaacaugcuaca

SEQ ID NO: 1795010 - RNA, 19 nt, Human
gaaaacguggcugcuucaa

SEQ ID NO: 1795011 - RNA, 18 nt, Human
gaaaacguggcugcuuca

SEQ ID NO: 1795012 - RNA, 15 nt, Human
gaaaacguggcugcu

SEQ ID NO: 1795013 - RNA, 16 nt, Human
gaaaacguggcugcuu

SEQ ID NO: 1795014 - RNA, 21 nt, Human
gaaaaccaagccguggcuucc

SEQ ID NO: 1795015 - RNA, 18 nt, Human
gaaaaccaagccguggcu

SEQ ID NO: 1795016 - RNA, 19 nt, Human
gaaaaccaagccguggcuu

SEQ ID NO: 1795017 - RNA, 15 nt, Human
cuuuuuucacuacau

SEQ ID NO: 1795018 - RNA, 14 nt, Human
cuuuuuucuaaagu

SEQ ID NO: 1795019 - RNA, 16 nt, Human
cuuuugagcauuuaga

SEQ ID NO: 1795020 - RNA, 21 nt, Human
cuuuugagugccuuacacaau

SEQ ID NO: 1795021 - RNA, 17 nt, Human
gaaaaaggaugcacaga

SEQ ID NO: 1795022 - RNA, 23 nt, Human
gaaaaaggaugcacagaguuguu

SEQ ID NO: 1795023 - RNA, 14 nt, Human
cuuuuuuggcugcu

SEQ ID NO: 1795024 - RNA, 15 nt, Human
cuuuuuuggcugcug

SEQ ID NO: 1795025 - RNA, 19 nt, Human
gaaaaucuuauaauuuaaa

SEQ ID NO: 1795026 - RNA, 16 nt, Human
gaaaaucagccugcuc

SEQ ID NO: 1795027 - RNA, 18 nt, Human
gaaaaucagccugcucca

SEQ ID NO: 1795028 - RNA, 14 nt, Human
gaaaaucagccugc

SEQ ID NO: 1795029 - RNA, 19 nt, Human
gaaaauaacgauaaaagac

SEQ ID NO: 1795030 - RNA, 17 nt, Human
gaaaagcugcugacagu

SEQ ID NO: 1795031 - RNA, 13 nt, Human
gaaaagcugcuga

SEQ ID NO: 1795032 - RNA, 20 nt, Human
gaaaaucuuauaauuuaaaa

SEQ ID NO: 1795033 - RNA, 22 nt, Human
gaaacacugggcuucuagaacc

SEQ ID NO: 1795034 - RNA, 18 nt, Human
gaaacagcuaaugggaca

SEQ ID NO: 1795035 - RNA, 20 nt, Human
gaaacagcucgacuuuaaaa

SEQ ID NO: 1795036 - RNA, 15 nt, Human
gaaacagcucgacuu

SEQ ID NO: 1795037 - RNA, 16 nt, Human
gaaacacuuugcauaa

SEQ ID NO: 1795038 - RNA, 16 nt, Human
cuuuucuuucagccaa

SEQ ID NO: 1795039 - RNA, 18 nt, Human
cuuuucuugcaugaggcu

SEQ ID NO: 1795040 - RNA, 23 nt, Human
cuuuucuugcaugaggcuagugu

SEQ ID NO: 1795041 - RNA, 18 nt, Human
cuuuucuguccgagcuuu

SEQ ID NO: 1795042 - RNA, 23 nt, Human
cuuuucuguccgagcuuugaaaa

SEQ ID NO: 1795043 - RNA, 20 nt, Human
cuuuucauaaccuagccuua

SEQ ID NO: 1795044 - RNA, 18 nt, Human
cuuuucacugcuggcugc

SEQ ID NO: 1795045 - RNA, 20 nt, Human
cuuuucacugcuggcugccu

SEQ ID NO: 1795046 - RNA, 17 nt, Human
cuuuucacugcuggcug

SEQ ID NO: 1795047 - RNA, 22 nt, Human
cuuuucauaaccuagccuuaga

SEQ ID NO: 1795048 - RNA, 18 nt, Human
cuuuguuuguugucagcu

SEQ ID NO: 1795049 - RNA, 20 nt, Human
cuuuguuuguugucagcuga

SEQ ID NO: 1795050 - RNA, 20 nt, Human
cuuuuacguccaucucuugu

SEQ ID NO: 1795051 - RNA, 18 nt, Human
cuuuguucuaaagaugga

SEQ ID NO: 1795052 - RNA, 14 nt, Human
cuuuguucuggcuc

SEQ ID NO: 1795053 - RNA, 15 nt, Human
cuuuguucuggcucu

SEQ ID NO: 1795054 - RNA, 19 nt, Human
cuuugugauuuuuguaauu

SEQ ID NO: 1795055 - RNA, 18 nt, Human
cuuugugauuuuuguaau

SEQ ID NO: 1795056 - RNA, 17 nt, Human
cuuugugauuuuuguaa

SEQ ID NO: 1795057 - RNA, 13 nt, Human
cuuugggaggcca

SEQ ID NO: 1795058 - RNA, 18 nt, Human
cuuuguccccaccgcaga

SEQ ID NO: 1795059 - RNA, 22 nt, Human
cuuuguccccaccgcagacagg

SEQ ID NO: 1795060 - RNA, 14 nt, Human
cuuugugauuuuug

SEQ ID NO: 1795061 - RNA, 16 nt, Human
cuuucccaucuuccaa

SEQ ID NO: 1795062 - RNA, 19 nt, Human
cuuuggacccugaggccca

SEQ ID NO: 1795063 - RNA, 17 nt, Human
cuuuggacccugaggcc

SEQ ID NO: 1795064 - RNA, 18 nt, Human
cuuuggacccugaggccc

SEQ ID NO: 1795065 - RNA, 18 nt, Human
cuuuggacagaagcagcu

SEQ ID NO: 1795066 - RNA, 19 nt, Human
cuuuggacagaagcagcuc

SEQ ID NO: 1795067 - RNA, 20 nt, Human
cuuuggacagaagcagcucu

SEQ ID NO: 1795068 - RNA, 21 nt, Human
cuuuggacagaagcagcucuu

SEQ ID NO: 1795069 - RNA, 15 nt, Human
cuuuggacccugagg

SEQ ID NO: 1795070 - RNA, 16 nt, Human
cuuuggacccugaggc

SEQ ID NO: 1795071 - RNA, 19 nt, Human
cuuguaaaggaauuuaaaa

SEQ ID NO: 1795072 - RNA, 16 nt, Human
cuuggggggcugaggu

SEQ ID NO: 1795073 - RNA, 22 nt, Human
cuuggggggcugaggugggagg

SEQ ID NO: 1795074 - RNA, 16 nt, Human
cuuggggaccagagcu

SEQ ID NO: 1795075 - RNA, 22 nt, Human
cuuggggaccagagcugccacc

SEQ ID NO: 1795076 - RNA, 15 nt, Human
cuuggggggcugagg

SEQ ID NO: 1795077 - RNA, 18 nt, Human
cuugggccacugugaaga

SEQ ID NO: 1795078 - RNA, 13 nt, Human
cuugggcuucauc

SEQ ID NO: 1795079 - RNA, 14 nt, Human
cuugggccacugug

SEQ ID NO: 1795080 - RNA, 20 nt, Human
cuuggggaccagagcugcca

SEQ ID NO: 1795081 - RNA, 21 nt, Human
cuuggggaccagagcugccac

SEQ ID NO: 1795082 - RNA, 22 nt, Human
cuugggcuucauccuccucaga

SEQ ID NO: 1795083 - RNA, 17 nt, Human
cuuggcugcagggaguc

SEQ ID NO: 1795084 - RNA, 13 nt, Human
cuugggaauuuua

SEQ ID NO: 1795085 - RNA, 16 nt, Human
cuuggcugcagggagu

SEQ ID NO: 1795086 - RNA, 22 nt, Human
cuuggaggaaggaaacccagcu

SEQ ID NO: 1795087 - RNA, 23 nt, Human
cuuggagggcaugaagacagaua

SEQ ID NO: 1795088 - RNA, 12 nt, Human
cuuggagggcau

SEQ ID NO: 1795089 - RNA, 14 nt, Human
cuugccacugccuc

SEQ ID NO: 1795090 - RNA, 15 nt, Human
cuugccacugccucu

SEQ ID NO: 1795091 - RNA, 21 nt, Human
cuucuccacccugcucuccga

SEQ ID NO: 1795092 - RNA, 18 nt, Human
cuucuccacccugcucuc

SEQ ID NO: 1795093 - RNA, 17 nt, Human
cuucuccacccugcucu

SEQ ID NO: 1795094 - RNA, 14 nt, Human
cuugcucugcugac

SEQ ID NO: 1795095 - RNA, 13 nt, Human
cuuggaagcuccg

SEQ ID NO: 1795096 - RNA, 13 nt, Human
cuuggaggaagga

SEQ ID NO: 1795097 - RNA, 16 nt, Human
cuuggaaaugggagac

SEQ ID NO: 1795098 - RNA, 17 nt, Human
cuugcucugcugacaga

SEQ ID NO: 1795099 - RNA, 16 nt, Human
cuugcucugcugacag

SEQ ID NO: 1795100 - RNA, 20 nt, Human
cuugcuucaaccccaugaga

SEQ ID NO: 1795101 - RNA, 21 nt, Human
cuuuauuuucuauaauuuaaa

SEQ ID NO: 1795102 - RNA, 17 nt, Human
cuuuauuaaauguagaa

SEQ ID NO: 1795103 - RNA, 20 nt, Human
cuuuauucuggcagaggagg

SEQ ID NO: 1795104 - RNA, 15 nt, Human
cuuuaguuuuuguga

SEQ ID NO: 1795105 - RNA, 13 nt, Human
cuuuaguuuuugu

SEQ ID NO: 1795106 - RNA, 18 nt, Human
cuuucauuugcuuuggaa

SEQ ID NO: 1795107 - RNA, 14 nt, Human
cuuucauuugcuuu

SEQ ID NO: 1795108 - RNA, 23 nt, Human
cuuucauauuuuaaacagaggau

SEQ ID NO: 1795109 - RNA, 19 nt, Human
cuuucauauuuuaaacaga

SEQ ID NO: 1795110 - RNA, 16 nt, Human
cuuucauauuuuaaac

SEQ ID NO: 1795111 - RNA, 18 nt, Human
cuuuccaaaugcccagcu

SEQ ID NO: 1795112 - RNA, 19 nt, Human
cuuuccaaaugcccagcuu

SEQ ID NO: 1795113 - RNA, 22 nt, Human
cuuuccaaaugcccagcuuaaa

SEQ ID NO: 1795114 - RNA, 14 nt, Human
cuuguuuucuggga

SEQ ID NO: 1795115 - RNA, 19 nt, Human
cuuguuuuuuuuuuccacu

SEQ ID NO: 1795116 - RNA, 20 nt, Human
cuuguuuuuuuuuuccacuu

SEQ ID NO: 1795117 - RNA, 21 nt, Human
cuuguuuuuuuuuuccacuua

SEQ ID NO: 1795118 - RNA, 20 nt, Human
cuuguguguuuauugucaaa

SEQ ID NO: 1795119 - RNA, 23 nt, Human
cuuguuggauuuuugucuugugu

SEQ ID NO: 1795120 - RNA, 21 nt, Human
cuuguuggauuuuugucuugu

SEQ ID NO: 1795121 - RNA, 21 nt, Human
cuuguguuucuuuaguuuuug

SEQ ID NO: 1795122 - RNA, 21 nt, Human
cuuguguguuuauugucaaag

SEQ ID NO: 1795123 - RNA, 16 nt, Human
cuguuucagaggcuca

SEQ ID NO: 1795124 - RNA, 17 nt, Human
cuguuugcuaagugagg

SEQ ID NO: 1795125 - RNA, 19 nt, Human
cuguuugcuaagugaggau

SEQ ID NO: 1795126 - RNA, 18 nt, Human
cuguuuagauaauacacc

SEQ ID NO: 1795127 - RNA, 17 nt, Human
cuguuucaaacuuuacu

SEQ ID NO: 1795128 - RNA, 15 nt, Human
cuguuucaaacuuua

SEQ ID NO: 1795129 - RNA, 17 nt, Human
cuguugcccaggcuggc

SEQ ID NO: 1795130 - RNA, 18 nt, Human
cuguugcccaggcuggcg

SEQ ID NO: 1795131 - RNA, 17 nt, Human
cuguuuagauaauacac

SEQ ID NO: 1795132 - RNA, 14 nt, Human
cuguuuagauaaua

SEQ ID NO: 1795133 - RNA, 22 nt, Human
cuguuuuacaaaaaagaaaaga

SEQ ID NO: 1795134 - RNA, 16 nt, Human
cuuaaaaaguggaaaa

SEQ ID NO: 1795135 - RNA, 17 nt, Human
cuuaaaaaguggaaaaa

SEQ ID NO: 1795136 - RNA, 13 nt, Human
cuguuuucucuug

SEQ ID NO: 1795137 - RNA, 16 nt, Human
cuguuaauaguucagg

SEQ ID NO: 1795138 - RNA, 18 nt, Human
cuguucuuaagacgugau

SEQ ID NO: 1795139 - RNA, 21 nt, Human
cuguucuuucuggcuaugcau

SEQ ID NO: 1795140 - RNA, 14 nt, Human
cuguucuuucuggc

SEQ ID NO: 1795141 - RNA, 13 nt, Human
cuguucuuucugg

SEQ ID NO: 1795142 - RNA, 21 nt, Human
cuguucuuuccaaaguacacu

SEQ ID NO: 1795143 - RNA, 19 nt, Human
cuguucuuuccaaaguaca

SEQ ID NO: 1795144 - RNA, 16 nt, Human
cuguucuuuccaaagu

SEQ ID NO: 1795145 - RNA, 15 nt, Human
cuguucuuuccaaag

SEQ ID NO: 1795146 - RNA, 16 nt, Human
cuguugcccaggcugg

SEQ ID NO: 1795147 - RNA, 15 nt, Human
cuguugcccaggcug

SEQ ID NO: 1795148 - RNA, 14 nt, Human
cuguugcccaggcu

SEQ ID NO: 1795149 - RNA, 13 nt, Human
cuguugcccaggc

SEQ ID NO: 1795150 - RNA, 12 nt, Human
cuguugcccagg

SEQ ID NO: 1795151 - RNA, 23 nt, Human
cuguucuuucuggcuaugcauuu

SEQ ID NO: 1795152 - RNA, 20 nt, Human
cuuaauucuuagcucauucu

SEQ ID NO: 1795153 - RNA, 17 nt, Human
cuuaaccagaucauugu

SEQ ID NO: 1795154 - RNA, 18 nt, Human
cuuaagaauuuugagcag

SEQ ID NO: 1795155 - RNA, 12 nt, Human
cuuaaaaauggu

SEQ ID NO: 1795156 - RNA, 20 nt, Human
cuuagaagucacacaguauu

SEQ ID NO: 1795157 - RNA, 17 nt, Human
cuuagaagucacacagu

SEQ ID NO: 1795158 - RNA, 16 nt, Human
cuuagaaguggaagua

SEQ ID NO: 1795159 - RNA, 16 nt, Human
cuuagaaauugcauuu

SEQ ID NO: 1795160 - RNA, 13 nt, Human
cuuacuguacaug

SEQ ID NO: 1795161 - RNA, 20 nt, Human
cuuagaaaaaccaccaccau

SEQ ID NO: 1795162 - RNA, 20 nt, Human
cuuaccugccaggaagccag

SEQ ID NO: 1795163 - RNA, 14 nt, Human
cuuagucacugaga

SEQ ID NO: 1795164 - RNA, 23 nt, Human
cuuagguuggcaaaaaggcagga

SEQ ID NO: 1795165 - RNA, 21 nt, Human
cuuagguuggcaaaaaggcag

SEQ ID NO: 1795166 - RNA, 18 nt, Human
cuuagaaguuuguuguga

SEQ ID NO: 1795167 - RNA, 19 nt, Human
cuuagaauuaguggcacuu

SEQ ID NO: 1795168 - RNA, 11 nt, Human
cuuagacaguc

SEQ ID NO: 1795169 - RNA, 15 nt, Human
cuucaguaagccgug

SEQ ID NO: 1795170 - RNA, 14 nt, Human
cuucagugccaaaa

SEQ ID NO: 1795171 - RNA, 13 nt, Human
cuuccacaagagc

SEQ ID NO: 1795172 - RNA, 14 nt, Human
cuuccacaagagcc

SEQ ID NO: 1795173 - RNA, 15 nt, Human
cuuccacaagagccc

SEQ ID NO: 1795174 - RNA, 14 nt, Human
cuucagccucccga

SEQ ID NO: 1795175 - RNA, 15 nt, Human
cuucagccugaaaga

SEQ ID NO: 1795176 - RNA, 20 nt, Human
cuucagccucccgaguagcu

SEQ ID NO: 1795177 - RNA, 16 nt, Human
cuucagccucccgagu

SEQ ID NO: 1795178 - RNA, 14 nt, Human
cuucaguaagccgu

SEQ ID NO: 1795179 - RNA, 15 nt, Human
cuucagcugacuuuu

SEQ ID NO: 1795180 - RNA, 19 nt, Human
cuucagcugacuuuucugu

SEQ ID NO: 1795181 - RNA, 23 nt, Human
cuucacauauugauuuccguuaa

SEQ ID NO: 1795182 - RNA, 14 nt, Human
cuucacauauugau

SEQ ID NO: 1795183 - RNA, 21 nt, Human
cuucaaggauccugagccaga

SEQ ID NO: 1795184 - RNA, 22 nt, Human
cuucaaggauccugagccagau

SEQ ID NO: 1795185 - RNA, 23 nt, Human
cuucaaggauccugagccagauu

SEQ ID NO: 1795186 - RNA, 15 nt, Human
cuucaaauauuuccc

SEQ ID NO: 1795187 - RNA, 21 nt, Human
cuuagucacugagacagcccg

SEQ ID NO: 1795188 - RNA, 20 nt, Human
cuuagucacugagacagccc

SEQ ID NO: 1795189 - RNA, 22 nt, Human
cuuagucacugagacagcccgg

SEQ ID NO: 1795190 - RNA, 17 nt, Human
cuucaaggauccugagc

SEQ ID NO: 1795191 - RNA, 18 nt, Human
cuucaaggauccugagcc

SEQ ID NO: 1795192 - RNA, 19 nt, Human
cuucaaggauccugagcca

SEQ ID NO: 1795193 - RNA, 20 nt, Human
cuucaaggauccugagccag

SEQ ID NO: 1795194 - RNA, 20 nt, Human
cuucaacugaccagccucca

SEQ ID NO: 1795195 - RNA, 23 nt, Human
cuucaacugaccagccuccaugc

SEQ ID NO: 1795196 - RNA, 17 nt, Human
cuucaacugaccagccu

SEQ ID NO: 1795197 - RNA, 16 nt, Human
cuucucacugccaugc

SEQ ID NO: 1795198 - RNA, 21 nt, Human
cuucucacugccaugccagcu

SEQ ID NO: 1795199 - RNA, 19 nt, Human
cuucgggaggucgaggcag

SEQ ID NO: 1795200 - RNA, 20 nt, Human
cuucggccuccauccugagg

SEQ ID NO: 1795201 - RNA, 17 nt, Human
cuucgcuccugugucuu

SEQ ID NO: 1795202 - RNA, 15 nt, Human
cuucgccaccugggu

SEQ ID NO: 1795203 - RNA, 14 nt, Human
cuucgccaccuggg

SEQ ID NO: 1795204 - RNA, 21 nt, Human
cuucgauacaccgggccugga

SEQ ID NO: 1795205 - RNA, 16 nt, Human
cuucgauacaccgggc

SEQ ID NO: 1795206 - RNA, 16 nt, Human
cuuccacaagagccca

SEQ ID NO: 1795207 - RNA, 12 nt, Human
cuucccccucca

SEQ ID NO: 1795208 - RNA, 15 nt, Human
cuucccccuccaauc

SEQ ID NO: 1795209 - RNA, 16 nt, Human
cuuccugugacuucag

SEQ ID NO: 1795210 - RNA, 13 nt, Human
cuuccugugacuu

SEQ ID NO: 1795211 - RNA, 21 nt, Human
cugucuuuuuucuaaaguaaa

SEQ ID NO: 1795212 - RNA, 15 nt, Human
cugugaaaggaaaga

SEQ ID NO: 1795213 - RNA, 14 nt, Human
cugucuuaauuuuc

SEQ ID NO: 1795214 - RNA, 18 nt, Human
cugucuucaguaagccgu

SEQ ID NO: 1795215 - RNA, 19 nt, Human
cugucuguuguauucauug

SEQ ID NO: 1795216 - RNA, 18 nt, Human
cugucuguuguauucauu

SEQ ID NO: 1795217 - RNA, 22 nt, Human
cugucauuugagcagggcucag

SEQ ID NO: 1795218 - RNA, 21 nt, Human
cugucauuugagcagggcuca

SEQ ID NO: 1795219 - RNA, 18 nt, Human
cugucaauuacaggaagu

SEQ ID NO: 1795220 - RNA, 23 nt, Human
cugucauuugagcagggcucagc

SEQ ID NO: 1795221 - RNA, 16 nt, Human
cugugaaaggaaagag

SEQ ID NO: 1795222 - RNA, 22 nt, Human
cugugaaaggaaagagggaggu

SEQ ID NO: 1795223 - RNA, 15 nt, Human
cugugauggggcccu

SEQ ID NO: 1795224 - RNA, 23 nt, Human
cugugauggggcccugccuccuu

SEQ ID NO: 1795225 - RNA, 16 nt, Human
cugugauggggcccug

SEQ ID NO: 1795226 - RNA, 21 nt, Human
cugugauggggcccugccucc

SEQ ID NO: 1795227 - RNA, 15 nt, Human
cugugccaugugcca

SEQ ID NO: 1795228 - RNA, 19 nt, Human
cugugcccuaaaguguauu

SEQ ID NO: 1795229 - RNA, 14 nt, Human
cugugccaugugcc

SEQ ID NO: 1795230 - RNA, 22 nt, Human
cuguggguuucuaaagcugcca

SEQ ID NO: 1795231 - RNA, 21 nt, Human
cuguggguuucuaaagcugcc

SEQ ID NO: 1795232 - RNA, 12 nt, Human
cugugccucugc

SEQ ID NO: 1795233 - RNA, 13 nt, Human
cugugccucugcc

SEQ ID NO: 1795234 - RNA, 14 nt, Human
cugugccucugccu

SEQ ID NO: 1795235 - RNA, 15 nt, Human
cugugccucugccug

SEQ ID NO: 1795236 - RNA, 16 nt, Human
cugugccucugccugu

SEQ ID NO: 1795237 - RNA, 17 nt, Human
cugugccucugccuguc

SEQ ID NO: 1795238 - RNA, 14 nt, Human
cuguggaucaaauc

SEQ ID NO: 1795239 - RNA, 24 nt, Human
cuguggaucaaauccagccugcug

SEQ ID NO: 1795240 - RNA, 18 nt, Human
cugugugugcgccuacag

SEQ ID NO: 1795241 - RNA, 20 nt, Human
cugugucuuuuuucacuaca

SEQ ID NO: 1795242 - RNA, 14 nt, Human
cugugugcucagga

SEQ ID NO: 1795243 - RNA, 21 nt, Human
cugggauuacaagcgugagcc

SEQ ID NO: 1795244 - RNA, 18 nt, Human
cugggauuacaggcguga

SEQ ID NO: 1795245 - RNA, 19 nt, Human
cugggccccugccucucug

SEQ ID NO: 1795246 - RNA, 20 nt, Human
cugggccccugccucucugc

SEQ ID NO: 1795247 - RNA, 23 nt, Human
cugggccccugccucucugcagg

SEQ ID NO: 1795248 - RNA, 13 nt, Human
cugggucgcccug

SEQ ID NO: 1795249 - RNA, 20 nt, Human
cuggggguucuuucuuccuc

SEQ ID NO: 1795250 - RNA, 23 nt, Human
cuggggguucuuucuuccucugc

SEQ ID NO: 1795251 - RNA, 15 nt, Human
cugggucgcccugga

SEQ ID NO: 1795252 - RNA, 16 nt, Human
cugggucgcccuggac

SEQ ID NO: 1795253 - RNA, 15 nt, Human
cugggcuucaguggc

SEQ ID NO: 1795254 - RNA, 22 nt, Human
cugggcuuggggaccagagcug

SEQ ID NO: 1795255 - RNA, 18 nt, Human
cugggcuugucuguagau

SEQ ID NO: 1795256 - RNA, 18 nt, Human
cugggggcugggcagagg

SEQ ID NO: 1795257 - RNA, 14 nt, Human
cugggggcugggca

SEQ ID NO: 1795258 - RNA, 16 nt, Human
cugggggccucuucug

SEQ ID NO: 1795259 - RNA, 19 nt, Human
cuguaauccuagcacuuug

SEQ ID NO: 1795260 - RNA, 22 nt, Human
cugguuagagguucccuuugac

SEQ ID NO: 1795261 - RNA, 21 nt, Human
cugguuagagguucccuuuga

SEQ ID NO: 1795262 - RNA, 15 nt, Human
cuguaauuugugaua

SEQ ID NO: 1795263 - RNA, 14 nt, Human
cuguaauuugugau

SEQ ID NO: 1795264 - RNA, 14 nt, Human
cuguacagagccca

SEQ ID NO: 1795265 - RNA, 15 nt, Human
cuguacagagcccac

SEQ ID NO: 1795266 - RNA, 18 nt, Human
cuguacagagcccacgcc

SEQ ID NO: 1795267 - RNA, 22 nt, Human
cuguacagagcccacgccccca

SEQ ID NO: 1795268 - RNA, 21 nt, Human
cugguggcagcucaccucucc

SEQ ID NO: 1795269 - RNA, 18 nt, Human
cugguggcagugggagcu

SEQ ID NO: 1795270 - RNA, 14 nt, Human
cugguggcaguggg

SEQ ID NO: 1795271 - RNA, 15 nt, Human
cugguggcagcugcg

SEQ ID NO: 1795272 - RNA, 20 nt, Human
cugguggcagcucaccucuc

SEQ ID NO: 1795273 - RNA, 17 nt, Human
cugguggcagcucaccu

SEQ ID NO: 1795274 - RNA, 18 nt, Human
cugguggcagcucaccuc

SEQ ID NO: 1795275 - RNA, 18 nt, Human
cuguacgucugacaggca

SEQ ID NO: 1795276 - RNA, 16 nt, Human
cuguacgucugacagg

SEQ ID NO: 1795277 - RNA, 15 nt, Human
cuguacgucugacag

SEQ ID NO: 1795278 - RNA, 14 nt, Human
cuguacgucugaca

SEQ ID NO: 1795279 - RNA, 21 nt, Human
cuguacaugaaaacacauuuu

SEQ ID NO: 1795280 - RNA, 20 nt, Human
cuguacaugaaaacacauuu

SEQ ID NO: 1795281 - RNA, 17 nt, Human
cuguacaugaaaacaca

SEQ ID NO: 1795282 - RNA, 20 nt, Human
cuguacgucugacaggcaau

SEQ ID NO: 1795283 - RNA, 19 nt, Human
cuguacgucugacaggcaa

SEQ ID NO: 1795284 - RNA, 14 nt, Human
cuguacuccuccca

SEQ ID NO: 1795285 - RNA, 15 nt, Human
cuguacuccucccag

SEQ ID NO: 1795286 - RNA, 16 nt, Human
cuguacuccucccagg

SEQ ID NO: 1795287 - RNA, 19 nt, Human
cuguacuccucccaggcgc

SEQ ID NO: 1795288 - RNA, 21 nt, Human
cuguacuccucccaggcgccc

SEQ ID NO: 1795289 - RNA, 20 nt, Human
cuguauuuuguuuuugucuu

SEQ ID NO: 1795290 - RNA, 15 nt, Human
cugucaauuacagga

SEQ ID NO: 1795291 - RNA, 16 nt, Human
cugucaauuacaggaa

SEQ ID NO: 1795292 - RNA, 20 nt, Human
cuguaucccaugagccucag

SEQ ID NO: 1795293 - RNA, 22 nt, Human
cuguaucccaugagccucagca

SEQ ID NO: 1795294 - RNA, 21 nt, Human
cuguaucccaugagccucagc

SEQ ID NO: 1795295 - RNA, 17 nt, Human
cuguauuagucacagag

SEQ ID NO: 1795296 - RNA, 19 nt, Human
cuguauuagucacagagau

SEQ ID NO: 1795297 - RNA, 18 nt, Human
ccuauauuguuuucagug

SEQ ID NO: 1795298 - RNA, 22 nt, Human
ccuauauuguuuucaguguaca

SEQ ID NO: 1795299 - RNA, 13 nt, Human
ccuaguuccacca

SEQ ID NO: 1795300 - RNA, 21 nt, Human
ccuaguuccaccaucaagcca

SEQ ID NO: 1795301 - RNA, 23 nt, Human
ccuaguuccaccaucaagccacc

SEQ ID NO: 1795302 - RNA, 13 nt, Human
ccuacuuccugug

SEQ ID NO: 1795303 - RNA, 21 nt, Human
ccuacuuccccuuccuaauuc

SEQ ID NO: 1795304 - RNA, 15 nt, Human
ccuacuuccugugac

SEQ ID NO: 1795305 - RNA, 22 nt, Human
ccuaccgagucucuucuccacu

SEQ ID NO: 1795306 - RNA, 23 nt, Human
ccuaccgagucucuucuccacug

SEQ ID NO: 1795307 - RNA, 15 nt, Human
ccuaaaauucagugg

SEQ ID NO: 1795308 - RNA, 16 nt, Human
ccuaaauauauuuuaa

SEQ ID NO: 1795309 - RNA, 18 nt, Human
ccuaaauauauuuuaaga

SEQ ID NO: 1795310 - RNA, 15 nt, Human
ccuacaagacacagu

SEQ ID NO: 1795311 - RNA, 18 nt, Human
ccgggaccccgagccugg

SEQ ID NO: 1795312 - RNA, 20 nt, Human
ccgggcgcgguggcucacgc

SEQ ID NO: 1795313 - RNA, 16 nt, Human
ccgggcguggugguga

SEQ ID NO: 1795314 - RNA, 13 nt, Human
ccgggcugggagc

SEQ ID NO: 1795315 - RNA, 18 nt, Human
ccgggcugggagcucugc

SEQ ID NO: 1795316 - RNA, 19 nt, Human
ccgggcugggagcucugca

SEQ ID NO: 1795317 - RNA, 22 nt, Human
ccgggcucugccucccaucacc

SEQ ID NO: 1795318 - RNA, 13 nt, Human
ccgggcucugccu

SEQ ID NO: 1795319 - RNA, 12 nt, Human
ccgcuuucuacc

SEQ ID NO: 1795320 - RNA, 15 nt, Human
ccgcucagcccuccc

SEQ ID NO: 1795321 - RNA, 19 nt, Human
ccgcucagcccucccugcc

SEQ ID NO: 1795322 - RNA, 21 nt, Human
ccgcucagcccucccugcccc

SEQ ID NO: 1795323 - RNA, 22 nt, Human
ccgcucagcccucccugccccu

SEQ ID NO: 1795324 - RNA, 23 nt, Human
ccgcuuucuacccagcgagcccu

SEQ ID NO: 1795325 - RNA, 15 nt, Human
ccggcuggccuggcc

SEQ ID NO: 1795326 - RNA, 19 nt, Human
ccgcuuucuacccagcgag

SEQ ID NO: 1795327 - RNA, 17 nt, Human
ccggcuggccuggcccc

SEQ ID NO: 1795328 - RNA, 18 nt, Human
ccggcuggccuggccccu

SEQ ID NO: 1795329 - RNA, 20 nt, Human
ccgggaagggggcugggaca

SEQ ID NO: 1795330 - RNA, 17 nt, Human
ccgggaccccgagccug

SEQ ID NO: 1795331 - RNA, 14 nt, Human
ccgcacugggcuug

SEQ ID NO: 1795332 - RNA, 19 nt, Human
ccgcacugggcuuggggac

SEQ ID NO: 1795333 - RNA, 21 nt, Human
ccgcuaagagggagggagggc

SEQ ID NO: 1795334 - RNA, 11 nt, Human
ccgcucagccc

SEQ ID NO: 1795335 - RNA, 12 nt, Human
ccgcucagcccu

SEQ ID NO: 1795336 - RNA, 13 nt, Human
ccgcucagcccuc

SEQ ID NO: 1795337 - RNA, 23 nt, Human
ccgcuaagagggagggagggcuc

SEQ ID NO: 1795338 - RNA, 17 nt, Human
ccgaguagcugggacua

SEQ ID NO: 1795339 - RNA, 17 nt, Human
ccgaggccuucucugaa

SEQ ID NO: 1795340 - RNA, 20 nt, Human
ccgaguagcugggacuacag

SEQ ID NO: 1795341 - RNA, 14 nt, Human
ccgaggccuucucu

SEQ ID NO: 1795342 - RNA, 18 nt, Human
cccugguuuccugcccug

SEQ ID NO: 1795343 - RNA, 19 nt, Human
cccugguuuccugcccugg

SEQ ID NO: 1795344 - RNA, 20 nt, Human
cccugguggcagcucaccuc

SEQ ID NO: 1795345 - RNA, 16 nt, Human
cccugguuuccugccc

SEQ ID NO: 1795346 - RNA, 17 nt, Human
cccugguuuccugcccu

SEQ ID NO: 1795347 - RNA, 16 nt, Human
ccucccaaagugcugg

SEQ ID NO: 1795348 - RNA, 15 nt, Human
ccucccaaagugcug

SEQ ID NO: 1795349 - RNA, 15 nt, Human
ccuccaugcugccuc

SEQ ID NO: 1795350 - RNA, 23 nt, Human
ccuccaugugggcuaguugggcu

SEQ ID NO: 1795351 - RNA, 14 nt, Human
ccuccaugcugccu

SEQ ID NO: 1795352 - RNA, 18 nt, Human
ccuccaucuaaacugccc

SEQ ID NO: 1795353 - RNA, 22 nt, Human
ccuccaggugcacaagcuccaa

SEQ ID NO: 1795354 - RNA, 19 nt, Human
ccuccaggugcacaagcuc

SEQ ID NO: 1795355 - RNA, 21 nt, Human
ccuccaggugcacaagcucca

SEQ ID NO: 1795356 - RNA, 22 nt, Human
ccucauaguaugguggcugggu

SEQ ID NO: 1795357 - RNA, 21 nt, Human
ccucauaguaugguggcuggg

SEQ ID NO: 1795358 - RNA, 13 nt, Human
ccucaucaccaac

SEQ ID NO: 1795359 - RNA, 14 nt, Human
ccucaucaccaacg

SEQ ID NO: 1795360 - RNA, 20 nt, Human
ccucauaguaugguggcugg

SEQ ID NO: 1795361 - RNA, 21 nt, Human
ccucauagcccucacccuggg

SEQ ID NO: 1795362 - RNA, 22 nt, Human
ccucauagcccucacccugggg

SEQ ID NO: 1795363 - RNA, 17 nt, Human
ccucauagcccucaccc

SEQ ID NO: 1795364 - RNA, 18 nt, Human
ccucauagcccucacccu

SEQ ID NO: 1795365 - RNA, 13 nt, Human
ccucauacccacc

SEQ ID NO: 1795366 - RNA, 11 nt, Human
ccucagugcca

SEQ ID NO: 1795367 - RNA, 20 nt, Human
ccucagucuggcccuuccuu

SEQ ID NO: 1795368 - RNA, 19 nt, Human
ccucagucuggcccuuccu

SEQ ID NO: 1795369 - RNA, 19 nt, Human
ccuaugcagagguccacaa

SEQ ID NO: 1795370 - RNA, 21 nt, Human
ccucaucuccccaucauuggu

SEQ ID NO: 1795371 - RNA, 13 nt, Human
ccucauccucaua

SEQ ID NO: 1795372 - RNA, 20 nt, Human
ccucauccucauacccaccc

SEQ ID NO: 1795373 - RNA, 23 nt, Human
ccuccaaucccaccaacccucag

SEQ ID NO: 1795374 - RNA, 21 nt, Human
ccucccgaguagcugggacua

SEQ ID NO: 1795375 - RNA, 20 nt, Human
ccucccgaguagcugggacu

SEQ ID NO: 1795376 - RNA, 22 nt, Human
ccucccugccccucccuucaac

SEQ ID NO: 1795377 - RNA, 24 nt, Human
ccucccugccccucccuucaacca

SEQ ID NO: 1795378 - RNA, 14 nt, Human
ccuccucagaucuu

SEQ ID NO: 1795379 - RNA, 18 nt, Human
ccucccugccccucccuu

SEQ ID NO: 1795380 - RNA, 21 nt, Human
ccucccugccccucccuucaa

SEQ ID NO: 1795381 - RNA, 10 nt, Human
ccucccuccc

SEQ ID NO: 1795382 - RNA, 14 nt, Human
ccuccugggcuaag

SEQ ID NO: 1795383 - RNA, 23 nt, Human
ccuccugccucgaacuggcugca

SEQ ID NO: 1795384 - RNA, 18 nt, Human
ccucgguguggagaagcg

SEQ ID NO: 1795385 - RNA, 16 nt, Human
ccucggugccuuccuc

SEQ ID NO: 1795386 - RNA, 14 nt, Human
ccucgguguggaga

SEQ ID NO: 1795387 - RNA, 16 nt, Human
ccucuaggaggucucu

SEQ ID NO: 1795388 - RNA, 17 nt, Human
ccucccgaauagcuggg

SEQ ID NO: 1795389 - RNA, 20 nt, Human
cccugcuuugggcugcccug

SEQ ID NO: 1795390 - RNA, 22 nt, Human
cccugcuuugggcugcccuggu

SEQ ID NO: 1795391 - RNA, 18 nt, Human
cccugcuuugggcugccc

SEQ ID NO: 1795392 - RNA, 19 nt, Human
cccugcuuugggcugcccu

SEQ ID NO: 1795393 - RNA, 17 nt, Human
cccugcuuugggcugcc

SEQ ID NO: 1795394 - RNA, 22 nt, Human
cccugcuggguguggcgcagca

SEQ ID NO: 1795395 - RNA, 18 nt, Human
cccugcccaccuggccuc

SEQ ID NO: 1795396 - RNA, 16 nt, Human
cccugcuggguguggc

SEQ ID NO: 1795397 - RNA, 21 nt, Human
cccugcuggguguggcgcagc

SEQ ID NO: 1795398 - RNA, 13 nt, Human
cccugcccaccug

SEQ ID NO: 1795399 - RNA, 14 nt, Human
cccugcccaccugg

SEQ ID NO: 1795400 - RNA, 17 nt, Human
cccugcccaccuggccu

SEQ ID NO: 1795401 - RNA, 19 nt, Human
cccuggcuuuucacugcug

SEQ ID NO: 1795402 - RNA, 22 nt, Human
cccuggcuuuucacugcuggcu

SEQ ID NO: 1795403 - RNA, 18 nt, Human
cccugggaggcagugaug

SEQ ID NO: 1795404 - RNA, 18 nt, Human
cccuggcuuuucacugcu

SEQ ID NO: 1795405 - RNA, 15 nt, Human
cccuggacugugugc

SEQ ID NO: 1795406 - RNA, 15 nt, Human
cccugggaggcucug

SEQ ID NO: 1795407 - RNA, 15 nt, Human
cccugguggcagcuc

SEQ ID NO: 1795408 - RNA, 16 nt, Human
cccugguggcagcuca

SEQ ID NO: 1795409 - RNA, 17 nt, Human
cccugguggcagcucac

SEQ ID NO: 1795410 - RNA, 16 nt, Human
cccucuggggcuguuc

SEQ ID NO: 1795411 - RNA, 15 nt, Human
cccugaaagcccuga

SEQ ID NO: 1795412 - RNA, 13 nt, Human
cccugaggcccag

SEQ ID NO: 1795413 - RNA, 16 nt, Human
cccugaaagcccugag

SEQ ID NO: 1795414 - RNA, 14 nt, Human
cccugaggcccaga

SEQ ID NO: 1795415 - RNA, 15 nt, Human
cccugaggcccagag

SEQ ID NO: 1795416 - RNA, 16 nt, Human
cccugaggcccagagg

SEQ ID NO: 1795417 - RNA, 17 nt, Human
cccugaggcccagaggg

SEQ ID NO: 1795418 - RNA, 18 nt, Human
cccugaggcccagagggc

SEQ ID NO: 1795419 - RNA, 19 nt, Human
cccugaggcccagagggcc

SEQ ID NO: 1795420 - RNA, 20 nt, Human
cccugaggcccagagggccu

SEQ ID NO: 1795421 - RNA, 23 nt, Human
cccugaggcccagagggccugca

SEQ ID NO: 1795422 - RNA, 12 nt, Human
cccugcacuugc

SEQ ID NO: 1795423 - RNA, 19 nt, Human
cccugcacuugcagacucu

SEQ ID NO: 1795424 - RNA, 22 nt, Human
cccugcacuugcagacucuaca

SEQ ID NO: 1795425 - RNA, 16 nt, Human
cccugcaaagcccagc

SEQ ID NO: 1795426 - RNA, 17 nt, Human
cccugcaaagcccagcu

SEQ ID NO: 1795427 - RNA, 19 nt, Human
cccugcaaagcccagcuug

SEQ ID NO: 1795428 - RNA, 20 nt, Human
cccugcaaagcccagcuuga

SEQ ID NO: 1795429 - RNA, 23 nt, Human
cccugcacaaagcccuuccaugu

SEQ ID NO: 1795430 - RNA, 15 nt, Human
cccugcaaagcccag

SEQ ID NO: 1795431 - RNA, 18 nt, Human
cccggugcccaagaauag

SEQ ID NO: 1795432 - RNA, 16 nt, Human
cccgggcucugccucc

SEQ ID NO: 1795433 - RNA, 17 nt, Human
cccgucgacguagaacc

SEQ ID NO: 1795434 - RNA, 22 nt, Human
cccgucucugguuccuccccuc

SEQ ID NO: 1795435 - RNA, 15 nt, Human
cccgugggguuccuc

SEQ ID NO: 1795436 - RNA, 21 nt, Human
cccuaccgagucucuucucca

SEQ ID NO: 1795437 - RNA, 18 nt, Human
cccuaccgagucucuucu

SEQ ID NO: 1795438 - RNA, 21 nt, Human
cccuaaugcgcaggcuggccc

SEQ ID NO: 1795439 - RNA, 22 nt, Human
cccuaaugcgcaggcuggcccu

SEQ ID NO: 1795440 - RNA, 17 nt, Human
cccuaaugcgcaggcug

SEQ ID NO: 1795441 - RNA, 23 nt, Human
cccuaaugcgcaggcuggcccug

SEQ ID NO: 1795442 - RNA, 20 nt, Human
cccuacaguugaaaaacagc

SEQ ID NO: 1795443 - RNA, 22 nt, Human
cccgaguagcugggacuacagg

SEQ ID NO: 1795444 - RNA, 19 nt, Human
cccgcugucagccauuccu

SEQ ID NO: 1795445 - RNA, 20 nt, Human
cccgcugucagccauuccug

SEQ ID NO: 1795446 - RNA, 12 nt, Human
cccgggcucugc

SEQ ID NO: 1795447 - RNA, 14 nt, Human
cccgggcucugccu

SEQ ID NO: 1795448 - RNA, 15 nt, Human
cccgggcucugccuc

SEQ ID NO: 1795449 - RNA, 21 nt, Human
cccgaguagcugggacuacag

SEQ ID NO: 1795450 - RNA, 18 nt, Human
cccgaguagcugggacua

SEQ ID NO: 1795451 - RNA, 17 nt, Human
cccgaguagcugggacu

SEQ ID NO: 1795452 - RNA, 16 nt, Human
cccgaguagcugggac

SEQ ID NO: 1795453 - RNA, 15 nt, Human
cccgaguagcuggga

SEQ ID NO: 1795454 - RNA, 14 nt, Human
cccgaguagcuggg

SEQ ID NO: 1795455 - RNA, 13 nt, Human
cccgaguagcugg

SEQ ID NO: 1795456 - RNA, 21 nt, Human
cccgaggccuucucugaagga

SEQ ID NO: 1795457 - RNA, 15 nt, Human
cccagagggccugca

SEQ ID NO: 1795458 - RNA, 14 nt, Human
cccagagggccugc

SEQ ID NO: 1795459 - RNA, 20 nt, Human
cccacaagaaaugaaagcag

SEQ ID NO: 1795460 - RNA, 16 nt, Human
cccaaugcacuuuguu

SEQ ID NO: 1795461 - RNA, 20 nt, Human
cccaaugcacuuuguucugg

SEQ ID NO: 1795462 - RNA, 23 nt, Human
cccaaugcacuuuguucuggcuc

SEQ ID NO: 1795463 - RNA, 13 nt, Human
cccacaagaaaug

SEQ ID NO: 1795464 - RNA, 19 nt, Human
cccacagcgcuggccggga

SEQ ID NO: 1795465 - RNA, 17 nt, Human
cccaccuggccucugca

SEQ ID NO: 1795466 - RNA, 19 nt, Human
cccaccuggccucugcacu

SEQ ID NO: 1795467 - RNA, 21 nt, Human
cccaccuggccucugcacucc

SEQ ID NO: 1795468 - RNA, 20 nt, Human
cccacgacugcccggcaggg

SEQ ID NO: 1795469 - RNA, 21 nt, Human
cccacgacugcccggcagggu

SEQ ID NO: 1795470 - RNA, 16 nt, Human
cccaccuggccucugc

SEQ ID NO: 1795471 - RNA, 12 nt, Human
cccacuucugcc

SEQ ID NO: 1795472 - RNA, 23 nt, Human
cccacuugagaauuacccuuuug

SEQ ID NO: 1795473 - RNA, 21 nt, Human
cccacgcuggagugcagugag

SEQ ID NO: 1795474 - RNA, 20 nt, Human
cccacgcuggagugcaguga

SEQ ID NO: 1795475 - RNA, 19 nt, Human
cccacgcuggagugcagug

SEQ ID NO: 1795476 - RNA, 18 nt, Human
cccaccaucaugucuggc

SEQ ID NO: 1795477 - RNA, 19 nt, Human
cccaccgcagacaggacca

SEQ ID NO: 1795478 - RNA, 20 nt, Human
cccaccgcagacaggaccag

SEQ ID NO: 1795479 - RNA, 23 nt, Human
cccaccgggcugggagcucugca

SEQ ID NO: 1795480 - RNA, 22 nt, Human
cccaccucucucacuccuugaa

SEQ ID NO: 1795481 - RNA, 14 nt, Human
cgaauagcugggac

SEQ ID NO: 1795482 - RNA, 13 nt, Human
cgaauagcuggga

SEQ ID NO: 1795483 - RNA, 17 nt, Human
cgagaucacgccacugc

SEQ ID NO: 1795484 - RNA, 18 nt, Human
cgagauagccaaggccaa

SEQ ID NO: 1795485 - RNA, 20 nt, Human
cgagauugcaccacugcacu

SEQ ID NO: 1795486 - RNA, 20 nt, Human
cgagaucacgccacugcacu

SEQ ID NO: 1795487 - RNA, 18 nt, Human
cgagaucacgccacugca

SEQ ID NO: 1795488 - RNA, 14 nt, Human
cgagcaugccugga

SEQ ID NO: 1795489 - RNA, 13 nt, Human
cgagcaugccugg

SEQ ID NO: 1795490 - RNA, 16 nt, Human
cgagcaugccuggaug

SEQ ID NO: 1795491 - RNA, 17 nt, Human
cgagcaugccuggaugg

SEQ ID NO: 1795492 - RNA, 20 nt, Human
cgagcaggcuucuucccccc

SEQ ID NO: 1795493 - RNA, 23 nt, Human
ccuuugacgccaucccagcccca

SEQ ID NO: 1795494 - RNA, 22 nt, Human
ccuuugacgccaucccagcccc

SEQ ID NO: 1795495 - RNA, 20 nt, Human
ccuuugacgccaucccagcc

SEQ ID NO: 1795496 - RNA, 21 nt, Human
ccuuugacgccaucccagccc

SEQ ID NO: 1795497 - RNA, 15 nt, Human
cgaaaacguggcugc

SEQ ID NO: 1795498 - RNA, 18 nt, Human
cgaaaacguggcugcuuc

SEQ ID NO: 1795499 - RNA, 19 nt, Human
cgaaaacguggcugcuuca

SEQ ID NO: 1795500 - RNA, 20 nt, Human
cgaaaacguggcugcuucaa

SEQ ID NO: 1795501 - RNA, 14 nt, Human
cgaacuggcugcaa

SEQ ID NO: 1795502 - RNA, 12 nt, Human
cgaacuggcugc

SEQ ID NO: 1795503 - RNA, 14 nt, Human
cgaacuccugaccu

SEQ ID NO: 1795504 - RNA, 19 nt, Human
cgaaagggacuuggaagcu

SEQ ID NO: 1795505 - RNA, 20 nt, Human
cgaaaggaugaaagugacca

SEQ ID NO: 1795506 - RNA, 22 nt, Human
cgaaagggacuuggaagcuccg

SEQ ID NO: 1795507 - RNA, 21 nt, Human
cgaaagaacaguccauugaaa

SEQ ID NO: 1795508 - RNA, 12 nt, Human
cgaaagaacagu

SEQ ID NO: 1795509 - RNA, 10 nt, Human
cgcagcccug

SEQ ID NO: 1795510 - RNA, 14 nt, Human
cgcagcccugcaga

SEQ ID NO: 1795511 - RNA, 15 nt, Human
cgcagacaggaccag

SEQ ID NO: 1795512 - RNA, 16 nt, Human
cgcagacaggaccagg

SEQ ID NO: 1795513 - RNA, 22 nt, Human
cgccaggggaaaaucagccugc

SEQ ID NO: 1795514 - RNA, 19 nt, Human
cgccagauucuuuccugag

SEQ ID NO: 1795515 - RNA, 20 nt, Human
cgccagauucuuuccugagg

SEQ ID NO: 1795516 - RNA, 21 nt, Human
cgccagauucuuuccugaggc

SEQ ID NO: 1795517 - RNA, 16 nt, Human
cgagcccugguggcag

SEQ ID NO: 1795518 - RNA, 15 nt, Human
cgagcccugguggca

SEQ ID NO: 1795519 - RNA, 18 nt, Human
cgagcaugccuggauggg

SEQ ID NO: 1795520 - RNA, 18 nt, Human
cgagcccugguggcagug

SEQ ID NO: 1795521 - RNA, 20 nt, Human
cgauuucuguuuagauaaua

SEQ ID NO: 1795522 - RNA, 17 nt, Human
cgccaugcuccuggccc

SEQ ID NO: 1795523 - RNA, 13 nt, Human
ccuugacucuuuc

SEQ ID NO: 1795524 - RNA, 23 nt, Human
ccuugaccauucuccaccugcca

SEQ ID NO: 1795525 - RNA, 20 nt, Human
ccuugaguugauucagcucu

SEQ ID NO: 1795526 - RNA, 13 nt, Human
ccuugaacuagga

SEQ ID NO: 1795527 - RNA, 20 nt, Human
ccuugaaaacuuuaugcuaa

SEQ ID NO: 1795528 - RNA, 16 nt, Human
ccuucggccuccaucc

SEQ ID NO: 1795529 - RNA, 15 nt, Human
ccuucggcgccuuaa

SEQ ID NO: 1795530 - RNA, 15 nt, Human
ccuucuccuucaccu

SEQ ID NO: 1795531 - RNA, 19 nt, Human
ccuucuccuucaccuuugu

SEQ ID NO: 1795532 - RNA, 21 nt, Human
ccuucuguggcucacagaacc

SEQ ID NO: 1795533 - RNA, 14 nt, Human
ccuucuguggcuca

SEQ ID NO: 1795534 - RNA, 16 nt, Human
ccuuugacgccauccc

SEQ ID NO: 1795535 - RNA, 17 nt, Human
ccuuugacgccauccca

SEQ ID NO: 1795536 - RNA, 18 nt, Human
ccuuugacgccaucccag

SEQ ID NO: 1795537 - RNA, 12 nt, Human
ccuugggacccc

SEQ ID NO: 1795538 - RNA, 22 nt, Human
ccuuggugucgggcaugacacg

SEQ ID NO: 1795539 - RNA, 21 nt, Human
ccuugguuaggcauuguggga

SEQ ID NO: 1795540 - RNA, 22 nt, Human
ccuugguuaggcauugugggaa

SEQ ID NO: 1795541 - RNA, 15 nt, Human
ccuuccucugagccu

SEQ ID NO: 1795542 - RNA, 16 nt, Human
ccuuccucugagccuu

SEQ ID NO: 1795543 - RNA, 21 nt, Human
ccuuccucuccacugccuucg

SEQ ID NO: 1795544 - RNA, 20 nt, Human
ccuuccucugagccuuggga

SEQ ID NO: 1795545 - RNA, 13 nt, Human
ccuuccucugagg

SEQ ID NO: 1795546 - RNA, 14 nt, Human
ccuuccucugaggc

SEQ ID NO: 1795547 - RNA, 22 nt, Human
ccuucauuuggcauuccccacu

SEQ ID NO: 1795548 - RNA, 20 nt, Human
ccuucggccuccauccugag

SEQ ID NO: 1795549 - RNA, 19 nt, Human
ccuucggccuccauccuga

SEQ ID NO: 1795550 - RNA, 14 nt, Human
ccuucggccuccau

SEQ ID NO: 1795551 - RNA, 14 nt, Human
ccuucacuuaggaa

SEQ ID NO: 1795552 - RNA, 21 nt, Human
ccuucaccuuuguccccaccg

SEQ ID NO: 1795553 - RNA, 14 nt, Human
ccuuagacaguccc

SEQ ID NO: 1795554 - RNA, 17 nt, Human
ccuucacagaugggugc

SEQ ID NO: 1795555 - RNA, 19 nt, Human
ccuucaccuuuguccccac

SEQ ID NO: 1795556 - RNA, 20 nt, Human
ccuucaccuuuguccccacc

SEQ ID NO: 1795557 - RNA, 11 nt, Human
ccuucagugcc

SEQ ID NO: 1795558 - RNA, 19 nt, Human
ccuucauuuggcauucccc

SEQ ID NO: 1795559 - RNA, 14 nt, Human
ccuucagugccaaa

SEQ ID NO: 1795560 - RNA, 12 nt, Human
ccuucagccuga

SEQ ID NO: 1795561 - RNA, 23 nt, Human
ccuguugggccaggagccuccug

SEQ ID NO: 1795562 - RNA, 12 nt, Human
ccuguuuaagag

SEQ ID NO: 1795563 - RNA, 15 nt, Human
ccuguuuaagagaca

SEQ ID NO: 1795564 - RNA, 14 nt, Human
ccuguuuguuucug

SEQ ID NO: 1795565 - RNA, 18 nt, Human
ccuguuuguuucugaaag

SEQ ID NO: 1795566 - RNA, 16 nt, Human
ccuguuucugcagcca

SEQ ID NO: 1795567 - RNA, 18 nt, Human
ccuguuucagaggcucag

SEQ ID NO: 1795568 - RNA, 21 nt, Human
ccugugucuugcaauggcagc

SEQ ID NO: 1795569 - RNA, 19 nt, Human
ccugugucuugcaauggca

SEQ ID NO: 1795570 - RNA, 17 nt, Human
ccugugucuugcaaugg

SEQ ID NO: 1795571 - RNA, 22 nt, Human
ccugugucuugcaauggcagcc

SEQ ID NO: 1795572 - RNA, 21 nt, Human
ccugugugugcgccuacagga

SEQ ID NO: 1795573 - RNA, 20 nt, Human
ccugugugugcgccuacagg

SEQ ID NO: 1795574 - RNA, 14 nt, Human
ccuuacacaauggu

SEQ ID NO: 1795575 - RNA, 20 nt, Human
ccuuacacaaugguuuucuu

SEQ ID NO: 1795576 - RNA, 17 nt, Human
ccuuaccacugcucuga

SEQ ID NO: 1795577 - RNA, 13 nt, Human
ccuuaccagcaga

SEQ ID NO: 1795578 - RNA, 15 nt, Human
ccuuacccucauguu

SEQ ID NO: 1795579 - RNA, 20 nt, Human
ccuuaccacugcucugauga

SEQ ID NO: 1795580 - RNA, 20 nt, Human
ccuuaccagcagagcaccuu

SEQ ID NO: 1795581 - RNA, 18 nt, Human
ccuuagaagucacacagu

SEQ ID NO: 1795582 - RNA, 14 nt, Human
ccuuagaaguggaa

SEQ ID NO: 1795583 - RNA, 17 nt, Human
ccuuagaagucacacag

SEQ ID NO: 1795584 - RNA, 19 nt, Human
ccuuacccucauguucuua

SEQ ID NO: 1795585 - RNA, 19 nt, Human
ccuuaccugccaggaagcc

SEQ ID NO: 1795586 - RNA, 12 nt, Human
ccuucagugccu

SEQ ID NO: 1795587 - RNA, 18 nt, Human
ccugcgggucacaggagg

SEQ ID NO: 1795588 - RNA, 22 nt, Human
ccugcgggucacaggagggagg

SEQ ID NO: 1795589 - RNA, 16 nt, Human
ccugcggugcuaucuc

SEQ ID NO: 1795590 - RNA, 17 nt, Human
ccugcggugcuaucucc

SEQ ID NO: 1795591 - RNA, 22 nt, Human
ccugccccucaacucuccucca

SEQ ID NO: 1795592 - RNA, 11 nt, Human
ccugccucagc

SEQ ID NO: 1795593 - RNA, 23 nt, Human
ccugccuguugggccaggagccu

SEQ ID NO: 1795594 - RNA, 20 nt, Human
ccugcuuugggcugcccugg

SEQ ID NO: 1795595 - RNA, 19 nt, Human
ccugcuuugggcugcccug

SEQ ID NO: 1795596 - RNA, 21 nt, Human
ccugcuuugggcugcccuggu

SEQ ID NO: 1795597 - RNA, 22 nt, Human
ccugcuuugggcugcccuggug

SEQ ID NO: 1795598 - RNA, 23 nt, Human
ccugcuuugggcugcccuggugc

SEQ ID NO: 1795599 - RNA, 15 nt, Human
ccugcugagucccag

SEQ ID NO: 1795600 - RNA, 14 nt, Human
ccugcuucaaauau

SEQ ID NO: 1795601 - RNA, 22 nt, Human
ccugcucuccgaccagacaccu

SEQ ID NO: 1795602 - RNA, 16 nt, Human
ccugcucuccucuugc

SEQ ID NO: 1795603 - RNA, 18 nt, Human
ccugcucuccucuugcca

SEQ ID NO: 1795604 - RNA, 19 nt, Human
ccugcucuccucuugccac

SEQ ID NO: 1795605 - RNA, 21 nt, Human
ccugcucuccucuugccacug

SEQ ID NO: 1795606 - RNA, 22 nt, Human
ccugcucuccucuugccacugc

SEQ ID NO: 1795607 - RNA, 21 nt, Human
ccugcucuccgaccagacacc

SEQ ID NO: 1795608 - RNA, 22 nt, Human
ccugcggugcuaucucccccag

SEQ ID NO: 1795609 - RNA, 22 nt, Human
ccuggucacaggacucugccuc

SEQ ID NO: 1795610 - RNA, 23 nt, Human
ccuggucacaggacucugccucc

SEQ ID NO: 1795611 - RNA, 21 nt, Human
ccuggucacaggacucugccu

SEQ ID NO: 1795612 - RNA, 18 nt, Human
ccuggggguucuuucuuc

SEQ ID NO: 1795613 - RNA, 21 nt, Human
ccuggggguucuuucuuccuc

SEQ ID NO: 1795614 - RNA, 22 nt, Human
ccuggggguucuuucuuccucu

SEQ ID NO: 1795615 - RNA, 23 nt, Human
ccuggggguucuuucuuccucug

SEQ ID NO: 1795616 - RNA, 20 nt, Human
ccuggcuuuucacugcuggc

SEQ ID NO: 1795617 - RNA, 18 nt, Human
ccuggcuuuucacugcug

SEQ ID NO: 1795618 - RNA, 21 nt, Human
ccuggcuuuucacugcuggcu

SEQ ID NO: 1795619 - RNA, 22 nt, Human
ccuggcuuuucacugcuggcug

SEQ ID NO: 1795620 - RNA, 23 nt, Human
ccuggcuuuucacugcuggcugc

SEQ ID NO: 1795621 - RNA, 24 nt, Human
ccuggcuuuucacugcuggcugcc

SEQ ID NO: 1795622 - RNA, 15 nt, Human
ccuggccagaugcac

SEQ ID NO: 1795623 - RNA, 21 nt, Human
ccuggcagccgugccuucagc

SEQ ID NO: 1795624 - RNA, 22 nt, Human
ccuggcagccgugccuucagcu

SEQ ID NO: 1795625 - RNA, 23 nt, Human
ccuggcucccacaggcccuuccu

SEQ ID NO: 1795626 - RNA, 17 nt, Human
ccuggcucccacaggcc

SEQ ID NO: 1795627 - RNA, 22 nt, Human
ccuggcuccaaacccucgaggc

SEQ ID NO: 1795628 - RNA, 23 nt, Human
ccuggcacccggccccugcuggu

SEQ ID NO: 1795629 - RNA, 22 nt, Human
ccuggcacuauaauguaagcuc

SEQ ID NO: 1795630 - RNA, 22 nt, Human
ccuggcacccggccccugcugg

SEQ ID NO: 1795631 - RNA, 12 nt, Human
ccuggcagcccc

SEQ ID NO: 1795632 - RNA, 14 nt, Human
ccuggcagccccug

SEQ ID NO: 1795633 - RNA, 13 nt, Human
ccuggcagccccu

SEQ ID NO: 1795634 - RNA, 18 nt, Human
ccuggaauauauaaccag

SEQ ID NO: 1795635 - RNA, 16 nt, Human
ccugacagaaggacuc

SEQ ID NO: 1795636 - RNA, 16 nt, Human
ccugagcuuucugcua

SEQ ID NO: 1795637 - RNA, 21 nt, Human
ccugaggcccagagggccugc

SEQ ID NO: 1795638 - RNA, 12 nt, Human
ccugagccagau

SEQ ID NO: 1795639 - RNA, 14 nt, Human
ccugagcuuucugc

SEQ ID NO: 1795640 - RNA, 11 nt, Human
ccugagcccca

SEQ ID NO: 1795641 - RNA, 22 nt, Human
ccugcaaccugauugugucucu

SEQ ID NO: 1795642 - RNA, 21 nt, Human
ccugcaaccugauugugucuc

SEQ ID NO: 1795643 - RNA, 17 nt, Human
ccugauugugucucuug

SEQ ID NO: 1795644 - RNA, 19 nt, Human
ccugauugugucucuuggu

SEQ ID NO: 1795645 - RNA, 11 nt, Human
ccugaggcccu

SEQ ID NO: 1795646 - RNA, 12 nt, Human
ccugaggcccuu

SEQ ID NO: 1795647 - RNA, 19 nt, Human
ccugaugcuucuucagaga

SEQ ID NO: 1795648 - RNA, 20 nt, Human
ccugaugcuucuucagagac

SEQ ID NO: 1795649 - RNA, 21 nt, Human
ccugaugcuucuucagagacu

SEQ ID NO: 1795650 - RNA, 22 nt, Human
ccugaugcuucuucagagacuc

SEQ ID NO: 1795651 - RNA, 14 nt, Human
ccugaggcccuucu

SEQ ID NO: 1795652 - RNA, 15 nt, Human
ccugauugugucucu

SEQ ID NO: 1795653 - RNA, 15 nt, Human
ccugcagggccaagc

SEQ ID NO: 1795654 - RNA, 18 nt, Human
ccugcaguacuuuaccuc

SEQ ID NO: 1795655 - RNA, 20 nt, Human
ccugcaguacuuuaccuccu

SEQ ID NO: 1795656 - RNA, 14 nt, Human
ccugcaagaacaag

SEQ ID NO: 1795657 - RNA, 13 nt, Human
ccugccaggaagc

SEQ ID NO: 1795658 - RNA, 14 nt, Human
ccugccaggaagcc

SEQ ID NO: 1795659 - RNA, 15 nt, Human
ccugccaggaagcca

SEQ ID NO: 1795660 - RNA, 17 nt, Human
ccugccaggaagccagc

SEQ ID NO: 1795661 - RNA, 22 nt, Human
ccugccagggacagagggggug

SEQ ID NO: 1795662 - RNA, 16 nt, Human
ccugccagggacagag

SEQ ID NO: 1795663 - RNA, 12 nt, Human
ccugccagggac

SEQ ID NO: 1795664 - RNA, 13 nt, Human
ccugccagggaca

SEQ ID NO: 1795665 - RNA, 14 nt, Human
ccugccagggacag

SEQ ID NO: 1795666 - RNA, 15 nt, Human
ccugccagggacaga

SEQ ID NO: 1795667 - RNA, 23 nt, Human
ccugccaggaagccagcaggcuc

SEQ ID NO: 1795668 - RNA, 16 nt, Human
ccugccaggcauggug

SEQ ID NO: 1795669 - RNA, 11 nt, Human
ccugccaggga

SEQ ID NO: 1795670 - RNA, 18 nt, Human
ccugccaggaagccagca

SEQ ID NO: 1795671 - RNA, 19 nt, Human
ccugccaggaagccagcag

SEQ ID NO: 1795672 - RNA, 21 nt, Human
ccugccaggaagccagcaggc

SEQ ID NO: 1795673 - RNA, 22 nt, Human
ccugccaggaagccagcaggcu

SEQ ID NO: 1795674 - RNA, 11 nt, Human
ccacugcucug

SEQ ID NO: 1795675 - RNA, 11 nt, Human
ccacugccucu

SEQ ID NO: 1795676 - RNA, 16 nt, Human
ccacugcgaccacaag

SEQ ID NO: 1795677 - RNA, 23 nt, Human
ccacugcacuccagccuggguga

SEQ ID NO: 1795678 - RNA, 15 nt, Human
ccacucccugcaacc

SEQ ID NO: 1795679 - RNA, 19 nt, Human
ccacugcacuccagccugg

SEQ ID NO: 1795680 - RNA, 20 nt, Human
ccacugcacuccagccuggg

SEQ ID NO: 1795681 - RNA, 22 nt, Human
ccacuacggaauaguuggcuag

SEQ ID NO: 1795682 - RNA, 18 nt, Human
ccacuacauucuguuaau

SEQ ID NO: 1795683 - RNA, 23 nt, Human
ccacuacggaauaguuggcuagg

SEQ ID NO: 1795684 - RNA, 17 nt, Human
ccacuccagaccccugg

SEQ ID NO: 1795685 - RNA, 19 nt, Human
ccacuccagaccccuggcu

SEQ ID NO: 1795686 - RNA, 12 nt, Human
ccacucccugca

SEQ ID NO: 1795687 - RNA, 13 nt, Human
ccacucccugcaa

SEQ ID NO: 1795688 - RNA, 13 nt, Human
ccacguuucuaaa

SEQ ID NO: 1795689 - RNA, 17 nt, Human
ccaccugccuguugggc

SEQ ID NO: 1795690 - RNA, 20 nt, Human
ccaccugccuguugggccag

SEQ ID NO: 1795691 - RNA, 14 nt, Human
ccaccugcccaacc

SEQ ID NO: 1795692 - RNA, 12 nt, Human
ccaccugccagg

SEQ ID NO: 1795693 - RNA, 17 nt, Human
ccaccucccacaaagga

SEQ ID NO: 1795694 - RNA, 15 nt, Human
ccacggccaggccag

SEQ ID NO: 1795695 - RNA, 14 nt, Human
ccacggccaggcca

SEQ ID NO: 1795696 - RNA, 13 nt, Human
ccacggccaggcc

SEQ ID NO: 1795697 - RNA, 12 nt, Human
ccacggccaggc

SEQ ID NO: 1795698 - RNA, 17 nt, Human
ccaccuggccucugcac

SEQ ID NO: 1795699 - RNA, 22 nt, Human
ccaccugcggugcuaucucccc

SEQ ID NO: 1795700 - RNA, 15 nt, Human
ccaccuggccucugc

SEQ ID NO: 1795701 - RNA, 16 nt, Human
ccaccuggccucugca

SEQ ID NO: 1795702 - RNA, 14 nt, Human
ccacccaggagccc

SEQ ID NO: 1795703 - RNA, 12 nt, Human
ccacccaggagc

SEQ ID NO: 1795704 - RNA, 15 nt, Human
ccaccucagccuccc

SEQ ID NO: 1795705 - RNA, 14 nt, Human
ccaccucagccucc

SEQ ID NO: 1795706 - RNA, 13 nt, Human
ccaccucagccuc

SEQ ID NO: 1795707 - RNA, 12 nt, Human
ccaccucagccu

SEQ ID NO: 1795708 - RNA, 18 nt, Human
ccacccugaaagcccuga

SEQ ID NO: 1795709 - RNA, 16 nt, Human
ccacccugaaagcccu

SEQ ID NO: 1795710 - RNA, 17 nt, Human
ccacccugaaagcccug

SEQ ID NO: 1795711 - RNA, 19 nt, Human
ccaccccucaacaccucug

SEQ ID NO: 1795712 - RNA, 21 nt, Human
ccacccaggagccccgaggcc

SEQ ID NO: 1795713 - RNA, 23 nt, Human
ccacaucuugcucugcugacaga

SEQ ID NO: 1795714 - RNA, 22 nt, Human
ccacaucuugcucugcugacag

SEQ ID NO: 1795715 - RNA, 16 nt, Human
ccacaucuugcucugc

SEQ ID NO: 1795716 - RNA, 14 nt, Human
ccaccaacauacuc

SEQ ID NO: 1795717 - RNA, 18 nt, Human
ccaccaacauacucccau

SEQ ID NO: 1795718 - RNA, 14 nt, Human
ccacaucuugcucu

SEQ ID NO: 1795719 - RNA, 23 nt, Human
ccacauagugaugguuccccugu

SEQ ID NO: 1795720 - RNA, 19 nt, Human
ccacauagugaugguuccc

SEQ ID NO: 1795721 - RNA, 21 nt, Human
ccacauagugaugguuccccu

SEQ ID NO: 1795722 - RNA, 22 nt, Human
ccacauagugaugguuccccug

SEQ ID NO: 1795723 - RNA, 13 nt, Human
ccacccaccucag

SEQ ID NO: 1795724 - RNA, 22 nt, Human
ccacccaagggccuggccugag

SEQ ID NO: 1795725 - RNA, 20 nt, Human
ccacccaagggccuggccug

SEQ ID NO: 1795726 - RNA, 21 nt, Human
ccacccaagggccuggccuga

SEQ ID NO: 1795727 - RNA, 15 nt, Human
ccacccaccucagcc

SEQ ID NO: 1795728 - RNA, 14 nt, Human
ccacccaccucagc

SEQ ID NO: 1795729 - RNA, 16 nt, Human
ccacccaccucagccu

SEQ ID NO: 1795730 - RNA, 16 nt, Human
ccaccacacccagccc

SEQ ID NO: 1795731 - RNA, 14 nt, Human
ccaccacacccagc

SEQ ID NO: 1795732 - RNA, 20 nt, Human
ccaccaacauacucccaucu

SEQ ID NO: 1795733 - RNA, 16 nt, Human
ccacccaagggccugg

SEQ ID NO: 1795734 - RNA, 17 nt, Human
ccacccaagggccuggc

SEQ ID NO: 1795735 - RNA, 19 nt, Human
ccacccaagggccuggccu

SEQ ID NO: 1795736 - RNA, 14 nt, Human
ccacacccagccca

SEQ ID NO: 1795737 - RNA, 13 nt, Human
ccacacccagccc

SEQ ID NO: 1795738 - RNA, 14 nt, Human
ccacacuccagcug

SEQ ID NO: 1795739 - RNA, 17 nt, Human
ccacacuccagcuggga

SEQ ID NO: 1795740 - RNA, 13 nt, Human
ccacacuccagcu

SEQ ID NO: 1795741 - RNA, 12 nt, Human
ccacacccagcc

SEQ ID NO: 1795742 - RNA, 17 nt, Human
ccacuguacuugcucuu

SEQ ID NO: 1795743 - RNA, 18 nt, Human
ccacuguacuugcucuug

SEQ ID NO: 1795744 - RNA, 19 nt, Human
ccacuguacuugcucuuga

SEQ ID NO: 1795745 - RNA, 19 nt, Human
ccagacaccuugacagggc

SEQ ID NO: 1795746 - RNA, 17 nt, Human
ccagacaccuugacagg

SEQ ID NO: 1795747 - RNA, 20 nt, Human
ccacuguacuugcucuugau

SEQ ID NO: 1795748 - RNA, 14 nt, Human
ccagagaggguggu

SEQ ID NO: 1795749 - RNA, 23 nt, Human
ccagagaggguggugaccucugc

SEQ ID NO: 1795750 - RNA, 21 nt, Human
ccagagaggguggugaccucu

SEQ ID NO: 1795751 - RNA, 20 nt, Human
ccagacaccuugacagggca

SEQ ID NO: 1795752 - RNA, 22 nt, Human
ccagaggagagaggacccccug

SEQ ID NO: 1795753 - RNA, 21 nt, Human
ccagaggagagaggacccccu

SEQ ID NO: 1795754 - RNA, 21 nt, Human
ccagagggagugacagaggca

SEQ ID NO: 1795755 - RNA, 20 nt, Human
ccagagggagugacagaggc

SEQ ID NO: 1795756 - RNA, 19 nt, Human
ccagagggagugacagagg

SEQ ID NO: 1795757 - RNA, 18 nt, Human
ccagagggagugacagag

SEQ ID NO: 1795758 - RNA, 17 nt, Human
ccagagggagugacaga

SEQ ID NO: 1795759 - RNA, 16 nt, Human
ccagagggagugacag

SEQ ID NO: 1795760 - RNA, 14 nt, Human
ccagagcugccacc

SEQ ID NO: 1795761 - RNA, 15 nt, Human
ccagagcugccaccu

SEQ ID NO: 1795762 - RNA, 16 nt, Human
ccagagcugccaccug

SEQ ID NO: 1795763 - RNA, 19 nt, Human
ccagagcugccaccugccu

SEQ ID NO: 1795764 - RNA, 11 nt, Human
ccagagcugcc

SEQ ID NO: 1795765 - RNA, 12 nt, Human
ccagagcugcca

SEQ ID NO: 1795766 - RNA, 13 nt, Human
ccagagcugccac

SEQ ID NO: 1795767 - RNA, 23 nt, Human
ccagagggagugacagaggcagc

SEQ ID NO: 1795768 - RNA, 22 nt, Human
ccagagggagugacagaggcag

SEQ ID NO: 1795769 - RNA, 13 nt, Human
ccagagggccugc

SEQ ID NO: 1795770 - RNA, 15 nt, Human
ccagagggccugcaa

SEQ ID NO: 1795771 - RNA, 16 nt, Human
ccagagggccugcaag

SEQ ID NO: 1795772 - RNA, 18 nt, Human
ccagauucuuuccugagg

SEQ ID NO: 1795773 - RNA, 19 nt, Human
ccagauucuuuccugaggc

SEQ ID NO: 1795774 - RNA, 20 nt, Human
ccagauucuuuccugaggcu

SEQ ID NO: 1795775 - RNA, 21 nt, Human
ccagauucuuuccugaggcug

SEQ ID NO: 1795776 - RNA, 22 nt, Human
ccagauucuuuccugaggcugg

SEQ ID NO: 1795777 - RNA, 20 nt, Human
ccagauugcaacaggcuggg

SEQ ID NO: 1795778 - RNA, 19 nt, Human
ccagauugcaacaggcugg

SEQ ID NO: 1795779 - RNA, 23 nt, Human
ccagauucuuuccugaggcuggg

SEQ ID NO: 1795780 - RNA, 21 nt, Human
ccagauugcaacaggcugggc

SEQ ID NO: 1795781 - RNA, 13 nt, Human
ccagauuuaugca

SEQ ID NO: 1795782 - RNA, 22 nt, Human
ccagauuuaugcauauuauuuu

SEQ ID NO: 1795783 - RNA, 12 nt, Human
ccagauuucacu

SEQ ID NO: 1795784 - RNA, 23 nt, Human
ccagcauaauacuugcuuuggaa

SEQ ID NO: 1795785 - RNA, 15 nt, Human
ccagccaaagccucc

SEQ ID NO: 1795786 - RNA, 18 nt, Human
ccagccaaagccuccucc

SEQ ID NO: 1795787 - RNA, 19 nt, Human
ccagccaaagccuccucca

SEQ ID NO: 1795788 - RNA, 15 nt, Human
ccagccccagugccc

SEQ ID NO: 1795789 - RNA, 13 nt, Human
ccagccccagugc

SEQ ID NO: 1795790 - RNA, 23 nt, Human
ccagccccaaaacucuccucugc

SEQ ID NO: 1795791 - RNA, 17 nt, Human
ccagcccuuagcaggga

SEQ ID NO: 1795792 - RNA, 16 nt, Human
ccagcccuuagcaggg

SEQ ID NO: 1795793 - RNA, 21 nt, Human
ccagcccuccuuaucaaagga

SEQ ID NO: 1795794 - RNA, 16 nt, Human
ccagccccagugccca

SEQ ID NO: 1795795 - RNA, 19 nt, Human
ccagccucaucucuuuguu

SEQ ID NO: 1795796 - RNA, 21 nt, Human
ccagccuccaagcuccaucuc

SEQ ID NO: 1795797 - RNA, 14 nt, Human
ccagccgccaugcu

SEQ ID NO: 1795798 - RNA, 18 nt, Human
ccagccgccaugcuccug

SEQ ID NO: 1795799 - RNA, 19 nt, Human
ccagccgccaugcuccugg

SEQ ID NO: 1795800 - RNA, 15 nt, Human
ccagcaagugagagc

SEQ ID NO: 1795801 - RNA, 14 nt, Human
ccagauuucacucu

SEQ ID NO: 1795802 - RNA, 22 nt, Human
ccagcaagugagagcugggugu

SEQ ID NO: 1795803 - RNA, 21 nt, Human
ccagcaagugagagcugggug

SEQ ID NO: 1795804 - RNA, 20 nt, Human
ccagcaagugagagcugggu

SEQ ID NO: 1795805 - RNA, 16 nt, Human
ccagcaagugagagcu

SEQ ID NO: 1795806 - RNA, 19 nt, Human
ccagcaauucuccugccuc

SEQ ID NO: 1795807 - RNA, 20 nt, Human
ccagcaauucuccugccuca

SEQ ID NO: 1795808 - RNA, 21 nt, Human
ccagcaauucuccugccucag

SEQ ID NO: 1795809 - RNA, 16 nt, Human
ccagcaauucuccugc

SEQ ID NO: 1795810 - RNA, 18 nt, Human
ccagcaauucuccugccu

SEQ ID NO: 1795811 - RNA, 19 nt, Human
ccauucuccaccugccagg

SEQ ID NO: 1795812 - RNA, 20 nt, Human
ccauucuccaccugccaggg

SEQ ID NO: 1795813 - RNA, 14 nt, Human
ccauuuguguuuau

SEQ ID NO: 1795814 - RNA, 15 nt, Human
cccaaagugcuggga

SEQ ID NO: 1795815 - RNA, 13 nt, Human
cccaaagugcugg

SEQ ID NO: 1795816 - RNA, 20 nt, Human
cccaaaacucuccucugcug

SEQ ID NO: 1795817 - RNA, 16 nt, Human
cccaaaacucuccucu

SEQ ID NO: 1795818 - RNA, 18 nt, Human
cccaaaacucuccucugc

SEQ ID NO: 1795819 - RNA, 16 nt, Human
cccaaagugcugggau

SEQ ID NO: 1795820 - RNA, 20 nt, Human
cccaaagugguauagaaaug

SEQ ID NO: 1795821 - RNA, 21 nt, Human
cccaaagugguauagaaaugc

SEQ ID NO: 1795822 - RNA, 23 nt, Human
cccaaauggaaaugggcagagca

SEQ ID NO: 1795823 - RNA, 18 nt, Human
cccaaauggaaaugggca

SEQ ID NO: 1795824 - RNA, 22 nt, Human
cccaaauggaaaugggcagagc

SEQ ID NO: 1795825 - RNA, 17 nt, Human
cccaaggcucugagcaa

SEQ ID NO: 1795826 - RNA, 15 nt, Human
cccaacccuggcacc

SEQ ID NO: 1795827 - RNA, 16 nt, Human
ccauguuggccaggcu

SEQ ID NO: 1795828 - RNA, 17 nt, Human
ccauguuggccaggcug

SEQ ID NO: 1795829 - RNA, 18 nt, Human
ccauguuggccaggcugc

SEQ ID NO: 1795830 - RNA, 21 nt, Human
ccauguuggccaggcugcucu

SEQ ID NO: 1795831 - RNA, 19 nt, Human
ccaugggacagggaggacg

SEQ ID NO: 1795832 - RNA, 16 nt, Human
ccaugggacagggagg

SEQ ID NO: 1795833 - RNA, 14 nt, Human
ccaucuaaacugcc

SEQ ID NO: 1795834 - RNA, 21 nt, Human
ccaugggaaaugucaacaagu

SEQ ID NO: 1795835 - RNA, 15 nt, Human
ccaucuaaacugccc

SEQ ID NO: 1795836 - RNA, 16 nt, Human
ccaucuaaacugcccc

SEQ ID NO: 1795837 - RNA, 23 nt, Human
ccauauucuguuggccaguguga

SEQ ID NO: 1795838 - RNA, 21 nt, Human
ccauaguaugggacuggccuc

SEQ ID NO: 1795839 - RNA, 12 nt, Human
ccauaggucacc

SEQ ID NO: 1795840 - RNA, 22 nt, Human
ccaguguuguggauuuaacaga

SEQ ID NO: 1795841 - RNA, 16 nt, Human
ccagugaggcucugcc

SEQ ID NO: 1795842 - RNA, 14 nt, Human
ccagugaggcucug

SEQ ID NO: 1795843 - RNA, 15 nt, Human
ccagugaggcucugc

SEQ ID NO: 1795844 - RNA, 22 nt, Human
ccagugguuccuaauccucuag

SEQ ID NO: 1795845 - RNA, 20 nt, Human
ccagugccgagaaggaagcc

SEQ ID NO: 1795846 - RNA, 17 nt, Human
ccagugaggcucugccc

SEQ ID NO: 1795847 - RNA, 13 nt, Human
ccaucuacccucc

SEQ ID NO: 1795848 - RNA, 24 nt, Human
ccaggcuguaucccaugagccuca

SEQ ID NO: 1795849 - RNA, 17 nt, Human
ccaggcuuagucacuga

SEQ ID NO: 1795850 - RNA, 18 nt, Human
ccaggcgccccuuccccc

SEQ ID NO: 1795851 - RNA, 19 nt, Human
ccaggcgccccuucccccu

SEQ ID NO: 1795852 - RNA, 22 nt, Human
ccaggcccucugcccacucccu

SEQ ID NO: 1795853 - RNA, 23 nt, Human
ccaggcccucugcccacucccug

SEQ ID NO: 1795854 - RNA, 20 nt, Human
ccaggcccucugcccacucc

SEQ ID NO: 1795855 - RNA, 21 nt, Human
ccaggcccucugcccacuccc

SEQ ID NO: 1795856 - RNA, 20 nt, Human
ccaggagccccgaggccuuc

SEQ ID NO: 1795857 - RNA, 12 nt, Human
ccaggagccucc

SEQ ID NO: 1795858 - RNA, 19 nt, Human
ccaggagccccgaggccuu

SEQ ID NO: 1795859 - RNA, 16 nt, Human
ccaggagccccgaggc

SEQ ID NO: 1795860 - RNA, 18 nt, Human
ccaggcauuccccaggag

SEQ ID NO: 1795861 - RNA, 19 nt, Human
ccaggcauuccccaggagg

SEQ ID NO: 1795862 - RNA, 21 nt, Human
ccaggcauuccccaggaggcc

SEQ ID NO: 1795863 - RNA, 15 nt, Human
ccagccuccaugcug

SEQ ID NO: 1795864 - RNA, 16 nt, Human
ccagccuccaugcugc

SEQ ID NO: 1795865 - RNA, 20 nt, Human
ccaggcuuagucacugagac

SEQ ID NO: 1795866 - RNA, 14 nt, Human
ccagggacagaggg

SEQ ID NO: 1795867 - RNA, 15 nt, Human
ccagggacagagggg

SEQ ID NO: 1795868 - RNA, 21 nt, Human
ccagggacagaggggguggcc

SEQ ID NO: 1795869 - RNA, 22 nt, Human
ccagggacagaggggguggccu

SEQ ID NO: 1795870 - RNA, 19 nt, Human
ccaggugcacaagcuccaa

SEQ ID NO: 1795871 - RNA, 20 nt, Human
ccaggugcacaagcuccaag

SEQ ID NO: 1795872 - RNA, 18 nt, Human
ccaggugcacaagcucca

SEQ ID NO: 1795873 - RNA, 21 nt, Human
ccagggcuggaaugauuucag

SEQ ID NO: 1795874 - RNA, 20 nt, Human
ccagucuggaaugcaguggu

SEQ ID NO: 1795875 - RNA, 19 nt, Human
ccagucuggaaugcagugg

SEQ ID NO: 1795876 - RNA, 18 nt, Human
ccagucuggaaugcagug

SEQ ID NO: 1795877 - RNA, 17 nt, Human
ccagguuuuuggucuga

SEQ ID NO: 1795878 - RNA, 18 nt, Human
ccagguuccacagaggac

SEQ ID NO: 1795879 - RNA, 15 nt, Human
ccagguuccacagag

SEQ ID NO: 1795880 - RNA, 24 nt, Human
ccaggugcacaagcuccaagcucc

SEQ ID NO: 1795881 - RNA, 23 nt, Human
cauuccugaugcuucuucagaga

SEQ ID NO: 1795882 - RNA, 14 nt, Human
cauuccugaugcuu

SEQ ID NO: 1795883 - RNA, 16 nt, Human
cauuccugaugcuucu

SEQ ID NO: 1795884 - RNA, 19 nt, Human
cauuccugaugcuucuuca

SEQ ID NO: 1795885 - RNA, 22 nt, Human
cauuccugaugcuucuucagag

SEQ ID NO: 1795886 - RNA, 13 nt, Human
cauucuggaauaa

SEQ ID NO: 1795887 - RNA, 17 nt, Human
cauucuguuaaucauua

SEQ ID NO: 1795888 - RNA, 20 nt, Human
cauucugccugcccaggccc

SEQ ID NO: 1795889 - RNA, 19 nt, Human
cauucugccugcccaggcc

SEQ ID NO: 1795890 - RNA, 18 nt, Human
cauucugccugcccaggc

SEQ ID NO: 1795891 - RNA, 17 nt, Human
cauucugccugcccagg

SEQ ID NO: 1795892 - RNA, 16 nt, Human
cauucugccugcccag

SEQ ID NO: 1795893 - RNA, 15 nt, Human
cauucugccugccca

SEQ ID NO: 1795894 - RNA, 13 nt, Human
cauucugccugcc

SEQ ID NO: 1795895 - RNA, 12 nt, Human
cauucugccugc

SEQ ID NO: 1795896 - RNA, 23 nt, Human
cauucuucuguacgucugacagg

SEQ ID NO: 1795897 - RNA, 19 nt, Human
cauucauuuucuggguguu

SEQ ID NO: 1795898 - RNA, 22 nt, Human
cauuccaccuucccaugcccug

SEQ ID NO: 1795899 - RNA, 17 nt, Human
cauuccaccuucccaug

SEQ ID NO: 1795900 - RNA, 13 nt, Human
cauuccccaggag

SEQ ID NO: 1795901 - RNA, 15 nt, Human
cauuccccaggaggc

SEQ ID NO: 1795902 - RNA, 17 nt, Human
cauuccccaggaggcca

SEQ ID NO: 1795903 - RNA, 17 nt, Human
cauuccccgucucuggu

SEQ ID NO: 1795904 - RNA, 13 nt, Human
cauuccccauggg

SEQ ID NO: 1795905 - RNA, 20 nt, Human
cauuccccaggaggccagcc

SEQ ID NO: 1795906 - RNA, 18 nt, Human
cauuccccaggaggccag

SEQ ID NO: 1795907 - RNA, 19 nt, Human
cauuccccaggaggccagc

SEQ ID NO: 1795908 - RNA, 21 nt, Human
cauuuuuaagugcugcauuua

SEQ ID NO: 1795909 - RNA, 17 nt, Human
cauuuuuaguagagaca

SEQ ID NO: 1795910 - RNA, 16 nt, Human
ccaaacccuucagugc

SEQ ID NO: 1795911 - RNA, 15 nt, Human
cauuugcuuuggaag

SEQ ID NO: 1795912 - RNA, 14 nt, Human
cauuugcuuuggaa

SEQ ID NO: 1795913 - RNA, 22 nt, Human
cauuuuacuuuuuccuggcuca

SEQ ID NO: 1795914 - RNA, 20 nt, Human
cauuuuacuuuuuccuggcu

SEQ ID NO: 1795915 - RNA, 17 nt, Human
cauuuuacuuuuuccug

SEQ ID NO: 1795916 - RNA, 23 nt, Human
cauuuuauuuuauuaugcaugaa

SEQ ID NO: 1795917 - RNA, 23 nt, Human
cauuuuaccuuugacaaagguaa

SEQ ID NO: 1795918 - RNA, 19 nt, Human
cauuuaaaacauuaaaaua

SEQ ID NO: 1795919 - RNA, 15 nt, Human
cauuuaaaaaaaauc

SEQ ID NO: 1795920 - RNA, 15 nt, Human
cauugugggaagggg

SEQ ID NO: 1795921 - RNA, 13 nt, Human
cauugugggaagg

SEQ ID NO: 1795922 - RNA, 14 nt, Human
cauugaccugaggc

SEQ ID NO: 1795923 - RNA, 15 nt, Human
cauugaccugaggcc

SEQ ID NO: 1795924 - RNA, 17 nt, Human
cauugaccugaggcccu

SEQ ID NO: 1795925 - RNA, 18 nt, Human
cauugaccugaggcccuu

SEQ ID NO: 1795926 - RNA, 22 nt, Human
cauuuacccuucuuuucugacu

SEQ ID NO: 1795927 - RNA, 19 nt, Human
cauuugaaaauuuugaugu

SEQ ID NO: 1795928 - RNA, 17 nt, Human
cauuugaaaauuuugau

SEQ ID NO: 1795929 - RNA, 14 nt, Human
caugcagcaucuaa

SEQ ID NO: 1795930 - RNA, 17 nt, Human
caugcugucccuuacgu

SEQ ID NO: 1795931 - RNA, 13 nt, Human
caugcugucccuu

SEQ ID NO: 1795932 - RNA, 15 nt, Human
caugcugucccuuac

SEQ ID NO: 1795933 - RNA, 17 nt, Human
caugcgggcuuccuccu

SEQ ID NO: 1795934 - RNA, 22 nt, Human
cauggacuucugccagcauaau

SEQ ID NO: 1795935 - RNA, 15 nt, Human
cauggacuuccacug

SEQ ID NO: 1795936 - RNA, 18 nt, Human
caugggccuccugugugu

SEQ ID NO: 1795937 - RNA, 23 nt, Human
caugggacagggaggacgcucuc

SEQ ID NO: 1795938 - RNA, 23 nt, Human
cauggucggaaaacaugcuacac

SEQ ID NO: 1795939 - RNA, 19 nt, Human
cauggucggaaaacaugcu

SEQ ID NO: 1795940 - RNA, 17 nt, Human
cauggucggaaaacaug

SEQ ID NO: 1795941 - RNA, 14 nt, Human
cauguguuccaagg

SEQ ID NO: 1795942 - RNA, 18 nt, Human
cauguguuggcagccucu

SEQ ID NO: 1795943 - RNA, 14 nt, Human
caugugcacaugca

SEQ ID NO: 1795944 - RNA, 15 nt, Human
caugugaugagagga

SEQ ID NO: 1795945 - RNA, 16 nt, Human
caugugaugagaggaa

SEQ ID NO: 1795946 - RNA, 17 nt, Human
caugugaugagaggaaa

SEQ ID NO: 1795947 - RNA, 18 nt, Human
caugugaugagaggaaau

SEQ ID NO: 1795948 - RNA, 20 nt, Human
caugugaugagaggaaauca

SEQ ID NO: 1795949 - RNA, 21 nt, Human
caugugaugagaggaaaucac

SEQ ID NO: 1795950 - RNA, 12 nt, Human
caugucuggcua

SEQ ID NO: 1795951 - RNA, 14 nt, Human
caugucucgacuca

SEQ ID NO: 1795952 - RNA, 14 nt, Human
cauuaaaauauaau

SEQ ID NO: 1795953 - RNA, 11 nt, Human
cauuaaaauau

SEQ ID NO: 1795954 - RNA, 20 nt, Human
cauguuucuuuguaaugaaa

SEQ ID NO: 1795955 - RNA, 14 nt, Human
cauguuugugauug

SEQ ID NO: 1795956 - RNA, 12 nt, Human
cauguuugugau

SEQ ID NO: 1795957 - RNA, 19 nt, Human
cauguuuuucuucucccuc

SEQ ID NO: 1795958 - RNA, 20 nt, Human
cauguuuuucuucucccuca

SEQ ID NO: 1795959 - RNA, 22 nt, Human
cauuaaaaaaaaaaaaaaaagu

SEQ ID NO: 1795960 - RNA, 15 nt, Human
cauguuugugauuga

SEQ ID NO: 1795961 - RNA, 23 nt, Human
cauccacugugccaugugccagg

SEQ ID NO: 1795962 - RNA, 17 nt, Human
cauccacugugccaugu

SEQ ID NO: 1795963 - RNA, 14 nt, Human
cauccacugugcca

SEQ ID NO: 1795964 - RNA, 12 nt, Human
cauccauccagg

SEQ ID NO: 1795965 - RNA, 17 nt, Human
cauccagguucagcuug

SEQ ID NO: 1795966 - RNA, 15 nt, Human
caucccucuggggcu

SEQ ID NO: 1795967 - RNA, 13 nt, Human
caucccuccuggg

SEQ ID NO: 1795968 - RNA, 20 nt, Human
caucaccaacgucugugcca

SEQ ID NO: 1795969 - RNA, 12 nt, Human
caucacccgcua

SEQ ID NO: 1795970 - RNA, 15 nt, Human
caucaugucuggcua

SEQ ID NO: 1795971 - RNA, 14 nt, Human
caucaugucuggcu

SEQ ID NO: 1795972 - RNA, 13 nt, Human
caucaugucuggc

SEQ ID NO: 1795973 - RNA, 16 nt, Human
caucauccuaagcuau

SEQ ID NO: 1795974 - RNA, 18 nt, Human
cauagugaugguuccccu

SEQ ID NO: 1795975 - RNA, 19 nt, Human
cauagugaugguuccccug

SEQ ID NO: 1795976 - RNA, 16 nt, Human
cauauaagugauugcu

SEQ ID NO: 1795977 - RNA, 23 nt, Human
cauauaagauucauauuuacuuc

SEQ ID NO: 1795978 - RNA, 15 nt, Human
cauaguaugguggcu

SEQ ID NO: 1795979 - RNA, 17 nt, Human
cauaguaugguggcugg

SEQ ID NO: 1795980 - RNA, 16 nt, Human
cauaguaugguggcug

SEQ ID NO: 1795981 - RNA, 22 nt, Human
cauauucuguuggccaguguga

SEQ ID NO: 1795982 - RNA, 17 nt, Human
cauauugauuuccguua

SEQ ID NO: 1795983 - RNA, 21 nt, Human
cauauugauuuccguuaaaau

SEQ ID NO: 1795984 - RNA, 13 nt, Human
cauauuguuacug

SEQ ID NO: 1795985 - RNA, 19 nt, Human
cauauuguuacugguacca

SEQ ID NO: 1795986 - RNA, 17 nt, Human
cauauuuuaaacagagg

SEQ ID NO: 1795987 - RNA, 16 nt, Human
cauauuuuaaacagag

SEQ ID NO: 1795988 - RNA, 14 nt, Human
caucaacaucuugg

SEQ ID NO: 1795989 - RNA, 18 nt, Human
cauauuuuaaacagagga

SEQ ID NO: 1795990 - RNA, 12 nt, Human
caugaagacaga

SEQ ID NO: 1795991 - RNA, 21 nt, Human
caugaaaacacauuuuucuua

SEQ ID NO: 1795992 - RNA, 19 nt, Human
caugaaaacacauuuuucu

SEQ ID NO: 1795993 - RNA, 17 nt, Human
caugaaaacacauuuuu

SEQ ID NO: 1795994 - RNA, 16 nt, Human
caugaaaacacauuuu

SEQ ID NO: 1795995 - RNA, 15 nt, Human
caugaaaacacauuu

SEQ ID NO: 1795996 - RNA, 14 nt, Human
caugaaaacacauu

SEQ ID NO: 1795997 - RNA, 13 nt, Human
caugaaaacacau

SEQ ID NO: 1795998 - RNA, 19 nt, Human
caugaagauguagaggaga

SEQ ID NO: 1795999 - RNA, 18 nt, Human
caugaagauguagaggag

SEQ ID NO: 1796000 - RNA, 23 nt, Human
caugacucguauaugucucaggu

SEQ ID NO: 1796001 - RNA, 20 nt, Human
caugacucguauaugucuca

SEQ ID NO: 1796002 - RNA, 13 nt, Human
caugagcaucagg

SEQ ID NO: 1796003 - RNA, 21 nt, Human
caugagccucagcauccuggc

SEQ ID NO: 1796004 - RNA, 20 nt, Human
caugagccucagcauccugg

SEQ ID NO: 1796005 - RNA, 19 nt, Human
caugagccucagcauccug

SEQ ID NO: 1796006 - RNA, 18 nt, Human
caugagccucagcauccu

SEQ ID NO: 1796007 - RNA, 17 nt, Human
caugagccucagcaucc

SEQ ID NO: 1796008 - RNA, 15 nt, Human
caugagccucagcau

SEQ ID NO: 1796009 - RNA, 12 nt, Human
caugagccucag

SEQ ID NO: 1796010 - RNA, 15 nt, Human
caugagcaucaggcc

SEQ ID NO: 1796011 - RNA, 16 nt, Human
caugagcaucaggcca

SEQ ID NO: 1796012 - RNA, 17 nt, Human
caugagcaucaggccag

SEQ ID NO: 1796013 - RNA, 18 nt, Human
caugagcaucaggccagg

SEQ ID NO: 1796014 - RNA, 20 nt, Human
caugagcaucaggccaggcc

SEQ ID NO: 1796015 - RNA, 21 nt, Human
caugagcaucaggccaggccc

SEQ ID NO: 1796016 - RNA, 22 nt, Human
caugagcaucaggccaggcccu

SEQ ID NO: 1796017 - RNA, 23 nt, Human
caugagcaucaggccaggcccuc

SEQ ID NO: 1796018 - RNA, 23 nt, Human
caugaguccccuguuuguuucug

SEQ ID NO: 1796019 - RNA, 14 nt, Human
caugaguccccugu

SEQ ID NO: 1796020 - RNA, 15 nt, Human
caugaguccccuguu

SEQ ID NO: 1796021 - RNA, 13 nt, Human
caugaguccccug

SEQ ID NO: 1796022 - RNA, 19 nt, Human
caugagguacugagaguga

SEQ ID NO: 1796023 - RNA, 16 nt, Human
caugagguacugagag

SEQ ID NO: 1796024 - RNA, 23 nt, Human
caugaggaacaaggcaaggcugu

SEQ ID NO: 1796025 - RNA, 23 nt, Human
caugagccucagcauccuggcac

SEQ ID NO: 1796026 - RNA, 22 nt, Human
caugagccucagcauccuggca

SEQ ID NO: 1796027 - RNA, 16 nt, Human
caugaggaacaaggca

SEQ ID NO: 1796028 - RNA, 17 nt, Human
caugaggaacaaggcaa

SEQ ID NO: 1796029 - RNA, 20 nt, Human
caugaggaacaaggcaaggc

SEQ ID NO: 1796030 - RNA, 21 nt, Human
caugaggaacaaggcaaggcu

SEQ ID NO: 1796031 - RNA, 15 nt, Human
caucucuccuccuuu

SEQ ID NO: 1796032 - RNA, 16 nt, Human
caucucuacaaaaagc

SEQ ID NO: 1796033 - RNA, 17 nt, Human
caucucccuuuuccaug

SEQ ID NO: 1796034 - RNA, 18 nt, Human
cauccuacaagacacagu

SEQ ID NO: 1796035 - RNA, 19 nt, Human
cauccuacaagacacagug

SEQ ID NO: 1796036 - RNA, 16 nt, Human
caucuugaauuguaag

SEQ ID NO: 1796037 - RNA, 21 nt, Human
caucuugaauuguaaggaaug

SEQ ID NO: 1796038 - RNA, 17 nt, Human
caucuugcucugcugac

SEQ ID NO: 1796039 - RNA, 16 nt, Human
caucuugcucugcuga

SEQ ID NO: 1796040 - RNA, 19 nt, Human
caucuugcucugcugacag

SEQ ID NO: 1796041 - RNA, 22 nt, Human
cagggaaacagcuaaugggaca

SEQ ID NO: 1796042 - RNA, 15 nt, Human
cagggaaggggacaa

SEQ ID NO: 1796043 - RNA, 17 nt, Human
cagggaaggggacaagg

SEQ ID NO: 1796044 - RNA, 13 nt, Human
cagggacagaggg

SEQ ID NO: 1796045 - RNA, 14 nt, Human
cagggacagagggg

SEQ ID NO: 1796046 - RNA, 20 nt, Human
cagggacagaggggguggcc

SEQ ID NO: 1796047 - RNA, 20 nt, Human
cagggcauggccagguggcc

SEQ ID NO: 1796048 - RNA, 14 nt, Human
cagggcacaccggg

SEQ ID NO: 1796049 - RNA, 23 nt, Human
cagggacagaggggguggccucc

SEQ ID NO: 1796050 - RNA, 21 nt, Human
cagggcacaccgggcacucag

SEQ ID NO: 1796051 - RNA, 19 nt, Human
cagggcacaccgggcacuc

SEQ ID NO: 1796052 - RNA, 17 nt, Human
cagggcacaccgggcac

SEQ ID NO: 1796053 - RNA, 15 nt, Human
cagggcacaccgggc

SEQ ID NO: 1796054 - RNA, 23 nt, Human
cagggcacaccgggcacucagaa

SEQ ID NO: 1796055 - RNA, 22 nt, Human
cagggcacaccgggcacucaga

SEQ ID NO: 1796056 - RNA, 19 nt, Human
caggggaggguagagcgga

SEQ ID NO: 1796057 - RNA, 16 nt, Human
cagggccuggcucagg

SEQ ID NO: 1796058 - RNA, 19 nt, Human
cagggccuggcucaggugg

SEQ ID NO: 1796059 - RNA, 13 nt, Human
cagggccuggcuc

SEQ ID NO: 1796060 - RNA, 14 nt, Human
cagggccuggcuca

SEQ ID NO: 1796061 - RNA, 15 nt, Human
cagggccuggcucag

SEQ ID NO: 1796062 - RNA, 20 nt, Human
caggcuccuuuagcgcccag

SEQ ID NO: 1796063 - RNA, 19 nt, Human
caggcuccuuuagcgccca

SEQ ID NO: 1796064 - RNA, 14 nt, Human
caggcuccuuuagc

SEQ ID NO: 1796065 - RNA, 18 nt, Human
caggcuccugccaccacg

SEQ ID NO: 1796066 - RNA, 13 nt, Human
caggcuccugcca

SEQ ID NO: 1796067 - RNA, 14 nt, Human
caggcuccugccac

SEQ ID NO: 1796068 - RNA, 15 nt, Human
caggcuccugccacc

SEQ ID NO: 1796069 - RNA, 16 nt, Human
caggcuccugccacca

SEQ ID NO: 1796070 - RNA, 21 nt, Human
caggcuccuuuagcgcccagu

SEQ ID NO: 1796071 - RNA, 20 nt, Human
caggcucgggcuccccagcc

SEQ ID NO: 1796072 - RNA, 12 nt, Human
caggcucucagg

SEQ ID NO: 1796073 - RNA, 13 nt, Human
caggcucucaggc

SEQ ID NO: 1796074 - RNA, 14 nt, Human
caggcucucaggcc

SEQ ID NO: 1796075 - RNA, 15 nt, Human
caggcucucaggcca

SEQ ID NO: 1796076 - RNA, 16 nt, Human
caggcucucaggccag

SEQ ID NO: 1796077 - RNA, 21 nt, Human
caggcucucaggccagcugcu

SEQ ID NO: 1796078 - RNA, 23 nt, Human
caggcucucaggccagcugcuug

SEQ ID NO: 1796079 - RNA, 17 nt, Human
caggcucucaggccagc

SEQ ID NO: 1796080 - RNA, 18 nt, Human
caggcucucaggccagcu

SEQ ID NO: 1796081 - RNA, 19 nt, Human
caggcucucaggccagcug

SEQ ID NO: 1796082 - RNA, 20 nt, Human
caggcucucaggccagcugc

SEQ ID NO: 1796083 - RNA, 19 nt, Human
caggcccggcuccaggcuc

SEQ ID NO: 1796084 - RNA, 18 nt, Human
caggcccggcuccaggcu

SEQ ID NO: 1796085 - RNA, 17 nt, Human
caggcccggcuccaggc

SEQ ID NO: 1796086 - RNA, 21 nt, Human
caggcccggcuccaggcuccu

SEQ ID NO: 1796087 - RNA, 20 nt, Human
caggcccggcuccaggcucc

SEQ ID NO: 1796088 - RNA, 22 nt, Human
caggcccggcuccaggcuccuu

SEQ ID NO: 1796089 - RNA, 13 nt, Human
caggcccucugcc

SEQ ID NO: 1796090 - RNA, 14 nt, Human
caggcccucugccc

SEQ ID NO: 1796091 - RNA, 15 nt, Human
caggcccucugccca

SEQ ID NO: 1796092 - RNA, 19 nt, Human
caggcccuuccucuccacu

SEQ ID NO: 1796093 - RNA, 20 nt, Human
caggcccuuccucuccacug

SEQ ID NO: 1796094 - RNA, 21 nt, Human
caggcccuuccucuccacugc

SEQ ID NO: 1796095 - RNA, 23 nt, Human
caggcccuuccucuccacugccu

SEQ ID NO: 1796096 - RNA, 16 nt, Human
caggcccuuccucucc

SEQ ID NO: 1796097 - RNA, 17 nt, Human
caggcccuuccucucca

SEQ ID NO: 1796098 - RNA, 15 nt, Human
caggcccuuccucuc

SEQ ID NO: 1796099 - RNA, 16 nt, Human
caggcccucugcccac

SEQ ID NO: 1796100 - RNA, 17 nt, Human
caggcccucugcccacu

SEQ ID NO: 1796101 - RNA, 19 nt, Human
caggcccucugcccacucc

SEQ ID NO: 1796102 - RNA, 20 nt, Human
caggcccucugcccacuccc

SEQ ID NO: 1796103 - RNA, 21 nt, Human
caggcccucugcccacucccu

SEQ ID NO: 1796104 - RNA, 22 nt, Human
caggcccucugcccacucccug

SEQ ID NO: 1796105 - RNA, 16 nt, Human
cagggaaacagcuaau

SEQ ID NO: 1796106 - RNA, 23 nt, Human
caggcuuuuuuaucaugugaaau

SEQ ID NO: 1796107 - RNA, 22 nt, Human
caggcuuagucacugagacagc

SEQ ID NO: 1796108 - RNA, 23 nt, Human
caggcuuagucacugagacagcc

SEQ ID NO: 1796109 - RNA, 21 nt, Human
caggcuguaucccaugagccu

SEQ ID NO: 1796110 - RNA, 20 nt, Human
caggcuguaucccaugagcc

SEQ ID NO: 1796111 - RNA, 14 nt, Human
caggcuguauccca

SEQ ID NO: 1796112 - RNA, 23 nt, Human
caggcuggucucgaacuccugac

SEQ ID NO: 1796113 - RNA, 19 nt, Human
caggcuggucucaaacucu

SEQ ID NO: 1796114 - RNA, 20 nt, Human
caggcuggucucgaacuccu

SEQ ID NO: 1796115 - RNA, 22 nt, Human
caggcuggucucgaacuccuga

SEQ ID NO: 1796116 - RNA, 12 nt, Human
caggcuggucuc

SEQ ID NO: 1796117 - RNA, 23 nt, Human
caggcuggucucaaacuccugac

SEQ ID NO: 1796118 - RNA, 23 nt, Human
caggcuguaucccaugagccuca

SEQ ID NO: 1796119 - RNA, 22 nt, Human
caggcuguaucccaugagccuc

SEQ ID NO: 1796120 - RNA, 14 nt, Human
caggcugugaguuu

SEQ ID NO: 1796121 - RNA, 16 nt, Human
caggcuuagucacuga

SEQ ID NO: 1796122 - RNA, 17 nt, Human
caggcuuagucacugag

SEQ ID NO: 1796123 - RNA, 20 nt, Human
caggcuuagucacugagaca

SEQ ID NO: 1796124 - RNA, 21 nt, Human
caggcuuagucacugagacag

SEQ ID NO: 1796125 - RNA, 23 nt, Human
caggcugggcuucaguggcagcu

SEQ ID NO: 1796126 - RNA, 21 nt, Human
caggcugggucgcccuggacu

SEQ ID NO: 1796127 - RNA, 23 nt, Human
caggcugggucgcccuggacugu

SEQ ID NO: 1796128 - RNA, 12 nt, Human
caggcuggcccu

SEQ ID NO: 1796129 - RNA, 14 nt, Human
caggcuggcccugc

SEQ ID NO: 1796130 - RNA, 15 nt, Human
caggcuggcccugcc

SEQ ID NO: 1796131 - RNA, 16 nt, Human
caggcuggcccugccc

SEQ ID NO: 1796132 - RNA, 23 nt, Human
caggcugcucuugaacuccugac

SEQ ID NO: 1796133 - RNA, 12 nt, Human
caggcugcucuu

SEQ ID NO: 1796134 - RNA, 20 nt, Human
caggcugcucuugaacuccu

SEQ ID NO: 1796135 - RNA, 12 nt, Human
caggcugagccu

SEQ ID NO: 1796136 - RNA, 18 nt, Human
caggcucuucuccuuuca

SEQ ID NO: 1796137 - RNA, 22 nt, Human
caggcucuucuccuuucacaac

SEQ ID NO: 1796138 - RNA, 14 nt, Human
caggcucuucuccu

SEQ ID NO: 1796139 - RNA, 15 nt, Human
caggcucuucuccuu

SEQ ID NO: 1796140 - RNA, 12 nt, Human
caggcucuucuc

SEQ ID NO: 1796141 - RNA, 13 nt, Human
caggcugagccuc

SEQ ID NO: 1796142 - RNA, 14 nt, Human
caggcugagccuca

SEQ ID NO: 1796143 - RNA, 15 nt, Human
caggcugagccucag

SEQ ID NO: 1796144 - RNA, 16 nt, Human
caggcugagccucagu

SEQ ID NO: 1796145 - RNA, 17 nt, Human
caggcugagccucaguc

SEQ ID NO: 1796146 - RNA, 21 nt, Human
caggcugagccucagucuccc

SEQ ID NO: 1796147 - RNA, 14 nt, Human
caggaucagucuga

SEQ ID NO: 1796148 - RNA, 13 nt, Human
caggaucagucug

SEQ ID NO: 1796149 - RNA, 18 nt, Human
caggaugaugacuaugga

SEQ ID NO: 1796150 - RNA, 20 nt, Human
caggaugaugacuauggaaa

SEQ ID NO: 1796151 - RNA, 22 nt, Human
caggaugaugacuauggaaaga

SEQ ID NO: 1796152 - RNA, 23 nt, Human
caggauggccgggcgcgguggcu

SEQ ID NO: 1796153 - RNA, 19 nt, Human
caggauguacaaggacagc

SEQ ID NO: 1796154 - RNA, 17 nt, Human
caggauucuuccucccu

SEQ ID NO: 1796155 - RNA, 18 nt, Human
caggauucuuccucccuc

SEQ ID NO: 1796156 - RNA, 20 nt, Human
caggauucuuccucccuccc

SEQ ID NO: 1796157 - RNA, 21 nt, Human
caggcaagcaccuccugccuc

SEQ ID NO: 1796158 - RNA, 16 nt, Human
caggcaagcaccuccu

SEQ ID NO: 1796159 - RNA, 15 nt, Human
caggcaagcaccucc

SEQ ID NO: 1796160 - RNA, 14 nt, Human
caggcaagcaccuc

SEQ ID NO: 1796161 - RNA, 14 nt, Human
caggcagccaggcc

SEQ ID NO: 1796162 - RNA, 15 nt, Human
caggcagccaggcca

SEQ ID NO: 1796163 - RNA, 13 nt, Human
caggcagguccag

SEQ ID NO: 1796164 - RNA, 20 nt, Human
caggcaggaaggcugagagg

SEQ ID NO: 1796165 - RNA, 16 nt, Human
caggcagccaggccac

SEQ ID NO: 1796166 - RNA, 17 nt, Human
caggcagccaggccaca

SEQ ID NO: 1796167 - RNA, 20 nt, Human
caggcauguucucugaggac

SEQ ID NO: 1796168 - RNA, 19 nt, Human
caggcauguucucugagga

SEQ ID NO: 1796169 - RNA, 18 nt, Human
caggcauguucucugagg

SEQ ID NO: 1796170 - RNA, 15 nt, Human
caggcauguucucug

SEQ ID NO: 1796171 - RNA, 13 nt, Human
caggcauucccca

SEQ ID NO: 1796172 - RNA, 15 nt, Human
caggcauuccccagg

SEQ ID NO: 1796173 - RNA, 16 nt, Human
caggcauuccccagga

SEQ ID NO: 1796174 - RNA, 17 nt, Human
caggcauuccccaggag

SEQ ID NO: 1796175 - RNA, 24 nt, Human
caggcauuccccaggaggccagcc

SEQ ID NO: 1796176 - RNA, 22 nt, Human
caggcauuccccaggaggccag

SEQ ID NO: 1796177 - RNA, 23 nt, Human
caggcauuccccaggaggccagc

SEQ ID NO: 1796178 - RNA, 18 nt, Human
caggcauuccccaggagg

SEQ ID NO: 1796179 - RNA, 19 nt, Human
caggcauuccccaggaggc

SEQ ID NO: 1796180 - RNA, 20 nt, Human
caggcauuccccaggaggcc

SEQ ID NO: 1796181 - RNA, 21 nt, Human
caggcauuccccaggaggcca

SEQ ID NO: 1796182 - RNA, 23 nt, Human
caggcaggucuugaacuccuggc

SEQ ID NO: 1796183 - RNA, 15 nt, Human
caggcaggugggaug

SEQ ID NO: 1796184 - RNA, 22 nt, Human
caggcaggucuugaacuccugg

SEQ ID NO: 1796185 - RNA, 13 nt, Human
caggcaggucuug

SEQ ID NO: 1796186 - RNA, 12 nt, Human
caggcaggucuu

SEQ ID NO: 1796187 - RNA, 19 nt, Human
caggcagguccaggguuug

SEQ ID NO: 1796188 - RNA, 15 nt, Human
caggcagguccaggg

SEQ ID NO: 1796189 - RNA, 14 nt, Human
caggcagguccagg

SEQ ID NO: 1796190 - RNA, 17 nt, Human
caggcaugguggcccac

SEQ ID NO: 1796191 - RNA, 13 nt, Human
caggccccugcca

SEQ ID NO: 1796192 - RNA, 21 nt, Human
caggccauuccccgucucugg

SEQ ID NO: 1796193 - RNA, 18 nt, Human
caggccaaacucaccugc

SEQ ID NO: 1796194 - RNA, 23 nt, Human
caggccaaacucaccugccccuc

SEQ ID NO: 1796195 - RNA, 13 nt, Human
caggccacaagac

SEQ ID NO: 1796196 - RNA, 17 nt, Human
caggccacaagacccuu

SEQ ID NO: 1796197 - RNA, 18 nt, Human
caggccacaagacccuug

SEQ ID NO: 1796198 - RNA, 18 nt, Human
caggccauuccccgucuc

SEQ ID NO: 1796199 - RNA, 20 nt, Human
caggccacaagacccuugug

SEQ ID NO: 1796200 - RNA, 21 nt, Human
caggccaggcccucugcccac

SEQ ID NO: 1796201 - RNA, 22 nt, Human
caggccaggcccucugcccacu

SEQ ID NO: 1796202 - RNA, 16 nt, Human
caggcccggcuccagg

SEQ ID NO: 1796203 - RNA, 20 nt, Human
caggccccugccacccuggg

SEQ ID NO: 1796204 - RNA, 19 nt, Human
caggccccugccacccugg

SEQ ID NO: 1796205 - RNA, 17 nt, Human
caggccccugccacccu

SEQ ID NO: 1796206 - RNA, 15 nt, Human
caggccccugccacc

SEQ ID NO: 1796207 - RNA, 15 nt, Human
caggcccggcuccag

SEQ ID NO: 1796208 - RNA, 14 nt, Human
caggcccggcucca

SEQ ID NO: 1796209 - RNA, 13 nt, Human
caggcccggcucc

SEQ ID NO: 1796210 - RNA, 12 nt, Human
caggacucugcc

SEQ ID NO: 1796211 - RNA, 13 nt, Human
caggacucugccu

SEQ ID NO: 1796212 - RNA, 15 nt, Human
caggacucugccucc

SEQ ID NO: 1796213 - RNA, 16 nt, Human
caggacucugccuccu

SEQ ID NO: 1796214 - RNA, 12 nt, Human
caggagugagca

SEQ ID NO: 1796215 - RNA, 20 nt, Human
caggagccuccugcccuuac

SEQ ID NO: 1796216 - RNA, 14 nt, Human
caggagccuccugc

SEQ ID NO: 1796217 - RNA, 17 nt, Human
caggagccuccugcccu

SEQ ID NO: 1796218 - RNA, 21 nt, Human
caggagcccugggaggcucug

SEQ ID NO: 1796219 - RNA, 18 nt, Human
caggagccccgaggccuu

SEQ ID NO: 1796220 - RNA, 16 nt, Human
caggagccccgaggcc

SEQ ID NO: 1796221 - RNA, 15 nt, Human
caggagccccgaggc

SEQ ID NO: 1796222 - RNA, 12 nt, Human
caggagcagcca

SEQ ID NO: 1796223 - RNA, 13 nt, Human
caggagcagccac

SEQ ID NO: 1796224 - RNA, 14 nt, Human
caggagcagccaca

SEQ ID NO: 1796225 - RNA, 19 nt, Human
caggagcagccacauuccu

SEQ ID NO: 1796226 - RNA, 22 nt, Human
caggagccccgaggccuucucu

SEQ ID NO: 1796227 - RNA, 20 nt, Human
caggagccccgaggccuucu

SEQ ID NO: 1796228 - RNA, 23 nt, Human
caggagccccgaggccuucucug

SEQ ID NO: 1796229 - RNA, 11 nt, Human
caggagcccug

SEQ ID NO: 1796230 - RNA, 14 nt, Human
caggagcccuggga

SEQ ID NO: 1796231 - RNA, 16 nt, Human
caggagcccugggagg

SEQ ID NO: 1796232 - RNA, 18 nt, Human
caggagcccugggaggcu

SEQ ID NO: 1796233 - RNA, 19 nt, Human
caggagcccugggaggcuc

SEQ ID NO: 1796234 - RNA, 17 nt, Human
caggaguggguugauuu

SEQ ID NO: 1796235 - RNA, 16 nt, Human
caggaguuggaagugu

SEQ ID NO: 1796236 - RNA, 19 nt, Human
caggaguuucguuuucaaa

SEQ ID NO: 1796237 - RNA, 21 nt, Human
caggaguuugagaccaaccug

SEQ ID NO: 1796238 - RNA, 13 nt, Human
caggauagacuuu

SEQ ID NO: 1796239 - RNA, 22 nt, Human
caggaguuugagaccaaccugg

SEQ ID NO: 1796240 - RNA, 23 nt, Human
caggaguuugagaccaaccuggg

SEQ ID NO: 1796241 - RNA, 23 nt, Human
caguaccauuuaauggggaggac

SEQ ID NO: 1796242 - RNA, 12 nt, Human
caguaauaacuc

SEQ ID NO: 1796243 - RNA, 13 nt, Human
caguaauaacucu

SEQ ID NO: 1796244 - RNA, 13 nt, Human
cagguucagcuug

SEQ ID NO: 1796245 - RNA, 15 nt, Human
cagguuccacagagg

SEQ ID NO: 1796246 - RNA, 19 nt, Human
cagguuccacagaggacac

SEQ ID NO: 1796247 - RNA, 12 nt, Human
cagguucagcuu

SEQ ID NO: 1796248 - RNA, 21 nt, Human
caguaaaugggggugcauuug

SEQ ID NO: 1796249 - RNA, 22 nt, Human
caguaaaugggggugcauuuga

SEQ ID NO: 1796250 - RNA, 12 nt, Human
caggugugaacc

SEQ ID NO: 1796251 - RNA, 19 nt, Human
caggugucccugcacuugc

SEQ ID NO: 1796252 - RNA, 18 nt, Human
caggugucccugcacuug

SEQ ID NO: 1796253 - RNA, 16 nt, Human
caggugucccugcacu

SEQ ID NO: 1796254 - RNA, 15 nt, Human
caggugucccugcac

SEQ ID NO: 1796255 - RNA, 23 nt, Human
caggugugaaccaccacacccag

SEQ ID NO: 1796256 - RNA, 22 nt, Human
caggugugaaccaccacaccca

SEQ ID NO: 1796257 - RNA, 19 nt, Human
caggugugaaccaccacac

SEQ ID NO: 1796258 - RNA, 16 nt, Human
caggugugaaccacca

SEQ ID NO: 1796259 - RNA, 21 nt, Human
caggugugagucaccaagccc

SEQ ID NO: 1796260 - RNA, 20 nt, Human
caggugugagucaccaagcc

SEQ ID NO: 1796261 - RNA, 16 nt, Human
caggugugagucacca

SEQ ID NO: 1796262 - RNA, 18 nt, Human
caggugugagccaccacg

SEQ ID NO: 1796263 - RNA, 23 nt, Human
caggugugagucaccaagcccag

SEQ ID NO: 1796264 - RNA, 22 nt, Human
caggugugagucaccaagccca

SEQ ID NO: 1796265 - RNA, 21 nt, Human
caggugugagccaccacgccc

SEQ ID NO: 1796266 - RNA, 14 nt, Human
caggugucccugca

SEQ ID NO: 1796267 - RNA, 11 nt, Human
caggugucccu

SEQ ID NO: 1796268 - RNA, 20 nt, Human
caggugguuauggagagggu

SEQ ID NO: 1796269 - RNA, 18 nt, Human
caggugguuauggagagg

SEQ ID NO: 1796270 - RNA, 23 nt, Human
cagguggggucacucuggcagcu

SEQ ID NO: 1796271 - RNA, 19 nt, Human
cagguggggucacucuggc

SEQ ID NO: 1796272 - RNA, 20 nt, Human
cagguggggucacucuggca

SEQ ID NO: 1796273 - RNA, 21 nt, Human
cagguggggucacucuggcag

SEQ ID NO: 1796274 - RNA, 22 nt, Human
cagguggggucacucuggcagc

SEQ ID NO: 1796275 - RNA, 17 nt, Human
cagguggggcagcuuga

SEQ ID NO: 1796276 - RNA, 18 nt, Human
cagguggggucacucugg

SEQ ID NO: 1796277 - RNA, 16 nt, Human
cagguggggcagcuug

SEQ ID NO: 1796278 - RNA, 15 nt, Human
cagguggggcagcuu

SEQ ID NO: 1796279 - RNA, 14 nt, Human
cagguggggcagcu

SEQ ID NO: 1796280 - RNA, 13 nt, Human
cagguggggcagc

SEQ ID NO: 1796281 - RNA, 21 nt, Human
caggguauuccagagugggga

SEQ ID NO: 1796282 - RNA, 20 nt, Human
caggguauuccagagugggg

SEQ ID NO: 1796283 - RNA, 12 nt, Human
cagggucccugg

SEQ ID NO: 1796284 - RNA, 14 nt, Human
cagggucccuggug

SEQ ID NO: 1796285 - RNA, 15 nt, Human
cagggucccuggugg

SEQ ID NO: 1796286 - RNA, 18 nt, Human
cagggucccugguggcag

SEQ ID NO: 1796287 - RNA, 19 nt, Human
cagggucccugguggcagc

SEQ ID NO: 1796288 - RNA, 22 nt, Human
cagggucccugguggcagcuca

SEQ ID NO: 1796289 - RNA, 15 nt, Human
cagggucucacucug

SEQ ID NO: 1796290 - RNA, 23 nt, Human
cagggucucacuauguugcccag

SEQ ID NO: 1796291 - RNA, 22 nt, Human
cagggucucacuauguugccca

SEQ ID NO: 1796292 - RNA, 21 nt, Human
cagggucucacuauguugccc

SEQ ID NO: 1796293 - RNA, 23 nt, Human
cagggucccugguggcagcucac

SEQ ID NO: 1796294 - RNA, 18 nt, Human
caggguccuguagcccua

SEQ ID NO: 1796295 - RNA, 17 nt, Human
cagguaacaggcagaua

SEQ ID NO: 1796296 - RNA, 16 nt, Human
cagguaacaggcagau

SEQ ID NO: 1796297 - RNA, 15 nt, Human
cagguaacaggcaga

SEQ ID NO: 1796298 - RNA, 14 nt, Human
cagguaacaggcag

SEQ ID NO: 1796299 - RNA, 16 nt, Human
cagggucucacucugu

SEQ ID NO: 1796300 - RNA, 17 nt, Human
cagggucucacucuguc

SEQ ID NO: 1796301 - RNA, 16 nt, Human
caggguuuugccaugu

SEQ ID NO: 1796302 - RNA, 14 nt, Human
caggggugggacac

SEQ ID NO: 1796303 - RNA, 15 nt, Human
caggggugggacacc

SEQ ID NO: 1796304 - RNA, 20 nt, Human
caggggugggacacccugug

SEQ ID NO: 1796305 - RNA, 21 nt, Human
caggggugggacacccuguga

SEQ ID NO: 1796306 - RNA, 11 nt, Human
caggucccuaa

SEQ ID NO: 1796307 - RNA, 12 nt, Human
caggucccuaau

SEQ ID NO: 1796308 - RNA, 13 nt, Human
caggucccuaaua

SEQ ID NO: 1796309 - RNA, 14 nt, Human
caggucccuaauaa

SEQ ID NO: 1796310 - RNA, 15 nt, Human
caggucccuaauaaa

SEQ ID NO: 1796311 - RNA, 16 nt, Human
caggucccuaauaaag

SEQ ID NO: 1796312 - RNA, 17 nt, Human
caggucccuaauaaagc

SEQ ID NO: 1796313 - RNA, 18 nt, Human
caggucccuaauaaagcu

SEQ ID NO: 1796314 - RNA, 21 nt, Human
cagguaacaggcagauacagg

SEQ ID NO: 1796315 - RNA, 20 nt, Human
cagguaacaggcagauacag

SEQ ID NO: 1796316 - RNA, 17 nt, Human
cagguaaucgaccugcc

SEQ ID NO: 1796317 - RNA, 18 nt, Human
cagguaaucgaccugccu

SEQ ID NO: 1796318 - RNA, 19 nt, Human
cagguaaucgaccugccuc

SEQ ID NO: 1796319 - RNA, 20 nt, Human
cagguaaucgaccugccucg

SEQ ID NO: 1796320 - RNA, 21 nt, Human
caggugagaagcagaggaagg

SEQ ID NO: 1796321 - RNA, 13 nt, Human
caggugagaagca

SEQ ID NO: 1796322 - RNA, 20 nt, Human
caggugagaagcagaggaag

SEQ ID NO: 1796323 - RNA, 15 nt, Human
cagguggccacucca

SEQ ID NO: 1796324 - RNA, 16 nt, Human
cagguggccacuccag

SEQ ID NO: 1796325 - RNA, 19 nt, Human
cagguggccacuccagacc

SEQ ID NO: 1796326 - RNA, 21 nt, Human
cagguggccacuccagacccc

SEQ ID NO: 1796327 - RNA, 23 nt, Human
caggucuugaacuccuggccuca

SEQ ID NO: 1796328 - RNA, 22 nt, Human
caggucuugaacuccuggccuc

SEQ ID NO: 1796329 - RNA, 21 nt, Human
caggucuugaacuccuggccu

SEQ ID NO: 1796330 - RNA, 20 nt, Human
caggucuugaacuccuggcc

SEQ ID NO: 1796331 - RNA, 19 nt, Human
caggucuugaacuccuggc

SEQ ID NO: 1796332 - RNA, 18 nt, Human
caggucuugaacuccugg

SEQ ID NO: 1796333 - RNA, 19 nt, Human
caggucccuaauaaagcug

SEQ ID NO: 1796334 - RNA, 20 nt, Human
caggucccuaauaaagcugu

SEQ ID NO: 1796335 - RNA, 21 nt, Human
caggucccuaauaaagcugug

SEQ ID NO: 1796336 - RNA, 22 nt, Human
caggucccuaauaaagcugugu

SEQ ID NO: 1796337 - RNA, 16 nt, Human
cagugaaagaaaauaa

SEQ ID NO: 1796338 - RNA, 20 nt, Human
cagugaaagaaaauaacaau

SEQ ID NO: 1796339 - RNA, 17 nt, Human
cagucuuguauuaaguu

SEQ ID NO: 1796340 - RNA, 16 nt, Human
cagucuuggcucacug

SEQ ID NO: 1796341 - RNA, 19 nt, Human
cagucuggaaugcaguggu

SEQ ID NO: 1796342 - RNA, 16 nt, Human
caguccucccaucuca

SEQ ID NO: 1796343 - RNA, 17 nt, Human
caguccucccaucucac

SEQ ID NO: 1796344 - RNA, 15 nt, Human
caguccuuaccagca

SEQ ID NO: 1796345 - RNA, 18 nt, Human
caguccuuaccagcagag

SEQ ID NO: 1796346 - RNA, 19 nt, Human
caguccuuaccagcagagc

SEQ ID NO: 1796347 - RNA, 20 nt, Human
caguccuuaccagcagagca

SEQ ID NO: 1796348 - RNA, 21 nt, Human
caguccuuaccagcagagcac

SEQ ID NO: 1796349 - RNA, 18 nt, Human
cagucuggaaugcagugg

SEQ ID NO: 1796350 - RNA, 15 nt, Human
cagugagacagcucu

SEQ ID NO: 1796351 - RNA, 18 nt, Human
cagugagucgaggacagg

SEQ ID NO: 1796352 - RNA, 17 nt, Human
cagugagucgaggacag

SEQ ID NO: 1796353 - RNA, 23 nt, Human
cagugaggguaaguauuuuccug

SEQ ID NO: 1796354 - RNA, 21 nt, Human
cagugaggcucugcccuuggu

SEQ ID NO: 1796355 - RNA, 17 nt, Human
cagugaggcucugcccu

SEQ ID NO: 1796356 - RNA, 18 nt, Human
cagugaggcucugcccuu

SEQ ID NO: 1796357 - RNA, 19 nt, Human
cagugaggcucugcccuug

SEQ ID NO: 1796358 - RNA, 20 nt, Human
cagugaggcucugcccuugg

SEQ ID NO: 1796359 - RNA, 24 nt, Human
cagugagccgagauugcaccacug

SEQ ID NO: 1796360 - RNA, 12 nt, Human
cagugaggcucu

SEQ ID NO: 1796361 - RNA, 13 nt, Human
cagugaggcucug

SEQ ID NO: 1796362 - RNA, 14 nt, Human
cagugaggcucugc

SEQ ID NO: 1796363 - RNA, 15 nt, Human
cagugaggcucugcc

SEQ ID NO: 1796364 - RNA, 16 nt, Human
cagugaggcucugccc

SEQ ID NO: 1796365 - RNA, 18 nt, Human
cagugauuaccagggacu

SEQ ID NO: 1796366 - RNA, 17 nt, Human
cagugauuaccagggac

SEQ ID NO: 1796367 - RNA, 15 nt, Human
cagugcccuccagga

SEQ ID NO: 1796368 - RNA, 23 nt, Human
cagugagucgaggacagggaggu

SEQ ID NO: 1796369 - RNA, 22 nt, Human
cagugagucgaggacagggagg

SEQ ID NO: 1796370 - RNA, 20 nt, Human
cagugagucgaggacaggga

SEQ ID NO: 1796371 - RNA, 19 nt, Human
cagugagucgaggacaggg

SEQ ID NO: 1796372 - RNA, 15 nt, Human
cagugccgagaagga

SEQ ID NO: 1796373 - RNA, 18 nt, Human
cagugccgagaaggaagc

SEQ ID NO: 1796374 - RNA, 11 nt, Human
cagugccuuau

SEQ ID NO: 1796375 - RNA, 13 nt, Human
cagugccuuaugg

SEQ ID NO: 1796376 - RNA, 15 nt, Human
cagugccuuauggaa

SEQ ID NO: 1796377 - RNA, 16 nt, Human
cagugccuuauggaac

SEQ ID NO: 1796378 - RNA, 17 nt, Human
cagugccuuauggaaca

SEQ ID NO: 1796379 - RNA, 18 nt, Human
cagugccuuauggaacac

SEQ ID NO: 1796380 - RNA, 19 nt, Human
cagugccuuauggaacacu

SEQ ID NO: 1796381 - RNA, 20 nt, Human
cagugccuuauggaacacuc

SEQ ID NO: 1796382 - RNA, 21 nt, Human
cagugccuuauggaacacucu

SEQ ID NO: 1796383 - RNA, 22 nt, Human
cagugccuuauggaacacucug

SEQ ID NO: 1796384 - RNA, 23 nt, Human
cagugccuuauggaacacucuga

SEQ ID NO: 1796385 - RNA, 13 nt, Human
caguaucucaggg

SEQ ID NO: 1796386 - RNA, 15 nt, Human
caguaucucagggcc

SEQ ID NO: 1796387 - RNA, 12 nt, Human
caguaucuugaa

SEQ ID NO: 1796388 - RNA, 18 nt, Human
caguaucuugaagacuuu

SEQ ID NO: 1796389 - RNA, 21 nt, Human
caguaucuugaagacuuuucu

SEQ ID NO: 1796390 - RNA, 12 nt, Human
caguauggcagc

SEQ ID NO: 1796391 - RNA, 12 nt, Human
caguagugauag

SEQ ID NO: 1796392 - RNA, 19 nt, Human
caguauuacuucugcuaca

SEQ ID NO: 1796393 - RNA, 18 nt, Human
caguauuacuucugcuac

SEQ ID NO: 1796394 - RNA, 16 nt, Human
caguauuacuucugcu

SEQ ID NO: 1796395 - RNA, 16 nt, Human
caguccauagcagaga

SEQ ID NO: 1796396 - RNA, 14 nt, Human
caguccauugaaag

SEQ ID NO: 1796397 - RNA, 13 nt, Human
caguccaugaaga

SEQ ID NO: 1796398 - RNA, 23 nt, Human
caguccccgugaaggagagcccu

SEQ ID NO: 1796399 - RNA, 16 nt, Human
cagucccccugcccca

SEQ ID NO: 1796400 - RNA, 17 nt, Human
cagucccccugccccag

SEQ ID NO: 1796401 - RNA, 17 nt, Human
cagucccugccaaugga

SEQ ID NO: 1796402 - RNA, 12 nt, Human
caguccucccau

SEQ ID NO: 1796403 - RNA, 13 nt, Human
caguccucccauc

SEQ ID NO: 1796404 - RNA, 14 nt, Human
caguccucccaucu

SEQ ID NO: 1796405 - RNA, 15 nt, Human
caguccucccaucuc

SEQ ID NO: 1796406 - RNA, 12 nt, Human
cagucccugcca

SEQ ID NO: 1796407 - RNA, 13 nt, Human
cagucccugccaa

SEQ ID NO: 1796408 - RNA, 14 nt, Human
cagucccugccaau

SEQ ID NO: 1796409 - RNA, 15 nt, Human
cagucccugccaaug

SEQ ID NO: 1796410 - RNA, 16 nt, Human
cagucccugccaaugg

SEQ ID NO: 1796411 - RNA, 20 nt, Human
cagcuuguaaauagcucagg

SEQ ID NO: 1796412 - RNA, 19 nt, Human
cagcuuguaaauagcucag

SEQ ID NO: 1796413 - RNA, 18 nt, Human
cagcuuguaaauagcuca

SEQ ID NO: 1796414 - RNA, 22 nt, Human
cagcuuguaaauagcucaggug

SEQ ID NO: 1796415 - RNA, 21 nt, Human
cagcuuguaaauagcucaggu

SEQ ID NO: 1796416 - RNA, 22 nt, Human
cagcuuuaaaaaauuaaucugg

SEQ ID NO: 1796417 - RNA, 23 nt, Human
cagcuuuccccaugucucgacuc

SEQ ID NO: 1796418 - RNA, 23 nt, Human
cagcuuuccucaaaacuucagac

SEQ ID NO: 1796419 - RNA, 12 nt, Human
cagcuuuguuug

SEQ ID NO: 1796420 - RNA, 21 nt, Human
cagcuuuguuuguugucagcu

SEQ ID NO: 1796421 - RNA, 22 nt, Human
cagcuuuguuuguugucagcug

SEQ ID NO: 1796422 - RNA, 23 nt, Human
cagcuuuguuuguugucagcuga

SEQ ID NO: 1796423 - RNA, 14 nt, Human
cagcuuugauauuu

SEQ ID NO: 1796424 - RNA, 21 nt, Human
cagcuucauuuccugugucuu

SEQ ID NO: 1796425 - RNA, 20 nt, Human
cagcuucauuuccugugucu

SEQ ID NO: 1796426 - RNA, 15 nt, Human
cagcuugaggguugg

SEQ ID NO: 1796427 - RNA, 14 nt, Human
cagcuugaggguug

SEQ ID NO: 1796428 - RNA, 18 nt, Human
cagcuugaccgugaggcc

SEQ ID NO: 1796429 - RNA, 19 nt, Human
cagcuugaccgugaggcca

SEQ ID NO: 1796430 - RNA, 20 nt, Human
cagcuugaccgugaggccag

SEQ ID NO: 1796431 - RNA, 21 nt, Human
cagcuugaccgugaggccaga

SEQ ID NO: 1796432 - RNA, 21 nt, Human
cagcuugaggguugggcuggu

SEQ ID NO: 1796433 - RNA, 20 nt, Human
cagcuugaggguugggcugg

SEQ ID NO: 1796434 - RNA, 19 nt, Human
cagcuugaggguugggcug

SEQ ID NO: 1796435 - RNA, 18 nt, Human
cagcuugaggguugggcu

SEQ ID NO: 1796436 - RNA, 14 nt, Human
caggaagcagcuuu

SEQ ID NO: 1796437 - RNA, 22 nt, Human
caggaagccagcaggcucucag

SEQ ID NO: 1796438 - RNA, 19 nt, Human
caggaagccagcaggcucu

SEQ ID NO: 1796439 - RNA, 21 nt, Human
caggaagccagcaggcucuca

SEQ ID NO: 1796440 - RNA, 14 nt, Human
caggaagccagcag

SEQ ID NO: 1796441 - RNA, 16 nt, Human
caggaagccagcaggc

SEQ ID NO: 1796442 - RNA, 17 nt, Human
caggaagccagcaggcu

SEQ ID NO: 1796443 - RNA, 18 nt, Human
caggaagccagcaggcuc

SEQ ID NO: 1796444 - RNA, 23 nt, Human
caggaagcucagggccuggcuca

SEQ ID NO: 1796445 - RNA, 20 nt, Human
caggaagcucagggccuggc

SEQ ID NO: 1796446 - RNA, 21 nt, Human
caggaagcucagggccuggcu

SEQ ID NO: 1796447 - RNA, 13 nt, Human
caggaagcucagg

SEQ ID NO: 1796448 - RNA, 14 nt, Human
caggaagcucaggg

SEQ ID NO: 1796449 - RNA, 15 nt, Human
caggaagcucagggc

SEQ ID NO: 1796450 - RNA, 16 nt, Human
caggaagcucagggcc

SEQ ID NO: 1796451 - RNA, 17 nt, Human
caggaagcucagggccu

SEQ ID NO: 1796452 - RNA, 18 nt, Human
caggaagcucagggccug

SEQ ID NO: 1796453 - RNA, 19 nt, Human
caggaagcucagggccugg

SEQ ID NO: 1796454 - RNA, 17 nt, Human
caggaccuguggccaag

SEQ ID NO: 1796455 - RNA, 16 nt, Human
caggaaguagaggagg

SEQ ID NO: 1796456 - RNA, 17 nt, Human
caggaaguacuggagaa

SEQ ID NO: 1796457 - RNA, 18 nt, Human
caggaaguacuggagaaa

SEQ ID NO: 1796458 - RNA, 20 nt, Human
caggaaguacuggagaaaau

SEQ ID NO: 1796459 - RNA, 15 nt, Human
caggaaguagaggag

SEQ ID NO: 1796460 - RNA, 12 nt, Human
caggaaguacug

SEQ ID NO: 1796461 - RNA, 14 nt, Human
caggaaguacugga

SEQ ID NO: 1796462 - RNA, 16 nt, Human
caggaaguacuggaga

SEQ ID NO: 1796463 - RNA, 19 nt, Human
caggaaggcugagaggaga

SEQ ID NO: 1796464 - RNA, 15 nt, Human
caggaaggcuaaagg

SEQ ID NO: 1796465 - RNA, 22 nt, Human
cagcugcuuuugucuaugggac

SEQ ID NO: 1796466 - RNA, 23 nt, Human
cagcugcuuuugucuaugggacu

SEQ ID NO: 1796467 - RNA, 19 nt, Human
cagcuggccgggagccuga

SEQ ID NO: 1796468 - RNA, 18 nt, Human
cagcuggagaaauauggu

SEQ ID NO: 1796469 - RNA, 23 nt, Human
cagcugggaucacauguggacuu

SEQ ID NO: 1796470 - RNA, 18 nt, Human
cagcuggggccaggcugg

SEQ ID NO: 1796471 - RNA, 19 nt, Human
cagcuggggccaggcuggg

SEQ ID NO: 1796472 - RNA, 20 nt, Human
cagcuggggccaggcugggu

SEQ ID NO: 1796473 - RNA, 21 nt, Human
cagcuggggccaggcuggguc

SEQ ID NO: 1796474 - RNA, 22 nt, Human
cagcuggggccaggcugggucg

SEQ ID NO: 1796475 - RNA, 21 nt, Human
cagcugggguggggaccucag

SEQ ID NO: 1796476 - RNA, 22 nt, Human
cagcugggguggggaccucagg

SEQ ID NO: 1796477 - RNA, 23 nt, Human
cagcugggguggggaccucaggc

SEQ ID NO: 1796478 - RNA, 18 nt, Human
cagcugguugagguuuca

SEQ ID NO: 1796479 - RNA, 16 nt, Human
cagcuggguuggaaaa

SEQ ID NO: 1796480 - RNA, 17 nt, Human
cagcuggguuggaaaac

SEQ ID NO: 1796481 - RNA, 24 nt, Human
cagcugcgguccacccaggagccc

SEQ ID NO: 1796482 - RNA, 23 nt, Human
cagcugcgguccacccaggagcc

SEQ ID NO: 1796483 - RNA, 22 nt, Human
cagcugcgguccacccaggagc

SEQ ID NO: 1796484 - RNA, 21 nt, Human
cagcugcgguccacccaggag

SEQ ID NO: 1796485 - RNA, 20 nt, Human
cagcugcgguccacccagga

SEQ ID NO: 1796486 - RNA, 19 nt, Human
cagcugcgguccacccagg

SEQ ID NO: 1796487 - RNA, 18 nt, Human
cagcugcgguccacccag

SEQ ID NO: 1796488 - RNA, 18 nt, Human
cagcugccugggaucccu

SEQ ID NO: 1796489 - RNA, 23 nt, Human
cagcugccugggaucccucaucc

SEQ ID NO: 1796490 - RNA, 13 nt, Human
cagcugcuugggc

SEQ ID NO: 1796491 - RNA, 14 nt, Human
cagcugcuugggcu

SEQ ID NO: 1796492 - RNA, 15 nt, Human
cagcugcuugggcuu

SEQ ID NO: 1796493 - RNA, 16 nt, Human
cagcugcuugggcuuc

SEQ ID NO: 1796494 - RNA, 18 nt, Human
cagcugcuugggcuucau

SEQ ID NO: 1796495 - RNA, 19 nt, Human
cagcugcuugggcuucauc

SEQ ID NO: 1796496 - RNA, 21 nt, Human
cagcugcuugggcuucauccu

SEQ ID NO: 1796497 - RNA, 22 nt, Human
cagcugcuugggcuucauccuc

SEQ ID NO: 1796498 - RNA, 21 nt, Human
cagcugcucaauaaaguacaa

SEQ ID NO: 1796499 - RNA, 17 nt, Human
cagcugcuacuacuccu

SEQ ID NO: 1796500 - RNA, 15 nt, Human
cagcucugcaagaau

SEQ ID NO: 1796501 - RNA, 16 nt, Human
cagcucugcaagaauu

SEQ ID NO: 1796502 - RNA, 21 nt, Human
cagcucugcaagaauugaagc

SEQ ID NO: 1796503 - RNA, 20 nt, Human
cagcucugcauacucauuag

SEQ ID NO: 1796504 - RNA, 23 nt, Human
cagcuccuucuguccuacucugu

SEQ ID NO: 1796505 - RNA, 21 nt, Human
cagcuccuucuguccuacucu

SEQ ID NO: 1796506 - RNA, 17 nt, Human
cagcuccuucuguccua

SEQ ID NO: 1796507 - RNA, 16 nt, Human
cagcuccuucuguccu

SEQ ID NO: 1796508 - RNA, 13 nt, Human
cagcucagagagg

SEQ ID NO: 1796509 - RNA, 17 nt, Human
cagcucagagagggugg

SEQ ID NO: 1796510 - RNA, 19 nt, Human
cagcucagagaggguggga

SEQ ID NO: 1796511 - RNA, 20 nt, Human
cagcucagagagggugggag

SEQ ID NO: 1796512 - RNA, 23 nt, Human
cagcucuucuccaggcuguaucc

SEQ ID NO: 1796513 - RNA, 19 nt, Human
cagcucuucuccaggcugu

SEQ ID NO: 1796514 - RNA, 18 nt, Human
cagcucuucuccaggcug

SEQ ID NO: 1796515 - RNA, 17 nt, Human
cagcucuucuccaggcu

SEQ ID NO: 1796516 - RNA, 16 nt, Human
cagcucuucuccaggc

SEQ ID NO: 1796517 - RNA, 15 nt, Human
cagcucuucuccagg

SEQ ID NO: 1796518 - RNA, 14 nt, Human
cagcucuucuccag

SEQ ID NO: 1796519 - RNA, 13 nt, Human
cagcucuucucca

SEQ ID NO: 1796520 - RNA, 23 nt, Human
cagcucuguccugggagugagcu

SEQ ID NO: 1796521 - RNA, 10 nt, Human
cagcucuuau

SEQ ID NO: 1796522 - RNA, 21 nt, Human
cagcucuuauauugccauuuc

SEQ ID NO: 1796523 - RNA, 18 nt, Human
cagcucuguccugggagu

SEQ ID NO: 1796524 - RNA, 17 nt, Human
cagcucuguccugggag

SEQ ID NO: 1796525 - RNA, 16 nt, Human
cagcucuguccuggga

SEQ ID NO: 1796526 - RNA, 14 nt, Human
cagcucuguccugg

SEQ ID NO: 1796527 - RNA, 13 nt, Human
cagcucuguccug

SEQ ID NO: 1796528 - RNA, 12 nt, Human
cagcucuguccu

SEQ ID NO: 1796529 - RNA, 22 nt, Human
cagcucugguccauagagagca

SEQ ID NO: 1796530 - RNA, 23 nt, Human
cagcucugguccauagagagcaa

SEQ ID NO: 1796531 - RNA, 10 nt, Human
cagcucuggu

SEQ ID NO: 1796532 - RNA, 13 nt, Human
cagcucuggucca

SEQ ID NO: 1796533 - RNA, 16 nt, Human
cagcucugguccauag

SEQ ID NO: 1796534 - RNA, 17 nt, Human
cagcucugguccauaga

SEQ ID NO: 1796535 - RNA, 18 nt, Human
cagcucugguccauagag

SEQ ID NO: 1796536 - RNA, 21 nt, Human
cagcucugguccauagagagc

SEQ ID NO: 1796537 - RNA, 22 nt, Human
caggaagcucagggccuggcuc

SEQ ID NO: 1796538 - RNA, 23 nt, Human
cagccucccgaguagcugggacu

SEQ ID NO: 1796539 - RNA, 22 nt, Human
cagccucccgaguagcugggac

SEQ ID NO: 1796540 - RNA, 21 nt, Human
cagccucccgaguagcuggga

SEQ ID NO: 1796541 - RNA, 20 nt, Human
cagccucccgaguagcuggg

SEQ ID NO: 1796542 - RNA, 19 nt, Human
cagccucccgaguagcugg

SEQ ID NO: 1796543 - RNA, 23 nt, Human
cagccucccgaauagcugggacu

SEQ ID NO: 1796544 - RNA, 20 nt, Human
cagccuccugaguagcugga

SEQ ID NO: 1796545 - RNA, 15 nt, Human
cagccuccugaguag

SEQ ID NO: 1796546 - RNA, 20 nt, Human
cagccugcuccagcuguuca

SEQ ID NO: 1796547 - RNA, 13 nt, Human
cagccuggcacag

SEQ ID NO: 1796548 - RNA, 20 nt, Human
cagccuggcacagggcagug

SEQ ID NO: 1796549 - RNA, 21 nt, Human
cagccuggcacagggcagugg

SEQ ID NO: 1796550 - RNA, 10 nt, Human
cagccuggca

SEQ ID NO: 1796551 - RNA, 15 nt, Human
cagccuggacccugu

SEQ ID NO: 1796552 - RNA, 19 nt, Human
cagccuggacccuguggau

SEQ ID NO: 1796553 - RNA, 22 nt, Human
cagccuugaccauucuccaccu

SEQ ID NO: 1796554 - RNA, 23 nt, Human
cagccuugaccauucuccaccug

SEQ ID NO: 1796555 - RNA, 24 nt, Human
cagccuugaccauucuccaccugc

SEQ ID NO: 1796556 - RNA, 17 nt, Human
cagccuugaccauucuc

SEQ ID NO: 1796557 - RNA, 20 nt, Human
cagccuugaccauucuccac

SEQ ID NO: 1796558 - RNA, 21 nt, Human
cagccuugaccauucuccacc

SEQ ID NO: 1796559 - RNA, 16 nt, Human
cagccugggcaaugug

SEQ ID NO: 1796560 - RNA, 19 nt, Human
cagccugggcaaugugaua

SEQ ID NO: 1796561 - RNA, 16 nt, Human
cagcuaaugggacacu

SEQ ID NO: 1796562 - RNA, 15 nt, Human
cagcuaaugggacac

SEQ ID NO: 1796563 - RNA, 19 nt, Human
cagcuaaucagcauucuca

SEQ ID NO: 1796564 - RNA, 20 nt, Human
cagcuaacauggaaguacua

SEQ ID NO: 1796565 - RNA, 19 nt, Human
cagcuacuugggaggcuga

SEQ ID NO: 1796566 - RNA, 20 nt, Human
cagcgagcccugguggcagu

SEQ ID NO: 1796567 - RNA, 19 nt, Human
cagcgagcccugguggcag

SEQ ID NO: 1796568 - RNA, 17 nt, Human
cagcgagcccugguggc

SEQ ID NO: 1796569 - RNA, 16 nt, Human
cagcgagcccuggugg

SEQ ID NO: 1796570 - RNA, 13 nt, Human
cagcgagcccugg

SEQ ID NO: 1796571 - RNA, 21 nt, Human
cagcgagcccugguggcagug

SEQ ID NO: 1796572 - RNA, 19 nt, Human
cagcuaacauggaaguacu

SEQ ID NO: 1796573 - RNA, 18 nt, Human
cagcuaacauggaaguac

SEQ ID NO: 1796574 - RNA, 19 nt, Human
cagcucaccagccccagug

SEQ ID NO: 1796575 - RNA, 17 nt, Human
cagcucaccagccccag

SEQ ID NO: 1796576 - RNA, 16 nt, Human
cagcucaccagcccca

SEQ ID NO: 1796577 - RNA, 15 nt, Human
cagcucaccagcccc

SEQ ID NO: 1796578 - RNA, 13 nt, Human
cagcucaccagcc

SEQ ID NO: 1796579 - RNA, 21 nt, Human
cagcucaccagccccagugcc

SEQ ID NO: 1796580 - RNA, 20 nt, Human
cagcucaccagccccagugc

SEQ ID NO: 1796581 - RNA, 22 nt, Human
cagcucaccagccccagugccc

SEQ ID NO: 1796582 - RNA, 13 nt, Human
cagcucaccucuc

SEQ ID NO: 1796583 - RNA, 15 nt, Human
cagcucaccucuccc

SEQ ID NO: 1796584 - RNA, 16 nt, Human
cagcucaccucucccu

SEQ ID NO: 1796585 - RNA, 17 nt, Human
cagcucaccucucccuu

SEQ ID NO: 1796586 - RNA, 21 nt, Human
cagcucacugcaaccuucgcc

SEQ ID NO: 1796587 - RNA, 15 nt, Human
cagcucacugcaacc

SEQ ID NO: 1796588 - RNA, 12 nt, Human
cagcucagagag

SEQ ID NO: 1796589 - RNA, 12 nt, Human
cagcucacugca

SEQ ID NO: 1796590 - RNA, 14 nt, Human
cagcucacugcaac

SEQ ID NO: 1796591 - RNA, 19 nt, Human
cagcucaccucucccuugg

SEQ ID NO: 1796592 - RNA, 20 nt, Human
cagcucaccucucccuugga

SEQ ID NO: 1796593 - RNA, 18 nt, Human
cagccucaaccuccuggg

SEQ ID NO: 1796594 - RNA, 17 nt, Human
cagccucaaccuccugg

SEQ ID NO: 1796595 - RNA, 21 nt, Human
cagccucaaccuccugggcua

SEQ ID NO: 1796596 - RNA, 20 nt, Human
cagccucaaccuccugggcu

SEQ ID NO: 1796597 - RNA, 19 nt, Human
cagccucaaccuccugggc

SEQ ID NO: 1796598 - RNA, 14 nt, Human
cagccuccaagcuc

SEQ ID NO: 1796599 - RNA, 20 nt, Human
cagccuccaagcuccaucuc

SEQ ID NO: 1796600 - RNA, 14 nt, Human
cagccucacagucc

SEQ ID NO: 1796601 - RNA, 15 nt, Human
cagccucacaguccu

SEQ ID NO: 1796602 - RNA, 20 nt, Human
cagccucacaguccuuacca

SEQ ID NO: 1796603 - RNA, 22 nt, Human
cagccucccgaauagcugggac

SEQ ID NO: 1796604 - RNA, 21 nt, Human
cagccucccgaauagcuggga

SEQ ID NO: 1796605 - RNA, 20 nt, Human
cagccucccgaauagcuggg

SEQ ID NO: 1796606 - RNA, 23 nt, Human
cagccucccaaagugcugggauu

SEQ ID NO: 1796607 - RNA, 21 nt, Human
cagccucccaaagugcuggga

SEQ ID NO: 1796608 - RNA, 20 nt, Human
cagccucccaaagugcuggg

SEQ ID NO: 1796609 - RNA, 19 nt, Human
cagccucccaaagugcugg

SEQ ID NO: 1796610 - RNA, 15 nt, Human
cagccuccaugcugc

SEQ ID NO: 1796611 - RNA, 17 nt, Human
cagccuccaugcugccu

SEQ ID NO: 1796612 - RNA, 20 nt, Human
cagccuccaugcugccucca

SEQ ID NO: 1796613 - RNA, 14 nt, Human
cagccuccaugcug

SEQ ID NO: 1796614 - RNA, 16 nt, Human
cagcccucccugcccc

SEQ ID NO: 1796615 - RNA, 17 nt, Human
cagcccucccugccccu

SEQ ID NO: 1796616 - RNA, 18 nt, Human
cagcccucccugccccuc

SEQ ID NO: 1796617 - RNA, 22 nt, Human
cagcccucccugccccucccuu

SEQ ID NO: 1796618 - RNA, 18 nt, Human
cagcccugcagagggcac

SEQ ID NO: 1796619 - RNA, 20 nt, Human
cagcccugcagagggcacag

SEQ ID NO: 1796620 - RNA, 13 nt, Human
cagcccugcagag

SEQ ID NO: 1796621 - RNA, 14 nt, Human
cagcccugcagagg

SEQ ID NO: 1796622 - RNA, 15 nt, Human
cagcccugcagaggg

SEQ ID NO: 1796623 - RNA, 16 nt, Human
cagcccugcagagggc

SEQ ID NO: 1796624 - RNA, 11 nt, Human
cagcccugcuu

SEQ ID NO: 1796625 - RNA, 13 nt, Human
cagcccugcuuug

SEQ ID NO: 1796626 - RNA, 19 nt, Human
cagcccugcuuugggcugc

SEQ ID NO: 1796627 - RNA, 20 nt, Human
cagcccugcuuugggcugcc

SEQ ID NO: 1796628 - RNA, 21 nt, Human
cagcccugcuuugggcugccc

SEQ ID NO: 1796629 - RNA, 22 nt, Human
cagcccugcuuugggcugcccu

SEQ ID NO: 1796630 - RNA, 23 nt, Human
cagcccugcuuugggcugcccug

SEQ ID NO: 1796631 - RNA, 9 nt, Human
cagccgugc

SEQ ID NO: 1796632 - RNA, 14 nt, Human
cagccgugccuuca

SEQ ID NO: 1796633 - RNA, 16 nt, Human
cagccgugccuucagc

SEQ ID NO: 1796634 - RNA, 18 nt, Human
cagccgugccuucagcuc

SEQ ID NO: 1796635 - RNA, 20 nt, Human
cagccgugccuucagcucua

SEQ ID NO: 1796636 - RNA, 21 nt, Human
cagccguguaaccauggaccc

SEQ ID NO: 1796637 - RNA, 14 nt, Human
cagccccauucugc

SEQ ID NO: 1796638 - RNA, 13 nt, Human
cagccccauucug

SEQ ID NO: 1796639 - RNA, 16 nt, Human
cagccccauccucugu

SEQ ID NO: 1796640 - RNA, 22 nt, Human
cagccccauccucuguacagag

SEQ ID NO: 1796641 - RNA, 22 nt, Human
cagccccaucccaaacccuuca

SEQ ID NO: 1796642 - RNA, 12 nt, Human
cagccccauccu

SEQ ID NO: 1796643 - RNA, 13 nt, Human
cagccccauccuc

SEQ ID NO: 1796644 - RNA, 14 nt, Human
cagccccauccucu

SEQ ID NO: 1796645 - RNA, 18 nt, Human
cagccccauucugccugc

SEQ ID NO: 1796646 - RNA, 23 nt, Human
cagccccuggaugcagccucaca

SEQ ID NO: 1796647 - RNA, 17 nt, Human
cagccccauucugccug

SEQ ID NO: 1796648 - RNA, 16 nt, Human
cagccccauucugccu

SEQ ID NO: 1796649 - RNA, 20 nt, Human
cagccccuguucuggcagag

SEQ ID NO: 1796650 - RNA, 21 nt, Human
cagccccuguucuggcagagu

SEQ ID NO: 1796651 - RNA, 18 nt, Human
cagccccagugcccacag

SEQ ID NO: 1796652 - RNA, 17 nt, Human
cagccccagugcccaca

SEQ ID NO: 1796653 - RNA, 11 nt, Human
cagccccaucc

SEQ ID NO: 1796654 - RNA, 21 nt, Human
cagccccaucccaaacccuuc

SEQ ID NO: 1796655 - RNA, 16 nt, Human
cagccccagugcccac

SEQ ID NO: 1796656 - RNA, 15 nt, Human
cagccccagugccca

SEQ ID NO: 1796657 - RNA, 14 nt, Human
cagccccagugccc

SEQ ID NO: 1796658 - RNA, 13 nt, Human
cagccccagugcc

SEQ ID NO: 1796659 - RNA, 22 nt, Human
cagcccuccaucuaaacugccc

SEQ ID NO: 1796660 - RNA, 23 nt, Human
cagcccuccaucuaaacugcccc

SEQ ID NO: 1796661 - RNA, 13 nt, Human
cagcccucccugc

SEQ ID NO: 1796662 - RNA, 15 nt, Human
cagcccucccugccc

SEQ ID NO: 1796663 - RNA, 21 nt, Human
cagcccgggcucugccuccca

SEQ ID NO: 1796664 - RNA, 22 nt, Human
cagcccgggcucugccucccau

SEQ ID NO: 1796665 - RNA, 17 nt, Human
cagcccgggcucugccu

SEQ ID NO: 1796666 - RNA, 18 nt, Human
cagcccgggcucugccuc

SEQ ID NO: 1796667 - RNA, 19 nt, Human
cagcccgggcucugccucc

SEQ ID NO: 1796668 - RNA, 20 nt, Human
cagcccgggcucugccuccc

SEQ ID NO: 1796669 - RNA, 24 nt, Human
cagccccuucugacccaugcugcc

SEQ ID NO: 1796670 - RNA, 22 nt, Human
cagccccuucugacccaugcug

SEQ ID NO: 1796671 - RNA, 23 nt, Human
cagccccuucugacccaugcugc

SEQ ID NO: 1796672 - RNA, 16 nt, Human
cagccccuucugaccc

SEQ ID NO: 1796673 - RNA, 17 nt, Human
cagccccuucugaccca

SEQ ID NO: 1796674 - RNA, 19 nt, Human
cagccccuucugacccaug

SEQ ID NO: 1796675 - RNA, 21 nt, Human
cagccccuucugacccaugcu

SEQ ID NO: 1796676 - RNA, 13 nt, Human
cagcccgggcucu

SEQ ID NO: 1796677 - RNA, 14 nt, Human
cagcccgggcucug

SEQ ID NO: 1796678 - RNA, 15 nt, Human
cagcccgggcucugc

SEQ ID NO: 1796679 - RNA, 16 nt, Human
cagcccgggcucugcc

SEQ ID NO: 1796680 - RNA, 20 nt, Human
cagcauccuggcacccggcc

SEQ ID NO: 1796681 - RNA, 19 nt, Human
cagcauccuggcacccggc

SEQ ID NO: 1796682 - RNA, 21 nt, Human
cagcauccuggcacccggccc

SEQ ID NO: 1796683 - RNA, 15 nt, Human
cagcauucucacucc

SEQ ID NO: 1796684 - RNA, 14 nt, Human
cagcauucucacuc

SEQ ID NO: 1796685 - RNA, 15 nt, Human
cagccaaagccuccu

SEQ ID NO: 1796686 - RNA, 16 nt, Human
cagccaaagccuccuc

SEQ ID NO: 1796687 - RNA, 18 nt, Human
cagccaaagccuccucca

SEQ ID NO: 1796688 - RNA, 21 nt, Human
cagccaaagccuccuccagcc

SEQ ID NO: 1796689 - RNA, 18 nt, Human
cagccaacuauggccugu

SEQ ID NO: 1796690 - RNA, 12 nt, Human
cagcaggcucuc

SEQ ID NO: 1796691 - RNA, 14 nt, Human
cagcaggcucucag

SEQ ID NO: 1796692 - RNA, 15 nt, Human
cagcaggcucucagg

SEQ ID NO: 1796693 - RNA, 19 nt, Human
cagcagccuggacccugug

SEQ ID NO: 1796694 - RNA, 22 nt, Human
cagcagccuggacccuguggau

SEQ ID NO: 1796695 - RNA, 12 nt, Human
cagcagccugga

SEQ ID NO: 1796696 - RNA, 14 nt, Human
cagcagccuggacc

SEQ ID NO: 1796697 - RNA, 15 nt, Human
cagcagccuggaccc

SEQ ID NO: 1796698 - RNA, 18 nt, Human
cagcagccuggacccugu

SEQ ID NO: 1796699 - RNA, 17 nt, Human
cagcauccuggcacccg

SEQ ID NO: 1796700 - RNA, 16 nt, Human
cagcauccuggcaccc

SEQ ID NO: 1796701 - RNA, 15 nt, Human
cagcauccuggcacc

SEQ ID NO: 1796702 - RNA, 14 nt, Human
cagcauccuggcac

SEQ ID NO: 1796703 - RNA, 20 nt, Human
cagcagggagggcuucugcc

SEQ ID NO: 1796704 - RNA, 16 nt, Human
cagcaggcucucaggc

SEQ ID NO: 1796705 - RNA, 17 nt, Human
cagcaggcucucaggcc

SEQ ID NO: 1796706 - RNA, 18 nt, Human
cagcaggcucucaggcca

SEQ ID NO: 1796707 - RNA, 19 nt, Human
cagcaggcucucaggccag

SEQ ID NO: 1796708 - RNA, 20 nt, Human
cagcaggcucucaggccagc

SEQ ID NO: 1796709 - RNA, 22 nt, Human
cagcaggcucucaggccagcug

SEQ ID NO: 1796710 - RNA, 18 nt, Human
cagcagggagggcuucug

SEQ ID NO: 1796711 - RNA, 19 nt, Human
cagccacauuccugaugcu

SEQ ID NO: 1796712 - RNA, 15 nt, Human
cagccacauuccuga

SEQ ID NO: 1796713 - RNA, 17 nt, Human
cagccacauuccugaug

SEQ ID NO: 1796714 - RNA, 14 nt, Human
cagccacauuccug

SEQ ID NO: 1796715 - RNA, 22 nt, Human
cagccacggccaggccagaggg

SEQ ID NO: 1796716 - RNA, 21 nt, Human
cagccacggccaggccagagg

SEQ ID NO: 1796717 - RNA, 19 nt, Human
cagccacggccaggccaga

SEQ ID NO: 1796718 - RNA, 18 nt, Human
cagccacggccaggccag

SEQ ID NO: 1796719 - RNA, 17 nt, Human
cagccacggccaggcca

SEQ ID NO: 1796720 - RNA, 16 nt, Human
cagccacggccaggcc

SEQ ID NO: 1796721 - RNA, 15 nt, Human
cagccacggccaggc

SEQ ID NO: 1796722 - RNA, 14 nt, Human
cagccacggccagg

SEQ ID NO: 1796723 - RNA, 23 nt, Human
cagccacggccaggccagaggga

SEQ ID NO: 1796724 - RNA, 22 nt, Human
cagccaguaaaugggggugcau

SEQ ID NO: 1796725 - RNA, 18 nt, Human
cagcccacuucugccaua

SEQ ID NO: 1796726 - RNA, 22 nt, Human
cagccccaaaacucuccucugc

SEQ ID NO: 1796727 - RNA, 20 nt, Human
cagccccaaaacucuccucu

SEQ ID NO: 1796728 - RNA, 21 nt, Human
cagccccaaaacucuccucug

SEQ ID NO: 1796729 - RNA, 15 nt, Human
cagcccacuucugcc

SEQ ID NO: 1796730 - RNA, 19 nt, Human
cagcccacauagugauggu

SEQ ID NO: 1796731 - RNA, 15 nt, Human
cagcccaccccucaa

SEQ ID NO: 1796732 - RNA, 19 nt, Human
cagauuuuuuacagcugcc

SEQ ID NO: 1796733 - RNA, 22 nt, Human
cagauuuuuuacagcugccugc

SEQ ID NO: 1796734 - RNA, 14 nt, Human
cagauucuuuccug

SEQ ID NO: 1796735 - RNA, 18 nt, Human
cagcaaaagaugcuucuc

SEQ ID NO: 1796736 - RNA, 23 nt, Human
cagaugggugcuuggaggaagga

SEQ ID NO: 1796737 - RNA, 15 nt, Human
cagaugcugugcaaa

SEQ ID NO: 1796738 - RNA, 18 nt, Human
cagaugggugcuuggagg

SEQ ID NO: 1796739 - RNA, 13 nt, Human
cagcagccccugc

SEQ ID NO: 1796740 - RNA, 16 nt, Human
cagcagccccugcaca

SEQ ID NO: 1796741 - RNA, 23 nt, Human
cagcagccccugcacaaagcccu

SEQ ID NO: 1796742 - RNA, 11 nt, Human
cagcagagcac

SEQ ID NO: 1796743 - RNA, 13 nt, Human
cagcagagcaccu

SEQ ID NO: 1796744 - RNA, 22 nt, Human
cagcagaaaugccuuacccuca

SEQ ID NO: 1796745 - RNA, 19 nt, Human
cagcagaaaugccuuaccc

SEQ ID NO: 1796746 - RNA, 17 nt, Human
cagcagaaaugccuuac

SEQ ID NO: 1796747 - RNA, 15 nt, Human
cagcagaaaugccuu

SEQ ID NO: 1796748 - RNA, 17 nt, Human
cagcaaggagauuuaca

SEQ ID NO: 1796749 - RNA, 18 nt, Human
cagcaaggagauuuacaa

SEQ ID NO: 1796750 - RNA, 12 nt, Human
cagcaagugaga

SEQ ID NO: 1796751 - RNA, 17 nt, Human
cagcaagugagagcugg

SEQ ID NO: 1796752 - RNA, 16 nt, Human
cagcaagugagagcug

SEQ ID NO: 1796753 - RNA, 15 nt, Human
cagcaagugagagcu

SEQ ID NO: 1796754 - RNA, 14 nt, Human
cagcaagugagagc

SEQ ID NO: 1796755 - RNA, 21 nt, Human
cagcaagugagagcugggugu

SEQ ID NO: 1796756 - RNA, 19 nt, Human
cagcaagugagagcugggu

SEQ ID NO: 1796757 - RNA, 21 nt, Human
cagcaauaaagcagcguuucu

SEQ ID NO: 1796758 - RNA, 13 nt, Human
cagcaauaaagca

SEQ ID NO: 1796759 - RNA, 22 nt, Human
cagcaauaaagcagcguuucua

SEQ ID NO: 1796760 - RNA, 15 nt, Human
cagcaauucuccugc

SEQ ID NO: 1796761 - RNA, 16 nt, Human
cagcaauucuccugcc

SEQ ID NO: 1796762 - RNA, 17 nt, Human
cagcaauucuccugccu

SEQ ID NO: 1796763 - RNA, 18 nt, Human
cagcaauucuccugccuc

SEQ ID NO: 1796764 - RNA, 19 nt, Human
cagcaauucuccugccuca

SEQ ID NO: 1796765 - RNA, 20 nt, Human
cagcaauucuccugccucag

SEQ ID NO: 1796766 - RNA, 14 nt, Human
cagcucaccagccc

SEQ ID NO: 1796767 - RNA, 18 nt, Human
cagccuccaugcugccuc

SEQ ID NO: 1796768 - RNA, 14 nt, Human
cagacccggcugcg

SEQ ID NO: 1796769 - RNA, 12 nt, Human
cagacccggcug

SEQ ID NO: 1796770 - RNA, 21 nt, Human
cagaccccuggcuuuucacug

SEQ ID NO: 1796771 - RNA, 22 nt, Human
cagaccccuggcuuuucacugc

SEQ ID NO: 1796772 - RNA, 23 nt, Human
cagaccccuggcuuuucacugcu

SEQ ID NO: 1796773 - RNA, 16 nt, Human
cagacccggcugcgug

SEQ ID NO: 1796774 - RNA, 12 nt, Human
cagacccugccc

SEQ ID NO: 1796775 - RNA, 13 nt, Human
cagacccugcccu

SEQ ID NO: 1796776 - RNA, 14 nt, Human
cagacccugcccug

SEQ ID NO: 1796777 - RNA, 22 nt, Human
cagacccugcccugugggcccc

SEQ ID NO: 1796778 - RNA, 15 nt, Human
cagacccugcccugu

SEQ ID NO: 1796779 - RNA, 16 nt, Human
cagacccugcccugug

SEQ ID NO: 1796780 - RNA, 17 nt, Human
cagacccugcccugugg

SEQ ID NO: 1796781 - RNA, 21 nt, Human
cagacccugcccugugggccc

SEQ ID NO: 1796782 - RNA, 13 nt, Human
cagaccccuggcu

SEQ ID NO: 1796783 - RNA, 14 nt, Human
cagaccccuggcuu

SEQ ID NO: 1796784 - RNA, 15 nt, Human
cagaccccuggcuuu

SEQ ID NO: 1796785 - RNA, 16 nt, Human
cagaccccuggcuuuu

SEQ ID NO: 1796786 - RNA, 18 nt, Human
cagaccccuggcuuuuca

SEQ ID NO: 1796787 - RNA, 14 nt, Human
cagaccacaaaacu

SEQ ID NO: 1796788 - RNA, 20 nt, Human
cagaccacaaaacuuuucua

SEQ ID NO: 1796789 - RNA, 23 nt, Human
cagagaaaguacuucuccacccu

SEQ ID NO: 1796790 - RNA, 19 nt, Human
cagagaaaguacuucucca

SEQ ID NO: 1796791 - RNA, 20 nt, Human
cagacuuuuuuuaaauagua

SEQ ID NO: 1796792 - RNA, 22 nt, Human
cagacaccuugacagggcacac

SEQ ID NO: 1796793 - RNA, 20 nt, Human
cagacaccuugacagggcac

SEQ ID NO: 1796794 - RNA, 19 nt, Human
cagacaccuugacagggca

SEQ ID NO: 1796795 - RNA, 20 nt, Human
cagacaguuaagagaaauga

SEQ ID NO: 1796796 - RNA, 19 nt, Human
cagacauacuaaccagcag

SEQ ID NO: 1796797 - RNA, 19 nt, Human
cagacauagaauuaacaca

SEQ ID NO: 1796798 - RNA, 17 nt, Human
cagacauagaauuaaca

SEQ ID NO: 1796799 - RNA, 23 nt, Human
cagacacaggcccggcuccaggc

SEQ ID NO: 1796800 - RNA, 22 nt, Human
cagacacaggcccggcuccagg

SEQ ID NO: 1796801 - RNA, 21 nt, Human
cagacacaggcccggcuccag

SEQ ID NO: 1796802 - RNA, 18 nt, Human
cagacacaggcccggcuc

SEQ ID NO: 1796803 - RNA, 17 nt, Human
cagacacaggcccggcu

SEQ ID NO: 1796804 - RNA, 15 nt, Human
cagacacaggcccgg

SEQ ID NO: 1796805 - RNA, 14 nt, Human
cagacacaggcccg

SEQ ID NO: 1796806 - RNA, 13 nt, Human
cagacacaggccc

SEQ ID NO: 1796807 - RNA, 14 nt, Human
cagacacaugucca

SEQ ID NO: 1796808 - RNA, 17 nt, Human
cagacacauguccaaga

SEQ ID NO: 1796809 - RNA, 21 nt, Human
cagacacauguccaagaagcc

SEQ ID NO: 1796810 - RNA, 22 nt, Human
cagacacauguccaagaagccc

SEQ ID NO: 1796811 - RNA, 23 nt, Human
cagacacauguccaagaagccca

SEQ ID NO: 1796812 - RNA, 22 nt, Human
cagacaaagcgugguggacaug

SEQ ID NO: 1796813 - RNA, 20 nt, Human
cagacaacaaaccuguuucu

SEQ ID NO: 1796814 - RNA, 24 nt, Human
cagaauuucccaaagcagugcaug

SEQ ID NO: 1796815 - RNA, 12 nt, Human
cagacaaagcgu

SEQ ID NO: 1796816 - RNA, 17 nt, Human
cagaauuucccaaagca

SEQ ID NO: 1796817 - RNA, 18 nt, Human
cagaauuucccaaagcag

SEQ ID NO: 1796818 - RNA, 19 nt, Human
cagaauuucccaaagcagu

SEQ ID NO: 1796819 - RNA, 20 nt, Human
cagaauuucccaaagcagug

SEQ ID NO: 1796820 - RNA, 15 nt, Human
cagaaucucgcucug

SEQ ID NO: 1796821 - RNA, 14 nt, Human
cagaauuucccaaa

SEQ ID NO: 1796822 - RNA, 11 nt, Human
cagaauucuca

SEQ ID NO: 1796823 - RNA, 18 nt, Human
cagaauucucuaguuuga

SEQ ID NO: 1796824 - RNA, 15 nt, Human
cagaauucucuaguu

SEQ ID NO: 1796825 - RNA, 22 nt, Human
cagaacccuuggagccaaugga

SEQ ID NO: 1796826 - RNA, 21 nt, Human
cagaagacacugaugggcaac

SEQ ID NO: 1796827 - RNA, 14 nt, Human
cagaagcagcucuu

SEQ ID NO: 1796828 - RNA, 13 nt, Human
cagaagcagcucu

SEQ ID NO: 1796829 - RNA, 20 nt, Human
cagaagcaacccaaauguuc

SEQ ID NO: 1796830 - RNA, 19 nt, Human
cagaagcaacccaaauguu

SEQ ID NO: 1796831 - RNA, 19 nt, Human
cagaaggaagacuucaucc

SEQ ID NO: 1796832 - RNA, 16 nt, Human
cagaaggaagacuuca

SEQ ID NO: 1796833 - RNA, 17 nt, Human
cagaaggaagacuucau

SEQ ID NO: 1796834 - RNA, 18 nt, Human
cagaaggaagacuucauc

SEQ ID NO: 1796835 - RNA, 17 nt, Human
cagaaucucaaauaacu

SEQ ID NO: 1796836 - RNA, 18 nt, Human
cagaaucucaaauaacua

SEQ ID NO: 1796837 - RNA, 14 nt, Human
cacuuuuguucuug

SEQ ID NO: 1796838 - RNA, 22 nt, Human
cacuuuuguucuugguuuguaa

SEQ ID NO: 1796839 - RNA, 18 nt, Human
cacuuuuauuuagcacca

SEQ ID NO: 1796840 - RNA, 12 nt, Human
cacuuugcauaa

SEQ ID NO: 1796841 - RNA, 22 nt, Human
cacuuucuagccagaggagaga

SEQ ID NO: 1796842 - RNA, 16 nt, Human
cacuuugggaggccaa

SEQ ID NO: 1796843 - RNA, 12 nt, Human
cacuuugggagg

SEQ ID NO: 1796844 - RNA, 13 nt, Human
cacuuugggaggc

SEQ ID NO: 1796845 - RNA, 13 nt, Human
cacuuuguucugg

SEQ ID NO: 1796846 - RNA, 14 nt, Human
cacuuuguucuggc

SEQ ID NO: 1796847 - RNA, 16 nt, Human
cacuuuguucuggcuc

SEQ ID NO: 1796848 - RNA, 23 nt, Human
cacuuuguucuggcucuuccagg

SEQ ID NO: 1796849 - RNA, 24 nt, Human
cagaaagaaguggggacagagcag

SEQ ID NO: 1796850 - RNA, 18 nt, Human
cagaaagcagaacaguga

SEQ ID NO: 1796851 - RNA, 19 nt, Human
cagaaagcagaacagugau

SEQ ID NO: 1796852 - RNA, 23 nt, Human
cagaacagugauuaccagggacu

SEQ ID NO: 1796853 - RNA, 16 nt, Human
cagaaaauggaagaca

SEQ ID NO: 1796854 - RNA, 20 nt, Human
cagaaaauggaagacagcuc

SEQ ID NO: 1796855 - RNA, 21 nt, Human
cagaaaauggaagacagcucu

SEQ ID NO: 1796856 - RNA, 22 nt, Human
cagaaaauggaagacagcucuu

SEQ ID NO: 1796857 - RNA, 23 nt, Human
cagaaaauggaagacagcucuua

SEQ ID NO: 1796858 - RNA, 16 nt, Human
cagacaacaaaccugu

SEQ ID NO: 1796859 - RNA, 16 nt, Human
cagaugcaccagcccu

SEQ ID NO: 1796860 - RNA, 14 nt, Human
cagaugcaccagcc

SEQ ID NO: 1796861 - RNA, 13 nt, Human
cagaugcaccagc

SEQ ID NO: 1796862 - RNA, 22 nt, Human
cagaugcaccagcccuuagcag

SEQ ID NO: 1796863 - RNA, 17 nt, Human
cagaugcaccagcccuu

SEQ ID NO: 1796864 - RNA, 22 nt, Human
cagauacaggaaaagcugcuga

SEQ ID NO: 1796865 - RNA, 21 nt, Human
cagauacaggaaaagcugcug

SEQ ID NO: 1796866 - RNA, 20 nt, Human
cagauacaggaaaagcugcu

SEQ ID NO: 1796867 - RNA, 20 nt, Human
cagaucucuaacuucaccau

SEQ ID NO: 1796868 - RNA, 19 nt, Human
cagaguuguuacauuuuua

SEQ ID NO: 1796869 - RNA, 18 nt, Human
cagaguuguuacauuuuu

SEQ ID NO: 1796870 - RNA, 15 nt, Human
cagaguuguuacauu

SEQ ID NO: 1796871 - RNA, 14 nt, Human
cagauaaacaguag

SEQ ID NO: 1796872 - RNA, 22 nt, Human
cagauaaagguucaugcaaacu

SEQ ID NO: 1796873 - RNA, 23 nt, Human
cagauaaauaguuuaugauucca

SEQ ID NO: 1796874 - RNA, 22 nt, Human
cagaguugaagacagagcuaca

SEQ ID NO: 1796875 - RNA, 14 nt, Human
cagaguuguuacau

SEQ ID NO: 1796876 - RNA, 17 nt, Human
cagaguugaagacagag

SEQ ID NO: 1796877 - RNA, 18 nt, Human
cagaguugaagacagagc

SEQ ID NO: 1796878 - RNA, 19 nt, Human
cagaguugaagacagagcu

SEQ ID NO: 1796879 - RNA, 20 nt, Human
cagaguugaagacagagcua

SEQ ID NO: 1796880 - RNA, 14 nt, Human
cagaguugaagaca

SEQ ID NO: 1796881 - RNA, 15 nt, Human
cagaguugaagacag

SEQ ID NO: 1796882 - RNA, 16 nt, Human
cagaguugaagacaga

SEQ ID NO: 1796883 - RNA, 20 nt, Human
cagagugagacucugucuca

SEQ ID NO: 1796884 - RNA, 19 nt, Human
cagagugagacucugucuc

SEQ ID NO: 1796885 - RNA, 18 nt, Human
cagagugagacucugucu

SEQ ID NO: 1796886 - RNA, 17 nt, Human
cagagugagacucuguc

SEQ ID NO: 1796887 - RNA, 16 nt, Human
cagagugagacucugu

SEQ ID NO: 1796888 - RNA, 23 nt, Human
cagagucucacuguugcccaggc

SEQ ID NO: 1796889 - RNA, 22 nt, Human
cagagucucacuguugcccagg

SEQ ID NO: 1796890 - RNA, 23 nt, Human
cagagucucgcucuguugcccag

SEQ ID NO: 1796891 - RNA, 23 nt, Human
cagagggagugacagaggcagcc

SEQ ID NO: 1796892 - RNA, 22 nt, Human
cagagggagugacagaggcagc

SEQ ID NO: 1796893 - RNA, 21 nt, Human
cagagggagugacagaggcag

SEQ ID NO: 1796894 - RNA, 20 nt, Human
cagagggagugacagaggca

SEQ ID NO: 1796895 - RNA, 15 nt, Human
cagagggccugcaag

SEQ ID NO: 1796896 - RNA, 19 nt, Human
cagagggccugcaagggag

SEQ ID NO: 1796897 - RNA, 21 nt, Human
cagagucucacuguugcccag

SEQ ID NO: 1796898 - RNA, 20 nt, Human
cagagucucacuguugccca

SEQ ID NO: 1796899 - RNA, 19 nt, Human
cagagucucacuguugccc

SEQ ID NO: 1796900 - RNA, 17 nt, Human
cagagucucacuguugc

SEQ ID NO: 1796901 - RNA, 13 nt, Human
cagagucucacug

SEQ ID NO: 1796902 - RNA, 22 nt, Human
cagaggcagccccauucugccu

SEQ ID NO: 1796903 - RNA, 20 nt, Human
cagaggcagccccauucugc

SEQ ID NO: 1796904 - RNA, 19 nt, Human
cagaggcagccccauucug

SEQ ID NO: 1796905 - RNA, 18 nt, Human
cagaggcagccccauucu

SEQ ID NO: 1796906 - RNA, 15 nt, Human
cagaggcagccccau

SEQ ID NO: 1796907 - RNA, 14 nt, Human
cagaggcagcccca

SEQ ID NO: 1796908 - RNA, 13 nt, Human
cagaggcagcccc

SEQ ID NO: 1796909 - RNA, 12 nt, Human
cagaggcagccc

SEQ ID NO: 1796910 - RNA, 21 nt, Human
cagaggccaugggccuccugu

SEQ ID NO: 1796911 - RNA, 20 nt, Human
cagaggccaugggccuccug

SEQ ID NO: 1796912 - RNA, 16 nt, Human
cagaggccaugggccu

SEQ ID NO: 1796913 - RNA, 19 nt, Human
cagaggccaugggccuccu

SEQ ID NO: 1796914 - RNA, 23 nt, Human
cagaggcagccccauucugccug

SEQ ID NO: 1796915 - RNA, 19 nt, Human
cagagggagugacagaggc

SEQ ID NO: 1796916 - RNA, 18 nt, Human
cagagggagugacagagg

SEQ ID NO: 1796917 - RNA, 16 nt, Human
cagagggagugacaga

SEQ ID NO: 1796918 - RNA, 14 nt, Human
cagagggagugaca

SEQ ID NO: 1796919 - RNA, 23 nt, Human
cagaggcugccucucccaucacu

SEQ ID NO: 1796920 - RNA, 23 nt, Human
cagaggcgcaugaauuugugaag

SEQ ID NO: 1796921 - RNA, 21 nt, Human
cagaggcucagauuguaauau

SEQ ID NO: 1796922 - RNA, 13 nt, Human
cagaggcugccuc

SEQ ID NO: 1796923 - RNA, 13 nt, Human
cagagaguggcuc

SEQ ID NO: 1796924 - RNA, 14 nt, Human
cagagaguggcucc

SEQ ID NO: 1796925 - RNA, 15 nt, Human
cagagaguggcuccu

SEQ ID NO: 1796926 - RNA, 18 nt, Human
cagagaguggcuccuccc

SEQ ID NO: 1796927 - RNA, 18 nt, Human
cagagcacagcagccccu

SEQ ID NO: 1796928 - RNA, 16 nt, Human
cagagcaccuuagaca

SEQ ID NO: 1796929 - RNA, 14 nt, Human
cagagcaagugaga

SEQ ID NO: 1796930 - RNA, 20 nt, Human
cagagcaagugagacccugu

SEQ ID NO: 1796931 - RNA, 21 nt, Human
cagagaccaucccugaaggcc

SEQ ID NO: 1796932 - RNA, 17 nt, Human
cagagaccaucccugaa

SEQ ID NO: 1796933 - RNA, 18 nt, Human
cagagaccaucccugaag

SEQ ID NO: 1796934 - RNA, 19 nt, Human
cagagaccaucccugaagg

SEQ ID NO: 1796935 - RNA, 20 nt, Human
cagagaccaucccugaaggc

SEQ ID NO: 1796936 - RNA, 13 nt, Human
cagagacuccugc

SEQ ID NO: 1796937 - RNA, 14 nt, Human
cagagacuccugca

SEQ ID NO: 1796938 - RNA, 15 nt, Human
cagagacuccugcag

SEQ ID NO: 1796939 - RNA, 16 nt, Human
cagagacuccugcagg

SEQ ID NO: 1796940 - RNA, 17 nt, Human
cagagacuccugcaggc

SEQ ID NO: 1796941 - RNA, 18 nt, Human
cagagacuccugcaggca

SEQ ID NO: 1796942 - RNA, 19 nt, Human
cagagacuccugcaggcag

SEQ ID NO: 1796943 - RNA, 21 nt, Human
cagagaaugaaagggcccaga

SEQ ID NO: 1796944 - RNA, 20 nt, Human
cagagaaugaaagggcccag

SEQ ID NO: 1796945 - RNA, 15 nt, Human
cagagaauucucuua

SEQ ID NO: 1796946 - RNA, 19 nt, Human
cagagaaugaaagggccca

SEQ ID NO: 1796947 - RNA, 16 nt, Human
cagagacacaagccuu

SEQ ID NO: 1796948 - RNA, 17 nt, Human
cagagacacaagccuuc

SEQ ID NO: 1796949 - RNA, 14 nt, Human
cagagacacaagcc

SEQ ID NO: 1796950 - RNA, 15 nt, Human
cagagacacaagccu

SEQ ID NO: 1796951 - RNA, 13 nt, Human
cagagaccauccc

SEQ ID NO: 1796952 - RNA, 14 nt, Human
cagagaccaucccu

SEQ ID NO: 1796953 - RNA, 16 nt, Human
cagagaccaucccuga

SEQ ID NO: 1796954 - RNA, 13 nt, Human
cagaggagagagg

SEQ ID NO: 1796955 - RNA, 15 nt, Human
cagaggagagaggac

SEQ ID NO: 1796956 - RNA, 19 nt, Human
cagaggagagaggaccccc

SEQ ID NO: 1796957 - RNA, 17 nt, Human
cagaggacacagagaag

SEQ ID NO: 1796958 - RNA, 15 nt, Human
cagaggacacagaga

SEQ ID NO: 1796959 - RNA, 11 nt, Human
cagaggcagcc

SEQ ID NO: 1796960 - RNA, 20 nt, Human
cagaggagagaggacccccu

SEQ ID NO: 1796961 - RNA, 13 nt, Human
cagagccugcagu

SEQ ID NO: 1796962 - RNA, 13 nt, Human
cagaggaaggaga

SEQ ID NO: 1796963 - RNA, 12 nt, Human
cagagccugcag

SEQ ID NO: 1796964 - RNA, 23 nt, Human
cagagcccacgcccccacuggug

SEQ ID NO: 1796965 - RNA, 17 nt, Human
cagagcccacgccccca

SEQ ID NO: 1796966 - RNA, 19 nt, Human
cagagcccacgcccccacu

SEQ ID NO: 1796967 - RNA, 20 nt, Human
cagagcccacgcccccacug

SEQ ID NO: 1796968 - RNA, 21 nt, Human
cagagcccacgcccccacugg

SEQ ID NO: 1796969 - RNA, 20 nt, Human
cagagcccaccuuggcucaa

SEQ ID NO: 1796970 - RNA, 16 nt, Human
cagagcccacgccccc

SEQ ID NO: 1796971 - RNA, 19 nt, Human
cagagcccaccuuggcuca

SEQ ID NO: 1796972 - RNA, 17 nt, Human
cagagcccaccuuggcu

SEQ ID NO: 1796973 - RNA, 15 nt, Human
cagagcccaccuugg

SEQ ID NO: 1796974 - RNA, 22 nt, Human
cagagccaccccuaaagagaua

SEQ ID NO: 1796975 - RNA, 23 nt, Human
cagagcaccuuagacagucccug

SEQ ID NO: 1796976 - RNA, 11 nt, Human
cagagcagaga

SEQ ID NO: 1796977 - RNA, 12 nt, Human
cagagcagagac

SEQ ID NO: 1796978 - RNA, 18 nt, Human
cagagcaccuuagacagu

SEQ ID NO: 1796979 - RNA, 19 nt, Human
cagagcaccuuagacaguc

SEQ ID NO: 1796980 - RNA, 21 nt, Human
cagagcaccuuagacaguccc

SEQ ID NO: 1796981 - RNA, 22 nt, Human
cagagcaccuuagacagucccu

SEQ ID NO: 1796982 - RNA, 13 nt, Human
cagagcagagacc

SEQ ID NO: 1796983 - RNA, 14 nt, Human
cagagcagagacca

SEQ ID NO: 1796984 - RNA, 15 nt, Human
cagagcagagaccau

SEQ ID NO: 1796985 - RNA, 17 nt, Human
cagagcagagaccaucc

SEQ ID NO: 1796986 - RNA, 18 nt, Human
cagagcagagaccauccc

SEQ ID NO: 1796987 - RNA, 19 nt, Human
cagagcagagaccaucccu

SEQ ID NO: 1796988 - RNA, 21 nt, Human
cagagcagagaccaucccuga

SEQ ID NO: 1796989 - RNA, 14 nt, Human
caccggcuggccug

SEQ ID NO: 1796990 - RNA, 15 nt, Human
caccggcuggccugg

SEQ ID NO: 1796991 - RNA, 16 nt, Human
caccggcuggccuggc

SEQ ID NO: 1796992 - RNA, 14 nt, Human
caccgggcacucag

SEQ ID NO: 1796993 - RNA, 20 nt, Human
caccggcuggccuggccccu

SEQ ID NO: 1796994 - RNA, 17 nt, Human
caccggcuggccuggcc

SEQ ID NO: 1796995 - RNA, 18 nt, Human
caccggcuggccuggccc

SEQ ID NO: 1796996 - RNA, 21 nt, Human
caccgcagacaggaccaggga

SEQ ID NO: 1796997 - RNA, 18 nt, Human
caccgggccacagagaaa

SEQ ID NO: 1796998 - RNA, 15 nt, Human
caccgggccacagag

SEQ ID NO: 1796999 - RNA, 22 nt, Human
caccgggcacucagaagacacu

SEQ ID NO: 1797000 - RNA, 15 nt, Human
caccgggcacucaga

SEQ ID NO: 1797001 - RNA, 15 nt, Human
caccggggccucgga

SEQ ID NO: 1797002 - RNA, 13 nt, Human
caccgggccugga

SEQ ID NO: 1797003 - RNA, 15 nt, Human
caccgugccuggcca

SEQ ID NO: 1797004 - RNA, 20 nt, Human
caccgugccuggccacgccc

SEQ ID NO: 1797005 - RNA, 14 nt, Human
caccucccccaucu

SEQ ID NO: 1797006 - RNA, 21 nt, Human
caccucccccaucucuucugg

SEQ ID NO: 1797007 - RNA, 11 nt, Human
caccuccugcc

SEQ ID NO: 1797008 - RNA, 13 nt, Human
caccuccugccuc

SEQ ID NO: 1797009 - RNA, 14 nt, Human
caccuccugccucg

SEQ ID NO: 1797010 - RNA, 13 nt, Human
caccucucccuug

SEQ ID NO: 1797011 - RNA, 14 nt, Human
caccucucccuugg

SEQ ID NO: 1797012 - RNA, 17 nt, Human
caccucucccuuggauu

SEQ ID NO: 1797013 - RNA, 15 nt, Human
caccugaagacucau

SEQ ID NO: 1797014 - RNA, 14 nt, Human
caccugaagacuca

SEQ ID NO: 1797015 - RNA, 23 nt, Human
caccugaagacucauucuucugu

SEQ ID NO: 1797016 - RNA, 15 nt, Human
caccucucucacucc

SEQ ID NO: 1797017 - RNA, 17 nt, Human
caccucucucacuccuu

SEQ ID NO: 1797018 - RNA, 18 nt, Human
caccucucucacuccuug

SEQ ID NO: 1797019 - RNA, 19 nt, Human
caccucucucacuccuuga

SEQ ID NO: 1797020 - RNA, 18 nt, Human
caccucugcacaagcugc

SEQ ID NO: 1797021 - RNA, 19 nt, Human
caccucugcacaagcugca

SEQ ID NO: 1797022 - RNA, 23 nt, Human
caccugcggugcuaucuccccca

SEQ ID NO: 1797023 - RNA, 20 nt, Human
caccuggaauauauaaccag

SEQ ID NO: 1797024 - RNA, 23 nt, Human
caccuggccucugcacuccccug

SEQ ID NO: 1797025 - RNA, 17 nt, Human
caccuggccucugcacu

SEQ ID NO: 1797026 - RNA, 18 nt, Human
caccuggccucugcacuc

SEQ ID NO: 1797027 - RNA, 19 nt, Human
caccuggccucugcacucc

SEQ ID NO: 1797028 - RNA, 20 nt, Human
caccuggccucugcacuccc

SEQ ID NO: 1797029 - RNA, 12 nt, Human
caccuggccucu

SEQ ID NO: 1797030 - RNA, 13 nt, Human
caccuggccucug

SEQ ID NO: 1797031 - RNA, 14 nt, Human
caccuggccucugc

SEQ ID NO: 1797032 - RNA, 15 nt, Human
caccuggccucugca

SEQ ID NO: 1797033 - RNA, 13 nt, Human
cacauauugauuu

SEQ ID NO: 1797034 - RNA, 20 nt, Human
caccccucaacaccucugca

SEQ ID NO: 1797035 - RNA, 21 nt, Human
cacccggccccugcugguuca

SEQ ID NO: 1797036 - RNA, 18 nt, Human
cacccggccccugcuggu

SEQ ID NO: 1797037 - RNA, 17 nt, Human
cacccggccccugcugg

SEQ ID NO: 1797038 - RNA, 16 nt, Human
cacccggccccugcug

SEQ ID NO: 1797039 - RNA, 14 nt, Human
cacccggccccugc

SEQ ID NO: 1797040 - RNA, 13 nt, Human
cacccggccccug

SEQ ID NO: 1797041 - RNA, 12 nt, Human
cacccggccccu

SEQ ID NO: 1797042 - RNA, 19 nt, Human
cacccgcuaagagggaggg

SEQ ID NO: 1797043 - RNA, 22 nt, Human
caccgaaaacguggcugcuuca

SEQ ID NO: 1797044 - RNA, 19 nt, Human
caccgaaaacguggcugcu

SEQ ID NO: 1797045 - RNA, 21 nt, Human
caccgaaaacguggcugcuuc

SEQ ID NO: 1797046 - RNA, 15 nt, Human
caccgaaaacguggc

SEQ ID NO: 1797047 - RNA, 18 nt, Human
caccgaaaacguggcugc

SEQ ID NO: 1797048 - RNA, 12 nt, Human
caccgcagacag

SEQ ID NO: 1797049 - RNA, 13 nt, Human
caccgcagacagg

SEQ ID NO: 1797050 - RNA, 14 nt, Human
caccgcagacagga

SEQ ID NO: 1797051 - RNA, 15 nt, Human
caccgcagacaggac

SEQ ID NO: 1797052 - RNA, 17 nt, Human
caccgcagacaggacca

SEQ ID NO: 1797053 - RNA, 18 nt, Human
caccgcagacaggaccag

SEQ ID NO: 1797054 - RNA, 11 nt, Human
cacccugugau

SEQ ID NO: 1797055 - RNA, 12 nt, Human
cacccugugaug

SEQ ID NO: 1797056 - RNA, 15 nt, Human
cacccugugaugggg

SEQ ID NO: 1797057 - RNA, 18 nt, Human
cacccugugauggggccc

SEQ ID NO: 1797058 - RNA, 20 nt, Human
cacccugugauggggcccug

SEQ ID NO: 1797059 - RNA, 21 nt, Human
cacccugugauggggcccugc

SEQ ID NO: 1797060 - RNA, 22 nt, Human
cacccugugauggggcccugcc

SEQ ID NO: 1797061 - RNA, 23 nt, Human
cacccugugauggggcccugccu

SEQ ID NO: 1797062 - RNA, 20 nt, Human
cacauauugauuuccguuaa

SEQ ID NO: 1797063 - RNA, 16 nt, Human
cacgccagauucuuuc

SEQ ID NO: 1797064 - RNA, 14 nt, Human
cacucuacuuagca

SEQ ID NO: 1797065 - RNA, 12 nt, Human
cacucuggcagc

SEQ ID NO: 1797066 - RNA, 13 nt, Human
cacucuggcagcu

SEQ ID NO: 1797067 - RNA, 14 nt, Human
cacucuggcagcuc

SEQ ID NO: 1797068 - RNA, 12 nt, Human
cacucuccuugg

SEQ ID NO: 1797069 - RNA, 12 nt, Human
cacucugagacu

SEQ ID NO: 1797070 - RNA, 23 nt, Human
cacucugagacucgcgacaaugc

SEQ ID NO: 1797071 - RNA, 14 nt, Human
cacuccuucacaga

SEQ ID NO: 1797072 - RNA, 21 nt, Human
cacuccuucacagaugggugc

SEQ ID NO: 1797073 - RNA, 17 nt, Human
cacucccugcaaccuga

SEQ ID NO: 1797074 - RNA, 13 nt, Human
cacuccuaccugg

SEQ ID NO: 1797075 - RNA, 14 nt, Human
cacuccuaccuggu

SEQ ID NO: 1797076 - RNA, 16 nt, Human
cacucaguccauagca

SEQ ID NO: 1797077 - RNA, 16 nt, Human
cacucaggucuguuuu

SEQ ID NO: 1797078 - RNA, 15 nt, Human
cacucauugaccuga

SEQ ID NO: 1797079 - RNA, 18 nt, Human
cacucauugaccugaggc

SEQ ID NO: 1797080 - RNA, 19 nt, Human
cacucauugaccugaggcc

SEQ ID NO: 1797081 - RNA, 20 nt, Human
cacucauugaccugaggccc

SEQ ID NO: 1797082 - RNA, 22 nt, Human
cacucauugaccugaggcccuu

SEQ ID NO: 1797083 - RNA, 12 nt, Human
cacucccugcaa

SEQ ID NO: 1797084 - RNA, 13 nt, Human
cacucccugcaac

SEQ ID NO: 1797085 - RNA, 16 nt, Human
cacucccugcaaccug

SEQ ID NO: 1797086 - RNA, 18 nt, Human
cacuaaccacgcuggacc

SEQ ID NO: 1797087 - RNA, 18 nt, Human
cacuaaggugugcucuga

SEQ ID NO: 1797088 - RNA, 17 nt, Human
cacuaaggugugcucug

SEQ ID NO: 1797089 - RNA, 16 nt, Human
cacuaaccacgcugga

SEQ ID NO: 1797090 - RNA, 15 nt, Human
cacuaaccacgcugg

SEQ ID NO: 1797091 - RNA, 14 nt, Human
cacuaaccacgcug

SEQ ID NO: 1797092 - RNA, 16 nt, Human
cacuaacaugauuugg

SEQ ID NO: 1797093 - RNA, 21 nt, Human
cacuaaauugacacuuaaaaa

SEQ ID NO: 1797094 - RNA, 21 nt, Human
cacuauagccuaggugacaga

SEQ ID NO: 1797095 - RNA, 14 nt, Human
cacuauagccuagg

SEQ ID NO: 1797096 - RNA, 18 nt, Human
cacuauaauguaagcucu

SEQ ID NO: 1797097 - RNA, 14 nt, Human
cacuauaauguaag

SEQ ID NO: 1797098 - RNA, 19 nt, Human
cacuauguugcccaggcag

SEQ ID NO: 1797099 - RNA, 18 nt, Human
cacuauguugcccaggca

SEQ ID NO: 1797100 - RNA, 17 nt, Human
cacuauguugcccaggc

SEQ ID NO: 1797101 - RNA, 16 nt, Human
cacuauguugcccagg

SEQ ID NO: 1797102 - RNA, 15 nt, Human
cacuauguugcccag

SEQ ID NO: 1797103 - RNA, 18 nt, Human
cacuaucccggcugcccu

SEQ ID NO: 1797104 - RNA, 19 nt, Human
cacuaucccggcugcccuu

SEQ ID NO: 1797105 - RNA, 21 nt, Human
cacuauguugcccaggcaggu

SEQ ID NO: 1797106 - RNA, 20 nt, Human
cacuauguugcccaggcagg

SEQ ID NO: 1797107 - RNA, 15 nt, Human
cacucaaaagcuggg

SEQ ID NO: 1797108 - RNA, 17 nt, Human
cacucaaaagcugggca

SEQ ID NO: 1797109 - RNA, 18 nt, Human
cacucaaaagcugggcag

SEQ ID NO: 1797110 - RNA, 19 nt, Human
cacucaaaagcugggcagg

SEQ ID NO: 1797111 - RNA, 20 nt, Human
cacucaaaagcugggcaggu

SEQ ID NO: 1797112 - RNA, 17 nt, Human
cacucagaagacacuga

SEQ ID NO: 1797113 - RNA, 16 nt, Human
cacucagaagacacug

SEQ ID NO: 1797114 - RNA, 12 nt, Human
cacucagaagac

SEQ ID NO: 1797115 - RNA, 20 nt, Human
cacucacauuuauucugcuc

SEQ ID NO: 1797116 - RNA, 19 nt, Human
cacucacauuuauucugcu

SEQ ID NO: 1797117 - RNA, 19 nt, Human
cacucagaagacacugaug

SEQ ID NO: 1797118 - RNA, 18 nt, Human
cacucagaagacacugau

SEQ ID NO: 1797119 - RNA, 22 nt, Human
cacucagaagacacugaugggc

SEQ ID NO: 1797120 - RNA, 13 nt, Human
cacuaaacaaaga

SEQ ID NO: 1797121 - RNA, 23 nt, Human
cacguuucuaaaggcuaccuuug

SEQ ID NO: 1797122 - RNA, 14 nt, Human
cacguuucuaaagg

SEQ ID NO: 1797123 - RNA, 12 nt, Human
cacguuucuaaa

SEQ ID NO: 1797124 - RNA, 22 nt, Human
cacguucuuacuaguuucccuu

SEQ ID NO: 1797125 - RNA, 16 nt, Human
cacgugguccuaaucu

SEQ ID NO: 1797126 - RNA, 19 nt, Human
cacgugguccuaaucuucu

SEQ ID NO: 1797127 - RNA, 14 nt, Human
cacguacacacaca

SEQ ID NO: 1797128 - RNA, 19 nt, Human
cacguacacacacauacac

SEQ ID NO: 1797129 - RNA, 18 nt, Human
cacguacacacacauaca

SEQ ID NO: 1797130 - RNA, 13 nt, Human
cacgugacagccg

SEQ ID NO: 1797131 - RNA, 20 nt, Human
cacggcucacugcagccuca

SEQ ID NO: 1797132 - RNA, 19 nt, Human
cacggcucacugcagccuc

SEQ ID NO: 1797133 - RNA, 17 nt, Human
cacggcucacugcagcc

SEQ ID NO: 1797134 - RNA, 16 nt, Human
cacggcucacugcagc

SEQ ID NO: 1797135 - RNA, 17 nt, Human
cacgcuggaccuugaac

SEQ ID NO: 1797136 - RNA, 14 nt, Human
cacgcuccuuccuc

SEQ ID NO: 1797137 - RNA, 20 nt, Human
cacgcuggaccuugaacugg

SEQ ID NO: 1797138 - RNA, 15 nt, Human
cacgggggccaagga

SEQ ID NO: 1797139 - RNA, 21 nt, Human
cacgcgugcacacaccagagc

SEQ ID NO: 1797140 - RNA, 16 nt, Human
cacgcgugcacacacc

SEQ ID NO: 1797141 - RNA, 15 nt, Human
cacgcgugcacacac

SEQ ID NO: 1797142 - RNA, 23 nt, Human
cacgcgugcacacaccagagccc

SEQ ID NO: 1797143 - RNA, 19 nt, Human
cacgccuguaauccuagca

SEQ ID NO: 1797144 - RNA, 20 nt, Human
cacgccuguaauccuagcac

SEQ ID NO: 1797145 - RNA, 14 nt, Human
caccuuagacaguc

SEQ ID NO: 1797146 - RNA, 16 nt, Human
caccuuagacaguccc

SEQ ID NO: 1797147 - RNA, 18 nt, Human
caccuuagacagucccug

SEQ ID NO: 1797148 - RNA, 19 nt, Human
caccuuagacagucccugc

SEQ ID NO: 1797149 - RNA, 22 nt, Human
caccuuagccugcccuccuuuc

SEQ ID NO: 1797150 - RNA, 21 nt, Human
caccuuagacagucccugcca

SEQ ID NO: 1797151 - RNA, 23 nt, Human
caccuuagacagucccugccaau

SEQ ID NO: 1797152 - RNA, 17 nt, Human
cacgacugcccggcagg

SEQ ID NO: 1797153 - RNA, 16 nt, Human
cacgacugcccggcag

SEQ ID NO: 1797154 - RNA, 16 nt, Human
cacgaauauugcugau

SEQ ID NO: 1797155 - RNA, 19 nt, Human
cacgaauauugcugauggu

SEQ ID NO: 1797156 - RNA, 22 nt, Human
cacgaauauugcugauggugca

SEQ ID NO: 1797157 - RNA, 13 nt, Human
caccuugacaggg

SEQ ID NO: 1797158 - RNA, 13 nt, Human
caccuucccaugc

SEQ ID NO: 1797159 - RNA, 14 nt, Human
caccuucccaugcc

SEQ ID NO: 1797160 - RNA, 16 nt, Human
caccuugacagggcac

SEQ ID NO: 1797161 - RNA, 15 nt, Human
caccuugacagggca

SEQ ID NO: 1797162 - RNA, 18 nt, Human
caccuugacagggcacac

SEQ ID NO: 1797163 - RNA, 17 nt, Human
cacgcacuucgggaggu

SEQ ID NO: 1797164 - RNA, 16 nt, Human
cacgauuucuguuuag

SEQ ID NO: 1797165 - RNA, 14 nt, Human
cacgauuucuguuu

SEQ ID NO: 1797166 - RNA, 12 nt, Human
cacgauuucugu

SEQ ID NO: 1797167 - RNA, 15 nt, Human
cacgccacugcacua

SEQ ID NO: 1797168 - RNA, 19 nt, Human
cacgccagauucuuuccug

SEQ ID NO: 1797169 - RNA, 20 nt, Human
cacgccagauucuuuccuga

SEQ ID NO: 1797170 - RNA, 22 nt, Human
cacgccagauucuuuccugagg

SEQ ID NO: 1797171 - RNA, 13 nt, Human
cacgccacugcac

SEQ ID NO: 1797172 - RNA, 23 nt, Human
cacgccagauucuuuccugaggc

SEQ ID NO: 1797173 - RNA, 13 nt, Human
cacgcccccacug

SEQ ID NO: 1797174 - RNA, 15 nt, Human
cacgcccccacuggu

SEQ ID NO: 1797175 - RNA, 17 nt, Human
cacgcccccacugguga

SEQ ID NO: 1797176 - RNA, 18 nt, Human
cacgcccccacuggugac

SEQ ID NO: 1797177 - RNA, 14 nt, Human
cacuguugcccagg

SEQ ID NO: 1797178 - RNA, 23 nt, Human
cacuucaggcucuucuccuuuca

SEQ ID NO: 1797179 - RNA, 14 nt, Human
cacuucaggcucuu

SEQ ID NO: 1797180 - RNA, 15 nt, Human
cacuucaggcucuuc

SEQ ID NO: 1797181 - RNA, 16 nt, Human
cacuucaggcucuucu

SEQ ID NO: 1797182 - RNA, 20 nt, Human
cacuucaggcucuucuccuu

SEQ ID NO: 1797183 - RNA, 12 nt, Human
cacuucagcuga

SEQ ID NO: 1797184 - RNA, 21 nt, Human
cacuucagcugacuuuucugu

SEQ ID NO: 1797185 - RNA, 21 nt, Human
cacuucgggaggucgaggcag

SEQ ID NO: 1797186 - RNA, 23 nt, Human
cacuucgggaggucgaggcagga

SEQ ID NO: 1797187 - RNA, 22 nt, Human
cacuucugccauauucuguugg

SEQ ID NO: 1797188 - RNA, 20 nt, Human
cacuuccauaaucuggacuc

SEQ ID NO: 1797189 - RNA, 16 nt, Human
cacuucccuacaugga

SEQ ID NO: 1797190 - RNA, 22 nt, Human
cacuugcagacucuacagaggc

SEQ ID NO: 1797191 - RNA, 19 nt, Human
cacuugcagacucuacaga

SEQ ID NO: 1797192 - RNA, 18 nt, Human
cacuugcagacucuacag

SEQ ID NO: 1797193 - RNA, 14 nt, Human
cacuugcagacucu

SEQ ID NO: 1797194 - RNA, 24 nt, Human
cacuugcagacucuacagaggcca

SEQ ID NO: 1797195 - RNA, 19 nt, Human
cacuuucuagccagaggag

SEQ ID NO: 1797196 - RNA, 20 nt, Human
cacuuucuagccagaggaga

SEQ ID NO: 1797197 - RNA, 15 nt, Human
cacuuggucugugag

SEQ ID NO: 1797198 - RNA, 13 nt, Human
cacuugcagacuc

SEQ ID NO: 1797199 - RNA, 19 nt, Human
cacuugaugacccccaacc

SEQ ID NO: 1797200 - RNA, 13 nt, Human
cacuugaguccag

SEQ ID NO: 1797201 - RNA, 19 nt, Human
cacuugacaucaacugcau

SEQ ID NO: 1797202 - RNA, 17 nt, Human
cacuugagaauuacccu

SEQ ID NO: 1797203 - RNA, 20 nt, Human
cacuugagaauuacccuuuu

SEQ ID NO: 1797204 - RNA, 16 nt, Human
cacuugacaucaacug

SEQ ID NO: 1797205 - RNA, 23 nt, Human
cacuugaacccgggaggcagagg

SEQ ID NO: 1797206 - RNA, 21 nt, Human
cacuugaacccgggaggcaga

SEQ ID NO: 1797207 - RNA, 20 nt, Human
cacuugaacccgggaggcag

SEQ ID NO: 1797208 - RNA, 16 nt, Human
cacugugccaugugcc

SEQ ID NO: 1797209 - RNA, 15 nt, Human
cacugugccaugugc

SEQ ID NO: 1797210 - RNA, 18 nt, Human
cacugugccaugugccag

SEQ ID NO: 1797211 - RNA, 13 nt, Human
cacugugcugagu

SEQ ID NO: 1797212 - RNA, 15 nt, Human
cacugugcugagucu

SEQ ID NO: 1797213 - RNA, 17 nt, Human
cacugugcugagucuga

SEQ ID NO: 1797214 - RNA, 20 nt, Human
cacugugcugagucugaagg

SEQ ID NO: 1797215 - RNA, 21 nt, Human
cacugugcugagucugaaggc

SEQ ID NO: 1797216 - RNA, 22 nt, Human
cacugugcugagucugaaggcu

SEQ ID NO: 1797217 - RNA, 13 nt, Human
cacuguucucugc

SEQ ID NO: 1797218 - RNA, 14 nt, Human
cacuguucucugcc

SEQ ID NO: 1797219 - RNA, 15 nt, Human
cacuguucucugccc

SEQ ID NO: 1797220 - RNA, 16 nt, Human
cacuguucucugcccu

SEQ ID NO: 1797221 - RNA, 17 nt, Human
cacuguucucugcccuc

SEQ ID NO: 1797222 - RNA, 19 nt, Human
cacuguucucugcccucca

SEQ ID NO: 1797223 - RNA, 21 nt, Human
cacuguucucugcccuccaag

SEQ ID NO: 1797224 - RNA, 22 nt, Human
cacuguucucugcccuccaaga

SEQ ID NO: 1797225 - RNA, 14 nt, Human
cacugugccaugug

SEQ ID NO: 1797226 - RNA, 13 nt, Human
cacugugaagaga

SEQ ID NO: 1797227 - RNA, 15 nt, Human
cacuguacuugcucu

SEQ ID NO: 1797228 - RNA, 18 nt, Human
cacuguacuugcucuuga

SEQ ID NO: 1797229 - RNA, 19 nt, Human
cacuguacuugcucuugau

SEQ ID NO: 1797230 - RNA, 23 nt, Human
cacugagaccccaggcuguuagg

SEQ ID NO: 1797231 - RNA, 23 nt, Human
cacugagacagcccgggcucugc

SEQ ID NO: 1797232 - RNA, 24 nt, Human
cacugaugggcaacccccagccug

SEQ ID NO: 1797233 - RNA, 18 nt, Human
cacugaugggcaaccccc

SEQ ID NO: 1797234 - RNA, 14 nt, Human
cacugaugggcaac

SEQ ID NO: 1797235 - RNA, 13 nt, Human
cacugcaaccucc

SEQ ID NO: 1797236 - RNA, 16 nt, Human
cacugcaaccuccgcc

SEQ ID NO: 1797237 - RNA, 14 nt, Human
cacugcaaccuccg

SEQ ID NO: 1797238 - RNA, 23 nt, Human
cacugcaaccuccgccucuuggg

SEQ ID NO: 1797239 - RNA, 17 nt, Human
cacugcaacuucugccu

SEQ ID NO: 1797240 - RNA, 14 nt, Human
cacugcaaccuucg

SEQ ID NO: 1797241 - RNA, 22 nt, Human
cacugcaaccuucgccaccugg

SEQ ID NO: 1797242 - RNA, 16 nt, Human
cacugcaacuucugcc

SEQ ID NO: 1797243 - RNA, 23 nt, Human
cacugcaaccuucgccaccuggg

SEQ ID NO: 1797244 - RNA, 18 nt, Human
cacugcacagugcaucuc

SEQ ID NO: 1797245 - RNA, 19 nt, Human
cacugcacagugcaucuca

SEQ ID NO: 1797246 - RNA, 21 nt, Human
cacugcacagugcaucucagc

SEQ ID NO: 1797247 - RNA, 22 nt, Human
cacugcacagugcaucucagcc

SEQ ID NO: 1797248 - RNA, 20 nt, Human
cacucugucgcccagucugg

SEQ ID NO: 1797249 - RNA, 23 nt, Human
cacugacauuguuggccaaagcc

SEQ ID NO: 1797250 - RNA, 19 nt, Human
cacucugucgcccagucug

SEQ ID NO: 1797251 - RNA, 16 nt, Human
cacucugucgcccagu

SEQ ID NO: 1797252 - RNA, 15 nt, Human
cacucugucgcccag

SEQ ID NO: 1797253 - RNA, 23 nt, Human
cacucuggcagcucagagagggu

SEQ ID NO: 1797254 - RNA, 20 nt, Human
cacucuggcagcucagagag

SEQ ID NO: 1797255 - RNA, 21 nt, Human
cacucuggcagcucagagagg

SEQ ID NO: 1797256 - RNA, 15 nt, Human
cacucuggcagcuca

SEQ ID NO: 1797257 - RNA, 16 nt, Human
cacucuggcagcucag

SEQ ID NO: 1797258 - RNA, 17 nt, Human
cacucuggcagcucaga

SEQ ID NO: 1797259 - RNA, 19 nt, Human
cacucuggcagcucagaga

SEQ ID NO: 1797260 - RNA, 14 nt, Human
cacugagacagccc

SEQ ID NO: 1797261 - RNA, 17 nt, Human
cacugagacagcccggg

SEQ ID NO: 1797262 - RNA, 19 nt, Human
cacugagacagcccgggcu

SEQ ID NO: 1797263 - RNA, 22 nt, Human
cacugagacagcccgggcucug

SEQ ID NO: 1797264 - RNA, 12 nt, Human
cacugagacagc

SEQ ID NO: 1797265 - RNA, 13 nt, Human
cacugagacagcc

SEQ ID NO: 1797266 - RNA, 12 nt, Human
cacugcucuggu

SEQ ID NO: 1797267 - RNA, 20 nt, Human
cacugcucugaugaagagga

SEQ ID NO: 1797268 - RNA, 15 nt, Human
cacugcugcccagcc

SEQ ID NO: 1797269 - RNA, 17 nt, Human
cacugcugcccagccuc

SEQ ID NO: 1797270 - RNA, 20 nt, Human
cacugccuucgauacaccgg

SEQ ID NO: 1797271 - RNA, 22 nt, Human
cacugccuucgauacaccgggc

SEQ ID NO: 1797272 - RNA, 18 nt, Human
cacugcacuauagccuag

SEQ ID NO: 1797273 - RNA, 19 nt, Human
cacugcaccgggccacaga

SEQ ID NO: 1797274 - RNA, 18 nt, Human
cacugcaccgggccacag

SEQ ID NO: 1797275 - RNA, 16 nt, Human
cacugcaccgggccac

SEQ ID NO: 1797276 - RNA, 15 nt, Human
cacugcaccgggcca

SEQ ID NO: 1797277 - RNA, 14 nt, Human
cacugcaccgggcc

SEQ ID NO: 1797278 - RNA, 23 nt, Human
cacugcacagugcaucucagccc

SEQ ID NO: 1797279 - RNA, 16 nt, Human
cacugccucuuccucc

SEQ ID NO: 1797280 - RNA, 20 nt, Human
cacugcuuuuggucugugug

SEQ ID NO: 1797281 - RNA, 22 nt, Human
cacugcuuccagugaggcucug

SEQ ID NO: 1797282 - RNA, 18 nt, Human
cacugcuuccagugaggc

SEQ ID NO: 1797283 - RNA, 19 nt, Human
cacugcuuccagugaggcu

SEQ ID NO: 1797284 - RNA, 20 nt, Human
cacugcuuccagugaggcuc

SEQ ID NO: 1797285 - RNA, 21 nt, Human
cacugcuuccagugaggcucu

SEQ ID NO: 1797286 - RNA, 12 nt, Human
cacugcuggcug

SEQ ID NO: 1797287 - RNA, 13 nt, Human
cacugcuggcugc

SEQ ID NO: 1797288 - RNA, 14 nt, Human
cacugcuggcugcc

SEQ ID NO: 1797289 - RNA, 15 nt, Human
cacugcuggcugccu

SEQ ID NO: 1797290 - RNA, 16 nt, Human
cacugcuggcugccuu

SEQ ID NO: 1797291 - RNA, 21 nt, Human
cacugcuggcugccuuagaac

SEQ ID NO: 1797292 - RNA, 13 nt, Human
cacugcuuaacuu

SEQ ID NO: 1797293 - RNA, 14 nt, Human
cacugcuuccagug

SEQ ID NO: 1797294 - RNA, 15 nt, Human
cacugcuuccaguga

SEQ ID NO: 1797295 - RNA, 16 nt, Human
cacugcuuccagugag

SEQ ID NO: 1797296 - RNA, 21 nt, Human
cacugcuuuuggucuguguga

SEQ ID NO: 1797297 - RNA, 17 nt, Human
cacuggaacacuaauga

SEQ ID NO: 1797298 - RNA, 15 nt, Human
cacuggacucaccuc

SEQ ID NO: 1797299 - RNA, 18 nt, Human
cacuggacucaccucccc

SEQ ID NO: 1797300 - RNA, 17 nt, Human
caagugauucuccugcc

SEQ ID NO: 1797301 - RNA, 16 nt, Human
caagugauucuccugc

SEQ ID NO: 1797302 - RNA, 22 nt, Human
caagugauucucaugccucagc

SEQ ID NO: 1797303 - RNA, 19 nt, Human
caagugaaaaaggaggaag

SEQ ID NO: 1797304 - RNA, 22 nt, Human
caagugauucuccugccucagc

SEQ ID NO: 1797305 - RNA, 21 nt, Human
caagugauucuccugccucag

SEQ ID NO: 1797306 - RNA, 14 nt, Human
caagugauucuccu

SEQ ID NO: 1797307 - RNA, 22 nt, Human
caagugugguagagugugccug

SEQ ID NO: 1797308 - RNA, 19 nt, Human
caaggauugcuacuguccu

SEQ ID NO: 1797309 - RNA, 15 nt, Human
caaggauugcuacug

SEQ ID NO: 1797310 - RNA, 19 nt, Human
caagggccuggccugagcu

SEQ ID NO: 1797311 - RNA, 12 nt, Human
caaggugggagg

SEQ ID NO: 1797312 - RNA, 23 nt, Human
caaggugggaggauugcuugagc

SEQ ID NO: 1797313 - RNA, 17 nt, Human
caagcacuaaacaaaga

SEQ ID NO: 1797314 - RNA, 18 nt, Human
caagcaccuccugccucg

SEQ ID NO: 1797315 - RNA, 16 nt, Human
caagcgugagccacug

SEQ ID NO: 1797316 - RNA, 17 nt, Human
caagccguggcuucccg

SEQ ID NO: 1797317 - RNA, 14 nt, Human
caagccguggcuuc

SEQ ID NO: 1797318 - RNA, 15 nt, Human
caagccguggcuucc

SEQ ID NO: 1797319 - RNA, 16 nt, Human
caagccguggcuuccc

SEQ ID NO: 1797320 - RNA, 21 nt, Human
caagccaccaacauacuccca

SEQ ID NO: 1797321 - RNA, 18 nt, Human
caagcgugagccacugca

SEQ ID NO: 1797322 - RNA, 17 nt, Human
caagcgugagccacugc

SEQ ID NO: 1797323 - RNA, 14 nt, Human
caaggacuaggguc

SEQ ID NO: 1797324 - RNA, 13 nt, Human
caaggauccugag

SEQ ID NO: 1797325 - RNA, 19 nt, Human
caaggaugccccguccccc

SEQ ID NO: 1797326 - RNA, 21 nt, Human
caaggaugaucuaggaagacu

SEQ ID NO: 1797327 - RNA, 14 nt, Human
caaauuuacagaga

SEQ ID NO: 1797328 - RNA, 15 nt, Human
caaauucugucucug

SEQ ID NO: 1797329 - RNA, 18 nt, Human
caaauucugucucuggau

SEQ ID NO: 1797330 - RNA, 24 nt, Human
caacaggcugggcuucaguggcag

SEQ ID NO: 1797331 - RNA, 23 nt, Human
caacaggcugggcuucaguggca

SEQ ID NO: 1797332 - RNA, 15 nt, Human
caaauuuacagagac

SEQ ID NO: 1797333 - RNA, 22 nt, Human
caacaucuuggucagauuugaa

SEQ ID NO: 1797334 - RNA, 19 nt, Human
caacagguuuuccugaaga

SEQ ID NO: 1797335 - RNA, 18 nt, Human
caacaggguuuuuuucca

SEQ ID NO: 1797336 - RNA, 15 nt, Human
caacagguuuuccug

SEQ ID NO: 1797337 - RNA, 19 nt, Human
caaccccuucgcuccugug

SEQ ID NO: 1797338 - RNA, 18 nt, Human
caaccccuucgcuccugu

SEQ ID NO: 1797339 - RNA, 21 nt, Human
caaccccuucgcuccuguguc

SEQ ID NO: 1797340 - RNA, 21 nt, Human
caacccucagagccaccccua

SEQ ID NO: 1797341 - RNA, 18 nt, Human
caacccucagagccaccc

SEQ ID NO: 1797342 - RNA, 16 nt, Human
caacauuguagccuca

SEQ ID NO: 1797343 - RNA, 11 nt, Human
caacuuuguau

SEQ ID NO: 1797344 - RNA, 12 nt, Human
caacuuuguaua

SEQ ID NO: 1797345 - RNA, 20 nt, Human
caacucuccuccagagucag

SEQ ID NO: 1797346 - RNA, 12 nt, Human
caacccucauca

SEQ ID NO: 1797347 - RNA, 15 nt, Human
caacccucaucacca

SEQ ID NO: 1797348 - RNA, 12 nt, Human
caacgcagcccu

SEQ ID NO: 1797349 - RNA, 13 nt, Human
caacgcagcccug

SEQ ID NO: 1797350 - RNA, 15 nt, Human
caacgcagcccugcu

SEQ ID NO: 1797351 - RNA, 18 nt, Human
caacgcagcccugcuuug

SEQ ID NO: 1797352 - RNA, 19 nt, Human
caacucuccuccagaguca

SEQ ID NO: 1797353 - RNA, 16 nt, Human
caaccugauugugucu

SEQ ID NO: 1797354 - RNA, 22 nt, Human
caagccaccaacauacucccau

SEQ ID NO: 1797355 - RNA, 18 nt, Human
auuuuuuuacuaauagac

SEQ ID NO: 1797356 - RNA, 18 nt, Human
caaagcuaggccuggcca

SEQ ID NO: 1797357 - RNA, 17 nt, Human
caaagcuaggccuggcc

SEQ ID NO: 1797358 - RNA, 16 nt, Human
caaagcuaggccuggc

SEQ ID NO: 1797359 - RNA, 22 nt, Human
caaagccaaagcuaggccuggc

SEQ ID NO: 1797360 - RNA, 21 nt, Human
caaagccaaagcuaggccugg

SEQ ID NO: 1797361 - RNA, 20 nt, Human
caaagccaaagcuaggccug

SEQ ID NO: 1797362 - RNA, 16 nt, Human
caaagcuuguuaagau

SEQ ID NO: 1797363 - RNA, 22 nt, Human
caaauucugcuugcuugcuuuu

SEQ ID NO: 1797364 - RNA, 14 nt, Human
caaauguggcuccu

SEQ ID NO: 1797365 - RNA, 20 nt, Human
caaauguucaucaaugaaug

SEQ ID NO: 1797366 - RNA, 21 nt, Human
caaauguucaucaaugaauga

SEQ ID NO: 1797367 - RNA, 13 nt, Human
caaaucagcugcu

SEQ ID NO: 1797368 - RNA, 15 nt, Human
caaaugucuuccugg

SEQ ID NO: 1797369 - RNA, 18 nt, Human
caaaugucuuccuggauu

SEQ ID NO: 1797370 - RNA, 16 nt, Human
caaaucagcugcuacu

SEQ ID NO: 1797371 - RNA, 21 nt, Human
caaaggaugcccaaagaugca

SEQ ID NO: 1797372 - RNA, 12 nt, Human
caaauauauuca

SEQ ID NO: 1797373 - RNA, 19 nt, Human
caaauacauuuaaaacauu

SEQ ID NO: 1797374 - RNA, 17 nt, Human
cacaccgggcacucaga

SEQ ID NO: 1797375 - RNA, 14 nt, Human
cacacccuguuuua

SEQ ID NO: 1797376 - RNA, 13 nt, Human
cacaccagagccc

SEQ ID NO: 1797377 - RNA, 12 nt, Human
cacaccagagcc

SEQ ID NO: 1797378 - RNA, 15 nt, Human
cacaccagagcccac

SEQ ID NO: 1797379 - RNA, 13 nt, Human
cacacccagccca

SEQ ID NO: 1797380 - RNA, 14 nt, Human
cacacaccagagcc

SEQ ID NO: 1797381 - RNA, 12 nt, Human
cacacagcucug

SEQ ID NO: 1797382 - RNA, 19 nt, Human
cacacagaggcugccucuc

SEQ ID NO: 1797383 - RNA, 12 nt, Human
cacagagaaagu

SEQ ID NO: 1797384 - RNA, 17 nt, Human
cacagaguuguuacauu

SEQ ID NO: 1797385 - RNA, 16 nt, Human
cacagaguuguuacau

SEQ ID NO: 1797386 - RNA, 21 nt, Human
cacacuugacaucaacugcau

SEQ ID NO: 1797387 - RNA, 18 nt, Human
cacacuucaggcucuucu

SEQ ID NO: 1797388 - RNA, 20 nt, Human
cacacuucaggcucuucucc

SEQ ID NO: 1797389 - RNA, 21 nt, Human
cacacuucaggcucuucuccu

SEQ ID NO: 1797390 - RNA, 22 nt, Human
cacacuucaggcucuucuccuu

SEQ ID NO: 1797391 - RNA, 14 nt, Human
cacacuucaggcuc

SEQ ID NO: 1797392 - RNA, 17 nt, Human
cacacuucaggcucuuc

SEQ ID NO: 1797393 - RNA, 18 nt, Human
cacaaaaguuucucuuuu

SEQ ID NO: 1797394 - RNA, 16 nt, Human
cacaaaaguuucucuu

SEQ ID NO: 1797395 - RNA, 17 nt, Human
cacaaccuucuguggcu

SEQ ID NO: 1797396 - RNA, 18 nt, Human
cacaaccuucuguggcuc

SEQ ID NO: 1797397 - RNA, 19 nt, Human
cacaaccuucuguggcuca

SEQ ID NO: 1797398 - RNA, 23 nt, Human
cacaaccuucuguggcucacaga

SEQ ID NO: 1797399 - RNA, 22 nt, Human
cacaacacacagauuugagcuc

SEQ ID NO: 1797400 - RNA, 21 nt, Human
cacaaauucugucucuggauu

SEQ ID NO: 1797401 - RNA, 21 nt, Human
caauaggaaaaacugauuuuu

SEQ ID NO: 1797402 - RNA, 20 nt, Human
caauaggaaaaacugauuuu

SEQ ID NO: 1797403 - RNA, 23 nt, Human
caaugcacuuuguucuggcucuu

SEQ ID NO: 1797404 - RNA, 19 nt, Human
caaugcaaaccaucauuga

SEQ ID NO: 1797405 - RNA, 20 nt, Human
caaugcaaaccaucauugaa

SEQ ID NO: 1797406 - RNA, 17 nt, Human
caaugcaaaccaucauu

SEQ ID NO: 1797407 - RNA, 18 nt, Human
caaugcaaaccaucauug

SEQ ID NO: 1797408 - RNA, 13 nt, Human
caaugaccuuuca

SEQ ID NO: 1797409 - RNA, 21 nt, Human
caaugacacagucuuggcuca

SEQ ID NO: 1797410 - RNA, 19 nt, Human
caaugacacagucuuggcu

SEQ ID NO: 1797411 - RNA, 14 nt, Human
caaugacacagucu

SEQ ID NO: 1797412 - RNA, 22 nt, Human
caaugaaugaaugaauggcuaa

SEQ ID NO: 1797413 - RNA, 19 nt, Human
caaugugaaaagaaaaaug

SEQ ID NO: 1797414 - RNA, 16 nt, Human
cacagcagccccugca

SEQ ID NO: 1797415 - RNA, 20 nt, Human
cacagcacgggggccaagga

SEQ ID NO: 1797416 - RNA, 20 nt, Human
cacagaugggugcuuggagg

SEQ ID NO: 1797417 - RNA, 21 nt, Human
cacagaguuguuacauuuuua

SEQ ID NO: 1797418 - RNA, 20 nt, Human
cacagaguuguuacauuuuu

SEQ ID NO: 1797419 - RNA, 14 nt, Human
cacagaugggugcu

SEQ ID NO: 1797420 - RNA, 18 nt, Human
cacagaugggugcuugga

SEQ ID NO: 1797421 - RNA, 15 nt, Human
cacaggaaguagagg

SEQ ID NO: 1797422 - RNA, 16 nt, Human
cacaggaucagucuga

SEQ ID NO: 1797423 - RNA, 15 nt, Human
cacaggaucagucug

SEQ ID NO: 1797424 - RNA, 12 nt, Human
cacaggaucagu

SEQ ID NO: 1797425 - RNA, 19 nt, Human
cacaggcccggcuccaggc

SEQ ID NO: 1797426 - RNA, 18 nt, Human
cacaggcccggcuccagg

SEQ ID NO: 1797427 - RNA, 17 nt, Human
cacaggcccggcuccag

SEQ ID NO: 1797428 - RNA, 16 nt, Human
cacaggcccggcucca

SEQ ID NO: 1797429 - RNA, 10 nt, Human
cacaggcagg

SEQ ID NO: 1797430 - RNA, 17 nt, Human
cacauacacacacacgc

SEQ ID NO: 1797431 - RNA, 22 nt, Human
cacauaauucaggaagcagcuu

SEQ ID NO: 1797432 - RNA, 23 nt, Human
cacaggcccggcuccaggcuccu

SEQ ID NO: 1797433 - RNA, 20 nt, Human
cacaggcccggcuccaggcu

SEQ ID NO: 1797434 - RNA, 18 nt, Human
cacagugagucgaggaca

SEQ ID NO: 1797435 - RNA, 15 nt, Human
cacaggcccuuccuc

SEQ ID NO: 1797436 - RNA, 20 nt, Human
cacagugagucgaggacagg

SEQ ID NO: 1797437 - RNA, 19 nt, Human
cacagugagucgaggacag

SEQ ID NO: 1797438 - RNA, 21 nt, Human
cacagugagucgaggacaggg

SEQ ID NO: 1797439 - RNA, 15 nt, Human
caccaagcccaguua

SEQ ID NO: 1797440 - RNA, 18 nt, Human
cacauuggagauguuuag

SEQ ID NO: 1797441 - RNA, 17 nt, Human
caccacacccagcccac

SEQ ID NO: 1797442 - RNA, 15 nt, Human
caccacacccagccc

SEQ ID NO: 1797443 - RNA, 13 nt, Human
caccacacccagc

SEQ ID NO: 1797444 - RNA, 20 nt, Human
caccacuacauucuguuaau

SEQ ID NO: 1797445 - RNA, 19 nt, Human
caccacuacauucuguuaa

SEQ ID NO: 1797446 - RNA, 18 nt, Human
caccacuacauucuguua

SEQ ID NO: 1797447 - RNA, 17 nt, Human
caccacuacauucuguu

SEQ ID NO: 1797448 - RNA, 16 nt, Human
caccacuacauucugu

SEQ ID NO: 1797449 - RNA, 14 nt, Human
caccaccucuuugg

SEQ ID NO: 1797450 - RNA, 18 nt, Human
caccacaugugcacaugc

SEQ ID NO: 1797451 - RNA, 15 nt, Human
caccacaugugcaca

SEQ ID NO: 1797452 - RNA, 19 nt, Human
caccacaugugcacaugca

SEQ ID NO: 1797453 - RNA, 14 nt, Human
cacauaucugucau

SEQ ID NO: 1797454 - RNA, 12 nt, Human
cacauaucuguc

SEQ ID NO: 1797455 - RNA, 17 nt, Human
cacauauuucagugagg

SEQ ID NO: 1797456 - RNA, 18 nt, Human
cacaucagcacgauuucu

SEQ ID NO: 1797457 - RNA, 19 nt, Human
cacaucagcacgauuucug

SEQ ID NO: 1797458 - RNA, 13 nt, Human
cacaugccucucu

SEQ ID NO: 1797459 - RNA, 17 nt, Human
cacaugccucucucagg

SEQ ID NO: 1797460 - RNA, 18 nt, Human
cacaugccucucucaggc

SEQ ID NO: 1797461 - RNA, 19 nt, Human
cacaugccucucucaggcc

SEQ ID NO: 1797462 - RNA, 15 nt, Human
cacaugugcacaugc

SEQ ID NO: 1797463 - RNA, 14 nt, Human
cacaugugcacaug

SEQ ID NO: 1797464 - RNA, 17 nt, Human
cacaugugcacaugcac

SEQ ID NO: 1797465 - RNA, 13 nt, Human
cacauguggacuu

SEQ ID NO: 1797466 - RNA, 16 nt, Human
cacauuccugaugcuu

SEQ ID NO: 1797467 - RNA, 22 nt, Human
cacccaccaucaugucuggcua

SEQ ID NO: 1797468 - RNA, 20 nt, Human
cacccaccaucaugucuggc

SEQ ID NO: 1797469 - RNA, 16 nt, Human
cacccaccucagccuc

SEQ ID NO: 1797470 - RNA, 14 nt, Human
cacccaccucagcc

SEQ ID NO: 1797471 - RNA, 13 nt, Human
cacccaccucagc

SEQ ID NO: 1797472 - RNA, 12 nt, Human
cacccaccucag

SEQ ID NO: 1797473 - RNA, 12 nt, Human
caccccagcccc

SEQ ID NO: 1797474 - RNA, 13 nt, Human
caccccagcccca

SEQ ID NO: 1797475 - RNA, 19 nt, Human
cacccaagggccuggccug

SEQ ID NO: 1797476 - RNA, 20 nt, Human
cacccaagggccuggccuga

SEQ ID NO: 1797477 - RNA, 21 nt, Human
cacccaagggccuggccugag

SEQ ID NO: 1797478 - RNA, 23 nt, Human
cacccaagggccuggccugagcu

SEQ ID NO: 1797479 - RNA, 16 nt, Human
cacccaagggccuggc

SEQ ID NO: 1797480 - RNA, 17 nt, Human
cacccaagggccuggcc

SEQ ID NO: 1797481 - RNA, 18 nt, Human
cacccaagggccuggccu

SEQ ID NO: 1797482 - RNA, 22 nt, Human
cacccccacccaagggccuggc

SEQ ID NO: 1797483 - RNA, 14 nt, Human
caccccuaaagaga

SEQ ID NO: 1797484 - RNA, 14 nt, Human
caccccggccaccu

SEQ ID NO: 1797485 - RNA, 15 nt, Human
caccccggccaccug

SEQ ID NO: 1797486 - RNA, 16 nt, Human
caccccggccaccugc

SEQ ID NO: 1797487 - RNA, 17 nt, Human
caccccggccaccugcg

SEQ ID NO: 1797488 - RNA, 15 nt, Human
caccccuaaagagau

SEQ ID NO: 1797489 - RNA, 12 nt, Human
aguccuguaaug

SEQ ID NO: 1797490 - RNA, 17 nt, Human
agucugaaggcuggguu

SEQ ID NO: 1797491 - RNA, 16 nt, Human
agucugaaggcugggu

SEQ ID NO: 1797492 - RNA, 13 nt, Human
agucugaaggcug

SEQ ID NO: 1797493 - RNA, 15 nt, Human
agucugaaggcuggg

SEQ ID NO: 1797494 - RNA, 22 nt, Human
aguccuggcaugggaaugaaug

SEQ ID NO: 1797495 - RNA, 20 nt, Human
aguccuggcaugggaaugaa

SEQ ID NO: 1797496 - RNA, 21 nt, Human
aguccuggcaugggaaugaau

SEQ ID NO: 1797497 - RNA, 18 nt, Human
agucuggaaugcaguggu

SEQ ID NO: 1797498 - RNA, 20 nt, Human
agugaacuugggccacugug

SEQ ID NO: 1797499 - RNA, 17 nt, Human
agucuggaaugcagugg

SEQ ID NO: 1797500 - RNA, 18 nt, Human
agucugauucccaagcuc

SEQ ID NO: 1797501 - RNA, 16 nt, Human
agucugauucccaagc

SEQ ID NO: 1797502 - RNA, 20 nt, Human
agucugauucccaagcucug

SEQ ID NO: 1797503 - RNA, 16 nt, Human
agugaagacaaugacu

SEQ ID NO: 1797504 - RNA, 14 nt, Human
agugaagacaauga

SEQ ID NO: 1797505 - RNA, 18 nt, Human
agugaccauacuaauuau

SEQ ID NO: 1797506 - RNA, 14 nt, Human
aguaugguggcugg

SEQ ID NO: 1797507 - RNA, 17 nt, Human
aguaugggacuggccuc

SEQ ID NO: 1797508 - RNA, 20 nt, Human
aguaugggacuggccucugc

SEQ ID NO: 1797509 - RNA, 16 nt, Human
aguaugaggcauuugu

SEQ ID NO: 1797510 - RNA, 15 nt, Human
aguaugaggcauuug

SEQ ID NO: 1797511 - RNA, 16 nt, Human
aguaugaauaaagaca

SEQ ID NO: 1797512 - RNA, 16 nt, Human
aguaucuuuuuauuca

SEQ ID NO: 1797513 - RNA, 11 nt, Human
aguaucuugaa

SEQ ID NO: 1797514 - RNA, 12 nt, Human
aguaucuugaag

SEQ ID NO: 1797515 - RNA, 15 nt, Human
aguaucuugaagacu

SEQ ID NO: 1797516 - RNA, 14 nt, Human
agugggagcugccu

SEQ ID NO: 1797517 - RNA, 15 nt, Human
agugggagcugccug

SEQ ID NO: 1797518 - RNA, 16 nt, Human
agugggagcugccugu

SEQ ID NO: 1797519 - RNA, 18 nt, Human
aguguauuuuuuuacuaa

SEQ ID NO: 1797520 - RNA, 17 nt, Human
aguguauuuuuuuacua

SEQ ID NO: 1797521 - RNA, 23 nt, Human
aguggcuuaaaacaacacucaca

SEQ ID NO: 1797522 - RNA, 13 nt, Human
aguggcuccuccc

SEQ ID NO: 1797523 - RNA, 17 nt, Human
aguggcuccucccggug

SEQ ID NO: 1797524 - RNA, 21 nt, Human
aguggcuccucccggugccca

SEQ ID NO: 1797525 - RNA, 22 nt, Human
aguugaaaaucuuauaauuuaa

SEQ ID NO: 1797526 - RNA, 19 nt, Human
aguucagguaacaggcaga

SEQ ID NO: 1797527 - RNA, 17 nt, Human
aguuacagacaaagcgu

SEQ ID NO: 1797528 - RNA, 20 nt, Human
aguucagguaacaggcagau

SEQ ID NO: 1797529 - RNA, 13 nt, Human
aguuaagccuuug

SEQ ID NO: 1797530 - RNA, 12 nt, Human
aguuaaauaaau

SEQ ID NO: 1797531 - RNA, 14 nt, Human
aguuaagccuuugg

SEQ ID NO: 1797532 - RNA, 14 nt, Human
aguuacagacaaag

SEQ ID NO: 1797533 - RNA, 16 nt, Human
aguuacagacaaagcg

SEQ ID NO: 1797534 - RNA, 23 nt, Human
aguugaaaaucuuauaauuuaaa

SEQ ID NO: 1797535 - RNA, 14 nt, Human
aguugaagacagag

SEQ ID NO: 1797536 - RNA, 20 nt, Human
aguuguuugauucagacagc

SEQ ID NO: 1797537 - RNA, 16 nt, Human
aguuguuaauaaaagu

SEQ ID NO: 1797538 - RNA, 18 nt, Human
auaaaggauuaaugucaa

SEQ ID NO: 1797539 - RNA, 22 nt, Human
auaaauuuuuuuuguuucauau

SEQ ID NO: 1797540 - RNA, 19 nt, Human
auaaauuuuuuuuguuuca

SEQ ID NO: 1797541 - RNA, 12 nt, Human
auaaagacaccu

SEQ ID NO: 1797542 - RNA, 11 nt, Human
auaaagacagg

SEQ ID NO: 1797543 - RNA, 13 nt, Human
auaaagcagcguu

SEQ ID NO: 1797544 - RNA, 20 nt, Human
auaaagcagcguuucuauga

SEQ ID NO: 1797545 - RNA, 19 nt, Human
auaaagcagcguuucuaug

SEQ ID NO: 1797546 - RNA, 18 nt, Human
auaaagcagcguuucuau

SEQ ID NO: 1797547 - RNA, 14 nt, Human
auaaagcagcguuu

SEQ ID NO: 1797548 - RNA, 15 nt, Human
auaaagcaggcagaa

SEQ ID NO: 1797549 - RNA, 18 nt, Human
auaaagcuguguggcagu

SEQ ID NO: 1797550 - RNA, 11 nt, Human
auaaaacuuuu

SEQ ID NO: 1797551 - RNA, 15 nt, Human
auaaaacuuuuuaaa

SEQ ID NO: 1797552 - RNA, 20 nt, Human
auaaacuuuuuucuuacugu

SEQ ID NO: 1797553 - RNA, 24 nt, Human
auaaacuuuaccuuuuuuauacau

SEQ ID NO: 1797554 - RNA, 21 nt, Human
auaaacuuuaccuuuuuuaua

SEQ ID NO: 1797555 - RNA, 17 nt, Human
auaaaacuuuuuaaaau

SEQ ID NO: 1797556 - RNA, 11 nt, Human
auacccacccc

SEQ ID NO: 1797557 - RNA, 12 nt, Human
auacccaccccc

SEQ ID NO: 1797558 - RNA, 18 nt, Human
auaccugucccccugaca

SEQ ID NO: 1797559 - RNA, 15 nt, Human
auaauguaagcucua

SEQ ID NO: 1797560 - RNA, 20 nt, Human
auacaccacuacauucuguu

SEQ ID NO: 1797561 - RNA, 19 nt, Human
auacaccacuacauucugu

SEQ ID NO: 1797562 - RNA, 23 nt, Human
auaccauuauauguucccccugu

SEQ ID NO: 1797563 - RNA, 21 nt, Human
auacaccacuacauucuguua

SEQ ID NO: 1797564 - RNA, 18 nt, Human
auacaccacuacauucug

SEQ ID NO: 1797565 - RNA, 21 nt, Human
auaaugcgugcauaccacuuu

SEQ ID NO: 1797566 - RNA, 20 nt, Human
auaaugcgugcauaccacuu

SEQ ID NO: 1797567 - RNA, 15 nt, Human
auagguuuaauaauu

SEQ ID NO: 1797568 - RNA, 12 nt, Human
auagguuauuuu

SEQ ID NO: 1797569 - RNA, 18 nt, Human
auaguaugguggcugggu

SEQ ID NO: 1797570 - RNA, 17 nt, Human
auaguaugguggcuggg

SEQ ID NO: 1797571 - RNA, 21 nt, Human
auagguauaaguggugugugu

SEQ ID NO: 1797572 - RNA, 15 nt, Human
auagccaaggccaaa

SEQ ID NO: 1797573 - RNA, 21 nt, Human
auagccaaggccaaaggaagc

SEQ ID NO: 1797574 - RNA, 19 nt, Human
auauuuacuucuuauacau

SEQ ID NO: 1797575 - RNA, 14 nt, Human
auauuauuuuaugu

SEQ ID NO: 1797576 - RNA, 23 nt, Human
auauuaugaagcuuuuaugugaa

SEQ ID NO: 1797577 - RNA, 22 nt, Human
auauuaccacagacauacuaac

SEQ ID NO: 1797578 - RNA, 16 nt, Human
auaucaaauauauuca

SEQ ID NO: 1797579 - RNA, 15 nt, Human
auaucaauuuaaaaa

SEQ ID NO: 1797580 - RNA, 15 nt, Human
aucaugugaaaucau

SEQ ID NO: 1797581 - RNA, 14 nt, Human
aucaugugaaauca

SEQ ID NO: 1797582 - RNA, 16 nt, Human
aucaugugaaaucauu

SEQ ID NO: 1797583 - RNA, 20 nt, Human
aucagccugcuccagcuguu

SEQ ID NO: 1797584 - RNA, 19 nt, Human
aucagccugcuccagcugu

SEQ ID NO: 1797585 - RNA, 17 nt, Human
aucagccugcuccagcu

SEQ ID NO: 1797586 - RNA, 18 nt, Human
aucagccugcuccagcug

SEQ ID NO: 1797587 - RNA, 23 nt, Human
aucagcacgauuucuguuuagau

SEQ ID NO: 1797588 - RNA, 20 nt, Human
aucagcacgauuucuguuua

SEQ ID NO: 1797589 - RNA, 19 nt, Human
aucagcacgauuucuguuu

SEQ ID NO: 1797590 - RNA, 14 nt, Human
aucaccgaaaacgu

SEQ ID NO: 1797591 - RNA, 19 nt, Human
aucaccgaaaacguggcug

SEQ ID NO: 1797592 - RNA, 21 nt, Human
aucaccgaaaacguggcugcu

SEQ ID NO: 1797593 - RNA, 21 nt, Human
aucacagccucugaaaaccaa

SEQ ID NO: 1797594 - RNA, 15 nt, Human
aucacauguggacuu

SEQ ID NO: 1797595 - RNA, 18 nt, Human
aucaccaacgucugugcc

SEQ ID NO: 1797596 - RNA, 19 nt, Human
aucaccaacgucugugcca

SEQ ID NO: 1797597 - RNA, 19 nt, Human
auccucccaccucagccuc

SEQ ID NO: 1797598 - RNA, 18 nt, Human
auccucccaccucagccu

SEQ ID NO: 1797599 - RNA, 20 nt, Human
auccucccaccucagccucc

SEQ ID NO: 1797600 - RNA, 12 nt, Human
auccucccaggc

SEQ ID NO: 1797601 - RNA, 15 nt, Human
aucggcauuuguuuc

SEQ ID NO: 1797602 - RNA, 15 nt, Human
auccucccaccucag

SEQ ID NO: 1797603 - RNA, 23 nt, Human
auccuccaggugcacaagcucca

SEQ ID NO: 1797604 - RNA, 11 nt, Human
auccuccaggu

SEQ ID NO: 1797605 - RNA, 16 nt, Human
auccccaagccuggca

SEQ ID NO: 1797606 - RNA, 15 nt, Human
auccccuguagagug

SEQ ID NO: 1797607 - RNA, 14 nt, Human
aucccauuuaaaaa

SEQ ID NO: 1797608 - RNA, 13 nt, Human
auccccaagccug

SEQ ID NO: 1797609 - RNA, 15 nt, Human
aucccauuuaaaaaa

SEQ ID NO: 1797610 - RNA, 15 nt, Human
auccagacccggcug

SEQ ID NO: 1797611 - RNA, 18 nt, Human
auccagaaagaaaacuug

SEQ ID NO: 1797612 - RNA, 16 nt, Human
auccagaaagaaaacu

SEQ ID NO: 1797613 - RNA, 18 nt, Human
aucuugaagacuuuucuu

SEQ ID NO: 1797614 - RNA, 14 nt, Human
aucuucuuuauaau

SEQ ID NO: 1797615 - RNA, 18 nt, Human
aucuugaauaauguaaga

SEQ ID NO: 1797616 - RNA, 17 nt, Human
aucuugaauuguaagga

SEQ ID NO: 1797617 - RNA, 16 nt, Human
aucucggcucacugca

SEQ ID NO: 1797618 - RNA, 14 nt, Human
aucucggcucacug

SEQ ID NO: 1797619 - RNA, 15 nt, Human
aucucggcucacugc

SEQ ID NO: 1797620 - RNA, 17 nt, Human
aucucugcuuuggaaau

SEQ ID NO: 1797621 - RNA, 15 nt, Human
aucuggacuccucug

SEQ ID NO: 1797622 - RNA, 16 nt, Human
aucuggacuccucugu

SEQ ID NO: 1797623 - RNA, 17 nt, Human
aucuggacuccucuguc

SEQ ID NO: 1797624 - RNA, 18 nt, Human
aucuggacuccucugucc

SEQ ID NO: 1797625 - RNA, 19 nt, Human
aucuggacuccucugucca

SEQ ID NO: 1797626 - RNA, 22 nt, Human
aucugcuuuuuaaagaaugcuc

SEQ ID NO: 1797627 - RNA, 13 nt, Human
augaaagacugua

SEQ ID NO: 1797628 - RNA, 16 nt, Human
augaaagacuguacaa

SEQ ID NO: 1797629 - RNA, 17 nt, Human
augaaagacuguacaaa

SEQ ID NO: 1797630 - RNA, 19 nt, Human
augaaagacuguacaaagu

SEQ ID NO: 1797631 - RNA, 19 nt, Human
augaaguuuuuuuuauaca

SEQ ID NO: 1797632 - RNA, 22 nt, Human
augaagcuuuuaugugaaacau

SEQ ID NO: 1797633 - RNA, 23 nt, Human
augaaguuuuuuuuauacaggau

SEQ ID NO: 1797634 - RNA, 21 nt, Human
augaccuuucaauaggaaaaa

SEQ ID NO: 1797635 - RNA, 22 nt, Human
augaccuuucaauaggaaaaac

SEQ ID NO: 1797636 - RNA, 23 nt, Human
augaccuuucaauaggaaaaacu

SEQ ID NO: 1797637 - RNA, 11 nt, Human
augcugcccug

SEQ ID NO: 1797638 - RNA, 16 nt, Human
augcucuuuacuucau

SEQ ID NO: 1797639 - RNA, 22 nt, Human
auggaggaaaaccaagccgugg

SEQ ID NO: 1797640 - RNA, 16 nt, Human
auggaggaaaaccaag

SEQ ID NO: 1797641 - RNA, 15 nt, Human
auggauuuccagcca

SEQ ID NO: 1797642 - RNA, 18 nt, Human
auggcugugccucugccu

SEQ ID NO: 1797643 - RNA, 14 nt, Human
augcuuguacauaa

SEQ ID NO: 1797644 - RNA, 13 nt, Human
augcuuguacaua

SEQ ID NO: 1797645 - RNA, 12 nt, Human
augcuuguacau

SEQ ID NO: 1797646 - RNA, 12 nt, Human
augcugcccugu

SEQ ID NO: 1797647 - RNA, 19 nt, Human
auggcugugccucugccug

SEQ ID NO: 1797648 - RNA, 20 nt, Human
auggcugugccucugccugu

SEQ ID NO: 1797649 - RNA, 24 nt, Human
augauguuuuccaugaguccccug

SEQ ID NO: 1797650 - RNA, 15 nt, Human
augcacaaacagagg

SEQ ID NO: 1797651 - RNA, 16 nt, Human
augaugccaugaggaa

SEQ ID NO: 1797652 - RNA, 17 nt, Human
augaugccaugaggaac

SEQ ID NO: 1797653 - RNA, 16 nt, Human
augcauauuauuuuau

SEQ ID NO: 1797654 - RNA, 20 nt, Human
augcauauuauuuuauguug

SEQ ID NO: 1797655 - RNA, 16 nt, Human
augcaugaaguaauau

SEQ ID NO: 1797656 - RNA, 19 nt, Human
augccucucucaggccaaa

SEQ ID NO: 1797657 - RNA, 16 nt, Human
augcacagaguuguua

SEQ ID NO: 1797658 - RNA, 16 nt, Human
augcacaaacagaggc

SEQ ID NO: 1797659 - RNA, 17 nt, Human
augcacaaacagaggcc

SEQ ID NO: 1797660 - RNA, 18 nt, Human
augcacagaguuguuaca

SEQ ID NO: 1797661 - RNA, 17 nt, Human
augcacagaguuguuac

SEQ ID NO: 1797662 - RNA, 23 nt, Human
auguaauuaaguacuauguauca

SEQ ID NO: 1797663 - RNA, 15 nt, Human
auggucggaaaacau

SEQ ID NO: 1797664 - RNA, 15 nt, Human
auguaauuaaguacu

SEQ ID NO: 1797665 - RNA, 17 nt, Human
auguaauuaaguacuau

SEQ ID NO: 1797666 - RNA, 19 nt, Human
auggucaccaaaucagcug

SEQ ID NO: 1797667 - RNA, 13 nt, Human
augucuuccugga

SEQ ID NO: 1797668 - RNA, 14 nt, Human
augucuuuucuugc

SEQ ID NO: 1797669 - RNA, 15 nt, Human
augugaaacauguuu

SEQ ID NO: 1797670 - RNA, 14 nt, Human
augugaaaucauuc

SEQ ID NO: 1797671 - RNA, 22 nt, Human
augugaaacuggauuaaacuua

SEQ ID NO: 1797672 - RNA, 20 nt, Human
augugggcuaguugggcuuc

SEQ ID NO: 1797673 - RNA, 17 nt, Human
auguucuaagaagugaa

SEQ ID NO: 1797674 - RNA, 12 nt, Human
auguucugggac

SEQ ID NO: 1797675 - RNA, 11 nt, Human
auguucuggga

SEQ ID NO: 1797676 - RNA, 13 nt, Human
auguucugggaca

SEQ ID NO: 1797677 - RNA, 19 nt, Human
auguuugccucugccucug

SEQ ID NO: 1797678 - RNA, 22 nt, Human
auguuugccucugccucugaca

SEQ ID NO: 1797679 - RNA, 15 nt, Human
agguucaaagauauu

SEQ ID NO: 1797680 - RNA, 14 nt, Human
agguucaaagauau

SEQ ID NO: 1797681 - RNA, 22 nt, Human
agguucccuuugacgccauccc

SEQ ID NO: 1797682 - RNA, 13 nt, Human
agguucccuuuga

SEQ ID NO: 1797683 - RNA, 23 nt, Human
agguucccuuugacgccauccca

SEQ ID NO: 1797684 - RNA, 23 nt, Human
aggugcuaggaacacuccuucac

SEQ ID NO: 1797685 - RNA, 19 nt, Human
aggugcuaggaacacuccu

SEQ ID NO: 1797686 - RNA, 22 nt, Human
aggugcuaggaacacuccuuca

SEQ ID NO: 1797687 - RNA, 20 nt, Human
agguaaaagcaucacaugaa

SEQ ID NO: 1797688 - RNA, 18 nt, Human
agguaaaucagacuauga

SEQ ID NO: 1797689 - RNA, 19 nt, Human
agguaaucgaccugccucg

SEQ ID NO: 1797690 - RNA, 21 nt, Human
agguaaucgaccugccucggc

SEQ ID NO: 1797691 - RNA, 23 nt, Human
agguaaaucagacuaugaaguuu

SEQ ID NO: 1797692 - RNA, 17 nt, Human
agguacaaccuguucug

SEQ ID NO: 1797693 - RNA, 12 nt, Human
aggucccuaaua

SEQ ID NO: 1797694 - RNA, 11 nt, Human
aggucccuaau

SEQ ID NO: 1797695 - RNA, 13 nt, Human
aggucccuaauaa

SEQ ID NO: 1797696 - RNA, 15 nt, Human
aggucccuaauaaag

SEQ ID NO: 1797697 - RNA, 16 nt, Human
aggucccuaauaaagc

SEQ ID NO: 1797698 - RNA, 18 nt, Human
aggucuguucuuuccaaa

SEQ ID NO: 1797699 - RNA, 23 nt, Human
aggucuguucuuuccaaaguaca

SEQ ID NO: 1797700 - RNA, 22 nt, Human
aggucuguucuuuccaaaguac

SEQ ID NO: 1797701 - RNA, 11 nt, Human
agggucccugg

SEQ ID NO: 1797702 - RNA, 12 nt, Human
aggguccugggg

SEQ ID NO: 1797703 - RNA, 15 nt, Human
aggguccuggggaac

SEQ ID NO: 1797704 - RNA, 21 nt, Human
aggguccuggggaaccugacc

SEQ ID NO: 1797705 - RNA, 23 nt, Human
aggguccuggggaaccugacccc

SEQ ID NO: 1797706 - RNA, 21 nt, Human
aggguaucaggugcugccauc

SEQ ID NO: 1797707 - RNA, 15 nt, Human
aggguaucuggugac

SEQ ID NO: 1797708 - RNA, 19 nt, Human
aggguaucaggugcugcca

SEQ ID NO: 1797709 - RNA, 19 nt, Human
aggggccucuuaugggcug

SEQ ID NO: 1797710 - RNA, 20 nt, Human
aggggccucuuaugggcugg

SEQ ID NO: 1797711 - RNA, 21 nt, Human
aggggccucuuaugggcuggg

SEQ ID NO: 1797712 - RNA, 21 nt, Human
aggcgugagccaccgugccug

SEQ ID NO: 1797713 - RNA, 23 nt, Human
aggcuacuguaaggcaaucaugg

SEQ ID NO: 1797714 - RNA, 21 nt, Human
aggcuagaaccaccugccuau

SEQ ID NO: 1797715 - RNA, 19 nt, Human
aggcccuuccucuccacug

SEQ ID NO: 1797716 - RNA, 22 nt, Human
aggcccuucucuccagccccug

SEQ ID NO: 1797717 - RNA, 23 nt, Human
aggcccuucucuccagccccugg

SEQ ID NO: 1797718 - RNA, 13 nt, Human
aggcccuuccucu

SEQ ID NO: 1797719 - RNA, 15 nt, Human
aggcccuuccucucc

SEQ ID NO: 1797720 - RNA, 17 nt, Human
aggcccuuccucuccac

SEQ ID NO: 1797721 - RNA, 18 nt, Human
aggcccuuccucuccacu

SEQ ID NO: 1797722 - RNA, 20 nt, Human
aggcccuucucuccagcccc

SEQ ID NO: 1797723 - RNA, 21 nt, Human
aggcccuucucuccagccccu

SEQ ID NO: 1797724 - RNA, 18 nt, Human
aggcuguaucccaugagc

SEQ ID NO: 1797725 - RNA, 13 nt, Human
aggcuguauccca

SEQ ID NO: 1797726 - RNA, 20 nt, Human
aggcugucaauuacaggaag

SEQ ID NO: 1797727 - RNA, 21 nt, Human
aggcugucaauuacaggaagu

SEQ ID NO: 1797728 - RNA, 22 nt, Human
agggacagaggggguggccucc

SEQ ID NO: 1797729 - RNA, 23 nt, Human
agggacagaggggguggccuccc

SEQ ID NO: 1797730 - RNA, 17 nt, Human
agggacgcuacccggga

SEQ ID NO: 1797731 - RNA, 23 nt, Human
agcugcgguccacccaggagccc

SEQ ID NO: 1797732 - RNA, 19 nt, Human
agcuucuguugcugccuca

SEQ ID NO: 1797733 - RNA, 23 nt, Human
agcuccgcuuucuacccagcgag

SEQ ID NO: 1797734 - RNA, 21 nt, Human
agcuccgcuuucuacccagcg

SEQ ID NO: 1797735 - RNA, 20 nt, Human
agcuccgcuuucuacccagc

SEQ ID NO: 1797736 - RNA, 13 nt, Human
agcuccuucuguc

SEQ ID NO: 1797737 - RNA, 12 nt, Human
agcuccuucugu

SEQ ID NO: 1797738 - RNA, 23 nt, Human
agcugagauuauaggcaccuacc

SEQ ID NO: 1797739 - RNA, 16 nt, Human
aggauguucugggaca

SEQ ID NO: 1797740 - RNA, 15 nt, Human
aggauguucugggac

SEQ ID NO: 1797741 - RNA, 22 nt, Human
aggauguacaaggacagccccu

SEQ ID NO: 1797742 - RNA, 22 nt, Human
aggauguucuagcauggcugcc

SEQ ID NO: 1797743 - RNA, 18 nt, Human
aggauguucugggacaca

SEQ ID NO: 1797744 - RNA, 14 nt, Human
aggauuaaauaaug

SEQ ID NO: 1797745 - RNA, 20 nt, Human
aggauuaaauaauguaaaua

SEQ ID NO: 1797746 - RNA, 14 nt, Human
aggauuauuggaaa

SEQ ID NO: 1797747 - RNA, 23 nt, Human
aggaugcuuguacauaaugcgug

SEQ ID NO: 1797748 - RNA, 21 nt, Human
aggaugcuuguacauaaugcg

SEQ ID NO: 1797749 - RNA, 18 nt, Human
aggaguggguugauuuca

SEQ ID NO: 1797750 - RNA, 13 nt, Human
aggaccucaggug

SEQ ID NO: 1797751 - RNA, 17 nt, Human
aggaauccagacccggc

SEQ ID NO: 1797752 - RNA, 21 nt, Human
aggaaucaugugccaagcaga

SEQ ID NO: 1797753 - RNA, 20 nt, Human
aggaauccagacccggcugc

SEQ ID NO: 1797754 - RNA, 21 nt, Human
agcuuuucccuuuuuuuaagu

SEQ ID NO: 1797755 - RNA, 23 nt, Human
agcauccuggcacccggccccug

SEQ ID NO: 1797756 - RNA, 22 nt, Human
agcauccuggcacccggccccu

SEQ ID NO: 1797757 - RNA, 23 nt, Human
agccaagugugguagagugugcc

SEQ ID NO: 1797758 - RNA, 23 nt, Human
agcaugccuggauggggcugcac

SEQ ID NO: 1797759 - RNA, 19 nt, Human
agcagugcaugcugucccu

SEQ ID NO: 1797760 - RNA, 20 nt, Human
agcagugcaugcugucccuu

SEQ ID NO: 1797761 - RNA, 18 nt, Human
agcagcguuucuaugaca

SEQ ID NO: 1797762 - RNA, 13 nt, Human
agcagcguuucua

SEQ ID NO: 1797763 - RNA, 20 nt, Human
agcacagacccugcccugug

SEQ ID NO: 1797764 - RNA, 18 nt, Human
agcacagacccugcccug

SEQ ID NO: 1797765 - RNA, 19 nt, Human
agcacagacccugcccugu

SEQ ID NO: 1797766 - RNA, 23 nt, Human
agcacacuugacaucaacugcau

SEQ ID NO: 1797767 - RNA, 17 nt, Human
agcacagacccugcccu

SEQ ID NO: 1797768 - RNA, 21 nt, Human
agccucccaaagugcugggau

SEQ ID NO: 1797769 - RNA, 17 nt, Human
agccgugccuucagcuc

SEQ ID NO: 1797770 - RNA, 22 nt, Human
agccucccacgacugcccggca

SEQ ID NO: 1797771 - RNA, 15 nt, Human
agccgugccuucagc

SEQ ID NO: 1797772 - RNA, 16 nt, Human
agccgugccuucagcu

SEQ ID NO: 1797773 - RNA, 21 nt, Human
agccgggcgugguggugagug

SEQ ID NO: 1797774 - RNA, 19 nt, Human
agccucccgaguagcuggg

SEQ ID NO: 1797775 - RNA, 18 nt, Human
agccucccgaguagcugg

SEQ ID NO: 1797776 - RNA, 20 nt, Human
agccucccgaguagcuggga

SEQ ID NO: 1797777 - RNA, 14 nt, Human
agccuccuccagcc

SEQ ID NO: 1797778 - RNA, 21 nt, Human
agccgccaugcuccuggccca

SEQ ID NO: 1797779 - RNA, 13 nt, Human
agccgcuggggcc

SEQ ID NO: 1797780 - RNA, 16 nt, Human
agccccauucugccug

SEQ ID NO: 1797781 - RNA, 13 nt, Human
agccccauucugc

SEQ ID NO: 1797782 - RNA, 17 nt, Human
agcccucacccuggggc

SEQ ID NO: 1797783 - RNA, 15 nt, Human
agccccagugcccac

SEQ ID NO: 1797784 - RNA, 14 nt, Human
agccccagugccca

SEQ ID NO: 1797785 - RNA, 13 nt, Human
agccccagugccc

SEQ ID NO: 1797786 - RNA, 18 nt, Human
agccagcaggcucucagg

SEQ ID NO: 1797787 - RNA, 19 nt, Human
agccagcaggcucucaggc

SEQ ID NO: 1797788 - RNA, 20 nt, Human
agccagcaggcucucaggcc

SEQ ID NO: 1797789 - RNA, 16 nt, Human
agacuggaagcacagc

SEQ ID NO: 1797790 - RNA, 17 nt, Human
agacuggaagcacagcu

SEQ ID NO: 1797791 - RNA, 19 nt, Human
agacuggaagcacagcuuc

SEQ ID NO: 1797792 - RNA, 21 nt, Human
agagaggguggugaccucugc

SEQ ID NO: 1797793 - RNA, 20 nt, Human
agagaggguggugaccucug

SEQ ID NO: 1797794 - RNA, 22 nt, Human
agagaggguggugaccucugcc

SEQ ID NO: 1797795 - RNA, 19 nt, Human
agagcccaccuuggcucaa

SEQ ID NO: 1797796 - RNA, 13 nt, Human
agagcccacgccc

SEQ ID NO: 1797797 - RNA, 17 nt, Human
agagcccacgcccccac

SEQ ID NO: 1797798 - RNA, 16 nt, Human
agagcccacgccccca

SEQ ID NO: 1797799 - RNA, 21 nt, Human
agacgcugugcugcccugccc

SEQ ID NO: 1797800 - RNA, 12 nt, Human
agacagcugccu

SEQ ID NO: 1797801 - RNA, 11 nt, Human
agacagcucuu

SEQ ID NO: 1797802 - RNA, 12 nt, Human
agacagcucuua

SEQ ID NO: 1797803 - RNA, 18 nt, Human
agacggagucccaccuug

SEQ ID NO: 1797804 - RNA, 22 nt, Human
agacgcugugcugcccugccca

SEQ ID NO: 1797805 - RNA, 17 nt, Human
agacgugauuuugcugu

SEQ ID NO: 1797806 - RNA, 15 nt, Human
agacagauacuccuc

SEQ ID NO: 1797807 - RNA, 21 nt, Human
agacagauacuccuccaaggu

SEQ ID NO: 1797808 - RNA, 16 nt, Human
agacagcccgggcucu

SEQ ID NO: 1797809 - RNA, 14 nt, Human
agacagcccgggcu

SEQ ID NO: 1797810 - RNA, 15 nt, Human
agacagcccgggcuc

SEQ ID NO: 1797811 - RNA, 19 nt, Human
agauauaugcucugcaugu

SEQ ID NO: 1797812 - RNA, 14 nt, Human
agauggcugugccu

SEQ ID NO: 1797813 - RNA, 14 nt, Human
agagugugccugaa

SEQ ID NO: 1797814 - RNA, 23 nt, Human
agaggguggugaccucugccuga

SEQ ID NO: 1797815 - RNA, 19 nt, Human
agaguggcuccucccggug

SEQ ID NO: 1797816 - RNA, 11 nt, Human
agagugggagc

SEQ ID NO: 1797817 - RNA, 23 nt, Human
agaguggcuccucccggugccca

SEQ ID NO: 1797818 - RNA, 19 nt, Human
agaguggggauaugauuua

SEQ ID NO: 1797819 - RNA, 19 nt, Human
agaggguggugaccucugc

SEQ ID NO: 1797820 - RNA, 22 nt, Human
agaggguggugaccucugccug

SEQ ID NO: 1797821 - RNA, 20 nt, Human
agaggguggugaccucugcc

SEQ ID NO: 1797822 - RNA, 12 nt, Human
agagggcacaga

SEQ ID NO: 1797823 - RNA, 14 nt, Human
agaggacuuuucuu

SEQ ID NO: 1797824 - RNA, 15 nt, Human
agaggagagaggacc

SEQ ID NO: 1797825 - RNA, 16 nt, Human
agaggagagaggaccc

SEQ ID NO: 1797826 - RNA, 16 nt, Human
agaggaaggagaggag

SEQ ID NO: 1797827 - RNA, 15 nt, Human
agagcccaggccucc

SEQ ID NO: 1797828 - RNA, 13 nt, Human
agagcccaggccu

SEQ ID NO: 1797829 - RNA, 14 nt, Human
agagcccaggccuc

SEQ ID NO: 1797830 - RNA, 15 nt, Human
aauccaaugaaauga

SEQ ID NO: 1797831 - RNA, 17 nt, Human
aauccagacccggcugc

SEQ ID NO: 1797832 - RNA, 19 nt, Human
aauccagacccggcugcgu

SEQ ID NO: 1797833 - RNA, 13 nt, Human
aauccagccugcu

SEQ ID NO: 1797834 - RNA, 15 nt, Human
aaucucaaauuucua

SEQ ID NO: 1797835 - RNA, 16 nt, Human
aaucucaaauuucuaa

SEQ ID NO: 1797836 - RNA, 16 nt, Human
aaucucuccauucccg

SEQ ID NO: 1797837 - RNA, 18 nt, Human
aaucucaaauuucuaaau

SEQ ID NO: 1797838 - RNA, 17 nt, Human
aaucucaaauuucuaaa

SEQ ID NO: 1797839 - RNA, 16 nt, Human
aaugauccccagcugu

SEQ ID NO: 1797840 - RNA, 20 nt, Human
aaugauccccagcuguuuau

SEQ ID NO: 1797841 - RNA, 19 nt, Human
aaugauccccagcuguuua

SEQ ID NO: 1797842 - RNA, 22 nt, Human
aaugauccccagcuguuuaugc

SEQ ID NO: 1797843 - RNA, 17 nt, Human
aauccaagcaaauguga

SEQ ID NO: 1797844 - RNA, 18 nt, Human
aauccaagcaaaugugaa

SEQ ID NO: 1797845 - RNA, 16 nt, Human
aauauauaucaaauau

SEQ ID NO: 1797846 - RNA, 13 nt, Human
aauagacaauuua

SEQ ID NO: 1797847 - RNA, 15 nt, Human
aaucaccgaaaacgu

SEQ ID NO: 1797848 - RNA, 19 nt, Human
aaucacauucgaguguuuc

SEQ ID NO: 1797849 - RNA, 14 nt, Human
aaucaccgaaaacg

SEQ ID NO: 1797850 - RNA, 21 nt, Human
aauauuagugaccucagcuuu

SEQ ID NO: 1797851 - RNA, 23 nt, Human
aauacuuugcagcacagcugaga

SEQ ID NO: 1797852 - RNA, 20 nt, Human
aauacucuacccucuuagaa

SEQ ID NO: 1797853 - RNA, 22 nt, Human
aauacucuacccucuuagaaaa

SEQ ID NO: 1797854 - RNA, 17 nt, Human
aaugugaaaagaaaaau

SEQ ID NO: 1797855 - RNA, 15 nt, Human
aaugugaaaagaaaa

SEQ ID NO: 1797856 - RNA, 16 nt, Human
aauguuugccucugcc

SEQ ID NO: 1797857 - RNA, 15 nt, Human
aauguuugccucugc

SEQ ID NO: 1797858 - RNA, 13 nt, Human
aauguuuccuuua

SEQ ID NO: 1797859 - RNA, 22 nt, Human
aauguuuacagauccccaagcc

SEQ ID NO: 1797860 - RNA, 12 nt, Human
aauguuuccuuu

SEQ ID NO: 1797861 - RNA, 23 nt, Human
aaugcuauaacuauguugauaaa

SEQ ID NO: 1797862 - RNA, 23 nt, Human
aaugccuuacccucauguucuua

SEQ ID NO: 1797863 - RNA, 22 nt, Human
aaugcgcaggcuggcccugccc

SEQ ID NO: 1797864 - RNA, 21 nt, Human
aaugcgcaggcuggcccugcc

SEQ ID NO: 1797865 - RNA, 18 nt, Human
aaugcgugcauaccacuu

SEQ ID NO: 1797866 - RNA, 19 nt, Human
aaugcgugcauaccacuuu

SEQ ID NO: 1797867 - RNA, 15 nt, Human
aauguuuuuuuuuaa

SEQ ID NO: 1797868 - RNA, 20 nt, Human
aauguuuuuuuuuaaagacu

SEQ ID NO: 1797869 - RNA, 22 nt, Human
aauguuuuuuuuuaaagacuuu

SEQ ID NO: 1797870 - RNA, 18 nt, Human
aagggacgcuacccggga

SEQ ID NO: 1797871 - RNA, 19 nt, Human
aaggucauuuuuuuuaaga

SEQ ID NO: 1797872 - RNA, 18 nt, Human
aaggucauuuuuuuuaag

SEQ ID NO: 1797873 - RNA, 22 nt, Human
aaguccucuuuucugagaggac

SEQ ID NO: 1797874 - RNA, 14 nt, Human
aagucuccaaaguc

SEQ ID NO: 1797875 - RNA, 18 nt, Human
aaguccucuuuucugaga

SEQ ID NO: 1797876 - RNA, 19 nt, Human
aaguccacaguggaaccag

SEQ ID NO: 1797877 - RNA, 14 nt, Human
aaguccacagugga

SEQ ID NO: 1797878 - RNA, 18 nt, Human
aaguauccugcuucugau

SEQ ID NO: 1797879 - RNA, 19 nt, Human
aaguagaagucuuagaugu

SEQ ID NO: 1797880 - RNA, 20 nt, Human
aaguagaagucuuagaugua

SEQ ID NO: 1797881 - RNA, 20 nt, Human
aaggugaggagcuugaaacc

SEQ ID NO: 1797882 - RNA, 15 nt, Human
aaguaguggagcccc

SEQ ID NO: 1797883 - RNA, 17 nt, Human
aaguaucccuacuguaa

SEQ ID NO: 1797884 - RNA, 23 nt, Human
aaguaucccuacuguaauuugug

SEQ ID NO: 1797885 - RNA, 18 nt, Human
aaguaucccuacuguaau

SEQ ID NO: 1797886 - RNA, 21 nt, Human
aaguagaagucuuagauguau

SEQ ID NO: 1797887 - RNA, 15 nt, Human
aagucuccaaagucu

SEQ ID NO: 1797888 - RNA, 20 nt, Human
aagucuguugauuaaagaug

SEQ ID NO: 1797889 - RNA, 21 nt, Human
aaguggaaaaauagccugccu

SEQ ID NO: 1797890 - RNA, 19 nt, Human
aaguggaaaaauagccugc

SEQ ID NO: 1797891 - RNA, 20 nt, Human
aagauguucuggauaccauu

SEQ ID NO: 1797892 - RNA, 15 nt, Human
aagauguucuggaua

SEQ ID NO: 1797893 - RNA, 12 nt, Human
aagauaaaugug

SEQ ID NO: 1797894 - RNA, 13 nt, Human
aagauaaaugugc

SEQ ID NO: 1797895 - RNA, 14 nt, Human
aagauaaaugugcu

SEQ ID NO: 1797896 - RNA, 20 nt, Human
aagccagcaggcucucaggc

SEQ ID NO: 1797897 - RNA, 23 nt, Human
aagccagcaggcucucaggccag

SEQ ID NO: 1797898 - RNA, 22 nt, Human
aagcagcguuucuaugacacau

SEQ ID NO: 1797899 - RNA, 21 nt, Human
aagcagcguuucuaugacaca

SEQ ID NO: 1797900 - RNA, 20 nt, Human
aagcagcguuucuaugacac

SEQ ID NO: 1797901 - RNA, 17 nt, Human
aagcagcguuucuauga

SEQ ID NO: 1797902 - RNA, 14 nt, Human
aagcagcguuucua

SEQ ID NO: 1797903 - RNA, 21 nt, Human
aagcuggucccacucagucca

SEQ ID NO: 1797904 - RNA, 18 nt, Human
aagcuggucccacucagu

SEQ ID NO: 1797905 - RNA, 18 nt, Human
aagcuguguggcagucug

SEQ ID NO: 1797906 - RNA, 13 nt, Human
aaggacacuagaa

SEQ ID NO: 1797907 - RNA, 13 nt, Human
aaggacagccccu

SEQ ID NO: 1797908 - RNA, 19 nt, Human
aaggacagccccuccucca

SEQ ID NO: 1797909 - RNA, 15 nt, Human
aaggauugcuacugu

SEQ ID NO: 1797910 - RNA, 15 nt, Human
aaggauguucuagca

SEQ ID NO: 1797911 - RNA, 12 nt, Human
aaggcagggagg

SEQ ID NO: 1797912 - RNA, 21 nt, Human
aagcgauucuucugcuucagc

SEQ ID NO: 1797913 - RNA, 17 nt, Human
aaaucuuauaauuuaaa

SEQ ID NO: 1797914 - RNA, 15 nt, Human
aaaugccuuuguacu

SEQ ID NO: 1797915 - RNA, 19 nt, Human
aaauugacacuuaaaaaug

SEQ ID NO: 1797916 - RNA, 13 nt, Human
aaauugcuccuug

SEQ ID NO: 1797917 - RNA, 14 nt, Human
aaauugcuccuuga

SEQ ID NO: 1797918 - RNA, 13 nt, Human
aaauuaaagcuga

SEQ ID NO: 1797919 - RNA, 17 nt, Human
aaauuaaagcugaaaac

SEQ ID NO: 1797920 - RNA, 21 nt, Human
aaauucuugcaaaguaucccu

SEQ ID NO: 1797921 - RNA, 18 nt, Human
aaauuuuuuuuguuucau

SEQ ID NO: 1797922 - RNA, 17 nt, Human
aaauuuuuuuuguuuca

SEQ ID NO: 1797923 - RNA, 18 nt, Human
aacaaauuuacagagaca

SEQ ID NO: 1797924 - RNA, 22 nt, Human
aaccacuggaaaguuuaugguu

SEQ ID NO: 1797925 - RNA, 15 nt, Human
aaccacuucagcuga

SEQ ID NO: 1797926 - RNA, 13 nt, Human
aaccacgcuggac

SEQ ID NO: 1797927 - RNA, 15 nt, Human
aacaucccuccuggg

SEQ ID NO: 1797928 - RNA, 15 nt, Human
aacccuauugguaaa

SEQ ID NO: 1797929 - RNA, 21 nt, Human
aacccuuggagccaauggaga

SEQ ID NO: 1797930 - RNA, 11 nt, Human
aacgcagcccu

SEQ ID NO: 1797931 - RNA, 15 nt, Human
aacgcugauuuaaag

SEQ ID NO: 1797932 - RNA, 14 nt, Human
aacugauaaagaug

SEQ ID NO: 1797933 - RNA, 16 nt, Human
aacugagugccuuuug

SEQ ID NO: 1797934 - RNA, 18 nt, Human
aacuuaaucuaaauggaa

SEQ ID NO: 1797935 - RNA, 16 nt, Human
aacuuaaucuaaaugg

SEQ ID NO: 1797936 - RNA, 15 nt, Human
aacuuaaucuaaaug

SEQ ID NO: 1797937 - RNA, 20 nt, Human
aacuuuaugcuaagugaaau

SEQ ID NO: 1797938 - RNA, 21 nt, Human
aacuuuaugcuaagugaaaua

SEQ ID NO: 1797939 - RNA, 19 nt, Human
aaauaguggugugauuugg

SEQ ID NO: 1797940 - RNA, 24 nt, Human
aaauagcucaggugucccugcacu

SEQ ID NO: 1797941 - RNA, 19 nt, Human
aaaucaaugcuauaacuau

SEQ ID NO: 1797942 - RNA, 16 nt, Human
aaauaaaacuuuuuaa

SEQ ID NO: 1797943 - RNA, 13 nt, Human
aaauaaaacuuuu

SEQ ID NO: 1797944 - RNA, 19 nt, Human
aaauaaaacuuuuuaaaau

SEQ ID NO: 1797945 - RNA, 13 nt, Human
aaaguggaaaaau

SEQ ID NO: 1797946 - RNA, 19 nt, Human
aaaggcuccaggagcagcc

SEQ ID NO: 1797947 - RNA, 20 nt, Human
aaaggcuccaggagcagcca

SEQ ID NO: 1797948 - RNA, 14 nt, Human
aaaggcagaagcaa

SEQ ID NO: 1797949 - RNA, 21 nt, Human
aaaggccuaauucuaugccug

SEQ ID NO: 1797950 - RNA, 15 nt, Human
aaaggcuccaggagc

SEQ ID NO: 1797951 - RNA, 16 nt, Human
aaaggcuccaggagca

SEQ ID NO: 1797952 - RNA, 22 nt, Human
aaagcccuuccaugucgccucu

SEQ ID NO: 1797953 - RNA, 23 nt, Human
aaagcccuuccaugucgccucug

SEQ ID NO: 1797954 - RNA, 16 nt, Human
aaagccuccuccagcc

SEQ ID NO: 1797955 - RNA, 19 nt, Human
aaagcccuuaggaagaauu

SEQ ID NO: 1797956 - RNA, 18 nt, Human
aaaccccuguaggccuca

SEQ ID NO: 1797957 - RNA, 16 nt, Human
aaacccuauugguaaa

SEQ ID NO: 1797958 - RNA, 13 nt, Human
aaacccucgaggc

SEQ ID NO: 1797959 - RNA, 24 nt, Human
aaacccucgaggcggaucuuugga

SEQ ID NO: 1797960 - RNA, 18 nt, Human
aaacucuccucugcugcu

SEQ ID NO: 1797961 - RNA, 18 nt, Human
aaaccaucauugaaaucu

SEQ ID NO: 1797962 - RNA, 15 nt, Human
aaagaaauauaccua

SEQ ID NO: 1797963 - RNA, 17 nt, Human
aaagaaauauaccuaaa

SEQ ID NO: 1797964 - RNA, 20 nt, Human
aaagaagguuucagaaagaa

SEQ ID NO: 1797965 - RNA, 14 nt, Human
aaagaguaggaaga

SEQ ID NO: 1797966 - RNA, 16 nt, Human
aaagauauuuugcuuu

SEQ ID NO: 1797967 - RNA, 12 nt, Human
aaagauauuuug

SEQ ID NO: 1797968 - RNA, 20 nt, Human
aaagauauuuugcuuuguga

SEQ ID NO: 1797969 - RNA, 17 nt, Human
aaagauauuuugcuuug

SEQ ID NO: 1797970 - RNA, 21 nt, Human
aaaauugaugggauuugguca

SEQ ID NO: 1797971 - RNA, 22 nt, Human
aaaaucucaaauuucuaaaucu

SEQ ID NO: 1797972 - RNA, 19 nt, Human
aaaaucucaaauuucuaaa

SEQ ID NO: 1797973 - RNA, 16 nt, Human
aaacacuguucucugc

SEQ ID NO: 1797974 - RNA, 22 nt, Human
aaacacugggagaaaugaaaaa

SEQ ID NO: 1797975 - RNA, 21 nt, Human
aaacacugggagaaaugaaaa

SEQ ID NO: 1797976 - RNA, 15 nt, Human
aaaaagaaaggaggg

SEQ ID NO: 1797977 - RNA, 21 nt, Human
aaaaucuacacuccagugaga

SEQ ID NO: 1797978 - RNA, 22 nt, Human
aaaaucccuuaccucggugccu

SEQ ID NO: 1797979 - RNA, 19 nt, Human
aaaauaaaauuaaagcuga

SEQ ID NO: 1797980 - RNA, 17 nt, Human
aaaauaaaacuuuuuaa

SEQ ID NO: 1797981 - RNA, 18 nt, Human
aaaaguucugcagauaaa

SEQ ID NO: 1797982 - RNA, 22 nt, Human
acccccugcaaagcccagcuug

SEQ ID NO: 1797983 - RNA, 18 nt, Human
acccccugcaaagcccag

SEQ ID NO: 1797984 - RNA, 20 nt, Human
acccccugcaaagcccagcu

SEQ ID NO: 1797985 - RNA, 14 nt, Human
acccccugcaaagc

SEQ ID NO: 1797986 - RNA, 17 nt, Human
acccccugcaaagccca

SEQ ID NO: 1797987 - RNA, 11 nt, Human
acccccugaau

SEQ ID NO: 1797988 - RNA, 16 nt, Human
acccaccucagccucc

SEQ ID NO: 1797989 - RNA, 15 nt, Human
acccaccucagccuc

SEQ ID NO: 1797990 - RNA, 14 nt, Human
acccaccucagccu

SEQ ID NO: 1797991 - RNA, 13 nt, Human
acccaccucagcc

SEQ ID NO: 1797992 - RNA, 23 nt, Human
acccaagggccuggccugagcug

SEQ ID NO: 1797993 - RNA, 17 nt, Human
acccacaagaaaugaaa

SEQ ID NO: 1797994 - RNA, 21 nt, Human
acccacaagaaaugaaagcag

SEQ ID NO: 1797995 - RNA, 20 nt, Human
accauauuaccacagacaua

SEQ ID NO: 1797996 - RNA, 18 nt, Human
acccaagggccuggccug

SEQ ID NO: 1797997 - RNA, 19 nt, Human
acccaagggccuggccuga

SEQ ID NO: 1797998 - RNA, 22 nt, Human
acccaagggccuggccugagcu

SEQ ID NO: 1797999 - RNA, 16 nt, Human
accauauuaccacaga

SEQ ID NO: 1798000 - RNA, 14 nt, Human
accauauuaccaca

SEQ ID NO: 1798001 - RNA, 19 nt, Human
accccuccaugugggcuag

SEQ ID NO: 1798002 - RNA, 16 nt, Human
accccuccaugugggc

SEQ ID NO: 1798003 - RNA, 17 nt, Human
accccucauagcccuca

SEQ ID NO: 1798004 - RNA, 18 nt, Human
acaugugcacaugcacgu

SEQ ID NO: 1798005 - RNA, 16 nt, Human
acaugugcacaugcac

SEQ ID NO: 1798006 - RNA, 19 nt, Human
acaugaucuucuuuauaau

SEQ ID NO: 1798007 - RNA, 19 nt, Human
acaucagcacgauuucugu

SEQ ID NO: 1798008 - RNA, 18 nt, Human
acaucagcacgauuucug

SEQ ID NO: 1798009 - RNA, 17 nt, Human
acaucagcacgauuucu

SEQ ID NO: 1798010 - RNA, 15 nt, Human
acaucagcacgauuu

SEQ ID NO: 1798011 - RNA, 23 nt, Human
acauguuucuuuguaaugaaaac

SEQ ID NO: 1798012 - RNA, 19 nt, Human
acauguuucuuuguaauga

SEQ ID NO: 1798013 - RNA, 22 nt, Human
acauguuucuuuguaaugaaaa

SEQ ID NO: 1798014 - RNA, 19 nt, Human
acaggguuuugccauguug

SEQ ID NO: 1798015 - RNA, 23 nt, Human
acaggcaaugcuggcuguuggcu

SEQ ID NO: 1798016 - RNA, 19 nt, Human
acaggcaaugcuggcuguu

SEQ ID NO: 1798017 - RNA, 21 nt, Human
acauaaugcgugcauaccacu

SEQ ID NO: 1798018 - RNA, 22 nt, Human
acauaaugcgugcauaccacuu

SEQ ID NO: 1798019 - RNA, 23 nt, Human
acauaaugcgugcauaccacuuu

SEQ ID NO: 1798020 - RNA, 15 nt, Human
acauuuauucugcuc

SEQ ID NO: 1798021 - RNA, 19 nt, Human
acauuuguucuauagcuuu

SEQ ID NO: 1798022 - RNA, 12 nt, Human
accaagcccagu

SEQ ID NO: 1798023 - RNA, 14 nt, Human
accaauauuguaca

SEQ ID NO: 1798024 - RNA, 13 nt, Human
accagaucauugu

SEQ ID NO: 1798025 - RNA, 19 nt, Human
accagagcugccaccugcc

SEQ ID NO: 1798026 - RNA, 13 nt, Human
accagcagaaaug

SEQ ID NO: 1798027 - RNA, 15 nt, Human
accagcccagacccu

SEQ ID NO: 1798028 - RNA, 17 nt, Human
accagccaguaaauggg

SEQ ID NO: 1798029 - RNA, 17 nt, Human
acaaggauugcuacugu

SEQ ID NO: 1798030 - RNA, 13 nt, Human
acaagaaaugaaa

SEQ ID NO: 1798031 - RNA, 12 nt, Human
acaaggcaaggc

SEQ ID NO: 1798032 - RNA, 14 nt, Human
acaaggcaaggcug

SEQ ID NO: 1798033 - RNA, 22 nt, Human
acaaaauguaggguuauaauaa

SEQ ID NO: 1798034 - RNA, 15 nt, Human
acaaggcaaggcugu

SEQ ID NO: 1798035 - RNA, 22 nt, Human
aauuuuguguaagaaauacaga

SEQ ID NO: 1798036 - RNA, 18 nt, Human
aauuuuguguaagaaaua

SEQ ID NO: 1798037 - RNA, 17 nt, Human
aauuuuguguaagaaau

SEQ ID NO: 1798038 - RNA, 15 nt, Human
aauuuuguguaagaa

SEQ ID NO: 1798039 - RNA, 14 nt, Human
aauuuuguguaaga

SEQ ID NO: 1798040 - RNA, 18 nt, Human
aauuuuguaauguaucaa

SEQ ID NO: 1798041 - RNA, 17 nt, Human
acacgcgugcacacacc

SEQ ID NO: 1798042 - RNA, 15 nt, Human
acacgcgugcacaca

SEQ ID NO: 1798043 - RNA, 16 nt, Human
acacgcuccuuccucu

SEQ ID NO: 1798044 - RNA, 14 nt, Human
acacgcuccuuccu

SEQ ID NO: 1798045 - RNA, 13 nt, Human
acacagcucuucu

SEQ ID NO: 1798046 - RNA, 11 nt, Human
acacagcucuu

SEQ ID NO: 1798047 - RNA, 22 nt, Human
acacauuuuauuuuauuaugca

SEQ ID NO: 1798048 - RNA, 21 nt, Human
acacauuuuauuuuauuaugc

SEQ ID NO: 1798049 - RNA, 22 nt, Human
acacauuuuuuaaaugcaccug

SEQ ID NO: 1798050 - RNA, 20 nt, Human
acacauuuuuuaaaugcacc

SEQ ID NO: 1798051 - RNA, 14 nt, Human
acacauuuuucaga

SEQ ID NO: 1798052 - RNA, 12 nt, Human
acacauuuuucu

SEQ ID NO: 1798053 - RNA, 19 nt, Human
acacagaggcugccucucc

SEQ ID NO: 1798054 - RNA, 20 nt, Human
acacagcucuguccugggag

SEQ ID NO: 1798055 - RNA, 17 nt, Human
acacagauuugagcuca

SEQ ID NO: 1798056 - RNA, 19 nt, Human
acagagugagacucugucu

SEQ ID NO: 1798057 - RNA, 15 nt, Human
acagagugagacucu

SEQ ID NO: 1798058 - RNA, 14 nt, Human
acagaggggguggc

SEQ ID NO: 1798059 - RNA, 19 nt, Human
acagccaacuauggccugu

SEQ ID NO: 1798060 - RNA, 17 nt, Human
acagccaacuauggccu

SEQ ID NO: 1798061 - RNA, 15 nt, Human
acagaggcagcccca

SEQ ID NO: 1798062 - RNA, 14 nt, Human
acagaggcagcccc

SEQ ID NO: 1798063 - RNA, 14 nt, Human
acagacacaggccc

SEQ ID NO: 1798064 - RNA, 13 nt, Human
acagacacaggcc

SEQ ID NO: 1798065 - RNA, 23 nt, Human
acagaggcagccccauucugccu

SEQ ID NO: 1798066 - RNA, 19 nt, Human
acagaggcagccccauucu

SEQ ID NO: 1798067 - RNA, 15 nt, Human
acagacacaggcccg

SEQ ID NO: 1798068 - RNA, 11 nt, Human
acagacacagg

SEQ ID NO: 1798069 - RNA, 13 nt, Human
acagacaaagcgu

SEQ ID NO: 1798070 - RNA, 15 nt, Human
acacuguacugcaau

SEQ ID NO: 1798071 - RNA, 15 nt, Human
acacugcauguuugu

SEQ ID NO: 1798072 - RNA, 14 nt, Human
acacugcauguuug

SEQ ID NO: 1798073 - RNA, 17 nt, Human
acagccacggccaggcc

SEQ ID NO: 1798074 - RNA, 16 nt, Human
acagccacggccaggc

SEQ ID NO: 1798075 - RNA, 15 nt, Human
acagccacggccagg

SEQ ID NO: 1798076 - RNA, 18 nt, Human
acagccacggccaggcca

SEQ ID NO: 1798077 - RNA, 18 nt, Human
acagcucuucuccaggcu

SEQ ID NO: 1798078 - RNA, 15 nt, Human
acaggaucagucuga

SEQ ID NO: 1798079 - RNA, 17 nt, Human
acagcucuucuccaggc

SEQ ID NO: 1798080 - RNA, 16 nt, Human
acagcucuucuccagg

SEQ ID NO: 1798081 - RNA, 12 nt, Human
acaggcaagcac

SEQ ID NO: 1798082 - RNA, 18 nt, Human
acaggcaaugcuggcugu

SEQ ID NO: 1798083 - RNA, 21 nt, Human
acaggaugaugacuauggaaa

SEQ ID NO: 1798084 - RNA, 19 nt, Human
acucaguccauagcagaga

SEQ ID NO: 1798085 - RNA, 18 nt, Human
acuauuuuucagaaucuc

SEQ ID NO: 1798086 - RNA, 13 nt, Human
acucaaaagcugg

SEQ ID NO: 1798087 - RNA, 18 nt, Human
acucaaaagcugggcagg

SEQ ID NO: 1798088 - RNA, 19 nt, Human
acucugucgcccagucugg

SEQ ID NO: 1798089 - RNA, 23 nt, Human
acucuaucaaguauuauaccuuu

SEQ ID NO: 1798090 - RNA, 17 nt, Human
acucuauguucuaagaa

SEQ ID NO: 1798091 - RNA, 15 nt, Human
acucuagggaaaaac

SEQ ID NO: 1798092 - RNA, 17 nt, Human
acucuagggaaaaacca

SEQ ID NO: 1798093 - RNA, 15 nt, Human
acgucugacaggcaa

SEQ ID NO: 1798094 - RNA, 14 nt, Human
acgucugacaggca

SEQ ID NO: 1798095 - RNA, 13 nt, Human
acgucugacaggc

SEQ ID NO: 1798096 - RNA, 11 nt, Human
acgcugugcug

SEQ ID NO: 1798097 - RNA, 12 nt, Human
acgcugugcugc

SEQ ID NO: 1798098 - RNA, 14 nt, Human
acgcugugcugccc

SEQ ID NO: 1798099 - RNA, 11 nt, Human
acgugaguccu

SEQ ID NO: 1798100 - RNA, 18 nt, Human
accuuggcugcagggagu

SEQ ID NO: 1798101 - RNA, 17 nt, Human
accuuggcugcagggag

SEQ ID NO: 1798102 - RNA, 13 nt, Human
accuuucccaucu

SEQ ID NO: 1798103 - RNA, 18 nt, Human
accuuucccaucuuccaa

SEQ ID NO: 1798104 - RNA, 15 nt, Human
accuuuaagagaaau

SEQ ID NO: 1798105 - RNA, 16 nt, Human
accugucccccugaca

SEQ ID NO: 1798106 - RNA, 12 nt, Human
accugucccccu

SEQ ID NO: 1798107 - RNA, 15 nt, Human
accugucccccugac

SEQ ID NO: 1798108 - RNA, 20 nt, Human
accugcccugcugaguccca

SEQ ID NO: 1798109 - RNA, 15 nt, Human
accucugcagcaaua

SEQ ID NO: 1798110 - RNA, 20 nt, Human
accucugcagcaauaaagca

SEQ ID NO: 1798111 - RNA, 18 nt, Human
accucugcagcaauaaag

SEQ ID NO: 1798112 - RNA, 21 nt, Human
accucugcagcaauaaagcag

SEQ ID NO: 1798113 - RNA, 16 nt, Human
agaaaggauaaaguug

SEQ ID NO: 1798114 - RNA, 22 nt, Human
agaaaguacuucuccacccugc

SEQ ID NO: 1798115 - RNA, 23 nt, Human
agaaaguacuucuccacccugcu

SEQ ID NO: 1798116 - RNA, 22 nt, Human
acuuuauuuucuauaauuuaaa

SEQ ID NO: 1798117 - RNA, 16 nt, Human
acuuuguucuggcucu

SEQ ID NO: 1798118 - RNA, 17 nt, Human
acuuuguucuggcucuu

SEQ ID NO: 1798119 - RNA, 22 nt, Human
acuuuaucuugaauaauguaag

SEQ ID NO: 1798120 - RNA, 20 nt, Human
acuuuguucuggcucuucca

SEQ ID NO: 1798121 - RNA, 19 nt, Human
acuuuguucuggcucuucc

SEQ ID NO: 1798122 - RNA, 12 nt, Human
acuuuuaugaua

SEQ ID NO: 1798123 - RNA, 16 nt, Human
acuuuuaugauacuug

SEQ ID NO: 1798124 - RNA, 13 nt, Human
acuuuuauaaacu

SEQ ID NO: 1798125 - RNA, 16 nt, Human
agaaaaucaggcuggc

SEQ ID NO: 1798126 - RNA, 19 nt, Human
agaaaauaguggugugauu

SEQ ID NO: 1798127 - RNA, 15 nt, Human
agaaaauaccaagga

SEQ ID NO: 1798128 - RNA, 14 nt, Human
acuuuucuuugugg

SEQ ID NO: 1798129 - RNA, 20 nt, Human
acuuuucauaaccuagccuu

SEQ ID NO: 1798130 - RNA, 23 nt, Human
acuuuuaugauacuugaaaauua

SEQ ID NO: 1798131 - RNA, 23 nt, Human
acuuuuauuuccagugaaaucag

SEQ ID NO: 1798132 - RNA, 16 nt, Human
acuuuucuuucagcca

SEQ ID NO: 1798133 - RNA, 18 nt, Human
acuuguaaaggaauuuaa

SEQ ID NO: 1798134 - RNA, 16 nt, Human
acuugguuuuuaaaaa

SEQ ID NO: 1798135 - RNA, 14 nt, Human
acuugggccacugu

SEQ ID NO: 1798136 - RNA, 15 nt, Human
acuugggccacugug

SEQ ID NO: 1798137 - RNA, 12 nt, Human
acuucagacaua

SEQ ID NO: 1798138 - RNA, 22 nt, Human
acugugcugagucugaaggcug

SEQ ID NO: 1798139 - RNA, 20 nt, Human
acugugcugagucugaaggc

SEQ ID NO: 1798140 - RNA, 18 nt, Human
acugguuccauggccucu

SEQ ID NO: 1798141 - RNA, 20 nt, Human
acugucucaagagggcacug

SEQ ID NO: 1798142 - RNA, 21 nt, Human
acugucucaagagggcacugg

SEQ ID NO: 1798143 - RNA, 23 nt, Human
acugucucaagagggcacuggug

SEQ ID NO: 1798144 - RNA, 17 nt, Human
acuggaagcacagcuuc

SEQ ID NO: 1798145 - RNA, 16 nt, Human
acugcccccucugccc

SEQ ID NO: 1798146 - RNA, 17 nt, Human
acugcccccucugcccu

SEQ ID NO: 1798147 - RNA, 19 nt, Human
acuggaagcacagcuucau

SEQ ID NO: 1798148 - RNA, 14 nt, Human
acugcccccucugc

SEQ ID NO: 1798149 - RNA, 15 nt, Human
acugcccccucugcc

SEQ ID NO: 1798150 - RNA, 18 nt, Human
acugguaggaaacuaggu

SEQ ID NO: 1798151 - RNA, 15 nt, Human
acuggagaaaaugga

SEQ ID NO: 1798152 - RNA, 20 nt, Human
acucugucucaguccaugaa

SEQ ID NO: 1798153 - RNA, 18 nt, Human
acucugucucaguccaug

SEQ ID NO: 1798154 - RNA, 15 nt, Human
aaaaaauauuuuccu

SEQ ID NO: 1798155 - RNA, 18 nt, Human
aaaaacagauuuggaaag

SEQ ID NO: 1798156 - RNA, 20 nt, Human
auuucuugagguaaaagcau

SEQ ID NO: 1798157 - RNA, 16 nt, Human
auuugaaaauuuugau

SEQ ID NO: 1798158 - RNA, 18 nt, Human
auuugaaacacuuugcau

SEQ ID NO: 1798159 - RNA, 20 nt, Human
auuucuuccacaagagccca

SEQ ID NO: 1798160 - RNA, 23 nt, Human
auuucuuccacaagagcccaggc

SEQ ID NO: 1798161 - RNA, 12 nt, Human
auuuauuuaaau

SEQ ID NO: 1798162 - RNA, 14 nt, Human
auuuauuuaaauuu

SEQ ID NO: 1798163 - RNA, 19 nt, Human
auuucccaacacaaagauu

SEQ ID NO: 1798164 - RNA, 22 nt, Human
auuuccacucaggucuguuuuc

SEQ ID NO: 1798165 - RNA, 18 nt, Human
auuucccaacacaaagau

SEQ ID NO: 1798166 - RNA, 16 nt, Human
auuuccacucaggucu

SEQ ID NO: 1798167 - RNA, 19 nt, Human
auuucccaaagcagugcau

SEQ ID NO: 1798168 - RNA, 13 nt, Human
auuugucaacaaa

SEQ ID NO: 1798169 - RNA, 15 nt, Human
auuugucaacaaagu

SEQ ID NO: 1798170 - RNA, 18 nt, Human
auuugugaagguggaaau

SEQ ID NO: 1798171 - RNA, 21 nt, Human
auuugugaagguggaaauaaa

SEQ ID NO: 1798172 - RNA, 23 nt, Human
auuugugaaaugauggugaaagu

SEQ ID NO: 1798173 - RNA, 22 nt, Human
auuuuaaaaauacagauagaua

SEQ ID NO: 1798174 - RNA, 19 nt, Human
auuggacaguaaaauccac

SEQ ID NO: 1798175 - RNA, 21 nt, Human
auugauuuccguuaaaauacc

SEQ ID NO: 1798176 - RNA, 16 nt, Human
auuggauuugucuuug

SEQ ID NO: 1798177 - RNA, 18 nt, Human
auugguaaagaauggaag

SEQ ID NO: 1798178 - RNA, 21 nt, Human
auuguuuggggaugagaaagg

SEQ ID NO: 1798179 - RNA, 13 nt, Human
auuuaaaagauac

SEQ ID NO: 1798180 - RNA, 17 nt, Human
auuuaaaagauacaguu

SEQ ID NO: 1798181 - RNA, 16 nt, Human
auuuaaaagauacagu

SEQ ID NO: 1798182 - RNA, 14 nt, Human
auuuaaaagauaca

SEQ ID NO: 1798183 - RNA, 21 nt, Human
auuguacaguuuuuauugcuu

SEQ ID NO: 1798184 - RNA, 15 nt, Human
auuguacaguuuuua

SEQ ID NO: 1798185 - RNA, 14 nt, Human
auuguacaguuuuu

SEQ ID NO: 1798186 - RNA, 23 nt, Human
auugucaaaguggugagaggcau

SEQ ID NO: 1798187 - RNA, 16 nt, Human
auugucaaagugguga

SEQ ID NO: 1798188 - RNA, 14 nt, Human
auugugggaagggg

SEQ ID NO: 1798189 - RNA, 13 nt, Human
auugugggaaggg

SEQ ID NO: 1798190 - RNA, 14 nt, Human
auuuucuauaauuu

SEQ ID NO: 1798191 - RNA, 15 nt, Human
auuuucuauaauuua

SEQ ID NO: 1798192 - RNA, 16 nt, Human
auuuuccugccaggca

SEQ ID NO: 1798193 - RNA, 19 nt, Human
auuuucccuauuagagaag

SEQ ID NO: 1798194 - RNA, 15 nt, Human
auuuuaauaaacacu

SEQ ID NO: 1798195 - RNA, 16 nt, Human
auuuuaauaaacacuc

SEQ ID NO: 1798196 - RNA, 17 nt, Human
auuuuaauaaacacucu

SEQ ID NO: 1798197 - RNA, 19 nt, Human
auuuugauccaagcugguc

SEQ ID NO: 1798198 - RNA, 19 nt, Human
auuuuccuguugucaagaa

SEQ ID NO: 1798199 - RNA, 17 nt, Human
auuuugauguuuuaagg

SEQ ID NO: 1798200 - RNA, 18 nt, Human
auuuugauguaaagaugu

SEQ ID NO: 1798201 - RNA, 17 nt, Human
auuuugauguaaagaug

SEQ ID NO: 1798202 - RNA, 15 nt, Human
auuuugauguuuuaa

SEQ ID NO: 1798203 - RNA, 18 nt, Human
auuuugccagugggaacu

SEQ ID NO: 1798204 - RNA, 21 nt, Human
auuuugcugucccuuuuccuu

SEQ ID NO: 1798205 - RNA, 20 nt, Human
auuuugcuaaaugugaauga

SEQ ID NO: 1798206 - RNA, 17 nt, Human
auuuuguguuuaggaac

SEQ ID NO: 1798207 - RNA, 23 nt, Human
auuuugucauauaagauucauau

SEQ ID NO: 1798208 - RNA, 12 nt, Human
auuuugucuuua

SEQ ID NO: 1798209 - RNA, 19 nt, Human
auuuugugcccccauguaa

SEQ ID NO: 1798210 - RNA, 20 nt, Human
auuuuguguaagaaauacag

SEQ ID NO: 1798211 - RNA, 18 nt, Human
auuuuguguaagaaauac

SEQ ID NO: 1798212 - RNA, 17 nt, Human
auuuuguguaagaaaua

SEQ ID NO: 1798213 - RNA, 16 nt, Human
auuuuguguaagaaau

SEQ ID NO: 1798214 - RNA, 18 nt, Human
auuuuguauauuuguauu

SEQ ID NO: 1798215 - RNA, 23 nt, Human
auuuuguaauguaucaaauacau

SEQ ID NO: 1798216 - RNA, 20 nt, Human
auuuuguaauguaucaaaua

SEQ ID NO: 1798217 - RNA, 22 nt, Human
auuuuguaauaauaaagaauag

SEQ ID NO: 1798218 - RNA, 19 nt, Human
auuuuguaauaauaaagaa

SEQ ID NO: 1798219 - RNA, 14 nt, Human
auuuuguaauaaua

SEQ ID NO: 1798220 - RNA, 20 nt, Human
auuuugcuuugugauuuuug

SEQ ID NO: 1798221 - RNA, 18 nt, Human
auuuugcuuugugauuuu

SEQ ID NO: 1798222 - RNA, 20 nt, Human
auuuugcuguagaagauggc

SEQ ID NO: 1798223 - RNA, 12 nt, Human
auuuugcuuugu

SEQ ID NO: 1798224 - RNA, 14 nt, Human
auuuuggaaaauaa

SEQ ID NO: 1798225 - RNA, 19 nt, Human
auuuuggaaaauaaauuau

SEQ ID NO: 1798226 - RNA, 20 nt, Human
auuuuggaaaauaaauuauu

SEQ ID NO: 1798227 - RNA, 22 nt, Human
auuuuugugauuuugugauuga

SEQ ID NO: 1798228 - RNA, 14 nt, Human
auuuuugucuugug

SEQ ID NO: 1798229 - RNA, 19 nt, Human
auuuuuguagagccagggu

SEQ ID NO: 1798230 - RNA, 12 nt, Human
auuuuuguaauu

SEQ ID NO: 1798231 - RNA, 18 nt, Human
auuuuuuaaauugaauuc

SEQ ID NO: 1798232 - RNA, 14 nt, Human
auuuuuuaaaugca

SEQ ID NO: 1798233 - RNA, 13 nt, Human
auuuuuuaaaugc

SEQ ID NO: 1798234 - RNA, 18 nt, Human
auuuuuuguuaaaugauu

SEQ ID NO: 1798235 - RNA, 21 nt, Human
auuuuuuaagugaaaauauag

SEQ ID NO: 1798236 - RNA, 19 nt, Human
auuuuuuacagcugccugc

SEQ ID NO: 1798237 - RNA, 21 nt, Human
auuuuguuuuugucuuaaaaa

SEQ ID NO: 1798238 - RNA, 21 nt, Human
auuuuucuuagggaaggauac

SEQ ID NO: 1798239 - RNA, 16 nt, Human
auuuuucagauauaaa

SEQ ID NO: 1798240 - RNA, 22 nt, Human
auuuuucuuagggaaggauaca

SEQ ID NO: 1798241 - RNA, 15 nt, Human
auuauauuuacaaau

SEQ ID NO: 1798242 - RNA, 14 nt, Human
auuauauuaugaag

SEQ ID NO: 1798243 - RNA, 19 nt, Human
auuauacccccugcaaagc

SEQ ID NO: 1798244 - RNA, 11 nt, Human
uuuguggaaaa

SEQ ID NO: 1798245 - RNA, 19 nt, Human
auucagacagcugccuggg

SEQ ID NO: 1798246 - RNA, 15 nt, Human
auuauuauuuggccc

SEQ ID NO: 1798247 - RNA, 18 nt, Human
auuaucuagauacuguau

SEQ ID NO: 1798248 - RNA, 14 nt, Human
auuaucuagauacu

SEQ ID NO: 1798249 - RNA, 19 nt, Human
auuaucuaaaaucugcuag

SEQ ID NO: 1798250 - RNA, 11 nt, Human
auucagacagc

SEQ ID NO: 1798251 - RNA, 12 nt, Human
auucagacagcu

SEQ ID NO: 1798252 - RNA, 13 nt, Human
auucagacagcug

SEQ ID NO: 1798253 - RNA, 13 nt, Human
auucacauuguau

SEQ ID NO: 1798254 - RNA, 20 nt, Human
auucacauuguauucagagu

SEQ ID NO: 1798255 - RNA, 18 nt, Human
auucagacagcugccugg

SEQ ID NO: 1798256 - RNA, 22 nt, Human
auucaggaagcagcuuucccca

SEQ ID NO: 1798257 - RNA, 12 nt, Human
auucaggaagcu

SEQ ID NO: 1798258 - RNA, 14 nt, Human
auucagacagcugc

SEQ ID NO: 1798259 - RNA, 15 nt, Human
auucagacagcugcc

SEQ ID NO: 1798260 - RNA, 16 nt, Human
auucagacagcugccu

SEQ ID NO: 1798261 - RNA, 17 nt, Human
auucagacagcugccug

SEQ ID NO: 1798262 - RNA, 23 nt, Human
auuccccgucucugguuccuccc

SEQ ID NO: 1798263 - RNA, 22 nt, Human
auuccccacccugaaagcccug

SEQ ID NO: 1798264 - RNA, 19 nt, Human
auuccagagcguguaguga

SEQ ID NO: 1798265 - RNA, 21 nt, Human
auuccagagaguggcuccucc

SEQ ID NO: 1798266 - RNA, 19 nt, Human
auuccagagaguggcuccu

SEQ ID NO: 1798267 - RNA, 13 nt, Human
auucaggaagcuc

SEQ ID NO: 1798268 - RNA, 14 nt, Human
auucuguuggccag

SEQ ID NO: 1798269 - RNA, 21 nt, Human
auucuguuggccagugugaca

SEQ ID NO: 1798270 - RNA, 19 nt, Human
auucuguuggccaguguga

SEQ ID NO: 1798271 - RNA, 22 nt, Human
auucugcucacauaucugucau

SEQ ID NO: 1798272 - RNA, 21 nt, Human
auucugcucacauaucuguca

SEQ ID NO: 1798273 - RNA, 20 nt, Human
auucugcucacauaucuguc

SEQ ID NO: 1798274 - RNA, 19 nt, Human
auucugcucacauaucugu

SEQ ID NO: 1798275 - RNA, 21 nt, Human
auucugccugcccaggccccu

SEQ ID NO: 1798276 - RNA, 20 nt, Human
auucugccugcccaggcccc

SEQ ID NO: 1798277 - RNA, 18 nt, Human
auucugcucacauaucug

SEQ ID NO: 1798278 - RNA, 21 nt, Human
auucucaugccucagccuccu

SEQ ID NO: 1798279 - RNA, 15 nt, Human
auucuagcuuugagc

SEQ ID NO: 1798280 - RNA, 17 nt, Human
auucucauuugucacac

SEQ ID NO: 1798281 - RNA, 22 nt, Human
auucucaugccucagccuccug

SEQ ID NO: 1798282 - RNA, 19 nt, Human
auucugccugcccaggccc

SEQ ID NO: 1798283 - RNA, 18 nt, Human
auucugccugcccaggcc

SEQ ID NO: 1798284 - RNA, 17 nt, Human
auucugccugcccaggc

SEQ ID NO: 1798285 - RNA, 16 nt, Human
auucugccugcccagg

SEQ ID NO: 1798286 - RNA, 15 nt, Human
auucugccugcccag

SEQ ID NO: 1798287 - RNA, 14 nt, Human
auucugccugccca

SEQ ID NO: 1798288 - RNA, 13 nt, Human
auucugccugccc

SEQ ID NO: 1798289 - RNA, 11 nt, Human
auucugccugc

SEQ ID NO: 1798290 - RNA, 17 nt, Human
auugacacuuaaaaaug

SEQ ID NO: 1798291 - RNA, 15 nt, Human
auugacacuuaaaaa

SEQ ID NO: 1798292 - RNA, 11 nt, Human
auugacuucuu

SEQ ID NO: 1798293 - RNA, 18 nt, Human
auugacacaguaccauuu

SEQ ID NO: 1798294 - RNA, 19 nt, Human
auugacacuuaaaaauggu

SEQ ID NO: 1798295 - RNA, 15 nt, Human
auugaaaaaccauuu

SEQ ID NO: 1798296 - RNA, 20 nt, Human
auugaaaucuuuuugcuuug

SEQ ID NO: 1798297 - RNA, 17 nt, Human
auugaaaucuuuuugcu

SEQ ID NO: 1798298 - RNA, 18 nt, Human
auugaaaucuuuuugcuu

SEQ ID NO: 1798299 - RNA, 13 nt, Human
auucuuccucccu

SEQ ID NO: 1798300 - RNA, 14 nt, Human
auucuuaaauaugu

SEQ ID NO: 1798301 - RNA, 20 nt, Human
augggcuggguucuacccag

SEQ ID NO: 1798302 - RNA, 18 nt, Human
augggccuccugugugug

SEQ ID NO: 1798303 - RNA, 17 nt, Human
augggggcacugaggac

SEQ ID NO: 1798304 - RNA, 14 nt, Human
augggggugcauuu

SEQ ID NO: 1798305 - RNA, 24 nt, Human
auggggcugcaccggcuggccugg

SEQ ID NO: 1798306 - RNA, 12 nt, Human
auggggcugcac

SEQ ID NO: 1798307 - RNA, 15 nt, Human
augggggugcauuug

SEQ ID NO: 1798308 - RNA, 15 nt, Human
augggauccuggagu

SEQ ID NO: 1798309 - RNA, 18 nt, Human
augggcaacccccagccu

SEQ ID NO: 1798310 - RNA, 19 nt, Human
uuucuggcuaugcauuuga

SEQ ID NO: 1798311 - RNA, 18 nt, Human
uuucuggcuaugcauuug

SEQ ID NO: 1798312 - RNA, 16 nt, Human
uuucuggcuaugcauu

SEQ ID NO: 1798313 - RNA, 15 nt, Human
uuucuggcuaugcau

SEQ ID NO: 1798314 - RNA, 19 nt, Human
uuucugcagccacuauugu

SEQ ID NO: 1798315 - RNA, 14 nt, Human
uuucugcagaaaca

SEQ ID NO: 1798316 - RNA, 23 nt, Human
uuucugggcaccggggccucgga

SEQ ID NO: 1798317 - RNA, 21 nt, Human
uuucugcagccacuauuguua

SEQ ID NO: 1798318 - RNA, 17 nt, Human
augguggcuggguugga

SEQ ID NO: 1798319 - RNA, 15 nt, Human
augguggcuggguug

SEQ ID NO: 1798320 - RNA, 13 nt, Human
augguggcugggu

SEQ ID NO: 1798321 - RNA, 12 nt, Human
augguggcuggg

SEQ ID NO: 1798322 - RNA, 16 nt, Human
auggugaugaaaugua

SEQ ID NO: 1798323 - RNA, 17 nt, Human
auggugaugaaauguaa

SEQ ID NO: 1798324 - RNA, 14 nt, Human
auggugaugaaaug

SEQ ID NO: 1798325 - RNA, 15 nt, Human
augggugcuuggagg

SEQ ID NO: 1798326 - RNA, 20 nt, Human
auggugagggauacccaucc

SEQ ID NO: 1798327 - RNA, 12 nt, Human
auggugcaauga

SEQ ID NO: 1798328 - RNA, 13 nt, Human
auggugcaaugac

SEQ ID NO: 1798329 - RNA, 15 nt, Human
auggugcaaugaccu

SEQ ID NO: 1798330 - RNA, 19 nt, Human
auggugcaaugaccuuuca

SEQ ID NO: 1798331 - RNA, 16 nt, Human
auggugcaaugaccuu

SEQ ID NO: 1798332 - RNA, 17 nt, Human
auggugcaaugaccuuu

SEQ ID NO: 1798333 - RNA, 17 nt, Human
auguaaaagacuuuuuu

SEQ ID NO: 1798334 - RNA, 13 nt, Human
augguuguacaua

SEQ ID NO: 1798335 - RNA, 19 nt, Human
augguuccccuguucacuc

SEQ ID NO: 1798336 - RNA, 20 nt, Human
augguuccccuguucacucu

SEQ ID NO: 1798337 - RNA, 16 nt, Human
augguuuucaaaauaa

SEQ ID NO: 1798338 - RNA, 14 nt, Human
augguuuucuugug

SEQ ID NO: 1798339 - RNA, 14 nt, Human
augguuuucaaaau

SEQ ID NO: 1798340 - RNA, 15 nt, Human
augguuuucaaaaua

SEQ ID NO: 1798341 - RNA, 13 nt, Human
auguagaggagaa

SEQ ID NO: 1798342 - RNA, 12 nt, Human
auguagaggaga

SEQ ID NO: 1798343 - RNA, 19 nt, Human
auguagaggagaaacugga

SEQ ID NO: 1798344 - RNA, 17 nt, Human
auguagaggagaaacug

SEQ ID NO: 1798345 - RNA, 19 nt, Human
auguagccccucuccugga

SEQ ID NO: 1798346 - RNA, 12 nt, Human
uuugaccucugc

SEQ ID NO: 1798347 - RNA, 15 nt, Human
uuugccguuauuaaa

SEQ ID NO: 1798348 - RNA, 22 nt, Human
uuugauucagacagcugccugg

SEQ ID NO: 1798349 - RNA, 13 nt, Human
uuugccucugccu

SEQ ID NO: 1798350 - RNA, 20 nt, Human
uuugauguaaagauguucug

SEQ ID NO: 1798351 - RNA, 20 nt, Human
uuugacgccaucccagcccc

SEQ ID NO: 1798352 - RNA, 13 nt, Human
uuugacgccaucc

SEQ ID NO: 1798353 - RNA, 14 nt, Human
uuugacgccauccc

SEQ ID NO: 1798354 - RNA, 16 nt, Human
uuugacgccaucccag

SEQ ID NO: 1798355 - RNA, 19 nt, Human
uuugacgccaucccagccc

SEQ ID NO: 1798356 - RNA, 23 nt, Human
uuugauuaaauucuugcaaagua

SEQ ID NO: 1798357 - RNA, 21 nt, Human
uuugauucagacagcugccug

SEQ ID NO: 1798358 - RNA, 21 nt, Human
uuugauuaaauucuugcaaag

SEQ ID NO: 1798359 - RNA, 18 nt, Human
uuugauuaaauucuugca

SEQ ID NO: 1798360 - RNA, 13 nt, Human
uuugauuaaauuc

SEQ ID NO: 1798361 - RNA, 22 nt, Human
uuugauguucuuucacccuuuu

SEQ ID NO: 1798362 - RNA, 19 nt, Human
auguaugaggaauuucugu

SEQ ID NO: 1798363 - RNA, 18 nt, Human
auguaugagguacaaccu

SEQ ID NO: 1798364 - RNA, 15 nt, Human
auguauguguaagua

SEQ ID NO: 1798365 - RNA, 16 nt, Human
auguauguguaaguau

SEQ ID NO: 1798366 - RNA, 12 nt, Human
augucaguguga

SEQ ID NO: 1798367 - RNA, 13 nt, Human
augucagugugac

SEQ ID NO: 1798368 - RNA, 17 nt, Human
auguccacugguucuuc

SEQ ID NO: 1798369 - RNA, 19 nt, Human
augucucgugguaggacug

SEQ ID NO: 1798370 - RNA, 17 nt, Human
augucucugagcauuag

SEQ ID NO: 1798371 - RNA, 16 nt, Human
augucucgugguagga

SEQ ID NO: 1798372 - RNA, 15 nt, Human
augucucgugguagg

SEQ ID NO: 1798373 - RNA, 13 nt, Human
augucgccucugc

SEQ ID NO: 1798374 - RNA, 14 nt, Human
augucgccucugca

SEQ ID NO: 1798375 - RNA, 17 nt, Human
augucucaggucccugc

SEQ ID NO: 1798376 - RNA, 22 nt, Human
augucucaggucccugcagggc

SEQ ID NO: 1798377 - RNA, 15 nt, Human
augucgccucugcau

SEQ ID NO: 1798378 - RNA, 20 nt, Human
uuugugaagguggaaauaaa

SEQ ID NO: 1798379 - RNA, 19 nt, Human
uuugucuuuggugaacauu

SEQ ID NO: 1798380 - RNA, 21 nt, Human
uuugucuuguguuucuuuagu

SEQ ID NO: 1798381 - RNA, 22 nt, Human
uuugugaaaugauggugaaagu

SEQ ID NO: 1798382 - RNA, 21 nt, Human
uuuguaauaauaaagaauagc

SEQ ID NO: 1798383 - RNA, 13 nt, Human
uuuguaaugaaaa

SEQ ID NO: 1798384 - RNA, 14 nt, Human
uuuguaaugaaaac

SEQ ID NO: 1798385 - RNA, 12 nt, Human
uuuguauaaaag

SEQ ID NO: 1798386 - RNA, 23 nt, Human
augugcacaugcacgugugugca

SEQ ID NO: 1798387 - RNA, 19 nt, Human
uuuguaauaauaaagaaua

SEQ ID NO: 1798388 - RNA, 23 nt, Human
augucucuuuaaugucacaggca

SEQ ID NO: 1798389 - RNA, 16 nt, Human
augugaugagaggaaa

SEQ ID NO: 1798390 - RNA, 17 nt, Human
augugaugagaggaaau

SEQ ID NO: 1798391 - RNA, 19 nt, Human
augugaugagaggaaauca

SEQ ID NO: 1798392 - RNA, 18 nt, Human
uuuaaauauaugcuaagu

SEQ ID NO: 1798393 - RNA, 12 nt, Human
uuuaauucaguu

SEQ ID NO: 1798394 - RNA, 19 nt, Human
uuuaauuuuuuugagacag

SEQ ID NO: 1798395 - RNA, 16 nt, Human
uuuaauuugaaauaug

SEQ ID NO: 1798396 - RNA, 17 nt, Human
augcagcaucuaaguaa

SEQ ID NO: 1798397 - RNA, 18 nt, Human
augcagccucacaguccu

SEQ ID NO: 1798398 - RNA, 23 nt, Human
augcagugguaugaucacggcuc

SEQ ID NO: 1798399 - RNA, 13 nt, Human
augcagugcuucc

SEQ ID NO: 1798400 - RNA, 16 nt, Human
augccucagccuccug

SEQ ID NO: 1798401 - RNA, 14 nt, Human
augcccuggaucca

SEQ ID NO: 1798402 - RNA, 12 nt, Human
augcccagcccc

SEQ ID NO: 1798403 - RNA, 13 nt, Human
augcccagccccu

SEQ ID NO: 1798404 - RNA, 14 nt, Human
augcccagccccuu

SEQ ID NO: 1798405 - RNA, 15 nt, Human
augcccagccccuuc

SEQ ID NO: 1798406 - RNA, 20 nt, Human
augcgugcauaccacuuuug

SEQ ID NO: 1798407 - RNA, 13 nt, Human
uuguguucaccuu

SEQ ID NO: 1798408 - RNA, 21 nt, Human
uuguuccacaaguuaaauaaa

SEQ ID NO: 1798409 - RNA, 20 nt, Human
uuguguuacuaaguuuuuau

SEQ ID NO: 1798410 - RNA, 15 nt, Human
uuguguuacuaaguu

SEQ ID NO: 1798411 - RNA, 13 nt, Human
uuguguuacuaag

SEQ ID NO: 1798412 - RNA, 23 nt, Human
augauaugcuuguaacuaaaaua

SEQ ID NO: 1798413 - RNA, 17 nt, Human
augauaugcuuguaacu

SEQ ID NO: 1798414 - RNA, 21 nt, Human
augauacuugaaaauuaacau

SEQ ID NO: 1798415 - RNA, 17 nt, Human
augauacuugaaaauua

SEQ ID NO: 1798416 - RNA, 17 nt, Human
augaucuaggaagacuu

SEQ ID NO: 1798417 - RNA, 20 nt, Human
augaucuaggaagacuuugg

SEQ ID NO: 1798418 - RNA, 13 nt, Human
uuuaaagaaugcu

SEQ ID NO: 1798419 - RNA, 22 nt, Human
augcaccagcccuuagcaggga

SEQ ID NO: 1798420 - RNA, 13 nt, Human
augcaccuggaau

SEQ ID NO: 1798421 - RNA, 17 nt, Human
augcacuuuguucuggc

SEQ ID NO: 1798422 - RNA, 19 nt, Human
augcacuuuguucuggcuc

SEQ ID NO: 1798423 - RNA, 20 nt, Human
augcacuuuguucuggcucu

SEQ ID NO: 1798424 - RNA, 15 nt, Human
augcaaccauuugaa

SEQ ID NO: 1798425 - RNA, 22 nt, Human
augcuagaacucccuuucaaca

SEQ ID NO: 1798426 - RNA, 21 nt, Human
augcuagaacucccuuucaac

SEQ ID NO: 1798427 - RNA, 20 nt, Human
augcuagaacucccuuucaa

SEQ ID NO: 1798428 - RNA, 17 nt, Human
uuuaucaugugaaauca

SEQ ID NO: 1798429 - RNA, 18 nt, Human
uuuaucaugugaaaucau

SEQ ID NO: 1798430 - RNA, 16 nt, Human
augcuaagacucagug

SEQ ID NO: 1798431 - RNA, 16 nt, Human
uuuauuuuguguuuag

SEQ ID NO: 1798432 - RNA, 20 nt, Human
uuuauuuuguguuuaggaac

SEQ ID NO: 1798433 - RNA, 22 nt, Human
uuucaaacuuuacuauggcccu

SEQ ID NO: 1798434 - RNA, 16 nt, Human
uuucaaacuuuacuau

SEQ ID NO: 1798435 - RNA, 22 nt, Human
uuucaaaauuguuacaaauugu

SEQ ID NO: 1798436 - RNA, 22 nt, Human
augcugugcccuaaaguguauu

SEQ ID NO: 1798437 - RNA, 13 nt, Human
augcuucucacug

SEQ ID NO: 1798438 - RNA, 17 nt, Human
uuuccaugaguccccug

SEQ ID NO: 1798439 - RNA, 18 nt, Human
uuuccaugaguccccugu

SEQ ID NO: 1798440 - RNA, 19 nt, Human
auggacuaacuugucuuug

SEQ ID NO: 1798441 - RNA, 11 nt, Human
auggacuuugu

SEQ ID NO: 1798442 - RNA, 12 nt, Human
auggacuuuguu

SEQ ID NO: 1798443 - RNA, 19 nt, Human
augggagagaagagaaugc

SEQ ID NO: 1798444 - RNA, 15 nt, Human
augggagagaagaga

SEQ ID NO: 1798445 - RNA, 18 nt, Human
auggcuaauguacugcau

SEQ ID NO: 1798446 - RNA, 19 nt, Human
auggcuaagcaaaauguga

SEQ ID NO: 1798447 - RNA, 18 nt, Human
auggagacugucucaaga

SEQ ID NO: 1798448 - RNA, 16 nt, Human
auccacccaccucagc

SEQ ID NO: 1798449 - RNA, 16 nt, Human
auccaguaucuugaag

SEQ ID NO: 1798450 - RNA, 15 nt, Human
auccacccaccucag

SEQ ID NO: 1798451 - RNA, 13 nt, Human
auccacccaccuc

SEQ ID NO: 1798452 - RNA, 21 nt, Human
auccaagcuggucccacucag

SEQ ID NO: 1798453 - RNA, 18 nt, Human
auccaagcuggucccacu

SEQ ID NO: 1798454 - RNA, 20 nt, Human
aucauuuuaccuuugacaaa

SEQ ID NO: 1798455 - RNA, 13 nt, Human
auccaucaggcca

SEQ ID NO: 1798456 - RNA, 21 nt, Human
auccaguaucuugaagacuuu

SEQ ID NO: 1798457 - RNA, 18 nt, Human
aucccauaugccugggca

SEQ ID NO: 1798458 - RNA, 19 nt, Human
aucccaaacccuucagugc

SEQ ID NO: 1798459 - RNA, 20 nt, Human
aucccaaacccuucagugcc

SEQ ID NO: 1798460 - RNA, 14 nt, Human
aucaggugcugcca

SEQ ID NO: 1798461 - RNA, 18 nt, Human
aucaguagccagcaucug

SEQ ID NO: 1798462 - RNA, 21 nt, Human
uucuccuuguguuacuaaguu

SEQ ID NO: 1798463 - RNA, 20 nt, Human
uucucuaguuugauuaaauu

SEQ ID NO: 1798464 - RNA, 17 nt, Human
uucucuaguuugauuaa

SEQ ID NO: 1798465 - RNA, 15 nt, Human
uucucuaguuugauu

SEQ ID NO: 1798466 - RNA, 17 nt, Human
uucuccuuucacaaccu

SEQ ID NO: 1798467 - RNA, 16 nt, Human
uucuggcucuuccagg

SEQ ID NO: 1798468 - RNA, 17 nt, Human
uucuggcucuuccaggc

SEQ ID NO: 1798469 - RNA, 18 nt, Human
uucugccugcccaggccc

SEQ ID NO: 1798470 - RNA, 17 nt, Human
uucugccugcccaggcc

SEQ ID NO: 1798471 - RNA, 21 nt, Human
uucugccugcccaggccccug

SEQ ID NO: 1798472 - RNA, 15 nt, Human
uucugccauauucug

SEQ ID NO: 1798473 - RNA, 23 nt, Human
uucugaacuuggcgcugccccug

SEQ ID NO: 1798474 - RNA, 19 nt, Human
uucugaacuuggcgcugcc

SEQ ID NO: 1798475 - RNA, 22 nt, Human
uucugaacuuggcgcugccccu

SEQ ID NO: 1798476 - RNA, 17 nt, Human
uugaaauuguauuacaa

SEQ ID NO: 1798477 - RNA, 19 nt, Human
uugaacccgggaggcagag

SEQ ID NO: 1798478 - RNA, 21 nt, Human
auccuaagcuauucaguaaua

SEQ ID NO: 1798479 - RNA, 18 nt, Human
auccuacaagacacagug

SEQ ID NO: 1798480 - RNA, 19 nt, Human
auccuacaagacacaguga

SEQ ID NO: 1798481 - RNA, 12 nt, Human
auccuaagcuau

SEQ ID NO: 1798482 - RNA, 16 nt, Human
auccuccucagaucuu

SEQ ID NO: 1798483 - RNA, 16 nt, Human
auccuaggcauuugcu

SEQ ID NO: 1798484 - RNA, 13 nt, Human
aucccucauccuc

SEQ ID NO: 1798485 - RNA, 21 nt, Human
aucccucauccucauacccac

SEQ ID NO: 1798486 - RNA, 23 nt, Human
aucccucauccucauacccaccc

SEQ ID NO: 1798487 - RNA, 13 nt, Human
aucccaugagccu

SEQ ID NO: 1798488 - RNA, 14 nt, Human
aucccucauccuca

SEQ ID NO: 1798489 - RNA, 24 nt, Human
aucccauaugccugggcagaagga

SEQ ID NO: 1798490 - RNA, 15 nt, Human
uucuucugcuucagc

SEQ ID NO: 1798491 - RNA, 13 nt, Human
uucuucugcuuca

SEQ ID NO: 1798492 - RNA, 14 nt, Human
uucuucucccucag

SEQ ID NO: 1798493 - RNA, 23 nt, Human
uucuuaagacgugauuuugcugu

SEQ ID NO: 1798494 - RNA, 21 nt, Human
uucuuaagacgugauuuugcu

SEQ ID NO: 1798495 - RNA, 13 nt, Human
uucuucucccuca

SEQ ID NO: 1798496 - RNA, 20 nt, Human
uucuucugcuucagccuccc

SEQ ID NO: 1798497 - RNA, 21 nt, Human
uucuucuuuuugcuucaaaaa

SEQ ID NO: 1798498 - RNA, 17 nt, Human
uucuucuuuuugcuuca

SEQ ID NO: 1798499 - RNA, 15 nt, Human
uucuuuguaaugaaa

SEQ ID NO: 1798500 - RNA, 16 nt, Human
uucuuuguaaugaaaa

SEQ ID NO: 1798501 - RNA, 14 nt, Human
uucuuuuuuuguga

SEQ ID NO: 1798502 - RNA, 19 nt, Human
uuccguagguuauuuucag

SEQ ID NO: 1798503 - RNA, 16 nt, Human
uuccguuaaaauacca

SEQ ID NO: 1798504 - RNA, 14 nt, Human
uuccguuaaaauac

SEQ ID NO: 1798505 - RNA, 23 nt, Human
uucccguggaacguuuuuccugu

SEQ ID NO: 1798506 - RNA, 15 nt, Human
uucccuauuagagaa

SEQ ID NO: 1798507 - RNA, 20 nt, Human
uucccucaccuuucccaucu

SEQ ID NO: 1798508 - RNA, 16 nt, Human
uucccgcucagcccuc

SEQ ID NO: 1798509 - RNA, 18 nt, Human
uucccgcucagcccuccc

SEQ ID NO: 1798510 - RNA, 21 nt, Human
uucccgcucagcccucccugc

SEQ ID NO: 1798511 - RNA, 22 nt, Human
uucccgcucagcccucccugcc

SEQ ID NO: 1798512 - RNA, 20 nt, Human
uuccuaaauauauuuuaaga

SEQ ID NO: 1798513 - RNA, 16 nt, Human
uuccuaauuccacagc

SEQ ID NO: 1798514 - RNA, 17 nt, Human
uuccuaauuccacagcu

SEQ ID NO: 1798515 - RNA, 18 nt, Human
uuccuaauuccacagcug

SEQ ID NO: 1798516 - RNA, 14 nt, Human
uuccucugagccuu

SEQ ID NO: 1798517 - RNA, 17 nt, Human
uuccucugagccuuggg

SEQ ID NO: 1798518 - RNA, 21 nt, Human
uuccucugaggcugaaauuca

SEQ ID NO: 1798519 - RNA, 14 nt, Human
uuccugaaccgaug

SEQ ID NO: 1798520 - RNA, 18 nt, Human
uuccugaagaauugaaaa

SEQ ID NO: 1798521 - RNA, 13 nt, Human
uuccucuuuccau

SEQ ID NO: 1798522 - RNA, 17 nt, Human
uuccucuuuccaucuac

SEQ ID NO: 1798523 - RNA, 22 nt, Human
uuccucuuuccaucuacccucc

SEQ ID NO: 1798524 - RNA, 11 nt, Human
uuccugugucu

SEQ ID NO: 1798525 - RNA, 14 nt, Human
aucaacagauaaau

SEQ ID NO: 1798526 - RNA, 18 nt, Human
auauuuuuuguuaaauga

SEQ ID NO: 1798527 - RNA, 20 nt, Human
auauuuuuuguuaaaugauu

SEQ ID NO: 1798528 - RNA, 14 nt, Human
aucaaugaguaaca

SEQ ID NO: 1798529 - RNA, 15 nt, Human
aucacggcucacugc

SEQ ID NO: 1798530 - RNA, 14 nt, Human
aucacgccacugca

SEQ ID NO: 1798531 - RNA, 13 nt, Human
aucacgccacugc

SEQ ID NO: 1798532 - RNA, 19 nt, Human
aucacggcucacugcagcc

SEQ ID NO: 1798533 - RNA, 18 nt, Human
aucacggcucacugcagc

SEQ ID NO: 1798534 - RNA, 20 nt, Human
aucaggccaggcccucugcc

SEQ ID NO: 1798535 - RNA, 12 nt, Human
aucagaauucuc

SEQ ID NO: 1798536 - RNA, 13 nt, Human
aucagcacgauuu

SEQ ID NO: 1798537 - RNA, 15 nt, Human
aucaggccaggcccu

SEQ ID NO: 1798538 - RNA, 16 nt, Human
aucaggccaggcccuc

SEQ ID NO: 1798539 - RNA, 18 nt, Human
aucaggccaggcccucug

SEQ ID NO: 1798540 - RNA, 16 nt, Human
uucucacuccuaccug

SEQ ID NO: 1798541 - RNA, 18 nt, Human
uucucacuccuaccuggu

SEQ ID NO: 1798542 - RNA, 18 nt, Human
aucagaaguuucucagcu

SEQ ID NO: 1798543 - RNA, 11 nt, Human
aucagaauucu

SEQ ID NO: 1798544 - RNA, 14 nt, Human
uucggccuccaucc

SEQ ID NO: 1798545 - RNA, 19 nt, Human
uucgcuccugugucuugca

SEQ ID NO: 1798546 - RNA, 15 nt, Human
uucgcuccugugucu

SEQ ID NO: 1798547 - RNA, 13 nt, Human
uucuaaaguaaaa

SEQ ID NO: 1798548 - RNA, 21 nt, Human
uucuaaaucuccaaaauaaaa

SEQ ID NO: 1798549 - RNA, 21 nt, Human
uucuaaaggcuaccuuuguau

SEQ ID NO: 1798550 - RNA, 20 nt, Human
uucuaaaggcuaccuuugua

SEQ ID NO: 1798551 - RNA, 19 nt, Human
uucuaaaggcuaccuuugu

SEQ ID NO: 1798552 - RNA, 15 nt, Human
uucggccuccauccu

SEQ ID NO: 1798553 - RNA, 16 nt, Human
uucuagcauggcugcc

SEQ ID NO: 1798554 - RNA, 13 nt, Human
uucuaagaaguga

SEQ ID NO: 1798555 - RNA, 23 nt, Human
uucuaagaagugaaaaucuacac

SEQ ID NO: 1798556 - RNA, 15 nt, Human
aucucccccagcccc

SEQ ID NO: 1798557 - RNA, 16 nt, Human
aucucccccagcccca

SEQ ID NO: 1798558 - RNA, 17 nt, Human
aucucccccagccccau

SEQ ID NO: 1798559 - RNA, 21 nt, Human
aucucccccagccccauccuc

SEQ ID NO: 1798560 - RNA, 21 nt, Human
aucucuucuggguuccuuccu

SEQ ID NO: 1798561 - RNA, 16 nt, Human
aucugaaaauguaugu

SEQ ID NO: 1798562 - RNA, 19 nt, Human
aucugaaaauguaugugua

SEQ ID NO: 1798563 - RNA, 20 nt, Human
aucugaaaauguauguguaa

SEQ ID NO: 1798564 - RNA, 22 nt, Human
aucugaaaauguauguguaagu

SEQ ID NO: 1798565 - RNA, 18 nt, Human
aucucuugagccugggag

SEQ ID NO: 1798566 - RNA, 14 nt, Human
aucugaaaauguau

SEQ ID NO: 1798567 - RNA, 15 nt, Human
aucucuugagccugg

SEQ ID NO: 1798568 - RNA, 14 nt, Human
aucuccaaaauaaa

SEQ ID NO: 1798569 - RNA, 21 nt, Human
aucuccaaaauaaaacuuuuu

SEQ ID NO: 1798570 - RNA, 20 nt, Human
aucuccaaaauaaaacuuuu

SEQ ID NO: 1798571 - RNA, 17 nt, Human
aucuccaaaauaaaacu

SEQ ID NO: 1798572 - RNA, 16 nt, Human
aucucagggccugguc

SEQ ID NO: 1798573 - RNA, 19 nt, Human
uugcaauggcagccuuggc

SEQ ID NO: 1798574 - RNA, 17 nt, Human
uugcaauggcagccuug

SEQ ID NO: 1798575 - RNA, 16 nt, Human
uugcaauggcagccuu

SEQ ID NO: 1798576 - RNA, 15 nt, Human
uugcaccacugcacu

SEQ ID NO: 1798577 - RNA, 16 nt, Human
uugcaccacugcacuc

SEQ ID NO: 1798578 - RNA, 18 nt, Human
uugcaccacugcacucca

SEQ ID NO: 1798579 - RNA, 14 nt, Human
uugauuaaagauga

SEQ ID NO: 1798580 - RNA, 14 nt, Human
uugauuaaauucuu

SEQ ID NO: 1798581 - RNA, 23 nt, Human
uugauguuuuaaggaugcuugua

SEQ ID NO: 1798582 - RNA, 13 nt, Human
uugauuaaagaug

SEQ ID NO: 1798583 - RNA, 13 nt, Human
uugauuaaauucu

SEQ ID NO: 1798584 - RNA, 23 nt, Human
aucugaaaauguauguguaagua

SEQ ID NO: 1798585 - RNA, 17 nt, Human
uugaagggaaauuucag

SEQ ID NO: 1798586 - RNA, 13 nt, Human
uugaagccuuugu

SEQ ID NO: 1798587 - RNA, 13 nt, Human
uugaaucacagua

SEQ ID NO: 1798588 - RNA, 16 nt, Human
auccucuguacagagc

SEQ ID NO: 1798589 - RNA, 17 nt, Human
auccucuguacagagcc

SEQ ID NO: 1798590 - RNA, 14 nt, Human
aucguucucugccu

SEQ ID NO: 1798591 - RNA, 13 nt, Human
aucuaaauggaac

SEQ ID NO: 1798592 - RNA, 18 nt, Human
aucuaaauggaaccacuc

SEQ ID NO: 1798593 - RNA, 17 nt, Human
aucuaaauggaaccacu

SEQ ID NO: 1798594 - RNA, 20 nt, Human
aucuaauauguaacaagcca

SEQ ID NO: 1798595 - RNA, 18 nt, Human
aucuacacuccagugaga

SEQ ID NO: 1798596 - RNA, 19 nt, Human
aucuacacuccagugagac

SEQ ID NO: 1798597 - RNA, 18 nt, Human
aucuaauauguaacaagc

SEQ ID NO: 1798598 - RNA, 15 nt, Human
uugauacuacaguuu

SEQ ID NO: 1798599 - RNA, 20 nt, Human
uugaguugauucagcucugc

SEQ ID NO: 1798600 - RNA, 20 nt, Human
uugagugaagcugggagaac

SEQ ID NO: 1798601 - RNA, 16 nt, Human
uugagauguguucaca

SEQ ID NO: 1798602 - RNA, 15 nt, Human
uugagaucagccugg

SEQ ID NO: 1798603 - RNA, 16 nt, Human
uugagaucagccuggg

SEQ ID NO: 1798604 - RNA, 12 nt, Human
uugagacagagu

SEQ ID NO: 1798605 - RNA, 19 nt, Human
augaaagggcccagagagg

SEQ ID NO: 1798606 - RNA, 18 nt, Human
augaacuuguaaaggaau

SEQ ID NO: 1798607 - RNA, 16 nt, Human
augaauauuuaguguu

SEQ ID NO: 1798608 - RNA, 11 nt, Human
augaagaggag

SEQ ID NO: 1798609 - RNA, 18 nt, Human
uuggggaccagagcugcc

SEQ ID NO: 1798610 - RNA, 21 nt, Human
augaauauuuaguguucauaa

SEQ ID NO: 1798611 - RNA, 23 nt, Human
augaauggcuaagcaaaauguga

SEQ ID NO: 1798612 - RNA, 18 nt, Human
uuggccccugcccggcug

SEQ ID NO: 1798613 - RNA, 16 nt, Human
uuggagggugucccaa

SEQ ID NO: 1798614 - RNA, 14 nt, Human
uugcuugaaagaaa

SEQ ID NO: 1798615 - RNA, 11 nt, Human
uuggagacaga

SEQ ID NO: 1798616 - RNA, 18 nt, Human
augaaagggcccagagag

SEQ ID NO: 1798617 - RNA, 17 nt, Human
aucuuugcagacaggca

SEQ ID NO: 1798618 - RNA, 18 nt, Human
aucuuugcagacaggcaa

SEQ ID NO: 1798619 - RNA, 22 nt, Human
aucuuuucauuuaggugaggaa

SEQ ID NO: 1798620 - RNA, 12 nt, Human
uugcuccuugac

SEQ ID NO: 1798621 - RNA, 14 nt, Human
aucuuauaauuuaa

SEQ ID NO: 1798622 - RNA, 13 nt, Human
aucuugcucugcu

SEQ ID NO: 1798623 - RNA, 20 nt, Human
aucuuggucagauuugaacu

SEQ ID NO: 1798624 - RNA, 23 nt, Human
aucugugaaaggaaagagggagg

SEQ ID NO: 1798625 - RNA, 18 nt, Human
aucugugaaaggaaagag

SEQ ID NO: 1798626 - RNA, 20 nt, Human
aucugcuagggaauaucaau

SEQ ID NO: 1798627 - RNA, 10 nt, Human
aucuggugac

SEQ ID NO: 1798628 - RNA, 16 nt, Human
aucuggugacuuuccu

SEQ ID NO: 1798629 - RNA, 17 nt, Human
aucuggugacuuuccuc

SEQ ID NO: 1798630 - RNA, 17 nt, Human
aucugugaaaggaaaga

SEQ ID NO: 1798631 - RNA, 13 nt, Human
uuaguagagacag

SEQ ID NO: 1798632 - RNA, 19 nt, Human
uuaguacuccccuccuuga

SEQ ID NO: 1798633 - RNA, 14 nt, Human
uuaguagagacagg

SEQ ID NO: 1798634 - RNA, 18 nt, Human
uuaguuuuugugaaguuu

SEQ ID NO: 1798635 - RNA, 21 nt, Human
uuaguuuuugugaaguuuaau

SEQ ID NO: 1798636 - RNA, 15 nt, Human
uuauaaaaauaaaaa

SEQ ID NO: 1798637 - RNA, 13 nt, Human
uuauaaacuuuac

SEQ ID NO: 1798638 - RNA, 21 nt, Human
uuauaaaaauaaaaaacacug

SEQ ID NO: 1798639 - RNA, 22 nt, Human
uuauaaaaauaaaaaacacugg

SEQ ID NO: 1798640 - RNA, 19 nt, Human
uuagauuaagaaauagaca

SEQ ID NO: 1798641 - RNA, 15 nt, Human
uuagauuaagaaaua

SEQ ID NO: 1798642 - RNA, 19 nt, Human
uuaggugugggggaagcac

SEQ ID NO: 1798643 - RNA, 15 nt, Human
uuaggugaggaagca

SEQ ID NO: 1798644 - RNA, 14 nt, Human
uuaguaaucauauu

SEQ ID NO: 1798645 - RNA, 13 nt, Human
uuaguaaucauau

SEQ ID NO: 1798646 - RNA, 18 nt, Human
uuagguuggcaaaaaggc

SEQ ID NO: 1798647 - RNA, 14 nt, Human
auaagccagacauc

SEQ ID NO: 1798648 - RNA, 21 nt, Human
auaagauucauauuuacuucu

SEQ ID NO: 1798649 - RNA, 22 nt, Human
auaagccaaaaaaugcuugcuu

SEQ ID NO: 1798650 - RNA, 22 nt, Human
auaaucuggacuccucugucca

SEQ ID NO: 1798651 - RNA, 23 nt, Human
auaauucacauuguauucagagu

SEQ ID NO: 1798652 - RNA, 20 nt, Human
auaauucaggaagcagcuuu

SEQ ID NO: 1798653 - RNA, 14 nt, Human
auaauuuuaaaugu

SEQ ID NO: 1798654 - RNA, 12 nt, Human
auaauuuuaaau

SEQ ID NO: 1798655 - RNA, 13 nt, Human
auaauuuuaaaug

SEQ ID NO: 1798656 - RNA, 15 nt, Human
uuacugcagcuuugu

SEQ ID NO: 1798657 - RNA, 18 nt, Human
uuaccagugccuuaaacu

SEQ ID NO: 1798658 - RNA, 23 nt, Human
uuacuguacagacagaaaaaacu

SEQ ID NO: 1798659 - RNA, 12 nt, Human
uuacuguacaug

SEQ ID NO: 1798660 - RNA, 23 nt, Human
uuacuguacaugaaaacacauuu

SEQ ID NO: 1798661 - RNA, 22 nt, Human
uuacuguacaugaaaacacauu

SEQ ID NO: 1798662 - RNA, 14 nt, Human
uuacuguacaugaa

SEQ ID NO: 1798663 - RNA, 13 nt, Human
uuacuguacauga

SEQ ID NO: 1798664 - RNA, 18 nt, Human
auaacuuuuuuuuaaguu

SEQ ID NO: 1798665 - RNA, 14 nt, Human
auaagauucauauu

SEQ ID NO: 1798666 - RNA, 16 nt, Human
uuagaagucacacagu

SEQ ID NO: 1798667 - RNA, 18 nt, Human
auaaauugcuccuugaca

SEQ ID NO: 1798668 - RNA, 15 nt, Human
auaacuauguugaua

SEQ ID NO: 1798669 - RNA, 14 nt, Human
uuacaggugugaac

SEQ ID NO: 1798670 - RNA, 20 nt, Human
uuacagggaugagccaccgc

SEQ ID NO: 1798671 - RNA, 19 nt, Human
uuaccagcagagcaccuua

SEQ ID NO: 1798672 - RNA, 13 nt, Human
auaaauugcuccu

SEQ ID NO: 1798673 - RNA, 16 nt, Human
auaaauugcuccuuga

SEQ ID NO: 1798674 - RNA, 15 nt, Human
uuaaucuaaauggaa

SEQ ID NO: 1798675 - RNA, 16 nt, Human
uuaauaaaaguacaug

SEQ ID NO: 1798676 - RNA, 22 nt, Human
uuaagacgaaacauuuguucua

SEQ ID NO: 1798677 - RNA, 15 nt, Human
uuaauuugaaauaug

SEQ ID NO: 1798678 - RNA, 13 nt, Human
uuaauuugaaaua

SEQ ID NO: 1798679 - RNA, 13 nt, Human
uuaaucuuuaauu

SEQ ID NO: 1798680 - RNA, 17 nt, Human
uuaaucuuuaauuuuac

SEQ ID NO: 1798681 - RNA, 19 nt, Human
uuaagaaaaaggaugcaca

SEQ ID NO: 1798682 - RNA, 19 nt, Human
uuaagacgaaacauuuguu

SEQ ID NO: 1798683 - RNA, 23 nt, Human
uuaagacauuuuuggaaggggac

SEQ ID NO: 1798684 - RNA, 18 nt, Human
uuaagacauuuuuggaag

SEQ ID NO: 1798685 - RNA, 19 nt, Human
auaaaagccuguuuaagag

SEQ ID NO: 1798686 - RNA, 20 nt, Human
auaaaagccuguuuaagaga

SEQ ID NO: 1798687 - RNA, 22 nt, Human
auaaaagggacugagaaauuua

SEQ ID NO: 1798688 - RNA, 22 nt, Human
uuaacuuuuauaaacuuuaccu

SEQ ID NO: 1798689 - RNA, 23 nt, Human
uuaacuuuuauaaacuuuaccuu

SEQ ID NO: 1798690 - RNA, 15 nt, Human
aguuuuuuuuauaca

SEQ ID NO: 1798691 - RNA, 17 nt, Human
aguuuaaauuguaauag

SEQ ID NO: 1798692 - RNA, 20 nt, Human
aguuuaaauuguaauaggcg

SEQ ID NO: 1798693 - RNA, 20 nt, Human
uuaaaaaucucaaauuucua

SEQ ID NO: 1798694 - RNA, 19 nt, Human
uuaaaaaucucaaauuucu

SEQ ID NO: 1798695 - RNA, 12 nt, Human
uuaaaaugagaa

SEQ ID NO: 1798696 - RNA, 19 nt, Human
uuaaaaugagaaaucuaaa

SEQ ID NO: 1798697 - RNA, 14 nt, Human
aguuucucuuuuca

SEQ ID NO: 1798698 - RNA, 13 nt, Human
aguuucucagcuc

SEQ ID NO: 1798699 - RNA, 15 nt, Human
aguuucucagcuccc

SEQ ID NO: 1798700 - RNA, 15 nt, Human
aguuucugccgcagc

SEQ ID NO: 1798701 - RNA, 15 nt, Human
aguuuguugaaacac

SEQ ID NO: 1798702 - RNA, 22 nt, Human
aguuuguuaguaugaggcauuu

SEQ ID NO: 1798703 - RNA, 19 nt, Human
aguuucugccgcagcccug

SEQ ID NO: 1798704 - RNA, 16 nt, Human
uuaacagaaauguaca

SEQ ID NO: 1798705 - RNA, 14 nt, Human
uuaacagaaaugua

SEQ ID NO: 1798706 - RNA, 13 nt, Human
uuaacagaaaugu

SEQ ID NO: 1798707 - RNA, 12 nt, Human
uuaacagaaaug

SEQ ID NO: 1798708 - RNA, 16 nt, Human
auacagaggcaacugc

SEQ ID NO: 1798709 - RNA, 17 nt, Human
auacagaggcaacugca

SEQ ID NO: 1798710 - RNA, 22 nt, Human
uuauaaacuuuuuucuuacugu

SEQ ID NO: 1798711 - RNA, 12 nt, Human
uuauaaacuuuu

SEQ ID NO: 1798712 - RNA, 16 nt, Human
uuauaaacuuuuuucu

SEQ ID NO: 1798713 - RNA, 18 nt, Human
uuauaaacuuuaccuuuu

SEQ ID NO: 1798714 - RNA, 17 nt, Human
uuauaaacuuuaccuuu

SEQ ID NO: 1798715 - RNA, 20 nt, Human
auacaguuacucagaauucu

SEQ ID NO: 1798716 - RNA, 23 nt, Human
auacaggaaaagcugcugacagu

SEQ ID NO: 1798717 - RNA, 23 nt, Human
auacagauagauauaugcucugc

SEQ ID NO: 1798718 - RNA, 18 nt, Human
auacaguuacucagaauu

SEQ ID NO: 1798719 - RNA, 21 nt, Human
auacaggaugaugacuaugga

SEQ ID NO: 1798720 - RNA, 13 nt, Human
auacguacacauu

SEQ ID NO: 1798721 - RNA, 13 nt, Human
auacgauaaauaa

SEQ ID NO: 1798722 - RNA, 16 nt, Human
auacguacacauuuua

SEQ ID NO: 1798723 - RNA, 15 nt, Human
auacguacacauuuu

SEQ ID NO: 1798724 - RNA, 14 nt, Human
auacguacacauuu

SEQ ID NO: 1798725 - RNA, 14 nt, Human
auaccuuuuuuaga

SEQ ID NO: 1798726 - RNA, 17 nt, Human
auaccagccaguaaaug

SEQ ID NO: 1798727 - RNA, 18 nt, Human
auaccacuuuuguucuug

SEQ ID NO: 1798728 - RNA, 17 nt, Human
auaccacuuuuguucuu

SEQ ID NO: 1798729 - RNA, 20 nt, Human
auacuaaccagcagaaaugc

SEQ ID NO: 1798730 - RNA, 19 nt, Human
auacuaaccagcagaaaug

SEQ ID NO: 1798731 - RNA, 13 nt, Human
auacuaaccagca

SEQ ID NO: 1798732 - RNA, 22 nt, Human
uuaugggcuggguucuacccag

SEQ ID NO: 1798733 - RNA, 13 nt, Human
uuaugggcugggu

SEQ ID NO: 1798734 - RNA, 19 nt, Human
uuauggcuuuugugcauua

SEQ ID NO: 1798735 - RNA, 13 nt, Human
uuaugugaaacau

SEQ ID NO: 1798736 - RNA, 15 nt, Human
uuaugugaaacaugu

SEQ ID NO: 1798737 - RNA, 22 nt, Human
uuaugugccagauuuaugcaua

SEQ ID NO: 1798738 - RNA, 11 nt, Human
uuaugacucca

SEQ ID NO: 1798739 - RNA, 22 nt, Human
uuaugauagcaaauggccucau

SEQ ID NO: 1798740 - RNA, 20 nt, Human
uuaugauacuugaaaauuaa

SEQ ID NO: 1798741 - RNA, 20 nt, Human
uuaugaagcuuuuaugugaa

SEQ ID NO: 1798742 - RNA, 21 nt, Human
uuaucacccagaagaaaauag

SEQ ID NO: 1798743 - RNA, 19 nt, Human
uuaucacccagaagaaaau

SEQ ID NO: 1798744 - RNA, 18 nt, Human
uuaucacccagaagaaaa

SEQ ID NO: 1798745 - RNA, 17 nt, Human
uuaucacccagaagaaa

SEQ ID NO: 1798746 - RNA, 11 nt, Human
auacucccauc

SEQ ID NO: 1798747 - RNA, 16 nt, Human
auacucauuaggaugg

SEQ ID NO: 1798748 - RNA, 18 nt, Human
auacucuuauagacaaca

SEQ ID NO: 1798749 - RNA, 16 nt, Human
auacucugcuuagaau

SEQ ID NO: 1798750 - RNA, 17 nt, Human
auacuccuccaagguua

SEQ ID NO: 1798751 - RNA, 14 nt, Human
auacucccaucugu

SEQ ID NO: 1798752 - RNA, 12 nt, Human
uuauucauaauu

SEQ ID NO: 1798753 - RNA, 20 nt, Human
uuauucacuuuuauuuagca

SEQ ID NO: 1798754 - RNA, 13 nt, Human
uuauuaugcauga

SEQ ID NO: 1798755 - RNA, 14 nt, Human
uuauuauauuuaca

SEQ ID NO: 1798756 - RNA, 15 nt, Human
uuauuauauuuacaa

SEQ ID NO: 1798757 - RNA, 12 nt, Human
uuauuaugcaug

SEQ ID NO: 1798758 - RNA, 13 nt, Human
auagaaguaaaaa

SEQ ID NO: 1798759 - RNA, 13 nt, Human
auagaaaugcugg

SEQ ID NO: 1798760 - RNA, 19 nt, Human
auagaaaugcugguuuuuc

SEQ ID NO: 1798761 - RNA, 22 nt, Human
auagaaaugcugguuuuucagu

SEQ ID NO: 1798762 - RNA, 14 nt, Human
auagaauaaaauuu

SEQ ID NO: 1798763 - RNA, 19 nt, Human
auagaauaaaauuuuuaau

SEQ ID NO: 1798764 - RNA, 22 nt, Human
auagaauaaaauuuuuaaucuu

SEQ ID NO: 1798765 - RNA, 17 nt, Human
auagaauuaacacauga

SEQ ID NO: 1798766 - RNA, 15 nt, Human
auagacagcaugaga

SEQ ID NO: 1798767 - RNA, 23 nt, Human
auagacaauuuauuauggcacau

SEQ ID NO: 1798768 - RNA, 22 nt, Human
auagacaauuuauuauggcaca

SEQ ID NO: 1798769 - RNA, 16 nt, Human
auagacaauuuauuau

SEQ ID NO: 1798770 - RNA, 18 nt, Human
auagacccacaagaggca

SEQ ID NO: 1798771 - RNA, 14 nt, Human
auagagagagacca

SEQ ID NO: 1798772 - RNA, 18 nt, Human
auagauaggucagugcaa

SEQ ID NO: 1798773 - RNA, 17 nt, Human
agugcagugagccgaga

SEQ ID NO: 1798774 - RNA, 16 nt, Human
agugcaugcugucccu

SEQ ID NO: 1798775 - RNA, 14 nt, Human
agugcaugcugucc

SEQ ID NO: 1798776 - RNA, 14 nt, Human
agugccaaaaacaa

SEQ ID NO: 1798777 - RNA, 16 nt, Human
agugaggaugaaaaaa

SEQ ID NO: 1798778 - RNA, 12 nt, Human
agugaggcucug

SEQ ID NO: 1798779 - RNA, 13 nt, Human
agugaggcucugc

SEQ ID NO: 1798780 - RNA, 23 nt, Human
agugagcugguuuuuagcggaga

SEQ ID NO: 1798781 - RNA, 22 nt, Human
uguggauuuaacagaaauguac

SEQ ID NO: 1798782 - RNA, 20 nt, Human
uguggauuuaacagaaaugu

SEQ ID NO: 1798783 - RNA, 19 nt, Human
uguggauuuaacagaaaug

SEQ ID NO: 1798784 - RNA, 14 nt, Human
uguggaugauaaaa

SEQ ID NO: 1798785 - RNA, 21 nt, Human
uguggaucaaauccagccugc

SEQ ID NO: 1798786 - RNA, 18 nt, Human
ugugcugcccugcccacc

SEQ ID NO: 1798787 - RNA, 19 nt, Human
ugugcugcccugcccaccu

SEQ ID NO: 1798788 - RNA, 20 nt, Human
ugugcugcccugcccaccug

SEQ ID NO: 1798789 - RNA, 21 nt, Human
ugugcugcccugcccaccugg

SEQ ID NO: 1798790 - RNA, 12 nt, Human
ugugcucugauc

SEQ ID NO: 1798791 - RNA, 21 nt, Human
ugugcucaggagcccugggag

SEQ ID NO: 1798792 - RNA, 18 nt, Human
ugugcugagucugaaggc

SEQ ID NO: 1798793 - RNA, 19 nt, Human
ugugcugagucugaaggcu

SEQ ID NO: 1798794 - RNA, 12 nt, Human
ugugcugcccug

SEQ ID NO: 1798795 - RNA, 18 nt, Human
agucuuucacauuuaaau

SEQ ID NO: 1798796 - RNA, 21 nt, Human
agugaacaaauuuacagagac

SEQ ID NO: 1798797 - RNA, 16 nt, Human
agucuuucacauuuaa

SEQ ID NO: 1798798 - RNA, 21 nt, Human
agugacugauggcuaauguac

SEQ ID NO: 1798799 - RNA, 16 nt, Human
agugaacuugggccac

SEQ ID NO: 1798800 - RNA, 23 nt, Human
agugaacaaauuuacagagacag

SEQ ID NO: 1798801 - RNA, 22 nt, Human
agugaacaaauuuacagagaca

SEQ ID NO: 1798802 - RNA, 12 nt, Human
agugagcugguu

SEQ ID NO: 1798803 - RNA, 22 nt, Human
ugugaugaugaaaugaggucag

SEQ ID NO: 1798804 - RNA, 19 nt, Human
ugugaugagaggaaaucac

SEQ ID NO: 1798805 - RNA, 22 nt, Human
agugagcacuaaggugugcucu

SEQ ID NO: 1798806 - RNA, 14 nt, Human
agugagcacuaagg

SEQ ID NO: 1798807 - RNA, 11 nt, Human
ugugaggaagc

SEQ ID NO: 1798808 - RNA, 12 nt, Human
ugugaggaagcc

SEQ ID NO: 1798809 - RNA, 16 nt, Human
ugugacugaucucucg

SEQ ID NO: 1798810 - RNA, 18 nt, Human
ugugacuucagcucuguu

SEQ ID NO: 1798811 - RNA, 19 nt, Human
ugugacuucagcucuguuu

SEQ ID NO: 1798812 - RNA, 19 nt, Human
agucucgcucuguugccca

SEQ ID NO: 1798813 - RNA, 19 nt, Human
agucucuucuccacuggau

SEQ ID NO: 1798814 - RNA, 21 nt, Human
agucucuucuccacuggaugg

SEQ ID NO: 1798815 - RNA, 16 nt, Human
agucucuugauucaua

SEQ ID NO: 1798816 - RNA, 17 nt, Human
agucucuugauucauaa

SEQ ID NO: 1798817 - RNA, 12 nt, Human
agucugaaggcu

SEQ ID NO: 1798818 - RNA, 13 nt, Human
agucuuagaugua

SEQ ID NO: 1798819 - RNA, 14 nt, Human
agucuuagauguau

SEQ ID NO: 1798820 - RNA, 16 nt, Human
agucuuagauguauau

SEQ ID NO: 1798821 - RNA, 23 nt, Human
agucuuagauguauauauuuccu

SEQ ID NO: 1798822 - RNA, 18 nt, Human
agugguauagaaaugcug

SEQ ID NO: 1798823 - RNA, 16 nt, Human
agugguauagaaaugc

SEQ ID NO: 1798824 - RNA, 15 nt, Human
agugguauagaaaug

SEQ ID NO: 1798825 - RNA, 14 nt, Human
agugguauagaaau

SEQ ID NO: 1798826 - RNA, 20 nt, Human
agugugacugaucucucgug

SEQ ID NO: 1798827 - RNA, 21 nt, Human
agugugccugaagucccagau

SEQ ID NO: 1798828 - RNA, 19 nt, Human
uguuccacaaguuaaauaa

SEQ ID NO: 1798829 - RNA, 13 nt, Human
uguuaugacucca

SEQ ID NO: 1798830 - RNA, 17 nt, Human
uguuaugacuccagaau

SEQ ID NO: 1798831 - RNA, 22 nt, Human
agugugguguuuccuggcacug

SEQ ID NO: 1798832 - RNA, 20 nt, Human
uguugcccaggcuggcgugc

SEQ ID NO: 1798833 - RNA, 23 nt, Human
uguugcccaggcuggcgugcagu

SEQ ID NO: 1798834 - RNA, 15 nt, Human
uguugcauagaauaa

SEQ ID NO: 1798835 - RNA, 15 nt, Human
uguucuaagaaguga

SEQ ID NO: 1798836 - RNA, 23 nt, Human
aguuacuaucaugucaaacguga

SEQ ID NO: 1798837 - RNA, 13 nt, Human
aguuacucagaau

SEQ ID NO: 1798838 - RNA, 20 nt, Human
aguguuguggauuuaacaga

SEQ ID NO: 1798839 - RNA, 19 nt, Human
aguguuguggauuuaacag

SEQ ID NO: 1798840 - RNA, 18 nt, Human
aguguguguuuuucauaa

SEQ ID NO: 1798841 - RNA, 16 nt, Human
aguguuguggauuuaa

SEQ ID NO: 1798842 - RNA, 16 nt, Human
agugcccuccaggaua

SEQ ID NO: 1798843 - RNA, 20 nt, Human
ugugucuugcaauggcagcc

SEQ ID NO: 1798844 - RNA, 11 nt, Human
uguguguuuau

SEQ ID NO: 1798845 - RNA, 22 nt, Human
uguguuaucacccagaagaaaa

SEQ ID NO: 1798846 - RNA, 23 nt, Human
uguguuaucacccagaagaaaau

SEQ ID NO: 1798847 - RNA, 16 nt, Human
uguuaacugagugccu

SEQ ID NO: 1798848 - RNA, 22 nt, Human
uguuaacugagugccuuuuggu

SEQ ID NO: 1798849 - RNA, 22 nt, Human
uguuaaguugauggugaugaaa

SEQ ID NO: 1798850 - RNA, 18 nt, Human
uguuaauaaaaguacaug

SEQ ID NO: 1798851 - RNA, 13 nt, Human
uguuaauaaaagu

SEQ ID NO: 1798852 - RNA, 19 nt, Human
uguuaauaaaaguacaugu

SEQ ID NO: 1798853 - RNA, 17 nt, Human
uguuacaaauuguagaa

SEQ ID NO: 1798854 - RNA, 18 nt, Human
uguuacaaauuguagaag

SEQ ID NO: 1798855 - RNA, 18 nt, Human
uguuacacuuuuuggaag

SEQ ID NO: 1798856 - RNA, 19 nt, Human
uguuacauaagauaaaugu

SEQ ID NO: 1798857 - RNA, 11 nt, Human
aguggcagcug

SEQ ID NO: 1798858 - RNA, 22 nt, Human
agugggcccaaugcacuuuguu

SEQ ID NO: 1798859 - RNA, 15 nt, Human
aguggggacagagca

SEQ ID NO: 1798860 - RNA, 14 nt, Human
aguggggaggggcu

SEQ ID NO: 1798861 - RNA, 17 nt, Human
aguggauggaaggggcu

SEQ ID NO: 1798862 - RNA, 23 nt, Human
aguacacuguuucaaacuuuacu

SEQ ID NO: 1798863 - RNA, 21 nt, Human
aguacacuguuucaaacuuua

SEQ ID NO: 1798864 - RNA, 16 nt, Human
aguaaaaacaaagaaa

SEQ ID NO: 1798865 - RNA, 23 nt, Human
aguaaaaacaaagaaauuaugug

SEQ ID NO: 1798866 - RNA, 21 nt, Human
uguacauggaauaacauguaa

SEQ ID NO: 1798867 - RNA, 18 nt, Human
uguauauauuuccuauau

SEQ ID NO: 1798868 - RNA, 22 nt, Human
uguauauauuuccuauauuguu

SEQ ID NO: 1798869 - RNA, 16 nt, Human
uguaggguuauaauaa

SEQ ID NO: 1798870 - RNA, 17 nt, Human
uguaggguuauaauaau

SEQ ID NO: 1798871 - RNA, 22 nt, Human
uguagugaaucacguaaagcua

SEQ ID NO: 1798872 - RNA, 20 nt, Human
agguuggcaaaaaggcagga

SEQ ID NO: 1798873 - RNA, 16 nt, Human
agguuucucaaagaaa

SEQ ID NO: 1798874 - RNA, 19 nt, Human
agguuucucaaagaaauuu

SEQ ID NO: 1798875 - RNA, 19 nt, Human
uguaauuaaguacuaugua

SEQ ID NO: 1798876 - RNA, 21 nt, Human
uguaauuaaguacuauguauc

SEQ ID NO: 1798877 - RNA, 18 nt, Human
uguaauuaaguacuaugu

SEQ ID NO: 1798878 - RNA, 20 nt, Human
uguacauaaugcgugcauac

SEQ ID NO: 1798879 - RNA, 19 nt, Human
uguacauaaugcgugcaua

SEQ ID NO: 1798880 - RNA, 12 nt, Human
uguacaguuuuu

SEQ ID NO: 1798881 - RNA, 20 nt, Human
uguaauuuuguguaagaaau

SEQ ID NO: 1798882 - RNA, 16 nt, Human
uguaauuuuguguaag

SEQ ID NO: 1798883 - RNA, 15 nt, Human
uguaauuuuguguaa

SEQ ID NO: 1798884 - RNA, 20 nt, Human
uguaauuuuuuuaucgucac

SEQ ID NO: 1798885 - RNA, 14 nt, Human
uguacaugaaaaca

SEQ ID NO: 1798886 - RNA, 16 nt, Human
uguacaugaaaacaca

SEQ ID NO: 1798887 - RNA, 14 nt, Human
uguacauauaagug

SEQ ID NO: 1798888 - RNA, 14 nt, Human
agguugaagcacca

SEQ ID NO: 1798889 - RNA, 14 nt, Human
agguugcagugagc

SEQ ID NO: 1798890 - RNA, 12 nt, Human
aggugugcucug

SEQ ID NO: 1798891 - RNA, 22 nt, Human
aggugugagucaccaagcccag

SEQ ID NO: 1798892 - RNA, 21 nt, Human
aggugugagucaccaagccca

SEQ ID NO: 1798893 - RNA, 20 nt, Human
aggugucccugcacuugcag

SEQ ID NO: 1798894 - RNA, 16 nt, Human
aggugucccugcacuu

SEQ ID NO: 1798895 - RNA, 13 nt, Human
ugggcugcccugg

SEQ ID NO: 1798896 - RNA, 14 nt, Human
ugggcugcccuggu

SEQ ID NO: 1798897 - RNA, 15 nt, Human
ugggcugcccuggug

SEQ ID NO: 1798898 - RNA, 16 nt, Human
ugggcugcccuggugc

SEQ ID NO: 1798899 - RNA, 12 nt, Human
aggugggaggau

SEQ ID NO: 1798900 - RNA, 23 nt, Human
agucucacuguugcccaggcugg

SEQ ID NO: 1798901 - RNA, 16 nt, Human
agucccccugccccag

SEQ ID NO: 1798902 - RNA, 14 nt, Human
aguccucccaucuc

SEQ ID NO: 1798903 - RNA, 16 nt, Human
aguccucccaucucac

SEQ ID NO: 1798904 - RNA, 22 nt, Human
agucagaaguuucugccgcagc

SEQ ID NO: 1798905 - RNA, 19 nt, Human
ugucccuuacgugaguccu

SEQ ID NO: 1798906 - RNA, 23 nt, Human
ugucccuuacgugaguccuggca

SEQ ID NO: 1798907 - RNA, 14 nt, Human
ugucgccucugcau

SEQ ID NO: 1798908 - RNA, 16 nt, Human
agucccaccuuggcug

SEQ ID NO: 1798909 - RNA, 15 nt, Human
agucccaccuuggcu

SEQ ID NO: 1798910 - RNA, 20 nt, Human
agucccaccuuggcugcagg

SEQ ID NO: 1798911 - RNA, 19 nt, Human
agucccaccuuggcugcag

SEQ ID NO: 1798912 - RNA, 18 nt, Human
agucccaccuuggcugca

SEQ ID NO: 1798913 - RNA, 17 nt, Human
agucccaggcugagccu

SEQ ID NO: 1798914 - RNA, 18 nt, Human
agucccaggcugagccuc

SEQ ID NO: 1798915 - RNA, 19 nt, Human
agucccaggcugagccuca

SEQ ID NO: 1798916 - RNA, 19 nt, Human
aguauucuuauuuaaugaa

SEQ ID NO: 1798917 - RNA, 15 nt, Human
agucaccaagcccag

SEQ ID NO: 1798918 - RNA, 21 nt, Human
aguauuuuccuguugucaaga

SEQ ID NO: 1798919 - RNA, 17 nt, Human
agucaccccggccaccu

SEQ ID NO: 1798920 - RNA, 23 nt, Human
ugucccugcacuugcagacucua

SEQ ID NO: 1798921 - RNA, 22 nt, Human
ugucccugcacuugcagacucu

SEQ ID NO: 1798922 - RNA, 20 nt, Human
ugucccugcacuugcagacu

SEQ ID NO: 1798923 - RNA, 16 nt, Human
uguccaagaagcccag

SEQ ID NO: 1798924 - RNA, 17 nt, Human
uguccaagaagcccagg

SEQ ID NO: 1798925 - RNA, 18 nt, Human
uguccaagaagcccagga

SEQ ID NO: 1798926 - RNA, 22 nt, Human
uguccaagaagcccaggaaagg

SEQ ID NO: 1798927 - RNA, 22 nt, Human
ugucauuugagcagggcucagc

SEQ ID NO: 1798928 - RNA, 21 nt, Human
ugucauuugagcagggcucag

SEQ ID NO: 1798929 - RNA, 20 nt, Human
ugucauuugagcagggcuca

SEQ ID NO: 1798930 - RNA, 20 nt, Human
ugucagguggggcagcuuga

SEQ ID NO: 1798931 - RNA, 18 nt, Human
ugucagguggggcagcuu

SEQ ID NO: 1798932 - RNA, 17 nt, Human
ugucagguggggcagcu

SEQ ID NO: 1798933 - RNA, 14 nt, Human
uguccaagaagccc

SEQ ID NO: 1798934 - RNA, 15 nt, Human
uguccaagaagccca

SEQ ID NO: 1798935 - RNA, 13 nt, Human
agggaaauuucag

SEQ ID NO: 1798936 - RNA, 15 nt, Human
agggacuuggaagcu

SEQ ID NO: 1798937 - RNA, 19 nt, Human
agggacuuggaagcuccgc

SEQ ID NO: 1798938 - RNA, 18 nt, Human
agggacuuggaagcuccg

SEQ ID NO: 1798939 - RNA, 20 nt, Human
agggacuuggaagcuccgcu

SEQ ID NO: 1798940 - RNA, 16 nt, Human
ugggacuacaggugug

SEQ ID NO: 1798941 - RNA, 18 nt, Human
ugggacucaaugcacuga

SEQ ID NO: 1798942 - RNA, 13 nt, Human
ugggacuggccuc

SEQ ID NO: 1798943 - RNA, 15 nt, Human
ugggagaaaugaaaa

SEQ ID NO: 1798944 - RNA, 14 nt, Human
ugggacuggccucu

SEQ ID NO: 1798945 - RNA, 16 nt, Human
ugggacuggccucugc

SEQ ID NO: 1798946 - RNA, 18 nt, Human
ugggacuacaggcaccca

SEQ ID NO: 1798947 - RNA, 18 nt, Human
agggagcaucagugcccu

SEQ ID NO: 1798948 - RNA, 14 nt, Human
ugggaggcucugga

SEQ ID NO: 1798949 - RNA, 17 nt, Human
ugggaggcucuggagcc

SEQ ID NO: 1798950 - RNA, 23 nt, Human
ugggaggcucuggagcccacugu

SEQ ID NO: 1798951 - RNA, 19 nt, Human
ugggaggcugagaugggag

SEQ ID NO: 1798952 - RNA, 22 nt, Human
ugggaggauugcuugagcucag

SEQ ID NO: 1798953 - RNA, 18 nt, Human
ugggaggauugcuugagc

SEQ ID NO: 1798954 - RNA, 21 nt, Human
ugggaggauugcuugagcuca

SEQ ID NO: 1798955 - RNA, 16 nt, Human
ugggagaaaugaaaaa

SEQ ID NO: 1798956 - RNA, 21 nt, Human
ugggagaaccaaaaagaggcu

SEQ ID NO: 1798957 - RNA, 22 nt, Human
ugggagaaccaaaaagaggcua

SEQ ID NO: 1798958 - RNA, 16 nt, Human
ugggauuuggucaaca

SEQ ID NO: 1798959 - RNA, 13 nt, Human
ugggcagaaggaa

SEQ ID NO: 1798960 - RNA, 23 nt, Human
ugggcagaaggaagacuucaucc

SEQ ID NO: 1798961 - RNA, 16 nt, Human
ugggcagaaggaagac

SEQ ID NO: 1798962 - RNA, 20 nt, Human
ugggcagaaggaagacuuca

SEQ ID NO: 1798963 - RNA, 15 nt, Human
ugggcucccuuccca

SEQ ID NO: 1798964 - RNA, 14 nt, Human
ugggcucccuuccc

SEQ ID NO: 1798965 - RNA, 18 nt, Human
agggcccagagagggugg

SEQ ID NO: 1798966 - RNA, 14 nt, Human
agggcccagagagg

SEQ ID NO: 1798967 - RNA, 20 nt, Human
agggcuccagacacaugucc

SEQ ID NO: 1798968 - RNA, 17 nt, Human
agggcacugguggcccg

SEQ ID NO: 1798969 - RNA, 13 nt, Human
agggcccagagag

SEQ ID NO: 1798970 - RNA, 12 nt, Human
agggcccagaga

SEQ ID NO: 1798971 - RNA, 17 nt, Human
agggcauggccaggugg

SEQ ID NO: 1798972 - RNA, 20 nt, Human
agggagugacagaggcagcc

SEQ ID NO: 1798973 - RNA, 20 nt, Human
agggagugaguugauagcac

SEQ ID NO: 1798974 - RNA, 23 nt, Human
agggaguccgaaagggacuugga

SEQ ID NO: 1798975 - RNA, 20 nt, Human
agggaguccgaaagggacuu

SEQ ID NO: 1798976 - RNA, 22 nt, Human
agggagggcuccagacacaugu

SEQ ID NO: 1798977 - RNA, 13 nt, Human
agggagggccugg

SEQ ID NO: 1798978 - RNA, 15 nt, Human
agggagggccugggc

SEQ ID NO: 1798979 - RNA, 12 nt, Human
agggagggcucc

SEQ ID NO: 1798980 - RNA, 13 nt, Human
agggagggcucca

SEQ ID NO: 1798981 - RNA, 17 nt, Human
agggagggcuccagaca

SEQ ID NO: 1798982 - RNA, 19 nt, Human
agggagggcuccagacaca

SEQ ID NO: 1798983 - RNA, 18 nt, Human
ugggaaacaaaaggauaa

SEQ ID NO: 1798984 - RNA, 21 nt, Human
uggcuuuugugcauuaucuag

SEQ ID NO: 1798985 - RNA, 16 nt, Human
uggcuuuugugcauua

SEQ ID NO: 1798986 - RNA, 22 nt, Human
uggcuucacggaagagccuugc

SEQ ID NO: 1798987 - RNA, 15 nt, Human
uggcuuuugugcauu

SEQ ID NO: 1798988 - RNA, 17 nt, Human
uggcuucacggaagagc

SEQ ID NO: 1798989 - RNA, 20 nt, Human
uggcuucacggaagagccuu

SEQ ID NO: 1798990 - RNA, 20 nt, Human
ugggaacaccauaggucacc

SEQ ID NO: 1798991 - RNA, 23 nt, Human
uggcugcaaaggguaucaggugc

SEQ ID NO: 1798992 - RNA, 14 nt, Human
uggcugugccucug

SEQ ID NO: 1798993 - RNA, 15 nt, Human
uggcugugccucugc

SEQ ID NO: 1798994 - RNA, 16 nt, Human
uggcugugccucugcc

SEQ ID NO: 1798995 - RNA, 17 nt, Human
uggcugugccucugccu

SEQ ID NO: 1798996 - RNA, 23 nt, Human
uggcuguuggcugggggccucag

SEQ ID NO: 1798997 - RNA, 14 nt, Human
uggcuucacggaag

SEQ ID NO: 1798998 - RNA, 18 nt, Human
uggcuguuggcugggggc

SEQ ID NO: 1798999 - RNA, 16 nt, Human
uggcuguuggcugggg

SEQ ID NO: 1799000 - RNA, 22 nt, Human
uggcugugccucugccugucuc

SEQ ID NO: 1799001 - RNA, 18 nt, Human
uggcugugccucugccug

SEQ ID NO: 1799002 - RNA, 19 nt, Human
uggcugugccucugccugu

SEQ ID NO: 1799003 - RNA, 13 nt, Human
aggcuccugccac

SEQ ID NO: 1799004 - RNA, 18 nt, Human
uggcuaagcaaaauguga

SEQ ID NO: 1799005 - RNA, 14 nt, Human
uggcuaaauucaug

SEQ ID NO: 1799006 - RNA, 17 nt, Human
aggcuccaggagcagcc

SEQ ID NO: 1799007 - RNA, 18 nt, Human
aggcuccaggagcagcca

SEQ ID NO: 1799008 - RNA, 19 nt, Human
aggcuccaggagcagccac

SEQ ID NO: 1799009 - RNA, 23 nt, Human
aggcuccaggagcagccacauuc

SEQ ID NO: 1799010 - RNA, 17 nt, Human
uggcuaauguacugcau

SEQ ID NO: 1799011 - RNA, 19 nt, Human
uggcuaauguacugcauau

SEQ ID NO: 1799012 - RNA, 21 nt, Human
uggcucacugcaacuucugcc

SEQ ID NO: 1799013 - RNA, 13 nt, Human
uggcucacgccug

SEQ ID NO: 1799014 - RNA, 15 nt, Human
aggcuuuuuuaucau

SEQ ID NO: 1799015 - RNA, 18 nt, Human
aggcuuuuuuaucaugug

SEQ ID NO: 1799016 - RNA, 21 nt, Human
aggcuuuuuuaucaugugaaa

SEQ ID NO: 1799017 - RNA, 23 nt, Human
aggcuuagucacugagacagccc

SEQ ID NO: 1799018 - RNA, 22 nt, Human
aggcuuagucacugagacagcc

SEQ ID NO: 1799019 - RNA, 21 nt, Human
aggcuuagucacugagacagc

SEQ ID NO: 1799020 - RNA, 23 nt, Human
aggcuucugguugaugccuguga

SEQ ID NO: 1799021 - RNA, 14 nt, Human
aggcugggcuucag

SEQ ID NO: 1799022 - RNA, 21 nt, Human
aggcugggcucccuucccacc

SEQ ID NO: 1799023 - RNA, 23 nt, Human
aggcugggcucccuucccaccuc

SEQ ID NO: 1799024 - RNA, 13 nt, Human
aggcugggcuccc

SEQ ID NO: 1799025 - RNA, 14 nt, Human
aggcugggcucccu

SEQ ID NO: 1799026 - RNA, 18 nt, Human
aggcugggcucccuuccc

SEQ ID NO: 1799027 - RNA, 22 nt, Human
aggcugggagagccuuccaggg

SEQ ID NO: 1799028 - RNA, 20 nt, Human
aggcugggagagccuuccag

SEQ ID NO: 1799029 - RNA, 21 nt, Human
aggcugggagagccuuccagg

SEQ ID NO: 1799030 - RNA, 19 nt, Human
aggcugggagagccuucca

SEQ ID NO: 1799031 - RNA, 16 nt, Human
aggcugggagagccuu

SEQ ID NO: 1799032 - RNA, 23 nt, Human
aggcugggcuucaguggcagcug

SEQ ID NO: 1799033 - RNA, 22 nt, Human
aggcugggcuucaguggcagcu

SEQ ID NO: 1799034 - RNA, 17 nt, Human
aggcugggggaagaagc

SEQ ID NO: 1799035 - RNA, 21 nt, Human
aggcugggcuucaguggcagc

SEQ ID NO: 1799036 - RNA, 20 nt, Human
aggcugggcuucaguggcag

SEQ ID NO: 1799037 - RNA, 19 nt, Human
aggcugggcuucaguggca

SEQ ID NO: 1799038 - RNA, 18 nt, Human
aggcugggcuucaguggc

SEQ ID NO: 1799039 - RNA, 20 nt, Human
aggcugggucgcccuggacu

SEQ ID NO: 1799040 - RNA, 21 nt, Human
aggcugggucgcccuggacug

SEQ ID NO: 1799041 - RNA, 14 nt, Human
aggcuggguucuga

SEQ ID NO: 1799042 - RNA, 17 nt, Human
aggcuggguucugaucc

SEQ ID NO: 1799043 - RNA, 15 nt, Human
aggcugggucgcccu

SEQ ID NO: 1799044 - RNA, 18 nt, Human
aggcugggucgcccugga

SEQ ID NO: 1799045 - RNA, 10 nt, Human
aggcuggguc

SEQ ID NO: 1799046 - RNA, 22 nt, Human
aggcugggggaagaagcucucu

SEQ ID NO: 1799047 - RNA, 15 nt, Human
uggacaccggaaaca

SEQ ID NO: 1799048 - RNA, 14 nt, Human
aggcaagcaccucc

SEQ ID NO: 1799049 - RNA, 16 nt, Human
aggcaacuugggaacu

SEQ ID NO: 1799050 - RNA, 14 nt, Human
uggaauuugaaaca

SEQ ID NO: 1799051 - RNA, 22 nt, Human
aggauugcuacuguccuaccca

SEQ ID NO: 1799052 - RNA, 18 nt, Human
aggaugcuuguacauaau

SEQ ID NO: 1799053 - RNA, 12 nt, Human
aggaucagucug

SEQ ID NO: 1799054 - RNA, 21 nt, Human
aggauccugagccagauuuca

SEQ ID NO: 1799055 - RNA, 16 nt, Human
aggaugcuuguacaua

SEQ ID NO: 1799056 - RNA, 15 nt, Human
aggaugcuuguacau

SEQ ID NO: 1799057 - RNA, 12 nt, Human
aggaucucuuga

SEQ ID NO: 1799058 - RNA, 10 nt, Human
ugcugcccug

SEQ ID NO: 1799059 - RNA, 12 nt, Human
ugcugcccugcc

SEQ ID NO: 1799060 - RNA, 13 nt, Human
uggaagcuccgcu

SEQ ID NO: 1799061 - RNA, 14 nt, Human
uggaacacucugag

SEQ ID NO: 1799062 - RNA, 12 nt, Human
uggaacacucug

SEQ ID NO: 1799063 - RNA, 20 nt, Human
uggaaguacuauaauuuacc

SEQ ID NO: 1799064 - RNA, 14 nt, Human
uggaaguaguggag

SEQ ID NO: 1799065 - RNA, 17 nt, Human
uggaaguaguggagccc

SEQ ID NO: 1799066 - RNA, 19 nt, Human
aggaguuucguuuucaaaa

SEQ ID NO: 1799067 - RNA, 21 nt, Human
aggaguuugagaccaaccugg

SEQ ID NO: 1799068 - RNA, 15 nt, Human
aggaggccagccuug

SEQ ID NO: 1799069 - RNA, 19 nt, Human
uggaagugaaaacuuugua

SEQ ID NO: 1799070 - RNA, 18 nt, Human
uggaagugaaaacuuugu

SEQ ID NO: 1799071 - RNA, 14 nt, Human
uggaagugcuaauu

SEQ ID NO: 1799072 - RNA, 16 nt, Human
aggcaaugcuggcugu

SEQ ID NO: 1799073 - RNA, 15 nt, Human
aggcaaugcuggcug

SEQ ID NO: 1799074 - RNA, 21 nt, Human
uggaggaaaaccaagccgugg

SEQ ID NO: 1799075 - RNA, 23 nt, Human
uggaggaaaaccaagccguggcu

SEQ ID NO: 1799076 - RNA, 22 nt, Human
uggacuuuguuaguuucuccaa

SEQ ID NO: 1799077 - RNA, 11 nt, Human
uggacuuuguu

SEQ ID NO: 1799078 - RNA, 19 nt, Human
uggagcccacuguacuugc

SEQ ID NO: 1799079 - RNA, 23 nt, Human
uggagcccacuguacuugcucuu

SEQ ID NO: 1799080 - RNA, 16 nt, Human
uggagcccacuguacu

SEQ ID NO: 1799081 - RNA, 24 nt, Human
uggacuuuguuaguuucuccaagc

SEQ ID NO: 1799082 - RNA, 22 nt, Human
aggcagccccauucugccugcc

SEQ ID NO: 1799083 - RNA, 21 nt, Human
aggcagccccauucugccugc

SEQ ID NO: 1799084 - RNA, 20 nt, Human
aggcagccccauucugccug

SEQ ID NO: 1799085 - RNA, 19 nt, Human
aggcagccccauucugccu

SEQ ID NO: 1799086 - RNA, 15 nt, Human
aggcacccaccauca

SEQ ID NO: 1799087 - RNA, 20 nt, Human
aggcaggaguuucguuuuca

SEQ ID NO: 1799088 - RNA, 12 nt, Human
aggcaggauggc

SEQ ID NO: 1799089 - RNA, 16 nt, Human
aggcagggagggccug

SEQ ID NO: 1799090 - RNA, 21 nt, Human
aggcagggucucacucugucg

SEQ ID NO: 1799091 - RNA, 20 nt, Human
aggcagggucucacucuguc

SEQ ID NO: 1799092 - RNA, 18 nt, Human
aggcagggucucacucug

SEQ ID NO: 1799093 - RNA, 19 nt, Human
aggcagggucucacucugu

SEQ ID NO: 1799094 - RNA, 14 nt, Human
aggcagguccaggg

SEQ ID NO: 1799095 - RNA, 22 nt, Human
aggcagggucucacucugucgc

SEQ ID NO: 1799096 - RNA, 21 nt, Human
aggcaggucuugaacuccugg

SEQ ID NO: 1799097 - RNA, 13 nt, Human
aggcuccaggagc

SEQ ID NO: 1799098 - RNA, 14 nt, Human
aggcuccaggagca

SEQ ID NO: 1799099 - RNA, 16 nt, Human
aggcuccaggagcagc

SEQ ID NO: 1799100 - RNA, 22 nt, Human
aggcuccacuuggucugugaga

SEQ ID NO: 1799101 - RNA, 21 nt, Human
aggcuccacuuggucugugag

SEQ ID NO: 1799102 - RNA, 17 nt, Human
aggcuccacuuggucug

SEQ ID NO: 1799103 - RNA, 11 nt, Human
aggcuccacuu

SEQ ID NO: 1799104 - RNA, 18 nt, Human
aggccuucucugaaggac

SEQ ID NO: 1799105 - RNA, 17 nt, Human
aggccuucucugaagga

SEQ ID NO: 1799106 - RNA, 14 nt, Human
aggcgccccuuccc

SEQ ID NO: 1799107 - RNA, 22 nt, Human
uggcaugggaaugaaugucagu

SEQ ID NO: 1799108 - RNA, 19 nt, Human
uggcccacgcacuucggga

SEQ ID NO: 1799109 - RNA, 13 nt, Human
uggcccacugcau

SEQ ID NO: 1799110 - RNA, 14 nt, Human
uggcccacugcauc

SEQ ID NO: 1799111 - RNA, 12 nt, Human
uggcccugcccu

SEQ ID NO: 1799112 - RNA, 13 nt, Human
uggcccugcccug

SEQ ID NO: 1799113 - RNA, 21 nt, Human
uggccucugcugauccuccca

SEQ ID NO: 1799114 - RNA, 20 nt, Human
uggccucugcacuccccugc

SEQ ID NO: 1799115 - RNA, 19 nt, Human
uggccucugcacuccccug

SEQ ID NO: 1799116 - RNA, 18 nt, Human
aggccaugggccuccugu

SEQ ID NO: 1799117 - RNA, 22 nt, Human
uggcagccgugccuucagcucu

SEQ ID NO: 1799118 - RNA, 23 nt, Human
aggccagagacacaagccuucgg

SEQ ID NO: 1799119 - RNA, 20 nt, Human
aggccauuccccgucucugg

SEQ ID NO: 1799120 - RNA, 15 nt, Human
aggcccagagggccu

SEQ ID NO: 1799121 - RNA, 16 nt, Human
aggcccagagggccug

SEQ ID NO: 1799122 - RNA, 18 nt, Human
uggcagccgugccuucag

SEQ ID NO: 1799123 - RNA, 19 nt, Human
uggcagccgugccuucagc

SEQ ID NO: 1799124 - RNA, 20 nt, Human
uggcagccgugccuucagcu

SEQ ID NO: 1799125 - RNA, 21 nt, Human
uggcagccgugccuucagcuc

SEQ ID NO: 1799126 - RNA, 14 nt, Human
uggcagcucagaga

SEQ ID NO: 1799127 - RNA, 15 nt, Human
uggcagcucagagag

SEQ ID NO: 1799128 - RNA, 16 nt, Human
uggcagcucagagagg

SEQ ID NO: 1799129 - RNA, 18 nt, Human
uggcagcucagagagggu

SEQ ID NO: 1799130 - RNA, 13 nt, Human
aggccagagacac

SEQ ID NO: 1799131 - RNA, 18 nt, Human
aggccagagacacaagcc

SEQ ID NO: 1799132 - RNA, 17 nt, Human
uggcagccgugccuuca

SEQ ID NO: 1799133 - RNA, 16 nt, Human
uggcaccagcagccug

SEQ ID NO: 1799134 - RNA, 17 nt, Human
uggcaccagcagccugg

SEQ ID NO: 1799135 - RNA, 16 nt, Human
uggcacagggcagugg

SEQ ID NO: 1799136 - RNA, 15 nt, Human
uggcacagggcagug

SEQ ID NO: 1799137 - RNA, 21 nt, Human
aggccccugccacccugggga

SEQ ID NO: 1799138 - RNA, 18 nt, Human
aggccccugccacccugg

SEQ ID NO: 1799139 - RNA, 17 nt, Human
aggccccugccacccug

SEQ ID NO: 1799140 - RNA, 15 nt, Human
aggccccugccaccc

SEQ ID NO: 1799141 - RNA, 13 nt, Human
aggccccugccac

SEQ ID NO: 1799142 - RNA, 19 nt, Human
aggcccagagggccugcaa

SEQ ID NO: 1799143 - RNA, 20 nt, Human
aggcccagagggccugcaag

SEQ ID NO: 1799144 - RNA, 16 nt, Human
aggcccggcuccaggc

SEQ ID NO: 1799145 - RNA, 15 nt, Human
aggcccggcuccagg

SEQ ID NO: 1799146 - RNA, 14 nt, Human
aggcccggcuccag

SEQ ID NO: 1799147 - RNA, 17 nt, Human
aggcccggcuccaggcu

SEQ ID NO: 1799148 - RNA, 12 nt, Human
aggccuggccag

SEQ ID NO: 1799149 - RNA, 13 nt, Human
aggccuggccaga

SEQ ID NO: 1799150 - RNA, 22 nt, Human
aggccuaauucuaugccugucu

SEQ ID NO: 1799151 - RNA, 19 nt, Human
aggccuaauucuaugccug

SEQ ID NO: 1799152 - RNA, 17 nt, Human
ugcugacuguuuucucu

SEQ ID NO: 1799153 - RNA, 17 nt, Human
ugcucuggacaggcaug

SEQ ID NO: 1799154 - RNA, 15 nt, Human
ugcucugcauguuac

SEQ ID NO: 1799155 - RNA, 18 nt, Human
ugcucugcauguuacaua

SEQ ID NO: 1799156 - RNA, 22 nt, Human
ugcucugaucauccacugugcc

SEQ ID NO: 1799157 - RNA, 18 nt, Human
ugcucugaugaagaggag

SEQ ID NO: 1799158 - RNA, 19 nt, Human
ugcucugaugaagaggagu

SEQ ID NO: 1799159 - RNA, 21 nt, Human
ugcugacuguuuucucuugag

SEQ ID NO: 1799160 - RNA, 24 nt, Human
ugcugacuguuuucucuugagagg

SEQ ID NO: 1799161 - RNA, 15 nt, Human
ugcugagucccaggc

SEQ ID NO: 1799162 - RNA, 18 nt, Human
ugcugagucccaggcuga

SEQ ID NO: 1799163 - RNA, 22 nt, Human
ugcugagucccaggcugagccu

SEQ ID NO: 1799164 - RNA, 18 nt, Human
aggaaaggcuccaggagc

SEQ ID NO: 1799165 - RNA, 20 nt, Human
aggaaaggcuccaggagcag

SEQ ID NO: 1799166 - RNA, 22 nt, Human
aggaaaggcuccaggagcagcc

SEQ ID NO: 1799167 - RNA, 23 nt, Human
aggaaaggcuccaggagcagcca

SEQ ID NO: 1799168 - RNA, 23 nt, Human
aggaauccagacccggcugcgug

SEQ ID NO: 1799169 - RNA, 19 nt, Human
aggaauugacccacaagaa

SEQ ID NO: 1799170 - RNA, 17 nt, Human
aggaagcucagggccug

SEQ ID NO: 1799171 - RNA, 18 nt, Human
aggaagcucagggccugg

SEQ ID NO: 1799172 - RNA, 22 nt, Human
aggaagcucagggccuggcuca

SEQ ID NO: 1799173 - RNA, 14 nt, Human
aggaagagaaaaaa

SEQ ID NO: 1799174 - RNA, 15 nt, Human
aggaagacuuuggaa

SEQ ID NO: 1799175 - RNA, 15 nt, Human
ugcugccauccaggu

SEQ ID NO: 1799176 - RNA, 14 nt, Human
ugcugccauccagg

SEQ ID NO: 1799177 - RNA, 13 nt, Human
ugcugccauccag

SEQ ID NO: 1799178 - RNA, 12 nt, Human
ugcugccaucca

SEQ ID NO: 1799179 - RNA, 22 nt, Human
ugcugccauccagguucagcuu

SEQ ID NO: 1799180 - RNA, 21 nt, Human
ugcugccauccagguucagcu

SEQ ID NO: 1799181 - RNA, 14 nt, Human
ugcugcccagccuc

SEQ ID NO: 1799182 - RNA, 16 nt, Human
ugcugcccagccucca

SEQ ID NO: 1799183 - RNA, 11 nt, Human
ugcugccaucc

SEQ ID NO: 1799184 - RNA, 22 nt, Human
ugcugccacacuucaggcucuu

SEQ ID NO: 1799185 - RNA, 15 nt, Human
ugcugccacacuuca

SEQ ID NO: 1799186 - RNA, 16 nt, Human
ugcugccacacuucag

SEQ ID NO: 1799187 - RNA, 19 nt, Human
ugcugccacacuucaggcu

SEQ ID NO: 1799188 - RNA, 22 nt, Human
aggaauuuuauuuuuuucugaa

SEQ ID NO: 1799189 - RNA, 21 nt, Human
agcuuguaaauagcucaggug

SEQ ID NO: 1799190 - RNA, 20 nt, Human
agcuuguaaauagcucaggu

SEQ ID NO: 1799191 - RNA, 19 nt, Human
agcuuguaaauagcucagg

SEQ ID NO: 1799192 - RNA, 21 nt, Human
ugcggacagccacggccaggc

SEQ ID NO: 1799193 - RNA, 20 nt, Human
ugcggacagccacggccagg

SEQ ID NO: 1799194 - RNA, 20 nt, Human
agcuuaaaggggcuagagug

SEQ ID NO: 1799195 - RNA, 12 nt, Human
agcuuaucucag

SEQ ID NO: 1799196 - RNA, 14 nt, Human
agcuuaucucaggg

SEQ ID NO: 1799197 - RNA, 15 nt, Human
agcuuaucucagggg

SEQ ID NO: 1799198 - RNA, 12 nt, Human
aggaaagaggcu

SEQ ID NO: 1799199 - RNA, 13 nt, Human
aggaaagaggcuc

SEQ ID NO: 1799200 - RNA, 16 nt, Human
aggaaagaggcucugg

SEQ ID NO: 1799201 - RNA, 17 nt, Human
aggaaagcaaaggagau

SEQ ID NO: 1799202 - RNA, 19 nt, Human
aggaaagcaaaggagauug

SEQ ID NO: 1799203 - RNA, 21 nt, Human
ugcuauaacuauguugauaaa

SEQ ID NO: 1799204 - RNA, 21 nt, Human
aggaaacccagcucuggucca

SEQ ID NO: 1799205 - RNA, 18 nt, Human
aggaaacccagcucuggu

SEQ ID NO: 1799206 - RNA, 20 nt, Human
aggaaacccagcucuggucc

SEQ ID NO: 1799207 - RNA, 15 nt, Human
aggaaacccagcucu

SEQ ID NO: 1799208 - RNA, 16 nt, Human
aggaaacccagcucug

SEQ ID NO: 1799209 - RNA, 17 nt, Human
aggaaacccagcucugg

SEQ ID NO: 1799210 - RNA, 12 nt, Human
agcuuugaaaau

SEQ ID NO: 1799211 - RNA, 16 nt, Human
agcuuugaaaauucag

SEQ ID NO: 1799212 - RNA, 18 nt, Human
agcuuugaaaauucagug

SEQ ID NO: 1799213 - RNA, 19 nt, Human
agcuuugaaaauucagugg

SEQ ID NO: 1799214 - RNA, 13 nt, Human
ugcgaaaggauga

SEQ ID NO: 1799215 - RNA, 18 nt, Human
ugcggacagccacggcca

SEQ ID NO: 1799216 - RNA, 19 nt, Human
ugcgaaaggaugaaaguga

SEQ ID NO: 1799217 - RNA, 17 nt, Human
ugccuguucagcuccag

SEQ ID NO: 1799218 - RNA, 16 nt, Human
ugccuguucagcucca

SEQ ID NO: 1799219 - RNA, 15 nt, Human
ugccuguucagcucc

SEQ ID NO: 1799220 - RNA, 21 nt, Human
ugccuuagaaccuuucuuaca

SEQ ID NO: 1799221 - RNA, 14 nt, Human
ugccuuagaaccuu

SEQ ID NO: 1799222 - RNA, 17 nt, Human
ugccuuagaaccuuucu

SEQ ID NO: 1799223 - RNA, 20 nt, Human
agcuggggccaggcuggguc

SEQ ID NO: 1799224 - RNA, 10 nt, Human
agcugccugu

SEQ ID NO: 1799225 - RNA, 17 nt, Human
agcuggagaaauauggu

SEQ ID NO: 1799226 - RNA, 21 nt, Human
agcugccugggaucccucauc

SEQ ID NO: 1799227 - RNA, 13 nt, Human
agcugccugggau

SEQ ID NO: 1799228 - RNA, 19 nt, Human
agcugccugggaucccuca

SEQ ID NO: 1799229 - RNA, 22 nt, Human
ugccucugacacacagcucugu

SEQ ID NO: 1799230 - RNA, 19 nt, Human
agcugggacuacaggugug

SEQ ID NO: 1799231 - RNA, 17 nt, Human
agcugggacuacaggug

SEQ ID NO: 1799232 - RNA, 22 nt, Human
agcugggaucacauguggacuu

SEQ ID NO: 1799233 - RNA, 18 nt, Human
agcugggauuacaggcuc

SEQ ID NO: 1799234 - RNA, 21 nt, Human
agcugggauuacaggcuccug

SEQ ID NO: 1799235 - RNA, 23 nt, Human
agcugggaugauuggagggggga

SEQ ID NO: 1799236 - RNA, 17 nt, Human
agcuggggccaggcugg

SEQ ID NO: 1799237 - RNA, 22 nt, Human
agcugggauuacaggcuccugc

SEQ ID NO: 1799238 - RNA, 23 nt, Human
agcugggauuacaggcuccugcc

SEQ ID NO: 1799239 - RNA, 14 nt, Human
agcugggcagguug

SEQ ID NO: 1799240 - RNA, 14 nt, Human
agcucuguccuggg

SEQ ID NO: 1799241 - RNA, 12 nt, Human
agcucuguccug

SEQ ID NO: 1799242 - RNA, 18 nt, Human
agcucuucuccaggcugu

SEQ ID NO: 1799243 - RNA, 13 nt, Human
agcugcacccuca

SEQ ID NO: 1799244 - RNA, 17 nt, Human
agcugcacccucaggca

SEQ ID NO: 1799245 - RNA, 18 nt, Human
agcugcacccucaggcag

SEQ ID NO: 1799246 - RNA, 19 nt, Human
agcugcacccucaggcagg

SEQ ID NO: 1799247 - RNA, 20 nt, Human
agcugcacccucaggcaggu

SEQ ID NO: 1799248 - RNA, 22 nt, Human
agcugcacccucaggcaggugg

SEQ ID NO: 1799249 - RNA, 12 nt, Human
agcucugcuccu

SEQ ID NO: 1799250 - RNA, 22 nt, Human
agcucugcuccucuccccagca

SEQ ID NO: 1799251 - RNA, 20 nt, Human
agcucugguccauagagagc

SEQ ID NO: 1799252 - RNA, 16 nt, Human
agcucucuccucccuu

SEQ ID NO: 1799253 - RNA, 22 nt, Human
agcucuaucaccaaggagccaa

SEQ ID NO: 1799254 - RNA, 17 nt, Human
agcucuaucaccaagga

SEQ ID NO: 1799255 - RNA, 22 nt, Human
ugcccuccaagaccuucuccuu

SEQ ID NO: 1799256 - RNA, 19 nt, Human
ugcccuccaagaccuucuc

SEQ ID NO: 1799257 - RNA, 20 nt, Human
ugcccuccaagaccuucucc

SEQ ID NO: 1799258 - RNA, 14 nt, Human
agcugccagccgag

SEQ ID NO: 1799259 - RNA, 13 nt, Human
agcugccaccugc

SEQ ID NO: 1799260 - RNA, 18 nt, Human
agcugcauacaguuugca

SEQ ID NO: 1799261 - RNA, 15 nt, Human
ugcccuuucugggca

SEQ ID NO: 1799262 - RNA, 21 nt, Human
ugccucugacacacagcucug

SEQ ID NO: 1799263 - RNA, 20 nt, Human
ugccucugacacacagcucu

SEQ ID NO: 1799264 - RNA, 19 nt, Human
ugccucucugcaggucccu

SEQ ID NO: 1799265 - RNA, 20 nt, Human
ugccucucugcaggucccua

SEQ ID NO: 1799266 - RNA, 16 nt, Human
ugccucucugcagguc

SEQ ID NO: 1799267 - RNA, 18 nt, Human
ugccucucugcagguccc

SEQ ID NO: 1799268 - RNA, 16 nt, Human
ugccucucucaggcca

SEQ ID NO: 1799269 - RNA, 15 nt, Human
ugccucucucaggcc

SEQ ID NO: 1799270 - RNA, 13 nt, Human
ugccucccaucac

SEQ ID NO: 1799271 - RNA, 14 nt, Human
ugccucccaucacc

SEQ ID NO: 1799272 - RNA, 19 nt, Human
ugccucccaucacccgcua

SEQ ID NO: 1799273 - RNA, 13 nt, Human
ugccucucucagg

SEQ ID NO: 1799274 - RNA, 14 nt, Human
ugccucucucaggc

SEQ ID NO: 1799275 - RNA, 14 nt, Human
ugcauuuccugaca

SEQ ID NO: 1799276 - RNA, 13 nt, Human
ugcauuuccugac

SEQ ID NO: 1799277 - RNA, 23 nt, Human
ugcauuugaaaauuuugauguuu

SEQ ID NO: 1799278 - RNA, 19 nt, Human
ugcauuugaaaauuuugau

SEQ ID NO: 1799279 - RNA, 22 nt, Human
agcgcccaguuggguggaugcc

SEQ ID NO: 1799280 - RNA, 14 nt, Human
agcgcccaguuggg

SEQ ID NO: 1799281 - RNA, 14 nt, Human
agccugcuccagcu

SEQ ID NO: 1799282 - RNA, 20 nt, Human
agcgcccacuagacccacug

SEQ ID NO: 1799283 - RNA, 17 nt, Human
agcgugagccacugcac

SEQ ID NO: 1799284 - RNA, 16 nt, Human
agcgugagccacugca

SEQ ID NO: 1799285 - RNA, 20 nt, Human
agcgugguggacaugcacag

SEQ ID NO: 1799286 - RNA, 23 nt, Human
agcgugguggacaugcacagcua

SEQ ID NO: 1799287 - RNA, 21 nt, Human
ugccauauucuguuggccagu

SEQ ID NO: 1799288 - RNA, 20 nt, Human
ugccauauucuguuggccag

SEQ ID NO: 1799289 - RNA, 15 nt, Human
agcggggacagcucc

SEQ ID NO: 1799290 - RNA, 17 nt, Human
agcggggacagcuccuu

SEQ ID NO: 1799291 - RNA, 16 nt, Human
agcggggacagcuccu

SEQ ID NO: 1799292 - RNA, 15 nt, Human
agcgugagccacugc

SEQ ID NO: 1799293 - RNA, 17 nt, Human
ugccauauucuguuggc

SEQ ID NO: 1799294 - RNA, 16 nt, Human
ugccauauucuguugg

SEQ ID NO: 1799295 - RNA, 15 nt, Human
ugccauauucuguug

SEQ ID NO: 1799296 - RNA, 19 nt, Human
ugccagucccccugcccca

SEQ ID NO: 1799297 - RNA, 17 nt, Human
ugccagucccccugccc

SEQ ID NO: 1799298 - RNA, 22 nt, Human
ugccagucaccccggccaccug

SEQ ID NO: 1799299 - RNA, 23 nt, Human
ugccagucaccccggccaccugc

SEQ ID NO: 1799300 - RNA, 23 nt, Human
ugccacugccucuuccucccuca

SEQ ID NO: 1799301 - RNA, 12 nt, Human
ugccacacuuca

SEQ ID NO: 1799302 - RNA, 15 nt, Human
ugccagucaccccgg

SEQ ID NO: 1799303 - RNA, 16 nt, Human
ugccagucaccccggc

SEQ ID NO: 1799304 - RNA, 18 nt, Human
ugccagucaccccggcca

SEQ ID NO: 1799305 - RNA, 20 nt, Human
ugccagucaccccggccacc

SEQ ID NO: 1799306 - RNA, 19 nt, Human
agcuauggugucauaggcu

SEQ ID NO: 1799307 - RNA, 19 nt, Human
ugccauguuggccaggcug

SEQ ID NO: 1799308 - RNA, 18 nt, Human
ugccauguuggccaggcu

SEQ ID NO: 1799309 - RNA, 17 nt, Human
ugccauguuggccaggc

SEQ ID NO: 1799310 - RNA, 17 nt, Human
agcucagggccuggcuc

SEQ ID NO: 1799311 - RNA, 15 nt, Human
agcucagggccuggc

SEQ ID NO: 1799312 - RNA, 16 nt, Human
agcucagggccuggcu

SEQ ID NO: 1799313 - RNA, 21 nt, Human
ugccauguuggccaggcuggu

SEQ ID NO: 1799314 - RNA, 20 nt, Human
ugccauguuggccaggcugg

SEQ ID NO: 1799315 - RNA, 18 nt, Human
agcucagggccuggcuca

SEQ ID NO: 1799316 - RNA, 23 nt, Human
ugcccaaccugcucuccucuugc

SEQ ID NO: 1799317 - RNA, 24 nt, Human
ugcccaaccugcucuccucuugcc

SEQ ID NO: 1799318 - RNA, 18 nt, Human
ugcccaaccugcucuccu

SEQ ID NO: 1799319 - RNA, 22 nt, Human
ugcccaaccugcucuccucuug

SEQ ID NO: 1799320 - RNA, 11 nt, Human
ugcccaggccc

SEQ ID NO: 1799321 - RNA, 20 nt, Human
ugcccaggcaggucuugaac

SEQ ID NO: 1799322 - RNA, 17 nt, Human
ugcccaggcaggucuug

SEQ ID NO: 1799323 - RNA, 16 nt, Human
ugcccaggcaggucuu

SEQ ID NO: 1799324 - RNA, 15 nt, Human
ugcccaggcaggucu

SEQ ID NO: 1799325 - RNA, 14 nt, Human
ugcccacaggauca

SEQ ID NO: 1799326 - RNA, 22 nt, Human
ugcccaggccccugccacccug

SEQ ID NO: 1799327 - RNA, 20 nt, Human
ugcccaggccccugccaccc

SEQ ID NO: 1799328 - RNA, 14 nt, Human
ugcccaggccccug

SEQ ID NO: 1799329 - RNA, 12 nt, Human
ugcccaggcccc

SEQ ID NO: 1799330 - RNA, 15 nt, Human
ugcccaggccugccu

SEQ ID NO: 1799331 - RNA, 17 nt, Human
ugcccaggccugccugu

SEQ ID NO: 1799332 - RNA, 12 nt, Human
ugccccccagcc

SEQ ID NO: 1799333 - RNA, 19 nt, Human
ugccccucaacucuccucc

SEQ ID NO: 1799334 - RNA, 16 nt, Human
ugccccgucccccucu

SEQ ID NO: 1799335 - RNA, 18 nt, Human
ugccccgucccccucugg

SEQ ID NO: 1799336 - RNA, 20 nt, Human
ugcagacucuacagaggcca

SEQ ID NO: 1799337 - RNA, 19 nt, Human
ugcagacucuacagaggcc

SEQ ID NO: 1799338 - RNA, 15 nt, Human
ugcacuccccugcug

SEQ ID NO: 1799339 - RNA, 22 nt, Human
ugcagacucuacagaggccaug

SEQ ID NO: 1799340 - RNA, 19 nt, Human
agcccuuccaugucgccuc

SEQ ID NO: 1799341 - RNA, 22 nt, Human
agcccuuccaugucgccucugc

SEQ ID NO: 1799342 - RNA, 23 nt, Human
agcccuuccaugucgccucugca

SEQ ID NO: 1799343 - RNA, 13 nt, Human
agcccuucauuug

SEQ ID NO: 1799344 - RNA, 14 nt, Human
agcccuucauuugg

SEQ ID NO: 1799345 - RNA, 15 nt, Human
agccucaaccuccug

SEQ ID NO: 1799346 - RNA, 20 nt, Human
agccucaaaacaaaggccua

SEQ ID NO: 1799347 - RNA, 18 nt, Human
agccucaaaacaaaggcc

SEQ ID NO: 1799348 - RNA, 17 nt, Human
agccuaggugacagagu

SEQ ID NO: 1799349 - RNA, 15 nt, Human
agccuaggugacaga

SEQ ID NO: 1799350 - RNA, 23 nt, Human
agccguuuguuccccaagacauu

SEQ ID NO: 1799351 - RNA, 22 nt, Human
ugcacuauagccuaggugacag

SEQ ID NO: 1799352 - RNA, 12 nt, Human
ugcacuccccug

SEQ ID NO: 1799353 - RNA, 13 nt, Human
ugcacuccccugc

SEQ ID NO: 1799354 - RNA, 14 nt, Human
ugcaccacugcacu

SEQ ID NO: 1799355 - RNA, 17 nt, Human
ugcacguauuuuaauag

SEQ ID NO: 1799356 - RNA, 15 nt, Human
ugcaccacugcacuc

SEQ ID NO: 1799357 - RNA, 15 nt, Human
ugcacacaccagagc

SEQ ID NO: 1799358 - RNA, 14 nt, Human
ugcacaagcugcac

SEQ ID NO: 1799359 - RNA, 15 nt, Human
ugcacaagcuccaag

SEQ ID NO: 1799360 - RNA, 16 nt, Human
ugcacaagcuccaagc

SEQ ID NO: 1799361 - RNA, 18 nt, Human
ugcacaagcuccaagcuc

SEQ ID NO: 1799362 - RNA, 20 nt, Human
ugcacaagcuccaagcuccc

SEQ ID NO: 1799363 - RNA, 22 nt, Human
ugcacaagcuccaagcucccag

SEQ ID NO: 1799364 - RNA, 23 nt, Human
ugcacaagcuccaagcucccagg

SEQ ID NO: 1799365 - RNA, 22 nt, Human
ugcauaccacuuuuguucuugg

SEQ ID NO: 1799366 - RNA, 21 nt, Human
ugcauaccacuuuuguucuug

SEQ ID NO: 1799367 - RNA, 13 nt, Human
ugcaugcuguccc

SEQ ID NO: 1799368 - RNA, 14 nt, Human
ugcaugcugucccu

SEQ ID NO: 1799369 - RNA, 15 nt, Human
ugcaugcugucccuu

SEQ ID NO: 1799370 - RNA, 20 nt, Human
ugcaugaaguaauaugcaca

SEQ ID NO: 1799371 - RNA, 22 nt, Human
ugcaugaaguaauaugcacaca

SEQ ID NO: 1799372 - RNA, 21 nt, Human
ugcaugaggcuaguguggugu

SEQ ID NO: 1799373 - RNA, 23 nt, Human
agccugcaguuauuaacacuaac

SEQ ID NO: 1799374 - RNA, 12 nt, Human
agccugcccucc

SEQ ID NO: 1799375 - RNA, 16 nt, Human
agccugccucuucucu

SEQ ID NO: 1799376 - RNA, 19 nt, Human
agccugccucuucucuacu

SEQ ID NO: 1799377 - RNA, 18 nt, Human
agccugaucaccugcccu

SEQ ID NO: 1799378 - RNA, 16 nt, Human
ugcaugcugucccuua

SEQ ID NO: 1799379 - RNA, 19 nt, Human
agccugaucaccugcccug

SEQ ID NO: 1799380 - RNA, 19 nt, Human
agccugagcgacagugaga

SEQ ID NO: 1799381 - RNA, 19 nt, Human
ugcagccucaaccuccugg

SEQ ID NO: 1799382 - RNA, 18 nt, Human
ugcagccucaaccuccug

SEQ ID NO: 1799383 - RNA, 18 nt, Human
agccugagcgacagugag

SEQ ID NO: 1799384 - RNA, 15 nt, Human
agccucagcauccug

SEQ ID NO: 1799385 - RNA, 16 nt, Human
agccucagcauccugg

SEQ ID NO: 1799386 - RNA, 14 nt, Human
agccucagcauccu

SEQ ID NO: 1799387 - RNA, 13 nt, Human
agccucagcaucc

SEQ ID NO: 1799388 - RNA, 18 nt, Human
agccucaaccuccugggc

SEQ ID NO: 1799389 - RNA, 17 nt, Human
agccucaaccuccuggg

SEQ ID NO: 1799390 - RNA, 21 nt, Human
ugcaggucccuaauaaagcug

SEQ ID NO: 1799391 - RNA, 17 nt, Human
ugcaggucccuaauaaa

SEQ ID NO: 1799392 - RNA, 14 nt, Human
ugcagugagccgag

SEQ ID NO: 1799393 - RNA, 18 nt, Human
ugcaggucccuaauaaag

SEQ ID NO: 1799394 - RNA, 19 nt, Human
ugcaggucccuaauaaagc

SEQ ID NO: 1799395 - RNA, 20 nt, Human
ugcaggucccuaauaaagcu

SEQ ID NO: 1799396 - RNA, 15 nt, Human
ugcauaauggucaga

SEQ ID NO: 1799397 - RNA, 11 nt, Human
ugcauaaaaug

SEQ ID NO: 1799398 - RNA, 12 nt, Human
ugcaguuuuccu

SEQ ID NO: 1799399 - RNA, 19 nt, Human
ugcagugagccgagauugu

SEQ ID NO: 1799400 - RNA, 18 nt, Human
agaagcuaagguuuagau

SEQ ID NO: 1799401 - RNA, 15 nt, Human
agaagcggcuggcag

SEQ ID NO: 1799402 - RNA, 16 nt, Human
agaagcggcuggcagc

SEQ ID NO: 1799403 - RNA, 16 nt, Human
ucuggcagcucagaga

SEQ ID NO: 1799404 - RNA, 12 nt, Human
ucuggauuauau

SEQ ID NO: 1799405 - RNA, 18 nt, Human
ucuggauuauauuaugaa

SEQ ID NO: 1799406 - RNA, 14 nt, Human
ucuggcagcucaga

SEQ ID NO: 1799407 - RNA, 15 nt, Human
ucuggcagcucagag

SEQ ID NO: 1799408 - RNA, 14 nt, Human
ucugcccuccaaga

SEQ ID NO: 1799409 - RNA, 18 nt, Human
ucugcccuccaagaccuu

SEQ ID NO: 1799410 - RNA, 16 nt, Human
ucugcucacauaucug

SEQ ID NO: 1799411 - RNA, 17 nt, Human
ucugcucacauaucugu

SEQ ID NO: 1799412 - RNA, 15 nt, Human
agaacucccuuucaa

SEQ ID NO: 1799413 - RNA, 14 nt, Human
agaacucccuuuca

SEQ ID NO: 1799414 - RNA, 21 nt, Human
agaacucaugacggaagaguu

SEQ ID NO: 1799415 - RNA, 15 nt, Human
ucugcagaaacagaa

SEQ ID NO: 1799416 - RNA, 16 nt, Human
agaaauguacagcaag

SEQ ID NO: 1799417 - RNA, 17 nt, Human
agaaauguacagcaagg

SEQ ID NO: 1799418 - RNA, 11 nt, Human
agaaauguguu

SEQ ID NO: 1799419 - RNA, 12 nt, Human
ucugcagagcag

SEQ ID NO: 1799420 - RNA, 19 nt, Human
ucugacccugcuucaaaua

SEQ ID NO: 1799421 - RNA, 21 nt, Human
ucugauucccaagcucugcuc

SEQ ID NO: 1799422 - RNA, 20 nt, Human
ucugauucccaagcucugcu

SEQ ID NO: 1799423 - RNA, 19 nt, Human
ucugauucccaagcucugc

SEQ ID NO: 1799424 - RNA, 22 nt, Human
ucucuuuaaugucacaggcagg

SEQ ID NO: 1799425 - RNA, 13 nt, Human
ucucuugagccug

SEQ ID NO: 1799426 - RNA, 14 nt, Human
ucucuugagccugg

SEQ ID NO: 1799427 - RNA, 15 nt, Human
ucucuugagccuggg

SEQ ID NO: 1799428 - RNA, 17 nt, Human
ucucuugagccugggag

SEQ ID NO: 1799429 - RNA, 19 nt, Human
agaaaaauaugaccacacu

SEQ ID NO: 1799430 - RNA, 17 nt, Human
agaaaaaugagccuggc

SEQ ID NO: 1799431 - RNA, 15 nt, Human
agaaagaagaugaau

SEQ ID NO: 1799432 - RNA, 15 nt, Human
agaaacuggaacucu

SEQ ID NO: 1799433 - RNA, 13 nt, Human
agaaacuggaacu

SEQ ID NO: 1799434 - RNA, 22 nt, Human
ucucugcccuaaugcgcaggcu

SEQ ID NO: 1799435 - RNA, 11 nt, Human
ucucugcccua

SEQ ID NO: 1799436 - RNA, 17 nt, Human
ucucuggccuucggccu

SEQ ID NO: 1799437 - RNA, 16 nt, Human
ucucuggccuucggcc

SEQ ID NO: 1799438 - RNA, 13 nt, Human
ucucuggccuucg

SEQ ID NO: 1799439 - RNA, 18 nt, Human
ucucuucuggguuccuuc

SEQ ID NO: 1799440 - RNA, 19 nt, Human
ucucuucuggguuccuucc

SEQ ID NO: 1799441 - RNA, 20 nt, Human
ucucuucuggguuccuuccu

SEQ ID NO: 1799442 - RNA, 21 nt, Human
ucucuucuggguuccuuccuc

SEQ ID NO: 1799443 - RNA, 14 nt, Human
ucucuugagagggu

SEQ ID NO: 1799444 - RNA, 20 nt, Human
ucuccuucaccuuugucccc

SEQ ID NO: 1799445 - RNA, 13 nt, Human
ucucuccagcccc

SEQ ID NO: 1799446 - RNA, 14 nt, Human
ucucuccagccccu

SEQ ID NO: 1799447 - RNA, 22 nt, Human
ucucuccuguaccucuugagcc

SEQ ID NO: 1799448 - RNA, 20 nt, Human
ucucuccuguaccucuugag

SEQ ID NO: 1799449 - RNA, 15 nt, Human
ucucuccagccccug

SEQ ID NO: 1799450 - RNA, 19 nt, Human
acuuguugauuaauggaaa

SEQ ID NO: 1799451 - RNA, 21 nt, Human
acuuguugauuaauggaaaug

SEQ ID NO: 1799452 - RNA, 13 nt, Human
ucuccucugcugc

SEQ ID NO: 1799453 - RNA, 14 nt, Human
ucuccucugcugcu

SEQ ID NO: 1799454 - RNA, 12 nt, Human
ucuccucugcug

SEQ ID NO: 1799455 - RNA, 19 nt, Human
ucucccuuggauugucccc

SEQ ID NO: 1799456 - RNA, 21 nt, Human
ucucccuuggauuguccccga

SEQ ID NO: 1799457 - RNA, 18 nt, Human
ucucccaaagugcuggga

SEQ ID NO: 1799458 - RNA, 11 nt, Human
ucucccuugga

SEQ ID NO: 1799459 - RNA, 18 nt, Human
ucucccuuggauuguccc

SEQ ID NO: 1799460 - RNA, 14 nt, Human
acuuuuggcauuuu

SEQ ID NO: 1799461 - RNA, 15 nt, Human
acuuuuuuuuaaguu

SEQ ID NO: 1799462 - RNA, 22 nt, Human
acuuuuuuuuuuuaagaguaaa

SEQ ID NO: 1799463 - RNA, 23 nt, Human
acuuuggaaagacuuuuccaacc

SEQ ID NO: 1799464 - RNA, 17 nt, Human
acuuuggaaagacuuuu

SEQ ID NO: 1799465 - RNA, 19 nt, Human
acuuugaggguguauauuu

SEQ ID NO: 1799466 - RNA, 13 nt, Human
acuuuggaaagac

SEQ ID NO: 1799467 - RNA, 14 nt, Human
acuuuggaaagacu

SEQ ID NO: 1799468 - RNA, 23 nt, Human
acuuugaccucugcagcaauaaa

SEQ ID NO: 1799469 - RNA, 19 nt, Human
acuuugaccucugcagcaa

SEQ ID NO: 1799470 - RNA, 23 nt, Human
acuuuaccuuuuuuauacauaaa

SEQ ID NO: 1799471 - RNA, 22 nt, Human
acuuuaccuuuuuuauacauaa

SEQ ID NO: 1799472 - RNA, 19 nt, Human
acuuuaccuuuuuuauaca

SEQ ID NO: 1799473 - RNA, 18 nt, Human
acuuuaccuuuuuuauac

SEQ ID NO: 1799474 - RNA, 22 nt, Human
ucuuccaggcugggagagccuu

SEQ ID NO: 1799475 - RNA, 17 nt, Human
ucuucaaaaugagcccu

SEQ ID NO: 1799476 - RNA, 22 nt, Human
ucuuauugcccacgcuggagug

SEQ ID NO: 1799477 - RNA, 18 nt, Human
ucuuauugcccacgcugg

SEQ ID NO: 1799478 - RNA, 14 nt, Human
ucuuauugcccacg

SEQ ID NO: 1799479 - RNA, 18 nt, Human
ucuuaugggcuggguucu

SEQ ID NO: 1799480 - RNA, 15 nt, Human
ucuuaugggcugggu

SEQ ID NO: 1799481 - RNA, 16 nt, Human
ucuuaugggcuggguu

SEQ ID NO: 1799482 - RNA, 14 nt, Human
ucuuaugggcuggg

SEQ ID NO: 1799483 - RNA, 23 nt, Human
agacaggcaagcaccuccugccu

SEQ ID NO: 1799484 - RNA, 15 nt, Human
agacaggaccaggga

SEQ ID NO: 1799485 - RNA, 16 nt, Human
agacaggaccagggau

SEQ ID NO: 1799486 - RNA, 21 nt, Human
agacaggguuuugccauguug

SEQ ID NO: 1799487 - RNA, 19 nt, Human
agacaggguuucaccaugu

SEQ ID NO: 1799488 - RNA, 19 nt, Human
agacagucccugccaaugg

SEQ ID NO: 1799489 - RNA, 15 nt, Human
agacagucccugcca

SEQ ID NO: 1799490 - RNA, 16 nt, Human
agacagucccugccaa

SEQ ID NO: 1799491 - RNA, 17 nt, Human
agacagucccugccaau

SEQ ID NO: 1799492 - RNA, 14 nt, Human
agacagacuagaag

SEQ ID NO: 1799493 - RNA, 18 nt, Human
agacagaaucucgcucug

SEQ ID NO: 1799494 - RNA, 22 nt, Human
agacagaaucucgcucugucgc

SEQ ID NO: 1799495 - RNA, 20 nt, Human
ucuguuggccagugugacaa

SEQ ID NO: 1799496 - RNA, 19 nt, Human
ucuguuggccagugugaca

SEQ ID NO: 1799497 - RNA, 18 nt, Human
ucuguuggccagugugac

SEQ ID NO: 1799498 - RNA, 22 nt, Human
ucugugaaaggaaagagggagg

SEQ ID NO: 1799499 - RNA, 24 nt, Human
ucuguccaggcacugcugcccagc

SEQ ID NO: 1799500 - RNA, 15 nt, Human
ucugugaaaggaaag

SEQ ID NO: 1799501 - RNA, 21 nt, Human
ucugugaaaggaaagagggag

SEQ ID NO: 1799502 - RNA, 23 nt, Human
agaauuucccaaagcagugcaug

SEQ ID NO: 1799503 - RNA, 17 nt, Human
agaauuucccaaagcag

SEQ ID NO: 1799504 - RNA, 18 nt, Human
agaauuucccaaagcagu

SEQ ID NO: 1799505 - RNA, 15 nt, Human
ucugucauuugagca

SEQ ID NO: 1799506 - RNA, 23 nt, Human
ucugucauuugagcagggcucag

SEQ ID NO: 1799507 - RNA, 20 nt, Human
ucugucauuugagcagggcu

SEQ ID NO: 1799508 - RNA, 16 nt, Human
ucuggguucacugcaa

SEQ ID NO: 1799509 - RNA, 14 nt, Human
ucuggguucacugc

SEQ ID NO: 1799510 - RNA, 11 nt, Human
ucuggggcugu

SEQ ID NO: 1799511 - RNA, 16 nt, Human
ucuggguuccuuccuc

SEQ ID NO: 1799512 - RNA, 18 nt, Human
ucugguccauagagagca

SEQ ID NO: 1799513 - RNA, 15 nt, Human
ucuuuacuucaugga

SEQ ID NO: 1799514 - RNA, 17 nt, Human
agacucuacagaggcca

SEQ ID NO: 1799515 - RNA, 21 nt, Human
agacucgcgacaaugcaaacc

SEQ ID NO: 1799516 - RNA, 19 nt, Human
agacucuacagaggccaug

SEQ ID NO: 1799517 - RNA, 18 nt, Human
agacuccugcaggcagcc

SEQ ID NO: 1799518 - RNA, 19 nt, Human
agacuccugcaggcagcca

SEQ ID NO: 1799519 - RNA, 20 nt, Human
agacuccugcaggcagccag

SEQ ID NO: 1799520 - RNA, 23 nt, Human
agacuccugcaggcagccaggcc

SEQ ID NO: 1799521 - RNA, 13 nt, Human
ucuuuccugaggc

SEQ ID NO: 1799522 - RNA, 14 nt, Human
ucuuuccugaggcu

SEQ ID NO: 1799523 - RNA, 15 nt, Human
ucuuuccugaggcug

SEQ ID NO: 1799524 - RNA, 16 nt, Human
ucuuuccugaggcugg

SEQ ID NO: 1799525 - RNA, 14 nt, Human
agacuccugcaggc

SEQ ID NO: 1799526 - RNA, 15 nt, Human
agacuccugcaggca

SEQ ID NO: 1799527 - RNA, 16 nt, Human
agacuccugcaggcag

SEQ ID NO: 1799528 - RNA, 17 nt, Human
agacuccugcaggcagc

SEQ ID NO: 1799529 - RNA, 15 nt, Human
agacuuuggaaagac

SEQ ID NO: 1799530 - RNA, 18 nt, Human
agagaaugaaagggccca

SEQ ID NO: 1799531 - RNA, 14 nt, Human
agacuuuggaaaga

SEQ ID NO: 1799532 - RNA, 12 nt, Human
agacuuuggaaa

SEQ ID NO: 1799533 - RNA, 18 nt, Human
agagaccaucccugaagg

SEQ ID NO: 1799534 - RNA, 15 nt, Human
agagaccaucccuga

SEQ ID NO: 1799535 - RNA, 13 nt, Human
agagaccaucccu

SEQ ID NO: 1799536 - RNA, 14 nt, Human
agagaccaucccug

SEQ ID NO: 1799537 - RNA, 14 nt, Human
agacuucaucccuc

SEQ ID NO: 1799538 - RNA, 17 nt, Human
agacuucaucccucugg

SEQ ID NO: 1799539 - RNA, 18 nt, Human
agacucauucuucuguac

SEQ ID NO: 1799540 - RNA, 17 nt, Human
agacucauucuucugua

SEQ ID NO: 1799541 - RNA, 12 nt, Human
agaccugccccu

SEQ ID NO: 1799542 - RNA, 19 nt, Human
agacuaucuaaauguugaa

SEQ ID NO: 1799543 - RNA, 17 nt, Human
agacuaucuaaauguug

SEQ ID NO: 1799544 - RNA, 18 nt, Human
agacuaucuaaauguuga

SEQ ID NO: 1799545 - RNA, 20 nt, Human
ucuugaugccuggcggggug

SEQ ID NO: 1799546 - RNA, 14 nt, Human
ucuugaugccuggc

SEQ ID NO: 1799547 - RNA, 16 nt, Human
ucuugcaauggcagcc

SEQ ID NO: 1799548 - RNA, 13 nt, Human
ucuugcaauggca

SEQ ID NO: 1799549 - RNA, 17 nt, Human
ucuugcaauggcagccu

SEQ ID NO: 1799550 - RNA, 12 nt, Human
agacccugcccu

SEQ ID NO: 1799551 - RNA, 13 nt, Human
agacccugcccug

SEQ ID NO: 1799552 - RNA, 14 nt, Human
agacccugcccugu

SEQ ID NO: 1799553 - RNA, 19 nt, Human
agaccuaacgagaaauaga

SEQ ID NO: 1799554 - RNA, 19 nt, Human
agacccuuguggucccacc

SEQ ID NO: 1799555 - RNA, 20 nt, Human
agacccuuguggucccaccc

SEQ ID NO: 1799556 - RNA, 22 nt, Human
agacccuuguggucccacccca

SEQ ID NO: 1799557 - RNA, 23 nt, Human
agacccuuguggucccaccccac

SEQ ID NO: 1799558 - RNA, 13 nt, Human
agacccuuguggu

SEQ ID NO: 1799559 - RNA, 15 nt, Human
agacccuuguggucc

SEQ ID NO: 1799560 - RNA, 16 nt, Human
agacccugcccugugg

SEQ ID NO: 1799561 - RNA, 19 nt, Human
agacccugcccugugggcc

SEQ ID NO: 1799562 - RNA, 21 nt, Human
agacccugcccugugggcccc

SEQ ID NO: 1799563 - RNA, 23 nt, Human
agacccugcccugugggccccca

SEQ ID NO: 1799564 - RNA, 19 nt, Human
agagugagacucugucuca

SEQ ID NO: 1799565 - RNA, 19 nt, Human
agauaaggguaucugguga

SEQ ID NO: 1799566 - RNA, 18 nt, Human
agauaauucuagcuuuga

SEQ ID NO: 1799567 - RNA, 18 nt, Human
agauaauacaccacuaca

SEQ ID NO: 1799568 - RNA, 19 nt, Human
agauacaggaaaagcugcu

SEQ ID NO: 1799569 - RNA, 22 nt, Human
agauauuuugcuuugugauuuu

SEQ ID NO: 1799570 - RNA, 19 nt, Human
agaucaaccccuucgcucc

SEQ ID NO: 1799571 - RNA, 14 nt, Human
agaucaaccccuuc

SEQ ID NO: 1799572 - RNA, 21 nt, Human
agaucaaccccuucgcuccug

SEQ ID NO: 1799573 - RNA, 22 nt, Human
agagucucacuguugcccaggc

SEQ ID NO: 1799574 - RNA, 14 nt, Human
agagugaacaaauu

SEQ ID NO: 1799575 - RNA, 20 nt, Human
agagucucacuguugcccag

SEQ ID NO: 1799576 - RNA, 16 nt, Human
agagugagacucuguc

SEQ ID NO: 1799577 - RNA, 15 nt, Human
agagugagacucugu

SEQ ID NO: 1799578 - RNA, 22 nt, Human
agagugaacaaauuuacagaga

SEQ ID NO: 1799579 - RNA, 14 nt, Human
ugaaugucagugug

SEQ ID NO: 1799580 - RNA, 15 nt, Human
ugaaugucaguguga

SEQ ID NO: 1799581 - RNA, 18 nt, Human
ugaaugucagugugacug

SEQ ID NO: 1799582 - RNA, 18 nt, Human
ugaagguggaaauaaacu

SEQ ID NO: 1799583 - RNA, 15 nt, Human
ugaaugcauaaaaug

SEQ ID NO: 1799584 - RNA, 16 nt, Human
ugaaugcauaaaaugu

SEQ ID NO: 1799585 - RNA, 18 nt, Human
ugaagauguagaggagaa

SEQ ID NO: 1799586 - RNA, 17 nt, Human
ugaagauguagaggaga

SEQ ID NO: 1799587 - RNA, 22 nt, Human
agagggagggagggcuccagac

SEQ ID NO: 1799588 - RNA, 21 nt, Human
agagggagggagggcuccaga

SEQ ID NO: 1799589 - RNA, 21 nt, Human
agaggcgcaugaauuugugaa

SEQ ID NO: 1799590 - RNA, 19 nt, Human
agagcugggugucaagagg

SEQ ID NO: 1799591 - RNA, 21 nt, Human
ugaagacaaugacuuacugua

SEQ ID NO: 1799592 - RNA, 15 nt, Human
agagcuucuggcacu

SEQ ID NO: 1799593 - RNA, 19 nt, Human
agagcuucuguugcugccu

SEQ ID NO: 1799594 - RNA, 20 nt, Human
agagcuucuguugcugccuc

SEQ ID NO: 1799595 - RNA, 21 nt, Human
agagcuucuguugcugccuca

SEQ ID NO: 1799596 - RNA, 12 nt, Human
agaggaaagcaa

SEQ ID NO: 1799597 - RNA, 16 nt, Human
agaggaaagcaaagga

SEQ ID NO: 1799598 - RNA, 18 nt, Human
agaggaaagcaaaggaga

SEQ ID NO: 1799599 - RNA, 19 nt, Human
agaggaaagcaaaggagau

SEQ ID NO: 1799600 - RNA, 11 nt, Human
agaggaaauca

SEQ ID NO: 1799601 - RNA, 12 nt, Human
agaggaaaucac

SEQ ID NO: 1799602 - RNA, 21 nt, Human
agaggaaaucaccgaaaacgu

SEQ ID NO: 1799603 - RNA, 18 nt, Human
agaggcaacugcauuggc

SEQ ID NO: 1799604 - RNA, 13 nt, Human
ucuuuguaaugaa

SEQ ID NO: 1799605 - RNA, 15 nt, Human
ucuuuguaaugaaaa

SEQ ID NO: 1799606 - RNA, 11 nt, Human
ugaacuuugac

SEQ ID NO: 1799607 - RNA, 12 nt, Human
ucuuuguaauga

SEQ ID NO: 1799608 - RNA, 14 nt, Human
ucuuuggucuacac

SEQ ID NO: 1799609 - RNA, 21 nt, Human
ucuuuggucuacacugugcug

SEQ ID NO: 1799610 - RNA, 17 nt, Human
ugaacuuugaccucugc

SEQ ID NO: 1799611 - RNA, 16 nt, Human
ugaacuuugaccucug

SEQ ID NO: 1799612 - RNA, 17 nt, Human
ugaagacaaugacuuac

SEQ ID NO: 1799613 - RNA, 13 nt, Human
ugaagacaaugac

SEQ ID NO: 1799614 - RNA, 11 nt, Human
ugaagacaaug

SEQ ID NO: 1799615 - RNA, 18 nt, Human
agaugcuucucacugcca

SEQ ID NO: 1799616 - RNA, 16 nt, Human
agaugcuucucacugc

SEQ ID NO: 1799617 - RNA, 23 nt, Human
agaugcuagaacucccuuucaac

SEQ ID NO: 1799618 - RNA, 14 nt, Human
ugaccucugccuga

SEQ ID NO: 1799619 - RNA, 23 nt, Human
ugaccccucauagcccucacccu

SEQ ID NO: 1799620 - RNA, 12 nt, Human
ugaccugaggcc

SEQ ID NO: 1799621 - RNA, 13 nt, Human
ugaccucugccug

SEQ ID NO: 1799622 - RNA, 19 nt, Human
ugaccccucauagcccuca

SEQ ID NO: 1799623 - RNA, 20 nt, Human
ugaccccucauagcccucac

SEQ ID NO: 1799624 - RNA, 17 nt, Human
ugaccccucauagcccu

SEQ ID NO: 1799625 - RNA, 22 nt, Human
ugacccccaaccaaguggcucc

SEQ ID NO: 1799626 - RNA, 15 nt, Human
agauguguucacaau

SEQ ID NO: 1799627 - RNA, 18 nt, Human
agauguguucacaaugga

SEQ ID NO: 1799628 - RNA, 12 nt, Human
ugacccaugcug

SEQ ID NO: 1799629 - RNA, 18 nt, Human
ugacauuguagagcuucu

SEQ ID NO: 1799630 - RNA, 12 nt, Human
ugaccacacucc

SEQ ID NO: 1799631 - RNA, 17 nt, Human
ugaccacacuccagcug

SEQ ID NO: 1799632 - RNA, 19 nt, Human
ugaccacacuccagcuggg

SEQ ID NO: 1799633 - RNA, 20 nt, Human
ugaccacacuccagcuggga

SEQ ID NO: 1799634 - RNA, 21 nt, Human
agaucauugugaaauuauuca

SEQ ID NO: 1799635 - RNA, 16 nt, Human
agauucaaucccagga

SEQ ID NO: 1799636 - RNA, 20 nt, Human
agauuauaggcaccuaccac

SEQ ID NO: 1799637 - RNA, 17 nt, Human
ugacuccagaauuuccc

SEQ ID NO: 1799638 - RNA, 19 nt, Human
ugacuccagaauuucccaa

SEQ ID NO: 1799639 - RNA, 17 nt, Human
ugaccugaggcccuucu

SEQ ID NO: 1799640 - RNA, 14 nt, Human
ugaccugaggcccu

SEQ ID NO: 1799641 - RNA, 15 nt, Human
ugaccugaggcccuu

SEQ ID NO: 1799642 - RNA, 20 nt, Human
ugacuccagaauuucccaaa

SEQ ID NO: 1799643 - RNA, 23 nt, Human
ugacuccagaauuucccaaagca

SEQ ID NO: 1799644 - RNA, 21 nt, Human
ugacuuauuuauauaaauuuu

SEQ ID NO: 1799645 - RNA, 20 nt, Human
ugacuuauuuauauaaauuu

SEQ ID NO: 1799646 - RNA, 21 nt, Human
ugacugugguagccagcaucg

SEQ ID NO: 1799647 - RNA, 21 nt, Human
agauugugccccugcacucca

SEQ ID NO: 1799648 - RNA, 16 nt, Human
agauugugccccugca

SEQ ID NO: 1799649 - RNA, 14 nt, Human
agauuuaugcauau

SEQ ID NO: 1799650 - RNA, 13 nt, Human
agauuucacucuc

SEQ ID NO: 1799651 - RNA, 14 nt, Human
agauuucacucucc

SEQ ID NO: 1799652 - RNA, 21 nt, Human
agcaaaaccaaauauuccaga

SEQ ID NO: 1799653 - RNA, 23 nt, Human
ugagccacugcaccgggccacag

SEQ ID NO: 1799654 - RNA, 13 nt, Human
ugagccagauuuc

SEQ ID NO: 1799655 - RNA, 14 nt, Human
ugagccagauuuca

SEQ ID NO: 1799656 - RNA, 16 nt, Human
ugagccagauuucacu

SEQ ID NO: 1799657 - RNA, 18 nt, Human
ugagccacugcaccgggc

SEQ ID NO: 1799658 - RNA, 21 nt, Human
ugagccacugcaccgggccac

SEQ ID NO: 1799659 - RNA, 18 nt, Human
ugagccaccgugccuggc

SEQ ID NO: 1799660 - RNA, 19 nt, Human
ugagccaccgugccuggcc

SEQ ID NO: 1799661 - RNA, 20 nt, Human
ugagccaccgugccuggcca

SEQ ID NO: 1799662 - RNA, 21 nt, Human
ugagccaccgugccuggccac

SEQ ID NO: 1799663 - RNA, 15 nt, Human
ugagccaccacgccc

SEQ ID NO: 1799664 - RNA, 14 nt, Human
ugagccaccgugcc

SEQ ID NO: 1799665 - RNA, 22 nt, Human
ugagcaucaggccaggcccucu

SEQ ID NO: 1799666 - RNA, 24 nt, Human
ugagcaucaggccaggcccucugc

SEQ ID NO: 1799667 - RNA, 21 nt, Human
ugagcaucaggccaggcccuc

SEQ ID NO: 1799668 - RNA, 23 nt, Human
ugagcacuaaggugugcucugau

SEQ ID NO: 1799669 - RNA, 22 nt, Human
ugagcacuaaggugugcucuga

SEQ ID NO: 1799670 - RNA, 21 nt, Human
ugagcacuaaggugugcucug

SEQ ID NO: 1799671 - RNA, 20 nt, Human
ugagcacuaaggugugcucu

SEQ ID NO: 1799672 - RNA, 16 nt, Human
ugagcaaauguggcuc

SEQ ID NO: 1799673 - RNA, 18 nt, Human
ugagcaaauguggcuccu

SEQ ID NO: 1799674 - RNA, 19 nt, Human
ugagcaaauguggcuccug

SEQ ID NO: 1799675 - RNA, 15 nt, Human
ugagcaauccugcaa

SEQ ID NO: 1799676 - RNA, 16 nt, Human
agcacagcuucauuuc

SEQ ID NO: 1799677 - RNA, 13 nt, Human
agcacaugccucu

SEQ ID NO: 1799678 - RNA, 14 nt, Human
agcacaugccucuc

SEQ ID NO: 1799679 - RNA, 16 nt, Human
agcacaugccucucuc

SEQ ID NO: 1799680 - RNA, 13 nt, Human
agcaagugagagc

SEQ ID NO: 1799681 - RNA, 20 nt, Human
agcaagugagacccugucuc

SEQ ID NO: 1799682 - RNA, 17 nt, Human
ugagccagauuucacuc

SEQ ID NO: 1799683 - RNA, 22 nt, Human
ugagccagauuucacucuccuu

SEQ ID NO: 1799684 - RNA, 14 nt, Human
agcaagugagagcu

SEQ ID NO: 1799685 - RNA, 18 nt, Human
agcaagugagagcugggu

SEQ ID NO: 1799686 - RNA, 22 nt, Human
agcaagugagagcuggguguca

SEQ ID NO: 1799687 - RNA, 21 nt, Human
agcacagcagccccugcacaa

SEQ ID NO: 1799688 - RNA, 22 nt, Human
agcacuuugggaggccaaggug

SEQ ID NO: 1799689 - RNA, 23 nt, Human
agcacuuugggaggccaaggugg

SEQ ID NO: 1799690 - RNA, 13 nt, Human
agcagaaaugccu

SEQ ID NO: 1799691 - RNA, 12 nt, Human
agcagaaaugcc

SEQ ID NO: 1799692 - RNA, 19 nt, Human
agcagaaaugccuuacccu

SEQ ID NO: 1799693 - RNA, 14 nt, Human
agcagaacagugau

SEQ ID NO: 1799694 - RNA, 23 nt, Human
agcaccuuagacagucccugcca

SEQ ID NO: 1799695 - RNA, 13 nt, Human
agcacgauuucug

SEQ ID NO: 1799696 - RNA, 15 nt, Human
agcacgauuucuguu

SEQ ID NO: 1799697 - RNA, 14 nt, Human
agcacgauuucugu

SEQ ID NO: 1799698 - RNA, 16 nt, Human
agcacgauuucuguuu

SEQ ID NO: 1799699 - RNA, 10 nt, Human
agcaccaggg

SEQ ID NO: 1799700 - RNA, 12 nt, Human
agcaccagggaa

SEQ ID NO: 1799701 - RNA, 13 nt, Human
agcaccagggaag

SEQ ID NO: 1799702 - RNA, 19 nt, Human
agcaccuuagacagucccu

SEQ ID NO: 1799703 - RNA, 20 nt, Human
agcaccuuagacagucccug

SEQ ID NO: 1799704 - RNA, 21 nt, Human
agcaccuuagacagucccugc

SEQ ID NO: 1799705 - RNA, 22 nt, Human
agcaccuuagacagucccugcc

SEQ ID NO: 1799706 - RNA, 14 nt, Human
ugagccugggaggu

SEQ ID NO: 1799707 - RNA, 11 nt, Human
ugagccuggca

SEQ ID NO: 1799708 - RNA, 16 nt, Human
ugagccuggcaagaau

SEQ ID NO: 1799709 - RNA, 19 nt, Human
ugagccugggaggucaagg

SEQ ID NO: 1799710 - RNA, 22 nt, Human
ugagccugggaggucaaggcug

SEQ ID NO: 1799711 - RNA, 14 nt, Human
ugagccuugaacuu

SEQ ID NO: 1799712 - RNA, 19 nt, Human
ugagccuugaacuuugacc

SEQ ID NO: 1799713 - RNA, 18 nt, Human
ugagccuugaacuuugac

SEQ ID NO: 1799714 - RNA, 17 nt, Human
ugagccuugaacuuuga

SEQ ID NO: 1799715 - RNA, 15 nt, Human
ugagccuugaacuuu

SEQ ID NO: 1799716 - RNA, 20 nt, Human
ugagcgacagugagacucug

SEQ ID NO: 1799717 - RNA, 16 nt, Human
ugagcgacagugagac

SEQ ID NO: 1799718 - RNA, 14 nt, Human
ugagcgacagugag

SEQ ID NO: 1799719 - RNA, 13 nt, Human
ugagcgacaguga

SEQ ID NO: 1799720 - RNA, 23 nt, Human
agcagagaaugaaagggcccaga

SEQ ID NO: 1799721 - RNA, 22 nt, Human
agcagagaaugaaagggcccag

SEQ ID NO: 1799722 - RNA, 14 nt, Human
agcagagaauucuc

SEQ ID NO: 1799723 - RNA, 21 nt, Human
agcagagaauucucuuaucca

SEQ ID NO: 1799724 - RNA, 15 nt, Human
agcagagaccauccc

SEQ ID NO: 1799725 - RNA, 16 nt, Human
agcagagaccaucccu

SEQ ID NO: 1799726 - RNA, 10 nt, Human
ugagccuggc

SEQ ID NO: 1799727 - RNA, 21 nt, Human
agcagagaaugaaagggccca

SEQ ID NO: 1799728 - RNA, 15 nt, Human
ugaggaagcaaaagc

SEQ ID NO: 1799729 - RNA, 22 nt, Human
ugaggaagcaaaagcaucuaug

SEQ ID NO: 1799730 - RNA, 14 nt, Human
ugaggaagccgcug

SEQ ID NO: 1799731 - RNA, 17 nt, Human
ugaggaagccgcugggg

SEQ ID NO: 1799732 - RNA, 18 nt, Human
ugaggaagccgcuggggc

SEQ ID NO: 1799733 - RNA, 19 nt, Human
ugaggaagccgcuggggcc

SEQ ID NO: 1799734 - RNA, 21 nt, Human
ugaggaagccgcuggggccag

SEQ ID NO: 1799735 - RNA, 13 nt, Human
ugagcuacaaaug

SEQ ID NO: 1799736 - RNA, 14 nt, Human
ugagcuacaaaugc

SEQ ID NO: 1799737 - RNA, 16 nt, Human
ugagcuacaaaugcau

SEQ ID NO: 1799738 - RNA, 14 nt, Human
ugagcuaggaauug

SEQ ID NO: 1799739 - RNA, 22 nt, Human
ugaggaauccagacccggcugc

SEQ ID NO: 1799740 - RNA, 21 nt, Human
ugaggaauccagacccggcug

SEQ ID NO: 1799741 - RNA, 22 nt, Human
ugaggacaagagaaaaaagcca

SEQ ID NO: 1799742 - RNA, 13 nt, Human
ugaggacaagaga

SEQ ID NO: 1799743 - RNA, 21 nt, Human
ugaggacacuaaccacgcugg

SEQ ID NO: 1799744 - RNA, 12 nt, Human
ugaggccagaga

SEQ ID NO: 1799745 - RNA, 12 nt, Human
ugaggcccagag

SEQ ID NO: 1799746 - RNA, 13 nt, Human
ugaggcccagagg

SEQ ID NO: 1799747 - RNA, 20 nt, Human
ugaggccagagacacaagcc

SEQ ID NO: 1799748 - RNA, 14 nt, Human
ugaggccagagaca

SEQ ID NO: 1799749 - RNA, 16 nt, Human
ugaggccagagacaca

SEQ ID NO: 1799750 - RNA, 23 nt, Human
ugaggcccagagggccugcaagg

SEQ ID NO: 1799751 - RNA, 21 nt, Human
ugaggcccagagggccugcaa

SEQ ID NO: 1799752 - RNA, 22 nt, Human
ugaggcccagagggccugcaag

SEQ ID NO: 1799753 - RNA, 15 nt, Human
ugaggcccagagggc

SEQ ID NO: 1799754 - RNA, 17 nt, Human
ugaggcccagagggccu

SEQ ID NO: 1799755 - RNA, 18 nt, Human
ugaggcccagagggccug

SEQ ID NO: 1799756 - RNA, 20 nt, Human
ugaggcccagagggccugca

SEQ ID NO: 1799757 - RNA, 17 nt, Human
agcagaggaaggagagg

SEQ ID NO: 1799758 - RNA, 19 nt, Human
agcagauggagaccccuug

SEQ ID NO: 1799759 - RNA, 20 nt, Human
ugaggguugggcugguguca

SEQ ID NO: 1799760 - RNA, 17 nt, Human
ugagguacugagaguga

SEQ ID NO: 1799761 - RNA, 13 nt, Human
ugaggucagagcc

SEQ ID NO: 1799762 - RNA, 22 nt, Human
ugagguacugagagugaacaaa

SEQ ID NO: 1799763 - RNA, 16 nt, Human
ugaggucagagccugc

SEQ ID NO: 1799764 - RNA, 14 nt, Human
ugaggucagagccu

SEQ ID NO: 1799765 - RNA, 17 nt, Human
ugaggucagagccugca

SEQ ID NO: 1799766 - RNA, 17 nt, Human
agcagagaccaucccug

SEQ ID NO: 1799767 - RNA, 18 nt, Human
agcagagaccaucccuga

SEQ ID NO: 1799768 - RNA, 19 nt, Human
agcagagaccaucccugaa

SEQ ID NO: 1799769 - RNA, 19 nt, Human
ugagguacaaccuguucug

SEQ ID NO: 1799770 - RNA, 20 nt, Human
agcagagaccaucccugaag

SEQ ID NO: 1799771 - RNA, 20 nt, Human
agcagagcaccuuagacagu

SEQ ID NO: 1799772 - RNA, 13 nt, Human
ugaggggccucuu

SEQ ID NO: 1799773 - RNA, 14 nt, Human
ugaggguaaguauu

SEQ ID NO: 1799774 - RNA, 12 nt, Human
ugaggggccucu

SEQ ID NO: 1799775 - RNA, 15 nt, Human
ugagggauuaucuuu

SEQ ID NO: 1799776 - RNA, 19 nt, Human
ugagggauacccaucccau

SEQ ID NO: 1799777 - RNA, 16 nt, Human
ugaggcccuucucucc

SEQ ID NO: 1799778 - RNA, 18 nt, Human
ugaggcccuucucuccag

SEQ ID NO: 1799779 - RNA, 19 nt, Human
ugaggcccuucucuccagc

SEQ ID NO: 1799780 - RNA, 20 nt, Human
ugaggcccuucucuccagcc

SEQ ID NO: 1799781 - RNA, 22 nt, Human
ugaggcccuucucuccagcccc

SEQ ID NO: 1799782 - RNA, 23 nt, Human
ugaggcccuucucuccagccccu

SEQ ID NO: 1799783 - RNA, 24 nt, Human
ugaggcccuucucuccagccccug

SEQ ID NO: 1799784 - RNA, 14 nt, Human
accacaucuugcuc

SEQ ID NO: 1799785 - RNA, 22 nt, Human
accacagacauacuaaccagca

SEQ ID NO: 1799786 - RNA, 21 nt, Human
accacagacauacuaaccagc

SEQ ID NO: 1799787 - RNA, 24 nt, Human
accacaucuugcucugcugacaga

SEQ ID NO: 1799788 - RNA, 21 nt, Human
accacaucuugcucugcugac

SEQ ID NO: 1799789 - RNA, 20 nt, Human
accacaucuugcucugcuga

SEQ ID NO: 1799790 - RNA, 16 nt, Human
accacaucuugcucug

SEQ ID NO: 1799791 - RNA, 20 nt, Human
accacucuaucaaguauuau

SEQ ID NO: 1799792 - RNA, 15 nt, Human
accacuucagcugac

SEQ ID NO: 1799793 - RNA, 13 nt, Human
accacuucagcug

SEQ ID NO: 1799794 - RNA, 14 nt, Human
accacuucagcuga

SEQ ID NO: 1799795 - RNA, 19 nt, Human
accacugcagaagacagua

SEQ ID NO: 1799796 - RNA, 14 nt, Human
accacugcagaaga

SEQ ID NO: 1799797 - RNA, 13 nt, Human
accacugcagaag

SEQ ID NO: 1799798 - RNA, 17 nt, Human
accagacaccuugacag

SEQ ID NO: 1799799 - RNA, 12 nt, Human
accacuuuuguu

SEQ ID NO: 1799800 - RNA, 23 nt, Human
accagacaccuugacagggcaca

SEQ ID NO: 1799801 - RNA, 22 nt, Human
accagacaccuugacagggcac

SEQ ID NO: 1799802 - RNA, 11 nt, Human
accagacaggu

SEQ ID NO: 1799803 - RNA, 22 nt, Human
accagagcccaccuuggcucaa

SEQ ID NO: 1799804 - RNA, 19 nt, Human
accagagcccaccuuggcu

SEQ ID NO: 1799805 - RNA, 23 nt, Human
ucaccugaagacucauucuucug

SEQ ID NO: 1799806 - RNA, 19 nt, Human
ucaccugaagacucauucu

SEQ ID NO: 1799807 - RNA, 13 nt, Human
ucaccucccccau

SEQ ID NO: 1799808 - RNA, 15 nt, Human
ucaccucccccaucu

SEQ ID NO: 1799809 - RNA, 19 nt, Human
accaggcaacuugggaacu

SEQ ID NO: 1799810 - RNA, 21 nt, Human
accaguguuguggauuuaaca

SEQ ID NO: 1799811 - RNA, 12 nt, Human
accagugccuua

SEQ ID NO: 1799812 - RNA, 18 nt, Human
ucacuguugcccaggcug

SEQ ID NO: 1799813 - RNA, 17 nt, Human
ucacuguugcccaggcu

SEQ ID NO: 1799814 - RNA, 19 nt, Human
ucacuguugcccaggcugg

SEQ ID NO: 1799815 - RNA, 12 nt, Human
ucacugcagccu

SEQ ID NO: 1799816 - RNA, 13 nt, Human
ucacugcagccuc

SEQ ID NO: 1799817 - RNA, 20 nt, Human
ucacugcacagugcaucuca

SEQ ID NO: 1799818 - RNA, 22 nt, Human
ucacugcacagugcaucucagc

SEQ ID NO: 1799819 - RNA, 24 nt, Human
ucacugcacagugcaucucagccc

SEQ ID NO: 1799820 - RNA, 16 nt, Human
ucacuguugcccaggc

SEQ ID NO: 1799821 - RNA, 16 nt, Human
ucaccugccccucaac

SEQ ID NO: 1799822 - RNA, 13 nt, Human
ucacugagacagc

SEQ ID NO: 1799823 - RNA, 14 nt, Human
ucacugagacagcc

SEQ ID NO: 1799824 - RNA, 15 nt, Human
ucacugagacagccc

SEQ ID NO: 1799825 - RNA, 23 nt, Human
accauuuugggguacccacugcu

SEQ ID NO: 1799826 - RNA, 15 nt, Human
acccaaaaggcagaa

SEQ ID NO: 1799827 - RNA, 13 nt, Human
acccaaaaggcag

SEQ ID NO: 1799828 - RNA, 15 nt, Human
accauuccccauggg

SEQ ID NO: 1799829 - RNA, 12 nt, Human
accauuccccau

SEQ ID NO: 1799830 - RNA, 23 nt, Human
accaugauuaaccacuucagcug

SEQ ID NO: 1799831 - RNA, 22 nt, Human
accaugauuaaccacuucagcu

SEQ ID NO: 1799832 - RNA, 13 nt, Human
accauucuccacc

SEQ ID NO: 1799833 - RNA, 16 nt, Human
accauucuccaccugc

SEQ ID NO: 1799834 - RNA, 18 nt, Human
accauucuccaccugcca

SEQ ID NO: 1799835 - RNA, 19 nt, Human
acccacuugcuuuuaaaau

SEQ ID NO: 1799836 - RNA, 16 nt, Human
acccagaagaaaauag

SEQ ID NO: 1799837 - RNA, 18 nt, Human
acccaaaaggcagaagca

SEQ ID NO: 1799838 - RNA, 21 nt, Human
acccaaauguucaucaaugaa

SEQ ID NO: 1799839 - RNA, 18 nt, Human
acccagcccacuucugcc

SEQ ID NO: 1799840 - RNA, 17 nt, Human
acccagcccacuucugc

SEQ ID NO: 1799841 - RNA, 16 nt, Human
acccagcccacuucug

SEQ ID NO: 1799842 - RNA, 18 nt, Human
ucagcggggacagcuccu

SEQ ID NO: 1799843 - RNA, 17 nt, Human
ucagcggggacagcucc

SEQ ID NO: 1799844 - RNA, 16 nt, Human
ucagcggggacagcuc

SEQ ID NO: 1799845 - RNA, 15 nt, Human
ucagcggggacagcu

SEQ ID NO: 1799846 - RNA, 20 nt, Human
ucaggccaaacucaccugcc

SEQ ID NO: 1799847 - RNA, 23 nt, Human
ucaggccaaacucaccugccccu

SEQ ID NO: 1799848 - RNA, 16 nt, Human
ucaggaagcucagggc

SEQ ID NO: 1799849 - RNA, 17 nt, Human
ucaggaagcucagggcc

SEQ ID NO: 1799850 - RNA, 19 nt, Human
ucaggaagcucagggccug

SEQ ID NO: 1799851 - RNA, 20 nt, Human
ucaggaagcucagggccugg

SEQ ID NO: 1799852 - RNA, 19 nt, Human
accccuucgcuccuguguc

SEQ ID NO: 1799853 - RNA, 16 nt, Human
ucagguaacaggcaga

SEQ ID NO: 1799854 - RNA, 15 nt, Human
ucagguaacaggcag

SEQ ID NO: 1799855 - RNA, 13 nt, Human
ucagguaacaggc

SEQ ID NO: 1799856 - RNA, 13 nt, Human
ucagggucccugg

SEQ ID NO: 1799857 - RNA, 14 nt, Human
ucagggucccuggu

SEQ ID NO: 1799858 - RNA, 18 nt, Human
ucagggucccugguggca

SEQ ID NO: 1799859 - RNA, 15 nt, Human
ucaggccagcugcuu

SEQ ID NO: 1799860 - RNA, 20 nt, Human
ucaggccagcugcuugggcu

SEQ ID NO: 1799861 - RNA, 11 nt, Human
ucaggccaggc

SEQ ID NO: 1799862 - RNA, 12 nt, Human
ucaggccaggcc

SEQ ID NO: 1799863 - RNA, 14 nt, Human
acccucuuagaaaa

SEQ ID NO: 1799864 - RNA, 14 nt, Human
acccugcccugugg

SEQ ID NO: 1799865 - RNA, 13 nt, Human
acccugcccugug

SEQ ID NO: 1799866 - RNA, 11 nt, Human
acccugcccug

SEQ ID NO: 1799867 - RNA, 12 nt, Human
acccugcccugu

SEQ ID NO: 1799868 - RNA, 16 nt, Human
acccuuguggucccac

SEQ ID NO: 1799869 - RNA, 17 nt, Human
acccuuguggucccacc

SEQ ID NO: 1799870 - RNA, 19 nt, Human
acccuuguggucccacccc

SEQ ID NO: 1799871 - RNA, 20 nt, Human
accccuucgcuccugugucu

SEQ ID NO: 1799872 - RNA, 13 nt, Human
ucagaagacacug

SEQ ID NO: 1799873 - RNA, 13 nt, Human
ucagaucuucugu

SEQ ID NO: 1799874 - RNA, 13 nt, Human
acccagcucuggu

SEQ ID NO: 1799875 - RNA, 15 nt, Human
acccagcucuggucc

SEQ ID NO: 1799876 - RNA, 18 nt, Human
ucagcccucccugccccu

SEQ ID NO: 1799877 - RNA, 19 nt, Human
ucagcccucccugccccuc

SEQ ID NO: 1799878 - RNA, 15 nt, Human
acccccagccugcua

SEQ ID NO: 1799879 - RNA, 16 nt, Human
acccccaaauuuucuu

SEQ ID NO: 1799880 - RNA, 14 nt, Human
acccccagccugcu

SEQ ID NO: 1799881 - RNA, 15 nt, Human
accccuggcuuuuca

SEQ ID NO: 1799882 - RNA, 17 nt, Human
accccuggcuuuucacu

SEQ ID NO: 1799883 - RNA, 19 nt, Human
ucagccuggcuucaaauug

SEQ ID NO: 1799884 - RNA, 10 nt, Human
ucagccuggg

SEQ ID NO: 1799885 - RNA, 12 nt, Human
ucagccugggca

SEQ ID NO: 1799886 - RNA, 12 nt, Human
accccuggcuuu

SEQ ID NO: 1799887 - RNA, 13 nt, Human
accuagccuuaga

SEQ ID NO: 1799888 - RNA, 20 nt, Human
accuccgccucuuggguuca

SEQ ID NO: 1799889 - RNA, 10 nt, Human
acccuuuucu

SEQ ID NO: 1799890 - RNA, 20 nt, Human
ucauauuuacuucuuauaca

SEQ ID NO: 1799891 - RNA, 21 nt, Human
ucauauuuacuucuuauacau

SEQ ID NO: 1799892 - RNA, 22 nt, Human
ucauauuuacuucuuauacauu

SEQ ID NO: 1799893 - RNA, 18 nt, Human
accgagucucuucuccac

SEQ ID NO: 1799894 - RNA, 17 nt, Human
accgccaaggcuggggg

SEQ ID NO: 1799895 - RNA, 20 nt, Human
accgagucucuucuccacug

SEQ ID NO: 1799896 - RNA, 21 nt, Human
accgagucucuucuccacugg

SEQ ID NO: 1799897 - RNA, 24 nt, Human
accgagucucuucuccacuggaug

SEQ ID NO: 1799898 - RNA, 20 nt, Human
accgcagacaggaccaggga

SEQ ID NO: 1799899 - RNA, 13 nt, Human
accucucccuugg

SEQ ID NO: 1799900 - RNA, 14 nt, Human
accucucccuugga

SEQ ID NO: 1799901 - RNA, 15 nt, Human
accucucccuuggau

SEQ ID NO: 1799902 - RNA, 12 nt, Human
accucugcacaa

SEQ ID NO: 1799903 - RNA, 23 nt, Human
accucucccuuggauuguccccg

SEQ ID NO: 1799904 - RNA, 14 nt, Human
accucucucacucc

SEQ ID NO: 1799905 - RNA, 19 nt, Human
accucucucacuccuugaa

SEQ ID NO: 1799906 - RNA, 17 nt, Human
accucggugccuuccuc

SEQ ID NO: 1799907 - RNA, 23 nt, Human
ucauucgcuacuaugauuuaauu

SEQ ID NO: 1799908 - RNA, 21 nt, Human
ucauucuccuuguguuacuaa

SEQ ID NO: 1799909 - RNA, 22 nt, Human
ucauugaccugaggcccuucuc

SEQ ID NO: 1799910 - RNA, 13 nt, Human
ucaugucuggcua

SEQ ID NO: 1799911 - RNA, 14 nt, Human
ucaugugaaaucau

SEQ ID NO: 1799912 - RNA, 17 nt, Human
ucauguucuuaauucuu

SEQ ID NO: 1799913 - RNA, 11 nt, Human
ucauguucuua

SEQ ID NO: 1799914 - RNA, 23 nt, Human
ucauccacugugccaugugccag

SEQ ID NO: 1799915 - RNA, 21 nt, Human
ucauccacugugccaugugcc

SEQ ID NO: 1799916 - RNA, 19 nt, Human
ucauccacugugccaugug

SEQ ID NO: 1799917 - RNA, 19 nt, Human
ucaugacaaagacugagua

SEQ ID NO: 1799918 - RNA, 12 nt, Human
accuucuccuuc

SEQ ID NO: 1799919 - RNA, 14 nt, Human
accuugacagggca

SEQ ID NO: 1799920 - RNA, 15 nt, Human
accuugaaugaugcc

SEQ ID NO: 1799921 - RNA, 15 nt, Human
accuugacagggcac

SEQ ID NO: 1799922 - RNA, 16 nt, Human
accuugacagggcaca

SEQ ID NO: 1799923 - RNA, 13 nt, Human
accuucuguggcu

SEQ ID NO: 1799924 - RNA, 15 nt, Human
accuucuguggcuca

SEQ ID NO: 1799925 - RNA, 16 nt, Human
accuucuguggcucac

SEQ ID NO: 1799926 - RNA, 12 nt, Human
accuucuguggc

SEQ ID NO: 1799927 - RNA, 13 nt, Human
accuucuccuuca

SEQ ID NO: 1799928 - RNA, 22 nt, Human
accuggucacaggacucugccu

SEQ ID NO: 1799929 - RNA, 23 nt, Human
accuggucacaggacucugccuc

SEQ ID NO: 1799930 - RNA, 15 nt, Human
uccaccaucaagcca

SEQ ID NO: 1799931 - RNA, 14 nt, Human
accuuagccugccc

SEQ ID NO: 1799932 - RNA, 17 nt, Human
accuuagacagucccug

SEQ ID NO: 1799933 - RNA, 14 nt, Human
uccagacccggcug

SEQ ID NO: 1799934 - RNA, 15 nt, Human
uccagccccuggaug

SEQ ID NO: 1799935 - RNA, 15 nt, Human
uccagaccccuggcu

SEQ ID NO: 1799936 - RNA, 16 nt, Human
uccagaccccuggcuu

SEQ ID NO: 1799937 - RNA, 17 nt, Human
uccagaccccuggcuuu

SEQ ID NO: 1799938 - RNA, 18 nt, Human
uccagaccccuggcuuuu

SEQ ID NO: 1799939 - RNA, 16 nt, Human
uccagccccuggaugc

SEQ ID NO: 1799940 - RNA, 17 nt, Human
uccagccccuggaugca

SEQ ID NO: 1799941 - RNA, 19 nt, Human
uccagccccuggaugcagc

SEQ ID NO: 1799942 - RNA, 21 nt, Human
uccagccccuggaugcagccu

SEQ ID NO: 1799943 - RNA, 23 nt, Human
uccagaccccuggcuuuucacug

SEQ ID NO: 1799944 - RNA, 22 nt, Human
uccagccccuggaugcagccuc

SEQ ID NO: 1799945 - RNA, 20 nt, Human
uccagccugagcgacaguga

SEQ ID NO: 1799946 - RNA, 21 nt, Human
uccagccugagcgacagugag

SEQ ID NO: 1799947 - RNA, 19 nt, Human
accuuuguauucucuccug

SEQ ID NO: 1799948 - RNA, 15 nt, Human
accuuuguauucucu

SEQ ID NO: 1799949 - RNA, 23 nt, Human
accuuuguauucucuccuguacc

SEQ ID NO: 1799950 - RNA, 22 nt, Human
uccagaaguuugagaucagccu

SEQ ID NO: 1799951 - RNA, 19 nt, Human
ucauuugagcagggcucag

SEQ ID NO: 1799952 - RNA, 17 nt, Human
accuggaauauauaacc

SEQ ID NO: 1799953 - RNA, 14 nt, Human
accuggaauauaua

SEQ ID NO: 1799954 - RNA, 19 nt, Human
accugcucuccucuugcca

SEQ ID NO: 1799955 - RNA, 18 nt, Human
accugcucuccucuugcc

SEQ ID NO: 1799956 - RNA, 17 nt, Human
accugcucuccucuugc

SEQ ID NO: 1799957 - RNA, 23 nt, Human
accugcggugcuaucucccccag

SEQ ID NO: 1799958 - RNA, 19 nt, Human
accugcggugcuaucuccc

SEQ ID NO: 1799959 - RNA, 22 nt, Human
accugcggugcuaucuccccca

SEQ ID NO: 1799960 - RNA, 15 nt, Human
accugaagucuuugu

SEQ ID NO: 1799961 - RNA, 22 nt, Human
accugaagucuuuguacagaca

SEQ ID NO: 1799962 - RNA, 18 nt, Human
accugcggugcuaucucc

SEQ ID NO: 1799963 - RNA, 21 nt, Human
ucauuugagcagggcucagcg

SEQ ID NO: 1799964 - RNA, 18 nt, Human
ucauuugugccagaaugc

SEQ ID NO: 1799965 - RNA, 14 nt, Human
ucauuugcuuugga

SEQ ID NO: 1799966 - RNA, 23 nt, Human
uccaaagucucuggaauuugaaa

SEQ ID NO: 1799967 - RNA, 13 nt, Human
ucauuuuuuuuaa

SEQ ID NO: 1799968 - RNA, 20 nt, Human
uccacaguggaaccagccca

SEQ ID NO: 1799969 - RNA, 16 nt, Human
uccacaguggaaccag

SEQ ID NO: 1799970 - RNA, 11 nt, Human
uccaagcuggu

SEQ ID NO: 1799971 - RNA, 14 nt, Human
uccacagugacucc

SEQ ID NO: 1799972 - RNA, 14 nt, Human
uccaaaugcagcuu

SEQ ID NO: 1799973 - RNA, 15 nt, Human
uccaaaugcagcuuu

SEQ ID NO: 1799974 - RNA, 18 nt, Human
uccaagcuccaucuccac

SEQ ID NO: 1799975 - RNA, 16 nt, Human
uccaagcucccaggca

SEQ ID NO: 1799976 - RNA, 14 nt, Human
uccaagcucccagg

SEQ ID NO: 1799977 - RNA, 15 nt, Human
uccaagcucccaggc

SEQ ID NO: 1799978 - RNA, 12 nt, Human
uccaagcuccca

SEQ ID NO: 1799979 - RNA, 13 nt, Human
uccaagcucccag

SEQ ID NO: 1799980 - RNA, 18 nt, Human
uccugugacuucagcucu

SEQ ID NO: 1799981 - RNA, 13 nt, Human
uccugcugcaguu

SEQ ID NO: 1799982 - RNA, 21 nt, Human
uccuggggguucuuucuuccu

SEQ ID NO: 1799983 - RNA, 22 nt, Human
uccuggggguucuuucuuccuc

SEQ ID NO: 1799984 - RNA, 23 nt, Human
uccuggggguucuuucuuccucu

SEQ ID NO: 1799985 - RNA, 18 nt, Human
uccuggggaaccugaccc

SEQ ID NO: 1799986 - RNA, 19 nt, Human
uccuggggaaccugacccc

SEQ ID NO: 1799987 - RNA, 22 nt, Human
acugcagccucaaccuccuggg

SEQ ID NO: 1799988 - RNA, 21 nt, Human
acugcagccucaaccuccugg

SEQ ID NO: 1799989 - RNA, 19 nt, Human
acugcagccucaaccuccu

SEQ ID NO: 1799990 - RNA, 13 nt, Human
acugcacuguuuu

SEQ ID NO: 1799991 - RNA, 23 nt, Human
acugcagccucaaccuccugggc

SEQ ID NO: 1799992 - RNA, 16 nt, Human
acugcagggacugcca

SEQ ID NO: 1799993 - RNA, 17 nt, Human
acugcagggacugccag

SEQ ID NO: 1799994 - RNA, 18 nt, Human
acugcagggacugccagu

SEQ ID NO: 1799995 - RNA, 24 nt, Human
uccugugucuugcaauggcagccu

SEQ ID NO: 1799996 - RNA, 23 nt, Human
uccugugucuugcaauggcagcc

SEQ ID NO: 1799997 - RNA, 14 nt, Human
uccugugugugcgc

SEQ ID NO: 1799998 - RNA, 13 nt, Human
uccugugugugcg

SEQ ID NO: 1799999 - RNA, 18 nt, Human
uccugugugugcgccuac

SEQ ID NO: 1800000 - RNA, 17 nt, Human
uccuguugucaagaaua

SEQ ID NO: 1800001 - RNA, 19 nt, Human
uccuguucuuaagacguga

SEQ ID NO: 1800002 - RNA, 19 nt, Human
uccuguucccaugagauga

SEQ ID NO: 1800003 - RNA, 20 nt, Human
uccugccucgaacuggcugc

SEQ ID NO: 1800004 - RNA, 21 nt, Human
uccugccucgaacuggcugca

SEQ ID NO: 1800005 - RNA, 19 nt, Human
uccugccucagccucccaa

SEQ ID NO: 1800006 - RNA, 22 nt, Human
uccugcaggcagccaggccaca

SEQ ID NO: 1800007 - RNA, 16 nt, Human
uccugcaggcagccag

SEQ ID NO: 1800008 - RNA, 17 nt, Human
uccugcaggcagccagg

SEQ ID NO: 1800009 - RNA, 19 nt, Human
uccugcaggcagccaggcc

SEQ ID NO: 1800010 - RNA, 20 nt, Human
uccugcaggcagccaggcca

SEQ ID NO: 1800011 - RNA, 19 nt, Human
uccugaguagcuggauuac

SEQ ID NO: 1800012 - RNA, 20 nt, Human
uccugaguagcugggauuac

SEQ ID NO: 1800013 - RNA, 16 nt, Human
acugcacagugcaucu

SEQ ID NO: 1800014 - RNA, 18 nt, Human
acugcacagugcaucuca

SEQ ID NO: 1800015 - RNA, 22 nt, Human
acugaggggaggggagcauggg

SEQ ID NO: 1800016 - RNA, 17 nt, Human
acugaggggaggggagc

SEQ ID NO: 1800017 - RNA, 15 nt, Human
acugaggaccagcca

SEQ ID NO: 1800018 - RNA, 14 nt, Human
acugaggaucagag

SEQ ID NO: 1800019 - RNA, 15 nt, Human
uccucuccccagcaa

SEQ ID NO: 1800020 - RNA, 18 nt, Human
acugaguacguugugcau

SEQ ID NO: 1800021 - RNA, 21 nt, Human
acugaguacguugugcauuug

SEQ ID NO: 1800022 - RNA, 19 nt, Human
acugaguacguugugcauu

SEQ ID NO: 1800023 - RNA, 16 nt, Human
acugagugccuuuugg

SEQ ID NO: 1800024 - RNA, 23 nt, Human
acugaguacguugugcauuuggu

SEQ ID NO: 1800025 - RNA, 22 nt, Human
acugaguacguugugcauuugg

SEQ ID NO: 1800026 - RNA, 14 nt, Human
acugcaaccuccgc

SEQ ID NO: 1800027 - RNA, 13 nt, Human
acugcaaccuccg

SEQ ID NO: 1800028 - RNA, 22 nt, Human
acugcaaccuccgccucuuggg

SEQ ID NO: 1800029 - RNA, 16 nt, Human
acugcaaccuccgccu

SEQ ID NO: 1800030 - RNA, 20 nt, Human
acugcaaccuucgccaccug

SEQ ID NO: 1800031 - RNA, 23 nt, Human
acugcaaccuucgccaccugggu

SEQ ID NO: 1800032 - RNA, 20 nt, Human
acuguacagacagaaaaaac

SEQ ID NO: 1800033 - RNA, 14 nt, Human
acuguacaaaguag

SEQ ID NO: 1800034 - RNA, 15 nt, Human
acuguacaaaguaga

SEQ ID NO: 1800035 - RNA, 19 nt, Human
acuguaauuugugauacaa

SEQ ID NO: 1800036 - RNA, 13 nt, Human
acuguacaaagua

SEQ ID NO: 1800037 - RNA, 13 nt, Human
acuguacuccucc

SEQ ID NO: 1800038 - RNA, 14 nt, Human
acuguacuccuccc

SEQ ID NO: 1800039 - RNA, 23 nt, Human
acuguagaaaagggaacugaaca

SEQ ID NO: 1800040 - RNA, 15 nt, Human
acuguacuccuccca

SEQ ID NO: 1800041 - RNA, 14 nt, Human
acuguacaugaaaa

SEQ ID NO: 1800042 - RNA, 13 nt, Human
acuguacaugaaa

SEQ ID NO: 1800043 - RNA, 23 nt, Human
acuguacaugaaaacacauuuuu

SEQ ID NO: 1800044 - RNA, 13 nt, Human
ucgcuccuguguc

SEQ ID NO: 1800045 - RNA, 17 nt, Human
acugggagaaaugaaaa

SEQ ID NO: 1800046 - RNA, 12 nt, Human
ucgcuccugugu

SEQ ID NO: 1800047 - RNA, 19 nt, Human
acuggguacuuguggacac

SEQ ID NO: 1800048 - RNA, 23 nt, Human
acuggguacuuguggacacagcu

SEQ ID NO: 1800049 - RNA, 20 nt, Human
acuggguacuuguggacaca

SEQ ID NO: 1800050 - RNA, 16 nt, Human
acuguaaggcaaucau

SEQ ID NO: 1800051 - RNA, 15 nt, Human
ucgaacuggcugcaa

SEQ ID NO: 1800052 - RNA, 13 nt, Human
ucgaacuggcugc

SEQ ID NO: 1800053 - RNA, 14 nt, Human
ucgaacuggcugca

SEQ ID NO: 1800054 - RNA, 15 nt, Human
uccuuucaccacaug

SEQ ID NO: 1800055 - RNA, 20 nt, Human
uccuuucacaaccuucugug

SEQ ID NO: 1800056 - RNA, 16 nt, Human
uccuuucacaaccuuc

SEQ ID NO: 1800057 - RNA, 18 nt, Human
uccuuucacaaccuucug

SEQ ID NO: 1800058 - RNA, 19 nt, Human
uccuuucacaaccuucugu

SEQ ID NO: 1800059 - RNA, 14 nt, Human
ucgcgacaaugcaa

SEQ ID NO: 1800060 - RNA, 13 nt, Human
ucgcgacaaugca

SEQ ID NO: 1800061 - RNA, 17 nt, Human
ucgaggacagggaggug

SEQ ID NO: 1800062 - RNA, 14 nt, Human
ucgaggacagggag

SEQ ID NO: 1800063 - RNA, 13 nt, Human
ucgaccugccucg

SEQ ID NO: 1800064 - RNA, 14 nt, Human
ucgagcaugccugg

SEQ ID NO: 1800065 - RNA, 15 nt, Human
ucgagcaugccugga

SEQ ID NO: 1800066 - RNA, 13 nt, Human
acugcuggcugcc

SEQ ID NO: 1800067 - RNA, 22 nt, Human
acuggauuaaacuuaaucuaaa

SEQ ID NO: 1800068 - RNA, 21 nt, Human
acugcuugugaaaggaaagag

SEQ ID NO: 1800069 - RNA, 12 nt, Human
acugcuggcugc

SEQ ID NO: 1800070 - RNA, 16 nt, Human
acugcugcccagccuc

SEQ ID NO: 1800071 - RNA, 18 nt, Human
acugcugcccagccucca

SEQ ID NO: 1800072 - RNA, 21 nt, Human
acugcugcccagccuccaagc

SEQ ID NO: 1800073 - RNA, 18 nt, Human
acugcuuccagugaggcu

SEQ ID NO: 1800074 - RNA, 21 nt, Human
acugcuuccagugaggcucug

SEQ ID NO: 1800075 - RNA, 22 nt, Human
acugcuuccagugaggcucugc

SEQ ID NO: 1800076 - RNA, 23 nt, Human
acugcuuccagugaggcucugcc

SEQ ID NO: 1800077 - RNA, 12 nt, Human
acugcucugaug

SEQ ID NO: 1800078 - RNA, 22 nt, Human
uccuucagugccuuauggaaca

SEQ ID NO: 1800079 - RNA, 13 nt, Human
uccuucagugccu

SEQ ID NO: 1800080 - RNA, 20 nt, Human
uccuucagugccuuauggaa

SEQ ID NO: 1800081 - RNA, 12 nt, Human
uccuucagugcc

SEQ ID NO: 1800082 - RNA, 11 nt, Human
uccuucagugc

SEQ ID NO: 1800083 - RNA, 13 nt, Human
uccuucagccuga

SEQ ID NO: 1800084 - RNA, 17 nt, Human
uccuuccucugagccuu

SEQ ID NO: 1800085 - RNA, 16 nt, Human
uccuuccucugaggcu

SEQ ID NO: 1800086 - RNA, 16 nt, Human
uccuuccucugagccu

SEQ ID NO: 1800087 - RNA, 23 nt, Human
acuggccucugcugauccuccca

SEQ ID NO: 1800088 - RNA, 22 nt, Human
acuggcugcaaaggguaucagg

SEQ ID NO: 1800089 - RNA, 14 nt, Human
acuaaaauaauuuu

SEQ ID NO: 1800090 - RNA, 19 nt, Human
acuaaaauaauuuuguaau

SEQ ID NO: 1800091 - RNA, 17 nt, Human
acuaaaauaauuuugua

SEQ ID NO: 1800092 - RNA, 16 nt, Human
acuaaaauaauuuugu

SEQ ID NO: 1800093 - RNA, 15 nt, Human
acuaaaauaauuuug

SEQ ID NO: 1800094 - RNA, 20 nt, Human
acuaaaauaauuuuguaaug

SEQ ID NO: 1800095 - RNA, 23 nt, Human
acuacaggugugagucaccaagc

SEQ ID NO: 1800096 - RNA, 17 nt, Human
acuaaccagcagaaaug

SEQ ID NO: 1800097 - RNA, 15 nt, Human
acuacaguccuccca

SEQ ID NO: 1800098 - RNA, 13 nt, Human
acuaaccacgcug

SEQ ID NO: 1800099 - RNA, 16 nt, Human
acuaaccagcagaaau

SEQ ID NO: 1800100 - RNA, 14 nt, Human
uccagcucaccagc

SEQ ID NO: 1800101 - RNA, 15 nt, Human
uccagcucaccagcc

SEQ ID NO: 1800102 - RNA, 12 nt, Human
acguuucuaaag

SEQ ID NO: 1800103 - RNA, 13 nt, Human
uccagccugggug

SEQ ID NO: 1800104 - RNA, 24 nt, Human
uccagccugggugacagagcaagu

SEQ ID NO: 1800105 - RNA, 13 nt, Human
acuaaaaauacaa

SEQ ID NO: 1800106 - RNA, 14 nt, Human
acguuucuaaaggc

SEQ ID NO: 1800107 - RNA, 19 nt, Human
ucccagugccgagaaggaa

SEQ ID NO: 1800108 - RNA, 22 nt, Human
ucccagugccgagaaggaagcc

SEQ ID NO: 1800109 - RNA, 17 nt, Human
acuacaguccucccauc

SEQ ID NO: 1800110 - RNA, 16 nt, Human
acuacaguccucccau

SEQ ID NO: 1800111 - RNA, 16 nt, Human
ucccauaugccugggc

SEQ ID NO: 1800112 - RNA, 15 nt, Human
ucccauaugccuggg

SEQ ID NO: 1800113 - RNA, 13 nt, Human
ucccaucucacac

SEQ ID NO: 1800114 - RNA, 14 nt, Human
ucccaucucacaca

SEQ ID NO: 1800115 - RNA, 19 nt, Human
ucccaucucacacaugagc

SEQ ID NO: 1800116 - RNA, 15 nt, Human
uccccaagccuggca

SEQ ID NO: 1800117 - RNA, 18 nt, Human
acuauagccuaggugaca

SEQ ID NO: 1800118 - RNA, 17 nt, Human
acuauagccuaggugac

SEQ ID NO: 1800119 - RNA, 23 nt, Human
acuauaauuuaccugaagucuuu

SEQ ID NO: 1800120 - RNA, 23 nt, Human
uccccaggaggccagccuugacc

SEQ ID NO: 1800121 - RNA, 24 nt, Human
uccccaccgcagacaggaccaggg

SEQ ID NO: 1800122 - RNA, 18 nt, Human
acuauguugcccaggcag

SEQ ID NO: 1800123 - RNA, 22 nt, Human
acuaugaaguuuuuuuuauaca

SEQ ID NO: 1800124 - RNA, 22 nt, Human
acuaucaugucaaacgugaaaa

SEQ ID NO: 1800125 - RNA, 16 nt, Human
acuaucccggcugccc

SEQ ID NO: 1800126 - RNA, 17 nt, Human
acuaucccggcugcccu

SEQ ID NO: 1800127 - RNA, 18 nt, Human
acuaucccggcugcccuu

SEQ ID NO: 1800128 - RNA, 23 nt, Human
acuauguugcccaggcaggucuu

SEQ ID NO: 1800129 - RNA, 20 nt, Human
acuauguugcccaggcaggu

SEQ ID NO: 1800130 - RNA, 19 nt, Human
acuauguugcccaggcagg

SEQ ID NO: 1800131 - RNA, 18 nt, Human
ucccuauuagagaagaga

SEQ ID NO: 1800132 - RNA, 18 nt, Human
ucccgaauagcugggacu

SEQ ID NO: 1800133 - RNA, 20 nt, Human
ucccgaguagcugggacuac

SEQ ID NO: 1800134 - RNA, 13 nt, Human
ucccgcucagccc

SEQ ID NO: 1800135 - RNA, 14 nt, Human
ucccgcucagcccu

SEQ ID NO: 1800136 - RNA, 15 nt, Human
ucccgcucagcccuc

SEQ ID NO: 1800137 - RNA, 16 nt, Human
ucccgcucagcccucc

SEQ ID NO: 1800138 - RNA, 20 nt, Human
ucccgcucagcccucccugc

SEQ ID NO: 1800139 - RNA, 16 nt, Human
ucccgaauagcuggga

SEQ ID NO: 1800140 - RNA, 15 nt, Human
ucccgaauagcuggg

SEQ ID NO: 1800141 - RNA, 20 nt, Human
acucaagacuuccagagccu

SEQ ID NO: 1800142 - RNA, 17 nt, Human
acucaagacuuccagag

SEQ ID NO: 1800143 - RNA, 22 nt, Human
ucccucauccucauacccaccc

SEQ ID NO: 1800144 - RNA, 21 nt, Human
ucccucagucuggcccuuccu

SEQ ID NO: 1800145 - RNA, 23 nt, Human
ucccucauuccaccuucccaugc

SEQ ID NO: 1800146 - RNA, 16 nt, Human
acucaucuagguaaau

SEQ ID NO: 1800147 - RNA, 18 nt, Human
acucaucuagguaaauua

SEQ ID NO: 1800148 - RNA, 14 nt, Human
acuccuaccuggua

SEQ ID NO: 1800149 - RNA, 20 nt, Human
acuccagcuggguuggaaaa

SEQ ID NO: 1800150 - RNA, 20 nt, Human
uccuagcacuuugggaggcc

SEQ ID NO: 1800151 - RNA, 14 nt, Human
uccuaggcauuugc

SEQ ID NO: 1800152 - RNA, 22 nt, Human
ucccuuugacgccaucccagcc

SEQ ID NO: 1800153 - RNA, 23 nt, Human
ucccuuugacgccaucccagccc

SEQ ID NO: 1800154 - RNA, 23 nt, Human
acuccugcacacgcuccuuccuc

SEQ ID NO: 1800155 - RNA, 22 nt, Human
ucccuuuccaaaugcccagcuu

SEQ ID NO: 1800156 - RNA, 11 nt, Human
ucccuucaacc

SEQ ID NO: 1800157 - RNA, 21 nt, Human
ucccuucaaccauuccccaug

SEQ ID NO: 1800158 - RNA, 18 nt, Human
ucccuuacgugaguccug

SEQ ID NO: 1800159 - RNA, 22 nt, Human
ucccuuacgugaguccuggcau

SEQ ID NO: 1800160 - RNA, 17 nt, Human
acucuccucugcugcug

SEQ ID NO: 1800161 - RNA, 20 nt, Human
acucgcgacaaugcaaacca

SEQ ID NO: 1800162 - RNA, 23 nt, Human
acucgcgacaaugcaaaccauca

SEQ ID NO: 1800163 - RNA, 19 nt, Human
uccuaggcauuugcugaau

SEQ ID NO: 1800164 - RNA, 18 nt, Human
acucgcgacaaugcaaac

SEQ ID NO: 1800165 - RNA, 21 nt, Human
acucuccucugcugcuggcug

SEQ ID NO: 1800166 - RNA, 18 nt, Human
acucuccucugcugcugg

SEQ ID NO: 1800167 - RNA, 19 nt, Human
acucuccucugcugcuggc

SEQ ID NO: 1800168 - RNA, 19 nt, Human
uccucccucccucuuuccc

SEQ ID NO: 1800169 - RNA, 17 nt, Human
uccucccucccucuuuc

SEQ ID NO: 1800170 - RNA, 15 nt, Human
uccucccucccucuu

SEQ ID NO: 1800171 - RNA, 12 nt, Human
uccucuccccag

SEQ ID NO: 1800172 - RNA, 15 nt, Human
uccucuccacugccu

SEQ ID NO: 1800173 - RNA, 16 nt, Human
uccucuccacugccuu

SEQ ID NO: 1800174 - RNA, 12 nt, Human
uccucuccacug

SEQ ID NO: 1800175 - RNA, 13 nt, Human
uccucuccacugc

SEQ ID NO: 1800176 - RNA, 14 nt, Human
uccucuccacugcc

SEQ ID NO: 1800177 - RNA, 22 nt, Human
uccuccccuccuccuggacucc

SEQ ID NO: 1800178 - RNA, 18 nt, Human
uccuccccuccuccugga

SEQ ID NO: 1800179 - RNA, 20 nt, Human
uccuccccuccuccuggacu

SEQ ID NO: 1800180 - RNA, 16 nt, Human
uccuccccuccuccug

SEQ ID NO: 1800181 - RNA, 22 nt, Human
uccucauacccacccccaccca

SEQ ID NO: 1800182 - RNA, 14 nt, Human
uccucauacccacc

SEQ ID NO: 1800183 - RNA, 18 nt, Human
uccucauacccaccccca

SEQ ID NO: 1800184 - RNA, 19 nt, Human
acucuuauugcccacgcug

SEQ ID NO: 1800185 - RNA, 16 nt, Human
acucuuauugcccacg

SEQ ID NO: 1800186 - RNA, 20 nt, Human
uccucagaucuucugugggu

SEQ ID NO: 1800187 - RNA, 19 nt, Human
uaugcucugcauguuacau

SEQ ID NO: 1800188 - RNA, 22 nt, Human
uauggccugugagcuaggaauu

SEQ ID NO: 1800189 - RNA, 14 nt, Human
uauggccuguggau

SEQ ID NO: 1800190 - RNA, 18 nt, Human
uaugcucugcauguuaca

SEQ ID NO: 1800191 - RNA, 20 nt, Human
acagcuaaucagcauucuca

SEQ ID NO: 1800192 - RNA, 17 nt, Human
acagcuaacauggaagu

SEQ ID NO: 1800193 - RNA, 14 nt, Human
acagcuaacaugga

SEQ ID NO: 1800194 - RNA, 15 nt, Human
acagcuaacauggaa

SEQ ID NO: 1800195 - RNA, 14 nt, Human
acagccuggcacag

SEQ ID NO: 1800196 - RNA, 15 nt, Human
acagccuggcacagg

SEQ ID NO: 1800197 - RNA, 16 nt, Human
uauggcuuuugugcau

SEQ ID NO: 1800198 - RNA, 14 nt, Human
uaugaucacggcuc

SEQ ID NO: 1800199 - RNA, 23 nt, Human
uaugaucacggcucacugcagcc

SEQ ID NO: 1800200 - RNA, 21 nt, Human
uaugaucacggcucacugcag

SEQ ID NO: 1800201 - RNA, 13 nt, Human
uaugaggcauuug

SEQ ID NO: 1800202 - RNA, 15 nt, Human
uaucuugaauaaugu

SEQ ID NO: 1800203 - RNA, 15 nt, Human
uaucuugaagacuuu

SEQ ID NO: 1800204 - RNA, 18 nt, Human
acagaguuuucacucuua

SEQ ID NO: 1800205 - RNA, 15 nt, Human
acagaguuguuacau

SEQ ID NO: 1800206 - RNA, 20 nt, Human
acagaguuuucacucuuauu

SEQ ID NO: 1800207 - RNA, 18 nt, Human
acagcagccccugcacaa

SEQ ID NO: 1800208 - RNA, 18 nt, Human
uaucucccccagccccau

SEQ ID NO: 1800209 - RNA, 17 nt, Human
uaucucccccagcccca

SEQ ID NO: 1800210 - RNA, 19 nt, Human
uaucuagauacuguaucau

SEQ ID NO: 1800211 - RNA, 16 nt, Human
uaucuagauacuguau

SEQ ID NO: 1800212 - RNA, 15 nt, Human
uaucuagauacugua

SEQ ID NO: 1800213 - RNA, 10 nt, Human
uaucagaauu

SEQ ID NO: 1800214 - RNA, 21 nt, Human
acagagugagacucugucuca

SEQ ID NO: 1800215 - RNA, 18 nt, Human
acagagcuacacagggga

SEQ ID NO: 1800216 - RNA, 16 nt, Human
acagagcuacacaggg

SEQ ID NO: 1800217 - RNA, 20 nt, Human
acagagcccacgcccccacu

SEQ ID NO: 1800218 - RNA, 20 nt, Human
acagacuggauguaccacca

SEQ ID NO: 1800219 - RNA, 13 nt, Human
acagacuucugaa

SEQ ID NO: 1800220 - RNA, 14 nt, Human
acagacuucugaaa

SEQ ID NO: 1800221 - RNA, 15 nt, Human
uauauuuacaaaugg

SEQ ID NO: 1800222 - RNA, 21 nt, Human
uaucaaguauuauaccuuuuu

SEQ ID NO: 1800223 - RNA, 14 nt, Human
uauauuuacaaaug

SEQ ID NO: 1800224 - RNA, 18 nt, Human
uaucacccagaagaaaau

SEQ ID NO: 1800225 - RNA, 23 nt, Human
acagacacaggcccggcuccagg

SEQ ID NO: 1800226 - RNA, 13 nt, Human
acacuccuucaca

SEQ ID NO: 1800227 - RNA, 11 nt, Human
acacuccuuca

SEQ ID NO: 1800228 - RNA, 13 nt, Human
acagacagcccuc

SEQ ID NO: 1800229 - RNA, 15 nt, Human
acagacagcccucca

SEQ ID NO: 1800230 - RNA, 17 nt, Human
acagacccugcccugug

SEQ ID NO: 1800231 - RNA, 16 nt, Human
acagacccugcccugu

SEQ ID NO: 1800232 - RNA, 18 nt, Human
acagacccugcccugugg

SEQ ID NO: 1800233 - RNA, 20 nt, Human
acagacccugcccugugggc

SEQ ID NO: 1800234 - RNA, 14 nt, Human
acagacuggaagca

SEQ ID NO: 1800235 - RNA, 16 nt, Human
uauauugauccagaaa

SEQ ID NO: 1800236 - RNA, 21 nt, Human
uagucaggugccucaagagaa

SEQ ID NO: 1800237 - RNA, 19 nt, Human
acaagcugcacccucaggc

SEQ ID NO: 1800238 - RNA, 21 nt, Human
acaagcugcacccucaggcag

SEQ ID NO: 1800239 - RNA, 22 nt, Human
acaagcugcacccucaggcagg

SEQ ID NO: 1800240 - RNA, 23 nt, Human
acaagcugcacccucaggcaggu

SEQ ID NO: 1800241 - RNA, 20 nt, Human
uaguuccucauuagcauuuu

SEQ ID NO: 1800242 - RNA, 12 nt, Human
uauaaaagccug

SEQ ID NO: 1800243 - RNA, 14 nt, Human
uauaaaagccuguu

SEQ ID NO: 1800244 - RNA, 17 nt, Human
uauaaaagccuguuuaa

SEQ ID NO: 1800245 - RNA, 18 nt, Human
acacaugcaaggucauuu

SEQ ID NO: 1800246 - RNA, 20 nt, Human
acacaugcaaggucauuuuu

SEQ ID NO: 1800247 - RNA, 19 nt, Human
acacaugcaaggucauuuu

SEQ ID NO: 1800248 - RNA, 21 nt, Human
acacccagcccacuucugcca

SEQ ID NO: 1800249 - RNA, 20 nt, Human
acacccagcccacuucugcc

SEQ ID NO: 1800250 - RNA, 19 nt, Human
acacccagcccacuucugc

SEQ ID NO: 1800251 - RNA, 21 nt, Human
acacaugcaaggucauuuuuu

SEQ ID NO: 1800252 - RNA, 11 nt, Human
acacccuguga

SEQ ID NO: 1800253 - RNA, 12 nt, Human
acacccugugau

SEQ ID NO: 1800254 - RNA, 18 nt, Human
acacccugugauggggcc

SEQ ID NO: 1800255 - RNA, 19 nt, Human
acacccugugauggggccc

SEQ ID NO: 1800256 - RNA, 16 nt, Human
acaccgggccuggaga

SEQ ID NO: 1800257 - RNA, 20 nt, Human
uauagccuaggugacagagu

SEQ ID NO: 1800258 - RNA, 19 nt, Human
uauaggaauugacccacaa

SEQ ID NO: 1800259 - RNA, 14 nt, Human
uauaggaauugacc

SEQ ID NO: 1800260 - RNA, 13 nt, Human
uauaggaauugac

SEQ ID NO: 1800261 - RNA, 21 nt, Human
acacucauugaccugaggccc

SEQ ID NO: 1800262 - RNA, 23 nt, Human
acacucauugaccugaggcccuu

SEQ ID NO: 1800263 - RNA, 13 nt, Human
uauauaucaaaua

SEQ ID NO: 1800264 - RNA, 14 nt, Human
uauacauuugauaa

SEQ ID NO: 1800265 - RNA, 14 nt, Human
uauacauaaacaag

SEQ ID NO: 1800266 - RNA, 13 nt, Human
uauacauaaacaa

SEQ ID NO: 1800267 - RNA, 21 nt, Human
uauacacuuacacuuuaugca

SEQ ID NO: 1800268 - RNA, 20 nt, Human
uauaaccaguguuguggauu

SEQ ID NO: 1800269 - RNA, 23 nt, Human
acaguucggugagcuacaaaugc

SEQ ID NO: 1800270 - RNA, 16 nt, Human
acaguucucuccuucu

SEQ ID NO: 1800271 - RNA, 19 nt, Human
acaguucggugagcuacaa

SEQ ID NO: 1800272 - RNA, 22 nt, Human
acaguucggugagcuacaaaug

SEQ ID NO: 1800273 - RNA, 20 nt, Human
acaguucaauucucauuugu

SEQ ID NO: 1800274 - RNA, 20 nt, Human
acaguuacucagaauucucu

SEQ ID NO: 1800275 - RNA, 13 nt, Human
acaguuacucaga

SEQ ID NO: 1800276 - RNA, 16 nt, Human
uauucuguuggccagu

SEQ ID NO: 1800277 - RNA, 15 nt, Human
uauucuuauuuaaug

SEQ ID NO: 1800278 - RNA, 24 nt, Human
uauucucuccuguaccucuugagc

SEQ ID NO: 1800279 - RNA, 20 nt, Human
uauucucuccuguaccucuu

SEQ ID NO: 1800280 - RNA, 17 nt, Human
acaguucucuccuucuu

SEQ ID NO: 1800281 - RNA, 17 nt, Human
uauugguguaagguacu

SEQ ID NO: 1800282 - RNA, 20 nt, Human
uauuuagcaccagggaaggg

SEQ ID NO: 1800283 - RNA, 18 nt, Human
uauuuacuucuuauacau

SEQ ID NO: 1800284 - RNA, 23 nt, Human
uauuuaauuuuuuugagacagag

SEQ ID NO: 1800285 - RNA, 14 nt, Human
uauuuaauucaugu

SEQ ID NO: 1800286 - RNA, 19 nt, Human
uauuuaguguucauaaaua

SEQ ID NO: 1800287 - RNA, 13 nt, Human
uauuuauuuaaau

SEQ ID NO: 1800288 - RNA, 14 nt, Human
uauuuauuuaguau

SEQ ID NO: 1800289 - RNA, 14 nt, Human
uauuuauuuaaauu

SEQ ID NO: 1800290 - RNA, 13 nt, Human
uauugucaaagug

SEQ ID NO: 1800291 - RNA, 17 nt, Human
uauugucaaagugguga

SEQ ID NO: 1800292 - RNA, 17 nt, Human
uauuguacaguuuuuau

SEQ ID NO: 1800293 - RNA, 15 nt, Human
uauuguacaguuuuu

SEQ ID NO: 1800294 - RNA, 14 nt, Human
uauuguacaguuuu

SEQ ID NO: 1800295 - RNA, 13 nt, Human
uauuguacaguuu

SEQ ID NO: 1800296 - RNA, 12 nt, Human
uauuguacaguu

SEQ ID NO: 1800297 - RNA, 11 nt, Human
uauuguacagu

SEQ ID NO: 1800298 - RNA, 15 nt, Human
uauuuaaugaaagac

SEQ ID NO: 1800299 - RNA, 21 nt, Human
uauuuaaugaaagacuguaca

SEQ ID NO: 1800300 - RNA, 20 nt, Human
acagugaaagaaaauaacaa

SEQ ID NO: 1800301 - RNA, 22 nt, Human
acagucuuguauuaaguuguua

SEQ ID NO: 1800302 - RNA, 18 nt, Human
acagucuuguauuaaguu

SEQ ID NO: 1800303 - RNA, 15 nt, Human
acagucuuguauuaa

SEQ ID NO: 1800304 - RNA, 14 nt, Human
acagucuuguauua

SEQ ID NO: 1800305 - RNA, 21 nt, Human
acaguccuuaccagcagagca

SEQ ID NO: 1800306 - RNA, 22 nt, Human
acaguccuuaccagcagagcac

SEQ ID NO: 1800307 - RNA, 15 nt, Human
acaguuaagagaaau

SEQ ID NO: 1800308 - RNA, 18 nt, Human
acagugagacucugucuc

SEQ ID NO: 1800309 - RNA, 14 nt, Human
acagugagacucug

SEQ ID NO: 1800310 - RNA, 22 nt, Human
acagggcacaccgggcacucag

SEQ ID NO: 1800311 - RNA, 22 nt, Human
acagguuuuccugaagaauuga

SEQ ID NO: 1800312 - RNA, 17 nt, Human
acaggcugggcuucagu

SEQ ID NO: 1800313 - RNA, 14 nt, Human
acaggcugggcuuc

SEQ ID NO: 1800314 - RNA, 21 nt, Human
acaggcugggcuucaguggca

SEQ ID NO: 1800315 - RNA, 21 nt, Human
acaguauggcagcuuuccuca

SEQ ID NO: 1800316 - RNA, 19 nt, Human
acaguauuacuucugcuac

SEQ ID NO: 1800317 - RNA, 17 nt, Human
acaguauuacuucugcu

SEQ ID NO: 1800318 - RNA, 16 nt, Human
acaguauuacuucugc

SEQ ID NO: 1800319 - RNA, 15 nt, Human
acaguauuacuucug

SEQ ID NO: 1800320 - RNA, 13 nt, Human
acagucccugcca

SEQ ID NO: 1800321 - RNA, 17 nt, Human
acaguccucccaucuca

SEQ ID NO: 1800322 - RNA, 18 nt, Human
acaguccuuaccagcaga

SEQ ID NO: 1800323 - RNA, 20 nt, Human
acaguccuuaccagcagagc

SEQ ID NO: 1800324 - RNA, 15 nt, Human
acagucccugccaau

SEQ ID NO: 1800325 - RNA, 13 nt, Human
acaguccucccau

SEQ ID NO: 1800326 - RNA, 14 nt, Human
acaguccucccauc

SEQ ID NO: 1800327 - RNA, 15 nt, Human
acaguccucccaucu

SEQ ID NO: 1800328 - RNA, 15 nt, Human
uauucagcucaugga

SEQ ID NO: 1800329 - RNA, 18 nt, Human
uauucaggaagcucaggg

SEQ ID NO: 1800330 - RNA, 22 nt, Human
uauucaggaagcucagggccug

SEQ ID NO: 1800331 - RNA, 23 nt, Human
uauucauagcagcuuauucacaa

SEQ ID NO: 1800332 - RNA, 12 nt, Human
uauuagagaaga

SEQ ID NO: 1800333 - RNA, 16 nt, Human
uauuaccacagacaua

SEQ ID NO: 1800334 - RNA, 23 nt, Human
uauuaaaaaucucaaauuucuaa

SEQ ID NO: 1800335 - RNA, 19 nt, Human
uauguuuuaagaggcaggg

SEQ ID NO: 1800336 - RNA, 17 nt, Human
uauguuuuaagaggcag

SEQ ID NO: 1800337 - RNA, 22 nt, Human
uauuaaaaaucucaaauuucua

SEQ ID NO: 1800338 - RNA, 20 nt, Human
uauuaaaaaucucaaauuuc

SEQ ID NO: 1800339 - RNA, 18 nt, Human
uauuaaaaaucucaaauu

SEQ ID NO: 1800340 - RNA, 16 nt, Human
uauuaaaaaucucaaa

SEQ ID NO: 1800341 - RNA, 22 nt, Human
aauuguuuggggaugagaaagg

SEQ ID NO: 1800342 - RNA, 12 nt, Human
aauugcuccuug

SEQ ID NO: 1800343 - RNA, 13 nt, Human
aauuuaaaagucu

SEQ ID NO: 1800344 - RNA, 19 nt, Human
aauuuacauacucugcuua

SEQ ID NO: 1800345 - RNA, 16 nt, Human
aauuucucuacugucu

SEQ ID NO: 1800346 - RNA, 20 nt, Human
aauuugaaacacuuugcaua

SEQ ID NO: 1800347 - RNA, 21 nt, Human
aauuucuaaaucuccaaaaua

SEQ ID NO: 1800348 - RNA, 13 nt, Human
aauuucuaaaucu

SEQ ID NO: 1800349 - RNA, 17 nt, Human
aauuuagaaauauaauu

SEQ ID NO: 1800350 - RNA, 15 nt, Human
aauuuaccugaaguc

SEQ ID NO: 1800351 - RNA, 21 nt, Human
aauucuugccaaauauaaaua

SEQ ID NO: 1800352 - RNA, 20 nt, Human
aauucuugcaaaguaucccu

SEQ ID NO: 1800353 - RNA, 14 nt, Human
aauucuugcaaagu

SEQ ID NO: 1800354 - RNA, 22 nt, Human
aauucuucuccacuuucuagcc

SEQ ID NO: 1800355 - RNA, 15 nt, Human
uacguacacauuuua

SEQ ID NO: 1800356 - RNA, 19 nt, Human
aauugacccacaagaaaug

SEQ ID NO: 1800357 - RNA, 16 nt, Human
aauugacccacaagaa

SEQ ID NO: 1800358 - RNA, 13 nt, Human
aauugacccacaa

SEQ ID NO: 1800359 - RNA, 14 nt, Human
uacgucugacaggc

SEQ ID NO: 1800360 - RNA, 14 nt, Human
uacguuaccaggca

SEQ ID NO: 1800361 - RNA, 14 nt, Human
uacguugugcauuu

SEQ ID NO: 1800362 - RNA, 13 nt, Human
uacguugugcauu

SEQ ID NO: 1800363 - RNA, 16 nt, Human
uacuauaauuuaccug

SEQ ID NO: 1800364 - RNA, 16 nt, Human
uacuauguaucaauga

SEQ ID NO: 1800365 - RNA, 18 nt, Human
uacucuuauagacaacau

SEQ ID NO: 1800366 - RNA, 22 nt, Human
uacucuucaguuaagccuuugg

SEQ ID NO: 1800367 - RNA, 18 nt, Human
acaagcacuaaacaaaga

SEQ ID NO: 1800368 - RNA, 17 nt, Human
acaagagcccaggccuc

SEQ ID NO: 1800369 - RNA, 18 nt, Human
acaagagcccaggccucc

SEQ ID NO: 1800370 - RNA, 21 nt, Human
acaagcgugagccacugcacc

SEQ ID NO: 1800371 - RNA, 20 nt, Human
acaagcgugagccacugcac

SEQ ID NO: 1800372 - RNA, 13 nt, Human
acaagcugcaccc

SEQ ID NO: 1800373 - RNA, 12 nt, Human
acaagccacccc

SEQ ID NO: 1800374 - RNA, 15 nt, Human
acaagccagcuggag

SEQ ID NO: 1800375 - RNA, 13 nt, Human
acaagccagcugg

SEQ ID NO: 1800376 - RNA, 12 nt, Human
acaacacucaca

SEQ ID NO: 1800377 - RNA, 15 nt, Human
acaacaaccugguca

SEQ ID NO: 1800378 - RNA, 18 nt, Human
acaaauucugucucugga

SEQ ID NO: 1800379 - RNA, 15 nt, Human
acaacaacaaaauga

SEQ ID NO: 1800380 - RNA, 19 nt, Human
uagcauuguaaaagcauuu

SEQ ID NO: 1800381 - RNA, 18 nt, Human
uagcauuguaaaagcauu

SEQ ID NO: 1800382 - RNA, 21 nt, Human
uagcaugucgucaaagcugaa

SEQ ID NO: 1800383 - RNA, 18 nt, Human
uagcaugucgucaaagcu

SEQ ID NO: 1800384 - RNA, 16 nt, Human
uagcaccagggaaggg

SEQ ID NO: 1800385 - RNA, 13 nt, Human
uagcaccagggaa

SEQ ID NO: 1800386 - RNA, 14 nt, Human
uagcaccagggaag

SEQ ID NO: 1800387 - RNA, 22 nt, Human
uagauuuuagacccuauugcug

SEQ ID NO: 1800388 - RNA, 16 nt, Human
uagcacagacccugcc

SEQ ID NO: 1800389 - RNA, 17 nt, Human
uagcacagacccugccc

SEQ ID NO: 1800390 - RNA, 18 nt, Human
uagcacagacccugcccu

SEQ ID NO: 1800391 - RNA, 19 nt, Human
uagcacagacccugcccug

SEQ ID NO: 1800392 - RNA, 15 nt, Human
uagagcuucuggcac

SEQ ID NO: 1800393 - RNA, 16 nt, Human
acaaaaagcauaaaaa

SEQ ID NO: 1800394 - RNA, 17 nt, Human
aauuuuuuugagacaga

SEQ ID NO: 1800395 - RNA, 13 nt, Human
acaaaaacauggc

SEQ ID NO: 1800396 - RNA, 14 nt, Human
aauuuuuguauuuu

SEQ ID NO: 1800397 - RNA, 21 nt, Human
aauuuuuuaagugaaaauaua

SEQ ID NO: 1800398 - RNA, 12 nt, Human
uagacagucccu

SEQ ID NO: 1800399 - RNA, 14 nt, Human
uagacagucccugc

SEQ ID NO: 1800400 - RNA, 17 nt, Human
aauuuuuauuaaauuau

SEQ ID NO: 1800401 - RNA, 18 nt, Human
aauuuuuauuaaauuaug

SEQ ID NO: 1800402 - RNA, 15 nt, Human
uagaagucacacagu

SEQ ID NO: 1800403 - RNA, 18 nt, Human
uagaagauggcacuuaua

SEQ ID NO: 1800404 - RNA, 22 nt, Human
uagaacugaauuuugucuuuau

SEQ ID NO: 1800405 - RNA, 17 nt, Human
uagaacugaauuuuguc

SEQ ID NO: 1800406 - RNA, 13 nt, Human
uagaacugaauuu

SEQ ID NO: 1800407 - RNA, 22 nt, Human
uacuucaaaaguuuguuugcuu

SEQ ID NO: 1800408 - RNA, 17 nt, Human
uacuucaaaaguuuguu

SEQ ID NO: 1800409 - RNA, 15 nt, Human
uagaacucccuuuca

SEQ ID NO: 1800410 - RNA, 14 nt, Human
uagacagcaugaga

SEQ ID NO: 1800411 - RNA, 16 nt, Human
uagacaauuuauuaug

SEQ ID NO: 1800412 - RNA, 20 nt, Human
uagaagucuuagauguauau

SEQ ID NO: 1800413 - RNA, 18 nt, Human
uagaagucuuagauguau

SEQ ID NO: 1800414 - RNA, 19 nt, Human
uagaagucuuagauguaua

SEQ ID NO: 1800415 - RNA, 16 nt, Human
uagaagucacacagua

SEQ ID NO: 1800416 - RNA, 16 nt, Human
uagaagucuuagaugu

SEQ ID NO: 1800417 - RNA, 17 nt, Human
uagaagucuuagaugua

SEQ ID NO: 1800418 - RNA, 20 nt, Human
aauacaguaucucagggccu

SEQ ID NO: 1800419 - RNA, 23 nt, Human
uaauacaccacuacauucuguua

SEQ ID NO: 1800420 - RNA, 21 nt, Human
uaauacaccacuacauucugu

SEQ ID NO: 1800421 - RNA, 22 nt, Human
uaauacaccacuacauucuguu

SEQ ID NO: 1800422 - RNA, 18 nt, Human
uaauacuugcuuuggaaa

SEQ ID NO: 1800423 - RNA, 13 nt, Human
uaauaccucccuu

SEQ ID NO: 1800424 - RNA, 17 nt, Human
uaaucuuuaauuuuaca

SEQ ID NO: 1800425 - RNA, 22 nt, Human
uaauccaagcaaaugugaauca

SEQ ID NO: 1800426 - RNA, 21 nt, Human
uaauauugauaugcuuauaca

SEQ ID NO: 1800427 - RNA, 15 nt, Human
aaugaaugucagugu

SEQ ID NO: 1800428 - RNA, 14 nt, Human
aaugaaugucagug

SEQ ID NO: 1800429 - RNA, 14 nt, Human
aaugaaugaaacau

SEQ ID NO: 1800430 - RNA, 15 nt, Human
aaugaaugaaugaau

SEQ ID NO: 1800431 - RNA, 23 nt, Human
aaucuucugaacuuggcgcugcc

SEQ ID NO: 1800432 - RNA, 13 nt, Human
aaucuugaaaaug

SEQ ID NO: 1800433 - RNA, 15 nt, Human
uaaugucacaggcag

SEQ ID NO: 1800434 - RNA, 17 nt, Human
uaaugucacaggcaggu

SEQ ID NO: 1800435 - RNA, 16 nt, Human
uaaugucacaggcagg

SEQ ID NO: 1800436 - RNA, 23 nt, Human
uaaugugaaacuggauuaaacuu

SEQ ID NO: 1800437 - RNA, 22 nt, Human
uaaugugaaacuggauuaaacu

SEQ ID NO: 1800438 - RNA, 20 nt, Human
uaaugugaaacuggauuaaa

SEQ ID NO: 1800439 - RNA, 12 nt, Human
uaaugugaaacu

SEQ ID NO: 1800440 - RNA, 15 nt, Human
uaauguaagacaaau

SEQ ID NO: 1800441 - RNA, 16 nt, Human
uaauguaagcucuacu

SEQ ID NO: 1800442 - RNA, 17 nt, Human
uaauguaagcucuacug

SEQ ID NO: 1800443 - RNA, 21 nt, Human
uacaagcgugagccacugcac

SEQ ID NO: 1800444 - RNA, 20 nt, Human
uacaauaaaaucuugaaaau

SEQ ID NO: 1800445 - RNA, 20 nt, Human
uacaagcgugagccacugca

SEQ ID NO: 1800446 - RNA, 19 nt, Human
uacaagcgugagccacugc

SEQ ID NO: 1800447 - RNA, 18 nt, Human
uacaagcgugagccacug

SEQ ID NO: 1800448 - RNA, 16 nt, Human
uacaagcgugagccac

SEQ ID NO: 1800449 - RNA, 16 nt, Human
uacaaaaacauggccu

SEQ ID NO: 1800450 - RNA, 18 nt, Human
uacaagccagcuggagaa

SEQ ID NO: 1800451 - RNA, 15 nt, Human
uacaaaaagcauaaa

SEQ ID NO: 1800452 - RNA, 13 nt, Human
uaauucauguugc

SEQ ID NO: 1800453 - RNA, 17 nt, Human
uaauuuaccugaagucu

SEQ ID NO: 1800454 - RNA, 18 nt, Human
uaauuuaccugaagucuu

SEQ ID NO: 1800455 - RNA, 13 nt, Human
uaauuuuuuacua

SEQ ID NO: 1800456 - RNA, 22 nt, Human
uaauuuuuguguuuuuaauaaa

SEQ ID NO: 1800457 - RNA, 21 nt, Human
uaauuuuuguauuuuuaguag

SEQ ID NO: 1800458 - RNA, 20 nt, Human
uaauuauacccccugcaaag

SEQ ID NO: 1800459 - RNA, 23 nt, Human
uaauuaguuccucauuagcauuu

SEQ ID NO: 1800460 - RNA, 19 nt, Human
aaugcacuuuguucuggcu

SEQ ID NO: 1800461 - RNA, 20 nt, Human
aaugcacuuuguucuggcuc

SEQ ID NO: 1800462 - RNA, 19 nt, Human
aaugcacaaacagaggccg

SEQ ID NO: 1800463 - RNA, 20 nt, Human
aaugcacaaacagaggccgc

SEQ ID NO: 1800464 - RNA, 13 nt, Human
aaugcacuuuguu

SEQ ID NO: 1800465 - RNA, 16 nt, Human
aaugcacuuuguucug

SEQ ID NO: 1800466 - RNA, 18 nt, Human
aaugcaaccauuugaaac

SEQ ID NO: 1800467 - RNA, 17 nt, Human
aaugcaaccauuugaaa

SEQ ID NO: 1800468 - RNA, 13 nt, Human
aaugcaaccauuu

SEQ ID NO: 1800469 - RNA, 18 nt, Human
aaugcacaaacagaggcc

SEQ ID NO: 1800470 - RNA, 22 nt, Human
aaugcaaaccaucauugaaauc

SEQ ID NO: 1800471 - RNA, 23 nt, Human
aaugcaaaccaucauugaaaucu

SEQ ID NO: 1800472 - RNA, 20 nt, Human
aaugaaugucagugugacug

SEQ ID NO: 1800473 - RNA, 21 nt, Human
aaugaaugucagugugacuga

SEQ ID NO: 1800474 - RNA, 13 nt, Human
aaugaccuuucaa

SEQ ID NO: 1800475 - RNA, 14 nt, Human
aaugaccuuucaau

SEQ ID NO: 1800476 - RNA, 15 nt, Human
aaugaccuuucaaua

SEQ ID NO: 1800477 - RNA, 16 nt, Human
aaugcaaaccaucauu

SEQ ID NO: 1800478 - RNA, 12 nt, Human
uacagucuugua

SEQ ID NO: 1800479 - RNA, 13 nt, Human
uacagucuuguau

SEQ ID NO: 1800480 - RNA, 15 nt, Human
uacauaaugcgugca

SEQ ID NO: 1800481 - RNA, 18 nt, Human
uacaguaucucagggccu

SEQ ID NO: 1800482 - RNA, 12 nt, Human
uacaguccuccc

SEQ ID NO: 1800483 - RNA, 15 nt, Human
uacaguccucccauc

SEQ ID NO: 1800484 - RNA, 17 nt, Human
uacaguccucccaucuc

SEQ ID NO: 1800485 - RNA, 18 nt, Human
uacaguccucccaucuca

SEQ ID NO: 1800486 - RNA, 13 nt, Human
aaugucacaggca

SEQ ID NO: 1800487 - RNA, 14 nt, Human
aauguauuuuuccu

SEQ ID NO: 1800488 - RNA, 14 nt, Human
aaugucacaggcag

SEQ ID NO: 1800489 - RNA, 22 nt, Human
aaugugaaacuggauuaaacuu

SEQ ID NO: 1800490 - RNA, 23 nt, Human
aauguacagcaaggagauuuaca

SEQ ID NO: 1800491 - RNA, 21 nt, Human
aauguacagcaaggagauuua

SEQ ID NO: 1800492 - RNA, 22 nt, Human
uacagcaaggagauuuacaacu

SEQ ID NO: 1800493 - RNA, 19 nt, Human
uacagacuggauguaccac

SEQ ID NO: 1800494 - RNA, 16 nt, Human
aaugguuuaaaugguc

SEQ ID NO: 1800495 - RNA, 13 nt, Human
aauguaagacaaa

SEQ ID NO: 1800496 - RNA, 13 nt, Human
aauguaagcucua

SEQ ID NO: 1800497 - RNA, 15 nt, Human
aauguaagcucuacu

SEQ ID NO: 1800498 - RNA, 17 nt, Human
aaugguuuucuugugug

SEQ ID NO: 1800499 - RNA, 18 nt, Human
aaugguuuucuugugugu

SEQ ID NO: 1800500 - RNA, 22 nt, Human
aaugguuuucuuguguguuuau

SEQ ID NO: 1800501 - RNA, 17 nt, Human
uacauguacugauuacu

SEQ ID NO: 1800502 - RNA, 13 nt, Human
aauuaaguacuau

SEQ ID NO: 1800503 - RNA, 19 nt, Human
uacauuagcaguuugcuuu

SEQ ID NO: 1800504 - RNA, 20 nt, Human
uacauuagcaguuugcuuug

SEQ ID NO: 1800505 - RNA, 19 nt, Human
aauuaacaugaauauuuag

SEQ ID NO: 1800506 - RNA, 20 nt, Human
aauuaagaaaggauaaaguu

SEQ ID NO: 1800507 - RNA, 22 nt, Human
aauuaacuuuuauaaacuuuac

SEQ ID NO: 1800508 - RNA, 20 nt, Human
aauuaacuuuuauaaacuuu

SEQ ID NO: 1800509 - RNA, 18 nt, Human
aauuaacuuuuauaaacu

SEQ ID NO: 1800510 - RNA, 15 nt, Human
aaugucacaggcagg

SEQ ID NO: 1800511 - RNA, 17 nt, Human
uaccauccccuguagag

SEQ ID NO: 1800512 - RNA, 20 nt, Human
uacauuuaaaacauuaaaau

SEQ ID NO: 1800513 - RNA, 19 nt, Human
uacauuuaaaacauuaaaa

SEQ ID NO: 1800514 - RNA, 16 nt, Human
uacauuuaaaacauua

SEQ ID NO: 1800515 - RNA, 15 nt, Human
uacauuuaaaacauu

SEQ ID NO: 1800516 - RNA, 17 nt, Human
uaccacuuuuguucuug

SEQ ID NO: 1800517 - RNA, 20 nt, Human
uacccuggcacuauaaugua

SEQ ID NO: 1800518 - RNA, 22 nt, Human
uacccuggcacuauaauguaag

SEQ ID NO: 1800519 - RNA, 20 nt, Human
uacccgggaagggggcuggg

SEQ ID NO: 1800520 - RNA, 16 nt, Human
uacccucauguucuua

SEQ ID NO: 1800521 - RNA, 18 nt, Human
guuccccuguucacucua

SEQ ID NO: 1800522 - RNA, 16 nt, Human
guucucugaggacacu

SEQ ID NO: 1800523 - RNA, 11 nt, Human
guucucugccc

SEQ ID NO: 1800524 - RNA, 13 nt, Human
guucucugcccuc

SEQ ID NO: 1800525 - RNA, 12 nt, Human
guucucugcccu

SEQ ID NO: 1800526 - RNA, 23 nt, Human
guugauagcacagacccugcccu

SEQ ID NO: 1800527 - RNA, 22 nt, Human
guugauagcacagacccugccc

SEQ ID NO: 1800528 - RNA, 22 nt, Human
guguuuaagacauuuuuggaag

SEQ ID NO: 1800529 - RNA, 11 nt, Human
aagcucccagg

SEQ ID NO: 1800530 - RNA, 13 nt, Human
guguuuauuguca

SEQ ID NO: 1800531 - RNA, 23 nt, Human
aagcucccaggcauuccccagga

SEQ ID NO: 1800532 - RNA, 12 nt, Human
aagcucccaggc

SEQ ID NO: 1800533 - RNA, 22 nt, Human
aagcucccaggcauuccccagg

SEQ ID NO: 1800534 - RNA, 16 nt, Human
aaggaaaaaauaacaa

SEQ ID NO: 1800535 - RNA, 19 nt, Human
aaggaaaaaauaacaauga

SEQ ID NO: 1800536 - RNA, 15 nt, Human
guuccccuguucacu

SEQ ID NO: 1800537 - RNA, 17 nt, Human
guuccccuguucacucu

SEQ ID NO: 1800538 - RNA, 16 nt, Human
aagcuuuuaugugaaa

SEQ ID NO: 1800539 - RNA, 13 nt, Human
aagcucugcuccu

SEQ ID NO: 1800540 - RNA, 18 nt, Human
aagcuguuacugucuuca

SEQ ID NO: 1800541 - RNA, 13 nt, Human
aaggauaaugaau

SEQ ID NO: 1800542 - RNA, 23 nt, Human
aaggauaaaguugguaaaccuuu

SEQ ID NO: 1800543 - RNA, 21 nt, Human
aaggauaaaguugguaaaccu

SEQ ID NO: 1800544 - RNA, 20 nt, Human
aaggaggaagagaaaaaaua

SEQ ID NO: 1800545 - RNA, 11 nt, Human
aaggauaaagu

SEQ ID NO: 1800546 - RNA, 11 nt, Human
aaggauccuga

SEQ ID NO: 1800547 - RNA, 12 nt, Human
aaggauccugag

SEQ ID NO: 1800548 - RNA, 13 nt, Human
aaggauccugagc

SEQ ID NO: 1800549 - RNA, 20 nt, Human
aaggauccugagccagauuu

SEQ ID NO: 1800550 - RNA, 22 nt, Human
aaggauccugagccagauuuca

SEQ ID NO: 1800551 - RNA, 22 nt, Human
aaggagcaagucagaauagaaa

SEQ ID NO: 1800552 - RNA, 18 nt, Human
aaggagauuuacaacugg

SEQ ID NO: 1800553 - RNA, 16 nt, Human
aaggaaacccagcucu

SEQ ID NO: 1800554 - RNA, 15 nt, Human
aaggaaacccagcuc

SEQ ID NO: 1800555 - RNA, 17 nt, Human
guugggcuggugucacc

SEQ ID NO: 1800556 - RNA, 17 nt, Human
guugcccaggcuggcgu

SEQ ID NO: 1800557 - RNA, 16 nt, Human
guugcccaggcuggcg

SEQ ID NO: 1800558 - RNA, 15 nt, Human
guugcccaggcuggc

SEQ ID NO: 1800559 - RNA, 12 nt, Human
guugcugccuca

SEQ ID NO: 1800560 - RNA, 14 nt, Human
guugcccaggcugg

SEQ ID NO: 1800561 - RNA, 15 nt, Human
aaggcuaccuuugua

SEQ ID NO: 1800562 - RNA, 13 nt, Human
aaggcuaccuuug

SEQ ID NO: 1800563 - RNA, 19 nt, Human
aaggccccgcccaggcuua

SEQ ID NO: 1800564 - RNA, 14 nt, Human
aaggccccgcccag

SEQ ID NO: 1800565 - RNA, 16 nt, Human
aaggccccgcccaggc

SEQ ID NO: 1800566 - RNA, 24 nt, Human
aaggaugcacagaguuguuacauu

SEQ ID NO: 1800567 - RNA, 14 nt, Human
aaggaugcccaaag

SEQ ID NO: 1800568 - RNA, 19 nt, Human
aaggaugcccaaagaugca

SEQ ID NO: 1800569 - RNA, 22 nt, Human
aagucuuauauauuguagauaa

SEQ ID NO: 1800570 - RNA, 18 nt, Human
aagucuuagauguauaua

SEQ ID NO: 1800571 - RNA, 19 nt, Human
aagucuuagauguauauau

SEQ ID NO: 1800572 - RNA, 17 nt, Human
aagucuuagauguauau

SEQ ID NO: 1800573 - RNA, 18 nt, Human
guuuuucuaggccugggg

SEQ ID NO: 1800574 - RNA, 15 nt, Human
guuuuuuuuuaaaga

SEQ ID NO: 1800575 - RNA, 16 nt, Human
guuuuugucuuaaaaa

SEQ ID NO: 1800576 - RNA, 18 nt, Human
aaguauucuuauuuaaug

SEQ ID NO: 1800577 - RNA, 19 nt, Human
aaguauucuuauuuaauga

SEQ ID NO: 1800578 - RNA, 24 nt, Human
aagucacacaguauuacuucugcu

SEQ ID NO: 1800579 - RNA, 19 nt, Human
aagucaaggguaggguggg

SEQ ID NO: 1800580 - RNA, 21 nt, Human
aagucaagugaaaaaggagga

SEQ ID NO: 1800581 - RNA, 13 nt, Human
aagucacacagug

SEQ ID NO: 1800582 - RNA, 14 nt, Human
aagucacugcacag

SEQ ID NO: 1800583 - RNA, 12 nt, Human
aagucacugcac

SEQ ID NO: 1800584 - RNA, 23 nt, Human
aaguacuucuccacccugcucuc

SEQ ID NO: 1800585 - RNA, 22 nt, Human
aaguacuucuccacccugcucu

SEQ ID NO: 1800586 - RNA, 21 nt, Human
aaguacuucuccacccugcuc

SEQ ID NO: 1800587 - RNA, 15 nt, Human
aaguacuggagaaaa

SEQ ID NO: 1800588 - RNA, 16 nt, Human
aaguacuauguaucaa

SEQ ID NO: 1800589 - RNA, 15 nt, Human
aaguacuauguauca

SEQ ID NO: 1800590 - RNA, 17 nt, Human
guuugccucugccucug

SEQ ID NO: 1800591 - RNA, 19 nt, Human
guuugcaucugaaaauuga

SEQ ID NO: 1800592 - RNA, 13 nt, Human
guuugcuaaguga

SEQ ID NO: 1800593 - RNA, 14 nt, Human
guuucucagcuccc

SEQ ID NO: 1800594 - RNA, 22 nt, Human
guuucuaugacacaugcaaggu

SEQ ID NO: 1800595 - RNA, 22 nt, Human
guuucugccgcagcccugcaga

SEQ ID NO: 1800596 - RNA, 16 nt, Human
guuuuaagaggcaggg

SEQ ID NO: 1800597 - RNA, 18 nt, Human
guuuuaaggaugcuugua

SEQ ID NO: 1800598 - RNA, 14 nt, Human
guuuuaagaggcag

SEQ ID NO: 1800599 - RNA, 16 nt, Human
guuuuacugcagcuuu

SEQ ID NO: 1800600 - RNA, 18 nt, Human
guuuuacugcagcuuugu

SEQ ID NO: 1800601 - RNA, 13 nt, Human
aagggcccagaga

SEQ ID NO: 1800602 - RNA, 15 nt, Human
aagggcccagagagg

SEQ ID NO: 1800603 - RNA, 19 nt, Human
aaggcugagaggagagaga

SEQ ID NO: 1800604 - RNA, 19 nt, Human
aaggguaucaggugcugcc

SEQ ID NO: 1800605 - RNA, 16 nt, Human
aaggguaucuggugac

SEQ ID NO: 1800606 - RNA, 17 nt, Human
aaggggcaguggugguu

SEQ ID NO: 1800607 - RNA, 14 nt, Human
aaggggcaguggug

SEQ ID NO: 1800608 - RNA, 19 nt, Human
uaaaauuuuuaaucuuuaa

SEQ ID NO: 1800609 - RNA, 19 nt, Human
uaaaccaaggcuagaacca

SEQ ID NO: 1800610 - RNA, 17 nt, Human
uaaaauuuuuaaucuuu

SEQ ID NO: 1800611 - RNA, 16 nt, Human
uaaaauuaaagcugaa

SEQ ID NO: 1800612 - RNA, 18 nt, Human
uaaaauuaaagcugaaaa

SEQ ID NO: 1800613 - RNA, 19 nt, Human
uaaaauuaaagcugaaaac

SEQ ID NO: 1800614 - RNA, 17 nt, Human
guuuuuuuuuaaagacu

SEQ ID NO: 1800615 - RNA, 17 nt, Human
aaguuacacauuuuuca

SEQ ID NO: 1800616 - RNA, 12 nt, Human
aaguuaaauaaa

SEQ ID NO: 1800617 - RNA, 14 nt, Human
aaguuaaauaaauc

SEQ ID NO: 1800618 - RNA, 17 nt, Human
aaguucugcagauaaac

SEQ ID NO: 1800619 - RNA, 14 nt, Human
aaguuuaauugacu

SEQ ID NO: 1800620 - RNA, 14 nt, Human
uaaagaagguuuca

SEQ ID NO: 1800621 - RNA, 16 nt, Human
uaaagacuuuuaugau

SEQ ID NO: 1800622 - RNA, 10 nt, Human
uaaagacaga

SEQ ID NO: 1800623 - RNA, 9 nt, Human
uaaagacag

SEQ ID NO: 1800624 - RNA, 15 nt, Human
uaaagacaccuacug

SEQ ID NO: 1800625 - RNA, 18 nt, Human
uaaagaguuaguuugagu

SEQ ID NO: 1800626 - RNA, 13 nt, Human
uaaagauggaaaa

SEQ ID NO: 1800627 - RNA, 19 nt, Human
uaaagaugagcuuugucua

SEQ ID NO: 1800628 - RNA, 19 nt, Human
uaaaggcuaccuuuguauu

SEQ ID NO: 1800629 - RNA, 21 nt, Human
uaaaggcuaccuuuguauucu

SEQ ID NO: 1800630 - RNA, 16 nt, Human
uaaaccgccaaggcug

SEQ ID NO: 1800631 - RNA, 18 nt, Human
uaaaccgccaaggcuggg

SEQ ID NO: 1800632 - RNA, 19 nt, Human
uaaacccaguaguggugac

SEQ ID NO: 1800633 - RNA, 12 nt, Human
uaaacugccccc

SEQ ID NO: 1800634 - RNA, 13 nt, Human
uaaauaacuuuuu

SEQ ID NO: 1800635 - RNA, 21 nt, Human
aauacaccacuacauucuguu

SEQ ID NO: 1800636 - RNA, 20 nt, Human
aauacaccacuacauucugu

SEQ ID NO: 1800637 - RNA, 18 nt, Human
aauacaccacuacauucu

SEQ ID NO: 1800638 - RNA, 16 nt, Human
aauacaccacuacauu

SEQ ID NO: 1800639 - RNA, 15 nt, Human
aauacaccacuacau

SEQ ID NO: 1800640 - RNA, 19 nt, Human
uaaaucuccaaaauaaaac

SEQ ID NO: 1800641 - RNA, 19 nt, Human
uaaauaguaaaaauaaaau

SEQ ID NO: 1800642 - RNA, 20 nt, Human
uaaauaguaaaaauaaaauu

SEQ ID NO: 1800643 - RNA, 13 nt, Human
uaacaagccaccc

SEQ ID NO: 1800644 - RNA, 16 nt, Human
uaacaacuaugauuug

SEQ ID NO: 1800645 - RNA, 21 nt, Human
uaacaacuaugauuuggaaaa

SEQ ID NO: 1800646 - RNA, 22 nt, Human
uaacaacuaugauuuggaaaau

SEQ ID NO: 1800647 - RNA, 19 nt, Human
uaaauuuuuuuuguuucau

SEQ ID NO: 1800648 - RNA, 22 nt, Human
uaaaucuccaaaauaaaacuuu

SEQ ID NO: 1800649 - RNA, 21 nt, Human
uaaaucuccaaaauaaaacuu

SEQ ID NO: 1800650 - RNA, 20 nt, Human
uaaaucuccaaaauaaaacu

SEQ ID NO: 1800651 - RNA, 17 nt, Human
uaaaugauuucauucaa

SEQ ID NO: 1800652 - RNA, 20 nt, Human
uaaauguuuuuuuuuaaaga

SEQ ID NO: 1800653 - RNA, 23 nt, Human
uaaauguuuuuuuuuaaagacuu

SEQ ID NO: 1800654 - RNA, 15 nt, Human
aauaacaauaaaaga

SEQ ID NO: 1800655 - RNA, 12 nt, Human
aauaacauguaa

SEQ ID NO: 1800656 - RNA, 19 nt, Human
aauaacauguaauuaagua

SEQ ID NO: 1800657 - RNA, 22 nt, Human
aauaacauguaauuaaguacua

SEQ ID NO: 1800658 - RNA, 12 nt, Human
aauaaauuauuu

SEQ ID NO: 1800659 - RNA, 15 nt, Human
aauaacuaaaaggua

SEQ ID NO: 1800660 - RNA, 12 nt, Human
aauaaaaauaau

SEQ ID NO: 1800661 - RNA, 16 nt, Human
aauaaaguacaagagc

SEQ ID NO: 1800662 - RNA, 14 nt, Human
aauaaaguaauuau

SEQ ID NO: 1800663 - RNA, 16 nt, Human
aauaaaaucuugaaaa

SEQ ID NO: 1800664 - RNA, 20 nt, Human
uaaaguguauuuuuuuacua

SEQ ID NO: 1800665 - RNA, 19 nt, Human
uaaaguguauuuuuuuacu

SEQ ID NO: 1800666 - RNA, 15 nt, Human
uaaaguguauuuuuu

SEQ ID NO: 1800667 - RNA, 14 nt, Human
uaaaguguauuuuu

SEQ ID NO: 1800668 - RNA, 22 nt, Human
uaaagucuguugauuaaagaug

SEQ ID NO: 1800669 - RNA, 21 nt, Human
uaaagucuguugauuaaagau

SEQ ID NO: 1800670 - RNA, 13 nt, Human
uaaagucaggggu

SEQ ID NO: 1800671 - RNA, 13 nt, Human
aagacccaaaagg

SEQ ID NO: 1800672 - RNA, 17 nt, Human
guggcagcugcggucca

SEQ ID NO: 1800673 - RNA, 14 nt, Human
guggcagcugcggu

SEQ ID NO: 1800674 - RNA, 22 nt, Human
guggcagcucaccucucccuug

SEQ ID NO: 1800675 - RNA, 18 nt, Human
guggcaccagcagccugg

SEQ ID NO: 1800676 - RNA, 13 nt, Human
guggcaccagcag

SEQ ID NO: 1800677 - RNA, 14 nt, Human
guggcaccagcagc

SEQ ID NO: 1800678 - RNA, 23 nt, Human
guggauuuaacagaaauguacag

SEQ ID NO: 1800679 - RNA, 21 nt, Human
guggauuuaacagaaauguac

SEQ ID NO: 1800680 - RNA, 19 nt, Human
gugcugggccccugccucu

SEQ ID NO: 1800681 - RNA, 16 nt, Human
gugcugggccccugcc

SEQ ID NO: 1800682 - RNA, 23 nt, Human
aagaagguuucagaaagaagugg

SEQ ID NO: 1800683 - RNA, 18 nt, Human
gugcugcccugcccaccu

SEQ ID NO: 1800684 - RNA, 21 nt, Human
gugcugcccugcccaccuggc

SEQ ID NO: 1800685 - RNA, 19 nt, Human
gugcugcccugcccaccug

SEQ ID NO: 1800686 - RNA, 20 nt, Human
gugcugcccugcccaccugg

SEQ ID NO: 1800687 - RNA, 24 nt, Human
guggacacagcucuucuccaggcu

SEQ ID NO: 1800688 - RNA, 17 nt, Human
guggacacagcucuucu

SEQ ID NO: 1800689 - RNA, 15 nt, Human
guggacacagcucuu

SEQ ID NO: 1800690 - RNA, 14 nt, Human
guggacacagcucu

SEQ ID NO: 1800691 - RNA, 16 nt, Human
aagaaaauaccaagga

SEQ ID NO: 1800692 - RNA, 15 nt, Human
aagaagcucucuccu

SEQ ID NO: 1800693 - RNA, 14 nt, Human
aagaagcucucucc

SEQ ID NO: 1800694 - RNA, 16 nt, Human
aagaagcccaggaaag

SEQ ID NO: 1800695 - RNA, 17 nt, Human
aagaagcccaggaaagg

SEQ ID NO: 1800696 - RNA, 22 nt, Human
aagaaaaguuuuguaaauuucu

SEQ ID NO: 1800697 - RNA, 21 nt, Human
aagaaaaguuuuguaaauuuc

SEQ ID NO: 1800698 - RNA, 16 nt, Human
aagaaaaguuuuguaa

SEQ ID NO: 1800699 - RNA, 15 nt, Human
aagaaaaguuuugua

SEQ ID NO: 1800700 - RNA, 20 nt, Human
aagaaaaaggaugcacagag

SEQ ID NO: 1800701 - RNA, 19 nt, Human
aagaaaaaggaugcacaga

SEQ ID NO: 1800702 - RNA, 22 nt, Human
aagaaaaaggaugcacagaguu

SEQ ID NO: 1800703 - RNA, 13 nt, Human
aacuuguuuucug

SEQ ID NO: 1800704 - RNA, 14 nt, Human
aacuuggcgcugcc

SEQ ID NO: 1800705 - RNA, 14 nt, Human
aacuuggaaauagu

SEQ ID NO: 1800706 - RNA, 15 nt, Human
aacuuguaaaugugg

SEQ ID NO: 1800707 - RNA, 17 nt, Human
aacuuggcgcugccccu

SEQ ID NO: 1800708 - RNA, 23 nt, Human
aacuugguucccauuugcuccuu

SEQ ID NO: 1800709 - RNA, 16 nt, Human
gugccuggccacgccc

SEQ ID NO: 1800710 - RNA, 15 nt, Human
gugccucugggacug

SEQ ID NO: 1800711 - RNA, 17 nt, Human
gugcacacaccagagcc

SEQ ID NO: 1800712 - RNA, 18 nt, Human
gugcacguacacacacau

SEQ ID NO: 1800713 - RNA, 14 nt, Human
gugcacacaccaga

SEQ ID NO: 1800714 - RNA, 12 nt, Human
gugcacacacca

SEQ ID NO: 1800715 - RNA, 20 nt, Human
gugcauuugaggucuguucu

SEQ ID NO: 1800716 - RNA, 22 nt, Human
gugcauuugaggucuguucuuu

SEQ ID NO: 1800717 - RNA, 21 nt, Human
gugcauuugaggucuguucuu

SEQ ID NO: 1800718 - RNA, 15 nt, Human
gugcauuuggugguu

SEQ ID NO: 1800719 - RNA, 14 nt, Human
gugccaagcagagg

SEQ ID NO: 1800720 - RNA, 12 nt, Human
aagcaaaugucu

SEQ ID NO: 1800721 - RNA, 13 nt, Human
aagcaaaugugaa

SEQ ID NO: 1800722 - RNA, 14 nt, Human
aagcaaaugugaau

SEQ ID NO: 1800723 - RNA, 16 nt, Human
aagcaagauuucagau

SEQ ID NO: 1800724 - RNA, 22 nt, Human
aagauguagaggagaaacugga

SEQ ID NO: 1800725 - RNA, 13 nt, Human
aagcaaaauguga

SEQ ID NO: 1800726 - RNA, 19 nt, Human
aagauguagaggagaaacu

SEQ ID NO: 1800727 - RNA, 16 nt, Human
aagaguaggaagacuu

SEQ ID NO: 1800728 - RNA, 18 nt, Human
aagaguaggaagacuuug

SEQ ID NO: 1800729 - RNA, 19 nt, Human
aagaguaggaagacuuugg

SEQ ID NO: 1800730 - RNA, 15 nt, Human
aagauauuuugcuuu

SEQ ID NO: 1800731 - RNA, 19 nt, Human
gugguguuuccuggcacug

SEQ ID NO: 1800732 - RNA, 18 nt, Human
gugguuauggagagggug

SEQ ID NO: 1800733 - RNA, 22 nt, Human
aagauauuuugcuuugugauuu

SEQ ID NO: 1800734 - RNA, 20 nt, Human
aagaguaggaagacuuugga

SEQ ID NO: 1800735 - RNA, 20 nt, Human
aagauauuuugcuuugugau

SEQ ID NO: 1800736 - RNA, 17 nt, Human
aagauauuuugcuuugu

SEQ ID NO: 1800737 - RNA, 19 nt, Human
guguguguaugcgugugug

SEQ ID NO: 1800738 - RNA, 19 nt, Human
gugugguguuuccuggcac

SEQ ID NO: 1800739 - RNA, 13 nt, Human
guguuuaagacau

SEQ ID NO: 1800740 - RNA, 14 nt, Human
guguuuaagacauu

SEQ ID NO: 1800741 - RNA, 20 nt, Human
gugucccaaaaagaaaggag

SEQ ID NO: 1800742 - RNA, 19 nt, Human
gugucuugcaauggcagcc

SEQ ID NO: 1800743 - RNA, 21 nt, Human
gugucuugcaauggcagccuu

SEQ ID NO: 1800744 - RNA, 18 nt, Human
gugugagucaccaagccc

SEQ ID NO: 1800745 - RNA, 13 nt, Human
gugugagucacca

SEQ ID NO: 1800746 - RNA, 15 nt, Human
gugugguguuuccug

SEQ ID NO: 1800747 - RNA, 12 nt, Human
aagaccagucca

SEQ ID NO: 1800748 - RNA, 23 nt, Human
aagaccccuuaccacugcucuga

SEQ ID NO: 1800749 - RNA, 21 nt, Human
aagacgcugugcugcccugcc

SEQ ID NO: 1800750 - RNA, 22 nt, Human
aagacgcugugcugcccugccc

SEQ ID NO: 1800751 - RNA, 23 nt, Human
aagacgcugugcugcccugccca

SEQ ID NO: 1800752 - RNA, 17 nt, Human
aagacucauucuucugu

SEQ ID NO: 1800753 - RNA, 16 nt, Human
aagagcccaggccucc

SEQ ID NO: 1800754 - RNA, 12 nt, Human
aagagcccaggc

SEQ ID NO: 1800755 - RNA, 14 nt, Human
aagagcccaggccu

SEQ ID NO: 1800756 - RNA, 16 nt, Human
aagacuguacaaagua

SEQ ID NO: 1800757 - RNA, 16 nt, Human
aagagauugugguuuc

SEQ ID NO: 1800758 - RNA, 19 nt, Human
aagagauugugguuucauu

SEQ ID NO: 1800759 - RNA, 16 nt, Human
guggcccgacagccug

SEQ ID NO: 1800760 - RNA, 21 nt, Human
guggcuucccgcucagcccuc

SEQ ID NO: 1800761 - RNA, 15 nt, Human
guggccucccaacuc

SEQ ID NO: 1800762 - RNA, 17 nt, Human
guggcccgacagccugg

SEQ ID NO: 1800763 - RNA, 13 nt, Human
guggccucccaac

SEQ ID NO: 1800764 - RNA, 14 nt, Human
guggccucccaacu

SEQ ID NO: 1800765 - RNA, 15 nt, Human
gugggauccuccagg

SEQ ID NO: 1800766 - RNA, 18 nt, Human
gugggauccuccaggugc

SEQ ID NO: 1800767 - RNA, 12 nt, Human
gugggagcugag

SEQ ID NO: 1800768 - RNA, 15 nt, Human
gugguguuuccuggc

SEQ ID NO: 1800769 - RNA, 16 nt, Human
gugguguuuccuggca

SEQ ID NO: 1800770 - RNA, 18 nt, Human
guggggggggugcugggc

SEQ ID NO: 1800771 - RNA, 19 nt, Human
aacagguuuuccugaagaa

SEQ ID NO: 1800772 - RNA, 20 nt, Human
aacagacuggaagcacagcu

SEQ ID NO: 1800773 - RNA, 13 nt, Human
guccuacccaccc

SEQ ID NO: 1800774 - RNA, 12 nt, Human
aacagaggauau

SEQ ID NO: 1800775 - RNA, 14 nt, Human
aacaucaacaucuu

SEQ ID NO: 1800776 - RNA, 22 nt, Human
aacauguuuuucuucucccuca

SEQ ID NO: 1800777 - RNA, 18 nt, Human
aacauacucccaucugug

SEQ ID NO: 1800778 - RNA, 16 nt, Human
aacauacucccaucug

SEQ ID NO: 1800779 - RNA, 20 nt, Human
aacauacucccaucugugaa

SEQ ID NO: 1800780 - RNA, 23 nt, Human
guccccuguuuguuucugaaagg

SEQ ID NO: 1800781 - RNA, 18 nt, Human
gucccccugacaacacuc

SEQ ID NO: 1800782 - RNA, 13 nt, Human
gucccccugacaa

SEQ ID NO: 1800783 - RNA, 15 nt, Human
guccccgcacugggc

SEQ ID NO: 1800784 - RNA, 16 nt, Human
guccccgcacugggcu

SEQ ID NO: 1800785 - RNA, 21 nt, Human
guccgaaagggacuuggaagc

SEQ ID NO: 1800786 - RNA, 13 nt, Human
gucccuuuuccuu

SEQ ID NO: 1800787 - RNA, 22 nt, Human
guccgaaagggacuuggaagcu

SEQ ID NO: 1800788 - RNA, 18 nt, Human
gucccaccuuggcugcag

SEQ ID NO: 1800789 - RNA, 17 nt, Human
gucccaccuuggcugca

SEQ ID NO: 1800790 - RNA, 20 nt, Human
gucccaccuuggcugcaggg

SEQ ID NO: 1800791 - RNA, 19 nt, Human
gucccaccuuggcugcagg

SEQ ID NO: 1800792 - RNA, 12 nt, Human
gucccccucugg

SEQ ID NO: 1800793 - RNA, 14 nt, Human
gucccccucuggcu

SEQ ID NO: 1800794 - RNA, 22 nt, Human
guagccucaaucgagugagaca

SEQ ID NO: 1800795 - RNA, 22 nt, Human
guagcucuaggagggcuggcaa

SEQ ID NO: 1800796 - RNA, 15 nt, Human
gucucaggucccugc

SEQ ID NO: 1800797 - RNA, 16 nt, Human
gucucaggucccugca

SEQ ID NO: 1800798 - RNA, 23 nt, Human
gucucaguccaugaagauguaga

SEQ ID NO: 1800799 - RNA, 15 nt, Human
gucuaugggacucaa

SEQ ID NO: 1800800 - RNA, 14 nt, Human
gucuaugggacuca

SEQ ID NO: 1800801 - RNA, 22 nt, Human
gucucaaacucuugaccucagg

SEQ ID NO: 1800802 - RNA, 16 nt, Human
gucucaaacuccugac

SEQ ID NO: 1800803 - RNA, 20 nt, Human
gucucaagagggcacuggug

SEQ ID NO: 1800804 - RNA, 22 nt, Human
gucucaagagggcacugguggc

SEQ ID NO: 1800805 - RNA, 15 nt, Human
gucucaagagggcac

SEQ ID NO: 1800806 - RNA, 17 nt, Human
gucucaagagggcacug

SEQ ID NO: 1800807 - RNA, 22 nt, Human
aacauuuguucuauagcuuuuc

SEQ ID NO: 1800808 - RNA, 16 nt, Human
aacauuuugucauaua

SEQ ID NO: 1800809 - RNA, 13 nt, Human
gucuccauguuug

SEQ ID NO: 1800810 - RNA, 13 nt, Human
aaccacaucuugc

SEQ ID NO: 1800811 - RNA, 16 nt, Human
aaccaaauauuccaga

SEQ ID NO: 1800812 - RNA, 17 nt, Human
guccugcugcaguugcc

SEQ ID NO: 1800813 - RNA, 13 nt, Human
guccugcugcagu

SEQ ID NO: 1800814 - RNA, 16 nt, Human
guccugcugcaguugc

SEQ ID NO: 1800815 - RNA, 13 nt, Human
aacauuaaaauau

SEQ ID NO: 1800816 - RNA, 14 nt, Human
gucgaggacaggga

SEQ ID NO: 1800817 - RNA, 14 nt, Human
gucgcccagucugg

SEQ ID NO: 1800818 - RNA, 13 nt, Human
gucgcccagucug

SEQ ID NO: 1800819 - RNA, 15 nt, Human
gucgcccaggcugga

SEQ ID NO: 1800820 - RNA, 20 nt, Human
gucgcccaggcuggagugca

SEQ ID NO: 1800821 - RNA, 14 nt, Human
gucgcccaggcugg

SEQ ID NO: 1800822 - RNA, 23 nt, Human
gucgcccagucuggaaugcagug

SEQ ID NO: 1800823 - RNA, 14 nt, Human
gucgcccuggacug

SEQ ID NO: 1800824 - RNA, 18 nt, Human
gucgcccuggacugugug

SEQ ID NO: 1800825 - RNA, 20 nt, Human
gucuaccugaggggccucuu

SEQ ID NO: 1800826 - RNA, 23 nt, Human
aacguggcugcuucaaggauccu

SEQ ID NO: 1800827 - RNA, 17 nt, Human
aacuagaacugaauuuu

SEQ ID NO: 1800828 - RNA, 16 nt, Human
gucuucaguaagccgu

SEQ ID NO: 1800829 - RNA, 15 nt, Human
gucuuuguacagaca

SEQ ID NO: 1800830 - RNA, 16 nt, Human
gucuuuguacagacaa

SEQ ID NO: 1800831 - RNA, 13 nt, Human
aaccuguucugcu

SEQ ID NO: 1800832 - RNA, 17 nt, Human
aaccuguucugcuuucc

SEQ ID NO: 1800833 - RNA, 19 nt, Human
aaccugauugugucucuug

SEQ ID NO: 1800834 - RNA, 18 nt, Human
aaccugauugugucucuu

SEQ ID NO: 1800835 - RNA, 23 nt, Human
gucugacaggcaaugcuggcugu

SEQ ID NO: 1800836 - RNA, 22 nt, Human
gucugacaggcaaugcuggcug

SEQ ID NO: 1800837 - RNA, 21 nt, Human
gucugacaggcaaugcuggcu

SEQ ID NO: 1800838 - RNA, 17 nt, Human
gucugaagucacugcac

SEQ ID NO: 1800839 - RNA, 19 nt, Human
gucugaagucacugcacag

SEQ ID NO: 1800840 - RNA, 20 nt, Human
gucucuugguccugcugcag

SEQ ID NO: 1800841 - RNA, 18 nt, Human
gucucuugguccugcugc

SEQ ID NO: 1800842 - RNA, 19 nt, Human
gucucuugguccugcugca

SEQ ID NO: 1800843 - RNA, 17 nt, Human
gucucuugguccugcug

SEQ ID NO: 1800844 - RNA, 23 nt, Human
gucucuuuaaugucacaggcagg

SEQ ID NO: 1800845 - RNA, 22 nt, Human
gucucuuuaaugucacaggcag

SEQ ID NO: 1800846 - RNA, 16 nt, Human
gucugaagucacugca

SEQ ID NO: 1800847 - RNA, 14 nt, Human
gucugaaggcuggg

SEQ ID NO: 1800848 - RNA, 19 nt, Human
gucugaaggcuggguucug

SEQ ID NO: 1800849 - RNA, 20 nt, Human
gucucuuuaaugucacaggc

SEQ ID NO: 1800850 - RNA, 19 nt, Human
gucucuuuaaugucacagg

SEQ ID NO: 1800851 - RNA, 18 nt, Human
gucucuuuaaugucacag

SEQ ID NO: 1800852 - RNA, 16 nt, Human
aacucuguuacacuuu

SEQ ID NO: 1800853 - RNA, 15 nt, Human
aacugaacauuccag

SEQ ID NO: 1800854 - RNA, 14 nt, Human
aacugaacucugac

SEQ ID NO: 1800855 - RNA, 17 nt, Human
gugaguccuggcauggg

SEQ ID NO: 1800856 - RNA, 19 nt, Human
gugaguacuacaguccucc

SEQ ID NO: 1800857 - RNA, 21 nt, Human
gugaguacuacaguccuccca

SEQ ID NO: 1800858 - RNA, 15 nt, Human
gugagucgaggacag

SEQ ID NO: 1800859 - RNA, 20 nt, Human
gugaguccuggcaugggaau

SEQ ID NO: 1800860 - RNA, 16 nt, Human
gugagaggggaacaga

SEQ ID NO: 1800861 - RNA, 13 nt, Human
gugagagcugggu

SEQ ID NO: 1800862 - RNA, 12 nt, Human
gugagacagacu

SEQ ID NO: 1800863 - RNA, 21 nt, Human
gugagcacuaaggugugcucu

SEQ ID NO: 1800864 - RNA, 15 nt, Human
gugagcaggcuguga

SEQ ID NO: 1800865 - RNA, 17 nt, Human
gugaguacuacaguccu

SEQ ID NO: 1800866 - RNA, 12 nt, Human
gugaccccaggu

SEQ ID NO: 1800867 - RNA, 12 nt, Human
gugagagcuggg

SEQ ID NO: 1800868 - RNA, 23 nt, Human
gugaagacaaugacuuacuguac

SEQ ID NO: 1800869 - RNA, 14 nt, Human
gugaagugaagaca

SEQ ID NO: 1800870 - RNA, 19 nt, Human
gugacagaggcagccccau

SEQ ID NO: 1800871 - RNA, 18 nt, Human
gugacagaggcagcccca

SEQ ID NO: 1800872 - RNA, 16 nt, Human
gugacagaggcagccc

SEQ ID NO: 1800873 - RNA, 14 nt, Human
gugacaugucuuuu

SEQ ID NO: 1800874 - RNA, 17 nt, Human
gugaccaaugaugguca

SEQ ID NO: 1800875 - RNA, 18 nt, Human
gugaccauguuuuguuua

SEQ ID NO: 1800876 - RNA, 18 nt, Human
gugaccagcaccaucucu

SEQ ID NO: 1800877 - RNA, 21 nt, Human
gugaccagcaccaucucuccu

SEQ ID NO: 1800878 - RNA, 19 nt, Human
cugccuguucagcuccagc

SEQ ID NO: 1800879 - RNA, 20 nt, Human
cugccuguugggccaggagc

SEQ ID NO: 1800880 - RNA, 18 nt, Human
cugccuguucagcuccag

SEQ ID NO: 1800881 - RNA, 17 nt, Human
cugccuguucagcucca

SEQ ID NO: 1800882 - RNA, 13 nt, Human
cugccuccucuuc

SEQ ID NO: 1800883 - RNA, 14 nt, Human
cugccuccucuuca

SEQ ID NO: 1800884 - RNA, 15 nt, Human
cugccuccucuucaa

SEQ ID NO: 1800885 - RNA, 24 nt, Human
cugccuccucuucaacugaccagc

SEQ ID NO: 1800886 - RNA, 23 nt, Human
cugccucucccaucacuucccua

SEQ ID NO: 1800887 - RNA, 15 nt, Human
cugccucucccauca

SEQ ID NO: 1800888 - RNA, 22 nt, Human
cugccucucccaucacuucccu

SEQ ID NO: 1800889 - RNA, 20 nt, Human
cugaucugaugcaagcaaga

SEQ ID NO: 1800890 - RNA, 18 nt, Human
cugcugacuguuuucucu

SEQ ID NO: 1800891 - RNA, 21 nt, Human
cugcugacuguuuucucuuga

SEQ ID NO: 1800892 - RNA, 23 nt, Human
cugccuguugggccaggagccuc

SEQ ID NO: 1800893 - RNA, 21 nt, Human
cugccuguugggccaggagcc

SEQ ID NO: 1800894 - RNA, 22 nt, Human
cugccuguugggccaggagccu

SEQ ID NO: 1800895 - RNA, 20 nt, Human
cugcuuuugucuaugggacu

SEQ ID NO: 1800896 - RNA, 22 nt, Human
cugcuucaaggauccugagcca

SEQ ID NO: 1800897 - RNA, 23 nt, Human
cugcuucaaggauccugagccag

SEQ ID NO: 1800898 - RNA, 19 nt, Human
cugcuucaaauauuucccu

SEQ ID NO: 1800899 - RNA, 12 nt, Human
cugcuucaagga

SEQ ID NO: 1800900 - RNA, 13 nt, Human
cugcuucaaggau

SEQ ID NO: 1800901 - RNA, 21 nt, Human
cugcuucaaggauccugagcc

SEQ ID NO: 1800902 - RNA, 14 nt, Human
cugcuucaaauauu

SEQ ID NO: 1800903 - RNA, 21 nt, Human
cugcuuuugucuaugggacuc

SEQ ID NO: 1800904 - RNA, 19 nt, Human
cugcuuuuuaaagaaugcu

SEQ ID NO: 1800905 - RNA, 14 nt, Human
cuggaagcacagcu

SEQ ID NO: 1800906 - RNA, 14 nt, Human
cuggagaaaaugga

SEQ ID NO: 1800907 - RNA, 20 nt, Human
cuggguucacugcaaccucc

SEQ ID NO: 1800908 - RNA, 18 nt, Human
cuggguucacugcaaccu

SEQ ID NO: 1800909 - RNA, 15 nt, Human
cuggguucacugcaa

SEQ ID NO: 1800910 - RNA, 15 nt, Human
cuggggccaggcugg

SEQ ID NO: 1800911 - RNA, 12 nt, Human
cugggccagaau

SEQ ID NO: 1800912 - RNA, 14 nt, Human
cugggccagaauuu

SEQ ID NO: 1800913 - RNA, 20 nt, Human
cugggcaccggggccucgga

SEQ ID NO: 1800914 - RNA, 12 nt, Human
cugggcagaagg

SEQ ID NO: 1800915 - RNA, 15 nt, Human
cugggcagaaggaag

SEQ ID NO: 1800916 - RNA, 14 nt, Human
cuggccuagcauac

SEQ ID NO: 1800917 - RNA, 15 nt, Human
cuggcccugcccugg

SEQ ID NO: 1800918 - RNA, 16 nt, Human
cuggccgggagccuga

SEQ ID NO: 1800919 - RNA, 22 nt, Human
cuggccgggaccccgagccugg

SEQ ID NO: 1800920 - RNA, 11 nt, Human
cuggcccugcc

SEQ ID NO: 1800921 - RNA, 13 nt, Human
cuggcccugcccu

SEQ ID NO: 1800922 - RNA, 14 nt, Human
cuggcccugcccug

SEQ ID NO: 1800923 - RNA, 22 nt, Human
cuggccccucagggucccuggu

SEQ ID NO: 1800924 - RNA, 11 nt, Human
cugggacacag

SEQ ID NO: 1800925 - RNA, 17 nt, Human
cuggcagaguugaagac

SEQ ID NO: 1800926 - RNA, 18 nt, Human
cuggcagaguugaagaca

SEQ ID NO: 1800927 - RNA, 14 nt, Human
cuggcagaggaggg

SEQ ID NO: 1800928 - RNA, 19 nt, Human
cuggcagaguugaagacag

SEQ ID NO: 1800929 - RNA, 11 nt, Human
cuggcagccca

SEQ ID NO: 1800930 - RNA, 12 nt, Human
cuggcagccccu

SEQ ID NO: 1800931 - RNA, 21 nt, Human
cuggcagccgugccuucagcu

SEQ ID NO: 1800932 - RNA, 22 nt, Human
cuggcagccgugccuucagcuc

SEQ ID NO: 1800933 - RNA, 19 nt, Human
cuggcagccgugccuucag

SEQ ID NO: 1800934 - RNA, 20 nt, Human
cuggcagccgugccuucagc

SEQ ID NO: 1800935 - RNA, 13 nt, Human
cuggcagccccug

SEQ ID NO: 1800936 - RNA, 14 nt, Human
cuuaaaacaacacu

SEQ ID NO: 1800937 - RNA, 17 nt, Human
cuuacaagccagcugga

SEQ ID NO: 1800938 - RNA, 16 nt, Human
cuuacaagccagcugg

SEQ ID NO: 1800939 - RNA, 21 nt, Human
cuuacauuagcaguuugcuuu

SEQ ID NO: 1800940 - RNA, 22 nt, Human
cuuacauuagcaguuugcuuug

SEQ ID NO: 1800941 - RNA, 20 nt, Human
cuuacauuuuacuuuuuccu

SEQ ID NO: 1800942 - RNA, 15 nt, Human
cuuaccagcagagca

SEQ ID NO: 1800943 - RNA, 22 nt, Human
cuguuggcugggggccucagug

SEQ ID NO: 1800944 - RNA, 19 nt, Human
cuguuggcugggggccuca

SEQ ID NO: 1800945 - RNA, 14 nt, Human
cuguuggcuggggg

SEQ ID NO: 1800946 - RNA, 12 nt, Human
cuguuuaagaga

SEQ ID NO: 1800947 - RNA, 14 nt, Human
cuguuuaagagaca

SEQ ID NO: 1800948 - RNA, 21 nt, Human
cuuaaaaaugguuuaaauggu

SEQ ID NO: 1800949 - RNA, 22 nt, Human
cuuagcucauucuccuuguguu

SEQ ID NO: 1800950 - RNA, 16 nt, Human
cuuaccagcagagcac

SEQ ID NO: 1800951 - RNA, 13 nt, Human
cuuagcugggaga

SEQ ID NO: 1800952 - RNA, 23 nt, Human
cuuagcucauucuccuuguguua

SEQ ID NO: 1800953 - RNA, 15 nt, Human
cuuaggaagaauuuu

SEQ ID NO: 1800954 - RNA, 19 nt, Human
cuuagggaaggauacaaaa

SEQ ID NO: 1800955 - RNA, 21 nt, Human
cuuagggaaggauacaaaagc

SEQ ID NO: 1800956 - RNA, 21 nt, Human
cugugcugcccugcccaccug

SEQ ID NO: 1800957 - RNA, 17 nt, Human
cugugucagcauagaag

SEQ ID NO: 1800958 - RNA, 19 nt, Human
cugugucagcauagaagua

SEQ ID NO: 1800959 - RNA, 15 nt, Human
cugugcugcccugcc

SEQ ID NO: 1800960 - RNA, 17 nt, Human
cugugcugcccugccca

SEQ ID NO: 1800961 - RNA, 18 nt, Human
cugugcugcccugcccac

SEQ ID NO: 1800962 - RNA, 19 nt, Human
cugugcugcccugcccacc

SEQ ID NO: 1800963 - RNA, 12 nt, Human
cugugcugcccu

SEQ ID NO: 1800964 - RNA, 13 nt, Human
cugugcugcccug

SEQ ID NO: 1800965 - RNA, 14 nt, Human
cugugcugcccugc

SEQ ID NO: 1800966 - RNA, 16 nt, Human
cugucgcccagucugg

SEQ ID NO: 1800967 - RNA, 15 nt, Human
cugucgcccagucug

SEQ ID NO: 1800968 - RNA, 19 nt, Human
cugucaauuacaggaagua

SEQ ID NO: 1800969 - RNA, 20 nt, Human
cugucaauuacaggaaguac

SEQ ID NO: 1800970 - RNA, 23 nt, Human
cugucaauuacaggaaguacugg

SEQ ID NO: 1800971 - RNA, 21 nt, Human
cuguccugggagugagcuggu

SEQ ID NO: 1800972 - RNA, 13 nt, Human
cuguagaguggga

SEQ ID NO: 1800973 - RNA, 19 nt, Human
cuguagaaaagggaacuga

SEQ ID NO: 1800974 - RNA, 22 nt, Human
cuggugacaugucuuuucuugc

SEQ ID NO: 1800975 - RNA, 13 nt, Human
cugguuuccugcc

SEQ ID NO: 1800976 - RNA, 14 nt, Human
cugguuuccugccc

SEQ ID NO: 1800977 - RNA, 16 nt, Human
cugguuuccugcccug

SEQ ID NO: 1800978 - RNA, 16 nt, Human
cuuucuacccagcgag

SEQ ID NO: 1800979 - RNA, 15 nt, Human
cuuucuacccagcga

SEQ ID NO: 1800980 - RNA, 18 nt, Human
cuuugacgccaucccagc

SEQ ID NO: 1800981 - RNA, 16 nt, Human
cuuugacgccauccca

SEQ ID NO: 1800982 - RNA, 17 nt, Human
cuuugacgccaucccag

SEQ ID NO: 1800983 - RNA, 22 nt, Human
cuuuguauucucuccuguaccu

SEQ ID NO: 1800984 - RNA, 21 nt, Human
cuuuuauaaacuuuaccuuuu

SEQ ID NO: 1800985 - RNA, 20 nt, Human
cuuuuauaaacuuuaccuuu

SEQ ID NO: 1800986 - RNA, 14 nt, Human
cuuuguaaugaaaa

SEQ ID NO: 1800987 - RNA, 15 nt, Human
cuuuguaaugaaaac

SEQ ID NO: 1800988 - RNA, 16 nt, Human
cuuuguaaugaaaacc

SEQ ID NO: 1800989 - RNA, 12 nt, Human
cuuuguaugcac

SEQ ID NO: 1800990 - RNA, 17 nt, Human
cuuuguauucucuccug

SEQ ID NO: 1800991 - RNA, 14 nt, Human
cuuucacccuuuuc

SEQ ID NO: 1800992 - RNA, 15 nt, Human
cuuucacccuuuucu

SEQ ID NO: 1800993 - RNA, 20 nt, Human
cuuucacccuuuucuguuug

SEQ ID NO: 1800994 - RNA, 23 nt, Human
cuuuaaugucacaggcaggucca

SEQ ID NO: 1800995 - RNA, 19 nt, Human
cuuggugucgggcaugaca

SEQ ID NO: 1800996 - RNA, 20 nt, Human
cuuggugucgggcaugacac

SEQ ID NO: 1800997 - RNA, 13 nt, Human
cuugucuuuggac

SEQ ID NO: 1800998 - RNA, 15 nt, Human
cuugucuuuggaccc

SEQ ID NO: 1800999 - RNA, 18 nt, Human
cuugucuuuggacccuga

SEQ ID NO: 1801000 - RNA, 19 nt, Human
cuugucuuuggacccugag

SEQ ID NO: 1801001 - RNA, 23 nt, Human
cuuggguucaagugauucuccug

SEQ ID NO: 1801002 - RNA, 22 nt, Human
cuugguagaagcccuucuaccu

SEQ ID NO: 1801003 - RNA, 14 nt, Human
cuugguccugcugc

SEQ ID NO: 1801004 - RNA, 16 nt, Human
cuuggucugugagaug

SEQ ID NO: 1801005 - RNA, 19 nt, Human
cuuggucugugagaugcua

SEQ ID NO: 1801006 - RNA, 13 nt, Human
cuucucacauuua

SEQ ID NO: 1801007 - RNA, 20 nt, Human
cuucucacauuuauauuuuu

SEQ ID NO: 1801008 - RNA, 22 nt, Human
cuuccucugaggcugaaauuca

SEQ ID NO: 1801009 - RNA, 22 nt, Human
cuuccucuuuccaucuacccuc

SEQ ID NO: 1801010 - RNA, 16 nt, Human
cuuccucugaggcuga

SEQ ID NO: 1801011 - RNA, 21 nt, Human
cuuccucuuuccaucuacccu

SEQ ID NO: 1801012 - RNA, 13 nt, Human
cuuccucuccacu

SEQ ID NO: 1801013 - RNA, 14 nt, Human
cuuccucuccacug

SEQ ID NO: 1801014 - RNA, 15 nt, Human
cuuccucuccacugc

SEQ ID NO: 1801015 - RNA, 14 nt, Human
cuuccucugagccu

SEQ ID NO: 1801016 - RNA, 15 nt, Human
cuuccucugagccuu

SEQ ID NO: 1801017 - RNA, 13 nt, Human
cuuccuccuggug

SEQ ID NO: 1801018 - RNA, 13 nt, Human
cuucuucagagac

SEQ ID NO: 1801019 - RNA, 14 nt, Human
cuucuucagagacu

SEQ ID NO: 1801020 - RNA, 18 nt, Human
cuucuucagagacuccug

SEQ ID NO: 1801021 - RNA, 23 nt, Human
cuuggauuguccccgacccuugc

SEQ ID NO: 1801022 - RNA, 24 nt, Human
cuuggauuguccccgacccuugcc

SEQ ID NO: 1801023 - RNA, 12 nt, Human
cuugcaaaguau

SEQ ID NO: 1801024 - RNA, 12 nt, Human
cuugauucauaa

SEQ ID NO: 1801025 - RNA, 18 nt, Human
cuugaauuguaaggaaug

SEQ ID NO: 1801026 - RNA, 16 nt, Human
cuugacaucaacugca

SEQ ID NO: 1801027 - RNA, 22 nt, Human
cuugauauccucuuugagugaa

SEQ ID NO: 1801028 - RNA, 17 nt, Human
cuugauauccucuuuga

SEQ ID NO: 1801029 - RNA, 18 nt, Human
cuugauguguuaucucuu

SEQ ID NO: 1801030 - RNA, 12 nt, Human
gaaaaugugugu

SEQ ID NO: 1801031 - RNA, 15 nt, Human
gaaaaugugugugug

SEQ ID NO: 1801032 - RNA, 14 nt, Human
gaaaagaauagaag

SEQ ID NO: 1801033 - RNA, 19 nt, Human
gaaaacuuguauuaugugu

SEQ ID NO: 1801034 - RNA, 22 nt, Human
gaaaacuuguauuauguguguu

SEQ ID NO: 1801035 - RNA, 23 nt, Human
gaaaagaaaaaugagccuggcaa

SEQ ID NO: 1801036 - RNA, 21 nt, Human
gaaaacuuuaugcuaagugaa

SEQ ID NO: 1801037 - RNA, 13 nt, Human
gaaagggcccaga

SEQ ID NO: 1801038 - RNA, 20 nt, Human
gaaagaacgcugauuuaaag

SEQ ID NO: 1801039 - RNA, 16 nt, Human
gaaaggcuccaggagc

SEQ ID NO: 1801040 - RNA, 13 nt, Human
gaaaggcuccagg

SEQ ID NO: 1801041 - RNA, 14 nt, Human
gaaaggcuccagga

SEQ ID NO: 1801042 - RNA, 15 nt, Human
gaaaggcuccaggag

SEQ ID NO: 1801043 - RNA, 17 nt, Human
gaaacuggauuaaacuu

SEQ ID NO: 1801044 - RNA, 13 nt, Human
gaaacuggauuaa

SEQ ID NO: 1801045 - RNA, 18 nt, Human
gaaagaaaaucaggcugg

SEQ ID NO: 1801046 - RNA, 16 nt, Human
gaaagggcccagagag

SEQ ID NO: 1801047 - RNA, 15 nt, Human
gaaagggcccagaga

SEQ ID NO: 1801048 - RNA, 17 nt, Human
gaaaugaaagcagggac

SEQ ID NO: 1801049 - RNA, 11 nt, Human
gaaaugaaaaa

SEQ ID NO: 1801050 - RNA, 17 nt, Human
gaacacauaauucagga

SEQ ID NO: 1801051 - RNA, 20 nt, Human
gaacacauaauucaggaagc

SEQ ID NO: 1801052 - RNA, 16 nt, Human
gaagacucauucuucu

SEQ ID NO: 1801053 - RNA, 18 nt, Human
gaagacucauucuucugu

SEQ ID NO: 1801054 - RNA, 17 nt, Human
gaagacucauucuucug

SEQ ID NO: 1801055 - RNA, 14 nt, Human
gaagcacagcuuca

SEQ ID NO: 1801056 - RNA, 13 nt, Human
gaagcacagcuuc

SEQ ID NO: 1801057 - RNA, 14 nt, Human
gaagcacaugccuc

SEQ ID NO: 1801058 - RNA, 22 nt, Human
gaagcacaugccucucucaggc

SEQ ID NO: 1801059 - RNA, 16 nt, Human
gaagcaccauaacuuu

SEQ ID NO: 1801060 - RNA, 12 nt, Human
gaagcagcucuu

SEQ ID NO: 1801061 - RNA, 14 nt, Human
gaagacagcucuua

SEQ ID NO: 1801062 - RNA, 15 nt, Human
gaagacagcucuuau

SEQ ID NO: 1801063 - RNA, 16 nt, Human
gaagacacugaugggc

SEQ ID NO: 1801064 - RNA, 21 nt, Human
gaagacacugaugggcaaccc

SEQ ID NO: 1801065 - RNA, 13 nt, Human
gaagacagagcua

SEQ ID NO: 1801066 - RNA, 15 nt, Human
gaagacagagcuaca

SEQ ID NO: 1801067 - RNA, 12 nt, Human
gaagacagcucu

SEQ ID NO: 1801068 - RNA, 13 nt, Human
gaagacagcucuu

SEQ ID NO: 1801069 - RNA, 13 nt, Human
gaacuccuggccu

SEQ ID NO: 1801070 - RNA, 14 nt, Human
gaacuccugaccuc

SEQ ID NO: 1801071 - RNA, 19 nt, Human
gaacccgggaggcagaggu

SEQ ID NO: 1801072 - RNA, 17 nt, Human
gaacccgggaggcagag

SEQ ID NO: 1801073 - RNA, 14 nt, Human
gaacuccuggccuc

SEQ ID NO: 1801074 - RNA, 15 nt, Human
gaacuccuggccuca

SEQ ID NO: 1801075 - RNA, 23 nt, Human
gaaccaccacacccagcccacuu

SEQ ID NO: 1801076 - RNA, 22 nt, Human
gaaccauggucggaaaacaugc

SEQ ID NO: 1801077 - RNA, 22 nt, Human
gaaccaccacacccagcccacu

SEQ ID NO: 1801078 - RNA, 21 nt, Human
gaaccaccacacccagcccac

SEQ ID NO: 1801079 - RNA, 20 nt, Human
gaaccaccacacccagccca

SEQ ID NO: 1801080 - RNA, 18 nt, Human
gaaccaccacacccagcc

SEQ ID NO: 1801081 - RNA, 12 nt, Human
gacgcugugcug

SEQ ID NO: 1801082 - RNA, 13 nt, Human
gacgcugugcugc

SEQ ID NO: 1801083 - RNA, 15 nt, Human
gacgcugugcugccc

SEQ ID NO: 1801084 - RNA, 22 nt, Human
gacugucucaagagggcacugg

SEQ ID NO: 1801085 - RNA, 23 nt, Human
gacugucucaagagggcacuggu

SEQ ID NO: 1801086 - RNA, 21 nt, Human
gacugucucaagagggcacug

SEQ ID NO: 1801087 - RNA, 14 nt, Human
gacugugugcucag

SEQ ID NO: 1801088 - RNA, 16 nt, Human
gacugugugcucagga

SEQ ID NO: 1801089 - RNA, 17 nt, Human
gacugugugcucaggag

SEQ ID NO: 1801090 - RNA, 20 nt, Human
gacugugugcucaggagccc

SEQ ID NO: 1801091 - RNA, 16 nt, Human
gacuguacuccuccca

SEQ ID NO: 1801092 - RNA, 17 nt, Human
gacuguacuccucccag

SEQ ID NO: 1801093 - RNA, 22 nt, Human
gacuguacaaaguagaagucuu

SEQ ID NO: 1801094 - RNA, 17 nt, Human
gacucaaugcacugaca

SEQ ID NO: 1801095 - RNA, 14 nt, Human
gacucaaugcacug

SEQ ID NO: 1801096 - RNA, 22 nt, Human
gacuuuguuaguuucuccaagc

SEQ ID NO: 1801097 - RNA, 23 nt, Human
gacuuuucuguccgagcuuugaa

SEQ ID NO: 1801098 - RNA, 21 nt, Human
gacuuuucuguccgagcuuug

SEQ ID NO: 1801099 - RNA, 16 nt, Human
gacuguuuucucuuga

SEQ ID NO: 1801100 - RNA, 18 nt, Human
gacuguuuucucuugaga

SEQ ID NO: 1801101 - RNA, 14 nt, Human
gacuuuggaaagac

SEQ ID NO: 1801102 - RNA, 14 nt, Human
gacuuuggaaagag

SEQ ID NO: 1801103 - RNA, 17 nt, Human
gagaagcggcuggcagc

SEQ ID NO: 1801104 - RNA, 13 nt, Human
gacccggcugcgu

SEQ ID NO: 1801105 - RNA, 12 nt, Human
gacccggcugcg

SEQ ID NO: 1801106 - RNA, 21 nt, Human
gaccccuggcuuuucacugcu

SEQ ID NO: 1801107 - RNA, 22 nt, Human
gaccccuggcuuuucacugcug

SEQ ID NO: 1801108 - RNA, 16 nt, Human
gacccuauugcugcuu

SEQ ID NO: 1801109 - RNA, 16 nt, Human
gaccaucccugaaggc

SEQ ID NO: 1801110 - RNA, 17 nt, Human
gaccaucccugaaggcc

SEQ ID NO: 1801111 - RNA, 16 nt, Human
gaccauucuccaccug

SEQ ID NO: 1801112 - RNA, 13 nt, Human
gaccccuggcuuu

SEQ ID NO: 1801113 - RNA, 17 nt, Human
gaccauucuccaccugc

SEQ ID NO: 1801114 - RNA, 14 nt, Human
gaccaucccugaag

SEQ ID NO: 1801115 - RNA, 15 nt, Human
gaccaucccugaagg

SEQ ID NO: 1801116 - RNA, 20 nt, Human
gacaguauggcagcuuuccu

SEQ ID NO: 1801117 - RNA, 17 nt, Human
gacaggguuucaccaug

SEQ ID NO: 1801118 - RNA, 14 nt, Human
gacagaaagcagaa

SEQ ID NO: 1801119 - RNA, 20 nt, Human
gacagaaagcagaacaguga

SEQ ID NO: 1801120 - RNA, 15 nt, Human
gacagcuccuucugu

SEQ ID NO: 1801121 - RNA, 14 nt, Human
gacagcuccuucug

SEQ ID NO: 1801122 - RNA, 13 nt, Human
gacagcuccuucu

SEQ ID NO: 1801123 - RNA, 11 nt, Human
gacagccuggc

SEQ ID NO: 1801124 - RNA, 12 nt, Human
gacagccuggca

SEQ ID NO: 1801125 - RNA, 16 nt, Human
gacagcuccuucuguc

SEQ ID NO: 1801126 - RNA, 14 nt, Human
gaggcugccucucc

SEQ ID NO: 1801127 - RNA, 12 nt, Human
gaggggaacaga

SEQ ID NO: 1801128 - RNA, 12 nt, Human
gagggcuccaga

SEQ ID NO: 1801129 - RNA, 13 nt, Human
gagggcuccagac

SEQ ID NO: 1801130 - RNA, 14 nt, Human
gagggcuccagaca

SEQ ID NO: 1801131 - RNA, 15 nt, Human
gagggcuccagacac

SEQ ID NO: 1801132 - RNA, 12 nt, Human
gaggcucugccc

SEQ ID NO: 1801133 - RNA, 13 nt, Human
gaggcucugcccu

SEQ ID NO: 1801134 - RNA, 14 nt, Human
gaggcucugcccuu

SEQ ID NO: 1801135 - RNA, 14 nt, Human
gaggcucuggagcc

SEQ ID NO: 1801136 - RNA, 19 nt, Human
gaggcucuggagcccacug

SEQ ID NO: 1801137 - RNA, 15 nt, Human
gaggcucugcccuug

SEQ ID NO: 1801138 - RNA, 17 nt, Human
gaggcucugcccuuggu

SEQ ID NO: 1801139 - RNA, 20 nt, Human
gaggccagagacacaagccu

SEQ ID NO: 1801140 - RNA, 18 nt, Human
gagugcagugagccgaga

SEQ ID NO: 1801141 - RNA, 13 nt, Human
gagugcagugagc

SEQ ID NO: 1801142 - RNA, 22 nt, Human
gaguugauacuacaguuuguua

SEQ ID NO: 1801143 - RNA, 21 nt, Human
gaguugauagcacagacccug

SEQ ID NO: 1801144 - RNA, 19 nt, Human
gaguugauacuacaguuug

SEQ ID NO: 1801145 - RNA, 18 nt, Human
gagugccuuacacaaugg

SEQ ID NO: 1801146 - RNA, 18 nt, Human
gagugagacucugucuca

SEQ ID NO: 1801147 - RNA, 14 nt, Human
gagugagacucugu

SEQ ID NO: 1801148 - RNA, 14 nt, Human
gagugagacagacu

SEQ ID NO: 1801149 - RNA, 18 nt, Human
gagucagaaguuucugcc

SEQ ID NO: 1801150 - RNA, 17 nt, Human
gaggugggauccuccag

SEQ ID NO: 1801151 - RNA, 14 nt, Human
gagucacuggaaca

SEQ ID NO: 1801152 - RNA, 21 nt, Human
gagucacuggaacacuaauga

SEQ ID NO: 1801153 - RNA, 15 nt, Human
gaggugggauccucc

SEQ ID NO: 1801154 - RNA, 16 nt, Human
gaggugggauccucca

SEQ ID NO: 1801155 - RNA, 13 nt, Human
gaggugggauccu

SEQ ID NO: 1801156 - RNA, 17 nt, Human
gagcaucaggccaggcc

SEQ ID NO: 1801157 - RNA, 12 nt, Human
gagccuuccagg

SEQ ID NO: 1801158 - RNA, 13 nt, Human
gagccuuccaggg

SEQ ID NO: 1801159 - RNA, 15 nt, Human
gagcgacagugagac

SEQ ID NO: 1801160 - RNA, 13 nt, Human
gagcgacagugag

SEQ ID NO: 1801161 - RNA, 19 nt, Human
gagcugccuguucagcucc

SEQ ID NO: 1801162 - RNA, 16 nt, Human
gagcugccuguucagc

SEQ ID NO: 1801163 - RNA, 15 nt, Human
gagcugccuguucag

SEQ ID NO: 1801164 - RNA, 17 nt, Human
gagcggagaaaggaagg

SEQ ID NO: 1801165 - RNA, 20 nt, Human
gagcugccuguucagcucca

SEQ ID NO: 1801166 - RNA, 20 nt, Human
gagcaucaggccaggcccuc

SEQ ID NO: 1801167 - RNA, 22 nt, Human
gagcaucaggccaggcccucug

SEQ ID NO: 1801168 - RNA, 19 nt, Human
gauguaauuuuguguaaga

SEQ ID NO: 1801169 - RNA, 13 nt, Human
gauguaauuuugu

SEQ ID NO: 1801170 - RNA, 18 nt, Human
gaugucccaacuuguaaa

SEQ ID NO: 1801171 - RNA, 17 nt, Human
gaugucccaacuuguaa

SEQ ID NO: 1801172 - RNA, 13 nt, Human
gauguaaagaugu

SEQ ID NO: 1801173 - RNA, 14 nt, Human
gauguaaagauguu

SEQ ID NO: 1801174 - RNA, 22 nt, Human
gauggaaaaaccacccccaaau

SEQ ID NO: 1801175 - RNA, 23 nt, Human
gauggaggaaaaccaagccgugg

SEQ ID NO: 1801176 - RNA, 16 nt, Human
gaugcuuguacauaau

SEQ ID NO: 1801177 - RNA, 14 nt, Human
gaugcuuguacaua

SEQ ID NO: 1801178 - RNA, 23 nt, Human
gaugcuucucacugccaugccag

SEQ ID NO: 1801179 - RNA, 14 nt, Human
gaugaugacuaugg

SEQ ID NO: 1801180 - RNA, 13 nt, Human
gaugaggcaaccc

SEQ ID NO: 1801181 - RNA, 18 nt, Human
gaucuggguucacugcaa

SEQ ID NO: 1801182 - RNA, 22 nt, Human
gaguugauagcacagacccugc

SEQ ID NO: 1801183 - RNA, 20 nt, Human
gaucuggguucacugcaacc

SEQ ID NO: 1801184 - RNA, 13 nt, Human
gauuucacucucc

SEQ ID NO: 1801185 - RNA, 16 nt, Human
gauuucacucuccuug

SEQ ID NO: 1801186 - RNA, 15 nt, Human
gauuucagcucacug

SEQ ID NO: 1801187 - RNA, 17 nt, Human
gauuucagcucacugca

SEQ ID NO: 1801188 - RNA, 20 nt, Human
gauuucagcucacugcaacc

SEQ ID NO: 1801189 - RNA, 17 nt, Human
gauuucacucuccuugg

SEQ ID NO: 1801190 - RNA, 18 nt, Human
gauuucacucuccuuggu

SEQ ID NO: 1801191 - RNA, 22 nt, Human
gauuuuuuuuuccuucagugcc

SEQ ID NO: 1801192 - RNA, 23 nt, Human
gauuuuuuuuuccuucagugccu

SEQ ID NO: 1801193 - RNA, 21 nt, Human
gauucuccugccucagccucc

SEQ ID NO: 1801194 - RNA, 20 nt, Human
gauucuccugccucagccuc

SEQ ID NO: 1801195 - RNA, 19 nt, Human
gauucuccugccucagccu

SEQ ID NO: 1801196 - RNA, 21 nt, Human
gauucuucugcuucagccucc

SEQ ID NO: 1801197 - RNA, 23 nt, Human
gauucuuauggacaaugacccag

SEQ ID NO: 1801198 - RNA, 23 nt, Human
gauuuaacagaaauguacagcaa

SEQ ID NO: 1801199 - RNA, 20 nt, Human
gauuuaacagaaauguacag

SEQ ID NO: 1801200 - RNA, 18 nt, Human
gcaacccccagccugcua

SEQ ID NO: 1801201 - RNA, 16 nt, Human
gcaaaagaugcuucuc

SEQ ID NO: 1801202 - RNA, 15 nt, Human
gcaaaagaugcuucu

SEQ ID NO: 1801203 - RNA, 18 nt, Human
gcaaccuccgccucuugg

SEQ ID NO: 1801204 - RNA, 22 nt, Human
gcaacccuggugaccagcacca

SEQ ID NO: 1801205 - RNA, 19 nt, Human
gcacacaccagagcccacc

SEQ ID NO: 1801206 - RNA, 18 nt, Human
gcacacaccagagcccac

SEQ ID NO: 1801207 - RNA, 17 nt, Human
gcacacaccagagccca

SEQ ID NO: 1801208 - RNA, 16 nt, Human
gcacacaccagagccc

SEQ ID NO: 1801209 - RNA, 15 nt, Human
gcacacaccagagcc

SEQ ID NO: 1801210 - RNA, 14 nt, Human
gcacacaccagagc

SEQ ID NO: 1801211 - RNA, 12 nt, Human
gcacacaccaga

SEQ ID NO: 1801212 - RNA, 21 nt, Human
gcaauaaagcagcguuucuau

SEQ ID NO: 1801213 - RNA, 11 nt, Human
gcaauaaagca

SEQ ID NO: 1801214 - RNA, 23 nt, Human
gcacacagcacgggggccaagga

SEQ ID NO: 1801215 - RNA, 11 nt, Human
gcacacagcac

SEQ ID NO: 1801216 - RNA, 20 nt, Human
gcacacaccagagcccaccu

SEQ ID NO: 1801217 - RNA, 11 nt, Human
gcacacauuuu

SEQ ID NO: 1801218 - RNA, 12 nt, Human
gcacacauuuuu

SEQ ID NO: 1801219 - RNA, 17 nt, Human
gcaccuaccaccacgcc

SEQ ID NO: 1801220 - RNA, 18 nt, Human
gcaccuaccaccacgccc

SEQ ID NO: 1801221 - RNA, 21 nt, Human
gcaccuacaguguacagucuu

SEQ ID NO: 1801222 - RNA, 19 nt, Human
gcaccuacaguguacaguc

SEQ ID NO: 1801223 - RNA, 18 nt, Human
gcaccuacaguguacagu

SEQ ID NO: 1801224 - RNA, 18 nt, Human
gcaccggcuggccuggcc

SEQ ID NO: 1801225 - RNA, 17 nt, Human
gcaccggcuggccuggc

SEQ ID NO: 1801226 - RNA, 15 nt, Human
gcaccggcuggccug

SEQ ID NO: 1801227 - RNA, 16 nt, Human
gcaccggcuggccugg

SEQ ID NO: 1801228 - RNA, 12 nt, Human
gcaccuccugcc

SEQ ID NO: 1801229 - RNA, 22 nt, Human
gcacuauagccuaggugacaga

SEQ ID NO: 1801230 - RNA, 17 nt, Human
gcacuccagccugggug

SEQ ID NO: 1801231 - RNA, 12 nt, Human
gcacuccccugc

SEQ ID NO: 1801232 - RNA, 16 nt, Human
gcauuugaaaauuuug

SEQ ID NO: 1801233 - RNA, 14 nt, Human
gcauuugaaaauuu

SEQ ID NO: 1801234 - RNA, 15 nt, Human
gcauuuaaaagauac

SEQ ID NO: 1801235 - RNA, 12 nt, Human
gcauuuaaaaga

SEQ ID NO: 1801236 - RNA, 14 nt, Human
gccaacuauggccu

SEQ ID NO: 1801237 - RNA, 15 nt, Human
gccaacuauggccug

SEQ ID NO: 1801238 - RNA, 19 nt, Human
gccaacuauggccugugga

SEQ ID NO: 1801239 - RNA, 21 nt, Human
gccaacuuuccccacguuaaa

SEQ ID NO: 1801240 - RNA, 14 nt, Human
gccaagaauucuua

SEQ ID NO: 1801241 - RNA, 18 nt, Human
gccaagaauucuuaaaua

SEQ ID NO: 1801242 - RNA, 20 nt, Human
gcauuguaaaagcauuuugu

SEQ ID NO: 1801243 - RNA, 17 nt, Human
gcaugugaugagaggaa

SEQ ID NO: 1801244 - RNA, 23 nt, Human
gcaugucccuaccgagucucuuc

SEQ ID NO: 1801245 - RNA, 19 nt, Human
gcaugggaaugaaugucag

SEQ ID NO: 1801246 - RNA, 13 nt, Human
gcaugggaaugaa

SEQ ID NO: 1801247 - RNA, 16 nt, Human
gcaugggaaugaaugu

SEQ ID NO: 1801248 - RNA, 14 nt, Human
gcauggccaggugg

SEQ ID NO: 1801249 - RNA, 17 nt, Human
gcauggccagguggcca

SEQ ID NO: 1801250 - RNA, 13 nt, Human
gcauggccaggug

SEQ ID NO: 1801251 - RNA, 23 nt, Human
gcauccuggcacccggccccugc

SEQ ID NO: 1801252 - RNA, 22 nt, Human
gcauccuggcacccggccccug

SEQ ID NO: 1801253 - RNA, 13 nt, Human
gcaucgcaaugua

SEQ ID NO: 1801254 - RNA, 21 nt, Human
gcauccuggcacccggccccu

SEQ ID NO: 1801255 - RNA, 17 nt, Human
gcauccuggcacccggc

SEQ ID NO: 1801256 - RNA, 19 nt, Human
gccaaggccaaaggaagca

SEQ ID NO: 1801257 - RNA, 17 nt, Human
gccaaggccaaaggaag

SEQ ID NO: 1801258 - RNA, 11 nt, Human
gccaaggccaa

SEQ ID NO: 1801259 - RNA, 22 nt, Human
gccaagcaccuagccucgcucu

SEQ ID NO: 1801260 - RNA, 15 nt, Human
gcauaaaaauuagcc

SEQ ID NO: 1801261 - RNA, 14 nt, Human
gcaguugccaguca

SEQ ID NO: 1801262 - RNA, 23 nt, Human
gcaguugccagucaccccggcca

SEQ ID NO: 1801263 - RNA, 16 nt, Human
gcauaccacuuuuguu

SEQ ID NO: 1801264 - RNA, 15 nt, Human
gcauaccacuuuugu

SEQ ID NO: 1801265 - RNA, 21 nt, Human
gcagcuugaggguugggcugg

SEQ ID NO: 1801266 - RNA, 19 nt, Human
gcagcuugaggguugggcu

SEQ ID NO: 1801267 - RNA, 22 nt, Human
gcaggcucgggcuccccagccc

SEQ ID NO: 1801268 - RNA, 12 nt, Human
gcaggcucucag

SEQ ID NO: 1801269 - RNA, 13 nt, Human
gcaggcucucagg

SEQ ID NO: 1801270 - RNA, 14 nt, Human
gcaggcucucaggc

SEQ ID NO: 1801271 - RNA, 15 nt, Human
gcaggcucucaggcc

SEQ ID NO: 1801272 - RNA, 16 nt, Human
gcaggcucucaggcca

SEQ ID NO: 1801273 - RNA, 22 nt, Human
gcagggaaacagcuaaugggac

SEQ ID NO: 1801274 - RNA, 13 nt, Human
gcaggcuggcccu

SEQ ID NO: 1801275 - RNA, 18 nt, Human
gcaggcucucaggccagc

SEQ ID NO: 1801276 - RNA, 17 nt, Human
gcaggcucucaggccag

SEQ ID NO: 1801277 - RNA, 16 nt, Human
gcagcuugaggguugg

SEQ ID NO: 1801278 - RNA, 15 nt, Human
gcagcuuauucacaa

SEQ ID NO: 1801279 - RNA, 20 nt, Human
gcagcugcuuuugucuaugg

SEQ ID NO: 1801280 - RNA, 13 nt, Human
gcagcugcuuuug

SEQ ID NO: 1801281 - RNA, 23 nt, Human
gcagcugcgguccacccaggagc

SEQ ID NO: 1801282 - RNA, 22 nt, Human
gcagcugcgguccacccaggag

SEQ ID NO: 1801283 - RNA, 16 nt, Human
gcacuuuguucuggcu

SEQ ID NO: 1801284 - RNA, 17 nt, Human
gcucugaucauccacug

SEQ ID NO: 1801285 - RNA, 23 nt, Human
gcucugaucauccacugugccau

SEQ ID NO: 1801286 - RNA, 23 nt, Human
gcucugcaagaauugaagcagga

SEQ ID NO: 1801287 - RNA, 11 nt, Human
gcucugcccuu

SEQ ID NO: 1801288 - RNA, 18 nt, Human
gcuccagcucaccagccc

SEQ ID NO: 1801289 - RNA, 19 nt, Human
gcuccacuuggucugugag

SEQ ID NO: 1801290 - RNA, 18 nt, Human
gcuccacuuggucuguga

SEQ ID NO: 1801291 - RNA, 21 nt, Human
gcuccagcucaccagccccag

SEQ ID NO: 1801292 - RNA, 20 nt, Human
gcuccagcucaccagcccca

SEQ ID NO: 1801293 - RNA, 16 nt, Human
gcucccacaggcccuu

SEQ ID NO: 1801294 - RNA, 17 nt, Human
gcucccacaggcccuuc

SEQ ID NO: 1801295 - RNA, 20 nt, Human
gcucccacaggcccuuccuc

SEQ ID NO: 1801296 - RNA, 21 nt, Human
gcucccacaggcccuuccucu

SEQ ID NO: 1801297 - RNA, 22 nt, Human
gcucccacaggcccuuccucuc

SEQ ID NO: 1801298 - RNA, 17 nt, Human
gcucccaggcauucccc

SEQ ID NO: 1801299 - RNA, 12 nt, Human
gcuccugccacc

SEQ ID NO: 1801300 - RNA, 18 nt, Human
gcuccugccaccacgccc

SEQ ID NO: 1801301 - RNA, 21 nt, Human
gcuccugccaccacgcccggc

SEQ ID NO: 1801302 - RNA, 14 nt, Human
gcuccuggcccacu

SEQ ID NO: 1801303 - RNA, 15 nt, Human
gcuccuggcccacug

SEQ ID NO: 1801304 - RNA, 20 nt, Human
gcuccuggcccacugcaucg

SEQ ID NO: 1801305 - RNA, 18 nt, Human
gcuccuggcccacugcau

SEQ ID NO: 1801306 - RNA, 19 nt, Human
gcuccuggcccacugcauc

SEQ ID NO: 1801307 - RNA, 15 nt, Human
gcuccacuuggucug

SEQ ID NO: 1801308 - RNA, 13 nt, Human
gcuaaugggacac

SEQ ID NO: 1801309 - RNA, 15 nt, Human
gcuaaugggacacua

SEQ ID NO: 1801310 - RNA, 23 nt, Human
gcuaagugauccucccaccucag

SEQ ID NO: 1801311 - RNA, 16 nt, Human
gcuaaucagcauucuc

SEQ ID NO: 1801312 - RNA, 17 nt, Human
gcuaaucagcauucuca

SEQ ID NO: 1801313 - RNA, 22 nt, Human
gcuaaucagcauucucacuccu

SEQ ID NO: 1801314 - RNA, 14 nt, Human
gcuaaucagcauuc

SEQ ID NO: 1801315 - RNA, 23 nt, Human
gcgugcacacaccagagcccacc

SEQ ID NO: 1801316 - RNA, 18 nt, Human
gcguuucuaugacacaug

SEQ ID NO: 1801317 - RNA, 20 nt, Human
gcgugcacacaccagagccc

SEQ ID NO: 1801318 - RNA, 22 nt, Human
gcgggaggauguucugggacac

SEQ ID NO: 1801319 - RNA, 21 nt, Human
gcgggaggauguucugggaca

SEQ ID NO: 1801320 - RNA, 20 nt, Human
gcgggaggauguucugggac

SEQ ID NO: 1801321 - RNA, 18 nt, Human
gcuagaacucccuuucaa

SEQ ID NO: 1801322 - RNA, 16 nt, Human
gcuagaacucccuuuc

SEQ ID NO: 1801323 - RNA, 15 nt, Human
gcuagaacucccuuu

SEQ ID NO: 1801324 - RNA, 14 nt, Human
gcuagaacucccuu

SEQ ID NO: 1801325 - RNA, 13 nt, Human
gcuagaacucccu

SEQ ID NO: 1801326 - RNA, 12 nt, Human
gcuagaacuccc

SEQ ID NO: 1801327 - RNA, 20 nt, Human
gcuauucaguaauaacucua

SEQ ID NO: 1801328 - RNA, 14 nt, Human
gcucacugcagccu

SEQ ID NO: 1801329 - RNA, 13 nt, Human
gcucacugcagcc

SEQ ID NO: 1801330 - RNA, 12 nt, Human
gcucacugcagc

SEQ ID NO: 1801331 - RNA, 11 nt, Human
gcucacugcag

SEQ ID NO: 1801332 - RNA, 16 nt, Human
gcucacugcagccuca

SEQ ID NO: 1801333 - RNA, 15 nt, Human
gcucacugcagccuc

SEQ ID NO: 1801334 - RNA, 17 nt, Human
gcucacugcagccucaa

SEQ ID NO: 1801335 - RNA, 16 nt, Human
gcucacugcauccucc

SEQ ID NO: 1801336 - RNA, 17 nt, Human
gcucaggugucccugca

SEQ ID NO: 1801337 - RNA, 16 nt, Human
gcucaggugucccugc

SEQ ID NO: 1801338 - RNA, 14 nt, Human
gcucaggugucccu

SEQ ID NO: 1801339 - RNA, 23 nt, Human
gcucagguggggucacucuggca

SEQ ID NO: 1801340 - RNA, 14 nt, Human
gcucagagagggug

SEQ ID NO: 1801341 - RNA, 20 nt, Human
gcucacugcauccuccgccu

SEQ ID NO: 1801342 - RNA, 13 nt, Human
gcucagagagggu

SEQ ID NO: 1801343 - RNA, 23 nt, Human
gcuaggccuggccagaugcacca

SEQ ID NO: 1801344 - RNA, 17 nt, Human
gcuaggccuggccagau

SEQ ID NO: 1801345 - RNA, 16 nt, Human
gcuaggccuggccaga

SEQ ID NO: 1801346 - RNA, 13 nt, Human
gcuaugcauuuga

SEQ ID NO: 1801347 - RNA, 19 nt, Human
gcuauucaguaauaacucu

SEQ ID NO: 1801348 - RNA, 12 nt, Human
gcuaugcauuug

SEQ ID NO: 1801349 - RNA, 21 nt, Human
gcuagugugguguuuccuggc

SEQ ID NO: 1801350 - RNA, 22 nt, Human
gcuagugugguguuuccuggca

SEQ ID NO: 1801351 - RNA, 15 nt, Human
gccugcccaggcccc

SEQ ID NO: 1801352 - RNA, 22 nt, Human
gccugcccaggccccugccacc

SEQ ID NO: 1801353 - RNA, 22 nt, Human
gccucgaacuggcugcaaaggg

SEQ ID NO: 1801354 - RNA, 20 nt, Human
gccucgaacuggcugcaaag

SEQ ID NO: 1801355 - RNA, 17 nt, Human
gccucuuaugggcuggg

SEQ ID NO: 1801356 - RNA, 18 nt, Human
gccucuuaugggcugggu

SEQ ID NO: 1801357 - RNA, 16 nt, Human
gccucuuaugggcugg

SEQ ID NO: 1801358 - RNA, 14 nt, Human
gccugcccaggccc

SEQ ID NO: 1801359 - RNA, 13 nt, Human
gccugcccaggcc

SEQ ID NO: 1801360 - RNA, 14 nt, Human
gccucuuggguuca

SEQ ID NO: 1801361 - RNA, 21 nt, Human
gccucuuaugggcuggguucu

SEQ ID NO: 1801362 - RNA, 17 nt, Human
gccucccaaagugcugg

SEQ ID NO: 1801363 - RNA, 16 nt, Human
gccucccaaagugcug

SEQ ID NO: 1801364 - RNA, 23 nt, Human
gccuccugugugugcgccuacag

SEQ ID NO: 1801365 - RNA, 19 nt, Human
gccuccugugugugcgccu

SEQ ID NO: 1801366 - RNA, 17 nt, Human
gccucgaacuggcugca

SEQ ID NO: 1801367 - RNA, 12 nt, Human
gccuccauccug

SEQ ID NO: 1801368 - RNA, 15 nt, Human
gcgagcccugguggc

SEQ ID NO: 1801369 - RNA, 17 nt, Human
gcgagcccugguggcag

SEQ ID NO: 1801370 - RNA, 17 nt, Human
gccuugaccauucucca

SEQ ID NO: 1801371 - RNA, 19 nt, Human
gccuugaccauucuccacc

SEQ ID NO: 1801372 - RNA, 20 nt, Human
gccuugaccauucuccaccu

SEQ ID NO: 1801373 - RNA, 21 nt, Human
gccuugaccauucuccaccug

SEQ ID NO: 1801374 - RNA, 21 nt, Human
gccuguugggccaggagccuc

SEQ ID NO: 1801375 - RNA, 20 nt, Human
gccuucggccuccauccuga

SEQ ID NO: 1801376 - RNA, 23 nt, Human
gccuucggccuccauccugaggc

SEQ ID NO: 1801377 - RNA, 21 nt, Human
gccuucggccuccauccugag

SEQ ID NO: 1801378 - RNA, 22 nt, Human
gcgaucuggguucacugcaacc

SEQ ID NO: 1801379 - RNA, 20 nt, Human
gcgcagcauauucaggaagc

SEQ ID NO: 1801380 - RNA, 20 nt, Human
gccuggccugagcugggaug

SEQ ID NO: 1801381 - RNA, 14 nt, Human
gccuggccugagcu

SEQ ID NO: 1801382 - RNA, 18 nt, Human
gccuggccugagcuggga

SEQ ID NO: 1801383 - RNA, 13 nt, Human
gccuggccugagc

SEQ ID NO: 1801384 - RNA, 18 nt, Human
gccugugccucugggacu

SEQ ID NO: 1801385 - RNA, 23 nt, Human
gccuggcuccaaacccucgaggc

SEQ ID NO: 1801386 - RNA, 13 nt, Human
gccuggcucaggu

SEQ ID NO: 1801387 - RNA, 16 nt, Human
gccugugccucuggga

SEQ ID NO: 1801388 - RNA, 17 nt, Human
gccugugccucugggac

SEQ ID NO: 1801389 - RNA, 19 nt, Human
gccuguucccauucuugca

SEQ ID NO: 1801390 - RNA, 23 nt, Human
gccuguucccauucuugcauggc

SEQ ID NO: 1801391 - RNA, 14 nt, Human
gccuguugggccag

SEQ ID NO: 1801392 - RNA, 15 nt, Human
gccuguugggccagg

SEQ ID NO: 1801393 - RNA, 16 nt, Human
gccuguugggccagga

SEQ ID NO: 1801394 - RNA, 18 nt, Human
gccuguugggccaggagc

SEQ ID NO: 1801395 - RNA, 20 nt, Human
gccuguugggccaggagccu

SEQ ID NO: 1801396 - RNA, 16 nt, Human
gcccuaaugcgcaggc

SEQ ID NO: 1801397 - RNA, 17 nt, Human
gcccuaaugcgcaggcu

SEQ ID NO: 1801398 - RNA, 19 nt, Human
gcccuaaugcgcaggcugg

SEQ ID NO: 1801399 - RNA, 20 nt, Human
gcccuaaugcgcaggcuggc

SEQ ID NO: 1801400 - RNA, 23 nt, Human
gcccuaaugcgcaggcuggcccu

SEQ ID NO: 1801401 - RNA, 15 nt, Human
gcccucacccugggg

SEQ ID NO: 1801402 - RNA, 15 nt, Human
gccccugcucuggug

SEQ ID NO: 1801403 - RNA, 20 nt, Human
gccccugccucucugcaggu

SEQ ID NO: 1801404 - RNA, 23 nt, Human
gccccugccucucugcagguccc

SEQ ID NO: 1801405 - RNA, 23 nt, Human
gcccgggcucugccucccaucac

SEQ ID NO: 1801406 - RNA, 16 nt, Human
gccccugccacccugg

SEQ ID NO: 1801407 - RNA, 17 nt, Human
gccccugccacccuggg

SEQ ID NO: 1801408 - RNA, 12 nt, Human
gcccccacuggu

SEQ ID NO: 1801409 - RNA, 20 nt, Human
gcccuuagcagggaaacagc

SEQ ID NO: 1801410 - RNA, 22 nt, Human
gcccuguccugccuaaggcuga

SEQ ID NO: 1801411 - RNA, 18 nt, Human
gcccugcccugguuuccu

SEQ ID NO: 1801412 - RNA, 14 nt, Human
gcccugccuccuuu

SEQ ID NO: 1801413 - RNA, 12 nt, Human
gcccugccuccu

SEQ ID NO: 1801414 - RNA, 13 nt, Human
gcccugccuccuu

SEQ ID NO: 1801415 - RNA, 22 nt, Human
gcccuuagcagggaaacagcua

SEQ ID NO: 1801416 - RNA, 20 nt, Human
gccgcagcccugcagagggc

SEQ ID NO: 1801417 - RNA, 18 nt, Human
gcccugcagagggcacag

SEQ ID NO: 1801418 - RNA, 11 nt, Human
gcccugcccug

SEQ ID NO: 1801419 - RNA, 12 nt, Human
gcccugcccugg

SEQ ID NO: 1801420 - RNA, 16 nt, Human
gcccugcccugguuuc

SEQ ID NO: 1801421 - RNA, 11 nt, Human
gcccugccucc

SEQ ID NO: 1801422 - RNA, 17 nt, Human
gcccugcccaccuggcc

SEQ ID NO: 1801423 - RNA, 20 nt, Human
gcccugcccaccuggccucu

SEQ ID NO: 1801424 - RNA, 21 nt, Human
gcccugcccaccuggccucug

SEQ ID NO: 1801425 - RNA, 22 nt, Human
gcccugcccaccuggccucugc

SEQ ID NO: 1801426 - RNA, 15 nt, Human
gccuaggugacagag

SEQ ID NO: 1801427 - RNA, 14 nt, Human
gccuaggugacaga

SEQ ID NO: 1801428 - RNA, 13 nt, Human
gccuaggugacag

SEQ ID NO: 1801429 - RNA, 23 nt, Human
gccuagcauacguacacauuuua

SEQ ID NO: 1801430 - RNA, 22 nt, Human
gccuagcauacguacacauuuu

SEQ ID NO: 1801431 - RNA, 21 nt, Human
gccuagcauacguacacauuu

SEQ ID NO: 1801432 - RNA, 20 nt, Human
gccuagcauacguacacauu

SEQ ID NO: 1801433 - RNA, 20 nt, Human
gccuaggugacagagugaga

SEQ ID NO: 1801434 - RNA, 20 nt, Human
ggacagcuccuucuguccua

SEQ ID NO: 1801435 - RNA, 19 nt, Human
ggacagcuccuucuguccu

SEQ ID NO: 1801436 - RNA, 22 nt, Human
ggacacuaaccacgcuggaccu

SEQ ID NO: 1801437 - RNA, 17 nt, Human
ggacacuaaccacgcug

SEQ ID NO: 1801438 - RNA, 18 nt, Human
ggacacagcucuucucca

SEQ ID NO: 1801439 - RNA, 15 nt, Human
ggacacagcucuucu

SEQ ID NO: 1801440 - RNA, 21 nt, Human
ggacacagcucuucuccaggc

SEQ ID NO: 1801441 - RNA, 19 nt, Human
ggacaaggacuaggguccu

SEQ ID NO: 1801442 - RNA, 16 nt, Human
ggaauccagacccggc

SEQ ID NO: 1801443 - RNA, 18 nt, Human
ggaauaacauguaauuaa

SEQ ID NO: 1801444 - RNA, 18 nt, Human
ggaaugaagcaaugcuuc

SEQ ID NO: 1801445 - RNA, 13 nt, Human
ggacaagagcagg

SEQ ID NO: 1801446 - RNA, 22 nt, Human
ggacaaggaugaucuaggaaga

SEQ ID NO: 1801447 - RNA, 23 nt, Human
ggacaaggaugaucuaggaagac

SEQ ID NO: 1801448 - RNA, 19 nt, Human
ggaaggaaacccagcucug

SEQ ID NO: 1801449 - RNA, 20 nt, Human
ggaaggaaacccagcucugg

SEQ ID NO: 1801450 - RNA, 16 nt, Human
ggaaggaaacccagcu

SEQ ID NO: 1801451 - RNA, 11 nt, Human
ggaagcuccgc

SEQ ID NO: 1801452 - RNA, 15 nt, Human
ggaagcucagggccu

SEQ ID NO: 1801453 - RNA, 23 nt, Human
ggaagcucagggccuggcucagg

SEQ ID NO: 1801454 - RNA, 15 nt, Human
ggaagccgcuggggc

SEQ ID NO: 1801455 - RNA, 13 nt, Human
ggaagacagcucu

SEQ ID NO: 1801456 - RNA, 14 nt, Human
ggaagacagcucuu

SEQ ID NO: 1801457 - RNA, 13 nt, Human
ggaagacuuugga

SEQ ID NO: 1801458 - RNA, 17 nt, Human
ggaagacuuuggaaaga

SEQ ID NO: 1801459 - RNA, 12 nt, Human
ggaagacuuugg

SEQ ID NO: 1801460 - RNA, 15 nt, Human
ggaagagaaaaaaua

SEQ ID NO: 1801461 - RNA, 18 nt, Human
ggaagacuuuggaaagag

SEQ ID NO: 1801462 - RNA, 13 nt, Human
ggaagagaaaaaa

SEQ ID NO: 1801463 - RNA, 15 nt, Human
ggaacacucugagac

SEQ ID NO: 1801464 - RNA, 16 nt, Human
ggaacacucugagacu

SEQ ID NO: 1801465 - RNA, 12 nt, Human
ggaacacucuga

SEQ ID NO: 1801466 - RNA, 14 nt, Human
ggaacacucugaga

SEQ ID NO: 1801467 - RNA, 23 nt, Human
ggacaggcauguucucugaggac

SEQ ID NO: 1801468 - RNA, 14 nt, Human
ggacuuggaagcuc

SEQ ID NO: 1801469 - RNA, 9 nt, Human
ggacuuugu

SEQ ID NO: 1801470 - RNA, 16 nt, Human
ggagaaaggaagggcu

SEQ ID NO: 1801471 - RNA, 13 nt, Human
ggagaaacuggaa

SEQ ID NO: 1801472 - RNA, 18 nt, Human
ggacucaaugcacugaca

SEQ ID NO: 1801473 - RNA, 16 nt, Human
ggacucaaugcacuga

SEQ ID NO: 1801474 - RNA, 20 nt, Human
ggacuaacuugucuuuggac

SEQ ID NO: 1801475 - RNA, 14 nt, Human
ggacuacaggugug

SEQ ID NO: 1801476 - RNA, 24 nt, Human
ggacuaacuugucuuuggacccug

SEQ ID NO: 1801477 - RNA, 15 nt, Human
ggacucaaugcacug

SEQ ID NO: 1801478 - RNA, 20 nt, Human
ggacguguuaugacuccaga

SEQ ID NO: 1801479 - RNA, 20 nt, Human
ggaccucaggccugggggcu

SEQ ID NO: 1801480 - RNA, 14 nt, Human
ggaccucaggccug

SEQ ID NO: 1801481 - RNA, 15 nt, Human
ggaccucaggccugg

SEQ ID NO: 1801482 - RNA, 13 nt, Human
ggaccucaggccu

SEQ ID NO: 1801483 - RNA, 12 nt, Human
ggacccugaggc

SEQ ID NO: 1801484 - RNA, 13 nt, Human
ggacccugaggcc

SEQ ID NO: 1801485 - RNA, 18 nt, Human
ggaccccgagccuggcuc

SEQ ID NO: 1801486 - RNA, 11 nt, Human
ggacccugagg

SEQ ID NO: 1801487 - RNA, 15 nt, Human
ggaccccgagccugg

SEQ ID NO: 1801488 - RNA, 12 nt, Human
ggacccccugaa

SEQ ID NO: 1801489 - RNA, 13 nt, Human
gcugcuggcuggu

SEQ ID NO: 1801490 - RNA, 18 nt, Human
gcugcugaaggcucgagc

SEQ ID NO: 1801491 - RNA, 13 nt, Human
gcucugcccuugg

SEQ ID NO: 1801492 - RNA, 15 nt, Human
gcucugguccauaga

SEQ ID NO: 1801493 - RNA, 16 nt, Human
gcucugguccauagag

SEQ ID NO: 1801494 - RNA, 23 nt, Human
gcucugguccauagagagcaaga

SEQ ID NO: 1801495 - RNA, 13 nt, Human
gcugcugaaggcu

SEQ ID NO: 1801496 - RNA, 14 nt, Human
gcugcugaaggcuc

SEQ ID NO: 1801497 - RNA, 15 nt, Human
gcugcugaaggcucg

SEQ ID NO: 1801498 - RNA, 22 nt, Human
gcuggagugcagugagccgaga

SEQ ID NO: 1801499 - RNA, 20 nt, Human
gcuggccuggccccucaggg

SEQ ID NO: 1801500 - RNA, 17 nt, Human
gcuggagugcagugagc

SEQ ID NO: 1801501 - RNA, 18 nt, Human
gcuggagugcagugagcc

SEQ ID NO: 1801502 - RNA, 20 nt, Human
gcuggcgugcaguggugcga

SEQ ID NO: 1801503 - RNA, 23 nt, Human
gcugggccccugccucucugcag

SEQ ID NO: 1801504 - RNA, 21 nt, Human
gcugggccccugccucucugc

SEQ ID NO: 1801505 - RNA, 22 nt, Human
gcugggccccugccucucugca

SEQ ID NO: 1801506 - RNA, 12 nt, Human
gcugggucgccc

SEQ ID NO: 1801507 - RNA, 17 nt, Human
gcuggcuguuggcuggg

SEQ ID NO: 1801508 - RNA, 16 nt, Human
gcuggcuguuggcugg

SEQ ID NO: 1801509 - RNA, 15 nt, Human
gcuggcuguuggcug

SEQ ID NO: 1801510 - RNA, 21 nt, Human
gcuggguggcaccagcagccu

SEQ ID NO: 1801511 - RNA, 22 nt, Human
gcuggguggcaccagcagccug

SEQ ID NO: 1801512 - RNA, 23 nt, Human
gcuggguggcaccagcagccugg

SEQ ID NO: 1801513 - RNA, 20 nt, Human
gcuuguaaauagcucaggug

SEQ ID NO: 1801514 - RNA, 14 nt, Human
gcuugagcucagga

SEQ ID NO: 1801515 - RNA, 23 nt, Human
gcuuguaacuaaaauaauuuugu

SEQ ID NO: 1801516 - RNA, 22 nt, Human
gcuuguaacuaaaauaauuuug

SEQ ID NO: 1801517 - RNA, 17 nt, Human
gcuuguaacuaaaauaa

SEQ ID NO: 1801518 - RNA, 12 nt, Human
gcuuguacauaa

SEQ ID NO: 1801519 - RNA, 22 nt, Human
gcuuccucauaguaugguggcu

SEQ ID NO: 1801520 - RNA, 12 nt, Human
gcuucagccucc

SEQ ID NO: 1801521 - RNA, 19 nt, Human
gcuucacggaagagccuug

SEQ ID NO: 1801522 - RNA, 18 nt, Human
gcuucacggaagagccuu

SEQ ID NO: 1801523 - RNA, 19 nt, Human
gcuucaaggauccugagcc

SEQ ID NO: 1801524 - RNA, 20 nt, Human
gcuucaaggauccugagcca

SEQ ID NO: 1801525 - RNA, 21 nt, Human
gcuucaaggauccugagccag

SEQ ID NO: 1801526 - RNA, 17 nt, Human
gcuucacggaagagccu

SEQ ID NO: 1801527 - RNA, 15 nt, Human
gcuucacggaagagc

SEQ ID NO: 1801528 - RNA, 16 nt, Human
guacuggagaaaaugg

SEQ ID NO: 1801529 - RNA, 14 nt, Human
guacccacugcucu

SEQ ID NO: 1801530 - RNA, 13 nt, Human
guacccacugcuc

SEQ ID NO: 1801531 - RNA, 18 nt, Human
guacuacaguccucccau

SEQ ID NO: 1801532 - RNA, 19 nt, Human
guacuacaguccucccauc

SEQ ID NO: 1801533 - RNA, 13 nt, Human
guacuauguauca

SEQ ID NO: 1801534 - RNA, 14 nt, Human
guacucauuaaaaa

SEQ ID NO: 1801535 - RNA, 15 nt, Human
guacuauguaucaau

SEQ ID NO: 1801536 - RNA, 17 nt, Human
guacuauguaucaauga

SEQ ID NO: 1801537 - RNA, 19 nt, Human
guacuccacauauuucagu

SEQ ID NO: 1801538 - RNA, 14 nt, Human
guacuccucccagg

SEQ ID NO: 1801539 - RNA, 20 nt, Human
guagaaauaucugaaaaugu

SEQ ID NO: 1801540 - RNA, 21 nt, Human
guagaaauaucugaaaaugua

SEQ ID NO: 1801541 - RNA, 23 nt, Human
guagaaauaucugaaaauguaug

SEQ ID NO: 1801542 - RNA, 21 nt, Human
guagaagucuuagauguauau

SEQ ID NO: 1801543 - RNA, 12 nt, Human
guagaagauggc

SEQ ID NO: 1801544 - RNA, 18 nt, Human
guagaagcccuucuaccu

SEQ ID NO: 1801545 - RNA, 11 nt, Human
guagagccagg

SEQ ID NO: 1801546 - RNA, 10 nt, Human
guagagccag

SEQ ID NO: 1801547 - RNA, 13 nt, Human
guagagacagggu

SEQ ID NO: 1801548 - RNA, 18 nt, Human
guagagccagggucucac

SEQ ID NO: 1801549 - RNA, 15 nt, Human
guagagccagggucu

SEQ ID NO: 1801550 - RNA, 21 nt, Human
guagccucaaucgagugagac

SEQ ID NO: 1801551 - RNA, 12 nt, Human
guagagacaggg

SEQ ID NO: 1801552 - RNA, 11 nt, Human
guagagacagg

SEQ ID NO: 1801553 - RNA, 20 nt, Human
guaccaagacuacuagggaa

SEQ ID NO: 1801554 - RNA, 23 nt, Human
guaccaagacuacuagggaaaug

SEQ ID NO: 1801555 - RNA, 12 nt, Human
guacccacugcu

SEQ ID NO: 1801556 - RNA, 23 nt, Human
guaccauuuaauggggaggacaa

SEQ ID NO: 1801557 - RNA, 22 nt, Human
guaccauuuaauggggaggaca

SEQ ID NO: 1801558 - RNA, 19 nt, Human
guacauggaauaacaugua

SEQ ID NO: 1801559 - RNA, 20 nt, Human
guacaugaaaacacauuuuu

SEQ ID NO: 1801560 - RNA, 19 nt, Human
guacaugaaaacacauuuu

SEQ ID NO: 1801561 - RNA, 18 nt, Human
guacaugaaaacacauuu

SEQ ID NO: 1801562 - RNA, 17 nt, Human
guacaugaaaacacauu

SEQ ID NO: 1801563 - RNA, 16 nt, Human
guacaugaaaacacau

SEQ ID NO: 1801564 - RNA, 15 nt, Human
guacaugaaaacaca

SEQ ID NO: 1801565 - RNA, 14 nt, Human
guacaugaaaacac

SEQ ID NO: 1801566 - RNA, 15 nt, Human
aaauccacuuuaucu

SEQ ID NO: 1801567 - RNA, 19 nt, Human
aaaucagccguguaaccau

SEQ ID NO: 1801568 - RNA, 12 nt, Human
aaaucagccugc

SEQ ID NO: 1801569 - RNA, 16 nt, Human
aaaucagcugcuacua

SEQ ID NO: 1801570 - RNA, 18 nt, Human
aaaucagccugcuccagc

SEQ ID NO: 1801571 - RNA, 15 nt, Human
aaauauuccugcauu

SEQ ID NO: 1801572 - RNA, 14 nt, Human
aaaucagacuauga

SEQ ID NO: 1801573 - RNA, 21 nt, Human
aaaucagacuaugaaguuuuu

SEQ ID NO: 1801574 - RNA, 15 nt, Human
guaauccaccugccu

SEQ ID NO: 1801575 - RNA, 21 nt, Human
guaauccaagcaaaugugaau

SEQ ID NO: 1801576 - RNA, 18 nt, Human
guaauaugcacacauuuu

SEQ ID NO: 1801577 - RNA, 17 nt, Human
guaauaugcacacauuu

SEQ ID NO: 1801578 - RNA, 16 nt, Human
guaauaugcacacauu

SEQ ID NO: 1801579 - RNA, 14 nt, Human
guaauaugcacaca

SEQ ID NO: 1801580 - RNA, 20 nt, Human
guaauaggcguaacuaauuu

SEQ ID NO: 1801581 - RNA, 15 nt, Human
aaauacagacuggau

SEQ ID NO: 1801582 - RNA, 17 nt, Human
aaauacagauagauaua

SEQ ID NO: 1801583 - RNA, 17 nt, Human
aaauacauuuaaaacau

SEQ ID NO: 1801584 - RNA, 18 nt, Human
aaauaccagccaguaaau

SEQ ID NO: 1801585 - RNA, 20 nt, Human
guaauuuuguguaagaaaua

SEQ ID NO: 1801586 - RNA, 16 nt, Human
guaauuuuguguaaga

SEQ ID NO: 1801587 - RNA, 14 nt, Human
guaauuuuguguaa

SEQ ID NO: 1801588 - RNA, 16 nt, Human
aaaguugguaaaccuu

SEQ ID NO: 1801589 - RNA, 17 nt, Human
aaaguugguaaaccuuu

SEQ ID NO: 1801590 - RNA, 14 nt, Human
aaauaauuuuguaa

SEQ ID NO: 1801591 - RNA, 13 nt, Human
aaauaauuuugua

SEQ ID NO: 1801592 - RNA, 12 nt, Human
aaauaauuuugu

SEQ ID NO: 1801593 - RNA, 23 nt, Human
aaaguucugcagauaaacaguag

SEQ ID NO: 1801594 - RNA, 22 nt, Human
aaaguuaccagugccuuaaacu

SEQ ID NO: 1801595 - RNA, 16 nt, Human
aaaguuaccagugccu

SEQ ID NO: 1801596 - RNA, 21 nt, Human
aaaguacuucuccacccugcu

SEQ ID NO: 1801597 - RNA, 20 nt, Human
aaaguacuucuccacccugc

SEQ ID NO: 1801598 - RNA, 23 nt, Human
aaaguacuucuccacccugcucu

SEQ ID NO: 1801599 - RNA, 18 nt, Human
aaaguaucccuacuguaa

SEQ ID NO: 1801600 - RNA, 19 nt, Human
aaaguacuucuccacccug

SEQ ID NO: 1801601 - RNA, 16 nt, Human
aaaguacauguuaaac

SEQ ID NO: 1801602 - RNA, 20 nt, Human
aaaguacacuguuucaaacu

SEQ ID NO: 1801603 - RNA, 20 nt, Human
aaagguauuuuaaucaccaa

SEQ ID NO: 1801604 - RNA, 13 nt, Human
gggaugagaaagg

SEQ ID NO: 1801605 - RNA, 19 nt, Human
aaaauuuagaaauauaauu

SEQ ID NO: 1801606 - RNA, 15 nt, Human
aaaauuuuuaaucuu

SEQ ID NO: 1801607 - RNA, 20 nt, Human
aaacaaaggccuaauucuau

SEQ ID NO: 1801608 - RNA, 20 nt, Human
aaaauuuugauguuuuaagg

SEQ ID NO: 1801609 - RNA, 19 nt, Human
aaacacaaacgggcucagc

SEQ ID NO: 1801610 - RNA, 11 nt, Human
aaacacauuuu

SEQ ID NO: 1801611 - RNA, 12 nt, Human
aaacacauuuuu

SEQ ID NO: 1801612 - RNA, 22 nt, Human
ggggaauguuugccucugccuc

SEQ ID NO: 1801613 - RNA, 18 nt, Human
ggggaauguuugccucug

SEQ ID NO: 1801614 - RNA, 13 nt, Human
ggggaaggcaggg

SEQ ID NO: 1801615 - RNA, 16 nt, Human
ggggaccagagcugcc

SEQ ID NO: 1801616 - RNA, 14 nt, Human
aaacaguagugaua

SEQ ID NO: 1801617 - RNA, 16 nt, Human
aaacauggccuuugcu

SEQ ID NO: 1801618 - RNA, 17 nt, Human
aaacauggccuuugcuu

SEQ ID NO: 1801619 - RNA, 11 nt, Human
ggggagaaagu

SEQ ID NO: 1801620 - RNA, 18 nt, Human
gggggccucagugccacu

SEQ ID NO: 1801621 - RNA, 17 nt, Human
gggggccucagugccac

SEQ ID NO: 1801622 - RNA, 15 nt, Human
gggggccucagugcc

SEQ ID NO: 1801623 - RNA, 12 nt, Human
gggggccucagu

SEQ ID NO: 1801624 - RNA, 15 nt, Human
ggggccucagugcca

SEQ ID NO: 1801625 - RNA, 22 nt, Human
aaacugcccccucugcccugcg

SEQ ID NO: 1801626 - RNA, 13 nt, Human
aaacucuccucug

SEQ ID NO: 1801627 - RNA, 19 nt, Human
aaacuguuaauaguucagg

SEQ ID NO: 1801628 - RNA, 16 nt, Human
aaacuuaaucuaaaug

SEQ ID NO: 1801629 - RNA, 18 nt, Human
aaacuuaaucuaaaugga

SEQ ID NO: 1801630 - RNA, 17 nt, Human
aaacuuaaucuaaaugg

SEQ ID NO: 1801631 - RNA, 22 nt, Human
aaacuaggugcauauuuauaaa

SEQ ID NO: 1801632 - RNA, 18 nt, Human
aaacuaggugcauauuua

SEQ ID NO: 1801633 - RNA, 15 nt, Human
aaacgggcucagcaa

SEQ ID NO: 1801634 - RNA, 18 nt, Human
aaaccuuuguuugcaucu

SEQ ID NO: 1801635 - RNA, 18 nt, Human
aaaccuuuuauauuuagu

SEQ ID NO: 1801636 - RNA, 23 nt, Human
aaaccaagucaagugaaaaagga

SEQ ID NO: 1801637 - RNA, 15 nt, Human
aaacauuaugaugug

SEQ ID NO: 1801638 - RNA, 13 nt, Human
gggucgcccugga

SEQ ID NO: 1801639 - RNA, 15 nt, Human
gggucgcccuggacu

SEQ ID NO: 1801640 - RNA, 19 nt, Human
gggggugcugggccccugc

SEQ ID NO: 1801641 - RNA, 13 nt, Human
aaagacagugaaa

SEQ ID NO: 1801642 - RNA, 9 nt, Human
aaagacaga

SEQ ID NO: 1801643 - RNA, 19 nt, Human
aaagacugaccaauauugu

SEQ ID NO: 1801644 - RNA, 12 nt, Human
aaacuuuguagu

SEQ ID NO: 1801645 - RNA, 16 nt, Human
aaacuuguauuaugug

SEQ ID NO: 1801646 - RNA, 14 nt, Human
ggguggccucccaa

SEQ ID NO: 1801647 - RNA, 15 nt, Human
ggguggggggggugc

SEQ ID NO: 1801648 - RNA, 19 nt, Human
aaacuucagacauagaauu

SEQ ID NO: 1801649 - RNA, 11 nt, Human
gguccugcugc

SEQ ID NO: 1801650 - RNA, 12 nt, Human
gguccugcugca

SEQ ID NO: 1801651 - RNA, 14 nt, Human
gguccugcugcagu

SEQ ID NO: 1801652 - RNA, 23 nt, Human
aaagauggcugugccucugccug

SEQ ID NO: 1801653 - RNA, 21 nt, Human
aaagauggcugugccucugcc

SEQ ID NO: 1801654 - RNA, 22 nt, Human
aaagauggcugugccucugccu

SEQ ID NO: 1801655 - RNA, 14 nt, Human
aaagacuguacaaa

SEQ ID NO: 1801656 - RNA, 23 nt, Human
aaagacugaguacguugugcauu

SEQ ID NO: 1801657 - RNA, 13 nt, Human
aaagacuguacaa

SEQ ID NO: 1801658 - RNA, 19 nt, Human
aaagaugcuucucacugcc

SEQ ID NO: 1801659 - RNA, 17 nt, Human
aaagaugcuucucacug

SEQ ID NO: 1801660 - RNA, 14 nt, Human
aaagaugcuucuca

SEQ ID NO: 1801661 - RNA, 15 nt, Human
aaagaggaaugaagu

SEQ ID NO: 1801662 - RNA, 22 nt, Human
aaagggacuuggaagcuccgcu

SEQ ID NO: 1801663 - RNA, 20 nt, Human
aaagggacugagaaauuuau

SEQ ID NO: 1801664 - RNA, 14 nt, Human
aaagguaaaucaga

SEQ ID NO: 1801665 - RNA, 17 nt, Human
aaaggagauuggaagga

SEQ ID NO: 1801666 - RNA, 21 nt, Human
aaaggagagcuagcagcaggg

SEQ ID NO: 1801667 - RNA, 22 nt, Human
aaaggaaagagggagguaagga

SEQ ID NO: 1801668 - RNA, 15 nt, Human
aaagcuuguuaagau

SEQ ID NO: 1801669 - RNA, 13 nt, Human
aaagcugcugaca

SEQ ID NO: 1801670 - RNA, 12 nt, Human
aaagcugaaaac

SEQ ID NO: 1801671 - RNA, 15 nt, Human
aaagcugaaaacugc

SEQ ID NO: 1801672 - RNA, 15 nt, Human
aaagcucacuuuacu

SEQ ID NO: 1801673 - RNA, 13 nt, Human
ggucgaggcagga

SEQ ID NO: 1801674 - RNA, 14 nt, Human
ggucgcccuggacu

SEQ ID NO: 1801675 - RNA, 13 nt, Human
ggugaacagaaca

SEQ ID NO: 1801676 - RNA, 20 nt, Human
ggucgcccuggacugugugc

SEQ ID NO: 1801677 - RNA, 24 nt, Human
ggugauccacccaccucagccucc

SEQ ID NO: 1801678 - RNA, 23 nt, Human
ggugauccacccaccucagccuc

SEQ ID NO: 1801679 - RNA, 18 nt, Human
ggugauccacccaccuca

SEQ ID NO: 1801680 - RNA, 12 nt, Human
ggugcaaugacc

SEQ ID NO: 1801681 - RNA, 18 nt, Human
ggugcaaaguucccuacu

SEQ ID NO: 1801682 - RNA, 13 nt, Human
ggugcaaugaccu

SEQ ID NO: 1801683 - RNA, 16 nt, Human
ggugcaaugaccuuuc

SEQ ID NO: 1801684 - RNA, 21 nt, Human
ggugcauauuuauaaaaauaa

SEQ ID NO: 1801685 - RNA, 21 nt, Human
ggugcauuugaggucuguucu

SEQ ID NO: 1801686 - RNA, 11 nt, Human
ggugcugggcc

SEQ ID NO: 1801687 - RNA, 13 nt, Human
ggugcugggcccc

SEQ ID NO: 1801688 - RNA, 15 nt, Human
ggugcugggccccug

SEQ ID NO: 1801689 - RNA, 16 nt, Human
ggugcugggccccugc

SEQ ID NO: 1801690 - RNA, 13 nt, Human
gguggaugccugg

SEQ ID NO: 1801691 - RNA, 20 nt, Human
ggcccuucucuccagccccu

SEQ ID NO: 1801692 - RNA, 21 nt, Human
ggcccuucucuccagccccug

SEQ ID NO: 1801693 - RNA, 15 nt, Human
ggcccggcuccaggc

SEQ ID NO: 1801694 - RNA, 14 nt, Human
ggccccugcugguu

SEQ ID NO: 1801695 - RNA, 13 nt, Human
ggccccugcuggu

SEQ ID NO: 1801696 - RNA, 13 nt, Human
ggcccggcuccag

SEQ ID NO: 1801697 - RNA, 23 nt, Human
ggccccugcugguucaggguugg

SEQ ID NO: 1801698 - RNA, 22 nt, Human
ggcccuucucuccagccccugg

SEQ ID NO: 1801699 - RNA, 23 nt, Human
ggcccuucucuccagccccugga

SEQ ID NO: 1801700 - RNA, 19 nt, Human
ggccucacuaggcuucugg

SEQ ID NO: 1801701 - RNA, 16 nt, Human
ggccuccauccugagg

SEQ ID NO: 1801702 - RNA, 15 nt, Human
ggccuccauccugag

SEQ ID NO: 1801703 - RNA, 14 nt, Human
ggccuccauccuga

SEQ ID NO: 1801704 - RNA, 20 nt, Human
ggccagugugacaaggauug

SEQ ID NO: 1801705 - RNA, 14 nt, Human
ggccaguugguccc

SEQ ID NO: 1801706 - RNA, 17 nt, Human
ggccaguuggucccccu

SEQ ID NO: 1801707 - RNA, 22 nt, Human
ggcagccccuguucuggcagag

SEQ ID NO: 1801708 - RNA, 21 nt, Human
ggcaguggugguuuucuguuc

SEQ ID NO: 1801709 - RNA, 20 nt, Human
ggcaguggugguuuucuguu

SEQ ID NO: 1801710 - RNA, 22 nt, Human
ggagacugcugagucaacccaa

SEQ ID NO: 1801711 - RNA, 16 nt, Human
ggagagaagagaaugc

SEQ ID NO: 1801712 - RNA, 11 nt, Human
ggcagccccug

SEQ ID NO: 1801713 - RNA, 23 nt, Human
ggcagccccauucugccugccca

SEQ ID NO: 1801714 - RNA, 15 nt, Human
ggcacugguggcccg

SEQ ID NO: 1801715 - RNA, 23 nt, Human
ggcacucagaagacacugauggg

SEQ ID NO: 1801716 - RNA, 13 nt, Human
ggcacaucagcac

SEQ ID NO: 1801717 - RNA, 23 nt, Human
ggcacagaaaauggaagacagcu

SEQ ID NO: 1801718 - RNA, 20 nt, Human
ggcacagaaaauggaagaca

SEQ ID NO: 1801719 - RNA, 21 nt, Human
ggcacagaaaauggaagacag

SEQ ID NO: 1801720 - RNA, 19 nt, Human
ggcacagaaaauggaagac

SEQ ID NO: 1801721 - RNA, 14 nt, Human
aaaaauaacaauga

SEQ ID NO: 1801722 - RNA, 19 nt, Human
ggcugggggccucagugcc

SEQ ID NO: 1801723 - RNA, 17 nt, Human
ggcugggggccucagug

SEQ ID NO: 1801724 - RNA, 16 nt, Human
ggcugggggccucagu

SEQ ID NO: 1801725 - RNA, 15 nt, Human
ggcugggggccucag

SEQ ID NO: 1801726 - RNA, 14 nt, Human
ggcugggucgcccu

SEQ ID NO: 1801727 - RNA, 17 nt, Human
ggcugggucgcccugga

SEQ ID NO: 1801728 - RNA, 20 nt, Human
ggcugggucgcccuggacug

SEQ ID NO: 1801729 - RNA, 19 nt, Human
ggcuggguggcaccagcag

SEQ ID NO: 1801730 - RNA, 19 nt, Human
ggcuggguucuacccaggu

SEQ ID NO: 1801731 - RNA, 21 nt, Human
ggcuggguucuacccaggugc

SEQ ID NO: 1801732 - RNA, 18 nt, Human
ggcuguaucccaugagcc

SEQ ID NO: 1801733 - RNA, 20 nt, Human
ggcuucaguggcagcugcuu

SEQ ID NO: 1801734 - RNA, 19 nt, Human
ggcuucaguggcagcugcu

SEQ ID NO: 1801735 - RNA, 17 nt, Human
ggcuucaguggcagcug

SEQ ID NO: 1801736 - RNA, 18 nt, Human
ggcuucaguggcagcugc

SEQ ID NO: 1801737 - RNA, 16 nt, Human
ggcuuccucauaguau

SEQ ID NO: 1801738 - RNA, 19 nt, Human
ggcuucccgcucagcccuc

SEQ ID NO: 1801739 - RNA, 21 nt, Human
ggcuucccgcucagcccuccc

SEQ ID NO: 1801740 - RNA, 15 nt, Human
ggcuucccgcucagc

SEQ ID NO: 1801741 - RNA, 16 nt, Human
ggcuucccgcucagcc

SEQ ID NO: 1801742 - RNA, 17 nt, Human
ggcuucccgcucagccc

SEQ ID NO: 1801743 - RNA, 18 nt, Human
ggcuucccgcucagcccu

SEQ ID NO: 1801744 - RNA, 14 nt, Human
ggcuucccgcucag

SEQ ID NO: 1801745 - RNA, 22 nt, Human
ggcuucauccuccucagaucuu

SEQ ID NO: 1801746 - RNA, 18 nt, Human
ggcuucauccuccucaga

SEQ ID NO: 1801747 - RNA, 15 nt, Human
gggacagcuccuucu

SEQ ID NO: 1801748 - RNA, 13 nt, Human
gggacagcuccuu

SEQ ID NO: 1801749 - RNA, 12 nt, Human
gggacagcuccu

SEQ ID NO: 1801750 - RNA, 13 nt, Human
gggacagagcaga

SEQ ID NO: 1801751 - RNA, 13 nt, Human
gggaagagacuug

SEQ ID NO: 1801752 - RNA, 13 nt, Human
gggaaccugaccc

SEQ ID NO: 1801753 - RNA, 18 nt, Human
gggaagaagcucucuccu

SEQ ID NO: 1801754 - RNA, 22 nt, Human
ggcuucccgcucagcccucccu

SEQ ID NO: 1801755 - RNA, 21 nt, Human
ggcuuccuccugguguggaag

SEQ ID NO: 1801756 - RNA, 18 nt, Human
aaaacucuccucugcugc

SEQ ID NO: 1801757 - RNA, 15 nt, Human
aaaacuucagacaua

SEQ ID NO: 1801758 - RNA, 22 nt, Human
aaaacuugauguguuaucucuu

SEQ ID NO: 1801759 - RNA, 14 nt, Human
aaaacaugcuacac

SEQ ID NO: 1801760 - RNA, 13 nt, Human
aaaacaugcuaca

SEQ ID NO: 1801761 - RNA, 12 nt, Human
aaaacccaagug

SEQ ID NO: 1801762 - RNA, 14 nt, Human
gggaccagagcugc

SEQ ID NO: 1801763 - RNA, 20 nt, Human
gggaccagagcugccaccug

SEQ ID NO: 1801764 - RNA, 17 nt, Human
aaaaaugguuuaaaugg

SEQ ID NO: 1801765 - RNA, 23 nt, Human
gggacuuggaagcuccgcuuucu

SEQ ID NO: 1801766 - RNA, 18 nt, Human
gggacuuggaagcuccgc

SEQ ID NO: 1801767 - RNA, 17 nt, Human
gggacuuggaagcuccg

SEQ ID NO: 1801768 - RNA, 15 nt, Human
gggacuuggaagcuc

SEQ ID NO: 1801769 - RNA, 21 nt, Human
gggagaaccaaaaagaggcua

SEQ ID NO: 1801770 - RNA, 15 nt, Human
aaaagcauuuuguaa

SEQ ID NO: 1801771 - RNA, 14 nt, Human
aaaagcauuuugua

SEQ ID NO: 1801772 - RNA, 16 nt, Human
aaaagcauuuuguaau

SEQ ID NO: 1801773 - RNA, 23 nt, Human
aaaagccagguuccacagaggac

SEQ ID NO: 1801774 - RNA, 15 nt, Human
gggaggucgaggcag

SEQ ID NO: 1801775 - RNA, 18 nt, Human
gggaggucaaggcugcag

SEQ ID NO: 1801776 - RNA, 15 nt, Human
gggagggagggcucc

SEQ ID NO: 1801777 - RNA, 16 nt, Human
gggagggagggcucca

SEQ ID NO: 1801778 - RNA, 23 nt, Human
gggagcaggcucgggcuccccag

SEQ ID NO: 1801779 - RNA, 15 nt, Human
gggagagccuuccag

SEQ ID NO: 1801780 - RNA, 19 nt, Human
gggagagccuuccaggggu

SEQ ID NO: 1801781 - RNA, 16 nt, Human
ggcucuucuccuuuca

SEQ ID NO: 1801782 - RNA, 22 nt, Human
ggcugacagacagcccuccauc

SEQ ID NO: 1801783 - RNA, 14 nt, Human
ggcucuucuccuuu

SEQ ID NO: 1801784 - RNA, 15 nt, Human
ggcucuucuccuuuc

SEQ ID NO: 1801785 - RNA, 23 nt, Human
ggcucuucuccuuucacaaccuu

SEQ ID NO: 1801786 - RNA, 19 nt, Human
ggcugccaaugggagcuca

SEQ ID NO: 1801787 - RNA, 20 nt, Human
ggcugccaaugggagcucau

SEQ ID NO: 1801788 - RNA, 22 nt, Human
ggcugcggaaugaaccacaucu

SEQ ID NO: 1801789 - RNA, 16 nt, Human
ggcugccuuagaaccu

SEQ ID NO: 1801790 - RNA, 22 nt, Human
ggcugcccuggugcugccacac

SEQ ID NO: 1801791 - RNA, 14 nt, Human
ggcugcccuggugc

SEQ ID NO: 1801792 - RNA, 15 nt, Human
ggcugcccuggugcu

SEQ ID NO: 1801793 - RNA, 16 nt, Human
ggcugcccuggugcug

SEQ ID NO: 1801794 - RNA, 19 nt, Human
ggcugcccuggugcugcca

SEQ ID NO: 1801795 - RNA, 13 nt, Human
ggcugcccuggug

SEQ ID NO: 1801796 - RNA, 21 nt, Human
ggcugccaaugggagcucaug

SEQ ID NO: 1801797 - RNA, 14 nt, Human
ggcucucaggccag

SEQ ID NO: 1801798 - RNA, 13 nt, Human
ggcucucaggcca

SEQ ID NO: 1801799 - RNA, 14 nt, Human
ggcucuuccaggcu

SEQ ID NO: 1801800 - RNA, 12 nt, Human
ggcucuucuccu

SEQ ID NO: 1801801 - RNA, 13 nt, Human
ggcucuucuccuu

SEQ ID NO: 1801802 - RNA, 12 nt, Human
ggcucuuccagg

SEQ ID NO: 1801803 - RNA, 11 nt, Human
ggcucucaggc

SEQ ID NO: 1801804 - RNA, 13 nt, Human
ggcugcugaaggc

SEQ ID NO: 1801805 - RNA, 14 nt, Human
ggcugggagagccu

SEQ ID NO: 1801806 - RNA, 15 nt, Human
ggcugggagagccuu

SEQ ID NO: 1801807 - RNA, 16 nt, Human
ggcugggagagccuuc

SEQ ID NO: 1801808 - RNA, 18 nt, Human
ggcugggagagccuucca

SEQ ID NO: 1801809 - RNA, 20 nt, Human
ggcucagcggggacagcucc

SEQ ID NO: 1801810 - RNA, 19 nt, Human
ggcucagcggggacagcuc

SEQ ID NO: 1801811 - RNA, 16 nt, Human
ggcucagauuguaaua

SEQ ID NO: 1801812 - RNA, 19 nt, Human
ggcucagguggggucacuc

SEQ ID NO: 1801813 - RNA, 20 nt, Human
ggcucagguggggucacucu

SEQ ID NO: 1801814 - RNA, 18 nt, Human
ggcucagcggggacagcu

SEQ ID NO: 1801815 - RNA, 19 nt, Human
ggcucagcaaaagaugcuu

SEQ ID NO: 1801816 - RNA, 17 nt, Human
ggcuccaaacccucgag

SEQ ID NO: 1801817 - RNA, 14 nt, Human
ggcuccacuugguc

SEQ ID NO: 1801818 - RNA, 20 nt, Human
caauaaaaucuugaaaaugc

SEQ ID NO: 1801819 - RNA, 15 nt, Human
caaggcucugagcaa

SEQ ID NO: 1801820 - RNA, 12 nt, Human
caagauuucaga

SEQ ID NO: 1801821 - RNA, 17 nt, Human
caaggcaaggcugucaa

SEQ ID NO: 1801822 - RNA, 16 nt, Human
caaggcaaggcuguca

SEQ ID NO: 1801823 - RNA, 18 nt, Human
caaggcaaggcugucaau

SEQ ID NO: 1801824 - RNA, 21 nt, Human
caaggccaaaggaagcacaug

SEQ ID NO: 1801825 - RNA, 19 nt, Human
caaggccaaaggaagcaca

SEQ ID NO: 1801826 - RNA, 20 nt, Human
caaggccaaaggaagcacau

SEQ ID NO: 1801827 - RNA, 21 nt, Human
caaugcuggcuguuggcuggg

SEQ ID NO: 1801828 - RNA, 20 nt, Human
caaugcuggcuguuggcugg

SEQ ID NO: 1801829 - RNA, 13 nt, Human
caaugcuggcugu

SEQ ID NO: 1801830 - RNA, 23 nt, Human
caaucccaccaacccucagagcc

SEQ ID NO: 1801831 - RNA, 16 nt, Human
caaucccaccaacccu

SEQ ID NO: 1801832 - RNA, 17 nt, Human
caaucccaccaacccuc

SEQ ID NO: 1801833 - RNA, 22 nt, Human
caaucccaccaacccucagagc

SEQ ID NO: 1801834 - RNA, 18 nt, Human
cacaagagcccaggccuc

SEQ ID NO: 1801835 - RNA, 19 nt, Human
cacaagagcccaggccucc

SEQ ID NO: 1801836 - RNA, 20 nt, Human
cacaagagcccaggccuccu

SEQ ID NO: 1801837 - RNA, 18 nt, Human
cacaagcuccaagcuccc

SEQ ID NO: 1801838 - RNA, 19 nt, Human
cacaagcuccaagcuccca

SEQ ID NO: 1801839 - RNA, 15 nt, Human
caaugggagcucaug

SEQ ID NO: 1801840 - RNA, 20 nt, Human
cacaagcuccaagcucccag

SEQ ID NO: 1801841 - RNA, 21 nt, Human
cacaagcuccaagcucccagg

SEQ ID NO: 1801842 - RNA, 14 nt, Human
cacagacccugccc

SEQ ID NO: 1801843 - RNA, 16 nt, Human
cacagacccugcccug

SEQ ID NO: 1801844 - RNA, 17 nt, Human
cacagacccugcccugu

SEQ ID NO: 1801845 - RNA, 14 nt, Human
cacagcucuguccu

SEQ ID NO: 1801846 - RNA, 11 nt, Human
cacagcucugu

SEQ ID NO: 1801847 - RNA, 18 nt, Human
cacagacccugcccugug

SEQ ID NO: 1801848 - RNA, 19 nt, Human
cacagcucuguccugggag

SEQ ID NO: 1801849 - RNA, 18 nt, Human
cacagcucuguccuggga

SEQ ID NO: 1801850 - RNA, 16 nt, Human
cacagcucuguccugg

SEQ ID NO: 1801851 - RNA, 15 nt, Human
cacagcucuguccug

SEQ ID NO: 1801852 - RNA, 15 nt, Human
cacagcucuucucca

SEQ ID NO: 1801853 - RNA, 14 nt, Human
cacagcucuucucc

SEQ ID NO: 1801854 - RNA, 17 nt, Human
cacagcucuucuccagg

SEQ ID NO: 1801855 - RNA, 13 nt, Human
cacagaacccuug

SEQ ID NO: 1801856 - RNA, 11 nt, Human
cacacauuuuu

SEQ ID NO: 1801857 - RNA, 10 nt, Human
cacacauuuu

SEQ ID NO: 1801858 - RNA, 20 nt, Human
cacacauuuuuuaaaugcac

SEQ ID NO: 1801859 - RNA, 19 nt, Human
cacacauuuuuuaaaugca

SEQ ID NO: 1801860 - RNA, 16 nt, Human
cacacauuuuuuaaau

SEQ ID NO: 1801861 - RNA, 12 nt, Human
cacacauuuuuu

SEQ ID NO: 1801862 - RNA, 16 nt, Human
cacccaggagccccga

SEQ ID NO: 1801863 - RNA, 18 nt, Human
cacccaccucagccuccc

SEQ ID NO: 1801864 - RNA, 16 nt, Human
caccagccccagugcc

SEQ ID NO: 1801865 - RNA, 13 nt, Human
caccagccccagu

SEQ ID NO: 1801866 - RNA, 17 nt, Human
cacccaccucagccucc

SEQ ID NO: 1801867 - RNA, 18 nt, Human
caccagggaaggggacaa

SEQ ID NO: 1801868 - RNA, 21 nt, Human
caccagggaaggggacaagga

SEQ ID NO: 1801869 - RNA, 13 nt, Human
caccagggaaggg

SEQ ID NO: 1801870 - RNA, 17 nt, Human
cacauuuuauuuuauua

SEQ ID NO: 1801871 - RNA, 21 nt, Human
cacauuuuauuuuauuaugca

SEQ ID NO: 1801872 - RNA, 20 nt, Human
cacauuuuauuuuauuaugc

SEQ ID NO: 1801873 - RNA, 19 nt, Human
cacauuuuauuuuauuaug

SEQ ID NO: 1801874 - RNA, 17 nt, Human
caccaacauacucccau

SEQ ID NO: 1801875 - RNA, 16 nt, Human
caccaacgucugugcc

SEQ ID NO: 1801876 - RNA, 13 nt, Human
caccaacccucag

SEQ ID NO: 1801877 - RNA, 14 nt, Human
caccaacgucugug

SEQ ID NO: 1801878 - RNA, 23 nt, Human
cacuguugcccaggcuggcgugc

SEQ ID NO: 1801879 - RNA, 19 nt, Human
cacuguugcccaggcuggc

SEQ ID NO: 1801880 - RNA, 18 nt, Human
cacuguugcccaggcugg

SEQ ID NO: 1801881 - RNA, 15 nt, Human
cacuuaaaaaugguu

SEQ ID NO: 1801882 - RNA, 13 nt, Human
cacugggcuucua

SEQ ID NO: 1801883 - RNA, 20 nt, Human
cacugggcuuggggaccaga

SEQ ID NO: 1801884 - RNA, 19 nt, Human
cacugggagaaaugaaaaa

SEQ ID NO: 1801885 - RNA, 14 nt, Human
cacugcagccucaa

SEQ ID NO: 1801886 - RNA, 19 nt, Human
cacugcagccucaaccucc

SEQ ID NO: 1801887 - RNA, 23 nt, Human
cacugcagccucaaccuccuggg

SEQ ID NO: 1801888 - RNA, 22 nt, Human
cacugcagccucaaccuccugg

SEQ ID NO: 1801889 - RNA, 21 nt, Human
cacugcagccucaaccuccug

SEQ ID NO: 1801890 - RNA, 20 nt, Human
cacugcagccucaaccuccu

SEQ ID NO: 1801891 - RNA, 17 nt, Human
cacugccaugccagcuu

SEQ ID NO: 1801892 - RNA, 18 nt, Human
cacuuguguuaugaagca

SEQ ID NO: 1801893 - RNA, 19 nt, Human
cacuuguugauuaauggaa

SEQ ID NO: 1801894 - RNA, 22 nt, Human
cacuuaaguuaguuccacugag

SEQ ID NO: 1801895 - RNA, 20 nt, Human
cacuuaaguuaguuccacug

SEQ ID NO: 1801896 - RNA, 18 nt, Human
cacuuucuagccagagga

SEQ ID NO: 1801897 - RNA, 16 nt, Human
cacuuucuagccagag

SEQ ID NO: 1801898 - RNA, 17 nt, Human
cacuuucuagccagagg

SEQ ID NO: 1801899 - RNA, 13 nt, Human
cacuuucuagcca

SEQ ID NO: 1801900 - RNA, 11 nt, Human
cagaacaguga

SEQ ID NO: 1801901 - RNA, 17 nt, Human
cagaacagugauuacca

SEQ ID NO: 1801902 - RNA, 12 nt, Human
cagaacagugau

SEQ ID NO: 1801903 - RNA, 14 nt, Human
cagaaguuucugcc

SEQ ID NO: 1801904 - RNA, 16 nt, Human
cagaaguuucugccgc

SEQ ID NO: 1801905 - RNA, 15 nt, Human
cagaaguuucucagc

SEQ ID NO: 1801906 - RNA, 19 nt, Human
cagaaguuucucagcuccc

SEQ ID NO: 1801907 - RNA, 18 nt, Human
cagaacagugauuaccag

SEQ ID NO: 1801908 - RNA, 16 nt, Human
cagaaauguacagcaa

SEQ ID NO: 1801909 - RNA, 20 nt, Human
cagaaagguuuucuucuuuu

SEQ ID NO: 1801910 - RNA, 22 nt, Human
cacucuuauugcccacgcugga

SEQ ID NO: 1801911 - RNA, 21 nt, Human
cacucuuauugcccacgcugg

SEQ ID NO: 1801912 - RNA, 20 nt, Human
cacucuuauugcccacgcug

SEQ ID NO: 1801913 - RNA, 21 nt, Human
cacuacauuauaaaugucucu

SEQ ID NO: 1801914 - RNA, 17 nt, Human
cacuacauucuguuaau

SEQ ID NO: 1801915 - RNA, 16 nt, Human
cacuacauucuguuaa

SEQ ID NO: 1801916 - RNA, 21 nt, Human
cacuacauucuguuaaucauu

SEQ ID NO: 1801917 - RNA, 12 nt, Human
cacuccagccug

SEQ ID NO: 1801918 - RNA, 13 nt, Human
cacuccagccuga

SEQ ID NO: 1801919 - RNA, 13 nt, Human
cacuccagccugg

SEQ ID NO: 1801920 - RNA, 14 nt, Human
cacuccagccuggg

SEQ ID NO: 1801921 - RNA, 23 nt, Human
cacuccagccugagcgacaguga

SEQ ID NO: 1801922 - RNA, 13 nt, Human
cacggccaggcca

SEQ ID NO: 1801923 - RNA, 12 nt, Human
cacggccaggcc

SEQ ID NO: 1801924 - RNA, 17 nt, Human
cacggccaggccagagg

SEQ ID NO: 1801925 - RNA, 14 nt, Human
cacggcucacugca

SEQ ID NO: 1801926 - RNA, 15 nt, Human
cacggcucacugcag

SEQ ID NO: 1801927 - RNA, 14 nt, Human
caccuuucccaucu

SEQ ID NO: 1801928 - RNA, 16 nt, Human
caccuuggcugcaggg

SEQ ID NO: 1801929 - RNA, 15 nt, Human
caccuuggcugcagg

SEQ ID NO: 1801930 - RNA, 18 nt, Human
caccuuggcugcagggag

SEQ ID NO: 1801931 - RNA, 23 nt, Human
caccuuuauucuggcagaggagg

SEQ ID NO: 1801932 - RNA, 18 nt, Human
caccugcccaaccugcuc

SEQ ID NO: 1801933 - RNA, 19 nt, Human
caccugcccaaccugcucu

SEQ ID NO: 1801934 - RNA, 13 nt, Human
caccugcccaacc

SEQ ID NO: 1801935 - RNA, 12 nt, Human
caccucagccuc

SEQ ID NO: 1801936 - RNA, 12 nt, Human
caccuacugagu

SEQ ID NO: 1801937 - RNA, 22 nt, Human
caaaugagaaaaugucuuuauu

SEQ ID NO: 1801938 - RNA, 23 nt, Human
caaaugcuguaacuuucugaaau

SEQ ID NO: 1801939 - RNA, 18 nt, Human
caaagauauuuugcuuug

SEQ ID NO: 1801940 - RNA, 22 nt, Human
caaagcagugcaugcugucccu

SEQ ID NO: 1801941 - RNA, 16 nt, Human
caaagauauuuugcuu

SEQ ID NO: 1801942 - RNA, 14 nt, Human
caaagauauuuugc

SEQ ID NO: 1801943 - RNA, 18 nt, Human
caaagcagugcaugcugu

SEQ ID NO: 1801944 - RNA, 21 nt, Human
caaagcagugcaugcuguccc

SEQ ID NO: 1801945 - RNA, 14 nt, Human
caaagguaaaucag

SEQ ID NO: 1801946 - RNA, 22 nt, Human
caaagguaaaucagacuaugaa

SEQ ID NO: 1801947 - RNA, 22 nt, Human
caaaguagaagucuuagaugua

SEQ ID NO: 1801948 - RNA, 21 nt, Human
caaaguaucccuacuguaauu

SEQ ID NO: 1801949 - RNA, 19 nt, Human
caaaguaucccuacuguaa

SEQ ID NO: 1801950 - RNA, 21 nt, Human
caacacacagauuugagcuca

SEQ ID NO: 1801951 - RNA, 22 nt, Human
caacacacagauuugagcucag

SEQ ID NO: 1801952 - RNA, 19 nt, Human
caagacccaaaaggcagaa

SEQ ID NO: 1801953 - RNA, 18 nt, Human
caagaccacguuucuaaa

SEQ ID NO: 1801954 - RNA, 17 nt, Human
caagaccacguuucuaa

SEQ ID NO: 1801955 - RNA, 14 nt, Human
caacucuccuccag

SEQ ID NO: 1801956 - RNA, 22 nt, Human
caagaauugaagcaggacuaaa

SEQ ID NO: 1801957 - RNA, 19 nt, Human
caacuacuaccuguaauga

SEQ ID NO: 1801958 - RNA, 18 nt, Human
caacuaauuuuuguauuu

SEQ ID NO: 1801959 - RNA, 18 nt, Human
caacucaccccagcccca

SEQ ID NO: 1801960 - RNA, 21 nt, Human
caaaaggauaaugaauacuuu

SEQ ID NO: 1801961 - RNA, 18 nt, Human
caaaccccgaccaccugc

SEQ ID NO: 1801962 - RNA, 21 nt, Human
caaaccccgaccaccugccca

SEQ ID NO: 1801963 - RNA, 14 nt, Human
caaacccuucagug

SEQ ID NO: 1801964 - RNA, 16 nt, Human
auuuuuuugagacaga

SEQ ID NO: 1801965 - RNA, 18 nt, Human
auuuuuuuuuccuucagu

SEQ ID NO: 1801966 - RNA, 20 nt, Human
auuuuuuuuuccuucagugc

SEQ ID NO: 1801967 - RNA, 22 nt, Human
auuuuuuuuuccuucagugccu

SEQ ID NO: 1801968 - RNA, 23 nt, Human
auuuuuuuuuccuucagugccuu

SEQ ID NO: 1801969 - RNA, 14 nt, Human
auuuuuagacagag

SEQ ID NO: 1801970 - RNA, 19 nt, Human
auuuuuaagugcugcauuu

SEQ ID NO: 1801971 - RNA, 18 nt, Human
auuuuuaagugcugcauu

SEQ ID NO: 1801972 - RNA, 16 nt, Human
auuuuuaagugcugca

SEQ ID NO: 1801973 - RNA, 21 nt, Human
auuuuauaucaauuuaaaaaa

SEQ ID NO: 1801974 - RNA, 18 nt, Human
auucaacagguuuuccug

SEQ ID NO: 1801975 - RNA, 20 nt, Human
auuaguacuccccuccuuga

SEQ ID NO: 1801976 - RNA, 11 nt, Human
auuaaauuaug

SEQ ID NO: 1801977 - RNA, 14 nt, Human
auuaggauuucaug

SEQ ID NO: 1801978 - RNA, 16 nt, Human
auuaggauuucaugau

SEQ ID NO: 1801979 - RNA, 17 nt, Human
auuaaaugcccagcccc

SEQ ID NO: 1801980 - RNA, 19 nt, Human
auuaaaugcccagccccuu

SEQ ID NO: 1801981 - RNA, 14 nt, Human
auucuugcaaagua

SEQ ID NO: 1801982 - RNA, 16 nt, Human
auucuugcaaaguauc

SEQ ID NO: 1801983 - RNA, 15 nt, Human
auucuugcaaaguau

SEQ ID NO: 1801984 - RNA, 22 nt, Human
auucuucuguacgucugacagg

SEQ ID NO: 1801985 - RNA, 20 nt, Human
auucuucugcuucagccucc

SEQ ID NO: 1801986 - RNA, 19 nt, Human
auucuucugcuucagccuc

SEQ ID NO: 1801987 - RNA, 19 nt, Human
auucucuaguuugauuaaa

SEQ ID NO: 1801988 - RNA, 18 nt, Human
auucucuaguuugauuaa

SEQ ID NO: 1801989 - RNA, 17 nt, Human
auucucuaguuugauua

SEQ ID NO: 1801990 - RNA, 22 nt, Human
auucuccuuguguuacuaaguu

SEQ ID NO: 1801991 - RNA, 21 nt, Human
auucuccuuguguuacuaagu

SEQ ID NO: 1801992 - RNA, 19 nt, Human
auucuccuuguguuacuaa

SEQ ID NO: 1801993 - RNA, 18 nt, Human
auucuccuuguguuacua

SEQ ID NO: 1801994 - RNA, 18 nt, Human
auuccugcauuugugaaa

SEQ ID NO: 1801995 - RNA, 15 nt, Human
auuccugcauuugug

SEQ ID NO: 1801996 - RNA, 16 nt, Human
auugcuuguuggauuu

SEQ ID NO: 1801997 - RNA, 14 nt, Human
auugcuugcacaaa

SEQ ID NO: 1801998 - RNA, 16 nt, Human
auuuaaugaaagacug

SEQ ID NO: 1801999 - RNA, 15 nt, Human
auuuaaugaaagacu

SEQ ID NO: 1802000 - RNA, 20 nt, Human
auuuaaugaaagacuguaca

SEQ ID NO: 1802001 - RNA, 21 nt, Human
auuuaaugaaagacuguacaa

SEQ ID NO: 1802002 - RNA, 16 nt, Human
auuuaugcauauuauu

SEQ ID NO: 1802003 - RNA, 22 nt, Human
auuuaugcauauuauuuuaugu

SEQ ID NO: 1802004 - RNA, 15 nt, Human
cagugccaaaaacaa

SEQ ID NO: 1802005 - RNA, 12 nt, Human
cagugcccacag

SEQ ID NO: 1802006 - RNA, 19 nt, Human
cagugggacagggcauggc

SEQ ID NO: 1802007 - RNA, 16 nt, Human
cagugggacagggcau

SEQ ID NO: 1802008 - RNA, 11 nt, Human
cagugggagcu

SEQ ID NO: 1802009 - RNA, 20 nt, Human
cagucugauucccaagcucu

SEQ ID NO: 1802010 - RNA, 19 nt, Human
cagucugauucccaagcuc

SEQ ID NO: 1802011 - RNA, 19 nt, Human
cagugcaugcugucccuua

SEQ ID NO: 1802012 - RNA, 22 nt, Human
cagugcaugcugucccuuacgu

SEQ ID NO: 1802013 - RNA, 23 nt, Human
cagugcaugcugucccuuacgug

SEQ ID NO: 1802014 - RNA, 14 nt, Human
cagucucccucccu

SEQ ID NO: 1802015 - RNA, 20 nt, Human
cagucaccccggccaccugc

SEQ ID NO: 1802016 - RNA, 19 nt, Human
cagucaccccggccaccug

SEQ ID NO: 1802017 - RNA, 22 nt, Human
cagucaccccggccaccugcgg

SEQ ID NO: 1802018 - RNA, 21 nt, Human
cagguuggugggggccucggu

SEQ ID NO: 1802019 - RNA, 16 nt, Human
cagguuuaagcuguua

SEQ ID NO: 1802020 - RNA, 18 nt, Human
cagguuuaagcuguuacu

SEQ ID NO: 1802021 - RNA, 18 nt, Human
cagggucucacucugucg

SEQ ID NO: 1802022 - RNA, 21 nt, Human
cagggucucacucugucgccc

SEQ ID NO: 1802023 - RNA, 22 nt, Human
cagggucucacucugucgccca

SEQ ID NO: 1802024 - RNA, 17 nt, Human
caggugauccacccacc

SEQ ID NO: 1802025 - RNA, 16 nt, Human
caggugauccacccac

SEQ ID NO: 1802026 - RNA, 12 nt, Human
caggguuggccc

SEQ ID NO: 1802027 - RNA, 14 nt, Human
caggguuggccccu

SEQ ID NO: 1802028 - RNA, 20 nt, Human
caggugauccacccaccuca

SEQ ID NO: 1802029 - RNA, 14 nt, Human
cagguugguggggg

SEQ ID NO: 1802030 - RNA, 14 nt, Human
caggugcgaaagga

SEQ ID NO: 1802031 - RNA, 18 nt, Human
caggugcuaggaacacuc

SEQ ID NO: 1802032 - RNA, 20 nt, Human
caggugcuaggaacacuccu

SEQ ID NO: 1802033 - RNA, 19 nt, Human
caggcugggcuucaguggc

SEQ ID NO: 1802034 - RNA, 17 nt, Human
caggcugggcuucagug

SEQ ID NO: 1802035 - RNA, 18 nt, Human
cagggaggacgcucucug

SEQ ID NO: 1802036 - RNA, 17 nt, Human
cagggaggacgcucucu

SEQ ID NO: 1802037 - RNA, 12 nt, Human
cagggagggccu

SEQ ID NO: 1802038 - RNA, 13 nt, Human
cagggagggccug

SEQ ID NO: 1802039 - RNA, 19 nt, Human
cagggaggacgcucucugg

SEQ ID NO: 1802040 - RNA, 16 nt, Human
caggcugggcuucagu

SEQ ID NO: 1802041 - RNA, 15 nt, Human
caggcuggcgugcag

SEQ ID NO: 1802042 - RNA, 20 nt, Human
caggcuggcccugcccuggu

SEQ ID NO: 1802043 - RNA, 17 nt, Human
caggcgccccuuccccc

SEQ ID NO: 1802044 - RNA, 17 nt, Human
caggcuggcccugcccu

SEQ ID NO: 1802045 - RNA, 18 nt, Human
caggcuggcccugcccug

SEQ ID NO: 1802046 - RNA, 19 nt, Human
caggcuggcccugcccugg

SEQ ID NO: 1802047 - RNA, 20 nt, Human
caggccugccuguucccauu

SEQ ID NO: 1802048 - RNA, 15 nt, Human
caggcgccccuuccc

SEQ ID NO: 1802049 - RNA, 18 nt, Human
cagggaggugaccccagg

SEQ ID NO: 1802050 - RNA, 14 nt, Human
cagggagggccugg

SEQ ID NO: 1802051 - RNA, 16 nt, Human
cagggagggccugggc

SEQ ID NO: 1802052 - RNA, 22 nt, Human
cagggaguccgaaagggacuug

SEQ ID NO: 1802053 - RNA, 23 nt, Human
caggagggagggggaaggcaggg

SEQ ID NO: 1802054 - RNA, 17 nt, Human
caggaggccagccuuga

SEQ ID NO: 1802055 - RNA, 15 nt, Human
caggagggaggggga

SEQ ID NO: 1802056 - RNA, 23 nt, Human
caggcacccaccaucaugucugg

SEQ ID NO: 1802057 - RNA, 22 nt, Human
caggcacccaccaucaugucug

SEQ ID NO: 1802058 - RNA, 18 nt, Human
caggcacccaccaucaug

SEQ ID NO: 1802059 - RNA, 14 nt, Human
caggaggccagccu

SEQ ID NO: 1802060 - RNA, 15 nt, Human
caggaggccagccuu

SEQ ID NO: 1802061 - RNA, 16 nt, Human
caggaggccagccuug

SEQ ID NO: 1802062 - RNA, 21 nt, Human
caggccagagggagugacaga

SEQ ID NO: 1802063 - RNA, 19 nt, Human
caggccagagggagugaca

SEQ ID NO: 1802064 - RNA, 23 nt, Human
caggccagagggagugacagagg

SEQ ID NO: 1802065 - RNA, 21 nt, Human
cagccgagauagccaaggcca

SEQ ID NO: 1802066 - RNA, 21 nt, Human
cagcccuuagcagggaaacag

SEQ ID NO: 1802067 - RNA, 16 nt, Human
cagcccuuagcaggga

SEQ ID NO: 1802068 - RNA, 22 nt, Human
cagccccuggaugcagccucac

SEQ ID NO: 1802069 - RNA, 15 nt, Human
cagcccuuagcaggg

SEQ ID NO: 1802070 - RNA, 17 nt, Human
cagccccuggaugcagc

SEQ ID NO: 1802071 - RNA, 18 nt, Human
cagccccuggaugcagcc

SEQ ID NO: 1802072 - RNA, 19 nt, Human
cagccccuggaugcagccu

SEQ ID NO: 1802073 - RNA, 21 nt, Human
cagccccuggaugcagccuca

SEQ ID NO: 1802074 - RNA, 12 nt, Human
cagccccuggau

SEQ ID NO: 1802075 - RNA, 13 nt, Human
cagccccuggaug

SEQ ID NO: 1802076 - RNA, 14 nt, Human
cagccccuggaugc

SEQ ID NO: 1802077 - RNA, 18 nt, Human
cagccugagcgacaguga

SEQ ID NO: 1802078 - RNA, 22 nt, Human
cagccugagcgacagugagacu

SEQ ID NO: 1802079 - RNA, 19 nt, Human
cagccugagcgacagugag

SEQ ID NO: 1802080 - RNA, 17 nt, Human
cagcggggacagcuccu

SEQ ID NO: 1802081 - RNA, 16 nt, Human
cagcggggacagcucc

SEQ ID NO: 1802082 - RNA, 15 nt, Human
cagcggggacagcuc

SEQ ID NO: 1802083 - RNA, 14 nt, Human
caggaaaggcucca

SEQ ID NO: 1802084 - RNA, 15 nt, Human
caggaaaggcuccag

SEQ ID NO: 1802085 - RNA, 19 nt, Human
cagcuucauuuccuguguc

SEQ ID NO: 1802086 - RNA, 18 nt, Human
cagcuucauuuccugugu

SEQ ID NO: 1802087 - RNA, 15 nt, Human
cagcuucauuuccug

SEQ ID NO: 1802088 - RNA, 18 nt, Human
cagcugugcucuggacag

SEQ ID NO: 1802089 - RNA, 19 nt, Human
cagcugugcucuggacagg

SEQ ID NO: 1802090 - RNA, 20 nt, Human
cagcuccagcucaccagccc

SEQ ID NO: 1802091 - RNA, 18 nt, Human
cagcuccagcucaccagc

SEQ ID NO: 1802092 - RNA, 17 nt, Human
cagcuccagcucaccag

SEQ ID NO: 1802093 - RNA, 16 nt, Human
cagcuccagcucacca

SEQ ID NO: 1802094 - RNA, 22 nt, Human
cagcuccagcucaccagcccca

SEQ ID NO: 1802095 - RNA, 21 nt, Human
cagcucccaaggcucugagca

SEQ ID NO: 1802096 - RNA, 15 nt, Human
cagcuccagcucacc

SEQ ID NO: 1802097 - RNA, 14 nt, Human
cagcuccagcucac

SEQ ID NO: 1802098 - RNA, 13 nt, Human
cagcuccagcuca

SEQ ID NO: 1802099 - RNA, 20 nt, Human
cagcaccuacaguguacagu

SEQ ID NO: 1802100 - RNA, 15 nt, Human
cagcaccuacagugu

SEQ ID NO: 1802101 - RNA, 22 nt, Human
cagccaggccacaagacccuug

SEQ ID NO: 1802102 - RNA, 12 nt, Human
cagccaggccac

SEQ ID NO: 1802103 - RNA, 13 nt, Human
cagccaggccaca

SEQ ID NO: 1802104 - RNA, 19 nt, Human
cagcauauucaggaagcuc

SEQ ID NO: 1802105 - RNA, 22 nt, Human
cagcauauucaggaagcucagg

SEQ ID NO: 1802106 - RNA, 23 nt, Human
cagcauauucaggaagcucaggg

SEQ ID NO: 1802107 - RNA, 22 nt, Human
cagagggccugcaagggaguga

SEQ ID NO: 1802108 - RNA, 19 nt, Human
cagaaguuucugccgcagc

SEQ ID NO: 1802109 - RNA, 20 nt, Human
cagaaguuugagaucagccu

SEQ ID NO: 1802110 - RNA, 22 nt, Human
cagaaguuugagaucagccugg

SEQ ID NO: 1802111 - RNA, 23 nt, Human
cagaaguuugagaucagccuggg

SEQ ID NO: 1802112 - RNA, 16 nt, Human
cagagcugccaccugc

SEQ ID NO: 1802113 - RNA, 18 nt, Human
cagagcugccaccugccu

SEQ ID NO: 1802114 - RNA, 20 nt, Human
cagagucagaaguuucugcc

SEQ ID NO: 1802115 - RNA, 18 nt, Human
cagaggggguggccuccc

SEQ ID NO: 1802116 - RNA, 17 nt, Human
cagaggggguggccucc

SEQ ID NO: 1802117 - RNA, 19 nt, Human
cagaggggguggccuccca

SEQ ID NO: 1802118 - RNA, 20 nt, Human
cagaggggguggccucccaa

SEQ ID NO: 1802119 - RNA, 12 nt, Human
cauuccuguucc

SEQ ID NO: 1802120 - RNA, 22 nt, Human
cauucgcuacuaugauuuaauu

SEQ ID NO: 1802121 - RNA, 13 nt, Human
cauucucacuccu

SEQ ID NO: 1802122 - RNA, 18 nt, Human
cauucuagguuugcaaga

SEQ ID NO: 1802123 - RNA, 14 nt, Human
cauucucacuccua

SEQ ID NO: 1802124 - RNA, 22 nt, Human
cauuaggugugacugaauuucu

SEQ ID NO: 1802125 - RNA, 23 nt, Human
cauuaucuagauacuguaucaug

SEQ ID NO: 1802126 - RNA, 13 nt, Human
cauguuggccagg

SEQ ID NO: 1802127 - RNA, 12 nt, Human
cauguuggccag

SEQ ID NO: 1802128 - RNA, 18 nt, Human
cauguccaagaagcccag

SEQ ID NO: 1802129 - RNA, 19 nt, Human
cauguccaagaagcccagg

SEQ ID NO: 1802130 - RNA, 20 nt, Human
cauguccaagaagcccagga

SEQ ID NO: 1802131 - RNA, 16 nt, Human
caugcacgugugugca

SEQ ID NO: 1802132 - RNA, 13 nt, Human
caugcuccuggcc

SEQ ID NO: 1802133 - RNA, 12 nt, Human
caugcugcccug

SEQ ID NO: 1802134 - RNA, 13 nt, Human
caugcugcccugu

SEQ ID NO: 1802135 - RNA, 22 nt, Human
caugauuaaccacuucagcuga

SEQ ID NO: 1802136 - RNA, 23 nt, Human
caugauuaaccacuucagcugac

SEQ ID NO: 1802137 - RNA, 12 nt, Human
caugcacaaauu

SEQ ID NO: 1802138 - RNA, 24 nt, Human
caugauuaaccacuucagcugacu

SEQ ID NO: 1802139 - RNA, 21 nt, Human
caugacacgaauauugcugau

SEQ ID NO: 1802140 - RNA, 23 nt, Human
caugacacgaauauugcugaugg

SEQ ID NO: 1802141 - RNA, 23 nt, Human
caugaaguaauaugcacacauuu

SEQ ID NO: 1802142 - RNA, 22 nt, Human
caugaaguaauaugcacacauu

SEQ ID NO: 1802143 - RNA, 19 nt, Human
caugaaguaauaugcacac

SEQ ID NO: 1802144 - RNA, 15 nt, Human
caugaaguaauaugc

SEQ ID NO: 1802145 - RNA, 14 nt, Human
cauggccagguggc

SEQ ID NO: 1802146 - RNA, 13 nt, Human
cauggccaggugg

SEQ ID NO: 1802147 - RNA, 14 nt, Human
caugcugcccugug

SEQ ID NO: 1802148 - RNA, 15 nt, Human
caugcugcccuguga

SEQ ID NO: 1802149 - RNA, 15 nt, Human
cagugggagcugccu

SEQ ID NO: 1802150 - RNA, 22 nt, Human
cauagcagagaaugaaagggcc

SEQ ID NO: 1802151 - RNA, 19 nt, Human
cauagcagagaaugaaagg

SEQ ID NO: 1802152 - RNA, 22 nt, Human
cauagcaccuaacaacauugua

SEQ ID NO: 1802153 - RNA, 22 nt, Human
cauagcuuacaagccagcugga

SEQ ID NO: 1802154 - RNA, 22 nt, Human
cauaugccugggcagaaggaag

SEQ ID NO: 1802155 - RNA, 15 nt, Human
cauaugccugggcag

SEQ ID NO: 1802156 - RNA, 20 nt, Human
cauaugccugggcagaagga

SEQ ID NO: 1802157 - RNA, 22 nt, Human
cauauucaggaagcucagggcc

SEQ ID NO: 1802158 - RNA, 20 nt, Human
cauauucaggaagcucaggg

SEQ ID NO: 1802159 - RNA, 14 nt, Human
cauauucaggaagc

SEQ ID NO: 1802160 - RNA, 15 nt, Human
cauauucaggaagcu

SEQ ID NO: 1802161 - RNA, 21 nt, Human
cauccccuguagagugggagc

SEQ ID NO: 1802162 - RNA, 14 nt, Human
cauccccuguagag

SEQ ID NO: 1802163 - RNA, 19 nt, Human
caucccauaugccugggca

SEQ ID NO: 1802164 - RNA, 20 nt, Human
caucaggccaggcccucugc

SEQ ID NO: 1802165 - RNA, 16 nt, Human
caucaggccaggcccu

SEQ ID NO: 1802166 - RNA, 19 nt, Human
caucaggccaggcccucug

SEQ ID NO: 1802167 - RNA, 15 nt, Human
caucaggccaggccc

SEQ ID NO: 1802168 - RNA, 15 nt, Human
cauuuggauuggaug

SEQ ID NO: 1802169 - RNA, 17 nt, Human
cauuugucacacacuuu

SEQ ID NO: 1802170 - RNA, 14 nt, Human
cauuugugaaauga

SEQ ID NO: 1802171 - RNA, 16 nt, Human
cauuugugaaaugaug

SEQ ID NO: 1802172 - RNA, 15 nt, Human
cauuuauucugcuca

SEQ ID NO: 1802173 - RNA, 14 nt, Human
cauuuauucugcuc

SEQ ID NO: 1802174 - RNA, 23 nt, Human
cauuguaaaagcauuuuguaaua

SEQ ID NO: 1802175 - RNA, 22 nt, Human
cauuguaaaagcauuuuguaau

SEQ ID NO: 1802176 - RNA, 21 nt, Human
cauuguaaaagcauuuuguaa

SEQ ID NO: 1802177 - RNA, 20 nt, Human
cauuguaaaagcauuuugua

SEQ ID NO: 1802178 - RNA, 15 nt, Human
cauuguaaaagcauu

SEQ ID NO: 1802179 - RNA, 16 nt, Human
cauuuuuuaaaugcac

SEQ ID NO: 1802180 - RNA, 15 nt, Human
cauuuuuuaaaugca

SEQ ID NO: 1802181 - RNA, 19 nt, Human
cauuuuuuaaaugcaccug

SEQ ID NO: 1802182 - RNA, 16 nt, Human
ccaaggccaaaggaag

SEQ ID NO: 1802183 - RNA, 13 nt, Human
ccaaaugcagcuu

SEQ ID NO: 1802184 - RNA, 15 nt, Human
ccaaaugcagcuuua

SEQ ID NO: 1802185 - RNA, 18 nt, Human
ccaaaugcagcuuuaaaa

SEQ ID NO: 1802186 - RNA, 12 nt, Human
ccaaaugcagcu

SEQ ID NO: 1802187 - RNA, 13 nt, Human
ccaagaagcccag

SEQ ID NO: 1802188 - RNA, 16 nt, Human
ccaacgucugugccau

SEQ ID NO: 1802189 - RNA, 22 nt, Human
ccaaauggaaaugggcagagca

SEQ ID NO: 1802190 - RNA, 13 nt, Human
ccaacgucugugc

SEQ ID NO: 1802191 - RNA, 15 nt, Human
ccaacgucugugcca

SEQ ID NO: 1802192 - RNA, 19 nt, Human
ccaagcuggucccacucag

SEQ ID NO: 1802193 - RNA, 12 nt, Human
ccaagcuggucc

SEQ ID NO: 1802194 - RNA, 14 nt, Human
ccaagaagcccagg

SEQ ID NO: 1802195 - RNA, 20 nt, Human
ccaagcuggucccacucagu

SEQ ID NO: 1802196 - RNA, 18 nt, Human
ccaaggaugccccguccc

SEQ ID NO: 1802197 - RNA, 15 nt, Human
ccaaggccaaaggaa

SEQ ID NO: 1802198 - RNA, 22 nt, Human
ccacagagaaaguacuucucca

SEQ ID NO: 1802199 - RNA, 13 nt, Human
ccacagaggacac

SEQ ID NO: 1802200 - RNA, 15 nt, Human
ccaccacgcccggcu

SEQ ID NO: 1802201 - RNA, 16 nt, Human
ccacacuucaggcucu

SEQ ID NO: 1802202 - RNA, 20 nt, Human
ccacacuucaggcucuucuc

SEQ ID NO: 1802203 - RNA, 21 nt, Human
ccacacuucaggcucuucucc

SEQ ID NO: 1802204 - RNA, 19 nt, Human
ccaccuuggcugcagggag

SEQ ID NO: 1802205 - RNA, 18 nt, Human
ccaccuuggcugcaggga

SEQ ID NO: 1802206 - RNA, 13 nt, Human
ccacgcccccacu

SEQ ID NO: 1802207 - RNA, 18 nt, Human
ccacgcuggaccuugaac

SEQ ID NO: 1802208 - RNA, 13 nt, Human
ccacgcuggagug

SEQ ID NO: 1802209 - RNA, 16 nt, Human
ccaccuuggcugcagg

SEQ ID NO: 1802210 - RNA, 15 nt, Human
ccaccuuggcugcag

SEQ ID NO: 1802211 - RNA, 14 nt, Human
ccaccuuggcugca

SEQ ID NO: 1802212 - RNA, 12 nt, Human
ccaccuuggcug

SEQ ID NO: 1802213 - RNA, 22 nt, Human
ccaccgggcugggagcucugca

SEQ ID NO: 1802214 - RNA, 19 nt, Human
ccaccaucaugucuggcua

SEQ ID NO: 1802215 - RNA, 18 nt, Human
ccaccaucaugucuggcu

SEQ ID NO: 1802216 - RNA, 19 nt, Human
ccaccgggcugggagcucu

SEQ ID NO: 1802217 - RNA, 15 nt, Human
ccuggggagaaagua

SEQ ID NO: 1802218 - RNA, 18 nt, Human
ccuggggaaccugacccc

SEQ ID NO: 1802219 - RNA, 19 nt, Human
ccugguggcagugggagcu

SEQ ID NO: 1802220 - RNA, 18 nt, Human
ccugguggcagugggagc

SEQ ID NO: 1802221 - RNA, 20 nt, Human
ccugguggcagugggagcug

SEQ ID NO: 1802222 - RNA, 18 nt, Human
ccugguuuccugcccugg

SEQ ID NO: 1802223 - RNA, 19 nt, Human
ccugguuuccugcccuggg

SEQ ID NO: 1802224 - RNA, 20 nt, Human
ccugguuuccugcccuggga

SEQ ID NO: 1802225 - RNA, 21 nt, Human
ccugguuuccugcccugggag

SEQ ID NO: 1802226 - RNA, 16 nt, Human
ccugguuuccugcccu

SEQ ID NO: 1802227 - RNA, 13 nt, Human
ccugguguggaag

SEQ ID NO: 1802228 - RNA, 20 nt, Human
ccuggccccucagggucccu

SEQ ID NO: 1802229 - RNA, 21 nt, Human
ccuggccccucagggucccug

SEQ ID NO: 1802230 - RNA, 18 nt, Human
ccuggccccucagggucc

SEQ ID NO: 1802231 - RNA, 17 nt, Human
ccuggauggggcugcac

SEQ ID NO: 1802232 - RNA, 18 nt, Human
ccuggauggggcugcacc

SEQ ID NO: 1802233 - RNA, 15 nt, Human
ccuggauggggcugc

SEQ ID NO: 1802234 - RNA, 17 nt, Human
ccugucucuacuaaaaa

SEQ ID NO: 1802235 - RNA, 22 nt, Human
ccugguuuccugcccugggagg

SEQ ID NO: 1802236 - RNA, 14 nt, Human
ccugcaggcagcca

SEQ ID NO: 1802237 - RNA, 12 nt, Human
ccugcaggcagc

SEQ ID NO: 1802238 - RNA, 13 nt, Human
ccugcaggcagcc

SEQ ID NO: 1802239 - RNA, 18 nt, Human
ccugaccccucauagccc

SEQ ID NO: 1802240 - RNA, 23 nt, Human
ccucuugccacugccucuuccuc

SEQ ID NO: 1802241 - RNA, 22 nt, Human
ccucuugccacugccucuuccu

SEQ ID NO: 1802242 - RNA, 14 nt, Human
ccucuugccacugc

SEQ ID NO: 1802243 - RNA, 15 nt, Human
ccucuuugagugaag

SEQ ID NO: 1802244 - RNA, 19 nt, Human
ccucuuucccucccuuccu

SEQ ID NO: 1802245 - RNA, 15 nt, Human
ccugcccaccuggcc

SEQ ID NO: 1802246 - RNA, 17 nt, Human
ccugcccaccuggccuc

SEQ ID NO: 1802247 - RNA, 19 nt, Human
ccugcccaggccccugcca

SEQ ID NO: 1802248 - RNA, 18 nt, Human
ccugcccaccuggccucu

SEQ ID NO: 1802249 - RNA, 19 nt, Human
ccugcccaccuggccucug

SEQ ID NO: 1802250 - RNA, 22 nt, Human
ccugcccaggccccugccaccc

SEQ ID NO: 1802251 - RNA, 21 nt, Human
ccugcccaggccccugccacc

SEQ ID NO: 1802252 - RNA, 15 nt, Human
ccugccucagccucc

SEQ ID NO: 1802253 - RNA, 16 nt, Human
ccugccucagccuccc

SEQ ID NO: 1802254 - RNA, 17 nt, Human
ccugccucagccucccg

SEQ ID NO: 1802255 - RNA, 13 nt, Human
ccugccucucugc

SEQ ID NO: 1802256 - RNA, 18 nt, Human
ccugcugagucccaggcu

SEQ ID NO: 1802257 - RNA, 19 nt, Human
ccugcugagucccaggcug

SEQ ID NO: 1802258 - RNA, 20 nt, Human
ccugcugagucccaggcuga

SEQ ID NO: 1802259 - RNA, 14 nt, Human
ccugccucucugca

SEQ ID NO: 1802260 - RNA, 15 nt, Human
ccugccucucugcag

SEQ ID NO: 1802261 - RNA, 20 nt, Human
ccucccuuggggccuaugca

SEQ ID NO: 1802262 - RNA, 16 nt, Human
ccucccuucucuucac

SEQ ID NO: 1802263 - RNA, 14 nt, Human
ccuccgccucuugg

SEQ ID NO: 1802264 - RNA, 13 nt, Human
ccuccgccucuug

SEQ ID NO: 1802265 - RNA, 19 nt, Human
ccucggacuuagcugggag

SEQ ID NO: 1802266 - RNA, 20 nt, Human
ccucggacuuagcugggaga

SEQ ID NO: 1802267 - RNA, 21 nt, Human
ccucgagguuucucaaagaaa

SEQ ID NO: 1802268 - RNA, 18 nt, Human
ccuccuuuucacaguucu

SEQ ID NO: 1802269 - RNA, 19 nt, Human
ccuccuaucagaaguuucu

SEQ ID NO: 1802270 - RNA, 23 nt, Human
ccuccuuugugaggaagccgcug

SEQ ID NO: 1802271 - RNA, 17 nt, Human
ccucccaucacccgcua

SEQ ID NO: 1802272 - RNA, 20 nt, Human
ccuccaagaccuucuccuuc

SEQ ID NO: 1802273 - RNA, 12 nt, Human
ccucccaucacc

SEQ ID NO: 1802274 - RNA, 16 nt, Human
ccuccaagaccuucuc

SEQ ID NO: 1802275 - RNA, 17 nt, Human
ccuccaagaccuucucc

SEQ ID NO: 1802276 - RNA, 19 nt, Human
ccuccaagaccuucuccuu

SEQ ID NO: 1802277 - RNA, 20 nt, Human
ccucaagugauucuccugcc

SEQ ID NO: 1802278 - RNA, 16 nt, Human
ccucaaccuccugggc

SEQ ID NO: 1802279 - RNA, 23 nt, Human
ccucaagugauucuccugccuca

SEQ ID NO: 1802280 - RNA, 21 nt, Human
ccucauuccaccuucccaugc

SEQ ID NO: 1802281 - RNA, 10 nt, Human
ccucaggccu

SEQ ID NO: 1802282 - RNA, 12 nt, Human
ccucaggcaggu

SEQ ID NO: 1802283 - RNA, 18 nt, Human
ccucaggcaggugggaug

SEQ ID NO: 1802284 - RNA, 15 nt, Human
ccucaaccuccuggg

SEQ ID NO: 1802285 - RNA, 19 nt, Human
ccucaacucuccuccagag

SEQ ID NO: 1802286 - RNA, 21 nt, Human
ccucaacucuccuccagaguc

SEQ ID NO: 1802287 - RNA, 23 nt, Human
ccucaacucuccuccagagucag

SEQ ID NO: 1802288 - RNA, 16 nt, Human
ccucaacaccucugca

SEQ ID NO: 1802289 - RNA, 14 nt, Human
ccucaaaugagaaa

SEQ ID NO: 1802290 - RNA, 15 nt, Human
ccgacagccuggcac

SEQ ID NO: 1802291 - RNA, 22 nt, Human
ccgacagccuggcacagggcag

SEQ ID NO: 1802292 - RNA, 13 nt, Human
ccgacagccuggc

SEQ ID NO: 1802293 - RNA, 14 nt, Human
ccgacagccuggca

SEQ ID NO: 1802294 - RNA, 12 nt, Human
ccgacagccugg

SEQ ID NO: 1802295 - RNA, 14 nt, Human
cccuucucuccagc

SEQ ID NO: 1802296 - RNA, 19 nt, Human
cccuucucuccagccccug

SEQ ID NO: 1802297 - RNA, 21 nt, Human
cccuuuuuuggcugcugaagg

SEQ ID NO: 1802298 - RNA, 22 nt, Human
cccuuuuuuggcugcugaaggc

SEQ ID NO: 1802299 - RNA, 23 nt, Human
cccuuuuuuggcugcugaaggcu

SEQ ID NO: 1802300 - RNA, 14 nt, Human
cccuccuuucacca

SEQ ID NO: 1802301 - RNA, 21 nt, Human
cccugugaguacuacaguccu

SEQ ID NO: 1802302 - RNA, 23 nt, Human
cccugugaguacuacaguccucc

SEQ ID NO: 1802303 - RNA, 15 nt, Human
cccugugauggggcc

SEQ ID NO: 1802304 - RNA, 15 nt, Human
cccugugggccccca

SEQ ID NO: 1802305 - RNA, 14 nt, Human
ccgcagcccugcag

SEQ ID NO: 1802306 - RNA, 18 nt, Human
ccgcagcccugcagaggg

SEQ ID NO: 1802307 - RNA, 23 nt, Human
ccgcagcccugcagagggcacag

SEQ ID NO: 1802308 - RNA, 17 nt, Human
ccggccaccugcggugc

SEQ ID NO: 1802309 - RNA, 18 nt, Human
ccggccaccugcggugcu

SEQ ID NO: 1802310 - RNA, 14 nt, Human
ccgucccccucugg

SEQ ID NO: 1802311 - RNA, 19 nt, Human
ccuagccuuagaagucaca

SEQ ID NO: 1802312 - RNA, 23 nt, Human
ccuagccugugccucugggacug

SEQ ID NO: 1802313 - RNA, 22 nt, Human
ccuagccuuagaagucacacag

SEQ ID NO: 1802314 - RNA, 12 nt, Human
ccuaauaaagcu

SEQ ID NO: 1802315 - RNA, 13 nt, Human
ccuaauaaagcug

SEQ ID NO: 1802316 - RNA, 21 nt, Human
ccuaaugcgcaggcuggcccu

SEQ ID NO: 1802317 - RNA, 23 nt, Human
ccaguuggguggaugccuggugg

SEQ ID NO: 1802318 - RNA, 13 nt, Human
ccaguuggucccc

SEQ ID NO: 1802319 - RNA, 19 nt, Human
ccauccagguucagcuugu

SEQ ID NO: 1802320 - RNA, 18 nt, Human
ccauccagguucagcuug

SEQ ID NO: 1802321 - RNA, 14 nt, Human
ccauaaucuggacu

SEQ ID NO: 1802322 - RNA, 21 nt, Human
ccauaaucuggacuccucugu

SEQ ID NO: 1802323 - RNA, 18 nt, Human
ccaguuggucccccuucc

SEQ ID NO: 1802324 - RNA, 20 nt, Human
ccaguuggucccccuuccau

SEQ ID NO: 1802325 - RNA, 20 nt, Human
ccaucccaaacccuucagug

SEQ ID NO: 1802326 - RNA, 19 nt, Human
ccaucccauaugccugggc

SEQ ID NO: 1802327 - RNA, 20 nt, Human
ccaucccauaugccugggca

SEQ ID NO: 1802328 - RNA, 21 nt, Human
ccaucccauaugccugggcag

SEQ ID NO: 1802329 - RNA, 12 nt, Human
ccaugucgccuc

SEQ ID NO: 1802330 - RNA, 15 nt, Human
ccaugucgccucugc

SEQ ID NO: 1802331 - RNA, 16 nt, Human
ccaugucgccucugca

SEQ ID NO: 1802332 - RNA, 17 nt, Human
ccaugucgccucugcau

SEQ ID NO: 1802333 - RNA, 19 nt, Human
ccaugucgccucugcauuc

SEQ ID NO: 1802334 - RNA, 18 nt, Human
ccaugaguccccuguuug

SEQ ID NO: 1802335 - RNA, 23 nt, Human
ccaugaggaacaaggcaaggcug

SEQ ID NO: 1802336 - RNA, 20 nt, Human
ccaugaggaacaaggcaagg

SEQ ID NO: 1802337 - RNA, 17 nt, Human
cccaacucaccccagcc

SEQ ID NO: 1802338 - RNA, 20 nt, Human
cccaacucaccccagcccca

SEQ ID NO: 1802339 - RNA, 20 nt, Human
cccaacuaauuuuuguauuu

SEQ ID NO: 1802340 - RNA, 15 nt, Human
cccaagcucugcucc

SEQ ID NO: 1802341 - RNA, 12 nt, Human
cccaagcucugc

SEQ ID NO: 1802342 - RNA, 14 nt, Human
cccaagcucugcuc

SEQ ID NO: 1802343 - RNA, 13 nt, Human
cccaagcucugcu

SEQ ID NO: 1802344 - RNA, 23 nt, Human
cccacugcuuuuggucuguguga

SEQ ID NO: 1802345 - RNA, 12 nt, Human
cccacccccacc

SEQ ID NO: 1802346 - RNA, 13 nt, Human
cccacucccugca

SEQ ID NO: 1802347 - RNA, 12 nt, Human
cccacucccugc

SEQ ID NO: 1802348 - RNA, 21 nt, Human
ccauuucauuugugccagaau

SEQ ID NO: 1802349 - RNA, 22 nt, Human
ccauuucauuugugccagaaug

SEQ ID NO: 1802350 - RNA, 15 nt, Human
cccaacucaccccag

SEQ ID NO: 1802351 - RNA, 16 nt, Human
cccaacucaccccagc

SEQ ID NO: 1802352 - RNA, 17 nt, Human
ccagccccagugcccac

SEQ ID NO: 1802353 - RNA, 14 nt, Human
ccagcagagcaccu

SEQ ID NO: 1802354 - RNA, 12 nt, Human
ccagcagagcac

SEQ ID NO: 1802355 - RNA, 13 nt, Human
ccagcagagcacc

SEQ ID NO: 1802356 - RNA, 18 nt, Human
ccagccccauccucugua

SEQ ID NO: 1802357 - RNA, 15 nt, Human
ccagccccauccucu

SEQ ID NO: 1802358 - RNA, 17 nt, Human
ccagccccauccucugu

SEQ ID NO: 1802359 - RNA, 12 nt, Human
ccagcagaaaug

SEQ ID NO: 1802360 - RNA, 23 nt, Human
ccagccccuucugacccaugcug

SEQ ID NO: 1802361 - RNA, 24 nt, Human
ccagccccuucugacccaugcugc

SEQ ID NO: 1802362 - RNA, 16 nt, Human
ccaggcuggcgugcag

SEQ ID NO: 1802363 - RNA, 12 nt, Human
ccaggcuggcgu

SEQ ID NO: 1802364 - RNA, 21 nt, Human
ccaggggaaaaucagccugcu

SEQ ID NO: 1802365 - RNA, 14 nt, Human
ccaggcaggucuug

SEQ ID NO: 1802366 - RNA, 12 nt, Human
ccaggcaggucu

SEQ ID NO: 1802367 - RNA, 23 nt, Human
ccaggcaggucuugaacuccugg

SEQ ID NO: 1802368 - RNA, 21 nt, Human
ccaggcugcucuugaacuccu

SEQ ID NO: 1802369 - RNA, 18 nt, Human
ccagucccccugccccag

SEQ ID NO: 1802370 - RNA, 16 nt, Human
ccccucuggcuccagc

SEQ ID NO: 1802371 - RNA, 18 nt, Human
ccccucuggcuccagcug

SEQ ID NO: 1802372 - RNA, 15 nt, Human
ccccugacaacacuc

SEQ ID NO: 1802373 - RNA, 18 nt, Human
ccccugcaaagcccagcu

SEQ ID NO: 1802374 - RNA, 20 nt, Human
ccccugcaaagcccagcuug

SEQ ID NO: 1802375 - RNA, 21 nt, Human
ccccugcaaagcccagcuuga

SEQ ID NO: 1802376 - RNA, 13 nt, Human
ccccugcacucca

SEQ ID NO: 1802377 - RNA, 16 nt, Human
ccccugccacccuggg

SEQ ID NO: 1802378 - RNA, 14 nt, Human
ccccugccacccug

SEQ ID NO: 1802379 - RNA, 15 nt, Human
ccccucugcccugcg

SEQ ID NO: 1802380 - RNA, 20 nt, Human
ccccucugcccugcggguca

SEQ ID NO: 1802381 - RNA, 23 nt, Human
ccccucugcccugcgggucacag

SEQ ID NO: 1802382 - RNA, 16 nt, Human
cccggccccugcuggu

SEQ ID NO: 1802383 - RNA, 15 nt, Human
cccggccccugcugg

SEQ ID NO: 1802384 - RNA, 20 nt, Human
cccggcuaauuuuuguauuu

SEQ ID NO: 1802385 - RNA, 15 nt, Human
cccgggaagggggcu

SEQ ID NO: 1802386 - RNA, 22 nt, Human
cccgaauagcugggacuacagg

SEQ ID NO: 1802387 - RNA, 18 nt, Human
cccgaauagcugggacua

SEQ ID NO: 1802388 - RNA, 17 nt, Human
cccgaauagcugggacu

SEQ ID NO: 1802389 - RNA, 16 nt, Human
cccgaauagcugggac

SEQ ID NO: 1802390 - RNA, 13 nt, Human
ccccuucugaccc

SEQ ID NO: 1802391 - RNA, 14 nt, Human
ccccuucugaccca

SEQ ID NO: 1802392 - RNA, 16 nt, Human
ccccuucugacccaug

SEQ ID NO: 1802393 - RNA, 15 nt, Human
cccucacccuggggc

SEQ ID NO: 1802394 - RNA, 16 nt, Human
cccucacccuggggcu

SEQ ID NO: 1802395 - RNA, 20 nt, Human
cccucaacucuccuccagag

SEQ ID NO: 1802396 - RNA, 16 nt, Human
cccucaacucuccucc

SEQ ID NO: 1802397 - RNA, 22 nt, Human
cccgggaagggggcugggacau

SEQ ID NO: 1802398 - RNA, 16 nt, Human
cccucaacaccucugc

SEQ ID NO: 1802399 - RNA, 18 nt, Human
cccgggaagggggcuggg

SEQ ID NO: 1802400 - RNA, 21 nt, Human
cccgggaagggggcugggaca

SEQ ID NO: 1802401 - RNA, 16 nt, Human
cccuccucucugcccu

SEQ ID NO: 1802402 - RNA, 15 nt, Human
cccuccucucugccc

SEQ ID NO: 1802403 - RNA, 15 nt, Human
cccauucugccugcc

SEQ ID NO: 1802404 - RNA, 14 nt, Human
cccauucugccugc

SEQ ID NO: 1802405 - RNA, 19 nt, Human
cccauucugccugcccagg

SEQ ID NO: 1802406 - RNA, 15 nt, Human
cccauuugcuccuuu

SEQ ID NO: 1802407 - RNA, 20 nt, Human
ccccagauugcaacaggcug

SEQ ID NO: 1802408 - RNA, 15 nt, Human
ccccagauugcaaca

SEQ ID NO: 1802409 - RNA, 17 nt, Human
ccccagaggcuggguga

SEQ ID NO: 1802410 - RNA, 14 nt, Human
ccccgcacugggcu

SEQ ID NO: 1802411 - RNA, 13 nt, Human
cccaggcuggagu

SEQ ID NO: 1802412 - RNA, 18 nt, Human
cccaggcugagccucagu

SEQ ID NO: 1802413 - RNA, 20 nt, Human
cccaggcuggagugcaauga

SEQ ID NO: 1802414 - RNA, 22 nt, Human
cccaggcuuagucacugagaca

SEQ ID NO: 1802415 - RNA, 15 nt, Human
cccaggcugagccuc

SEQ ID NO: 1802416 - RNA, 16 nt, Human
cccaggcugagccuca

SEQ ID NO: 1802417 - RNA, 17 nt, Human
cccaggcugagccucag

SEQ ID NO: 1802418 - RNA, 17 nt, Human
cccaggaaaggcuccag

SEQ ID NO: 1802419 - RNA, 18 nt, Human
cccaggaaaggcuccagg

SEQ ID NO: 1802420 - RNA, 16 nt, Human
cccacuggacucaccu

SEQ ID NO: 1802421 - RNA, 15 nt, Human
cccaggaaaggcucc

SEQ ID NO: 1802422 - RNA, 16 nt, Human
cccaggaaaggcucca

SEQ ID NO: 1802423 - RNA, 21 nt, Human
cccauccucuguacagagccc

SEQ ID NO: 1802424 - RNA, 22 nt, Human
cccauccucuguacagagccca

SEQ ID NO: 1802425 - RNA, 19 nt, Human
cgaguagcugagauuauag

SEQ ID NO: 1802426 - RNA, 18 nt, Human
cgauacaccgggccugga

SEQ ID NO: 1802427 - RNA, 20 nt, Human
cgauacaccgggccuggaga

SEQ ID NO: 1802428 - RNA, 21 nt, Human
cgauacaccgggccuggagaa

SEQ ID NO: 1802429 - RNA, 21 nt, Human
cgagguuucucaaagaaauuu

SEQ ID NO: 1802430 - RNA, 13 nt, Human
cgcugccccuggc

SEQ ID NO: 1802431 - RNA, 16 nt, Human
cgcugccccuggcagc

SEQ ID NO: 1802432 - RNA, 17 nt, Human
cgcugccccuggcagcc

SEQ ID NO: 1802433 - RNA, 23 nt, Human
cgcuggaccuugaacuggguacu

SEQ ID NO: 1802434 - RNA, 19 nt, Human
cgcuggaccuugaacuggg

SEQ ID NO: 1802435 - RNA, 18 nt, Human
cgcugccccuggcagccc

SEQ ID NO: 1802436 - RNA, 16 nt, Human
cgccuuaaggauguuc

SEQ ID NO: 1802437 - RNA, 18 nt, Human
cgcuggccgggaccccga

SEQ ID NO: 1802438 - RNA, 23 nt, Human
cgcuggccgggaccccgagccug

SEQ ID NO: 1802439 - RNA, 17 nt, Human
cgcuggggccaguuggu

SEQ ID NO: 1802440 - RNA, 20 nt, Human
cgcuggggccaguugguccc

SEQ ID NO: 1802441 - RNA, 22 nt, Human
cguguccccuauccuacuuccc

SEQ ID NO: 1802442 - RNA, 21 nt, Human
cguuaaaaacagauuuggaaa

SEQ ID NO: 1802443 - RNA, 14 nt, Human
cguuaaaaacagau

SEQ ID NO: 1802444 - RNA, 13 nt, Human
cguuaaaauacca

SEQ ID NO: 1802445 - RNA, 14 nt, Human
cguuaccaggcagg

SEQ ID NO: 1802446 - RNA, 15 nt, Human
cuaaagcugccagcc

SEQ ID NO: 1802447 - RNA, 16 nt, Human
cuaaaggcuaccuuug

SEQ ID NO: 1802448 - RNA, 15 nt, Human
cuaaaggcuaccuuu

SEQ ID NO: 1802449 - RNA, 21 nt, Human
cuaaagaagguuucagaaaga

SEQ ID NO: 1802450 - RNA, 14 nt, Human
cuaaagcugccagc

SEQ ID NO: 1802451 - RNA, 19 nt, Human
cuaaaggcuaccuuuguau

SEQ ID NO: 1802452 - RNA, 17 nt, Human
cuaaaggcuaccuuugu

SEQ ID NO: 1802453 - RNA, 22 nt, Human
cuaaaguguauuuuuuuacuaa

SEQ ID NO: 1802454 - RNA, 13 nt, Human
cgguguggagaag

SEQ ID NO: 1802455 - RNA, 16 nt, Human
cguacacauuuuauuu

SEQ ID NO: 1802456 - RNA, 13 nt, Human
cguacacauuuua

SEQ ID NO: 1802457 - RNA, 15 nt, Human
cggagacggaguccc

SEQ ID NO: 1802458 - RNA, 19 nt, Human
cuaguuugauuaaauucuu

SEQ ID NO: 1802459 - RNA, 17 nt, Human
cuaguuugauuaaauuc

SEQ ID NO: 1802460 - RNA, 13 nt, Human
cuaggguccuggg

SEQ ID NO: 1802461 - RNA, 14 nt, Human
cuaggguccugggg

SEQ ID NO: 1802462 - RNA, 15 nt, Human
cuaggguccugggga

SEQ ID NO: 1802463 - RNA, 14 nt, Human
cuagggaagauaau

SEQ ID NO: 1802464 - RNA, 20 nt, Human
cuaguuugauuaaauucuug

SEQ ID NO: 1802465 - RNA, 13 nt, Human
cuaggccuggcca

SEQ ID NO: 1802466 - RNA, 19 nt, Human
cuagccagaggagagagga

SEQ ID NO: 1802467 - RNA, 17 nt, Human
cuagccagaggagagag

SEQ ID NO: 1802468 - RNA, 19 nt, Human
cuaggccuggccagaugca

SEQ ID NO: 1802469 - RNA, 18 nt, Human
cuaggccuggccagaugc

SEQ ID NO: 1802470 - RNA, 15 nt, Human
cuaggccuggccaga

SEQ ID NO: 1802471 - RNA, 14 nt, Human
cuaggccuggccag

SEQ ID NO: 1802472 - RNA, 12 nt, Human
cuaggccugggg

SEQ ID NO: 1802473 - RNA, 13 nt, Human
cuaggccugggga

SEQ ID NO: 1802474 - RNA, 21 nt, Human
cuagacccacuggacucaccu

SEQ ID NO: 1802475 - RNA, 20 nt, Human
cuagcauacguacacauuuu

SEQ ID NO: 1802476 - RNA, 19 nt, Human
cuagcauacguacacauuu

SEQ ID NO: 1802477 - RNA, 18 nt, Human
cuagcauacguacacauu

SEQ ID NO: 1802478 - RNA, 16 nt, Human
cuagcauacguacaca

SEQ ID NO: 1802479 - RNA, 18 nt, Human
cuaccuuccaguuccuca

SEQ ID NO: 1802480 - RNA, 17 nt, Human
cuacuaccuguaaugac

SEQ ID NO: 1802481 - RNA, 16 nt, Human
cuaccugaggggccuc

SEQ ID NO: 1802482 - RNA, 19 nt, Human
cuaccugaggggccucuua

SEQ ID NO: 1802483 - RNA, 23 nt, Human
cuaccugaggggccucuuauggg

SEQ ID NO: 1802484 - RNA, 20 nt, Human
cuacuagggaaaugccuuug

SEQ ID NO: 1802485 - RNA, 13 nt, Human
cucaccugccccu

SEQ ID NO: 1802486 - RNA, 18 nt, Human
cucaccugccccucaacu

SEQ ID NO: 1802487 - RNA, 14 nt, Human
cucaccugccccuc

SEQ ID NO: 1802488 - RNA, 16 nt, Human
cucaccugccccucaa

SEQ ID NO: 1802489 - RNA, 16 nt, Human
cucaccucccccaucu

SEQ ID NO: 1802490 - RNA, 13 nt, Human
cucaccucucccu

SEQ ID NO: 1802491 - RNA, 14 nt, Human
cucaccucucccuu

SEQ ID NO: 1802492 - RNA, 15 nt, Human
cucaccucucccuug

SEQ ID NO: 1802493 - RNA, 16 nt, Human
cucaccucucccuugg

SEQ ID NO: 1802494 - RNA, 17 nt, Human
cucaccucucccuugga

SEQ ID NO: 1802495 - RNA, 14 nt, Human
cucacccuggggcu

SEQ ID NO: 1802496 - RNA, 23 nt, Human
cuaugucauuugcuggagcucug

SEQ ID NO: 1802497 - RNA, 15 nt, Human
cuauguugcccaggc

SEQ ID NO: 1802498 - RNA, 22 nt, Human
cuauguguagggcgggaggaug

SEQ ID NO: 1802499 - RNA, 19 nt, Human
cuauguaucaaugaguaac

SEQ ID NO: 1802500 - RNA, 20 nt, Human
cuaucucccccagccccauc

SEQ ID NO: 1802501 - RNA, 17 nt, Human
cuauguugcccaggcag

SEQ ID NO: 1802502 - RNA, 16 nt, Human
cuauguugcccaggca

SEQ ID NO: 1802503 - RNA, 14 nt, Human
cuauuuuucagaau

SEQ ID NO: 1802504 - RNA, 13 nt, Human
cucaaaacaaagg

SEQ ID NO: 1802505 - RNA, 18 nt, Human
cucaaaaaaagaaaaaga

SEQ ID NO: 1802506 - RNA, 22 nt, Human
cucaaagaaauuuccacucagg

SEQ ID NO: 1802507 - RNA, 14 nt, Human
cucaaaacaaaggc

SEQ ID NO: 1802508 - RNA, 14 nt, Human
cucacaaaggaugc

SEQ ID NO: 1802509 - RNA, 12 nt, Human
cucaaauaacua

SEQ ID NO: 1802510 - RNA, 14 nt, Human
cucacacaugagca

SEQ ID NO: 1802511 - RNA, 21 nt, Human
cucacacaugagcaucaggcc

SEQ ID NO: 1802512 - RNA, 23 nt, Human
cugaggaauccagacccggcugc

SEQ ID NO: 1802513 - RNA, 14 nt, Human
cugaggggccucuu

SEQ ID NO: 1802514 - RNA, 13 nt, Human
cugaggugggagg

SEQ ID NO: 1802515 - RNA, 22 nt, Human
cugaggugggaggaucucuuga

SEQ ID NO: 1802516 - RNA, 14 nt, Human
cugaggaauccaga

SEQ ID NO: 1802517 - RNA, 22 nt, Human
cugagcuugcagagaugaggcc

SEQ ID NO: 1802518 - RNA, 22 nt, Human
cugagcugggaugauuggaggg

SEQ ID NO: 1802519 - RNA, 12 nt, Human
cugagcugggau

SEQ ID NO: 1802520 - RNA, 19 nt, Human
cugacccugcuucaaauau

SEQ ID NO: 1802521 - RNA, 17 nt, Human
cugaucucucgugauug

SEQ ID NO: 1802522 - RNA, 18 nt, Human
cugaucucucgugauuga

SEQ ID NO: 1802523 - RNA, 23 nt, Human
cugacacacagcucuguccuggg

SEQ ID NO: 1802524 - RNA, 22 nt, Human
cugacacacagcucuguccugg

SEQ ID NO: 1802525 - RNA, 21 nt, Human
cugacacacagcucuguccug

SEQ ID NO: 1802526 - RNA, 20 nt, Human
cugacacacagcucuguccu

SEQ ID NO: 1802527 - RNA, 19 nt, Human
cugacacacagcucugucc

SEQ ID NO: 1802528 - RNA, 18 nt, Human
cugacacacagcucuguc

SEQ ID NO: 1802529 - RNA, 17 nt, Human
cugacacacagcucugu

SEQ ID NO: 1802530 - RNA, 16 nt, Human
cugacacacagcucug

SEQ ID NO: 1802531 - RNA, 15 nt, Human
cugacacacagcucu

SEQ ID NO: 1802532 - RNA, 13 nt, Human
cugacacacagcu

SEQ ID NO: 1802533 - RNA, 14 nt, Human
cugaaaauguaugu

SEQ ID NO: 1802534 - RNA, 17 nt, Human
cugaccccucauagccc

SEQ ID NO: 1802535 - RNA, 20 nt, Human
cugaccccucauagcccuca

SEQ ID NO: 1802536 - RNA, 21 nt, Human
cugaccccucauagcccucac

SEQ ID NO: 1802537 - RNA, 13 nt, Human
cucuugagccugg

SEQ ID NO: 1802538 - RNA, 14 nt, Human
cucuugagccuggg

SEQ ID NO: 1802539 - RNA, 15 nt, Human
cucuugagccuggga

SEQ ID NO: 1802540 - RNA, 16 nt, Human
cucuugagccugggag

SEQ ID NO: 1802541 - RNA, 22 nt, Human
cucuugauucauaaugacuuaa

SEQ ID NO: 1802542 - RNA, 24 nt, Human
cucuugauucauaaugacuuaagc

SEQ ID NO: 1802543 - RNA, 22 nt, Human
cucuugccacugccucuuccuc

SEQ ID NO: 1802544 - RNA, 17 nt, Human
cugaaagaggaaugaag

SEQ ID NO: 1802545 - RNA, 13 nt, Human
cugaaagaggaau

SEQ ID NO: 1802546 - RNA, 19 nt, Human
cucugcacaagcugcaccc

SEQ ID NO: 1802547 - RNA, 17 nt, Human
cucugcacaagcugcac

SEQ ID NO: 1802548 - RNA, 18 nt, Human
cucugcacaagcugcacc

SEQ ID NO: 1802549 - RNA, 17 nt, Human
cucccaccucagccucc

SEQ ID NO: 1802550 - RNA, 16 nt, Human
cucccaccucagccuc

SEQ ID NO: 1802551 - RNA, 14 nt, Human
cucccaccucagcc

SEQ ID NO: 1802552 - RNA, 22 nt, Human
cuccaggugcacaagcuccaag

SEQ ID NO: 1802553 - RNA, 18 nt, Human
cuccaggugcacaagcuc

SEQ ID NO: 1802554 - RNA, 19 nt, Human
cuccaggugcacaagcucc

SEQ ID NO: 1802555 - RNA, 20 nt, Human
cuccaggugcacaagcucca

SEQ ID NO: 1802556 - RNA, 23 nt, Human
cuccaggcuguaucccaugagcc

SEQ ID NO: 1802557 - RNA, 16 nt, Human
cuccagacacaugucc

SEQ ID NO: 1802558 - RNA, 22 nt, Human
cuccagaauuucccaaagcagu

SEQ ID NO: 1802559 - RNA, 11 nt, Human
cuccagacaca

SEQ ID NO: 1802560 - RNA, 16 nt, Human
cucagaaucucaaaua

SEQ ID NO: 1802561 - RNA, 17 nt, Human
cucagaaucucaaauaa

SEQ ID NO: 1802562 - RNA, 21 nt, Human
cuccagaauuucccaaagcag

SEQ ID NO: 1802563 - RNA, 16 nt, Human
cucccucccucuuucc

SEQ ID NO: 1802564 - RNA, 15 nt, Human
cucccucuuucccuc

SEQ ID NO: 1802565 - RNA, 19 nt, Human
cucccucuuucccucccuu

SEQ ID NO: 1802566 - RNA, 20 nt, Human
cuccgcuuucuacccagcga

SEQ ID NO: 1802567 - RNA, 21 nt, Human
cuccgcuuucuacccagcgag

SEQ ID NO: 1802568 - RNA, 22 nt, Human
cuccgcuuucuacccagcgagc

SEQ ID NO: 1802569 - RNA, 23 nt, Human
cuccgcuuucuacccagcgagcc

SEQ ID NO: 1802570 - RNA, 10 nt, Human
cucuccucug

SEQ ID NO: 1802571 - RNA, 17 nt, Human
cucucuggccuucggcc

SEQ ID NO: 1802572 - RNA, 22 nt, Human
cucucuggccuucggccuccau

SEQ ID NO: 1802573 - RNA, 19 nt, Human
cucucuggccuucggccuc

SEQ ID NO: 1802574 - RNA, 16 nt, Human
cucuccgaccagacac

SEQ ID NO: 1802575 - RNA, 21 nt, Human
cucuccgaccagacaccuuga

SEQ ID NO: 1802576 - RNA, 13 nt, Human
cucuccuccuuuu

SEQ ID NO: 1802577 - RNA, 20 nt, Human
cucuccuccuuuucacaguu

SEQ ID NO: 1802578 - RNA, 17 nt, Human
cucgugguaggacugua

SEQ ID NO: 1802579 - RNA, 16 nt, Human
cucgugguaggacugu

SEQ ID NO: 1802580 - RNA, 15 nt, Human
cucgugguaggacug

SEQ ID NO: 1802581 - RNA, 13 nt, Human
cucucccuuggau

SEQ ID NO: 1802582 - RNA, 16 nt, Human
cucugcacaagcugca

SEQ ID NO: 1802583 - RNA, 22 nt, Human
cuccuuuagcgcccaguugggu

SEQ ID NO: 1802584 - RNA, 17 nt, Human
cuccuuuagcgcccagu

SEQ ID NO: 1802585 - RNA, 16 nt, Human
cuccuuuagcgcccag

SEQ ID NO: 1802586 - RNA, 22 nt, Human
cuccuagccugugccucuggga

SEQ ID NO: 1802587 - RNA, 24 nt, Human
cuccuuuucacaguucucuccuuc

SEQ ID NO: 1802588 - RNA, 13 nt, Human
cucgaacuccuga

SEQ ID NO: 1802589 - RNA, 16 nt, Human
cucgaacuccugaccu

SEQ ID NO: 1802590 - RNA, 17 nt, Human
cucgaacuccugaccuu

SEQ ID NO: 1802591 - RNA, 11 nt, Human
cucggugccuu

SEQ ID NO: 1802592 - RNA, 18 nt, Human
cucguauaugucucaggu

SEQ ID NO: 1802593 - RNA, 20 nt, Human
cucguauaugucucaggucc

SEQ ID NO: 1802594 - RNA, 21 nt, Human
uugaaaaucuuauaauuuaaa

SEQ ID NO: 1802595 - RNA, 21 nt, Human
uucuuuccugaggcugggcuc

SEQ ID NO: 1802596 - RNA, 18 nt, Human
uugaaaauuaacaugaau

SEQ ID NO: 1802597 - RNA, 15 nt, Human
uugaacuuugaccuc

SEQ ID NO: 1802598 - RNA, 12 nt, Human
uugaaugaugcc

SEQ ID NO: 1802599 - RNA, 16 nt, Human
uugaaugaugccauga

SEQ ID NO: 1802600 - RNA, 18 nt, Human
uugaacuuugaccucugc

SEQ ID NO: 1802601 - RNA, 17 nt, Human
uugaacuuugaccucug

SEQ ID NO: 1802602 - RNA, 20 nt, Human
uugaacuuugaccucugcag

SEQ ID NO: 1802603 - RNA, 13 nt, Human
uucugugcagcca

SEQ ID NO: 1802604 - RNA, 15 nt, Human
uucuggcagaggagg

SEQ ID NO: 1802605 - RNA, 20 nt, Human
uucuggcagaguugaagaca

SEQ ID NO: 1802606 - RNA, 16 nt, Human
uucuggcuaugcauuu

SEQ ID NO: 1802607 - RNA, 17 nt, Human
uucuuauguugcccagu

SEQ ID NO: 1802608 - RNA, 13 nt, Human
uucuucagagacu

SEQ ID NO: 1802609 - RNA, 17 nt, Human
uucuuagggaaggauac

SEQ ID NO: 1802610 - RNA, 14 nt, Human
uucuuguguguuua

SEQ ID NO: 1802611 - RNA, 22 nt, Human
uugauauuuucaacgcagcccu

SEQ ID NO: 1802612 - RNA, 16 nt, Human
uugauaugcuuauaca

SEQ ID NO: 1802613 - RNA, 17 nt, Human
uugauccagaaagaaaa

SEQ ID NO: 1802614 - RNA, 17 nt, Human
uugauucagacagcugc

SEQ ID NO: 1802615 - RNA, 21 nt, Human
uugauucagacagcugccugg

SEQ ID NO: 1802616 - RNA, 23 nt, Human
uugauucagacagcugccuggga

SEQ ID NO: 1802617 - RNA, 16 nt, Human
uugauucagcucugca

SEQ ID NO: 1802618 - RNA, 19 nt, Human
uugagccuugaacuuugac

SEQ ID NO: 1802619 - RNA, 13 nt, Human
uugagcucagccc

SEQ ID NO: 1802620 - RNA, 16 nt, Human
uugagccuugaacuuu

SEQ ID NO: 1802621 - RNA, 15 nt, Human
uugagccuugaacuu

SEQ ID NO: 1802622 - RNA, 14 nt, Human
uugagccuugaacu

SEQ ID NO: 1802623 - RNA, 19 nt, Human
uugccauguuggccaggcu

SEQ ID NO: 1802624 - RNA, 18 nt, Human
uugccauguuggccaggc

SEQ ID NO: 1802625 - RNA, 17 nt, Human
uugccauguuggccagg

SEQ ID NO: 1802626 - RNA, 16 nt, Human
uugccauguuggccag

SEQ ID NO: 1802627 - RNA, 13 nt, Human
uugccagucaccc

SEQ ID NO: 1802628 - RNA, 16 nt, Human
uugcauaacguauaaa

SEQ ID NO: 1802629 - RNA, 23 nt, Human
uugcagacaggcaagcaccuccu

SEQ ID NO: 1802630 - RNA, 17 nt, Human
uugcagcacagcugaga

SEQ ID NO: 1802631 - RNA, 18 nt, Human
uugcagcgauuaauaaca

SEQ ID NO: 1802632 - RNA, 19 nt, Human
uugcagcgauuaauaacag

SEQ ID NO: 1802633 - RNA, 13 nt, Human
uugauucauaaug

SEQ ID NO: 1802634 - RNA, 17 nt, Human
uugauucauaaugacuu

SEQ ID NO: 1802635 - RNA, 16 nt, Human
uuggacagaagcagcu

SEQ ID NO: 1802636 - RNA, 19 nt, Human
uuggacagaagcagcucuu

SEQ ID NO: 1802637 - RNA, 19 nt, Human
uuggaagcuccgcuuucua

SEQ ID NO: 1802638 - RNA, 15 nt, Human
uuggauuguccccga

SEQ ID NO: 1802639 - RNA, 15 nt, Human
uuggacccugaggcc

SEQ ID NO: 1802640 - RNA, 18 nt, Human
uuggacccugaggcccag

SEQ ID NO: 1802641 - RNA, 19 nt, Human
uuggacccugaggcccaga

SEQ ID NO: 1802642 - RNA, 21 nt, Human
uuggacccugaggcccagagg

SEQ ID NO: 1802643 - RNA, 21 nt, Human
uugccauguuggccaggcugg

SEQ ID NO: 1802644 - RNA, 20 nt, Human
uugccauguuggccaggcug

SEQ ID NO: 1802645 - RNA, 14 nt, Human
uugcugcuugaggc

SEQ ID NO: 1802646 - RNA, 16 nt, Human
uugcugcuugaggcaa

SEQ ID NO: 1802647 - RNA, 16 nt, Human
uugcugucccuuuucc

SEQ ID NO: 1802648 - RNA, 18 nt, Human
uugcugucccuuuuccuu

SEQ ID NO: 1802649 - RNA, 20 nt, Human
uuggucugacccacugcuuu

SEQ ID NO: 1802650 - RNA, 13 nt, Human
uuguaaaauggug

SEQ ID NO: 1802651 - RNA, 12 nt, Human
uuguaaaauggu

SEQ ID NO: 1802652 - RNA, 15 nt, Human
uuggucugugagaug

SEQ ID NO: 1802653 - RNA, 23 nt, Human
uuggcuucacggaagagccuugc

SEQ ID NO: 1802654 - RNA, 14 nt, Human
uugggaauuuuauu

SEQ ID NO: 1802655 - RNA, 16 nt, Human
uuguaccgcaauguga

SEQ ID NO: 1802656 - RNA, 20 nt, Human
uuguaaaauggugugaccac

SEQ ID NO: 1802657 - RNA, 18 nt, Human
uuguacuuuagggaagua

SEQ ID NO: 1802658 - RNA, 14 nt, Human
uugucuaugggacu

SEQ ID NO: 1802659 - RNA, 22 nt, Human
uugucaaaguggugagaggcau

SEQ ID NO: 1802660 - RNA, 22 nt, Human
uuguaugaaagauggcugugcc

SEQ ID NO: 1802661 - RNA, 20 nt, Human
uuguaugauccuaaugaaug

SEQ ID NO: 1802662 - RNA, 20 nt, Human
uugucuaugggacucaaugc

SEQ ID NO: 1802663 - RNA, 22 nt, Human
uugucaagaauagcauuguaaa

SEQ ID NO: 1802664 - RNA, 17 nt, Human
uugucugaagucacugc

SEQ ID NO: 1802665 - RNA, 18 nt, Human
uugucugaagucacugca

SEQ ID NO: 1802666 - RNA, 12 nt, Human
uuuaaaaugucu

SEQ ID NO: 1802667 - RNA, 16 nt, Human
uuuaaaaugagaaauc

SEQ ID NO: 1802668 - RNA, 13 nt, Human
uuuaacagaaaug

SEQ ID NO: 1802669 - RNA, 13 nt, Human
uuuaaaagauaca

SEQ ID NO: 1802670 - RNA, 20 nt, Human
uuguuuggggaugagaaagg

SEQ ID NO: 1802671 - RNA, 19 nt, Human
uuguuucuuucucugagga

SEQ ID NO: 1802672 - RNA, 16 nt, Human
uuguuucuuucucuga

SEQ ID NO: 1802673 - RNA, 19 nt, Human
uugucuuuggugaacauug

SEQ ID NO: 1802674 - RNA, 20 nt, Human
uugucuuuggacccugaggc

SEQ ID NO: 1802675 - RNA, 24 nt, Human
uugucuuuggacccugaggcccag

SEQ ID NO: 1802676 - RNA, 15 nt, Human
uugucuuuggacccu

SEQ ID NO: 1802677 - RNA, 13 nt, Human
uuuacagcugccu

SEQ ID NO: 1802678 - RNA, 13 nt, Human
uuuacagagacag

SEQ ID NO: 1802679 - RNA, 22 nt, Human
uuuaauaaacacucuugaaaaa

SEQ ID NO: 1802680 - RNA, 13 nt, Human
uuuaauaaaccau

SEQ ID NO: 1802681 - RNA, 14 nt, Human
uuuaauaaacacuc

SEQ ID NO: 1802682 - RNA, 15 nt, Human
uuuaauaaacacucu

SEQ ID NO: 1802683 - RNA, 15 nt, Human
uuuaacagaaaugua

SEQ ID NO: 1802684 - RNA, 14 nt, Human
uuuaacagaaaugu

SEQ ID NO: 1802685 - RNA, 19 nt, Human
uuuagacccuauugcugcu

SEQ ID NO: 1802686 - RNA, 17 nt, Human
uuuaguugcaacuuugu

SEQ ID NO: 1802687 - RNA, 18 nt, Human
uuuaguugcaacuuugua

SEQ ID NO: 1802688 - RNA, 22 nt, Human
uuuagacccuauugcugcuuga

SEQ ID NO: 1802689 - RNA, 18 nt, Human
uuuauaaacuuuaccuuu

SEQ ID NO: 1802690 - RNA, 20 nt, Human
uuuauacauaaacaagacca

SEQ ID NO: 1802691 - RNA, 12 nt, Human
uuuauacauaaa

SEQ ID NO: 1802692 - RNA, 20 nt, Human
uuuccuaaauauauuuuaag

SEQ ID NO: 1802693 - RNA, 17 nt, Human
uuuccacucaggucugu

SEQ ID NO: 1802694 - RNA, 17 nt, Human
uuucagccaagaauucu

SEQ ID NO: 1802695 - RNA, 22 nt, Human
uuuaugauacuugaaaauuaac

SEQ ID NO: 1802696 - RNA, 14 nt, Human
uuucugaaauaaca

SEQ ID NO: 1802697 - RNA, 18 nt, Human
uuucuacccagcgagccc

SEQ ID NO: 1802698 - RNA, 15 nt, Human
uuucuacccagcgag

SEQ ID NO: 1802699 - RNA, 22 nt, Human
uuucuacccagcgagcccuggu

SEQ ID NO: 1802700 - RNA, 17 nt, Human
uuucuaaaguaaaaaca

SEQ ID NO: 1802701 - RNA, 22 nt, Human
uuucuaaaguaaaaacaaagaa

SEQ ID NO: 1802702 - RNA, 19 nt, Human
uuucuaaaucuccaaaaua

SEQ ID NO: 1802703 - RNA, 19 nt, Human
uuuccuggcacugcuucca

SEQ ID NO: 1802704 - RNA, 22 nt, Human
uuuccucuuagucgagccaagu

SEQ ID NO: 1802705 - RNA, 23 nt, Human
uuuccuggcacugcuuccaguga

SEQ ID NO: 1802706 - RNA, 16 nt, Human
uuugcuugaaagaaaa

SEQ ID NO: 1802707 - RNA, 14 nt, Human
uuugcuugaaagaa

SEQ ID NO: 1802708 - RNA, 15 nt, Human
uuuggacccugaggc

SEQ ID NO: 1802709 - RNA, 19 nt, Human
uuuggacccugaggcccag

SEQ ID NO: 1802710 - RNA, 14 nt, Human
uuugauccaagcug

SEQ ID NO: 1802711 - RNA, 16 nt, Human
uuuguaugcacuuugu

SEQ ID NO: 1802712 - RNA, 15 nt, Human
uuuguauucucuccu

SEQ ID NO: 1802713 - RNA, 21 nt, Human
uuugaaauuguauuacaaauc

SEQ ID NO: 1802714 - RNA, 19 nt, Human
uuucuuguguguuuauugu

SEQ ID NO: 1802715 - RNA, 23 nt, Human
uuucugaucugaugcaagcaaga

SEQ ID NO: 1802716 - RNA, 18 nt, Human
uuucuuaaccagaucauu

SEQ ID NO: 1802717 - RNA, 16 nt, Human
uuugagaucagccugg

SEQ ID NO: 1802718 - RNA, 17 nt, Human
uuugagaucagccuggg

SEQ ID NO: 1802719 - RNA, 21 nt, Human
uuugaggguguauauuuucug

SEQ ID NO: 1802720 - RNA, 15 nt, Human
uucacgugguccuaa

SEQ ID NO: 1802721 - RNA, 18 nt, Human
uucacggaagagccuugc

SEQ ID NO: 1802722 - RNA, 13 nt, Human
uucaauaggaaaa

SEQ ID NO: 1802723 - RNA, 15 nt, Human
uucaauaggaaaaac

SEQ ID NO: 1802724 - RNA, 18 nt, Human
uucaauaggaaaaacuga

SEQ ID NO: 1802725 - RNA, 20 nt, Human
uucaauaggaaaaacugauu

SEQ ID NO: 1802726 - RNA, 21 nt, Human
uucagaguugaugguuguaca

SEQ ID NO: 1802727 - RNA, 22 nt, Human
uucagaguugaugguuguacau

SEQ ID NO: 1802728 - RNA, 19 nt, Human
uucagagacuccugcaggc

SEQ ID NO: 1802729 - RNA, 20 nt, Human
uucagacauagaauuaacac

SEQ ID NO: 1802730 - RNA, 21 nt, Human
uucagacagcugccugggauc

SEQ ID NO: 1802731 - RNA, 16 nt, Human
uucagacauagaauua

SEQ ID NO: 1802732 - RNA, 13 nt, Human
uucacucuccuug

SEQ ID NO: 1802733 - RNA, 17 nt, Human
uuauugucaaaguggug

SEQ ID NO: 1802734 - RNA, 18 nt, Human
uuauugucaaagugguga

SEQ ID NO: 1802735 - RNA, 20 nt, Human
uuauuuuauguugcauagaa

SEQ ID NO: 1802736 - RNA, 17 nt, Human
uucaacugaccagccuc

SEQ ID NO: 1802737 - RNA, 20 nt, Human
uucaacgcagcccugcuuug

SEQ ID NO: 1802738 - RNA, 16 nt, Human
uucaacgcagcccugc

SEQ ID NO: 1802739 - RNA, 19 nt, Human
uucaacgcagcccugcuuu

SEQ ID NO: 1802740 - RNA, 16 nt, Human
uuauggaacacucuga

SEQ ID NO: 1802741 - RNA, 22 nt, Human
uuaugcaugaaguaauaugcac

SEQ ID NO: 1802742 - RNA, 14 nt, Human
uuaugcauagauaa

SEQ ID NO: 1802743 - RNA, 16 nt, Human
uuaugcaugaaguaau

SEQ ID NO: 1802744 - RNA, 17 nt, Human
uuaucuagauacuguau

SEQ ID NO: 1802745 - RNA, 20 nt, Human
uuaucuugaauaauguaaga

SEQ ID NO: 1802746 - RNA, 15 nt, Human
uuaguugcuguaugu

SEQ ID NO: 1802747 - RNA, 13 nt, Human
uuaguugcuguau

SEQ ID NO: 1802748 - RNA, 20 nt, Human
uuaguugcaacuuuguauaa

SEQ ID NO: 1802749 - RNA, 16 nt, Human
uuaucuagauacugua

SEQ ID NO: 1802750 - RNA, 16 nt, Human
uuaguuccucauuagc

SEQ ID NO: 1802751 - RNA, 14 nt, Human
uuaguuccuugagu

SEQ ID NO: 1802752 - RNA, 13 nt, Human
uuaguugcaacuu

SEQ ID NO: 1802753 - RNA, 15 nt, Human
uuauugcccacgcug

SEQ ID NO: 1802754 - RNA, 19 nt, Human
uuauugcagcgauuaauaa

SEQ ID NO: 1802755 - RNA, 11 nt, Human
uuauucugcuc

SEQ ID NO: 1802756 - RNA, 20 nt, Human
uuccagcaauucuccugccu

SEQ ID NO: 1802757 - RNA, 21 nt, Human
uuccagcaauucuccugccuc

SEQ ID NO: 1802758 - RNA, 22 nt, Human
uuccagcaauucuccugccuca

SEQ ID NO: 1802759 - RNA, 23 nt, Human
uuccagcaauucuccugccucag

SEQ ID NO: 1802760 - RNA, 16 nt, Human
uucccauuugcuccuu

SEQ ID NO: 1802761 - RNA, 15 nt, Human
uuccccaggaggcca

SEQ ID NO: 1802762 - RNA, 16 nt, Human
uuccccaggaggccag

SEQ ID NO: 1802763 - RNA, 14 nt, Human
uucccauucuugca

SEQ ID NO: 1802764 - RNA, 11 nt, Human
uucccucccuu

SEQ ID NO: 1802765 - RNA, 17 nt, Human
uucccucccuuccucuu

SEQ ID NO: 1802766 - RNA, 20 nt, Human
uucccucccuuccucuuucc

SEQ ID NO: 1802767 - RNA, 19 nt, Human
uuccccaugucucgacuca

SEQ ID NO: 1802768 - RNA, 11 nt, Human
uuccccauggg

SEQ ID NO: 1802769 - RNA, 21 nt, Human
uuccccaggaggccagccuug

SEQ ID NO: 1802770 - RNA, 17 nt, Human
uuccccaggaggccagc

SEQ ID NO: 1802771 - RNA, 18 nt, Human
uuccccaggaggccagcc

SEQ ID NO: 1802772 - RNA, 19 nt, Human
uuccccaggaggccagccu

SEQ ID NO: 1802773 - RNA, 20 nt, Human
uuccccaggaggccagccuu

SEQ ID NO: 1802774 - RNA, 16 nt, Human
uucauuugcuuuggaa

SEQ ID NO: 1802775 - RNA, 15 nt, Human
uuccaaauucugcuu

SEQ ID NO: 1802776 - RNA, 18 nt, Human
uuccacucaggucuguuu

SEQ ID NO: 1802777 - RNA, 17 nt, Human
uuccagagaguggcucc

SEQ ID NO: 1802778 - RNA, 18 nt, Human
uuccagagaguggcuccu

SEQ ID NO: 1802779 - RNA, 19 nt, Human
uuccagagaguggcuccuc

SEQ ID NO: 1802780 - RNA, 20 nt, Human
uuccagagaguggcuccucc

SEQ ID NO: 1802781 - RNA, 21 nt, Human
uuccagagaguggcuccuccc

SEQ ID NO: 1802782 - RNA, 16 nt, Human
uucauuuccugugucu

SEQ ID NO: 1802783 - RNA, 15 nt, Human
uucauuuccuguguc

SEQ ID NO: 1802784 - RNA, 12 nt, Human
uucauuugcuuu

SEQ ID NO: 1802785 - RNA, 17 nt, Human
uucaugcaaacuuuauu

SEQ ID NO: 1802786 - RNA, 21 nt, Human
uucaucuugaauuguaaggaa

SEQ ID NO: 1802787 - RNA, 11 nt, Human
uucaggaagcu

SEQ ID NO: 1802788 - RNA, 13 nt, Human
uucaggaagcuca

SEQ ID NO: 1802789 - RNA, 20 nt, Human
uuccuugaguugauucagcu

SEQ ID NO: 1802790 - RNA, 14 nt, Human
uuccuggcacugcu

SEQ ID NO: 1802791 - RNA, 17 nt, Human
uuccugccaggcauggu

SEQ ID NO: 1802792 - RNA, 16 nt, Human
uuccugcauuugugaa

SEQ ID NO: 1802793 - RNA, 18 nt, Human
uuccugcauuugugaaau

SEQ ID NO: 1802794 - RNA, 23 nt, Human
uuccugaugcuucuucagagacu

SEQ ID NO: 1802795 - RNA, 15 nt, Human
uuccugcauuuguga

SEQ ID NO: 1802796 - RNA, 18 nt, Human
uuccugaugcuucuucag

SEQ ID NO: 1802797 - RNA, 19 nt, Human
uuccugaugcuucuucaga

SEQ ID NO: 1802798 - RNA, 15 nt, Human
uuccugaugcuucuu

SEQ ID NO: 1802799 - RNA, 15 nt, Human
uucuaaagauggaaa

SEQ ID NO: 1802800 - RNA, 13 nt, Human
uucuaaagcugcc

SEQ ID NO: 1802801 - RNA, 17 nt, Human
uucuaaagcugccagcc

SEQ ID NO: 1802802 - RNA, 20 nt, Human
uucgggaggucgaggcagga

SEQ ID NO: 1802803 - RNA, 21 nt, Human
uucccuuugacgccaucccag

SEQ ID NO: 1802804 - RNA, 22 nt, Human
uucccuuugacgccaucccagc

SEQ ID NO: 1802805 - RNA, 20 nt, Human
uucccuuugacgccauccca

SEQ ID NO: 1802806 - RNA, 13 nt, Human
uuccucauuagca

SEQ ID NO: 1802807 - RNA, 19 nt, Human
uucccccuccaaucccacc

SEQ ID NO: 1802808 - RNA, 18 nt, Human
uuacuuagguguggggga

SEQ ID NO: 1802809 - RNA, 12 nt, Human
uuacuucugcua

SEQ ID NO: 1802810 - RNA, 23 nt, Human
uuacuucuuauacauuugauaaa

SEQ ID NO: 1802811 - RNA, 11 nt, Human
uuacuucugcu

SEQ ID NO: 1802812 - RNA, 19 nt, Human
uuacuauggcccuggccua

SEQ ID NO: 1802813 - RNA, 19 nt, Human
uuacugucuuuuuucuaaa

SEQ ID NO: 1802814 - RNA, 17 nt, Human
uuacugucuuuuuucua

SEQ ID NO: 1802815 - RNA, 21 nt, Human
uuacuuaaaccgccaaggcug

SEQ ID NO: 1802816 - RNA, 21 nt, Human
uuacuaucaugucaaacguga

SEQ ID NO: 1802817 - RNA, 19 nt, Human
uuacuaucaugucaaacgu

SEQ ID NO: 1802818 - RNA, 17 nt, Human
uuacuaguuucccuugc

SEQ ID NO: 1802819 - RNA, 16 nt, Human
uuacuaauagacaauu

SEQ ID NO: 1802820 - RNA, 14 nt, Human
uuacuaaguuuuua

SEQ ID NO: 1802821 - RNA, 13 nt, Human
uuacuaaguuuuu

SEQ ID NO: 1802822 - RNA, 16 nt, Human
uuagacagucccugcc

SEQ ID NO: 1802823 - RNA, 17 nt, Human
uuagacagucccugcca

SEQ ID NO: 1802824 - RNA, 18 nt, Human
uuagacagucccugccaa

SEQ ID NO: 1802825 - RNA, 15 nt, Human
uuagacagucccugc

SEQ ID NO: 1802826 - RNA, 14 nt, Human
uuacuuuguguuca

SEQ ID NO: 1802827 - RNA, 18 nt, Human
uuacuuuaaaaggagcca

SEQ ID NO: 1802828 - RNA, 17 nt, Human
uuacuuuaaaaggagcc

SEQ ID NO: 1802829 - RNA, 16 nt, Human
uuaguaugaggcauuu

SEQ ID NO: 1802830 - RNA, 18 nt, Human
uuaguaugaggcauuugu

SEQ ID NO: 1802831 - RNA, 16 nt, Human
uuaguuccacugagac

SEQ ID NO: 1802832 - RNA, 15 nt, Human
uuaguuccacugaga

SEQ ID NO: 1802833 - RNA, 14 nt, Human
uuaguguucauaaa

SEQ ID NO: 1802834 - RNA, 18 nt, Human
uuaggauguugaaaaagu

SEQ ID NO: 1802835 - RNA, 22 nt, Human
uuaggccaaaaaaauguaagau

SEQ ID NO: 1802836 - RNA, 17 nt, Human
uuaguagagacaggguu

SEQ ID NO: 1802837 - RNA, 12 nt, Human
uuagcugggaga

SEQ ID NO: 1802838 - RNA, 15 nt, Human
uuagauaaauauuga

SEQ ID NO: 1802839 - RNA, 22 nt, Human
uuagauaauacaccacuacauu

SEQ ID NO: 1802840 - RNA, 14 nt, Human
uuagaguugauacu

SEQ ID NO: 1802841 - RNA, 21 nt, Human
uguuucagaggcucagauugu

SEQ ID NO: 1802842 - RNA, 20 nt, Human
uguuucauauugaugugugu

SEQ ID NO: 1802843 - RNA, 15 nt, Human
uguuucaaacuuuac

SEQ ID NO: 1802844 - RNA, 16 nt, Human
uguuuagauaauacac

SEQ ID NO: 1802845 - RNA, 20 nt, Human
uguuuuaagaggcagggucu

SEQ ID NO: 1802846 - RNA, 13 nt, Human
uguuugugauuga

SEQ ID NO: 1802847 - RNA, 18 nt, Human
uguuuuuuuuuuccacuu

SEQ ID NO: 1802848 - RNA, 19 nt, Human
uguuuuuuuuuuccacuua

SEQ ID NO: 1802849 - RNA, 18 nt, Human
uguuuuuuuuuaaagacu

SEQ ID NO: 1802850 - RNA, 17 nt, Human
uuaaaagauacaguuac

SEQ ID NO: 1802851 - RNA, 14 nt, Human
uuaaaagauacagu

SEQ ID NO: 1802852 - RNA, 19 nt, Human
uguuuuaaggaugcuugua

SEQ ID NO: 1802853 - RNA, 22 nt, Human
uguuuuaagaggcagggucuca

SEQ ID NO: 1802854 - RNA, 18 nt, Human
uguuuuaaggaugcuugu

SEQ ID NO: 1802855 - RNA, 17 nt, Human
uguuuuguuuggagaca

SEQ ID NO: 1802856 - RNA, 21 nt, Human
uuaaaauaccagccaguaaau

SEQ ID NO: 1802857 - RNA, 21 nt, Human
uuaaauguuuuuuuuuaaaga

SEQ ID NO: 1802858 - RNA, 23 nt, Human
uuaaauguuuuuuuuuaaagacu

SEQ ID NO: 1802859 - RNA, 12 nt, Human
uuaaagacagag

SEQ ID NO: 1802860 - RNA, 11 nt, Human
uuaaagacaga

SEQ ID NO: 1802861 - RNA, 17 nt, Human
uuaaccacuucagcuga

SEQ ID NO: 1802862 - RNA, 16 nt, Human
uuaacuucacauauug

SEQ ID NO: 1802863 - RNA, 15 nt, Human
uuaacuuuuauaaac

SEQ ID NO: 1802864 - RNA, 17 nt, Human
uuaacuuuuauaaacuu

SEQ ID NO: 1802865 - RNA, 16 nt, Human
uuaacuuuuauaaacu

SEQ ID NO: 1802866 - RNA, 18 nt, Human
uuaacuuuuauaaacuuu

SEQ ID NO: 1802867 - RNA, 20 nt, Human
uuacaagcgugagccacugc

SEQ ID NO: 1802868 - RNA, 21 nt, Human
uuacaagcgugagccacugca

SEQ ID NO: 1802869 - RNA, 17 nt, Human
uuaagcuguuacugucu

SEQ ID NO: 1802870 - RNA, 15 nt, Human
uuaagccuuuggaaa

SEQ ID NO: 1802871 - RNA, 16 nt, Human
uuaagccuuuggaaac

SEQ ID NO: 1802872 - RNA, 21 nt, Human
uuaaugauaugcuuguaacua

SEQ ID NO: 1802873 - RNA, 18 nt, Human
uuaauauugauaugcuua

SEQ ID NO: 1802874 - RNA, 22 nt, Human
uuaauauugauaugcuuauaca

SEQ ID NO: 1802875 - RNA, 13 nt, Human
uggacuccucugu

SEQ ID NO: 1802876 - RNA, 14 nt, Human
uggacuccucuguc

SEQ ID NO: 1802877 - RNA, 21 nt, Human
uggagaagcucccugaaguaa

SEQ ID NO: 1802878 - RNA, 14 nt, Human
uggagacugucuca

SEQ ID NO: 1802879 - RNA, 21 nt, Human
uggaggaaggaaacccagcuc

SEQ ID NO: 1802880 - RNA, 23 nt, Human
uggaggaaggaaacccagcucug

SEQ ID NO: 1802881 - RNA, 16 nt, Human
uggcaaaaaggcagga

SEQ ID NO: 1802882 - RNA, 17 nt, Human
uggauuuuugucuugug

SEQ ID NO: 1802883 - RNA, 12 nt, Human
uggcaaaaaggc

SEQ ID NO: 1802884 - RNA, 15 nt, Human
uggcacuauaaugua

SEQ ID NO: 1802885 - RNA, 16 nt, Human
uggcacuauaauguaa

SEQ ID NO: 1802886 - RNA, 18 nt, Human
uggccagaugcaccagcc

SEQ ID NO: 1802887 - RNA, 17 nt, Human
uggccagaugcaccagc

SEQ ID NO: 1802888 - RNA, 17 nt, Human
uggcagaguugaagaca

SEQ ID NO: 1802889 - RNA, 19 nt, Human
uggcagaguugaagacaga

SEQ ID NO: 1802890 - RNA, 21 nt, Human
uggcagaguggauucuugaac

SEQ ID NO: 1802891 - RNA, 12 nt, Human
uggcagaggagg

SEQ ID NO: 1802892 - RNA, 15 nt, Human
uggcagaguugaaga

SEQ ID NO: 1802893 - RNA, 19 nt, Human
uggccagaugcaccagccc

SEQ ID NO: 1802894 - RNA, 16 nt, Human
uggccaggcugcucuu

SEQ ID NO: 1802895 - RNA, 17 nt, Human
uggccaggcugcucuug

SEQ ID NO: 1802896 - RNA, 13 nt, Human
uggccaggcuggu

SEQ ID NO: 1802897 - RNA, 20 nt, Human
uggccaggcugcucuugaac

SEQ ID NO: 1802898 - RNA, 16 nt, Human
uggccccugcccggcu

SEQ ID NO: 1802899 - RNA, 15 nt, Human
uggccccugcccggc

SEQ ID NO: 1802900 - RNA, 14 nt, Human
uggccccugcccgg

SEQ ID NO: 1802901 - RNA, 20 nt, Human
uggccccugcccggcugcgg

SEQ ID NO: 1802902 - RNA, 18 nt, Human
uggcuccucccggugccc

SEQ ID NO: 1802903 - RNA, 19 nt, Human
uggcuccucccggugccca

SEQ ID NO: 1802904 - RNA, 14 nt, Human
uggcuccucccggu

SEQ ID NO: 1802905 - RNA, 16 nt, Human
uggcuccucccggugc

SEQ ID NO: 1802906 - RNA, 11 nt, Human
uggcugcuuca

SEQ ID NO: 1802907 - RNA, 15 nt, Human
uggcugcuucaagga

SEQ ID NO: 1802908 - RNA, 16 nt, Human
uggcugcuucaaggau

SEQ ID NO: 1802909 - RNA, 14 nt, Human
uggcucccacaggc

SEQ ID NO: 1802910 - RNA, 17 nt, Human
uggcucccacaggcccu

SEQ ID NO: 1802911 - RNA, 20 nt, Human
uggcucccacaggcccuucc

SEQ ID NO: 1802912 - RNA, 15 nt, Human
uggcgggguggggug

SEQ ID NO: 1802913 - RNA, 23 nt, Human
uggccucccaacucaccccagcc

SEQ ID NO: 1802914 - RNA, 22 nt, Human
uggcgcagcauauucaggaagc

SEQ ID NO: 1802915 - RNA, 23 nt, Human
uggcgcagcauauucaggaagcu

SEQ ID NO: 1802916 - RNA, 16 nt, Human
uggcgcugccccuggc

SEQ ID NO: 1802917 - RNA, 23 nt, Human
uggcgcugccccuggcagccccu

SEQ ID NO: 1802918 - RNA, 15 nt, Human
uggucccccuuccau

SEQ ID NO: 1802919 - RNA, 16 nt, Human
uggucccccuuccaug

SEQ ID NO: 1802920 - RNA, 18 nt, Human
uggucccccuuccaugga

SEQ ID NO: 1802921 - RNA, 23 nt, Human
uggucccccuuccauggacuuug

SEQ ID NO: 1802922 - RNA, 17 nt, Human
ugguccuaaucuucuga

SEQ ID NO: 1802923 - RNA, 19 nt, Human
ugguccuaaucuucugaac

SEQ ID NO: 1802924 - RNA, 13 nt, Human
ugguccugcugca

SEQ ID NO: 1802925 - RNA, 15 nt, Human
ugguccugcugcagu

SEQ ID NO: 1802926 - RNA, 23 nt, Human
ugguccugcugcaguugccaguc

SEQ ID NO: 1802927 - RNA, 14 nt, Human
uggucccccuucca

SEQ ID NO: 1802928 - RNA, 19 nt, Human
uggucacaggacucugccu

SEQ ID NO: 1802929 - RNA, 18 nt, Human
uggucacaggacucugcc

SEQ ID NO: 1802930 - RNA, 22 nt, Human
uggucacaggaaguagaggagg

SEQ ID NO: 1802931 - RNA, 22 nt, Human
uggugaccucugccugaaguca

SEQ ID NO: 1802932 - RNA, 17 nt, Human
uggugaccucugccuga

SEQ ID NO: 1802933 - RNA, 16 nt, Human
uggugaccucugccug

SEQ ID NO: 1802934 - RNA, 15 nt, Human
uggugaccucugccu

SEQ ID NO: 1802935 - RNA, 19 nt, Human
uggugacuuuccucuuugg

SEQ ID NO: 1802936 - RNA, 21 nt, Human
uggugcaaugaccuuucaaua

SEQ ID NO: 1802937 - RNA, 14 nt, Human
uggugaccucugcc

SEQ ID NO: 1802938 - RNA, 13 nt, Human
uggugaccucugc

SEQ ID NO: 1802939 - RNA, 19 nt, Human
uggucuacacugugcugag

SEQ ID NO: 1802940 - RNA, 15 nt, Human
uggucuacacugugc

SEQ ID NO: 1802941 - RNA, 16 nt, Human
uggucuacacugugcu

SEQ ID NO: 1802942 - RNA, 17 nt, Human
uggucuacacugugcug

SEQ ID NO: 1802943 - RNA, 18 nt, Human
uggucuacacugugcuga

SEQ ID NO: 1802944 - RNA, 17 nt, Human
uggucggaaaacaugcu

SEQ ID NO: 1802945 - RNA, 14 nt, Human
uggucggaaaacau

SEQ ID NO: 1802946 - RNA, 23 nt, Human
ugggcagagcagagaccaucccu

SEQ ID NO: 1802947 - RNA, 21 nt, Human
ugggccccugccucucugcag

SEQ ID NO: 1802948 - RNA, 23 nt, Human
ugggccccugccucucugcaggu

SEQ ID NO: 1802949 - RNA, 11 nt, Human
ugggccuucag

SEQ ID NO: 1802950 - RNA, 14 nt, Human
ugggccuggcuccc

SEQ ID NO: 1802951 - RNA, 20 nt, Human
uggcugggggccucagugcc

SEQ ID NO: 1802952 - RNA, 17 nt, Human
uggcugggggccucagu

SEQ ID NO: 1802953 - RNA, 16 nt, Human
uggcugggggccucag

SEQ ID NO: 1802954 - RNA, 19 nt, Human
ugggaucacauguggacuu

SEQ ID NO: 1802955 - RNA, 14 nt, Human
ugggagugggccca

SEQ ID NO: 1802956 - RNA, 16 nt, Human
ugggagugggcccaau

SEQ ID NO: 1802957 - RNA, 22 nt, Human
ugggauuacaagcgugagccac

SEQ ID NO: 1802958 - RNA, 17 nt, Human
ugggauuacaggcguga

SEQ ID NO: 1802959 - RNA, 22 nt, Human
ugggcagagcagagaccauccc

SEQ ID NO: 1802960 - RNA, 14 nt, Human
ugggauccuccagg

SEQ ID NO: 1802961 - RNA, 12 nt, Human
ugggauccucca

SEQ ID NO: 1802962 - RNA, 13 nt, Human
ugggauccuccag

SEQ ID NO: 1802963 - RNA, 18 nt, Human
uggguacuuguggacaca

SEQ ID NO: 1802964 - RNA, 17 nt, Human
uggguacuuguggacac

SEQ ID NO: 1802965 - RNA, 15 nt, Human
uggggguucuuucuu

SEQ ID NO: 1802966 - RNA, 19 nt, Human
uggggguucuuucuuccuc

SEQ ID NO: 1802967 - RNA, 20 nt, Human
uggggguucuuucuuccucu

SEQ ID NO: 1802968 - RNA, 22 nt, Human
uggggguucuuucuuccucugc

SEQ ID NO: 1802969 - RNA, 13 nt, Human
uggggggggugcu

SEQ ID NO: 1802970 - RNA, 16 nt, Human
ugggggaguggccaca

SEQ ID NO: 1802971 - RNA, 23 nt, Human
uggggaugagaaagguugaagca

SEQ ID NO: 1802972 - RNA, 20 nt, Human
uggggccaggcugggucgcc

SEQ ID NO: 1802973 - RNA, 15 nt, Human
uggggaugagaaagg

SEQ ID NO: 1802974 - RNA, 21 nt, Human
uggggccaggcugggucgccc

SEQ ID NO: 1802975 - RNA, 22 nt, Human
uggggccaggcugggucgcccu

SEQ ID NO: 1802976 - RNA, 20 nt, Human
uggggccaguuggucccccu

SEQ ID NO: 1802977 - RNA, 15 nt, Human
ugggccuucagggag

SEQ ID NO: 1802978 - RNA, 12 nt, Human
ugggccuucagg

SEQ ID NO: 1802979 - RNA, 15 nt, Human
ugccucaagagaagg

SEQ ID NO: 1802980 - RNA, 14 nt, Human
ugccucaagagaag

SEQ ID NO: 1802981 - RNA, 14 nt, Human
ugccuccucuucaa

SEQ ID NO: 1802982 - RNA, 16 nt, Human
ugccuccucuucaacu

SEQ ID NO: 1802983 - RNA, 13 nt, Human
ugcccugggaggc

SEQ ID NO: 1802984 - RNA, 15 nt, Human
ugcccugggaggcag

SEQ ID NO: 1802985 - RNA, 17 nt, Human
ugcccugggaggcagug

SEQ ID NO: 1802986 - RNA, 18 nt, Human
ugcccugggaggcaguga

SEQ ID NO: 1802987 - RNA, 15 nt, Human
ugcccugcccaccug

SEQ ID NO: 1802988 - RNA, 16 nt, Human
ugcccugcccaccugg

SEQ ID NO: 1802989 - RNA, 20 nt, Human
ugcccugcccaccuggccuc

SEQ ID NO: 1802990 - RNA, 12 nt, Human
ugcccuggugcu

SEQ ID NO: 1802991 - RNA, 14 nt, Human
ugcccuggugcugc

SEQ ID NO: 1802992 - RNA, 16 nt, Human
ugcccuggugcugcca

SEQ ID NO: 1802993 - RNA, 17 nt, Human
ugcccuggugcugccac

SEQ ID NO: 1802994 - RNA, 17 nt, Human
ugcccugguuuccugcc

SEQ ID NO: 1802995 - RNA, 18 nt, Human
ugcccugguuuccugccc

SEQ ID NO: 1802996 - RNA, 19 nt, Human
ugcccugguuuccugcccu

SEQ ID NO: 1802997 - RNA, 20 nt, Human
ugcccugguuuccugcccug

SEQ ID NO: 1802998 - RNA, 23 nt, Human
ugcccugguuuccugcccuggga

SEQ ID NO: 1802999 - RNA, 23 nt, Human
ugcccugugaguacuacaguccu

SEQ ID NO: 1803000 - RNA, 15 nt, Human
ugccccucccuucaa

SEQ ID NO: 1803001 - RNA, 16 nt, Human
ugccccucccuucaac

SEQ ID NO: 1803002 - RNA, 17 nt, Human
ugccccuccucucugcc

SEQ ID NO: 1803003 - RNA, 18 nt, Human
ugccccuccucucugccc

SEQ ID NO: 1803004 - RNA, 19 nt, Human
ugccccuccucucugcccu

SEQ ID NO: 1803005 - RNA, 20 nt, Human
ugccccuccucucugcccua

SEQ ID NO: 1803006 - RNA, 16 nt, Human
ugccccuggcagcccc

SEQ ID NO: 1803007 - RNA, 14 nt, Human
ugcccggcugcgga

SEQ ID NO: 1803008 - RNA, 12 nt, Human
ugcccggcugcg

SEQ ID NO: 1803009 - RNA, 20 nt, Human
ugcccaggcuggcgugcagu

SEQ ID NO: 1803010 - RNA, 19 nt, Human
ugcccaggcuggcgugcag

SEQ ID NO: 1803011 - RNA, 18 nt, Human
ugcccaggcuggcgugca

SEQ ID NO: 1803012 - RNA, 21 nt, Human
ugcaguggugcgaucuggguu

SEQ ID NO: 1803013 - RNA, 21 nt, Human
ugcaguuacacuaaaagguga

SEQ ID NO: 1803014 - RNA, 13 nt, Human
ugcagggaguccg

SEQ ID NO: 1803015 - RNA, 15 nt, Human
ugauuuaauuugaaa

SEQ ID NO: 1803016 - RNA, 16 nt, Human
ugcaguugccagucac

SEQ ID NO: 1803017 - RNA, 18 nt, Human
ugcauauuauuuuauguu

SEQ ID NO: 1803018 - RNA, 16 nt, Human
ugccacuaaauugaca

SEQ ID NO: 1803019 - RNA, 20 nt, Human
ugccaggaagccagcaggcu

SEQ ID NO: 1803020 - RNA, 22 nt, Human
ugccaggaagccagcaggcucu

SEQ ID NO: 1803021 - RNA, 14 nt, Human
ugccaggcauggug

SEQ ID NO: 1803022 - RNA, 23 nt, Human
ugcauuuggugguuucagaaaug

SEQ ID NO: 1803023 - RNA, 21 nt, Human
ugcauuuggugguuucagaaa

SEQ ID NO: 1803024 - RNA, 23 nt, Human
ugcucuccgaccagacaccuuga

SEQ ID NO: 1803025 - RNA, 12 nt, Human
ugcucuccucuu

SEQ ID NO: 1803026 - RNA, 14 nt, Human
ugcucuccucuugc

SEQ ID NO: 1803027 - RNA, 17 nt, Human
ugcucuugaugccuggc

SEQ ID NO: 1803028 - RNA, 15 nt, Human
ugcucaggagcccug

SEQ ID NO: 1803029 - RNA, 17 nt, Human
ugcucacauaucuguca

SEQ ID NO: 1803030 - RNA, 18 nt, Human
ugcucaggagcccuggga

SEQ ID NO: 1803031 - RNA, 19 nt, Human
ugcucaggagcccugggag

SEQ ID NO: 1803032 - RNA, 20 nt, Human
ugcucaggagcccugggagg

SEQ ID NO: 1803033 - RNA, 17 nt, Human
ugcuagaacucccuuuc

SEQ ID NO: 1803034 - RNA, 15 nt, Human
ugcuagaacucccuu

SEQ ID NO: 1803035 - RNA, 14 nt, Human
ugcuagaacucccu

SEQ ID NO: 1803036 - RNA, 13 nt, Human
ugcuagaacuccc

SEQ ID NO: 1803037 - RNA, 22 nt, Human
ugcuaggaacacuccuucacag

SEQ ID NO: 1803038 - RNA, 21 nt, Human
ugcuaggaacacuccuucaca

SEQ ID NO: 1803039 - RNA, 20 nt, Human
ugcuaggaacacuccuucac

SEQ ID NO: 1803040 - RNA, 17 nt, Human
ugcggacagccacggcc

SEQ ID NO: 1803041 - RNA, 22 nt, Human
ugcuacuguccuacccacccuc

SEQ ID NO: 1803042 - RNA, 21 nt, Human
ugcuacuguccuacccacccu

SEQ ID NO: 1803043 - RNA, 22 nt, Human
ugcuaagacucaguggggaggg

SEQ ID NO: 1803044 - RNA, 20 nt, Human
ugccuugcauaauggucaga

SEQ ID NO: 1803045 - RNA, 21 nt, Human
ugcgcaggcuggcccugcccu

SEQ ID NO: 1803046 - RNA, 22 nt, Human
ugcgcaggcuggcccugcccug

SEQ ID NO: 1803047 - RNA, 23 nt, Human
ugcgcaggcuggcccugcccugg

SEQ ID NO: 1803048 - RNA, 20 nt, Human
ugcugggauuacagguguga

SEQ ID NO: 1803049 - RNA, 19 nt, Human
ugcugcuugaggcaacuca

SEQ ID NO: 1803050 - RNA, 14 nt, Human
ugcugggccccugc

SEQ ID NO: 1803051 - RNA, 12 nt, Human
ugcugcuugagg

SEQ ID NO: 1803052 - RNA, 16 nt, Human
ugcugggccccugccu

SEQ ID NO: 1803053 - RNA, 17 nt, Human
ugcugggccccugccuc

SEQ ID NO: 1803054 - RNA, 18 nt, Human
ugcugggccccugccucu

SEQ ID NO: 1803055 - RNA, 19 nt, Human
ugcugggccccugccucuc

SEQ ID NO: 1803056 - RNA, 21 nt, Human
ugcugggccccugccucucug

SEQ ID NO: 1803057 - RNA, 22 nt, Human
ugcugggccccugccucucugc

SEQ ID NO: 1803058 - RNA, 23 nt, Human
ugcugggccccugccucucugca

SEQ ID NO: 1803059 - RNA, 24 nt, Human
ugcugggccccugccucucugcag

SEQ ID NO: 1803060 - RNA, 15 nt, Human
ugcugccugcuuuuu

SEQ ID NO: 1803061 - RNA, 17 nt, Human
ugcugccugcuuuuuau

SEQ ID NO: 1803062 - RNA, 23 nt, Human
ugcugcauuuaaaagauacaguu

SEQ ID NO: 1803063 - RNA, 19 nt, Human
ugcugcauuuaaaagauac

SEQ ID NO: 1803064 - RNA, 18 nt, Human
ugcugcauuuaaaagaua

SEQ ID NO: 1803065 - RNA, 17 nt, Human
ugcugcauuuaaaagau

SEQ ID NO: 1803066 - RNA, 18 nt, Human
ugcuguaacuuucugaaa

SEQ ID NO: 1803067 - RNA, 18 nt, Human
ugcugguuuuucaguuuu

SEQ ID NO: 1803068 - RNA, 16 nt, Human
ugcugguuuuucaguu

SEQ ID NO: 1803069 - RNA, 15 nt, Human
ugcugguuuuucagu

SEQ ID NO: 1803070 - RNA, 12 nt, Human
ugcugguuuuuc

SEQ ID NO: 1803071 - RNA, 13 nt, Human
ugcugguuuuagu

SEQ ID NO: 1803072 - RNA, 17 nt, Human
ugcugggcuugucugua

SEQ ID NO: 1803073 - RNA, 20 nt, Human
ugcugggggggauuguaaaa

SEQ ID NO: 1803074 - RNA, 13 nt, Human
ugcuggguguggc

SEQ ID NO: 1803075 - RNA, 20 nt, Human
ugauucaacagguuuuccug

SEQ ID NO: 1803076 - RNA, 13 nt, Human
ugauucagacagc

SEQ ID NO: 1803077 - RNA, 14 nt, Human
ugauucagacagcu

SEQ ID NO: 1803078 - RNA, 15 nt, Human
ugauucagacagcug

SEQ ID NO: 1803079 - RNA, 16 nt, Human
ugauucagacagcugc

SEQ ID NO: 1803080 - RNA, 12 nt, Human
ugauucacagug

SEQ ID NO: 1803081 - RNA, 13 nt, Human
ugauuauauguca

SEQ ID NO: 1803082 - RNA, 20 nt, Human
ugauguucuuucacccuuuu

SEQ ID NO: 1803083 - RNA, 16 nt, Human
ugauuaccagggacug

SEQ ID NO: 1803084 - RNA, 21 nt, Human
ugauucuccugccucagccuc

SEQ ID NO: 1803085 - RNA, 23 nt, Human
ugauucagacagcugccugggau

SEQ ID NO: 1803086 - RNA, 18 nt, Human
ugauucagacagcugccu

SEQ ID NO: 1803087 - RNA, 19 nt, Human
ugauucagacagcugccug

SEQ ID NO: 1803088 - RNA, 20 nt, Human
ugauucagacagcugccugg

SEQ ID NO: 1803089 - RNA, 21 nt, Human
ugauucagacagcugccuggg

SEQ ID NO: 1803090 - RNA, 16 nt, Human
ugauugugucucuugg

SEQ ID NO: 1803091 - RNA, 20 nt, Human
ugauuggcaggaguuggaag

SEQ ID NO: 1803092 - RNA, 13 nt, Human
ugauuggaggggg

SEQ ID NO: 1803093 - RNA, 21 nt, Human
ugauuggaggggggagguggg

SEQ ID NO: 1803094 - RNA, 23 nt, Human
ugaugcuacaggauuugaaauug

SEQ ID NO: 1803095 - RNA, 21 nt, Human
ugaugccugugaacugaacuc

SEQ ID NO: 1803096 - RNA, 20 nt, Human
ugaugcuacaggauuugaaa

SEQ ID NO: 1803097 - RNA, 15 nt, Human
ugaugccugugaacu

SEQ ID NO: 1803098 - RNA, 20 nt, Human
ugaugccugugaacugaacu

SEQ ID NO: 1803099 - RNA, 11 nt, Human
ugaugccuggc

SEQ ID NO: 1803100 - RNA, 16 nt, Human
ugaucuuugcagacag

SEQ ID NO: 1803101 - RNA, 18 nt, Human
ugaucuuugcagacaggc

SEQ ID NO: 1803102 - RNA, 14 nt, Human
ugaugguuccccug

SEQ ID NO: 1803103 - RNA, 13 nt, Human
ugaugguuguaca

SEQ ID NO: 1803104 - RNA, 14 nt, Human
ugaugguuguacau

SEQ ID NO: 1803105 - RNA, 21 nt, Human
ugaugguuguacauauaagug

SEQ ID NO: 1803106 - RNA, 16 nt, Human
ugaugcuucuucagag

SEQ ID NO: 1803107 - RNA, 17 nt, Human
ugaugcuucuucagaga

SEQ ID NO: 1803108 - RNA, 18 nt, Human
ugaugcuucuucagagac

SEQ ID NO: 1803109 - RNA, 19 nt, Human
ugaugucccaacuuguaaa

SEQ ID NO: 1803110 - RNA, 16 nt, Human
ugauguguuaucucuu

SEQ ID NO: 1803111 - RNA, 19 nt, Human
ugauccacccaccucagcc

SEQ ID NO: 1803112 - RNA, 18 nt, Human
ugauccacccaccucagc

SEQ ID NO: 1803113 - RNA, 17 nt, Human
ugauccacccaccucag

SEQ ID NO: 1803114 - RNA, 17 nt, Human
ugaucucucgugauuga

SEQ ID NO: 1803115 - RNA, 15 nt, Human
ugaucugugggcaca

SEQ ID NO: 1803116 - RNA, 20 nt, Human
ugaucuucuuuauaauucua

SEQ ID NO: 1803117 - RNA, 13 nt, Human
ugauagcacagac

SEQ ID NO: 1803118 - RNA, 14 nt, Human
ugauagcacagacc

SEQ ID NO: 1803119 - RNA, 18 nt, Human
ugauagcaaauggccuca

SEQ ID NO: 1803120 - RNA, 17 nt, Human
ugauccaagcugguccc

SEQ ID NO: 1803121 - RNA, 15 nt, Human
ugauccaagcugguc

SEQ ID NO: 1803122 - RNA, 14 nt, Human
ugauccaagcuggu

SEQ ID NO: 1803123 - RNA, 13 nt, Human
ugauccaagcugg

SEQ ID NO: 1803124 - RNA, 17 nt, Human
ugagcagggcucagcgg

SEQ ID NO: 1803125 - RNA, 16 nt, Human
ugagcagggcucagcg

SEQ ID NO: 1803126 - RNA, 19 nt, Human
ugagcagggcucagcgggg

SEQ ID NO: 1803127 - RNA, 18 nt, Human
ugagcaucaggccaggcc

SEQ ID NO: 1803128 - RNA, 19 nt, Human
ugagcaucaggccaggccc

SEQ ID NO: 1803129 - RNA, 20 nt, Human
ugagcaucaggccaggcccu

SEQ ID NO: 1803130 - RNA, 21 nt, Human
ugagccucagcauccuggcac

SEQ ID NO: 1803131 - RNA, 18 nt, Human
ugagccucagcauccugg

SEQ ID NO: 1803132 - RNA, 22 nt, Human
ugagccucagcauccuggcacc

SEQ ID NO: 1803133 - RNA, 14 nt, Human
ugagccucagucuc

SEQ ID NO: 1803134 - RNA, 17 nt, Human
ugagccucagcauccug

SEQ ID NO: 1803135 - RNA, 21 nt, Human
ugagccgagaucacgccacug

SEQ ID NO: 1803136 - RNA, 19 nt, Human
ugagccgagaucacgccac

SEQ ID NO: 1803137 - RNA, 18 nt, Human
ugagcccuguccugccua

SEQ ID NO: 1803138 - RNA, 16 nt, Human
ugagagugaacaaauu

SEQ ID NO: 1803139 - RNA, 20 nt, Human
ugagacucgcgacaaugcaa

SEQ ID NO: 1803140 - RNA, 21 nt, Human
ugagacucgcgacaaugcaaa

SEQ ID NO: 1803141 - RNA, 22 nt, Human
ugagacucgcgacaaugcaaac

SEQ ID NO: 1803142 - RNA, 23 nt, Human
ugagacucgcgacaaugcaaacc

SEQ ID NO: 1803143 - RNA, 15 nt, Human
ugagcagggcucagc

SEQ ID NO: 1803144 - RNA, 14 nt, Human
ugagcagggcucag

SEQ ID NO: 1803145 - RNA, 13 nt, Human
ugagcagggcuca

SEQ ID NO: 1803146 - RNA, 12 nt, Human
ugagcagggcuc

SEQ ID NO: 1803147 - RNA, 15 nt, Human
ugagaucaaaacggu

SEQ ID NO: 1803148 - RNA, 14 nt, Human
ugagaucagccugg

SEQ ID NO: 1803149 - RNA, 15 nt, Human
ugagaucagccuggg

SEQ ID NO: 1803150 - RNA, 19 nt, Human
ugagacucgcgacaaugca

SEQ ID NO: 1803151 - RNA, 21 nt, Human
ugaccucaggugauccaccca

SEQ ID NO: 1803152 - RNA, 20 nt, Human
ugaccucaggugauccaccc

SEQ ID NO: 1803153 - RNA, 22 nt, Human
ugaccucagcuuugauauuuca

SEQ ID NO: 1803154 - RNA, 16 nt, Human
ugaccucagcuuugau

SEQ ID NO: 1803155 - RNA, 17 nt, Human
ugagaaauuuauaaacu

SEQ ID NO: 1803156 - RNA, 17 nt, Human
ugagggaacagagaggu

SEQ ID NO: 1803157 - RNA, 13 nt, Human
ugaggcucugccc

SEQ ID NO: 1803158 - RNA, 14 nt, Human
ugaggcucugcccu

SEQ ID NO: 1803159 - RNA, 20 nt, Human
ugaggcuccacuuggucugu

SEQ ID NO: 1803160 - RNA, 18 nt, Human
ugaggcuccacuuggucu

SEQ ID NO: 1803161 - RNA, 12 nt, Human
ugaggugggagg

SEQ ID NO: 1803162 - RNA, 13 nt, Human
ugaggugggagga

SEQ ID NO: 1803163 - RNA, 16 nt, Human
ugaggagcuugaaacc

SEQ ID NO: 1803164 - RNA, 13 nt, Human
ugagcugggauga

SEQ ID NO: 1803165 - RNA, 23 nt, Human
ugaggcauuuguuugaacugaua

SEQ ID NO: 1803166 - RNA, 23 nt, Human
ugaggcuagugugguguuuccug

SEQ ID NO: 1803167 - RNA, 21 nt, Human
ugaggcauuuguuugaacuga

SEQ ID NO: 1803168 - RNA, 17 nt, Human
ugaggcuaguguggugu

SEQ ID NO: 1803169 - RNA, 20 nt, Human
ugaggcauuuguuugaacug

SEQ ID NO: 1803170 - RNA, 19 nt, Human
ugaggcauuuguuugaacu

SEQ ID NO: 1803171 - RNA, 23 nt, Human
ugaggcaucgcaauguaagacuc

SEQ ID NO: 1803172 - RNA, 12 nt, Human
ugaggcauuugu

SEQ ID NO: 1803173 - RNA, 22 nt, Human
ugaguuugggccccagaggcug

SEQ ID NO: 1803174 - RNA, 23 nt, Human
ugaguuugggccccagaggcugg

SEQ ID NO: 1803175 - RNA, 14 nt, Human
ugagugagcaugcc

SEQ ID NO: 1803176 - RNA, 16 nt, Human
ugaguugauagcacag

SEQ ID NO: 1803177 - RNA, 20 nt, Human
ugaguugauagcacagaccc

SEQ ID NO: 1803178 - RNA, 13 nt, Human
ugagucugaaggc

SEQ ID NO: 1803179 - RNA, 15 nt, Human
ugagucugaaggcug

SEQ ID NO: 1803180 - RNA, 17 nt, Human
ugagucugaaggcuggg

SEQ ID NO: 1803181 - RNA, 18 nt, Human
ugagucugaaggcugggu

SEQ ID NO: 1803182 - RNA, 19 nt, Human
ugagucgaggacagggagg

SEQ ID NO: 1803183 - RNA, 19 nt, Human
ugagucccaggcugagccu

SEQ ID NO: 1803184 - RNA, 15 nt, Human
ugagucccaggcuga

SEQ ID NO: 1803185 - RNA, 21 nt, Human
ugaggugggaggaucucuuga

SEQ ID NO: 1803186 - RNA, 19 nt, Human
ugaguccagaaguuugaga

SEQ ID NO: 1803187 - RNA, 20 nt, Human
ugaaaagcuccauuuuuagu

SEQ ID NO: 1803188 - RNA, 13 nt, Human
ugaaaauuuugau

SEQ ID NO: 1803189 - RNA, 21 nt, Human
ugaaaauuuugauguuuuaag

SEQ ID NO: 1803190 - RNA, 19 nt, Human
ugaaaauuuugauguuuua

SEQ ID NO: 1803191 - RNA, 14 nt, Human
ugaaacauuuuguc

SEQ ID NO: 1803192 - RNA, 13 nt, Human
ugaaagggcccag

SEQ ID NO: 1803193 - RNA, 23 nt, Human
ugaaagggaguauuacaaaaaca

SEQ ID NO: 1803194 - RNA, 20 nt, Human
ugaaaccccuguaggccuca

SEQ ID NO: 1803195 - RNA, 19 nt, Human
ugaaagauggcugugccuc

SEQ ID NO: 1803196 - RNA, 18 nt, Human
ugaaagauggcugugccu

SEQ ID NO: 1803197 - RNA, 18 nt, Human
ugaaagcccugagcuuuc

SEQ ID NO: 1803198 - RNA, 12 nt, Human
ugaaauuauuca

SEQ ID NO: 1803199 - RNA, 16 nt, Human
ugaaaucaguuacucu

SEQ ID NO: 1803200 - RNA, 17 nt, Human
ugaaaucaguuacucuu

SEQ ID NO: 1803201 - RNA, 16 nt, Human
ugaacuccuggccuca

SEQ ID NO: 1803202 - RNA, 20 nt, Human
ugaaccaccacacccagccc

SEQ ID NO: 1803203 - RNA, 17 nt, Human
ugaaccaccacacccag

SEQ ID NO: 1803204 - RNA, 23 nt, Human
ugaaccacaucuugcucugcuga

SEQ ID NO: 1803205 - RNA, 19 nt, Human
ugaaccacaucuugcucug

SEQ ID NO: 1803206 - RNA, 22 nt, Human
ugaaccaagaacuuuccaggaa

SEQ ID NO: 1803207 - RNA, 20 nt, Human
ugaacauugguucuuucauu

SEQ ID NO: 1803208 - RNA, 12 nt, Human
ucuuugccaagu

SEQ ID NO: 1803209 - RNA, 21 nt, Human
ucuuuggacagaagcagcucu

SEQ ID NO: 1803210 - RNA, 22 nt, Human
ucuuuggacagaagcagcucuu

SEQ ID NO: 1803211 - RNA, 19 nt, Human
ucuuuggacagaagcagcu

SEQ ID NO: 1803212 - RNA, 17 nt, Human
ucuuuggacacucacac

SEQ ID NO: 1803213 - RNA, 21 nt, Human
ucuuucauuugcuuuggaagu

SEQ ID NO: 1803214 - RNA, 17 nt, Human
ucuuuccaaaguacacu

SEQ ID NO: 1803215 - RNA, 14 nt, Human
ucuuuccaaaguac

SEQ ID NO: 1803216 - RNA, 13 nt, Human
ucuuuccaaagua

SEQ ID NO: 1803217 - RNA, 16 nt, Human
ucuuucagccaagaau

SEQ ID NO: 1803218 - RNA, 19 nt, Human
ucuuucagccaagaauucu

SEQ ID NO: 1803219 - RNA, 20 nt, Human
ucuuucagccaagaauucuu

SEQ ID NO: 1803220 - RNA, 21 nt, Human
ucuuucagccaagaauucuua

SEQ ID NO: 1803221 - RNA, 15 nt, Human
ucuugcaugaggcua

SEQ ID NO: 1803222 - RNA, 13 nt, Human
ucuccucuugcca

SEQ ID NO: 1803223 - RNA, 16 nt, Human
ucuccucuugccacug

SEQ ID NO: 1803224 - RNA, 16 nt, Human
ucucccuucauccuuc

SEQ ID NO: 1803225 - RNA, 20 nt, Human
ucuccucugcugcuggcugg

SEQ ID NO: 1803226 - RNA, 22 nt, Human
ucuccucuugccacugccucuu

SEQ ID NO: 1803227 - RNA, 17 nt, Human
ucuccucuugccacugc

SEQ ID NO: 1803228 - RNA, 23 nt, Human
ucuuucacccuuuucuguuugcu

SEQ ID NO: 1803229 - RNA, 16 nt, Human
ucuuguguguuuauug

SEQ ID NO: 1803230 - RNA, 12 nt, Human
ucuuguguuucu

SEQ ID NO: 1803231 - RNA, 21 nt, Human
ucuuguguguuuauugucaaa

SEQ ID NO: 1803232 - RNA, 18 nt, Human
ugacaaggauugcuacug

SEQ ID NO: 1803233 - RNA, 19 nt, Human
ugacagagugagacucugu

SEQ ID NO: 1803234 - RNA, 23 nt, Human
ugacauaaguauuuaauucaugu

SEQ ID NO: 1803235 - RNA, 17 nt, Human
ugacagagugagacucu

SEQ ID NO: 1803236 - RNA, 14 nt, Human
ugacagagugagac

SEQ ID NO: 1803237 - RNA, 23 nt, Human
ugacagaggcagccccauucugc

SEQ ID NO: 1803238 - RNA, 18 nt, Human
ugacagaggcagccccau

SEQ ID NO: 1803239 - RNA, 17 nt, Human
ugacagaggcagcccca

SEQ ID NO: 1803240 - RNA, 16 nt, Human
ugacagaggcagcccc

SEQ ID NO: 1803241 - RNA, 15 nt, Human
ugacagaggcagccc

SEQ ID NO: 1803242 - RNA, 14 nt, Human
ugacagaggcagcc

SEQ ID NO: 1803243 - RNA, 23 nt, Human
ugacagacacaggcccggcucca

SEQ ID NO: 1803244 - RNA, 20 nt, Human
ugacagacacaggcccggcu

SEQ ID NO: 1803245 - RNA, 13 nt, Human
ugacagaggcagc

SEQ ID NO: 1803246 - RNA, 16 nt, Human
ugacagacagcccucc

SEQ ID NO: 1803247 - RNA, 13 nt, Human
ugacaugucuuuu

SEQ ID NO: 1803248 - RNA, 15 nt, Human
ugacaugucuuuucu

SEQ ID NO: 1803249 - RNA, 19 nt, Human
ugaccagcaccaucucucc

SEQ ID NO: 1803250 - RNA, 20 nt, Human
ugaccacugcagaagacagu

SEQ ID NO: 1803251 - RNA, 20 nt, Human
ugaccagcaccaucucuccu

SEQ ID NO: 1803252 - RNA, 16 nt, Human
ugaccauucuccaccu

SEQ ID NO: 1803253 - RNA, 17 nt, Human
ugaccauucuccaccug

SEQ ID NO: 1803254 - RNA, 18 nt, Human
ugaccauucuccaccugc

SEQ ID NO: 1803255 - RNA, 19 nt, Human
ugaccauucuccaccugcc

SEQ ID NO: 1803256 - RNA, 13 nt, Human
ugaccgugaggcc

SEQ ID NO: 1803257 - RNA, 14 nt, Human
ugaccgugaggcca

SEQ ID NO: 1803258 - RNA, 16 nt, Human
ugaccgugaggccaga

SEQ ID NO: 1803259 - RNA, 20 nt, Human
ugaccgugaggccagagaca

SEQ ID NO: 1803260 - RNA, 17 nt, Human
ugaaggccccgcccagg

SEQ ID NO: 1803261 - RNA, 20 nt, Human
ugaaggacauugcggacagc

SEQ ID NO: 1803262 - RNA, 19 nt, Human
ugaaggacauugcggacag

SEQ ID NO: 1803263 - RNA, 22 nt, Human
ugaaggacauugcggacagcca

SEQ ID NO: 1803264 - RNA, 20 nt, Human
ugaaggagagcccuucauuu

SEQ ID NO: 1803265 - RNA, 16 nt, Human
ugaaggagagcccuuc

SEQ ID NO: 1803266 - RNA, 15 nt, Human
ugaaggccccgccca

SEQ ID NO: 1803267 - RNA, 16 nt, Human
ugaaggccccgcccag

SEQ ID NO: 1803268 - RNA, 17 nt, Human
ugaacuccuggccucaa

SEQ ID NO: 1803269 - RNA, 16 nt, Human
ugaacucugacaacag

SEQ ID NO: 1803270 - RNA, 20 nt, Human
ugaaggaauaaauugcuccu

SEQ ID NO: 1803271 - RNA, 16 nt, Human
ugaauuauuuucucuc

SEQ ID NO: 1803272 - RNA, 23 nt, Human
ugaaugaugauccuaggcauuug

SEQ ID NO: 1803273 - RNA, 14 nt, Human
ugaauaaagacacc

SEQ ID NO: 1803274 - RNA, 15 nt, Human
ugaauaaagacaccu

SEQ ID NO: 1803275 - RNA, 22 nt, Human
ugaaucauuuuaccuuugacaa

SEQ ID NO: 1803276 - RNA, 23 nt, Human
ugaaucauuuuaccuuugacaaa

SEQ ID NO: 1803277 - RNA, 13 nt, Human
ucgugacaacacu

SEQ ID NO: 1803278 - RNA, 14 nt, Human
uccuuagaagugga

SEQ ID NO: 1803279 - RNA, 18 nt, Human
ucggacuuagcugggaga

SEQ ID NO: 1803280 - RNA, 20 nt, Human
ucgugguaggacuguagaaa

SEQ ID NO: 1803281 - RNA, 15 nt, Human
ucgugguaggacugu

SEQ ID NO: 1803282 - RNA, 14 nt, Human
ucgugguaggacug

SEQ ID NO: 1803283 - RNA, 16 nt, Human
ucguguccccuauccu

SEQ ID NO: 1803284 - RNA, 20 nt, Human
ucuaaaggcuaccuuuguau

SEQ ID NO: 1803285 - RNA, 19 nt, Human
ucuaaaggcuaccuuugua

SEQ ID NO: 1803286 - RNA, 17 nt, Human
ucuaaaggcuaccuuug

SEQ ID NO: 1803287 - RNA, 18 nt, Human
ucuaaaggcuaccuuugu

SEQ ID NO: 1803288 - RNA, 14 nt, Human
ucuaucaccaagga

SEQ ID NO: 1803289 - RNA, 17 nt, Human
ucuaugacacaugcaag

SEQ ID NO: 1803290 - RNA, 14 nt, Human
ucuaugacacaugc

SEQ ID NO: 1803291 - RNA, 15 nt, Human
ucuaggaagacuuug

SEQ ID NO: 1803292 - RNA, 16 nt, Human
ucuaggaagacuuugg

SEQ ID NO: 1803293 - RNA, 19 nt, Human
ucuaggaagacuuuggaaa

SEQ ID NO: 1803294 - RNA, 21 nt, Human
ucuaggaagacuuuggaaaga

SEQ ID NO: 1803295 - RNA, 16 nt, Human
ucuacagaggccaugg

SEQ ID NO: 1803296 - RNA, 15 nt, Human
ucuacagaggccaug

SEQ ID NO: 1803297 - RNA, 14 nt, Human
ucuaccuuccugca

SEQ ID NO: 1803298 - RNA, 23 nt, Human
ucucaguccaugaagauguagag

SEQ ID NO: 1803299 - RNA, 13 nt, Human
ucuaugggacuca

SEQ ID NO: 1803300 - RNA, 12 nt, Human
ucuaugggacuc

SEQ ID NO: 1803301 - RNA, 19 nt, Human
ucuaugggacucaaugcac

SEQ ID NO: 1803302 - RNA, 16 nt, Human
ucucauacucaccuca

SEQ ID NO: 1803303 - RNA, 18 nt, Human
ucucauacucaccucacc

SEQ ID NO: 1803304 - RNA, 16 nt, Human
ucuccacccugcucuc

SEQ ID NO: 1803305 - RNA, 14 nt, Human
ucuccacccugcuc

SEQ ID NO: 1803306 - RNA, 17 nt, Human
ucuccacccugcucucc

SEQ ID NO: 1803307 - RNA, 13 nt, Human
ucuccacccugcu

SEQ ID NO: 1803308 - RNA, 16 nt, Human
ucucaugccucagccu

SEQ ID NO: 1803309 - RNA, 19 nt, Human
ucucaugccucagccuccu

SEQ ID NO: 1803310 - RNA, 13 nt, Human
ucucaugccucag

SEQ ID NO: 1803311 - RNA, 13 nt, Human
ucuccacuccaga

SEQ ID NO: 1803312 - RNA, 22 nt, Human
ucuccaccugccagggacagag

SEQ ID NO: 1803313 - RNA, 17 nt, Human
ucuccaccugccaggga

SEQ ID NO: 1803314 - RNA, 19 nt, Human
ucuccaccugccagggaca

SEQ ID NO: 1803315 - RNA, 14 nt, Human
ucuccaccugccag

SEQ ID NO: 1803316 - RNA, 15 nt, Human
ucuccaccugccagg

SEQ ID NO: 1803317 - RNA, 16 nt, Human
ucuccaccugccaggg

SEQ ID NO: 1803318 - RNA, 13 nt, Human
ucucccccagccc

SEQ ID NO: 1803319 - RNA, 12 nt, Human
ucucccccagcc

SEQ ID NO: 1803320 - RNA, 11 nt, Human
ucuccaggcug

SEQ ID NO: 1803321 - RNA, 18 nt, Human
ucucccucagucuggccc

SEQ ID NO: 1803322 - RNA, 23 nt, Human
ucucccucagucuggcccuuccu

SEQ ID NO: 1803323 - RNA, 14 nt, Human
ucucccucccuugg

SEQ ID NO: 1803324 - RNA, 22 nt, Human
ucuccagccccuggaugcagcc

SEQ ID NO: 1803325 - RNA, 16 nt, Human
ucuccagccccuggau

SEQ ID NO: 1803326 - RNA, 18 nt, Human
ucuccagccccuggaugc

SEQ ID NO: 1803327 - RNA, 14 nt, Human
ucuccacugccuuc

SEQ ID NO: 1803328 - RNA, 12 nt, Human
ucuccagccccu

SEQ ID NO: 1803329 - RNA, 13 nt, Human
ucuccagccccug

SEQ ID NO: 1803330 - RNA, 14 nt, Human
ucuccagccccugg

SEQ ID NO: 1803331 - RNA, 15 nt, Human
ucuccagccccugga

SEQ ID NO: 1803332 - RNA, 12 nt, Human
uccuaguuccac

SEQ ID NO: 1803333 - RNA, 23 nt, Human
uccuauauuguuuucaguguaca

SEQ ID NO: 1803334 - RNA, 17 nt, Human
uccuaucagaaguuucu

SEQ ID NO: 1803335 - RNA, 18 nt, Human
uccucauuagcauuuugc

SEQ ID NO: 1803336 - RNA, 10 nt, Human
uccuccaggu

SEQ ID NO: 1803337 - RNA, 13 nt, Human
uccucccaccuca

SEQ ID NO: 1803338 - RNA, 12 nt, Human
uccucccaccuc

SEQ ID NO: 1803339 - RNA, 16 nt, Human
uccgcuuucuacccag

SEQ ID NO: 1803340 - RNA, 20 nt, Human
uccgcuuucuacccagcgag

SEQ ID NO: 1803341 - RNA, 18 nt, Human
uccgcuuucuacccagcg

SEQ ID NO: 1803342 - RNA, 20 nt, Human
uccuaagcuauucaguaaua

SEQ ID NO: 1803343 - RNA, 21 nt, Human
uccuaagcuauucaguaauaa

SEQ ID NO: 1803344 - RNA, 14 nt, Human
uccgccucuugggu

SEQ ID NO: 1803345 - RNA, 15 nt, Human
ucccuuccucuuucc

SEQ ID NO: 1803346 - RNA, 16 nt, Human
ucccuuccucuuucca

SEQ ID NO: 1803347 - RNA, 22 nt, Human
ucccuucaaccauuccccaugg

SEQ ID NO: 1803348 - RNA, 21 nt, Human
ucccccuguuucagaggcuca

SEQ ID NO: 1803349 - RNA, 15 nt, Human
ucccccuuccaugga

SEQ ID NO: 1803350 - RNA, 23 nt, Human
uccuggcacccggccccugcugg

SEQ ID NO: 1803351 - RNA, 13 nt, Human
uccuggcacugcu

SEQ ID NO: 1803352 - RNA, 16 nt, Human
uccuggcacugcuucc

SEQ ID NO: 1803353 - RNA, 12 nt, Human
uccuggccucaa

SEQ ID NO: 1803354 - RNA, 11 nt, Human
uccuguagccc

SEQ ID NO: 1803355 - RNA, 13 nt, Human
uccuguagcccua

SEQ ID NO: 1803356 - RNA, 16 nt, Human
uccugccuaaggcuga

SEQ ID NO: 1803357 - RNA, 19 nt, Human
uccugccuaaggcugaacu

SEQ ID NO: 1803358 - RNA, 14 nt, Human
uccuggaguucugg

SEQ ID NO: 1803359 - RNA, 20 nt, Human
uccugcccuuaccugccagg

SEQ ID NO: 1803360 - RNA, 11 nt, Human
uccugcccugg

SEQ ID NO: 1803361 - RNA, 12 nt, Human
uccugcccuggg

SEQ ID NO: 1803362 - RNA, 14 nt, Human
uccugcccugggag

SEQ ID NO: 1803363 - RNA, 15 nt, Human
uccugcccugggagg

SEQ ID NO: 1803364 - RNA, 21 nt, Human
uccugcccugggaggcaguga

SEQ ID NO: 1803365 - RNA, 17 nt, Human
uccugcccuuaccugcc

SEQ ID NO: 1803366 - RNA, 16 nt, Human
uccugcauuugugaaa

SEQ ID NO: 1803367 - RNA, 21 nt, Human
uccugaggcuccacuuggucu

SEQ ID NO: 1803368 - RNA, 20 nt, Human
uccugaggcuccacuugguc

SEQ ID NO: 1803369 - RNA, 19 nt, Human
uccugaggcuccacuuggu

SEQ ID NO: 1803370 - RNA, 11 nt, Human
uccugccacca

SEQ ID NO: 1803371 - RNA, 16 nt, Human
uccugccaccacgccc

SEQ ID NO: 1803372 - RNA, 13 nt, Human
uccugccaggcau

SEQ ID NO: 1803373 - RNA, 14 nt, Human
uccugccaggcaug

SEQ ID NO: 1803374 - RNA, 10 nt, Human
uccugcccug

SEQ ID NO: 1803375 - RNA, 18 nt, Human
uccugccccugagcccau

SEQ ID NO: 1803376 - RNA, 17 nt, Human
uccugccccugagccca

SEQ ID NO: 1803377 - RNA, 14 nt, Human
uccaucaggccacu

SEQ ID NO: 1803378 - RNA, 14 nt, Human
uccauagagagcaa

SEQ ID NO: 1803379 - RNA, 15 nt, Human
uccauagagagcaag

SEQ ID NO: 1803380 - RNA, 21 nt, Human
uccauaaucuggacuccucug

SEQ ID NO: 1803381 - RNA, 20 nt, Human
uccaugggccauaugaaaag

SEQ ID NO: 1803382 - RNA, 14 nt, Human
uccaugcugccucc

SEQ ID NO: 1803383 - RNA, 15 nt, Human
uccaugcugccucca

SEQ ID NO: 1803384 - RNA, 13 nt, Human
uccauggacuuug

SEQ ID NO: 1803385 - RNA, 22 nt, Human
uccauaaucuggacuccucugu

SEQ ID NO: 1803386 - RNA, 20 nt, Human
uccagguuuaagcuguuacu

SEQ ID NO: 1803387 - RNA, 22 nt, Human
uccaggggugggacacccugug

SEQ ID NO: 1803388 - RNA, 22 nt, Human
uccagcaauucuccugccucag

SEQ ID NO: 1803389 - RNA, 19 nt, Human
uccaggggugggacacccu

SEQ ID NO: 1803390 - RNA, 20 nt, Human
uccaggggugggacacccug

SEQ ID NO: 1803391 - RNA, 12 nt, Human
uccaggagcagc

SEQ ID NO: 1803392 - RNA, 13 nt, Human
uccaggagcagcc

SEQ ID NO: 1803393 - RNA, 14 nt, Human
uccaggagcagcca

SEQ ID NO: 1803394 - RNA, 15 nt, Human
uccaggagcagccac

SEQ ID NO: 1803395 - RNA, 23 nt, Human
uccagaaagaaaacuuguauuau

SEQ ID NO: 1803396 - RNA, 20 nt, Human
uccacuuucuagccagagga

SEQ ID NO: 1803397 - RNA, 21 nt, Human
uccacuuucuagccagaggag

SEQ ID NO: 1803398 - RNA, 23 nt, Human
uccacuuggucugugagaugcua

SEQ ID NO: 1803399 - RNA, 19 nt, Human
uccacuuucuagccagagg

SEQ ID NO: 1803400 - RNA, 16 nt, Human
uccaaaguacacuguu

SEQ ID NO: 1803401 - RNA, 14 nt, Human
uccaaaguacacug

SEQ ID NO: 1803402 - RNA, 21 nt, Human
uccacuuggucugugagaugc

SEQ ID NO: 1803403 - RNA, 18 nt, Human
uccccagauugcaacagg

SEQ ID NO: 1803404 - RNA, 13 nt, Human
uccccagauugca

SEQ ID NO: 1803405 - RNA, 20 nt, Human
ucccaugagccucagcaucc

SEQ ID NO: 1803406 - RNA, 22 nt, Human
uccccagcaagugagagcuggg

SEQ ID NO: 1803407 - RNA, 21 nt, Human
uccccagcaagugagagcugg

SEQ ID NO: 1803408 - RNA, 20 nt, Human
uccccagcaagugagagcug

SEQ ID NO: 1803409 - RNA, 23 nt, Human
uccccagauugcaacaggcuggg

SEQ ID NO: 1803410 - RNA, 22 nt, Human
uccccagauugcaacaggcugg

SEQ ID NO: 1803411 - RNA, 20 nt, Human
uccccagauugcaacaggcu

SEQ ID NO: 1803412 - RNA, 19 nt, Human
uccccagauugcaacaggc

SEQ ID NO: 1803413 - RNA, 22 nt, Human
ucccccagccccauccucugua

SEQ ID NO: 1803414 - RNA, 20 nt, Human
ucccccagccccauccucug

SEQ ID NO: 1803415 - RNA, 21 nt, Human
ucccccagccccauccucugu

SEQ ID NO: 1803416 - RNA, 15 nt, Human
uccccaggaggccag

SEQ ID NO: 1803417 - RNA, 16 nt, Human
uccccaggaggccagc

SEQ ID NO: 1803418 - RNA, 17 nt, Human
ucccccagccccauccu

SEQ ID NO: 1803419 - RNA, 17 nt, Human
uccccaggaggccagcc

SEQ ID NO: 1803420 - RNA, 14 nt, Human
uccccaggaggcca

SEQ ID NO: 1803421 - RNA, 18 nt, Human
ucccaccuuggcugcagg

SEQ ID NO: 1803422 - RNA, 20 nt, Human
ucccagcugugcucuggaca

SEQ ID NO: 1803423 - RNA, 17 nt, Human
ucccaccuuggcugcag

SEQ ID NO: 1803424 - RNA, 16 nt, Human
ucccaccuuggcugca

SEQ ID NO: 1803425 - RNA, 13 nt, Human
ucccaccuuggcu

SEQ ID NO: 1803426 - RNA, 20 nt, Human
uccaugugggcuaguugggc

SEQ ID NO: 1803427 - RNA, 22 nt, Human
ucccaccucucucacuccuuga

SEQ ID NO: 1803428 - RNA, 19 nt, Human
ucccaugagccucagcauc

SEQ ID NO: 1803429 - RNA, 18 nt, Human
ucccaugagccucagcau

SEQ ID NO: 1803430 - RNA, 16 nt, Human
ucccaggcgccccuuc

SEQ ID NO: 1803431 - RNA, 15 nt, Human
ucccaucuuccaagg

SEQ ID NO: 1803432 - RNA, 22 nt, Human
ucccagcugugcucuggacagg

SEQ ID NO: 1803433 - RNA, 21 nt, Human
ucccagcugugcucuggacag

SEQ ID NO: 1803434 - RNA, 23 nt, Human
ucccagcugugcucuggacaggc

SEQ ID NO: 1803435 - RNA, 24 nt, Human
ucccaggcauuccccaggaggcca

SEQ ID NO: 1803436 - RNA, 21 nt, Human
ucaggccugggggcugggcag

SEQ ID NO: 1803437 - RNA, 15 nt, Human
ucaggcucuucuccu

SEQ ID NO: 1803438 - RNA, 20 nt, Human
ucaggaucaaaccccgacca

SEQ ID NO: 1803439 - RNA, 11 nt, Human
ucaggagcccu

SEQ ID NO: 1803440 - RNA, 12 nt, Human
ucaggagcccug

SEQ ID NO: 1803441 - RNA, 14 nt, Human
ucaggagcccuggg

SEQ ID NO: 1803442 - RNA, 15 nt, Human
ucaggagcccuggga

SEQ ID NO: 1803443 - RNA, 24 nt, Human
ucagcuccagcucaccagccccag

SEQ ID NO: 1803444 - RNA, 23 nt, Human
ucagcuccagcucaccagcccca

SEQ ID NO: 1803445 - RNA, 23 nt, Human
ucagcucugcaagaauugaagca

SEQ ID NO: 1803446 - RNA, 23 nt, Human
ucaggaagcucagggccuggcuc

SEQ ID NO: 1803447 - RNA, 20 nt, Human
ucagguggggcagcuugagg

SEQ ID NO: 1803448 - RNA, 16 nt, Human
ucagucucccucccuu

SEQ ID NO: 1803449 - RNA, 23 nt, Human
ucagucugauucccaagcucugc

SEQ ID NO: 1803450 - RNA, 22 nt, Human
ucagucugauucccaagcucug

SEQ ID NO: 1803451 - RNA, 21 nt, Human
ucagucugauucccaagcucu

SEQ ID NO: 1803452 - RNA, 19 nt, Human
ucagguggggcagcuugag

SEQ ID NO: 1803453 - RNA, 18 nt, Human
ucagguggggcagcuuga

SEQ ID NO: 1803454 - RNA, 23 nt, Human
ucaggugauccacccaccucagc

SEQ ID NO: 1803455 - RNA, 16 nt, Human
ucaggugauccaccca

SEQ ID NO: 1803456 - RNA, 23 nt, Human
ucaggugagaagcagaggaagga

SEQ ID NO: 1803457 - RNA, 21 nt, Human
ucaggugaaacuccagaugcc

SEQ ID NO: 1803458 - RNA, 12 nt, Human
ucaggucccugc

SEQ ID NO: 1803459 - RNA, 16 nt, Human
ucaggcucuucuccuu

SEQ ID NO: 1803460 - RNA, 21 nt, Human
ucaggcucuucuccuuucaca

SEQ ID NO: 1803461 - RNA, 13 nt, Human
uccaaaguacacu

SEQ ID NO: 1803462 - RNA, 16 nt, Human
ucauuaggauggcuag

SEQ ID NO: 1803463 - RNA, 14 nt, Human
ucauggugcucaga

SEQ ID NO: 1803464 - RNA, 17 nt, Human
ucaucaaugaaugaaug

SEQ ID NO: 1803465 - RNA, 12 nt, Human
ucauagcagcuu

SEQ ID NO: 1803466 - RNA, 11 nt, Human
ucauagcagcu

SEQ ID NO: 1803467 - RNA, 20 nt, Human
ucaguguacauggaauaaca

SEQ ID NO: 1803468 - RNA, 17 nt, Human
ucauccacugugccaug

SEQ ID NO: 1803469 - RNA, 14 nt, Human
ucauccacugugcc

SEQ ID NO: 1803470 - RNA, 18 nt, Human
ucauccacugugccaugu

SEQ ID NO: 1803471 - RNA, 16 nt, Human
ucaucuccccaucauu

SEQ ID NO: 1803472 - RNA, 17 nt, Human
uauuauauuuacaaaug

SEQ ID NO: 1803473 - RNA, 14 nt, Human
uauuauaccuuuuu

SEQ ID NO: 1803474 - RNA, 13 nt, Human
uauuauaccuuuu

SEQ ID NO: 1803475 - RNA, 12 nt, Human
uauuauaccuuu

SEQ ID NO: 1803476 - RNA, 15 nt, Human
uauuaaguuguuaau

SEQ ID NO: 1803477 - RNA, 14 nt, Human
uauuaaggaagaca

SEQ ID NO: 1803478 - RNA, 24 nt, Human
uauuaagaaagacuaucuaaaugu

SEQ ID NO: 1803479 - RNA, 20 nt, Human
uauuauggaggcaggaguuu

SEQ ID NO: 1803480 - RNA, 14 nt, Human
uauggaggcaggag

SEQ ID NO: 1803481 - RNA, 13 nt, Human
uauguguguuuua

SEQ ID NO: 1803482 - RNA, 21 nt, Human
uauguugcccaggcaggucuu

SEQ ID NO: 1803483 - RNA, 17 nt, Human
uauguugaagccuuugu

SEQ ID NO: 1803484 - RNA, 18 nt, Human
uauguugguagauucuaa

SEQ ID NO: 1803485 - RNA, 22 nt, Human
uauguucuuaguggauguucug

SEQ ID NO: 1803486 - RNA, 17 nt, Human
uauguucuaagaaguga

SEQ ID NO: 1803487 - RNA, 16 nt, Human
uauuaagaaagacuau

SEQ ID NO: 1803488 - RNA, 15 nt, Human
uauuaaaugcccagc

SEQ ID NO: 1803489 - RNA, 17 nt, Human
uauuaaaugcccagccc

SEQ ID NO: 1803490 - RNA, 19 nt, Human
uauuaaaugcccagccccu

SEQ ID NO: 1803491 - RNA, 22 nt, Human
uauugcagcgauuaauaacagg

SEQ ID NO: 1803492 - RNA, 18 nt, Human
uauucauuguggucauag

SEQ ID NO: 1803493 - RNA, 20 nt, Human
uauugauaugcuuauacacu

SEQ ID NO: 1803494 - RNA, 15 nt, Human
uauugcccacgcugg

SEQ ID NO: 1803495 - RNA, 14 nt, Human
uauugcccacgcug

SEQ ID NO: 1803496 - RNA, 13 nt, Human
uauugcccacgcu

SEQ ID NO: 1803497 - RNA, 15 nt, Human
uauugcuugcacaaa

SEQ ID NO: 1803498 - RNA, 21 nt, Human
uauugcuugcacaaaccaauu

SEQ ID NO: 1803499 - RNA, 23 nt, Human
uauugcugauggugcaaugaccu

SEQ ID NO: 1803500 - RNA, 22 nt, Human
uauugcugauggugcaaugacc

SEQ ID NO: 1803501 - RNA, 22 nt, Human
uauuuauuaaaugcccagcccc

SEQ ID NO: 1803502 - RNA, 17 nt, Human
uauuuaugggauccugg

SEQ ID NO: 1803503 - RNA, 12 nt, Human
ucacauuuaaau

SEQ ID NO: 1803504 - RNA, 22 nt, Human
ucacauuguauucagaguugau

SEQ ID NO: 1803505 - RNA, 14 nt, Human
ucacauuuauucug

SEQ ID NO: 1803506 - RNA, 21 nt, Human
ucaccaaaucagcugcuacua

SEQ ID NO: 1803507 - RNA, 17 nt, Human
ucaccaacgucugugcc

SEQ ID NO: 1803508 - RNA, 18 nt, Human
ucaccaacgucugugcca

SEQ ID NO: 1803509 - RNA, 13 nt, Human
ucaccaagcccag

SEQ ID NO: 1803510 - RNA, 18 nt, Human
ucacccgcuaagagggag

SEQ ID NO: 1803511 - RNA, 22 nt, Human
ucaccgaaaacguggcugcuuc

SEQ ID NO: 1803512 - RNA, 23 nt, Human
ucaccgaaaacguggcugcuuca

SEQ ID NO: 1803513 - RNA, 15 nt, Human
ucaccgaaaacgugg

SEQ ID NO: 1803514 - RNA, 19 nt, Human
ucaccgaaaacguggcugc

SEQ ID NO: 1803515 - RNA, 20 nt, Human
ucaccgaaaacguggcugcu

SEQ ID NO: 1803516 - RNA, 21 nt, Human
ucaccgaaaacguggcugcuu

SEQ ID NO: 1803517 - RNA, 19 nt, Human
ucacccgcuaagagggagg

SEQ ID NO: 1803518 - RNA, 20 nt, Human
ucacccuggggcuaggaaau

SEQ ID NO: 1803519 - RNA, 12 nt, Human
ucacccuuuucu

SEQ ID NO: 1803520 - RNA, 14 nt, Human
ucaccgaaaacgug

SEQ ID NO: 1803521 - RNA, 22 nt, Human
ucacaagacccaaaaggcagaa

SEQ ID NO: 1803522 - RNA, 15 nt, Human
ucacacacuuuggcu

SEQ ID NO: 1803523 - RNA, 22 nt, Human
ucacacaugagcaucaggccag

SEQ ID NO: 1803524 - RNA, 23 nt, Human
ucacacaugagcaucaggccagg

SEQ ID NO: 1803525 - RNA, 17 nt, Human
ucacaggacucugccuc

SEQ ID NO: 1803526 - RNA, 18 nt, Human
ucacaggacucugccucc

SEQ ID NO: 1803527 - RNA, 16 nt, Human
ucacaggacucugccu

SEQ ID NO: 1803528 - RNA, 19 nt, Human
ucacaggacucugccuccu

SEQ ID NO: 1803529 - RNA, 23 nt, Human
ucacaggacucugccuccucuuc

SEQ ID NO: 1803530 - RNA, 19 nt, Human
ucacaggagggagggggaa

SEQ ID NO: 1803531 - RNA, 23 nt, Human
ucaaaccccgaccaccugcccaa

SEQ ID NO: 1803532 - RNA, 19 nt, Human
ucaaaccccgaccaccugc

SEQ ID NO: 1803533 - RNA, 20 nt, Human
ucaaaccccgaccaccugcc

SEQ ID NO: 1803534 - RNA, 12 nt, Human
ucaaagagguuu

SEQ ID NO: 1803535 - RNA, 23 nt, Human
ucaaagagguuuuaaaaaaaucc

SEQ ID NO: 1803536 - RNA, 19 nt, Human
ucaaccccuucgcuccugu

SEQ ID NO: 1803537 - RNA, 18 nt, Human
ucaaccccuucgcuccug

SEQ ID NO: 1803538 - RNA, 15 nt, Human
ucaaccuccugggcu

SEQ ID NO: 1803539 - RNA, 20 nt, Human
ucaaccccuucgcuccugug

SEQ ID NO: 1803540 - RNA, 16 nt, Human
ucaaccuccugggcua

SEQ ID NO: 1803541 - RNA, 20 nt, Human
ucaacucuccuccagaguca

SEQ ID NO: 1803542 - RNA, 24 nt, Human
ucaacugaccagccuccaugcugc

SEQ ID NO: 1803543 - RNA, 18 nt, Human
ucaacugaccagccucca

SEQ ID NO: 1803544 - RNA, 14 nt, Human
ucaacucccugccc

SEQ ID NO: 1803545 - RNA, 15 nt, Human
ucaacucccugcccc

SEQ ID NO: 1803546 - RNA, 21 nt, Human
ucaacucccugccccccagcc

SEQ ID NO: 1803547 - RNA, 22 nt, Human
ucaacucccugccccccagccc

SEQ ID NO: 1803548 - RNA, 19 nt, Human
ucaagcgauucuucugcuu

SEQ ID NO: 1803549 - RNA, 18 nt, Human
ucaagcgauucuucugcu

SEQ ID NO: 1803550 - RNA, 21 nt, Human
ucaagcgauucuucugcuuca

SEQ ID NO: 1803551 - RNA, 12 nt, Human
ucaagccaccaa

SEQ ID NO: 1803552 - RNA, 20 nt, Human
ucaagccaccaacauacucc

SEQ ID NO: 1803553 - RNA, 13 nt, Human
ucaaggauccuga

SEQ ID NO: 1803554 - RNA, 14 nt, Human
ucaaggauccugag

SEQ ID NO: 1803555 - RNA, 15 nt, Human
ucaaggauccugagc

SEQ ID NO: 1803556 - RNA, 16 nt, Human
ucaaggauccugagcc

SEQ ID NO: 1803557 - RNA, 17 nt, Human
ucaaggauccugagcca

SEQ ID NO: 1803558 - RNA, 16 nt, Human
uaggucagugcaaaua

SEQ ID NO: 1803559 - RNA, 15 nt, Human
uaggucucaauaccu

SEQ ID NO: 1803560 - RNA, 16 nt, Human
uagguaaauuacaguu

SEQ ID NO: 1803561 - RNA, 20 nt, Human
uagguauaaguggugugugu

SEQ ID NO: 1803562 - RNA, 19 nt, Human
uagggaaaaaccagcgugu

SEQ ID NO: 1803563 - RNA, 20 nt, Human
uagggaaaaaccagcgugug

SEQ ID NO: 1803564 - RNA, 21 nt, Human
uagggaaaaaccagcguguga

SEQ ID NO: 1803565 - RNA, 12 nt, Human
uaggaauugacc

SEQ ID NO: 1803566 - RNA, 16 nt, Human
uaggaauuguguuuau

SEQ ID NO: 1803567 - RNA, 18 nt, Human
uaggccaugggacaggga

SEQ ID NO: 1803568 - RNA, 16 nt, Human
uaggccaugggacagg

SEQ ID NO: 1803569 - RNA, 18 nt, Human
uaggccuggccagaugca

SEQ ID NO: 1803570 - RNA, 15 nt, Human
uaggccuggccagau

SEQ ID NO: 1803571 - RNA, 13 nt, Human
uaguguucauaaa

SEQ ID NO: 1803572 - RNA, 20 nt, Human
uaguugcaacuuuguauaaa

SEQ ID NO: 1803573 - RNA, 23 nt, Human
uaggugacagagugagacucugu

SEQ ID NO: 1803574 - RNA, 21 nt, Human
uaggugauccacucgccuuca

SEQ ID NO: 1803575 - RNA, 13 nt, Human
uaguaucaaaaga

SEQ ID NO: 1803576 - RNA, 21 nt, Human
uauaugcucugcauguuacau

SEQ ID NO: 1803577 - RNA, 23 nt, Human
uauauaaauuuuuuuuguuucau

SEQ ID NO: 1803578 - RNA, 18 nt, Human
uauacgauaaauaacuuu

SEQ ID NO: 1803579 - RNA, 15 nt, Human
uauaauucacauugu

SEQ ID NO: 1803580 - RNA, 16 nt, Human
uaugacuccagaauuu

SEQ ID NO: 1803581 - RNA, 17 nt, Human
uaugacuccagaauuuc

SEQ ID NO: 1803582 - RNA, 23 nt, Human
uaugacuccagaauuucccaaag

SEQ ID NO: 1803583 - RNA, 18 nt, Human
uaugauuuaauuugaaau

SEQ ID NO: 1803584 - RNA, 17 nt, Human
uaugauuuaauuugaaa

SEQ ID NO: 1803585 - RNA, 15 nt, Human
uaugauuuggaaaau

SEQ ID NO: 1803586 - RNA, 17 nt, Human
uaugauuuggaaaauaa

SEQ ID NO: 1803587 - RNA, 12 nt, Human
uaugauuuuuaa

SEQ ID NO: 1803588 - RNA, 18 nt, Human
uaugauuuggaaaauaaa

SEQ ID NO: 1803589 - RNA, 23 nt, Human
uaugauuuuuaaagaaaaguuuu

SEQ ID NO: 1803590 - RNA, 14 nt, Human
uaugcacacauuuu

SEQ ID NO: 1803591 - RNA, 13 nt, Human
uaugcacacauuu

SEQ ID NO: 1803592 - RNA, 18 nt, Human
uaugcaaucaaaucugcu

SEQ ID NO: 1803593 - RNA, 18 nt, Human
uaugcagagguccacaac

SEQ ID NO: 1803594 - RNA, 20 nt, Human
uaugcauauuauuuuauguu

SEQ ID NO: 1803595 - RNA, 18 nt, Human
uaugcaugaaguaauaug

SEQ ID NO: 1803596 - RNA, 13 nt, Human
uaugcaugaagua

SEQ ID NO: 1803597 - RNA, 22 nt, Human
uaugcuuauacacuuacacuuu

SEQ ID NO: 1803598 - RNA, 20 nt, Human
uaugcuuguaacuaaaauaa

SEQ ID NO: 1803599 - RNA, 18 nt, Human
uaugcuuguaacuaaaau

SEQ ID NO: 1803600 - RNA, 13 nt, Human
uauggaacacucu

SEQ ID NO: 1803601 - RNA, 16 nt, Human
uauggaacacucugag

SEQ ID NO: 1803602 - RNA, 17 nt, Human
uauggaacacucugaga

SEQ ID NO: 1803603 - RNA, 18 nt, Human
uauggaacacucugagac

SEQ ID NO: 1803604 - RNA, 17 nt, Human
uauggacaaugacccag

SEQ ID NO: 1803605 - RNA, 19 nt, Human
uauggaacacucugagacu

SEQ ID NO: 1803606 - RNA, 23 nt, Human
uaucugucauuugagcagggcuc

SEQ ID NO: 1803607 - RNA, 21 nt, Human
uaucugucauuugagcagggc

SEQ ID NO: 1803608 - RNA, 20 nt, Human
uaucugucauuugagcaggg

SEQ ID NO: 1803609 - RNA, 20 nt, Human
uaugaaguuuuuuuuauaca

SEQ ID NO: 1803610 - RNA, 18 nt, Human
uaugaauaaagacaccua

SEQ ID NO: 1803611 - RNA, 14 nt, Human
uaucuugaagacuu

SEQ ID NO: 1803612 - RNA, 15 nt, Human
uaugaauacuuugca

SEQ ID NO: 1803613 - RNA, 13 nt, Human
uaugaauacuuug

SEQ ID NO: 1803614 - RNA, 12 nt, Human
uaugaauaacau

SEQ ID NO: 1803615 - RNA, 14 nt, Human
uaugaccacacucc

SEQ ID NO: 1803616 - RNA, 19 nt, Human
uaugaccacacuccagcug

SEQ ID NO: 1803617 - RNA, 12 nt, Human
uaugacacaugc

SEQ ID NO: 1803618 - RNA, 22 nt, Human
uaugacacaugcaaggucauuu

SEQ ID NO: 1803619 - RNA, 21 nt, Human
uaucuaauauguaacaagcca

SEQ ID NO: 1803620 - RNA, 16 nt, Human
uaucgucacugcuuaa

SEQ ID NO: 1803621 - RNA, 14 nt, Human
uauccuucagccug

SEQ ID NO: 1803622 - RNA, 15 nt, Human
uauccuucagccuga

SEQ ID NO: 1803623 - RNA, 15 nt, Human
uaucguaaaauuaag

SEQ ID NO: 1803624 - RNA, 18 nt, Human
uaucguaaaauuaagaaa

SEQ ID NO: 1803625 - RNA, 16 nt, Human
uaucuaaauguugaaa

SEQ ID NO: 1803626 - RNA, 19 nt, Human
uauauguuuuaagaggcag

SEQ ID NO: 1803627 - RNA, 22 nt, Human
gugcugccauccagguucagcu

SEQ ID NO: 1803628 - RNA, 21 nt, Human
gugcugccacacuucaggcuc

SEQ ID NO: 1803629 - RNA, 11 nt, Human
gugcugcccug

SEQ ID NO: 1803630 - RNA, 12 nt, Human
gugcuuggagga

SEQ ID NO: 1803631 - RNA, 13 nt, Human
gugcuuggaggaa

SEQ ID NO: 1803632 - RNA, 15 nt, Human
gugcuuggaggaagg

SEQ ID NO: 1803633 - RNA, 18 nt, Human
gugcuuauguaugaggua

SEQ ID NO: 1803634 - RNA, 18 nt, Human
guggaaaaauagccugcc

SEQ ID NO: 1803635 - RNA, 16 nt, Human
gugcucuggacaggca

SEQ ID NO: 1803636 - RNA, 15 nt, Human
gugcucuggacaggc

SEQ ID NO: 1803637 - RNA, 22 nt, Human
gugccgagaaggaagccuccca

SEQ ID NO: 1803638 - RNA, 21 nt, Human
gugccuuggggacaagagcag

SEQ ID NO: 1803639 - RNA, 18 nt, Human
gugcucuggacaggcaug

SEQ ID NO: 1803640 - RNA, 17 nt, Human
gugcucuggacaggcau

SEQ ID NO: 1803641 - RNA, 23 nt, Human
gugcugaaugguuuucaaaauaa

SEQ ID NO: 1803642 - RNA, 19 nt, Human
gugcugaaugguuuucaaa

SEQ ID NO: 1803643 - RNA, 20 nt, Human
gugcugaaugguuuucaaaa

SEQ ID NO: 1803644 - RNA, 19 nt, Human
gugcugccauccagguuca

SEQ ID NO: 1803645 - RNA, 18 nt, Human
gugcugccauccagguuc

SEQ ID NO: 1803646 - RNA, 15 nt, Human
gugcugccauccagg

SEQ ID NO: 1803647 - RNA, 12 nt, Human
gugcugccacac

SEQ ID NO: 1803648 - RNA, 20 nt, Human
gugcugcauuuaaaagauac

SEQ ID NO: 1803649 - RNA, 19 nt, Human
gugcugcauuuaaaagaua

SEQ ID NO: 1803650 - RNA, 12 nt, Human
gugcugcauuua

SEQ ID NO: 1803651 - RNA, 12 nt, Human
gugcugagucug

SEQ ID NO: 1803652 - RNA, 16 nt, Human
gugcugagucugaagg

SEQ ID NO: 1803653 - RNA, 17 nt, Human
gugcugagucugaaggc

SEQ ID NO: 1803654 - RNA, 18 nt, Human
gugcugagucugaaggcu

SEQ ID NO: 1803655 - RNA, 19 nt, Human
gugcugagucugaaggcug

SEQ ID NO: 1803656 - RNA, 18 nt, Human
guggaugccugguggcag

SEQ ID NO: 1803657 - RNA, 16 nt, Human
guggaugccugguggc

SEQ ID NO: 1803658 - RNA, 17 nt, Human
guggaguucaucuugaa

SEQ ID NO: 1803659 - RNA, 22 nt, Human
guggaacguuuuuccuguucuu

SEQ ID NO: 1803660 - RNA, 13 nt, Human
guggacuuuuauu

SEQ ID NO: 1803661 - RNA, 20 nt, Human
guggagaagcggcuggcagc

SEQ ID NO: 1803662 - RNA, 18 nt, Human
guggagaggcccggccuc

SEQ ID NO: 1803663 - RNA, 19 nt, Human
guggcagcugcuuuugucu

SEQ ID NO: 1803664 - RNA, 13 nt, Human
guggcagcugcuu

SEQ ID NO: 1803665 - RNA, 12 nt, Human
guggcagcugcu

SEQ ID NO: 1803666 - RNA, 23 nt, Human
guggcagcugcgguccacccagg

SEQ ID NO: 1803667 - RNA, 22 nt, Human
guggcagcugcgguccacccag

SEQ ID NO: 1803668 - RNA, 21 nt, Human
guggcagcugcgguccaccca

SEQ ID NO: 1803669 - RNA, 20 nt, Human
guggaugccugguggcagcu

SEQ ID NO: 1803670 - RNA, 19 nt, Human
guggcagcugcgguccacc

SEQ ID NO: 1803671 - RNA, 17 nt, Human
guggcagugggagcugc

SEQ ID NO: 1803672 - RNA, 16 nt, Human
guggcagugggagcug

SEQ ID NO: 1803673 - RNA, 15 nt, Human
guggcagugggagcu

SEQ ID NO: 1803674 - RNA, 11 nt, Human
guggcagucug

SEQ ID NO: 1803675 - RNA, 21 nt, Human
guggcagugggagcugccugu

SEQ ID NO: 1803676 - RNA, 19 nt, Human
guggcagugggagcugccu

SEQ ID NO: 1803677 - RNA, 14 nt, Human
guggccaaguucuu

SEQ ID NO: 1803678 - RNA, 21 nt, Human
guggccacuccagaccccugg

SEQ ID NO: 1803679 - RNA, 14 nt, Human
gugagcuacaaaug

SEQ ID NO: 1803680 - RNA, 14 nt, Human
gugagccacugcac

SEQ ID NO: 1803681 - RNA, 22 nt, Human
gugagccaccgugccuggccac

SEQ ID NO: 1803682 - RNA, 16 nt, Human
gugagcuccuaagcca

SEQ ID NO: 1803683 - RNA, 11 nt, Human
gugaggaagcc

SEQ ID NO: 1803684 - RNA, 16 nt, Human
gugaggaagccgcugg

SEQ ID NO: 1803685 - RNA, 19 nt, Human
gugaggaagccgcuggggc

SEQ ID NO: 1803686 - RNA, 13 nt, Human
gugagccacugca

SEQ ID NO: 1803687 - RNA, 17 nt, Human
gugagccaccgugccug

SEQ ID NO: 1803688 - RNA, 21 nt, Human
gugagccaccgugccuggcca

SEQ ID NO: 1803689 - RNA, 16 nt, Human
gugagccaccacgccc

SEQ ID NO: 1803690 - RNA, 15 nt, Human
gugagccaccgugcc

SEQ ID NO: 1803691 - RNA, 15 nt, Human
gugagccaccacgcc

SEQ ID NO: 1803692 - RNA, 17 nt, Human
gugacugaucucucgug

SEQ ID NO: 1803693 - RNA, 17 nt, Human
gugagcaggcugugagu

SEQ ID NO: 1803694 - RNA, 16 nt, Human
gugacaacacuugugu

SEQ ID NO: 1803695 - RNA, 16 nt, Human
gugaccucagcuuuga

SEQ ID NO: 1803696 - RNA, 15 nt, Human
gugacugaauuucuu

SEQ ID NO: 1803697 - RNA, 18 nt, Human
gugacugaauuucuuuug

SEQ ID NO: 1803698 - RNA, 16 nt, Human
gugacugaauuucuuu

SEQ ID NO: 1803699 - RNA, 19 nt, Human
gugaaagaaaauaacaaua

SEQ ID NO: 1803700 - RNA, 12 nt, Human
gugaaacuggau

SEQ ID NO: 1803701 - RNA, 16 nt, Human
gugaaaaugugugugu

SEQ ID NO: 1803702 - RNA, 12 nt, Human
gugaaaagaaua

SEQ ID NO: 1803703 - RNA, 14 nt, Human
gugaaaagaaaaau

SEQ ID NO: 1803704 - RNA, 23 nt, Human
gugaaaagaaaaaugagccuggc

SEQ ID NO: 1803705 - RNA, 18 nt, Human
gugaaauuauucauaauu

SEQ ID NO: 1803706 - RNA, 20 nt, Human
gugaaauuauucauaauuau

SEQ ID NO: 1803707 - RNA, 13 nt, Human
gugaaaucauuca

SEQ ID NO: 1803708 - RNA, 19 nt, Human
gugaaaggaaagagggagg

SEQ ID NO: 1803709 - RNA, 16 nt, Human
gugaaucacguaaagc

SEQ ID NO: 1803710 - RNA, 18 nt, Human
gugaaucacguaaagcua

SEQ ID NO: 1803711 - RNA, 14 nt, Human
gugaaucagagcac

SEQ ID NO: 1803712 - RNA, 19 nt, Human
gugcauaaguuaacuucca

SEQ ID NO: 1803713 - RNA, 22 nt, Human
gugcaaaguucccuacuuccug

SEQ ID NO: 1803714 - RNA, 22 nt, Human
gugccagguuuuuggucugacc

SEQ ID NO: 1803715 - RNA, 20 nt, Human
gugccagguuuuuggucuga

SEQ ID NO: 1803716 - RNA, 18 nt, Human
gugcaugcagcaucuaag

SEQ ID NO: 1803717 - RNA, 18 nt, Human
gugcaucucagcccacau

SEQ ID NO: 1803718 - RNA, 15 nt, Human
gugcaucucagccca

SEQ ID NO: 1803719 - RNA, 21 nt, Human
gugcauaccacuuuuguucuu

SEQ ID NO: 1803720 - RNA, 14 nt, Human
gugcauaccacuuu

SEQ ID NO: 1803721 - RNA, 13 nt, Human
gugcauaccacuu

SEQ ID NO: 1803722 - RNA, 20 nt, Human
gugcccacaggaucagucug

SEQ ID NO: 1803723 - RNA, 23 nt, Human
gugcccaagaauagaugcugacu

SEQ ID NO: 1803724 - RNA, 20 nt, Human
gugauccacccaccucagcc

SEQ ID NO: 1803725 - RNA, 18 nt, Human
gugauccacccaccucag

SEQ ID NO: 1803726 - RNA, 15 nt, Human
gugauccacccaccu

SEQ ID NO: 1803727 - RNA, 13 nt, Human
gugaggccagaga

SEQ ID NO: 1803728 - RNA, 23 nt, Human
gugaggauuaaauaauguaaaua

SEQ ID NO: 1803729 - RNA, 11 nt, Human
gugaggccaga

SEQ ID NO: 1803730 - RNA, 18 nt, Human
gugauccucccaccucag

SEQ ID NO: 1803731 - RNA, 15 nt, Human
gugauccucccaccu

SEQ ID NO: 1803732 - RNA, 14 nt, Human
gugauccucccacc

SEQ ID NO: 1803733 - RNA, 14 nt, Human
gugauccacucgcc

SEQ ID NO: 1803734 - RNA, 22 nt, Human
gugauccucccaccucagccuc

SEQ ID NO: 1803735 - RNA, 20 nt, Human
gugauccucccaccucagcc

SEQ ID NO: 1803736 - RNA, 23 nt, Human
gugauccucccaccucagccucc

SEQ ID NO: 1803737 - RNA, 20 nt, Human
gugauucacagugugaaucu

SEQ ID NO: 1803738 - RNA, 23 nt, Human
gugauucuccugccucagccucc

SEQ ID NO: 1803739 - RNA, 13 nt, Human
gugauucuccugc

SEQ ID NO: 1803740 - RNA, 16 nt, Human
gugauuuugcuguaga

SEQ ID NO: 1803741 - RNA, 22 nt, Human
gugauucuccugccucagccuc

SEQ ID NO: 1803742 - RNA, 20 nt, Human
gugauucuccugccucagcc

SEQ ID NO: 1803743 - RNA, 19 nt, Human
gugauucuccugccucagc

SEQ ID NO: 1803744 - RNA, 18 nt, Human
gugauucuccugccucag

SEQ ID NO: 1803745 - RNA, 17 nt, Human
gugauucuccugccuca

SEQ ID NO: 1803746 - RNA, 16 nt, Human
gugauucuccugccuc

SEQ ID NO: 1803747 - RNA, 14 nt, Human
gugauucuccugcc

SEQ ID NO: 1803748 - RNA, 20 nt, Human
gugauucucaugccucagcc

SEQ ID NO: 1803749 - RNA, 23 nt, Human
gucguuaaaaacagauuuggaaa

SEQ ID NO: 1803750 - RNA, 15 nt, Human
guccuuaccagcaga

SEQ ID NO: 1803751 - RNA, 16 nt, Human
guccuuaccagcagag

SEQ ID NO: 1803752 - RNA, 17 nt, Human
guccuuaccagcagagc

SEQ ID NO: 1803753 - RNA, 15 nt, Human
gucuacacugugcug

SEQ ID NO: 1803754 - RNA, 23 nt, Human
gucucacuguugcccaggcuggc

SEQ ID NO: 1803755 - RNA, 22 nt, Human
gucucacuguugcccaggcugg

SEQ ID NO: 1803756 - RNA, 21 nt, Human
gucucacuguugcccaggcug

SEQ ID NO: 1803757 - RNA, 20 nt, Human
gucucacuguugcccaggcu

SEQ ID NO: 1803758 - RNA, 19 nt, Human
gucucacuguugcccaggc

SEQ ID NO: 1803759 - RNA, 18 nt, Human
gucucacuguugcccagg

SEQ ID NO: 1803760 - RNA, 17 nt, Human
gucucacuguugcccag

SEQ ID NO: 1803761 - RNA, 16 nt, Human
gucucacuguugccca

SEQ ID NO: 1803762 - RNA, 23 nt, Human
gucucacuauguugcccaggcag

SEQ ID NO: 1803763 - RNA, 13 nt, Human
gucucacuguugc

SEQ ID NO: 1803764 - RNA, 21 nt, Human
gucucacuauguugcccaggc

SEQ ID NO: 1803765 - RNA, 20 nt, Human
gucucacuauguugcccagg

SEQ ID NO: 1803766 - RNA, 21 nt, Human
gucugaggaauccagacccgg

SEQ ID NO: 1803767 - RNA, 19 nt, Human
gucugauucccaagcucug

SEQ ID NO: 1803768 - RNA, 18 nt, Human
gucugauucccaagcucu

SEQ ID NO: 1803769 - RNA, 17 nt, Human
gucugauucccaagcuc

SEQ ID NO: 1803770 - RNA, 21 nt, Human
gucugauucccaagcucugcu

SEQ ID NO: 1803771 - RNA, 20 nt, Human
gucugauucccaagcucugc

SEQ ID NO: 1803772 - RNA, 19 nt, Human
gucugaggaauccagaccc

SEQ ID NO: 1803773 - RNA, 18 nt, Human
gucugaggaauccagacc

SEQ ID NO: 1803774 - RNA, 15 nt, Human
gucugacccacugcu

SEQ ID NO: 1803775 - RNA, 17 nt, Human
gucucuucuccacugga

SEQ ID NO: 1803776 - RNA, 14 nt, Human
gucugacccacugc

SEQ ID NO: 1803777 - RNA, 13 nt, Human
gucugacccacug

SEQ ID NO: 1803778 - RNA, 15 nt, Human
gucucuucuccacug

SEQ ID NO: 1803779 - RNA, 16 nt, Human
gucucuucuccacugg

SEQ ID NO: 1803780 - RNA, 14 nt, Human
gucucuucuccacu

SEQ ID NO: 1803781 - RNA, 13 nt, Human
gucucgugguagg

SEQ ID NO: 1803782 - RNA, 12 nt, Human
gucccagugccg

SEQ ID NO: 1803783 - RNA, 13 nt, Human
guccuacucugug

SEQ ID NO: 1803784 - RNA, 17 nt, Human
gucccugguggcagcuc

SEQ ID NO: 1803785 - RNA, 16 nt, Human
gucccugguggcagcu

SEQ ID NO: 1803786 - RNA, 23 nt, Human
guccuacucugugucaggugggg

SEQ ID NO: 1803787 - RNA, 15 nt, Human
guccuacucuguguc

SEQ ID NO: 1803788 - RNA, 23 nt, Human
guccuagaaauuccccacccuga

SEQ ID NO: 1803789 - RNA, 18 nt, Human
guccugggagugagcugg

SEQ ID NO: 1803790 - RNA, 17 nt, Human
guccugggagugagcug

SEQ ID NO: 1803791 - RNA, 19 nt, Human
guccugggagugagcuggu

SEQ ID NO: 1803792 - RNA, 19 nt, Human
guccuggggaaccugaccc

SEQ ID NO: 1803793 - RNA, 20 nt, Human
guccuggggaaccugacccc

SEQ ID NO: 1803794 - RNA, 17 nt, Human
guccuggcaugggaaug

SEQ ID NO: 1803795 - RNA, 16 nt, Human
guccugggagugagcu

SEQ ID NO: 1803796 - RNA, 15 nt, Human
guccugggagugagc

SEQ ID NO: 1803797 - RNA, 23 nt, Human
guccucccaucucacacaugagc

SEQ ID NO: 1803798 - RNA, 12 nt, Human
guccucccaucu

SEQ ID NO: 1803799 - RNA, 13 nt, Human
guccucccaucuc

SEQ ID NO: 1803800 - RNA, 14 nt, Human
guccucccaucuca

SEQ ID NO: 1803801 - RNA, 21 nt, Human
gucaagaauagcauuguaaaa

SEQ ID NO: 1803802 - RNA, 19 nt, Human
gucaagugaaaaaggagga

SEQ ID NO: 1803803 - RNA, 16 nt, Human
gucaagugaaaaagga

SEQ ID NO: 1803804 - RNA, 18 nt, Human
gucaagugaaaaaggagg

SEQ ID NO: 1803805 - RNA, 19 nt, Human
gucaagagggucugaggaa

SEQ ID NO: 1803806 - RNA, 18 nt, Human
gucaagagggucugagga

SEQ ID NO: 1803807 - RNA, 20 nt, Human
gucaccugaagacucauucu

SEQ ID NO: 1803808 - RNA, 13 nt, Human
gucaccccggcca

SEQ ID NO: 1803809 - RNA, 15 nt, Human
gucaccccggccacc

SEQ ID NO: 1803810 - RNA, 16 nt, Human
gucaauuacaggaagu

SEQ ID NO: 1803811 - RNA, 13 nt, Human
gucaauuacagga

SEQ ID NO: 1803812 - RNA, 15 nt, Human
gucaauuacaggaag

SEQ ID NO: 1803813 - RNA, 19 nt, Human
guauuuauuuaguauuuau

SEQ ID NO: 1803814 - RNA, 14 nt, Human
guauuauaccuuuu

SEQ ID NO: 1803815 - RNA, 15 nt, Human
guauuauguguguuu

SEQ ID NO: 1803816 - RNA, 15 nt, Human
guauuacuucugcua

SEQ ID NO: 1803817 - RNA, 14 nt, Human
guauuacuucugcu

SEQ ID NO: 1803818 - RNA, 13 nt, Human
guauuacuucugc

SEQ ID NO: 1803819 - RNA, 15 nt, Human
guagagugggagcug

SEQ ID NO: 1803820 - RNA, 13 nt, Human
guagagugggagc

SEQ ID NO: 1803821 - RNA, 15 nt, Human
gucccacucagucca

SEQ ID NO: 1803822 - RNA, 14 nt, Human
gucccacucagucc

SEQ ID NO: 1803823 - RNA, 17 nt, Human
gucccagauacuugggg

SEQ ID NO: 1803824 - RNA, 16 nt, Human
guccacccaggagccc

SEQ ID NO: 1803825 - RNA, 15 nt, Human
guccacccaggagcc

SEQ ID NO: 1803826 - RNA, 14 nt, Human
guccacccaggagc

SEQ ID NO: 1803827 - RNA, 21 nt, Human
gucauauaagauucauauuua

SEQ ID NO: 1803828 - RNA, 16 nt, Human
gucaucucagcuggau

SEQ ID NO: 1803829 - RNA, 22 nt, Human
gucauaacuagaacugaauuuu

SEQ ID NO: 1803830 - RNA, 17 nt, Human
gucauaacuagaacuga

SEQ ID NO: 1803831 - RNA, 17 nt, Human
ggggaucacagccucug

SEQ ID NO: 1803832 - RNA, 22 nt, Human
gggcuuggggaccagagcugcc

SEQ ID NO: 1803833 - RNA, 21 nt, Human
gggcuuggggaccagagcugc

SEQ ID NO: 1803834 - RNA, 13 nt, Human
ggggaguggccac

SEQ ID NO: 1803835 - RNA, 18 nt, Human
gggcuucaguggcagcug

SEQ ID NO: 1803836 - RNA, 17 nt, Human
gggcuucaguggcagcu

SEQ ID NO: 1803837 - RNA, 16 nt, Human
gggcuucaguggcagc

SEQ ID NO: 1803838 - RNA, 15 nt, Human
gggcuucaguggcag

SEQ ID NO: 1803839 - RNA, 20 nt, Human
gggcuucaguggcagcugcu

SEQ ID NO: 1803840 - RNA, 19 nt, Human
gggcuucaguggcagcugc

SEQ ID NO: 1803841 - RNA, 19 nt, Human
gggcuucauccuccucaga

SEQ ID NO: 1803842 - RNA, 20 nt, Human
gggcuucauccuccucagau

SEQ ID NO: 1803843 - RNA, 20 nt, Human
gggcuuggggaccagagcug

SEQ ID NO: 1803844 - RNA, 23 nt, Human
ggguacuuguggacacagcucuu

SEQ ID NO: 1803845 - RNA, 23 nt, Human
ggguagagcggagaaaggaaggg

SEQ ID NO: 1803846 - RNA, 22 nt, Human
ggguacuuguggacacagcucu

SEQ ID NO: 1803847 - RNA, 19 nt, Human
ggguacuuguggacacagc

SEQ ID NO: 1803848 - RNA, 15 nt, Human
ggguacccacugcuc

SEQ ID NO: 1803849 - RNA, 13 nt, Human
ggguacccacugc

SEQ ID NO: 1803850 - RNA, 18 nt, Human
ggguacccacugcucugg

SEQ ID NO: 1803851 - RNA, 20 nt, Human
gggguucuuucuuccucugc

SEQ ID NO: 1803852 - RNA, 22 nt, Human
gggguucuuucuuccucugcug

SEQ ID NO: 1803853 - RNA, 23 nt, Human
gggguucccuuuuuuggcugcug

SEQ ID NO: 1803854 - RNA, 13 nt, Human
ggggcugggacau

SEQ ID NO: 1803855 - RNA, 16 nt, Human
ggggcugggcagagga

SEQ ID NO: 1803856 - RNA, 17 nt, Human
ggggcugggcagaggaa

SEQ ID NO: 1803857 - RNA, 14 nt, Human
ggggcugccagggg

SEQ ID NO: 1803858 - RNA, 20 nt, Human
ggcucccacaggcccuuccu

SEQ ID NO: 1803859 - RNA, 21 nt, Human
ggcucccacaggcccuuccuc

SEQ ID NO: 1803860 - RNA, 12 nt, Human
gggccuggcuca

SEQ ID NO: 1803861 - RNA, 10 nt, Human
gggccuggca

SEQ ID NO: 1803862 - RNA, 22 nt, Human
gggccuggcagccgugccuuca

SEQ ID NO: 1803863 - RNA, 12 nt, Human
gggccuggccug

SEQ ID NO: 1803864 - RNA, 18 nt, Human
gggccuggucguuuucaa

SEQ ID NO: 1803865 - RNA, 14 nt, Human
gggccuggcucagg

SEQ ID NO: 1803866 - RNA, 16 nt, Human
gggccuggcucaggug

SEQ ID NO: 1803867 - RNA, 13 nt, Human
gggcucccuuccc

SEQ ID NO: 1803868 - RNA, 16 nt, Human
gggcgcgguggcucac

SEQ ID NO: 1803869 - RNA, 14 nt, Human
gggcucccuuccca

SEQ ID NO: 1803870 - RNA, 17 nt, Human
gggcucccuucccaccu

SEQ ID NO: 1803871 - RNA, 18 nt, Human
gggcucccuucccaccuc

SEQ ID NO: 1803872 - RNA, 23 nt, Human
gggcucccuucccaccucucuca

SEQ ID NO: 1803873 - RNA, 16 nt, Human
gggcugaggugggagg

SEQ ID NO: 1803874 - RNA, 14 nt, Human
gggcugcaccggcu

SEQ ID NO: 1803875 - RNA, 14 nt, Human
gggcuucaguggca

SEQ ID NO: 1803876 - RNA, 13 nt, Human
gggcucugccucc

SEQ ID NO: 1803877 - RNA, 15 nt, Human
gggcucugccuccca

SEQ ID NO: 1803878 - RNA, 16 nt, Human
gggcucugccucccau

SEQ ID NO: 1803879 - RNA, 17 nt, Human
gggcucugccucccauc

SEQ ID NO: 1803880 - RNA, 20 nt, Human
gggcucugccucccaucacc

SEQ ID NO: 1803881 - RNA, 21 nt, Human
gguacuuguggacacagcucu

SEQ ID NO: 1803882 - RNA, 22 nt, Human
gguacuuguggacacagcucuu

SEQ ID NO: 1803883 - RNA, 15 nt, Human
ggguugggcuggugu

SEQ ID NO: 1803884 - RNA, 17 nt, Human
gguacccacugcucugg

SEQ ID NO: 1803885 - RNA, 20 nt, Human
ggguuucaccauguuggcca

SEQ ID NO: 1803886 - RNA, 19 nt, Human
ggguuggccccugcccggc

SEQ ID NO: 1803887 - RNA, 14 nt, Human
ggguucuuucuucc

SEQ ID NO: 1803888 - RNA, 16 nt, Human
ggguuggccccugccc

SEQ ID NO: 1803889 - RNA, 23 nt, Human
ggguucccuuuuuuggcugcuga

SEQ ID NO: 1803890 - RNA, 22 nt, Human
ggguucuacccaggugcuagga

SEQ ID NO: 1803891 - RNA, 17 nt, Human
ggguucuacccaggugc

SEQ ID NO: 1803892 - RNA, 22 nt, Human
ggguuccagcaauucuccugcc

SEQ ID NO: 1803893 - RNA, 19 nt, Human
gggugcugggccccugccu

SEQ ID NO: 1803894 - RNA, 16 nt, Human
ggucagagccugcagu

SEQ ID NO: 1803895 - RNA, 15 nt, Human
ggucagagccugcag

SEQ ID NO: 1803896 - RNA, 14 nt, Human
ggucagagccugca

SEQ ID NO: 1803897 - RNA, 13 nt, Human
ggucagagccugc

SEQ ID NO: 1803898 - RNA, 12 nt, Human
ggucagagccug

SEQ ID NO: 1803899 - RNA, 22 nt, Human
ggucacucuggcagcucagaga

SEQ ID NO: 1803900 - RNA, 16 nt, Human
ggucacucuggcagcu

SEQ ID NO: 1803901 - RNA, 20 nt, Human
ggucacucuggcagcucaga

SEQ ID NO: 1803902 - RNA, 13 nt, Human
ggucccccuucca

SEQ ID NO: 1803903 - RNA, 18 nt, Human
ggucccccuuccauggac

SEQ ID NO: 1803904 - RNA, 23 nt, Human
ggucccccuuccauggacuuugu

SEQ ID NO: 1803905 - RNA, 14 nt, Human
ggucccacucaguc

SEQ ID NO: 1803906 - RNA, 12 nt, Human
ggucccacucag

SEQ ID NO: 1803907 - RNA, 22 nt, Human
ggucccacucaguccauagcag

SEQ ID NO: 1803908 - RNA, 22 nt, Human
ggucccaccccacacacgccag

SEQ ID NO: 1803909 - RNA, 13 nt, Human
gguggcagcugcg

SEQ ID NO: 1803910 - RNA, 12 nt, Human
gguggcagcugc

SEQ ID NO: 1803911 - RNA, 11 nt, Human
gguggcagcug

SEQ ID NO: 1803912 - RNA, 13 nt, Human
gguggcagcucac

SEQ ID NO: 1803913 - RNA, 23 nt, Human
gguggcagcugcgguccacccag

SEQ ID NO: 1803914 - RNA, 15 nt, Human
gguggcagcugcggu

SEQ ID NO: 1803915 - RNA, 16 nt, Human
gguggcagugggagcu

SEQ ID NO: 1803916 - RNA, 23 nt, Human
ggugcuaucucccccagccccau

SEQ ID NO: 1803917 - RNA, 22 nt, Human
ggugcuaucucccccagcccca

SEQ ID NO: 1803918 - RNA, 22 nt, Human
ggugauagguauaaguggugug

SEQ ID NO: 1803919 - RNA, 21 nt, Human
ggugaccucugccugaaguca

SEQ ID NO: 1803920 - RNA, 16 nt, Human
ggugaccucugccuga

SEQ ID NO: 1803921 - RNA, 14 nt, Human
ggugaccucugccu

SEQ ID NO: 1803922 - RNA, 21 nt, Human
ggugacagagugagacucugu

SEQ ID NO: 1803923 - RNA, 18 nt, Human
ggugaagugaagacaaug

SEQ ID NO: 1803924 - RNA, 19 nt, Human
ggucugaggaauccagacc

SEQ ID NO: 1803925 - RNA, 14 nt, Human
ggugaacauugcaa

SEQ ID NO: 1803926 - RNA, 16 nt, Human
ggugaacuugguuccc

SEQ ID NO: 1803927 - RNA, 16 nt, Human
ggucugacccacugcu

SEQ ID NO: 1803928 - RNA, 15 nt, Human
ggucugacccacugc

SEQ ID NO: 1803929 - RNA, 19 nt, Human
ggucucgaacuccugaccu

SEQ ID NO: 1803930 - RNA, 20 nt, Human
ggucucgaacuccugaccuu

SEQ ID NO: 1803931 - RNA, 16 nt, Human
ggucucacucugucgc

SEQ ID NO: 1803932 - RNA, 12 nt, Human
ggucucacucug

SEQ ID NO: 1803933 - RNA, 22 nt, Human
ggucucacuauguugcccaggc

SEQ ID NO: 1803934 - RNA, 23 nt, Human
gguccuagaaauuccccacccug

SEQ ID NO: 1803935 - RNA, 22 nt, Human
ggucccugguggcagcucaccu

SEQ ID NO: 1803936 - RNA, 18 nt, Human
ggucccuaauaaagcugu

SEQ ID NO: 1803937 - RNA, 14 nt, Human
ggucccugguggca

SEQ ID NO: 1803938 - RNA, 12 nt, Human
ggucccuaauaa

SEQ ID NO: 1803939 - RNA, 13 nt, Human
ggucccuaauaaa

SEQ ID NO: 1803940 - RNA, 16 nt, Human
ggucccuaauaaagcu

SEQ ID NO: 1803941 - RNA, 17 nt, Human
ggucccuaauaaagcug

SEQ ID NO: 1803942 - RNA, 23 nt, Human
gguuuugccauguuggccaggcu

SEQ ID NO: 1803943 - RNA, 15 nt, Human
gguuuucuguucuuu

SEQ ID NO: 1803944 - RNA, 13 nt, Human
gguuuucuguucu

SEQ ID NO: 1803945 - RNA, 12 nt, Human
gguuuucuguuc

SEQ ID NO: 1803946 - RNA, 13 nt, Human
guaaaaauaaaau

SEQ ID NO: 1803947 - RNA, 14 nt, Human
guaaaaauaaaauu

SEQ ID NO: 1803948 - RNA, 18 nt, Human
guaaaaacaaagaaauua

SEQ ID NO: 1803949 - RNA, 20 nt, Human
guaaaaacaaagaaauuaug

SEQ ID NO: 1803950 - RNA, 15 nt, Human
guaaaagacuuuuuu

SEQ ID NO: 1803951 - RNA, 21 nt, Human
gguucaagcgauucuucugcu

SEQ ID NO: 1803952 - RNA, 17 nt, Human
gguggccucccaacuca

SEQ ID NO: 1803953 - RNA, 13 nt, Human
gguggccucccaa

SEQ ID NO: 1803954 - RNA, 16 nt, Human
gguggcccgacagccu

SEQ ID NO: 1803955 - RNA, 17 nt, Human
gguggcccgacagccug

SEQ ID NO: 1803956 - RNA, 18 nt, Human
gguggcccgacagccugg

SEQ ID NO: 1803957 - RNA, 19 nt, Human
gguggcccgacagccuggc

SEQ ID NO: 1803958 - RNA, 20 nt, Human
gguggcccgacagccuggca

SEQ ID NO: 1803959 - RNA, 14 nt, Human
gguugaagcaccaa

SEQ ID NO: 1803960 - RNA, 18 nt, Human
gguucuuucuuccucugc

SEQ ID NO: 1803961 - RNA, 12 nt, Human
gguucagcuugu

SEQ ID NO: 1803962 - RNA, 17 nt, Human
gguucuuucuuccucug

SEQ ID NO: 1803963 - RNA, 23 nt, Human
gguucaagcgauucuucugcuuc

SEQ ID NO: 1803964 - RNA, 22 nt, Human
gguucaagcgauucuucugcuu

SEQ ID NO: 1803965 - RNA, 20 nt, Human
gguucacugcaaccuccgcc

SEQ ID NO: 1803966 - RNA, 13 nt, Human
gguuggugggggc

SEQ ID NO: 1803967 - RNA, 13 nt, Human
gguuuaagcuguu

SEQ ID NO: 1803968 - RNA, 18 nt, Human
gguuggcaaaaaggcagg

SEQ ID NO: 1803969 - RNA, 14 nt, Human
gguugggcuggugu

SEQ ID NO: 1803970 - RNA, 16 nt, Human
guaaaagcauuuugua

SEQ ID NO: 1803971 - RNA, 20 nt, Human
guaaaugggggugcauuuga

SEQ ID NO: 1803972 - RNA, 19 nt, Human
guaaaugggggugcauuug

SEQ ID NO: 1803973 - RNA, 18 nt, Human
guaaaugggggugcauuu

SEQ ID NO: 1803974 - RNA, 22 nt, Human
guaaauuaacuuuuauaaacuu

SEQ ID NO: 1803975 - RNA, 21 nt, Human
guaaauuaacuuuuauaaacu

SEQ ID NO: 1803976 - RNA, 17 nt, Human
guaaauuaacuuuuaua

SEQ ID NO: 1803977 - RNA, 16 nt, Human
guaaauuaacuuuuau

SEQ ID NO: 1803978 - RNA, 15 nt, Human
guaaauuaacuuuua

SEQ ID NO: 1803979 - RNA, 16 nt, Human
guaaaugguaugucau

SEQ ID NO: 1803980 - RNA, 18 nt, Human
guaaggaauaccuguccc

SEQ ID NO: 1803981 - RNA, 20 nt, Human
guaaggaauaccuguccccc

SEQ ID NO: 1803982 - RNA, 21 nt, Human
guaaggaauaccugucccccu

SEQ ID NO: 1803983 - RNA, 23 nt, Human
guaaggaauaccugucccccuga

SEQ ID NO: 1803984 - RNA, 13 nt, Human
guaaggaaugauu

SEQ ID NO: 1803985 - RNA, 22 nt, Human
guaaguauucuuauuuaaugaa

SEQ ID NO: 1803986 - RNA, 23 nt, Human
guaaauuaacuuuuauaaacuuu

SEQ ID NO: 1803987 - RNA, 16 nt, Human
guaagaaauacagacu

SEQ ID NO: 1803988 - RNA, 13 nt, Human
guaagaaauacag

SEQ ID NO: 1803989 - RNA, 19 nt, Human
guaagaucguucucugccu

SEQ ID NO: 1803990 - RNA, 15 nt, Human
guacccacugcucug

SEQ ID NO: 1803991 - RNA, 13 nt, Human
guacaguuuuuau

SEQ ID NO: 1803992 - RNA, 12 nt, Human
guacaguuuuua

SEQ ID NO: 1803993 - RNA, 20 nt, Human
guacauaaugcgugcauacc

SEQ ID NO: 1803994 - RNA, 14 nt, Human
guacagucuuguau

SEQ ID NO: 1803995 - RNA, 13 nt, Human
guacagucuugua

SEQ ID NO: 1803996 - RNA, 16 nt, Human
guacagucuuguauua

SEQ ID NO: 1803997 - RNA, 16 nt, Human
guacagacaacaaacc

SEQ ID NO: 1803998 - RNA, 15 nt, Human
guacagacagaaaaa

SEQ ID NO: 1803999 - RNA, 21 nt, Human
guacacuguuucaaacuuuac

SEQ ID NO: 1804000 - RNA, 20 nt, Human
guacacuguuucaaacuuua

SEQ ID NO: 1804001 - RNA, 19 nt, Human
guacacuguuucaaacuuu

SEQ ID NO: 1804002 - RNA, 12 nt, Human
guacagagccca

SEQ ID NO: 1804003 - RNA, 18 nt, Human
guacagagcccacgcccc

SEQ ID NO: 1804004 - RNA, 22 nt, Human
guacagagcccacgcccccacu

SEQ ID NO: 1804005 - RNA, 20 nt, Human
guacagcaaggagauuuaca

SEQ ID NO: 1804006 - RNA, 18 nt, Human
guaaugaugucguuugaa

SEQ ID NO: 1804007 - RNA, 19 nt, Human
guaauguaucaaauacauu

SEQ ID NO: 1804008 - RNA, 15 nt, Human
guaaucguguccccu

SEQ ID NO: 1804009 - RNA, 11 nt, Human
guaaugaaaac

SEQ ID NO: 1804010 - RNA, 13 nt, Human
guaaugaaaacca

SEQ ID NO: 1804011 - RNA, 21 nt, Human
guaauuaaguacuauguauca

SEQ ID NO: 1804012 - RNA, 14 nt, Human
guaauuaaguacua

SEQ ID NO: 1804013 - RNA, 17 nt, Human
guaauuaaguacuaugu

SEQ ID NO: 1804014 - RNA, 20 nt, Human
guaauuaaguacuauguauc

SEQ ID NO: 1804015 - RNA, 18 nt, Human
guacacuguuucaaacuu

SEQ ID NO: 1804016 - RNA, 23 nt, Human
guacuuuauuuucuauaauuuaa

SEQ ID NO: 1804017 - RNA, 21 nt, Human
guacuuguggacacagcucuu

SEQ ID NO: 1804018 - RNA, 22 nt, Human
guacuuucauauuuuaaacaga

SEQ ID NO: 1804019 - RNA, 20 nt, Human
guagaaaagggaacugaaca

SEQ ID NO: 1804020 - RNA, 16 nt, Human
guagagcggagaaagg

SEQ ID NO: 1804021 - RNA, 15 nt, Human
guagaggagaaacug

SEQ ID NO: 1804022 - RNA, 19 nt, Human
guacuucuccacccugcuc

SEQ ID NO: 1804023 - RNA, 18 nt, Human
guacuucuccacccugcu

SEQ ID NO: 1804024 - RNA, 17 nt, Human
guacuucuccacccugc

SEQ ID NO: 1804025 - RNA, 16 nt, Human
guacuucuccacccug

SEQ ID NO: 1804026 - RNA, 21 nt, Human
guacuucuccacccugcucuc

SEQ ID NO: 1804027 - RNA, 20 nt, Human
guacuucuccacccugcucu

SEQ ID NO: 1804028 - RNA, 14 nt, Human
guacuugcucuuga

SEQ ID NO: 1804029 - RNA, 20 nt, Human
guacuuguggacacagcucu

SEQ ID NO: 1804030 - RNA, 16 nt, Human
guacuuguggacacag

SEQ ID NO: 1804031 - RNA, 22 nt, Human
guacuugcucuugaugccuggc

SEQ ID NO: 1804032 - RNA, 15 nt, Human
guacuugcucuugau

SEQ ID NO: 1804033 - RNA, 16 nt, Human
guacuugcucuugaug

SEQ ID NO: 1804034 - RNA, 18 nt, Human
guacuugcucuugaugcc

SEQ ID NO: 1804035 - RNA, 19 nt, Human
guacuugcucuugaugccu

SEQ ID NO: 1804036 - RNA, 15 nt, Human
guaccgcaaugugac

SEQ ID NO: 1804037 - RNA, 16 nt, Human
guacccacugcucugg

SEQ ID NO: 1804038 - RNA, 22 nt, Human
guaccucuugagccuugaacuu

SEQ ID NO: 1804039 - RNA, 21 nt, Human
guaccucuugagccuugaacu

SEQ ID NO: 1804040 - RNA, 13 nt, Human
guaccucuugagc

SEQ ID NO: 1804041 - RNA, 15 nt, Human
guacgucugacaggc

SEQ ID NO: 1804042 - RNA, 14 nt, Human
guacgucugacagg

SEQ ID NO: 1804043 - RNA, 17 nt, Human
guacgucugacaggcaa

SEQ ID NO: 1804044 - RNA, 14 nt, Human
guacguugugcauu

SEQ ID NO: 1804045 - RNA, 16 nt, Human
guacguugugcauuug

SEQ ID NO: 1804046 - RNA, 15 nt, Human
guacguugugcauuu

SEQ ID NO: 1804047 - RNA, 15 nt, Human
guacuucuccacccu

SEQ ID NO: 1804048 - RNA, 14 nt, Human
guacuucuccaccc

SEQ ID NO: 1804049 - RNA, 17 nt, Human
guacuacaguccuccca

SEQ ID NO: 1804050 - RNA, 17 nt, Human
guacguugugcauuugg

SEQ ID NO: 1804051 - RNA, 15 nt, Human
guacuaaggaaucuu

SEQ ID NO: 1804052 - RNA, 23 nt, Human
guacuaaggaaucuuucugcuuu

SEQ ID NO: 1804053 - RNA, 23 nt, Human
gcuaagagggagggagggcucca

SEQ ID NO: 1804054 - RNA, 17 nt, Human
gcuaagcaaaaugugau

SEQ ID NO: 1804055 - RNA, 14 nt, Human
gcuacccgggaagg

SEQ ID NO: 1804056 - RNA, 15 nt, Human
gcuacccgggaaggg

SEQ ID NO: 1804057 - RNA, 21 nt, Human
gcuacccgggaagggggcugg

SEQ ID NO: 1804058 - RNA, 21 nt, Human
gcuagagguucaaagauauuu

SEQ ID NO: 1804059 - RNA, 19 nt, Human
gcuagagguucaaagauau

SEQ ID NO: 1804060 - RNA, 22 nt, Human
gcuacuaugauuuaauuugaaa

SEQ ID NO: 1804061 - RNA, 20 nt, Human
gcuacuaugauuuaauuuga

SEQ ID NO: 1804062 - RNA, 18 nt, Human
gcuagagguucaaagaua

SEQ ID NO: 1804063 - RNA, 16 nt, Human
gcuaucucccccagcc

SEQ ID NO: 1804064 - RNA, 17 nt, Human
gcuaucucccccagccc

SEQ ID NO: 1804065 - RNA, 18 nt, Human
gcuaucucccccagcccc

SEQ ID NO: 1804066 - RNA, 23 nt, Human
gcuaucucccccagccccauccu

SEQ ID NO: 1804067 - RNA, 19 nt, Human
gcuaucucccccagcccca

SEQ ID NO: 1804068 - RNA, 20 nt, Human
gcuaucucccccagccccau

SEQ ID NO: 1804069 - RNA, 21 nt, Human
gcuaucucccccagccccauc

SEQ ID NO: 1804070 - RNA, 22 nt, Human
gcuaucucccccagccccaucc

SEQ ID NO: 1804071 - RNA, 23 nt, Human
gcgugagccacugcaccgggcca

SEQ ID NO: 1804072 - RNA, 18 nt, Human
gcgugagccacugcaccg

SEQ ID NO: 1804073 - RNA, 15 nt, Human
gcgugagaccugccc

SEQ ID NO: 1804074 - RNA, 13 nt, Human
gcuaaaugugaau

SEQ ID NO: 1804075 - RNA, 16 nt, Human
gcuaaaugugaaugau

SEQ ID NO: 1804076 - RNA, 22 nt, Human
gcuaagagggagggagggcucc

SEQ ID NO: 1804077 - RNA, 19 nt, Human
gcgguccacccaggagccc

SEQ ID NO: 1804078 - RNA, 18 nt, Human
gcgguccacccaggagcc

SEQ ID NO: 1804079 - RNA, 20 nt, Human
gcgguccacccaggagcccc

SEQ ID NO: 1804080 - RNA, 16 nt, Human
gcgguccacccaggag

SEQ ID NO: 1804081 - RNA, 13 nt, Human
gcggggacagcuc

SEQ ID NO: 1804082 - RNA, 12 nt, Human
gcggggacagcu

SEQ ID NO: 1804083 - RNA, 15 nt, Human
gcgggcuuccuccug

SEQ ID NO: 1804084 - RNA, 17 nt, Human
gccugugaacugaacuc

SEQ ID NO: 1804085 - RNA, 23 nt, Human
gccugugagcuaggaauuguguu

SEQ ID NO: 1804086 - RNA, 14 nt, Human
gcuccaucuccacu

SEQ ID NO: 1804087 - RNA, 24 nt, Human
gcuccaggcuccuuuagcgcccag

SEQ ID NO: 1804088 - RNA, 20 nt, Human
gcuccagcuguucagcuggu

SEQ ID NO: 1804089 - RNA, 23 nt, Human
gcuccaggcuccuuuagcgccca

SEQ ID NO: 1804090 - RNA, 16 nt, Human
gcuccaggcuccuuua

SEQ ID NO: 1804091 - RNA, 13 nt, Human
gcuccaggcuccu

SEQ ID NO: 1804092 - RNA, 11 nt, Human
gcuccagcugu

SEQ ID NO: 1804093 - RNA, 20 nt, Human
gcuccauuuuuagugaaaua

SEQ ID NO: 1804094 - RNA, 19 nt, Human
gcuccaaacccucgaggcg

SEQ ID NO: 1804095 - RNA, 16 nt, Human
gcuccaaaugcagcuu

SEQ ID NO: 1804096 - RNA, 13 nt, Human
gcuccaagcuccc

SEQ ID NO: 1804097 - RNA, 14 nt, Human
gcuccaagcuccca

SEQ ID NO: 1804098 - RNA, 15 nt, Human
gcuccaagcucccag

SEQ ID NO: 1804099 - RNA, 17 nt, Human
gcuccagcuggccggga

SEQ ID NO: 1804100 - RNA, 23 nt, Human
gcuccagcuggccgggagccuga

SEQ ID NO: 1804101 - RNA, 21 nt, Human
gcuccaagcucccaggcauuc

SEQ ID NO: 1804102 - RNA, 16 nt, Human
gcuccaagcucccagg

SEQ ID NO: 1804103 - RNA, 17 nt, Human
gcuccaagcucccaggc

SEQ ID NO: 1804104 - RNA, 18 nt, Human
gcuccaagcucccaggca

SEQ ID NO: 1804105 - RNA, 19 nt, Human
gcuccaagcucccaggcau

SEQ ID NO: 1804106 - RNA, 18 nt, Human
gcucaggugucccugcac

SEQ ID NO: 1804107 - RNA, 22 nt, Human
gcucagcggggacagcuccuuc

SEQ ID NO: 1804108 - RNA, 21 nt, Human
gcucagcggggacagcuccuu

SEQ ID NO: 1804109 - RNA, 20 nt, Human
gcucagcggggacagcuccu

SEQ ID NO: 1804110 - RNA, 16 nt, Human
gcucagcggggacagc

SEQ ID NO: 1804111 - RNA, 15 nt, Human
gcucagcggggacag

SEQ ID NO: 1804112 - RNA, 19 nt, Human
gcucaggugucccugcacu

SEQ ID NO: 1804113 - RNA, 17 nt, Human
gcuccaaacccucgagg

SEQ ID NO: 1804114 - RNA, 18 nt, Human
gcuccaaacccucgaggc

SEQ ID NO: 1804115 - RNA, 16 nt, Human
gcuccaaacccucgag

SEQ ID NO: 1804116 - RNA, 19 nt, Human
gcucaccagccccagugcc

SEQ ID NO: 1804117 - RNA, 23 nt, Human
gcucaccagccccagugcccaca

SEQ ID NO: 1804118 - RNA, 20 nt, Human
gcucaccagccccagugccc

SEQ ID NO: 1804119 - RNA, 17 nt, Human
gcucagcaaaagaugcu

SEQ ID NO: 1804120 - RNA, 20 nt, Human
gcucagcaaaagaugcuucu

SEQ ID NO: 1804121 - RNA, 22 nt, Human
gcucagcaaaagaugcuucuca

SEQ ID NO: 1804122 - RNA, 23 nt, Human
gcucagcaaaagaugcuucucac

SEQ ID NO: 1804123 - RNA, 17 nt, Human
gcucuccgaccagacac

SEQ ID NO: 1804124 - RNA, 13 nt, Human
gcucuccgaccag

SEQ ID NO: 1804125 - RNA, 19 nt, Human
gcucuccgaccagacaccu

SEQ ID NO: 1804126 - RNA, 19 nt, Human
gcucuccucuugccacugc

SEQ ID NO: 1804127 - RNA, 22 nt, Human
gcucuccucuugccacugccuc

SEQ ID NO: 1804128 - RNA, 15 nt, Human
gcucuccucuugcca

SEQ ID NO: 1804129 - RNA, 13 nt, Human
gcucucuggccuu

SEQ ID NO: 1804130 - RNA, 12 nt, Human
gcucucuggccu

SEQ ID NO: 1804131 - RNA, 11 nt, Human
gcucucuggcc

SEQ ID NO: 1804132 - RNA, 16 nt, Human
gcucgagcaugccugg

SEQ ID NO: 1804133 - RNA, 17 nt, Human
gcucgagcaugccugga

SEQ ID NO: 1804134 - RNA, 21 nt, Human
gcuccuucuguccuacucugu

SEQ ID NO: 1804135 - RNA, 19 nt, Human
gcucccuucccaccucucu

SEQ ID NO: 1804136 - RNA, 15 nt, Human
gcuccuucuguccua

SEQ ID NO: 1804137 - RNA, 15 nt, Human
gcucccuucccaccu

SEQ ID NO: 1804138 - RNA, 16 nt, Human
gcucccuucccaccuc

SEQ ID NO: 1804139 - RNA, 18 nt, Human
gcucccuucccaccucuc

SEQ ID NO: 1804140 - RNA, 14 nt, Human
gcucugcccuuggu

SEQ ID NO: 1804141 - RNA, 23 nt, Human
gcucugcccuugguuaggcauug

SEQ ID NO: 1804142 - RNA, 11 nt, Human
gcucugccucc

SEQ ID NO: 1804143 - RNA, 20 nt, Human
gcucucuggccuucggccuc

SEQ ID NO: 1804144 - RNA, 19 nt, Human
gcucucuggccuucggccu

SEQ ID NO: 1804145 - RNA, 15 nt, Human
gcucucuggccuucg

SEQ ID NO: 1804146 - RNA, 14 nt, Human
gcucucuggccuuc

SEQ ID NO: 1804147 - RNA, 14 nt, Human
gcucugcuccucuc

SEQ ID NO: 1804148 - RNA, 13 nt, Human
gcucugcuccucu

SEQ ID NO: 1804149 - RNA, 13 nt, Human
gcucugccuccca

SEQ ID NO: 1804150 - RNA, 14 nt, Human
gcucugccucccau

SEQ ID NO: 1804151 - RNA, 15 nt, Human
gcucugccucccauc

SEQ ID NO: 1804152 - RNA, 22 nt, Human
gcucugccucccaucacccgcu

SEQ ID NO: 1804153 - RNA, 23 nt, Human
gcucugcugacagacacaggccc

SEQ ID NO: 1804154 - RNA, 20 nt, Human
gcucugcugacagacacagg

SEQ ID NO: 1804155 - RNA, 19 nt, Human
gcucugcugacagacacag

SEQ ID NO: 1804156 - RNA, 18 nt, Human
gcucugcugacagacaca

SEQ ID NO: 1804157 - RNA, 14 nt, Human
gcucugcugacaga

SEQ ID NO: 1804158 - RNA, 13 nt, Human
gcucugcugacag

SEQ ID NO: 1804159 - RNA, 21 nt, Human
gcucugcuccucuccccagca

SEQ ID NO: 1804160 - RNA, 19 nt, Human
gcucugcuccucuccccag

SEQ ID NO: 1804161 - RNA, 22 nt, Human
gcucuggacaggcauguucucu

SEQ ID NO: 1804162 - RNA, 21 nt, Human
gcucuggacaggcauguucuc

SEQ ID NO: 1804163 - RNA, 16 nt, Human
gcucuggacaggcaug

SEQ ID NO: 1804164 - RNA, 15 nt, Human
gcucuggacaggcau

SEQ ID NO: 1804165 - RNA, 14 nt, Human
gcucuggacaggca

SEQ ID NO: 1804166 - RNA, 22 nt, Human
gcucugcuccccuaaagccuca

SEQ ID NO: 1804167 - RNA, 12 nt, Human
gcucuucuccag

SEQ ID NO: 1804168 - RNA, 22 nt, Human
gcucuuccaggcugggagagcc

SEQ ID NO: 1804169 - RNA, 19 nt, Human
gcucuuccaggcugggaga

SEQ ID NO: 1804170 - RNA, 18 nt, Human
gcucuuccaggcugggag

SEQ ID NO: 1804171 - RNA, 16 nt, Human
gcucuucuccaggcug

SEQ ID NO: 1804172 - RNA, 14 nt, Human
gcucuucuccaggc

SEQ ID NO: 1804173 - RNA, 17 nt, Human
gcucuucuccuuucaca

SEQ ID NO: 1804174 - RNA, 21 nt, Human
gcucuucuccuuucacaaccu

SEQ ID NO: 1804175 - RNA, 13 nt, Human
gcucuucuccuuu

SEQ ID NO: 1804176 - RNA, 23 nt, Human
gcucuucuccuuucacaaccuuc

SEQ ID NO: 1804177 - RNA, 14 nt, Human
gcucuugaugccug

SEQ ID NO: 1804178 - RNA, 15 nt, Human
gcucuugaugccugg

SEQ ID NO: 1804179 - RNA, 16 nt, Human
gcucuugaugccuggc

SEQ ID NO: 1804180 - RNA, 21 nt, Human
gcugacagacacaggcccggc

SEQ ID NO: 1804181 - RNA, 17 nt, Human
gcugacagacagcccuc

SEQ ID NO: 1804182 - RNA, 17 nt, Human
gcucuugaugccuggcg

SEQ ID NO: 1804183 - RNA, 18 nt, Human
gcugacuguacuccuccc

SEQ ID NO: 1804184 - RNA, 19 nt, Human
gcugacuguacuccuccca

SEQ ID NO: 1804185 - RNA, 18 nt, Human
gcugauggugcaaugacc

SEQ ID NO: 1804186 - RNA, 21 nt, Human
gcugauggugcaaugaccuuu

SEQ ID NO: 1804187 - RNA, 21 nt, Human
gcugcaguugccagucacccc

SEQ ID NO: 1804188 - RNA, 18 nt, Human
gcugcaguugccagucac

SEQ ID NO: 1804189 - RNA, 20 nt, Human
gcugcaguugccagucaccc

SEQ ID NO: 1804190 - RNA, 17 nt, Human
gcugcauuuaaaagaua

SEQ ID NO: 1804191 - RNA, 15 nt, Human
gcugauggugcaaug

SEQ ID NO: 1804192 - RNA, 16 nt, Human
gcugauggugcaauga

SEQ ID NO: 1804193 - RNA, 22 nt, Human
gcugagugggggaucacagccu

SEQ ID NO: 1804194 - RNA, 23 nt, Human
gcugagugggggaucacagccuc

SEQ ID NO: 1804195 - RNA, 21 nt, Human
gcugacuguacuccucccagg

SEQ ID NO: 1804196 - RNA, 17 nt, Human
gcugagucccaggcuga

SEQ ID NO: 1804197 - RNA, 21 nt, Human
gcugagucccaggcugagccu

SEQ ID NO: 1804198 - RNA, 22 nt, Human
gcugagucccaggcugagccuc

SEQ ID NO: 1804199 - RNA, 15 nt, Human
gcugagucugaaggc

SEQ ID NO: 1804200 - RNA, 16 nt, Human
gcugagucugaaggcu

SEQ ID NO: 1804201 - RNA, 18 nt, Human
gcugagucugaaggcugg

SEQ ID NO: 1804202 - RNA, 19 nt, Human
gcugagucugaaggcuggg

SEQ ID NO: 1804203 - RNA, 15 nt, Human
gccugcuccagcugu

SEQ ID NO: 1804204 - RNA, 16 nt, Human
gccugcuccagcuguu

SEQ ID NO: 1804205 - RNA, 18 nt, Human
gccugcuccagcuguuca

SEQ ID NO: 1804206 - RNA, 18 nt, Human
gccugcuuuuuauggccu

SEQ ID NO: 1804207 - RNA, 19 nt, Human
gccugcuuuuuauggccug

SEQ ID NO: 1804208 - RNA, 22 nt, Human
gccugcuuuuuauggccuguga

SEQ ID NO: 1804209 - RNA, 22 nt, Human
gccugaagucacacagugaguc

SEQ ID NO: 1804210 - RNA, 19 nt, Human
gccucugcugauccuccca

SEQ ID NO: 1804211 - RNA, 18 nt, Human
gccucugcugauccuccc

SEQ ID NO: 1804212 - RNA, 13 nt, Human
gccucugccuguc

SEQ ID NO: 1804213 - RNA, 12 nt, Human
gccucugccugu

SEQ ID NO: 1804214 - RNA, 23 nt, Human
gccucucugcaggucccuaauaa

SEQ ID NO: 1804215 - RNA, 18 nt, Human
gccucucugcaggucccu

SEQ ID NO: 1804216 - RNA, 20 nt, Human
gccucucugcaggucccuaa

SEQ ID NO: 1804217 - RNA, 21 nt, Human
gccucucugcaggucccuaau

SEQ ID NO: 1804218 - RNA, 15 nt, Human
gccuggccagaugca

SEQ ID NO: 1804219 - RNA, 14 nt, Human
gccuggccagaugc

SEQ ID NO: 1804220 - RNA, 16 nt, Human
gccuggccagaugcac

SEQ ID NO: 1804221 - RNA, 15 nt, Human
gccugggcagaagga

SEQ ID NO: 1804222 - RNA, 15 nt, Human
gccuggauggggcug

SEQ ID NO: 1804223 - RNA, 14 nt, Human
gccuggauggggcu

SEQ ID NO: 1804224 - RNA, 13 nt, Human
gccuggccacgcc

SEQ ID NO: 1804225 - RNA, 21 nt, Human
gccugggggcugggcagagga

SEQ ID NO: 1804226 - RNA, 20 nt, Human
gccugggggcugggcagagg

SEQ ID NO: 1804227 - RNA, 18 nt, Human
gccugggcagaaggaaga

SEQ ID NO: 1804228 - RNA, 16 nt, Human
gccugggcagaaggaa

SEQ ID NO: 1804229 - RNA, 17 nt, Human
gccugggcagaaggaag

SEQ ID NO: 1804230 - RNA, 21 nt, Human
gccucaagugauucuccugcc

SEQ ID NO: 1804231 - RNA, 20 nt, Human
gccucaagugauucuccugc

SEQ ID NO: 1804232 - RNA, 19 nt, Human
gccucaagugauucuccug

SEQ ID NO: 1804233 - RNA, 17 nt, Human
gccucaaccuccugggc

SEQ ID NO: 1804234 - RNA, 16 nt, Human
gccucaaccuccuggg

SEQ ID NO: 1804235 - RNA, 14 nt, Human
gccucaaccuccug

SEQ ID NO: 1804236 - RNA, 16 nt, Human
gccuaaggcugaacuu

SEQ ID NO: 1804237 - RNA, 17 nt, Human
gccuaagugcagccccg

SEQ ID NO: 1804238 - RNA, 22 nt, Human
gccuauauuuuuuguuaaauga

SEQ ID NO: 1804239 - RNA, 14 nt, Human
gccucagugccacu

SEQ ID NO: 1804240 - RNA, 12 nt, Human
gccucagugcca

SEQ ID NO: 1804241 - RNA, 15 nt, Human
gccucagucucccuc

SEQ ID NO: 1804242 - RNA, 18 nt, Human
gccucagucucccucccu

SEQ ID NO: 1804243 - RNA, 23 nt, Human
gccucagccucccaaagugcugg

SEQ ID NO: 1804244 - RNA, 18 nt, Human
gccucagccuccugagua

SEQ ID NO: 1804245 - RNA, 16 nt, Human
gccucagccuccugag

SEQ ID NO: 1804246 - RNA, 14 nt, Human
gccucagccucccg

SEQ ID NO: 1804247 - RNA, 21 nt, Human
gccucccacgacugcccggca

SEQ ID NO: 1804248 - RNA, 14 nt, Human
gccucccacgacug

SEQ ID NO: 1804249 - RNA, 21 nt, Human
gccucccgaauagcugggacu

SEQ ID NO: 1804250 - RNA, 15 nt, Human
gccucagugccacua

SEQ ID NO: 1804251 - RNA, 21 nt, Human
gccucccaacucaccccagcc

SEQ ID NO: 1804252 - RNA, 22 nt, Human
gccucccaacucaccccagccc

SEQ ID NO: 1804253 - RNA, 23 nt, Human
gccucccaacucaccccagcccc

SEQ ID NO: 1804254 - RNA, 15 nt, Human
gccucccgaguagcu

SEQ ID NO: 1804255 - RNA, 23 nt, Human
gccucccgaauagcugggacuac

SEQ ID NO: 1804256 - RNA, 17 nt, Human
gccucccgaguagcugg

SEQ ID NO: 1804257 - RNA, 20 nt, Human
gccucggacuuagcugggag

SEQ ID NO: 1804258 - RNA, 21 nt, Human
gccucggacuuagcugggaga

SEQ ID NO: 1804259 - RNA, 19 nt, Human
gccucucugcaggucccua

SEQ ID NO: 1804260 - RNA, 12 nt, Human
gcccucugccca

SEQ ID NO: 1804261 - RNA, 16 nt, Human
gcccugagcuuucugc

SEQ ID NO: 1804262 - RNA, 18 nt, Human
gcccggcuccaggcuccu

SEQ ID NO: 1804263 - RNA, 17 nt, Human
gcccggcuccaggcucc

SEQ ID NO: 1804264 - RNA, 20 nt, Human
gcccugcuuugggcugcccu

SEQ ID NO: 1804265 - RNA, 21 nt, Human
gcccugcuuugggcugcccug

SEQ ID NO: 1804266 - RNA, 19 nt, Human
gcccugcuuugggcugccc

SEQ ID NO: 1804267 - RNA, 22 nt, Human
gcccugcuuugggcugcccugg

SEQ ID NO: 1804268 - RNA, 23 nt, Human
gcccugcuuugggcugcccuggu

SEQ ID NO: 1804269 - RNA, 12 nt, Human
gcccuggacugu

SEQ ID NO: 1804270 - RNA, 16 nt, Human
gcccuggacugugugc

SEQ ID NO: 1804271 - RNA, 22 nt, Human
gcccuggacugugugcucagga

SEQ ID NO: 1804272 - RNA, 16 nt, Human
gcccggcuccaggcuc

SEQ ID NO: 1804273 - RNA, 12 nt, Human
gccccuuccccc

SEQ ID NO: 1804274 - RNA, 16 nt, Human
gcccgacagccuggca

SEQ ID NO: 1804275 - RNA, 17 nt, Human
gcccgacagccuggcac

SEQ ID NO: 1804276 - RNA, 19 nt, Human
gcccgacagccuggcacag

SEQ ID NO: 1804277 - RNA, 15 nt, Human
gccccugccacccug

SEQ ID NO: 1804278 - RNA, 14 nt, Human
gccccugccacccu

SEQ ID NO: 1804279 - RNA, 21 nt, Human
gccccuguucuggcagaguug

SEQ ID NO: 1804280 - RNA, 13 nt, Human
gccccugccaccc

SEQ ID NO: 1804281 - RNA, 15 nt, Human
gcagacucuacagag

SEQ ID NO: 1804282 - RNA, 12 nt, Human
gccccucccuuc

SEQ ID NO: 1804283 - RNA, 14 nt, Human
gccccucccuucaa

SEQ ID NO: 1804284 - RNA, 15 nt, Human
gccccucccuucaac

SEQ ID NO: 1804285 - RNA, 18 nt, Human
gccccuccucucugcccu

SEQ ID NO: 1804286 - RNA, 19 nt, Human
gccccuccucucugcccua

SEQ ID NO: 1804287 - RNA, 20 nt, Human
gcccuuccucuccacugccu

SEQ ID NO: 1804288 - RNA, 23 nt, Human
gcccuucucuccagccccuggau

SEQ ID NO: 1804289 - RNA, 21 nt, Human
gcccuucucuccagccccugg

SEQ ID NO: 1804290 - RNA, 22 nt, Human
gcccuucucuccagccccugga

SEQ ID NO: 1804291 - RNA, 17 nt, Human
gcccuuccucuccacug

SEQ ID NO: 1804292 - RNA, 16 nt, Human
gcccuuccucuccacu

SEQ ID NO: 1804293 - RNA, 18 nt, Human
gcccuuccucuccacugc

SEQ ID NO: 1804294 - RNA, 19 nt, Human
gcccuuccucuccacugcc

SEQ ID NO: 1804295 - RNA, 21 nt, Human
gcccuuccucuccacugccuu

SEQ ID NO: 1804296 - RNA, 19 nt, Human
gcccuucucuccagccccu

SEQ ID NO: 1804297 - RNA, 19 nt, Human
gccgagaucacgccacugc

SEQ ID NO: 1804298 - RNA, 18 nt, Human
gccgagaucacgccacug

SEQ ID NO: 1804299 - RNA, 18 nt, Human
gccgagauugcaccacug

SEQ ID NO: 1804300 - RNA, 17 nt, Human
gccgagauugcaccacu

SEQ ID NO: 1804301 - RNA, 16 nt, Human
gccgagaucacgccac

SEQ ID NO: 1804302 - RNA, 23 nt, Human
gcccugguggcagugggagcugc

SEQ ID NO: 1804303 - RNA, 22 nt, Human
gcccugguggcagugggagcug

SEQ ID NO: 1804304 - RNA, 21 nt, Human
gcccugguggcagugggagcu

SEQ ID NO: 1804305 - RNA, 20 nt, Human
gcccugguggcagugggagc

SEQ ID NO: 1804306 - RNA, 19 nt, Human
gcccugguggcagugggag

SEQ ID NO: 1804307 - RNA, 18 nt, Human
gcccugguggcaguggga

SEQ ID NO: 1804308 - RNA, 17 nt, Human
gcccugguggcaguggg

SEQ ID NO: 1804309 - RNA, 14 nt, Human
gcccugguggcagu

SEQ ID NO: 1804310 - RNA, 17 nt, Human
gcccugguuuccugccc

SEQ ID NO: 1804311 - RNA, 18 nt, Human
gcccugguuuccugcccu

SEQ ID NO: 1804312 - RNA, 19 nt, Human
gcccugguuuccugcccug

SEQ ID NO: 1804313 - RNA, 20 nt, Human
gcccugguuuccugcccugg

SEQ ID NO: 1804314 - RNA, 21 nt, Human
gcccugguuuccugcccuggg

SEQ ID NO: 1804315 - RNA, 23 nt, Human
gcccugguuuccugcccugggag

SEQ ID NO: 1804316 - RNA, 14 nt, Human
gcccugguuuccug

SEQ ID NO: 1804317 - RNA, 15 nt, Human
gcccugguuuccugc

SEQ ID NO: 1804318 - RNA, 15 nt, Human
gcccuggcucccaca

SEQ ID NO: 1804319 - RNA, 19 nt, Human
gcccuggcucccacaggcc

SEQ ID NO: 1804320 - RNA, 20 nt, Human
gcccuggcucccacaggccc

SEQ ID NO: 1804321 - RNA, 11 nt, Human
gcccugggagg

SEQ ID NO: 1804322 - RNA, 14 nt, Human
gcccugggaggcag

SEQ ID NO: 1804323 - RNA, 13 nt, Human
gcccugggaggcu

SEQ ID NO: 1804324 - RNA, 14 nt, Human
gcccugggaggcuc

SEQ ID NO: 1804325 - RNA, 15 nt, Human
gcccugggaggcucu

SEQ ID NO: 1804326 - RNA, 16 nt, Human
gcccugggaggcucug

SEQ ID NO: 1804327 - RNA, 15 nt, Human
gcccuggugcugcca

SEQ ID NO: 1804328 - RNA, 16 nt, Human
gcccuggugcugccac

SEQ ID NO: 1804329 - RNA, 17 nt, Human
gcccuggugcugccaca

SEQ ID NO: 1804330 - RNA, 21 nt, Human
gcccuggugcugccacacuuc

SEQ ID NO: 1804331 - RNA, 16 nt, Human
gcccugggaggcagug

SEQ ID NO: 1804332 - RNA, 23 nt, Human
gcccugggaggcucuggagccca

SEQ ID NO: 1804333 - RNA, 17 nt, Human
gcccugggaggcucugg

SEQ ID NO: 1804334 - RNA, 18 nt, Human
gcccugggaggcucugga

SEQ ID NO: 1804335 - RNA, 19 nt, Human
gcccugggaggcucuggag

SEQ ID NO: 1804336 - RNA, 21 nt, Human
gcccugggaggcucuggagcc

SEQ ID NO: 1804337 - RNA, 18 nt, Human
ggaaguacuggagaaaau

SEQ ID NO: 1804338 - RNA, 12 nt, Human
ggaaguacugga

SEQ ID NO: 1804339 - RNA, 16 nt, Human
ggaaguacuggagaaa

SEQ ID NO: 1804340 - RNA, 18 nt, Human
ggaagugcuaauuuugaa

SEQ ID NO: 1804341 - RNA, 20 nt, Human
ggaagugacgguuuaauggg

SEQ ID NO: 1804342 - RNA, 13 nt, Human
ggaaccugacccc

SEQ ID NO: 1804343 - RNA, 14 nt, Human
ggaaggcagggagg

SEQ ID NO: 1804344 - RNA, 17 nt, Human
ggaaggcugagaggaga

SEQ ID NO: 1804345 - RNA, 23 nt, Human
ggaaggggagauaaggguaucug

SEQ ID NO: 1804346 - RNA, 19 nt, Human
ggaauuuucaucuaggauu

SEQ ID NO: 1804347 - RNA, 12 nt, Human
ggaauuguguuu

SEQ ID NO: 1804348 - RNA, 19 nt, Human
ggaauguuugccucugccu

SEQ ID NO: 1804349 - RNA, 12 nt, Human
ggaaugcagugg

SEQ ID NO: 1804350 - RNA, 24 nt, Human
ggaaugauuaauuaaaacacaaca

SEQ ID NO: 1804351 - RNA, 20 nt, Human
ggacauugcggacagccacg

SEQ ID NO: 1804352 - RNA, 22 nt, Human
ggacagccacggccaggccaga

SEQ ID NO: 1804353 - RNA, 21 nt, Human
ggacagccacggccaggccag

SEQ ID NO: 1804354 - RNA, 20 nt, Human
ggacagccacggccaggcca

SEQ ID NO: 1804355 - RNA, 19 nt, Human
ggacagccacggccaggcc

SEQ ID NO: 1804356 - RNA, 15 nt, Human
ggacagccacggcca

SEQ ID NO: 1804357 - RNA, 17 nt, Human
ggacacucaaaagcugg

SEQ ID NO: 1804358 - RNA, 22 nt, Human
ggacacucaaaagcugggcagg

SEQ ID NO: 1804359 - RNA, 17 nt, Human
ggaccuugaacugggua

SEQ ID NO: 1804360 - RNA, 15 nt, Human
ggaccuugaacuggg

SEQ ID NO: 1804361 - RNA, 17 nt, Human
ggacgcuacccgggaag

SEQ ID NO: 1804362 - RNA, 19 nt, Human
ggacgcuacccgggaaggg

SEQ ID NO: 1804363 - RNA, 20 nt, Human
ggacgcuacccgggaagggg

SEQ ID NO: 1804364 - RNA, 13 nt, Human
ggaccagagcugc

SEQ ID NO: 1804365 - RNA, 19 nt, Human
ggaccucaggugagaagca

SEQ ID NO: 1804366 - RNA, 23 nt, Human
ggaccucaggugagaagcagagg

SEQ ID NO: 1804367 - RNA, 15 nt, Human
ggacgcucucuggcc

SEQ ID NO: 1804368 - RNA, 14 nt, Human
ggacgcucucuggc

SEQ ID NO: 1804369 - RNA, 13 nt, Human
ggacgcucucugg

SEQ ID NO: 1804370 - RNA, 18 nt, Human
ggacuggccucugcugau

SEQ ID NO: 1804371 - RNA, 17 nt, Human
ggagaagcggcuggcag

SEQ ID NO: 1804372 - RNA, 18 nt, Human
ggagaagcggcuggcagc

SEQ ID NO: 1804373 - RNA, 19 nt, Human
ggagaaucacuugaacccg

SEQ ID NO: 1804374 - RNA, 15 nt, Human
ggagaaucacuugaa

SEQ ID NO: 1804375 - RNA, 17 nt, Human
ggacugugugcucagga

SEQ ID NO: 1804376 - RNA, 15 nt, Human
gcuuuguaugcacuu

SEQ ID NO: 1804377 - RNA, 18 nt, Human
gcuuugucuacuucaaaa

SEQ ID NO: 1804378 - RNA, 15 nt, Human
gcuuugugauuuuug

SEQ ID NO: 1804379 - RNA, 20 nt, Human
gcuugaggguugggcuggug

SEQ ID NO: 1804380 - RNA, 18 nt, Human
gcuugaggguugggcugg

SEQ ID NO: 1804381 - RNA, 22 nt, Human
gcuugaggguugggcugguguc

SEQ ID NO: 1804382 - RNA, 13 nt, Human
gcuuuucacugcu

SEQ ID NO: 1804383 - RNA, 14 nt, Human
gcuuuucacugcug

SEQ ID NO: 1804384 - RNA, 18 nt, Human
gcuuuucacugcuggcug

SEQ ID NO: 1804385 - RNA, 21 nt, Human
gcuuuguuuguugucagcuga

SEQ ID NO: 1804386 - RNA, 22 nt, Human
gcuuuucacugcuggcugccuu

SEQ ID NO: 1804387 - RNA, 23 nt, Human
gcuuuucacugcuggcugccuua

SEQ ID NO: 1804388 - RNA, 18 nt, Human
ggaaaacaugcuacacac

SEQ ID NO: 1804389 - RNA, 20 nt, Human
ggaaaagcugcugacagugu

SEQ ID NO: 1804390 - RNA, 18 nt, Human
ggaaaagcugcugacagu

SEQ ID NO: 1804391 - RNA, 14 nt, Human
ggaaaagcugcuga

SEQ ID NO: 1804392 - RNA, 21 nt, Human
ggaaaaccaagccguggcuuc

SEQ ID NO: 1804393 - RNA, 23 nt, Human
ggaaaaucagccugcuccagcug

SEQ ID NO: 1804394 - RNA, 19 nt, Human
ggaaaaucagccugcucca

SEQ ID NO: 1804395 - RNA, 12 nt, Human
ggaaaggcucca

SEQ ID NO: 1804396 - RNA, 13 nt, Human
ggaaaggcuccag

SEQ ID NO: 1804397 - RNA, 14 nt, Human
ggaaaggcuccagg

SEQ ID NO: 1804398 - RNA, 22 nt, Human
ggaaaggcuccaggagcagcca

SEQ ID NO: 1804399 - RNA, 17 nt, Human
ggaaaggcuccaggagc

SEQ ID NO: 1804400 - RNA, 19 nt, Human
ggaaaggcuccaggagcag

SEQ ID NO: 1804401 - RNA, 20 nt, Human
ggaaaggcuccaggagcagc

SEQ ID NO: 1804402 - RNA, 21 nt, Human
ggaaaggcuccaggagcagcc

SEQ ID NO: 1804403 - RNA, 21 nt, Human
ggaaaucaccgaaaacguggc

SEQ ID NO: 1804404 - RNA, 14 nt, Human
ggaaaucaccgaaa

SEQ ID NO: 1804405 - RNA, 16 nt, Human
ggaacaggaaacugau

SEQ ID NO: 1804406 - RNA, 20 nt, Human
gcugccaaugggagcucaug

SEQ ID NO: 1804407 - RNA, 15 nt, Human
gcugccaaugggagc

SEQ ID NO: 1804408 - RNA, 16 nt, Human
gcugccaaugggagcu

SEQ ID NO: 1804409 - RNA, 19 nt, Human
gcugccaaugggagcucau

SEQ ID NO: 1804410 - RNA, 21 nt, Human
gcugugggcgugagaccugcc

SEQ ID NO: 1804411 - RNA, 22 nt, Human
gcugugggcgugagaccugccc

SEQ ID NO: 1804412 - RNA, 20 nt, Human
gcugugggcgugagaccugc

SEQ ID NO: 1804413 - RNA, 14 nt, Human
gcuguucagcuggu

SEQ ID NO: 1804414 - RNA, 21 nt, Human
gcuuagucacugagacagccc

SEQ ID NO: 1804415 - RNA, 19 nt, Human
gcuuagucacugagacagc

SEQ ID NO: 1804416 - RNA, 20 nt, Human
gcuuagucacugagacagcc

SEQ ID NO: 1804417 - RNA, 15 nt, Human
gcuuagucacugaga

SEQ ID NO: 1804418 - RNA, 17 nt, Human
gcuuagucacugagaca

SEQ ID NO: 1804419 - RNA, 16 nt, Human
gcuugaggguugggcu

SEQ ID NO: 1804420 - RNA, 15 nt, Human
gcuuccagugaggcu

SEQ ID NO: 1804421 - RNA, 21 nt, Human
gcuucauccuccucagaucuu

SEQ ID NO: 1804422 - RNA, 17 nt, Human
gcuucauuuccuguguc

SEQ ID NO: 1804423 - RNA, 16 nt, Human
gcuuccagugaggcuc

SEQ ID NO: 1804424 - RNA, 18 nt, Human
gcuuccagugaggcucug

SEQ ID NO: 1804425 - RNA, 16 nt, Human
gcuucauuuccugugu

SEQ ID NO: 1804426 - RNA, 13 nt, Human
gcuucauuuccug

SEQ ID NO: 1804427 - RNA, 12 nt, Human
gcuucauccucc

SEQ ID NO: 1804428 - RNA, 15 nt, Human
gcuucauccuccuca

SEQ ID NO: 1804429 - RNA, 18 nt, Human
gcuucaguggcagcugcu

SEQ ID NO: 1804430 - RNA, 17 nt, Human
gcuucaguggcagcugc

SEQ ID NO: 1804431 - RNA, 16 nt, Human
gcuucaguggcagcug

SEQ ID NO: 1804432 - RNA, 23 nt, Human
gcuuaugauagcaaauggccuca

SEQ ID NO: 1804433 - RNA, 12 nt, Human
gcuuauacacuu

SEQ ID NO: 1804434 - RNA, 20 nt, Human
gcuuauacacuuacacuuua

SEQ ID NO: 1804435 - RNA, 19 nt, Human
gcuuaucucaggggugugc

SEQ ID NO: 1804436 - RNA, 23 nt, Human
ggauuacaagcgugagccacugc

SEQ ID NO: 1804437 - RNA, 19 nt, Human
ggauuacaggcuccugcca

SEQ ID NO: 1804438 - RNA, 16 nt, Human
ggauucuuauggacaa

SEQ ID NO: 1804439 - RNA, 16 nt, Human
ggauucuuccucccuc

SEQ ID NO: 1804440 - RNA, 17 nt, Human
ggcaacccccagccugc

SEQ ID NO: 1804441 - RNA, 16 nt, Human
ggcaacccccagccug

SEQ ID NO: 1804442 - RNA, 15 nt, Human
ggauuguaaaauggu

SEQ ID NO: 1804443 - RNA, 17 nt, Human
ggauugcuacuguccua

SEQ ID NO: 1804444 - RNA, 23 nt, Human
ggcacccaccaucaugucuggcu

SEQ ID NO: 1804445 - RNA, 22 nt, Human
ggcacccggccccugcugguuc

SEQ ID NO: 1804446 - RNA, 18 nt, Human
ggcaccggggccucggac

SEQ ID NO: 1804447 - RNA, 23 nt, Human
ggcaaugcuggcuguuggcuggg

SEQ ID NO: 1804448 - RNA, 15 nt, Human
ggcaaugcuggcugu

SEQ ID NO: 1804449 - RNA, 14 nt, Human
ggcaaugcuggcug

SEQ ID NO: 1804450 - RNA, 18 nt, Human
ggcaacccccagccugcu

SEQ ID NO: 1804451 - RNA, 19 nt, Human
ggcaaucauggugcucaga

SEQ ID NO: 1804452 - RNA, 19 nt, Human
ggauuacaagcgugagcca

SEQ ID NO: 1804453 - RNA, 15 nt, Human
ggaugcuuguacaua

SEQ ID NO: 1804454 - RNA, 19 nt, Human
ggaugcagccucacagucc

SEQ ID NO: 1804455 - RNA, 23 nt, Human
ggaugcacagaguuguuacauuu

SEQ ID NO: 1804456 - RNA, 21 nt, Human
ggaugauuggaggggggaggu

SEQ ID NO: 1804457 - RNA, 16 nt, Human
ggaugcagccucacag

SEQ ID NO: 1804458 - RNA, 17 nt, Human
ggaugcagccucacagu

SEQ ID NO: 1804459 - RNA, 12 nt, Human
ggauccuccagg

SEQ ID NO: 1804460 - RNA, 13 nt, Human
ggauccuccaggu

SEQ ID NO: 1804461 - RNA, 22 nt, Human
ggaucccucauccucauaccca

SEQ ID NO: 1804462 - RNA, 13 nt, Human
ggaucccucaucc

SEQ ID NO: 1804463 - RNA, 17 nt, Human
ggaucccucauccucau

SEQ ID NO: 1804464 - RNA, 22 nt, Human
ggaucaaaccccgaccaccugc

SEQ ID NO: 1804465 - RNA, 18 nt, Human
ggauacaaaagcauguga

SEQ ID NO: 1804466 - RNA, 14 nt, Human
ggagugcagugagc

SEQ ID NO: 1804467 - RNA, 20 nt, Human
ggagugcaaugacacagucu

SEQ ID NO: 1804468 - RNA, 12 nt, Human
ggagugcaguga

SEQ ID NO: 1804469 - RNA, 16 nt, Human
ggcauuccccaggagg

SEQ ID NO: 1804470 - RNA, 18 nt, Human
ggcauuccccaggaggcc

SEQ ID NO: 1804471 - RNA, 19 nt, Human
ggcauuccccaggaggcca

SEQ ID NO: 1804472 - RNA, 22 nt, Human
ggcaugggaaugaaugucagug

SEQ ID NO: 1804473 - RNA, 17 nt, Human
ggcauuccccaggaggc

SEQ ID NO: 1804474 - RNA, 18 nt, Human
ggcaugggaaugaauguc

SEQ ID NO: 1804475 - RNA, 17 nt, Human
ggccacuccagaccccu

SEQ ID NO: 1804476 - RNA, 16 nt, Human
ggccaugggccuccug

SEQ ID NO: 1804477 - RNA, 16 nt, Human
ggccaggcugcucuug

SEQ ID NO: 1804478 - RNA, 14 nt, Human
ggccaggcugcucu

SEQ ID NO: 1804479 - RNA, 15 nt, Human
ggccaggcugcucuu

SEQ ID NO: 1804480 - RNA, 11 nt, Human
ggccaggcugc

SEQ ID NO: 1804481 - RNA, 23 nt, Human
ggccagcugcuugggcuucaucc

SEQ ID NO: 1804482 - RNA, 18 nt, Human
ggccaggcccucugccca

SEQ ID NO: 1804483 - RNA, 20 nt, Human
ggccagccuugaccauucuc

SEQ ID NO: 1804484 - RNA, 22 nt, Human
ggccagccuugaccauucucca

SEQ ID NO: 1804485 - RNA, 17 nt, Human
ggccagcugcuugggcu

SEQ ID NO: 1804486 - RNA, 17 nt, Human
ggcagcuugaggguugg

SEQ ID NO: 1804487 - RNA, 22 nt, Human
ggcagcugcuuuugucuauggg

SEQ ID NO: 1804488 - RNA, 16 nt, Human
ggcagcucaccucucc

SEQ ID NO: 1804489 - RNA, 13 nt, Human
ggcagcucagaga

SEQ ID NO: 1804490 - RNA, 21 nt, Human
ggcagcucagagaggguggga

SEQ ID NO: 1804491 - RNA, 12 nt, Human
ggcagcucaccu

SEQ ID NO: 1804492 - RNA, 14 nt, Human
ggcagcucaccucu

SEQ ID NO: 1804493 - RNA, 16 nt, Human
ggcagugggagcugcc

SEQ ID NO: 1804494 - RNA, 21 nt, Human
ggcagugggacagggcauggc

SEQ ID NO: 1804495 - RNA, 14 nt, Human
ggcagugggagcug

SEQ ID NO: 1804496 - RNA, 13 nt, Human
ggcagugggagcu

SEQ ID NO: 1804497 - RNA, 20 nt, Human
ggcagggucucacucugucg

SEQ ID NO: 1804498 - RNA, 19 nt, Human
ggcagggucucacucuguc

SEQ ID NO: 1804499 - RNA, 17 nt, Human
ggcauggccagguggcc

SEQ ID NO: 1804500 - RNA, 18 nt, Human
ggcauggccagguggcca

SEQ ID NO: 1804501 - RNA, 15 nt, Human
ggcaugaagacagau

SEQ ID NO: 1804502 - RNA, 18 nt, Human
ggcaugacacgaauauug

SEQ ID NO: 1804503 - RNA, 21 nt, Human
ggcccucugcccacucccugc

SEQ ID NO: 1804504 - RNA, 19 nt, Human
ggcccucugcccacucccu

SEQ ID NO: 1804505 - RNA, 20 nt, Human
ggcccucugcccacucccug

SEQ ID NO: 1804506 - RNA, 13 nt, Human
ggcccucugccca

SEQ ID NO: 1804507 - RNA, 15 nt, Human
ggcccucugcccacu

SEQ ID NO: 1804508 - RNA, 16 nt, Human
ggcccucugcccacuc

SEQ ID NO: 1804509 - RNA, 17 nt, Human
ggcccucugcccacucc

SEQ ID NO: 1804510 - RNA, 12 nt, Human
ggcccagagagg

SEQ ID NO: 1804511 - RNA, 11 nt, Human
ggcccagagag

SEQ ID NO: 1804512 - RNA, 22 nt, Human
ggcccugcccugguuuccugcc

SEQ ID NO: 1804513 - RNA, 14 nt, Human
ggcccugccuccuu

SEQ ID NO: 1804514 - RNA, 15 nt, Human
ggcccugccuccuuu

SEQ ID NO: 1804515 - RNA, 13 nt, Human
ggcccuggcuccc

SEQ ID NO: 1804516 - RNA, 22 nt, Human
ggcccuggcucccacaggcccu

SEQ ID NO: 1804517 - RNA, 11 nt, Human
ggcccugcccu

SEQ ID NO: 1804518 - RNA, 12 nt, Human
ggcccugcccug

SEQ ID NO: 1804519 - RNA, 13 nt, Human
ggcccugcccugg

SEQ ID NO: 1804520 - RNA, 20 nt, Human
ggcccugcccugguuuccug

SEQ ID NO: 1804521 - RNA, 13 nt, Human
ggcccugccuccu

SEQ ID NO: 1804522 - RNA, 23 nt, Human
ggccuagcauacguacacauuuu

SEQ ID NO: 1804523 - RNA, 22 nt, Human
ggccucggacuuagcugggaga

SEQ ID NO: 1804524 - RNA, 20 nt, Human
ggccucggacuuagcuggga

SEQ ID NO: 1804525 - RNA, 17 nt, Human
ggccucggacuuagcug

SEQ ID NO: 1804526 - RNA, 18 nt, Human
ggccucuuaugggcuggg

SEQ ID NO: 1804527 - RNA, 20 nt, Human
ggccucgguguggagaagcg

SEQ ID NO: 1804528 - RNA, 17 nt, Human
ggccucuuaugggcugg

SEQ ID NO: 1804529 - RNA, 13 nt, Human
ggccucugcacuc

SEQ ID NO: 1804530 - RNA, 14 nt, Human
ggccucugcacucc

SEQ ID NO: 1804531 - RNA, 15 nt, Human
ggccucugcacuccc

SEQ ID NO: 1804532 - RNA, 16 nt, Human
ggccucugcacucccc

SEQ ID NO: 1804533 - RNA, 16 nt, Human
ggcuccaggcuccuuu

SEQ ID NO: 1804534 - RNA, 17 nt, Human
ggcucccacaggcccuu

SEQ ID NO: 1804535 - RNA, 18 nt, Human
ggcucccacaggcccuuc

SEQ ID NO: 1804536 - RNA, 19 nt, Human
ggcucccacaggcccuucc

SEQ ID NO: 1804537 - RNA, 11 nt, Human
ggcuccaggcu

SEQ ID NO: 1804538 - RNA, 21 nt, Human
ggcucaaguccucuuuucuga

SEQ ID NO: 1804539 - RNA, 15 nt, Human
ggcucaaguccucuu

SEQ ID NO: 1804540 - RNA, 12 nt, Human
ggcuccagcugg

SEQ ID NO: 1804541 - RNA, 12 nt, Human
ggcuccaggagc

SEQ ID NO: 1804542 - RNA, 13 nt, Human
ggcuccaggagca

SEQ ID NO: 1804543 - RNA, 19 nt, Human
ggcuccaggagcagccaca

SEQ ID NO: 1804544 - RNA, 15 nt, Human
ggcuaguugggcuuc

SEQ ID NO: 1804545 - RNA, 23 nt, Human
ggcuagugugguguuuccuggca

SEQ ID NO: 1804546 - RNA, 16 nt, Human
ggcuaguugggcuucc

SEQ ID NO: 1804547 - RNA, 19 nt, Human
ggcuaugggggcacugagg

SEQ ID NO: 1804548 - RNA, 15 nt, Human
ggcuaugcauuugaa

SEQ ID NO: 1804549 - RNA, 16 nt, Human
ggcuaggaccccucca

SEQ ID NO: 1804550 - RNA, 22 nt, Human
ggcuaggaccccuccauguggg

SEQ ID NO: 1804551 - RNA, 22 nt, Human
ggcuagagguucaaagauauuu

SEQ ID NO: 1804552 - RNA, 17 nt, Human
ggcuagagguucaaaga

SEQ ID NO: 1804553 - RNA, 19 nt, Human
ggccuggccugagcuggga

SEQ ID NO: 1804554 - RNA, 18 nt, Human
ggccuguccaacacaucu

SEQ ID NO: 1804555 - RNA, 11 nt, Human
ggccugugagc

SEQ ID NO: 1804556 - RNA, 14 nt, Human
ggccugggggcugg

SEQ ID NO: 1804557 - RNA, 20 nt, Human
ggccugggggcugggcagag

SEQ ID NO: 1804558 - RNA, 22 nt, Human
ggccugggggcugggcagagga

SEQ ID NO: 1804559 - RNA, 18 nt, Human
ggcgcugccccuggcagc

SEQ ID NO: 1804560 - RNA, 19 nt, Human
ggcgcugccccuggcagcc

SEQ ID NO: 1804561 - RNA, 21 nt, Human
ggcgcugccccuggcagcccc

SEQ ID NO: 1804562 - RNA, 23 nt, Human
ggcgcugccccuggcagccccug

SEQ ID NO: 1804563 - RNA, 15 nt, Human
gaguugaagacagag

SEQ ID NO: 1804564 - RNA, 17 nt, Human
gaguugaagacagagcu

SEQ ID NO: 1804565 - RNA, 21 nt, Human
gaguugaagacagagcuacac

SEQ ID NO: 1804566 - RNA, 20 nt, Human
gaguucauacccuguuacca

SEQ ID NO: 1804567 - RNA, 14 nt, Human
gaguucaucuugaa

SEQ ID NO: 1804568 - RNA, 19 nt, Human
gaguucaucuugaauugua

SEQ ID NO: 1804569 - RNA, 20 nt, Human
gaguucaucuugaauuguaa

SEQ ID NO: 1804570 - RNA, 13 nt, Human
gaguuacagacaa

SEQ ID NO: 1804571 - RNA, 15 nt, Human
gaguuacagacaaag

SEQ ID NO: 1804572 - RNA, 12 nt, Human
gaguuacagaca

SEQ ID NO: 1804573 - RNA, 20 nt, Human
gagugugccugaagucccag

SEQ ID NO: 1804574 - RNA, 17 nt, Human
gagugacagaggcagcc

SEQ ID NO: 1804575 - RNA, 15 nt, Human
gaguggguugauuuc

SEQ ID NO: 1804576 - RNA, 13 nt, Human
gagugggugaaua

SEQ ID NO: 1804577 - RNA, 20 nt, Human
gauacaggaaaagcugcuga

SEQ ID NO: 1804578 - RNA, 22 nt, Human
gauaagaaccuuuugagugccu

SEQ ID NO: 1804579 - RNA, 23 nt, Human
gauacaggaaaagcugcugacag

SEQ ID NO: 1804580 - RNA, 21 nt, Human
gauacaggaaaagcugcugac

SEQ ID NO: 1804581 - RNA, 16 nt, Human
gauagcacagacccug

SEQ ID NO: 1804582 - RNA, 15 nt, Human
gauagcacagacccu

SEQ ID NO: 1804583 - RNA, 22 nt, Human
gauagccaaggccaaaggaagc

SEQ ID NO: 1804584 - RNA, 16 nt, Human
gaucacggcucacugc

SEQ ID NO: 1804585 - RNA, 15 nt, Human
gaucacggcucacug

SEQ ID NO: 1804586 - RNA, 18 nt, Human
gaucacggcucacugcag

SEQ ID NO: 1804587 - RNA, 14 nt, Human
gaucacagccucug

SEQ ID NO: 1804588 - RNA, 15 nt, Human
gauauaagugugugu

SEQ ID NO: 1804589 - RNA, 20 nt, Human
gaggucagagccugcaguua

SEQ ID NO: 1804590 - RNA, 17 nt, Human
gaggucagagccugcag

SEQ ID NO: 1804591 - RNA, 15 nt, Human
gagguugggaggcca

SEQ ID NO: 1804592 - RNA, 17 nt, Human
gagguugggaggccauu

SEQ ID NO: 1804593 - RNA, 20 nt, Human
gagguuucucaaagaaauuu

SEQ ID NO: 1804594 - RNA, 16 nt, Human
gagguuucaaaccucc

SEQ ID NO: 1804595 - RNA, 22 nt, Human
gaguagcugggacuacaggcac

SEQ ID NO: 1804596 - RNA, 12 nt, Human
gaguaggaagac

SEQ ID NO: 1804597 - RNA, 13 nt, Human
gaguaggaagacu

SEQ ID NO: 1804598 - RNA, 17 nt, Human
gaguaggaagacuuugg

SEQ ID NO: 1804599 - RNA, 19 nt, Human
gaguagcugggacuacagg

SEQ ID NO: 1804600 - RNA, 21 nt, Human
gaguacuacaguccucccauc

SEQ ID NO: 1804601 - RNA, 23 nt, Human
gaguacuacaguccucccaucuc

SEQ ID NO: 1804602 - RNA, 22 nt, Human
gaguaauccaagcaaaugugaa

SEQ ID NO: 1804603 - RNA, 20 nt, Human
gaguacuacaguccucccau

SEQ ID NO: 1804604 - RNA, 14 nt, Human
gagucgaggacagg

SEQ ID NO: 1804605 - RNA, 19 nt, Human
gaguccgaaagggacuugg

SEQ ID NO: 1804606 - RNA, 16 nt, Human
gagucgaggacaggga

SEQ ID NO: 1804607 - RNA, 15 nt, Human
gagucgaggacaggg

SEQ ID NO: 1804608 - RNA, 18 nt, Human
gaguaggaagacuuugga

SEQ ID NO: 1804609 - RNA, 19 nt, Human
gaguaggaagacuuuggaa

SEQ ID NO: 1804610 - RNA, 11 nt, Human
gaguauauguc

SEQ ID NO: 1804611 - RNA, 16 nt, Human
gagugacagaggcagc

SEQ ID NO: 1804612 - RNA, 15 nt, Human
gagugacagaggcag

SEQ ID NO: 1804613 - RNA, 14 nt, Human
gagugacagaggca

SEQ ID NO: 1804614 - RNA, 17 nt, Human
gagugaagcugggagaa

SEQ ID NO: 1804615 - RNA, 15 nt, Human
gagucugaaggcugg

SEQ ID NO: 1804616 - RNA, 14 nt, Human
gagucugaaggcug

SEQ ID NO: 1804617 - RNA, 12 nt, Human
gagucugaaggc

SEQ ID NO: 1804618 - RNA, 13 nt, Human
gagucugaaggcu

SEQ ID NO: 1804619 - RNA, 19 nt, Human
gaggcagccccauucugcc

SEQ ID NO: 1804620 - RNA, 19 nt, Human
gaggcagagguugcaguga

SEQ ID NO: 1804621 - RNA, 9 nt, Human
gaggcaggg

SEQ ID NO: 1804622 - RNA, 20 nt, Human
gaggcagccccauucugccu

SEQ ID NO: 1804623 - RNA, 21 nt, Human
gaggcagccccauucugccug

SEQ ID NO: 1804624 - RNA, 23 nt, Human
gaggccaugggccuccugugugu

SEQ ID NO: 1804625 - RNA, 21 nt, Human
gaggccaugggccuccugugu

SEQ ID NO: 1804626 - RNA, 20 nt, Human
gaggccaugggccuccugug

SEQ ID NO: 1804627 - RNA, 18 nt, Human
gaggccaugggccuccug

SEQ ID NO: 1804628 - RNA, 17 nt, Human
gaggccaugggccuccu

SEQ ID NO: 1804629 - RNA, 14 nt, Human
gaggccaugggccu

SEQ ID NO: 1804630 - RNA, 13 nt, Human
gaggaucucuuga

SEQ ID NO: 1804631 - RNA, 22 nt, Human
gagcccuguccugccuaaggcu

SEQ ID NO: 1804632 - RNA, 22 nt, Human
gaggaucucuugagccugggag

SEQ ID NO: 1804633 - RNA, 16 nt, Human
gaggaucucuugagcc

SEQ ID NO: 1804634 - RNA, 19 nt, Human
gaggaucucuugagccugg

SEQ ID NO: 1804635 - RNA, 20 nt, Human
gaggauugcuugagcucagg

SEQ ID NO: 1804636 - RNA, 19 nt, Human
gaggccuucucugaaggac

SEQ ID NO: 1804637 - RNA, 18 nt, Human
gaggccuucucugaagga

SEQ ID NO: 1804638 - RNA, 16 nt, Human
gaggccuucucugaag

SEQ ID NO: 1804639 - RNA, 16 nt, Human
gaggcugggcucccuu

SEQ ID NO: 1804640 - RNA, 21 nt, Human
gaggcgcaugaauuugugaag

SEQ ID NO: 1804641 - RNA, 11 nt, Human
gaggcccagag

SEQ ID NO: 1804642 - RNA, 13 nt, Human
gaggcccagaggg

SEQ ID NO: 1804643 - RNA, 14 nt, Human
gaggcccagagggc

SEQ ID NO: 1804644 - RNA, 19 nt, Human
gaggcccagagggccugca

SEQ ID NO: 1804645 - RNA, 15 nt, Human
gaggcccagagggcc

SEQ ID NO: 1804646 - RNA, 16 nt, Human
gaggcccagagggccu

SEQ ID NO: 1804647 - RNA, 22 nt, Human
gaggcccuucucuccagccccu

SEQ ID NO: 1804648 - RNA, 21 nt, Human
gaggcccuucucuccagcccc

SEQ ID NO: 1804649 - RNA, 15 nt, Human
gaggcccuucucucc

SEQ ID NO: 1804650 - RNA, 20 nt, Human
gaggcccuucucuccagccc

SEQ ID NO: 1804651 - RNA, 14 nt, Human
gagggucugaggaa

SEQ ID NO: 1804652 - RNA, 13 nt, Human
gagggucugagga

SEQ ID NO: 1804653 - RNA, 22 nt, Human
gagggugucccaaaaagaaagg

SEQ ID NO: 1804654 - RNA, 21 nt, Human
gaggguggugaccucugccug

SEQ ID NO: 1804655 - RNA, 14 nt, Human
gaggguggugaccu

SEQ ID NO: 1804656 - RNA, 15 nt, Human
gagggugggaguggg

SEQ ID NO: 1804657 - RNA, 12 nt, Human
gaggguggaaua

SEQ ID NO: 1804658 - RNA, 21 nt, Human
gagggugaagugaagacaaug

SEQ ID NO: 1804659 - RNA, 13 nt, Human
gaggucagagccu

SEQ ID NO: 1804660 - RNA, 12 nt, Human
gaggucagagcc

SEQ ID NO: 1804661 - RNA, 17 nt, Human
gaggucaaggcugcagu

SEQ ID NO: 1804662 - RNA, 15 nt, Human
gaggguugggcuggu

SEQ ID NO: 1804663 - RNA, 14 nt, Human
gaggguugggcugg

SEQ ID NO: 1804664 - RNA, 24 nt, Human
gagguaaggaauaccugucccccu

SEQ ID NO: 1804665 - RNA, 21 nt, Human
gagguaaggaauaccuguccc

SEQ ID NO: 1804666 - RNA, 13 nt, Human
gaggguaaggcug

SEQ ID NO: 1804667 - RNA, 17 nt, Human
gaggggguggccuccca

SEQ ID NO: 1804668 - RNA, 17 nt, Human
gaggggcugugggcgug

SEQ ID NO: 1804669 - RNA, 18 nt, Human
gagggagugacagaggca

SEQ ID NO: 1804670 - RNA, 20 nt, Human
gagggagggggaaggcaggg

SEQ ID NO: 1804671 - RNA, 20 nt, Human
gagggagggcuccagacaca

SEQ ID NO: 1804672 - RNA, 22 nt, Human
gagggagugacagaggcagccc

SEQ ID NO: 1804673 - RNA, 21 nt, Human
gagggagugacagaggcagcc

SEQ ID NO: 1804674 - RNA, 19 nt, Human
gagggagggcuccagacac

SEQ ID NO: 1804675 - RNA, 20 nt, Human
gaggcugggcucccuuccca

SEQ ID NO: 1804676 - RNA, 15 nt, Human
gcacagugcaucuca

SEQ ID NO: 1804677 - RNA, 18 nt, Human
gcacagugcaucucagcc

SEQ ID NO: 1804678 - RNA, 13 nt, Human
gcacagugcaucu

SEQ ID NO: 1804679 - RNA, 22 nt, Human
gcacagaguuguuacauuuuua

SEQ ID NO: 1804680 - RNA, 21 nt, Human
gcacagaguuguuacauuuuu

SEQ ID NO: 1804681 - RNA, 19 nt, Human
gcacagaguuguuacauuu

SEQ ID NO: 1804682 - RNA, 18 nt, Human
gcacagaguuguuacauu

SEQ ID NO: 1804683 - RNA, 16 nt, Human
gcacagaguuguuaca

SEQ ID NO: 1804684 - RNA, 22 nt, Human
gcaccccagcuggggccaggcu

SEQ ID NO: 1804685 - RNA, 12 nt, Human
gcaccauaacuu

SEQ ID NO: 1804686 - RNA, 20 nt, Human
gcaccuuagacagucccugc

SEQ ID NO: 1804687 - RNA, 21 nt, Human
gcaccuuagacagucccugcc

SEQ ID NO: 1804688 - RNA, 15 nt, Human
gcacgauuucuguuu

SEQ ID NO: 1804689 - RNA, 13 nt, Human
gcacgauuucugu

SEQ ID NO: 1804690 - RNA, 14 nt, Human
gcagacaggcaagc

SEQ ID NO: 1804691 - RNA, 13 nt, Human
gcagacaggcaag

SEQ ID NO: 1804692 - RNA, 12 nt, Human
gcagacaggcaa

SEQ ID NO: 1804693 - RNA, 14 nt, Human
gcacugcugcccag

SEQ ID NO: 1804694 - RNA, 15 nt, Human
gcacugcugcccagc

SEQ ID NO: 1804695 - RNA, 18 nt, Human
gcacugcugcccagccuc

SEQ ID NO: 1804696 - RNA, 20 nt, Human
gcacugcugcccagccucca

SEQ ID NO: 1804697 - RNA, 16 nt, Human
gcacgauuucuguuua

SEQ ID NO: 1804698 - RNA, 23 nt, Human
gcacugcuuccagugaggcucug

SEQ ID NO: 1804699 - RNA, 14 nt, Human
gcacugguggcccg

SEQ ID NO: 1804700 - RNA, 19 nt, Human
gcacugguggcccgacagc

SEQ ID NO: 1804701 - RNA, 20 nt, Human
gcaauucuccugccucagcc

SEQ ID NO: 1804702 - RNA, 18 nt, Human
gcaauucuccugccucag

SEQ ID NO: 1804703 - RNA, 19 nt, Human
gcaauucuccugccucagc

SEQ ID NO: 1804704 - RNA, 14 nt, Human
gcaauucuccugcc

SEQ ID NO: 1804705 - RNA, 15 nt, Human
gcaauucuccugccu

SEQ ID NO: 1804706 - RNA, 16 nt, Human
gcaauucuccugccuc

SEQ ID NO: 1804707 - RNA, 17 nt, Human
gcaauucuccugccuca

SEQ ID NO: 1804708 - RNA, 15 nt, Human
gcacaaacagaggcc

SEQ ID NO: 1804709 - RNA, 16 nt, Human
gcacaaacagaggccg

SEQ ID NO: 1804710 - RNA, 14 nt, Human
gcacaaacagaggc

SEQ ID NO: 1804711 - RNA, 14 nt, Human
gcaaugugauaaaa

SEQ ID NO: 1804712 - RNA, 15 nt, Human
gcaauggcagccuug

SEQ ID NO: 1804713 - RNA, 14 nt, Human
gcaacucaucuuag

SEQ ID NO: 1804714 - RNA, 23 nt, Human
gcacagaaaauggaagacagcuc

SEQ ID NO: 1804715 - RNA, 21 nt, Human
gcacagaaaauggaagacagc

SEQ ID NO: 1804716 - RNA, 22 nt, Human
gcacagaaaauggaagacagcu

SEQ ID NO: 1804717 - RNA, 14 nt, Human
gcacagacccugcc

SEQ ID NO: 1804718 - RNA, 15 nt, Human
gcacagacccugccc

SEQ ID NO: 1804719 - RNA, 16 nt, Human
gcacagacccugcccu

SEQ ID NO: 1804720 - RNA, 17 nt, Human
gcacagacccugcccug

SEQ ID NO: 1804721 - RNA, 15 nt, Human
gcacagaguuguuac

SEQ ID NO: 1804722 - RNA, 22 nt, Human
gcacagacccugcccugugggc

SEQ ID NO: 1804723 - RNA, 18 nt, Human
gcacagacccugcccugu

SEQ ID NO: 1804724 - RNA, 19 nt, Human
gcacagacccugcccugug

SEQ ID NO: 1804725 - RNA, 20 nt, Human
gcacagacccugcccugugg

SEQ ID NO: 1804726 - RNA, 21 nt, Human
gcacagacccugcccuguggg

SEQ ID NO: 1804727 - RNA, 20 nt, Human
gcacagaaaauggaagacag

SEQ ID NO: 1804728 - RNA, 23 nt, Human
gcacaaauucugucucuggauua

SEQ ID NO: 1804729 - RNA, 21 nt, Human
gcacaagcuccaagcucccag

SEQ ID NO: 1804730 - RNA, 18 nt, Human
gcacaagcuccaagcucc

SEQ ID NO: 1804731 - RNA, 15 nt, Human
gcacaagcuccaagc

SEQ ID NO: 1804732 - RNA, 17 nt, Human
gcacaagcuccaagcuc

SEQ ID NO: 1804733 - RNA, 13 nt, Human
gaugguuccccug

SEQ ID NO: 1804734 - RNA, 18 nt, Human
gaugguuccccuguucac

SEQ ID NO: 1804735 - RNA, 21 nt, Human
gaugguuccccuguucacucu

SEQ ID NO: 1804736 - RNA, 12 nt, Human
gauggugcaaug

SEQ ID NO: 1804737 - RNA, 14 nt, Human
gauggugcaaugac

SEQ ID NO: 1804738 - RNA, 17 nt, Human
gauggugcaaugaccuu

SEQ ID NO: 1804739 - RNA, 15 nt, Human
gauggugcaaugacc

SEQ ID NO: 1804740 - RNA, 16 nt, Human
gauggugcaaugaccu

SEQ ID NO: 1804741 - RNA, 22 nt, Human
gauuacaagcgugagccacugc

SEQ ID NO: 1804742 - RNA, 20 nt, Human
gauuaaagaugagcuuuguc

SEQ ID NO: 1804743 - RNA, 15 nt, Human
gauuaaacuuaaucu

SEQ ID NO: 1804744 - RNA, 23 nt, Human
gauuacaagcgugagccacugca

SEQ ID NO: 1804745 - RNA, 18 nt, Human
gauuacaggcaugugcca

SEQ ID NO: 1804746 - RNA, 20 nt, Human
gauuacaggcgugagccacc

SEQ ID NO: 1804747 - RNA, 17 nt, Human
gauuacaggcuccugcc

SEQ ID NO: 1804748 - RNA, 16 nt, Human
gauguuuaguaaucau

SEQ ID NO: 1804749 - RNA, 21 nt, Human
gaugccccgucccccucuggc

SEQ ID NO: 1804750 - RNA, 17 nt, Human
gaugcugacuguacucc

SEQ ID NO: 1804751 - RNA, 20 nt, Human
gaugcugacuguacuccucc

SEQ ID NO: 1804752 - RNA, 22 nt, Human
gaugcuagaacucccuuucaac

SEQ ID NO: 1804753 - RNA, 20 nt, Human
gaugcuagaacucccuuuca

SEQ ID NO: 1804754 - RNA, 16 nt, Human
gaugccccgucccccu

SEQ ID NO: 1804755 - RNA, 18 nt, Human
gaugcuagaacucccuuu

SEQ ID NO: 1804756 - RNA, 19 nt, Human
gaugcccaaagaugcagcc

SEQ ID NO: 1804757 - RNA, 20 nt, Human
gaugcccaaagaugcagccg

SEQ ID NO: 1804758 - RNA, 21 nt, Human
gaugggcaacccccagccugc

SEQ ID NO: 1804759 - RNA, 24 nt, Human
gauggggcccugccuccuuuguga

SEQ ID NO: 1804760 - RNA, 20 nt, Human
gaugggcaacccccagccug

SEQ ID NO: 1804761 - RNA, 22 nt, Human
gauggccgggcgcgguggcuca

SEQ ID NO: 1804762 - RNA, 13 nt, Human
gauggggcugcac

SEQ ID NO: 1804763 - RNA, 19 nt, Human
gauggggcugcaccggcug

SEQ ID NO: 1804764 - RNA, 15 nt, Human
gauggggcugcaccg

SEQ ID NO: 1804765 - RNA, 19 nt, Human
gaugggugcuuggaggaag

SEQ ID NO: 1804766 - RNA, 15 nt, Human
gauugcaacaggcug

SEQ ID NO: 1804767 - RNA, 14 nt, Human
gauucuccugccuc

SEQ ID NO: 1804768 - RNA, 16 nt, Human
gauucucaugccucag

SEQ ID NO: 1804769 - RNA, 20 nt, Human
gauuacagggaugagccacc

SEQ ID NO: 1804770 - RNA, 18 nt, Human
gauuacagggaugagcca

SEQ ID NO: 1804771 - RNA, 18 nt, Human
gauuacaggcuccugcca

SEQ ID NO: 1804772 - RNA, 21 nt, Human
gauuacaggcuccugccacca

SEQ ID NO: 1804773 - RNA, 12 nt, Human
gauuuaaaucag

SEQ ID NO: 1804774 - RNA, 14 nt, Human
gauuuaacagaaau

SEQ ID NO: 1804775 - RNA, 13 nt, Human
gauuuaacagaaa

SEQ ID NO: 1804776 - RNA, 16 nt, Human
gauuugagcucagccc

SEQ ID NO: 1804777 - RNA, 22 nt, Human
gauuuccguuaaaauaccagcc

SEQ ID NO: 1804778 - RNA, 15 nt, Human
gauuuaacagaaaug

SEQ ID NO: 1804779 - RNA, 15 nt, Human
gcaaaccaucauuga

SEQ ID NO: 1804780 - RNA, 23 nt, Human
gcaaaugugaaucauuuuaccuu

SEQ ID NO: 1804781 - RNA, 15 nt, Human
gcaaauguggcuccu

SEQ ID NO: 1804782 - RNA, 19 nt, Human
gauuuugauccaagcuggu

SEQ ID NO: 1804783 - RNA, 21 nt, Human
gauuuugaaauuuuuauuaaa

SEQ ID NO: 1804784 - RNA, 16 nt, Human
gauuuugcuguagaag

SEQ ID NO: 1804785 - RNA, 12 nt, Human
gcaaaccaucau

SEQ ID NO: 1804786 - RNA, 16 nt, Human
gacaaggaaaaaauaa

SEQ ID NO: 1804787 - RNA, 21 nt, Human
gacaaggauugcuacuguccu

SEQ ID NO: 1804788 - RNA, 19 nt, Human
gacaaggauugcuacuguc

SEQ ID NO: 1804789 - RNA, 18 nt, Human
gacaaggauugcuacugu

SEQ ID NO: 1804790 - RNA, 21 nt, Human
gacaaggaugaucuaggaaga

SEQ ID NO: 1804791 - RNA, 22 nt, Human
gacaaugcaaaccaucauugaa

SEQ ID NO: 1804792 - RNA, 12 nt, Human
gacaaugugaaa

SEQ ID NO: 1804793 - RNA, 18 nt, Human
gacaaugugaaaagaaaa

SEQ ID NO: 1804794 - RNA, 19 nt, Human
gacaaugugaaaagaaaaa

SEQ ID NO: 1804795 - RNA, 20 nt, Human
gacaaugugaaaagaaaaau

SEQ ID NO: 1804796 - RNA, 19 nt, Human
gacacaggcccggcuccag

SEQ ID NO: 1804797 - RNA, 22 nt, Human
gacacaagccuucggcgccuua

SEQ ID NO: 1804798 - RNA, 16 nt, Human
gacacaagccuucggc

SEQ ID NO: 1804799 - RNA, 21 nt, Human
gacacaggcccggcuccaggc

SEQ ID NO: 1804800 - RNA, 20 nt, Human
gacacaggcccggcuccagg

SEQ ID NO: 1804801 - RNA, 14 nt, Human
gacacaugcaaggu

SEQ ID NO: 1804802 - RNA, 19 nt, Human
gacacaugcaaggucauuu

SEQ ID NO: 1804803 - RNA, 15 nt, Human
gacacauguccaaga

SEQ ID NO: 1804804 - RNA, 20 nt, Human
gacacauguccaagaagccc

SEQ ID NO: 1804805 - RNA, 23 nt, Human
gacacauguccaagaagcccagg

SEQ ID NO: 1804806 - RNA, 16 nt, Human
gacaacagacuucuga

SEQ ID NO: 1804807 - RNA, 22 nt, Human
gacaacacucauugaccugagg

SEQ ID NO: 1804808 - RNA, 23 nt, Human
gacaacacucauugaccugaggc

SEQ ID NO: 1804809 - RNA, 15 nt, Human
gaauuguaaggaaug

SEQ ID NO: 1804810 - RNA, 21 nt, Human
gaauuucuucaacucccugcc

SEQ ID NO: 1804811 - RNA, 22 nt, Human
gaauuucuuuugccguuauuaa

SEQ ID NO: 1804812 - RNA, 20 nt, Human
gaauuugugaagguggaaau

SEQ ID NO: 1804813 - RNA, 15 nt, Human
gaaugcuguauaugu

SEQ ID NO: 1804814 - RNA, 21 nt, Human
gaaugcacaaacagaggccgc

SEQ ID NO: 1804815 - RNA, 21 nt, Human
gaaugaaagggcccagagagg

SEQ ID NO: 1804816 - RNA, 20 nt, Human
gaaugcacaaacagaggccg

SEQ ID NO: 1804817 - RNA, 20 nt, Human
gaauccagacccggcugcgu

SEQ ID NO: 1804818 - RNA, 18 nt, Human
gaauccagacccggcugc

SEQ ID NO: 1804819 - RNA, 12 nt, Human
gaaaggcuccag

SEQ ID NO: 1804820 - RNA, 15 nt, Human
gaauguuugccucug

SEQ ID NO: 1804821 - RNA, 21 nt, Human
gaauugacccacaagaaauga

SEQ ID NO: 1804822 - RNA, 16 nt, Human
gaauugacccacaaga

SEQ ID NO: 1804823 - RNA, 13 nt, Human
gaaugucagugug

SEQ ID NO: 1804824 - RNA, 21 nt, Human
gaccagacaccuugacagggc

SEQ ID NO: 1804825 - RNA, 11 nt, Human
gaccagagcug

SEQ ID NO: 1804826 - RNA, 14 nt, Human
gaccacguuucuaa

SEQ ID NO: 1804827 - RNA, 16 nt, Human
gaccacguuucuaaag

SEQ ID NO: 1804828 - RNA, 21 nt, Human
gaccacugcagaagacaguau

SEQ ID NO: 1804829 - RNA, 13 nt, Human
gaccaccugccca

SEQ ID NO: 1804830 - RNA, 14 nt, Human
gaccaccugcccaa

SEQ ID NO: 1804831 - RNA, 18 nt, Human
gacaugggaaaggggaag

SEQ ID NO: 1804832 - RNA, 19 nt, Human
gaccauucuccaccugcca

SEQ ID NO: 1804833 - RNA, 20 nt, Human
gaccauucuccaccugccag

SEQ ID NO: 1804834 - RNA, 21 nt, Human
gaccauucuccaccugccagg

SEQ ID NO: 1804835 - RNA, 22 nt, Human
gaccauucuccaccugccaggg

SEQ ID NO: 1804836 - RNA, 21 nt, Human
gaccagccuccaugcugccuc

SEQ ID NO: 1804837 - RNA, 22 nt, Human
gaccagccuccaugcugccucc

SEQ ID NO: 1804838 - RNA, 20 nt, Human
gaccagccuccaugcugccu

SEQ ID NO: 1804839 - RNA, 18 nt, Human
gaccagagcugccaccug

SEQ ID NO: 1804840 - RNA, 19 nt, Human
gaccagagcugccaccugc

SEQ ID NO: 1804841 - RNA, 13 nt, Human
gaccagagcugcc

SEQ ID NO: 1804842 - RNA, 14 nt, Human
gaccagagcugcca

SEQ ID NO: 1804843 - RNA, 15 nt, Human
gaccagagcugccac

SEQ ID NO: 1804844 - RNA, 17 nt, Human
gaccagagcugccaccu

SEQ ID NO: 1804845 - RNA, 21 nt, Human
gaccccuccaugugggcuagu

SEQ ID NO: 1804846 - RNA, 22 nt, Human
gacccugaggcccagagggccu

SEQ ID NO: 1804847 - RNA, 18 nt, Human
gaccccuccaugugggcu

SEQ ID NO: 1804848 - RNA, 14 nt, Human
gaccccuccaugug

SEQ ID NO: 1804849 - RNA, 23 nt, Human
gacccugaggcccagagggccug

SEQ ID NO: 1804850 - RNA, 12 nt, Human
gacccugcccug

SEQ ID NO: 1804851 - RNA, 12 nt, Human
gacccccaacca

SEQ ID NO: 1804852 - RNA, 21 nt, Human
gacccccaaccaaguggcucc

SEQ ID NO: 1804853 - RNA, 22 nt, Human
gacccacaagaaaugaaagcag

SEQ ID NO: 1804854 - RNA, 15 nt, Human
gacccacaagaaaug

SEQ ID NO: 1804855 - RNA, 16 nt, Human
gacccaaaaggcagaa

SEQ ID NO: 1804856 - RNA, 12 nt, Human
gacccugucuca

SEQ ID NO: 1804857 - RNA, 19 nt, Human
gacccuuguggucccaccc

SEQ ID NO: 1804858 - RNA, 20 nt, Human
gacccuuguggucccacccc

SEQ ID NO: 1804859 - RNA, 21 nt, Human
gacccuuguggucccacccca

SEQ ID NO: 1804860 - RNA, 19 nt, Human
gaccgugaggccagagaca

SEQ ID NO: 1804861 - RNA, 18 nt, Human
gaccgugaggccagagac

SEQ ID NO: 1804862 - RNA, 16 nt, Human
gaccgugaggccagag

SEQ ID NO: 1804863 - RNA, 17 nt, Human
gaccgugaggccagaga

SEQ ID NO: 1804864 - RNA, 16 nt, Human
gacagggaggugaccc

SEQ ID NO: 1804865 - RNA, 18 nt, Human
gacagggaggacgcucuc

SEQ ID NO: 1804866 - RNA, 23 nt, Human
gacagggcacaccgggcacucag

SEQ ID NO: 1804867 - RNA, 24 nt, Human
gacagggcacaccgggcacucaga

SEQ ID NO: 1804868 - RNA, 14 nt, Human
gacaguuaagagaa

SEQ ID NO: 1804869 - RNA, 14 nt, Human
gacaggaccaggga

SEQ ID NO: 1804870 - RNA, 15 nt, Human
gacaggaccagggau

SEQ ID NO: 1804871 - RNA, 23 nt, Human
gacaggaccagggauuuccauga

SEQ ID NO: 1804872 - RNA, 17 nt, Human
gacagggaggacgcucu

SEQ ID NO: 1804873 - RNA, 14 nt, Human
gacaugaucuucuu

SEQ ID NO: 1804874 - RNA, 14 nt, Human
gacaugggaaaggg

SEQ ID NO: 1804875 - RNA, 22 nt, Human
gacaguuaagagaaaugagcuu

SEQ ID NO: 1804876 - RNA, 20 nt, Human
gacauagaauuaacacauga

SEQ ID NO: 1804877 - RNA, 14 nt, Human
gacagagucucacu

SEQ ID NO: 1804878 - RNA, 23 nt, Human
gacagaggggguggccucccaac

SEQ ID NO: 1804879 - RNA, 21 nt, Human
gacagaggggguggccuccca

SEQ ID NO: 1804880 - RNA, 22 nt, Human
gacagaggggguggccucccaa

SEQ ID NO: 1804881 - RNA, 17 nt, Human
gacagaggcagccccau

SEQ ID NO: 1804882 - RNA, 15 nt, Human
gacagaggggguggc

SEQ ID NO: 1804883 - RNA, 18 nt, Human
gacagaggggguggccuc

SEQ ID NO: 1804884 - RNA, 19 nt, Human
gacagaggggguggccucc

SEQ ID NO: 1804885 - RNA, 16 nt, Human
gacagaggcagcccca

SEQ ID NO: 1804886 - RNA, 14 nt, Human
gacagaggcagccc

SEQ ID NO: 1804887 - RNA, 21 nt, Human
gacagagcaagugagacccug

SEQ ID NO: 1804888 - RNA, 19 nt, Human
gacagccacggccaggcca

SEQ ID NO: 1804889 - RNA, 18 nt, Human
gacagccacggccaggcc

SEQ ID NO: 1804890 - RNA, 17 nt, Human
gacagccacggccaggc

SEQ ID NO: 1804891 - RNA, 14 nt, Human
gacagccacggcca

SEQ ID NO: 1804892 - RNA, 22 nt, Human
gacagagugagacucugucuca

SEQ ID NO: 1804893 - RNA, 20 nt, Human
gacagagugagacucugucu

SEQ ID NO: 1804894 - RNA, 21 nt, Human
gacagccacggccaggccaga

SEQ ID NO: 1804895 - RNA, 20 nt, Human
gacagccacggccaggccag

SEQ ID NO: 1804896 - RNA, 16 nt, Human
gacagcugccugggau

SEQ ID NO: 1804897 - RNA, 17 nt, Human
gacagcugccugggauc

SEQ ID NO: 1804898 - RNA, 18 nt, Human
gacagcugccugggaucc

SEQ ID NO: 1804899 - RNA, 21 nt, Human
gacagcugccugggaucccuc

SEQ ID NO: 1804900 - RNA, 13 nt, Human
gacuuggaagcuc

SEQ ID NO: 1804901 - RNA, 19 nt, Human
gacuuaaaauauuccugca

SEQ ID NO: 1804902 - RNA, 19 nt, Human
gacuuaagcacacuugaca

SEQ ID NO: 1804903 - RNA, 16 nt, Human
gagaaagguugaagca

SEQ ID NO: 1804904 - RNA, 22 nt, Human
gagaaaguacuucuccacccug

SEQ ID NO: 1804905 - RNA, 21 nt, Human
gagaaaugaaaaaauauauau

SEQ ID NO: 1804906 - RNA, 14 nt, Human
gagaaaugagcuug

SEQ ID NO: 1804907 - RNA, 14 nt, Human
gagaagagaaugca

SEQ ID NO: 1804908 - RNA, 16 nt, Human
gagaagagaaugcaca

SEQ ID NO: 1804909 - RNA, 16 nt, Human
gagaagcagaggaagg

SEQ ID NO: 1804910 - RNA, 22 nt, Human
gacugaguacguugugcauuug

SEQ ID NO: 1804911 - RNA, 21 nt, Human
gacugaguacguugugcauuu

SEQ ID NO: 1804912 - RNA, 17 nt, Human
gacucgcgacaaugcaa

SEQ ID NO: 1804913 - RNA, 15 nt, Human
gacugcccggcaggg

SEQ ID NO: 1804914 - RNA, 13 nt, Human
gacugcccggcag

SEQ ID NO: 1804915 - RNA, 23 nt, Human
gacugaguacguugugcauuugg

SEQ ID NO: 1804916 - RNA, 18 nt, Human
gacuggaagcacagcuuc

SEQ ID NO: 1804917 - RNA, 16 nt, Human
gacuggaagcacagcu

SEQ ID NO: 1804918 - RNA, 15 nt, Human
gacuggaagcacagc

SEQ ID NO: 1804919 - RNA, 14 nt, Human
gacuggaagcacag

SEQ ID NO: 1804920 - RNA, 11 nt, Human
gacuccucugu

SEQ ID NO: 1804921 - RNA, 14 nt, Human
gacuccucugucca

SEQ ID NO: 1804922 - RNA, 12 nt, Human
gacuccugcagg

SEQ ID NO: 1804923 - RNA, 23 nt, Human
gacuccugcacacgcuccuuccu

SEQ ID NO: 1804924 - RNA, 13 nt, Human
gacuccugcaggc

SEQ ID NO: 1804925 - RNA, 13 nt, Human
gacucgcgacaau

SEQ ID NO: 1804926 - RNA, 13 nt, Human
gacuacaggugug

SEQ ID NO: 1804927 - RNA, 21 nt, Human
gacuacaggugugagucacca

SEQ ID NO: 1804928 - RNA, 18 nt, Human
gacuacaggugugaguca

SEQ ID NO: 1804929 - RNA, 15 nt, Human
gacucauucuucugu

SEQ ID NO: 1804930 - RNA, 14 nt, Human
gacucauucuucug

SEQ ID NO: 1804931 - RNA, 16 nt, Human
gagaguggcuccuccc

SEQ ID NO: 1804932 - RNA, 21 nt, Human
gagaguggcuccucccggugc

SEQ ID NO: 1804933 - RNA, 13 nt, Human
gagaguggcuccu

SEQ ID NO: 1804934 - RNA, 14 nt, Human
gagagggugggagu

SEQ ID NO: 1804935 - RNA, 20 nt, Human
gagagggugggagugggccc

SEQ ID NO: 1804936 - RNA, 16 nt, Human
gagagggugggagugg

SEQ ID NO: 1804937 - RNA, 19 nt, Human
gagaggggaacagacugga

SEQ ID NO: 1804938 - RNA, 13 nt, Human
gagaggggcacag

SEQ ID NO: 1804939 - RNA, 16 nt, Human
gagagcccuucauuug

SEQ ID NO: 1804940 - RNA, 19 nt, Human
gagagagcuucuguugcug

SEQ ID NO: 1804941 - RNA, 22 nt, Human
gagagagcuucuguugcugccu

SEQ ID NO: 1804942 - RNA, 23 nt, Human
gagaaugcacaaacagaggccgc

SEQ ID NO: 1804943 - RNA, 20 nt, Human
gagacagcucugcauacuca

SEQ ID NO: 1804944 - RNA, 22 nt, Human
gagacaggguuuugccauguug

SEQ ID NO: 1804945 - RNA, 14 nt, Human
gagaccaucccuga

SEQ ID NO: 1804946 - RNA, 18 nt, Human
gagaccaucccugaaggc

SEQ ID NO: 1804947 - RNA, 21 nt, Human
gagaccaucccugaaggcccc

SEQ ID NO: 1804948 - RNA, 13 nt, Human
gagacucugucuc

SEQ ID NO: 1804949 - RNA, 20 nt, Human
gagacucgcgacaaugcaaa

SEQ ID NO: 1804950 - RNA, 21 nt, Human
gagacucgcgacaaugcaaac

SEQ ID NO: 1804951 - RNA, 19 nt, Human
gagacuccugcaggcagcc

SEQ ID NO: 1804952 - RNA, 20 nt, Human
gagacuccugcaggcagcca

SEQ ID NO: 1804953 - RNA, 21 nt, Human
gagacuccugcaggcagccag

SEQ ID NO: 1804954 - RNA, 18 nt, Human
gagcccugguggcagugg

SEQ ID NO: 1804955 - RNA, 19 nt, Human
gagccagggucucacuaug

SEQ ID NO: 1804956 - RNA, 23 nt, Human
gagcccacuguacuugcucuuga

SEQ ID NO: 1804957 - RNA, 23 nt, Human
gagccagauuucacucuccuugg

SEQ ID NO: 1804958 - RNA, 14 nt, Human
gagccagggucuca

SEQ ID NO: 1804959 - RNA, 21 nt, Human
gagccagcagccuggcucucc

SEQ ID NO: 1804960 - RNA, 12 nt, Human
gagcagagacca

SEQ ID NO: 1804961 - RNA, 16 nt, Human
gagcagagaauucucu

SEQ ID NO: 1804962 - RNA, 19 nt, Human
gagccaauuuaaagaaaac

SEQ ID NO: 1804963 - RNA, 20 nt, Human
gagccagauuucacucuccu

SEQ ID NO: 1804964 - RNA, 15 nt, Human
gagcauuagauuucu

SEQ ID NO: 1804965 - RNA, 21 nt, Human
gagcauuagauuucucauuug

SEQ ID NO: 1804966 - RNA, 15 nt, Human
gagcacuaaggugug

SEQ ID NO: 1804967 - RNA, 21 nt, Human
gagcaccuuagacagucccug

SEQ ID NO: 1804968 - RNA, 22 nt, Human
gagcaccuuagacagucccugc

SEQ ID NO: 1804969 - RNA, 21 nt, Human
gagcacuaaggugugcucuga

SEQ ID NO: 1804970 - RNA, 20 nt, Human
gagcaccuuagacagucccu

SEQ ID NO: 1804971 - RNA, 23 nt, Human
gagaucaaccccuucgcuccugu

SEQ ID NO: 1804972 - RNA, 16 nt, Human
gagauagccaaggcca

SEQ ID NO: 1804973 - RNA, 14 nt, Human
gagauagccaaggc

SEQ ID NO: 1804974 - RNA, 19 nt, Human
gagaucacgccacugcacu

SEQ ID NO: 1804975 - RNA, 18 nt, Human
gagaucacgccacugcac

SEQ ID NO: 1804976 - RNA, 19 nt, Human
gagauagccaaggccaaag

SEQ ID NO: 1804977 - RNA, 17 nt, Human
gagaugaggccgccaug

SEQ ID NO: 1804978 - RNA, 15 nt, Human
cugccucuucucuac

SEQ ID NO: 1804979 - RNA, 17 nt, Human
cugccugcccaggcccc

SEQ ID NO: 1804980 - RNA, 16 nt, Human
cugccugcccaggccc

SEQ ID NO: 1804981 - RNA, 15 nt, Human
cugccugaagucaca

SEQ ID NO: 1804982 - RNA, 20 nt, Human
cugccugcccaggccccugc

SEQ ID NO: 1804983 - RNA, 21 nt, Human
cugccugggaucccucauccu

SEQ ID NO: 1804984 - RNA, 22 nt, Human
cugccugggaucccucauccuc

SEQ ID NO: 1804985 - RNA, 20 nt, Human
cugccucucugcaggucccu

SEQ ID NO: 1804986 - RNA, 21 nt, Human
cugccucucugcaggucccua

SEQ ID NO: 1804987 - RNA, 23 nt, Human
cugccucugacacacagcucugu

SEQ ID NO: 1804988 - RNA, 22 nt, Human
cugccucugacacacagcucug

SEQ ID NO: 1804989 - RNA, 15 nt, Human
cugccucugacacac

SEQ ID NO: 1804990 - RNA, 22 nt, Human
cugccucucugcaggucccuaa

SEQ ID NO: 1804991 - RNA, 12 nt, Human
cugccucccauc

SEQ ID NO: 1804992 - RNA, 14 nt, Human
cugccucccaucac

SEQ ID NO: 1804993 - RNA, 16 nt, Human
cugccucccaucaccc

SEQ ID NO: 1804994 - RNA, 19 nt, Human
cugccucccaucacccgcu

SEQ ID NO: 1804995 - RNA, 11 nt, Human
cugccucccau

SEQ ID NO: 1804996 - RNA, 22 nt, Human
cugcccugcugagucccaggcu

SEQ ID NO: 1804997 - RNA, 20 nt, Human
cugcccugcgggucacagga

SEQ ID NO: 1804998 - RNA, 12 nt, Human
cugcccuccaag

SEQ ID NO: 1804999 - RNA, 14 nt, Human
cucccuucccaccu

SEQ ID NO: 1805000 - RNA, 15 nt, Human
cucccuucccaccuc

SEQ ID NO: 1805001 - RNA, 16 nt, Human
cucccuucccaccucu

SEQ ID NO: 1805002 - RNA, 17 nt, Human
cucccuucccaccucuc

SEQ ID NO: 1805003 - RNA, 17 nt, Human
cugccgcagcccugcag

SEQ ID NO: 1805004 - RNA, 18 nt, Human
cugccgcagcccugcaga

SEQ ID NO: 1805005 - RNA, 21 nt, Human
cugcccuuucugggcaccggg

SEQ ID NO: 1805006 - RNA, 15 nt, Human
cugccgcagcccugc

SEQ ID NO: 1805007 - RNA, 14 nt, Human
cugccgcagcccug

SEQ ID NO: 1805008 - RNA, 19 nt, Human
cugcgaccacaagaaggau

SEQ ID NO: 1805009 - RNA, 19 nt, Human
cugcuccagcuguucagcu

SEQ ID NO: 1805010 - RNA, 20 nt, Human
cugcuccagcuguucagcug

SEQ ID NO: 1805011 - RNA, 14 nt, Human
cugcucuccucuug

SEQ ID NO: 1805012 - RNA, 20 nt, Human
cugcucuccucuugccacug

SEQ ID NO: 1805013 - RNA, 12 nt, Human
cugcugcccagc

SEQ ID NO: 1805014 - RNA, 15 nt, Human
cugcugcccagccuc

SEQ ID NO: 1805015 - RNA, 22 nt, Human
cugcugcccagccuccaagcuc

SEQ ID NO: 1805016 - RNA, 17 nt, Human
cugcugaaggaauaaau

SEQ ID NO: 1805017 - RNA, 18 nt, Human
cugcugaaggaauaaauu

SEQ ID NO: 1805018 - RNA, 21 nt, Human
cugcucuccucuugccacugc

SEQ ID NO: 1805019 - RNA, 11 nt, Human
cugcugaaggc

SEQ ID NO: 1805020 - RNA, 23 nt, Human
cugcugguucaggguuggccccu

SEQ ID NO: 1805021 - RNA, 15 nt, Human
cugcugguucagggu

SEQ ID NO: 1805022 - RNA, 13 nt, Human
cugcugguucagg

SEQ ID NO: 1805023 - RNA, 12 nt, Human
cugcuggcugcc

SEQ ID NO: 1805024 - RNA, 15 nt, Human
cugcuuccagugagg

SEQ ID NO: 1805025 - RNA, 16 nt, Human
cugcuuccagugaggc

SEQ ID NO: 1805026 - RNA, 18 nt, Human
cugcuuccagugaggcuc

SEQ ID NO: 1805027 - RNA, 19 nt, Human
cugcuuccagugaggcucu

SEQ ID NO: 1805028 - RNA, 20 nt, Human
cugcuuccagugaggcucug

SEQ ID NO: 1805029 - RNA, 21 nt, Human
cugcuuccagugaggcucugc

SEQ ID NO: 1805030 - RNA, 23 nt, Human
cugcuuccagugaggcucugccc

SEQ ID NO: 1805031 - RNA, 15 nt, Human
cugcugcuggcuggu

SEQ ID NO: 1805032 - RNA, 15 nt, Human
cuggcgugcaguggu

SEQ ID NO: 1805033 - RNA, 14 nt, Human
cuggcgugcagugg

SEQ ID NO: 1805034 - RNA, 14 nt, Human
cuggccugugucua

SEQ ID NO: 1805035 - RNA, 23 nt, Human
cuggccuucggccuccauccuga

SEQ ID NO: 1805036 - RNA, 21 nt, Human
cuggcucuuccaggcugggag

SEQ ID NO: 1805037 - RNA, 22 nt, Human
cuggcucuuccaggcugggaga

SEQ ID NO: 1805038 - RNA, 24 nt, Human
cuggcucuuccaggcugggagagc

SEQ ID NO: 1805039 - RNA, 21 nt, Human
cuggccucugcacuccccugc

SEQ ID NO: 1805040 - RNA, 18 nt, Human
cuggccucugcacucccc

SEQ ID NO: 1805041 - RNA, 20 nt, Human
cuggccucugcacuccccug

SEQ ID NO: 1805042 - RNA, 13 nt, Human
cuggccuggcccc

SEQ ID NO: 1805043 - RNA, 24 nt, Human
cuggccuggccccucagggucccu

SEQ ID NO: 1805044 - RNA, 22 nt, Human
cuggccuucggccuccauccug

SEQ ID NO: 1805045 - RNA, 20 nt, Human
cuggagugcagugagccgag

SEQ ID NO: 1805046 - RNA, 19 nt, Human
cuggcacccggccccugcu

SEQ ID NO: 1805047 - RNA, 21 nt, Human
cuggcacccggccccugcugg

SEQ ID NO: 1805048 - RNA, 20 nt, Human
cuggcacccggccccugcug

SEQ ID NO: 1805049 - RNA, 22 nt, Human
cuggcacccggccccugcuggu

SEQ ID NO: 1805050 - RNA, 19 nt, Human
cuggcacugcuuccaguga

SEQ ID NO: 1805051 - RNA, 20 nt, Human
cuggcacugcuuccagugag

SEQ ID NO: 1805052 - RNA, 23 nt, Human
cuggcacugcuuccagugaggcu

SEQ ID NO: 1805053 - RNA, 14 nt, Human
cuggcacuuggaga

SEQ ID NO: 1805054 - RNA, 21 nt, Human
cuggcacuuggagacuuguau

SEQ ID NO: 1805055 - RNA, 15 nt, Human
cuggcccacugcauc

SEQ ID NO: 1805056 - RNA, 19 nt, Human
cuggcaguggaacuaagaa

SEQ ID NO: 1805057 - RNA, 14 nt, Human
cuggccagaugcac

SEQ ID NO: 1805058 - RNA, 17 nt, Human
cuggagugcagugagcc

SEQ ID NO: 1805059 - RNA, 16 nt, Human
cuggagugcagugagc

SEQ ID NO: 1805060 - RNA, 15 nt, Human
cuggagugcagugag

SEQ ID NO: 1805061 - RNA, 14 nt, Human
cuggagugcaguga

SEQ ID NO: 1805062 - RNA, 22 nt, Human
cuggagguacgaaaagagggga

SEQ ID NO: 1805063 - RNA, 17 nt, Human
cuggagguacgaaaaga

SEQ ID NO: 1805064 - RNA, 13 nt, Human
cuggagcucugcc

SEQ ID NO: 1805065 - RNA, 12 nt, Human
cuggagcucugc

SEQ ID NO: 1805066 - RNA, 16 nt, Human
cuggagcucugcccau

SEQ ID NO: 1805067 - RNA, 21 nt, Human
cuggaccuugaacuggguacu

SEQ ID NO: 1805068 - RNA, 20 nt, Human
cuggaccuugaacuggguac

SEQ ID NO: 1805069 - RNA, 17 nt, Human
cuggaccuugaacuggg

SEQ ID NO: 1805070 - RNA, 14 nt, Human
cuggacuccucugu

SEQ ID NO: 1805071 - RNA, 17 nt, Human
cuggacuccucugucca

SEQ ID NO: 1805072 - RNA, 18 nt, Human
cuggacuccucuguccag

SEQ ID NO: 1805073 - RNA, 19 nt, Human
cuggacuccucuguccagg

SEQ ID NO: 1805074 - RNA, 20 nt, Human
cuggacuccucuguccaggc

SEQ ID NO: 1805075 - RNA, 15 nt, Human
cuggacccuguggau

SEQ ID NO: 1805076 - RNA, 16 nt, Human
cuggaccuugaacugg

SEQ ID NO: 1805077 - RNA, 17 nt, Human
cuggacaggcauguucu

SEQ ID NO: 1805078 - RNA, 14 nt, Human
cuggacaggcaugu

SEQ ID NO: 1805079 - RNA, 23 nt, Human
cuggacaggcauguucucugagg

SEQ ID NO: 1805080 - RNA, 13 nt, Human
cuggaauuugaaa

SEQ ID NO: 1805081 - RNA, 11 nt, Human
cugugccucug

SEQ ID NO: 1805082 - RNA, 14 nt, Human
cugugccucuggga

SEQ ID NO: 1805083 - RNA, 16 nt, Human
cugugccucugggacu

SEQ ID NO: 1805084 - RNA, 22 nt, Human
cugugcugcccugcccaccugg

SEQ ID NO: 1805085 - RNA, 17 nt, Human
cugugccucugggacug

SEQ ID NO: 1805086 - RNA, 18 nt, Human
cugugccucugggacugg

SEQ ID NO: 1805087 - RNA, 17 nt, Human
cuguggaugauaaaaca

SEQ ID NO: 1805088 - RNA, 16 nt, Human
cuguggccaaguucuu

SEQ ID NO: 1805089 - RNA, 18 nt, Human
cuguggccaaguucuuag

SEQ ID NO: 1805090 - RNA, 21 nt, Human
cugugggcgugagaccugccc

SEQ ID NO: 1805091 - RNA, 22 nt, Human
cugugggcgugagaccugcccc

SEQ ID NO: 1805092 - RNA, 14 nt, Human
cugugggcccccaa

SEQ ID NO: 1805093 - RNA, 19 nt, Human
cugugauggggcccugccu

SEQ ID NO: 1805094 - RNA, 20 nt, Human
cugugauggggcccugccuc

SEQ ID NO: 1805095 - RNA, 18 nt, Human
cugugccaugugccaggu

SEQ ID NO: 1805096 - RNA, 16 nt, Human
cugugccaugugccag

SEQ ID NO: 1805097 - RNA, 22 nt, Human
cugugccauuuuguauuuuacu

SEQ ID NO: 1805098 - RNA, 14 nt, Human
cugugccauuuugu

SEQ ID NO: 1805099 - RNA, 18 nt, Human
cugugauggggcccugcc

SEQ ID NO: 1805100 - RNA, 17 nt, Human
cugugauggggcccugc

SEQ ID NO: 1805101 - RNA, 23 nt, Human
cugugaguacuacaguccuccca

SEQ ID NO: 1805102 - RNA, 20 nt, Human
cugugaguacuacaguccuc

SEQ ID NO: 1805103 - RNA, 21 nt, Human
cugugaguacuacaguccucc

SEQ ID NO: 1805104 - RNA, 18 nt, Human
cugucuccauguuugaug

SEQ ID NO: 1805105 - RNA, 23 nt, Human
cugucucaagagggcacuggugg

SEQ ID NO: 1805106 - RNA, 20 nt, Human
cugugugugcgccuacagga

SEQ ID NO: 1805107 - RNA, 23 nt, Human
cugugucuugcaauggcagccuu

SEQ ID NO: 1805108 - RNA, 22 nt, Human
cugugucuugcaauggcagccu

SEQ ID NO: 1805109 - RNA, 21 nt, Human
cugugucuugcaauggcagcc

SEQ ID NO: 1805110 - RNA, 23 nt, Human
cugugggcgugagaccugccccu

SEQ ID NO: 1805111 - RNA, 23 nt, Human
cugugugcucaggagcccuggga

SEQ ID NO: 1805112 - RNA, 15 nt, Human
cuguguggcagucug

SEQ ID NO: 1805113 - RNA, 19 nt, Human
cugugugcucaggagcccu

SEQ ID NO: 1805114 - RNA, 16 nt, Human
cugugugcucaggagc

SEQ ID NO: 1805115 - RNA, 20 nt, Human
cugugugcucaggagcccug

SEQ ID NO: 1805116 - RNA, 21 nt, Human
cugugugcucaggagcccugg

SEQ ID NO: 1805117 - RNA, 13 nt, Human
cuguucucugccc

SEQ ID NO: 1805118 - RNA, 20 nt, Human
cuguucucugcccuccaaga

SEQ ID NO: 1805119 - RNA, 18 nt, Human
cuguucucugcccuccaa

SEQ ID NO: 1805120 - RNA, 19 nt, Human
cuguucucugcccuccaag

SEQ ID NO: 1805121 - RNA, 14 nt, Human
cuguucucugcccu

SEQ ID NO: 1805122 - RNA, 15 nt, Human
cuguucucugcccuc

SEQ ID NO: 1805123 - RNA, 16 nt, Human
cuguucucugcccucc

SEQ ID NO: 1805124 - RNA, 17 nt, Human
cuguucucugcccucca

SEQ ID NO: 1805125 - RNA, 18 nt, Human
cuguucccauucuugcau

SEQ ID NO: 1805126 - RNA, 18 nt, Human
cuguuacacuuuuuggaa

SEQ ID NO: 1805127 - RNA, 19 nt, Human
cuguuacacuuuuuggaag

SEQ ID NO: 1805128 - RNA, 13 nt, Human
cuguuacugucuu

SEQ ID NO: 1805129 - RNA, 19 nt, Human
cuguucagcugguugaggu

SEQ ID NO: 1805130 - RNA, 21 nt, Human
cuguucagcugguugagguuu

SEQ ID NO: 1805131 - RNA, 14 nt, Human
cugguggcagcugc

SEQ ID NO: 1805132 - RNA, 13 nt, Human
cugguggcagcug

SEQ ID NO: 1805133 - RNA, 20 nt, Human
cugguggcccgacagccugg

SEQ ID NO: 1805134 - RNA, 21 nt, Human
cugguggcccgacagccuggc

SEQ ID NO: 1805135 - RNA, 22 nt, Human
cugguggcccgacagccuggca

SEQ ID NO: 1805136 - RNA, 23 nt, Human
cugguggcccgacagccuggcac

SEQ ID NO: 1805137 - RNA, 23 nt, Human
cugguggcagcucaccucucccu

SEQ ID NO: 1805138 - RNA, 12 nt, Human
cuggugcugcca

SEQ ID NO: 1805139 - RNA, 13 nt, Human
cuggugcugccac

SEQ ID NO: 1805140 - RNA, 20 nt, Human
cuggugcugccacacuucag

SEQ ID NO: 1805141 - RNA, 22 nt, Human
cuggugcugccacacuucaggc

SEQ ID NO: 1805142 - RNA, 18 nt, Human
cuggucacaggacucugc

SEQ ID NO: 1805143 - RNA, 12 nt, Human
cugguuccuccc

SEQ ID NO: 1805144 - RNA, 16 nt, Human
cugguuccauggccuc

SEQ ID NO: 1805145 - RNA, 13 nt, Human
cugguuccucccc

SEQ ID NO: 1805146 - RNA, 23 nt, Human
cuguaaucacagcuacuugggag

SEQ ID NO: 1805147 - RNA, 20 nt, Human
cuguaauccuagcacuuugg

SEQ ID NO: 1805148 - RNA, 13 nt, Human
cuguacaaaguag

SEQ ID NO: 1805149 - RNA, 15 nt, Human
cuguacaaaguagaa

SEQ ID NO: 1805150 - RNA, 15 nt, Human
cugggggaagaagcu

SEQ ID NO: 1805151 - RNA, 19 nt, Human
cugggggcugggcagagga

SEQ ID NO: 1805152 - RNA, 22 nt, Human
cugggggggauuguaaaauggu

SEQ ID NO: 1805153 - RNA, 13 nt, Human
cugggggaagaag

SEQ ID NO: 1805154 - RNA, 24 nt, Human
cugggcuucaguggcagcugcuuu

SEQ ID NO: 1805155 - RNA, 22 nt, Human
cuggguaacuagggaagauaau

SEQ ID NO: 1805156 - RNA, 20 nt, Human
cuggguaacuagggaagaua

SEQ ID NO: 1805157 - RNA, 14 nt, Human
cuggguucuaccca

SEQ ID NO: 1805158 - RNA, 15 nt, Human
cuggguucuacccag

SEQ ID NO: 1805159 - RNA, 16 nt, Human
cuggguucuacccagg

SEQ ID NO: 1805160 - RNA, 17 nt, Human
cuggguucuacccaggu

SEQ ID NO: 1805161 - RNA, 22 nt, Human
cugucccuuacgugaguccugg

SEQ ID NO: 1805162 - RNA, 15 nt, Human
cuguccgagcuuuga

SEQ ID NO: 1805163 - RNA, 14 nt, Human
cuguccuacccacc

SEQ ID NO: 1805164 - RNA, 23 nt, Human
cugucucaaaaaaacacaaaagu

SEQ ID NO: 1805165 - RNA, 16 nt, Human
cugucucaaaaaaaga

SEQ ID NO: 1805166 - RNA, 22 nt, Human
cugucucaagagggcacuggug

SEQ ID NO: 1805167 - RNA, 18 nt, Human
cugucucaaaaaaagaaa

SEQ ID NO: 1805168 - RNA, 20 nt, Human
cugucccuuacgugaguccu

SEQ ID NO: 1805169 - RNA, 17 nt, Human
cuguccccgcacugggc

SEQ ID NO: 1805170 - RNA, 18 nt, Human
cuguccccgcacugggcu

SEQ ID NO: 1805171 - RNA, 19 nt, Human
cuguccccgcacugggcuu

SEQ ID NO: 1805172 - RNA, 22 nt, Human
cuguccccgcacugggcuuggg

SEQ ID NO: 1805173 - RNA, 23 nt, Human
cuguaucccaugagccucagcau

SEQ ID NO: 1805174 - RNA, 23 nt, Human
cuguccaggcacugcugcccagc

SEQ ID NO: 1805175 - RNA, 17 nt, Human
cuguccaggcacugcug

SEQ ID NO: 1805176 - RNA, 14 nt, Human
cugucaaggcucag

SEQ ID NO: 1805177 - RNA, 13 nt, Human
cugucaaggcuca

SEQ ID NO: 1805178 - RNA, 13 nt, Human
cugucaauuacag

SEQ ID NO: 1805179 - RNA, 13 nt, Human
cuguacagagccc

SEQ ID NO: 1805180 - RNA, 23 nt, Human
cuucacagaugggugcuuggagg

SEQ ID NO: 1805181 - RNA, 16 nt, Human
cuucaaccauucccca

SEQ ID NO: 1805182 - RNA, 20 nt, Human
cuucaaccauuccccauggg

SEQ ID NO: 1805183 - RNA, 16 nt, Human
cuucaacucccugccc

SEQ ID NO: 1805184 - RNA, 10 nt, Human
cuucaaggau

SEQ ID NO: 1805185 - RNA, 13 nt, Human
cuucaaggauccu

SEQ ID NO: 1805186 - RNA, 15 nt, Human
cuucaaggauccuga

SEQ ID NO: 1805187 - RNA, 16 nt, Human
cuucaaggauccugag

SEQ ID NO: 1805188 - RNA, 17 nt, Human
cuuauuuaaugaaagac

SEQ ID NO: 1805189 - RNA, 18 nt, Human
cuuauuuaaugaaagacu

SEQ ID NO: 1805190 - RNA, 17 nt, Human
cuucaaagcaaaugucu

SEQ ID NO: 1805191 - RNA, 21 nt, Human
cuucaaaaguuuguuugcuua

SEQ ID NO: 1805192 - RNA, 16 nt, Human
cuguucugcacacagc

SEQ ID NO: 1805193 - RNA, 16 nt, Human
cuguucuggcagaguu

SEQ ID NO: 1805194 - RNA, 19 nt, Human
cuuagauguauauauuucc

SEQ ID NO: 1805195 - RNA, 16 nt, Human
cuuagucacugagaca

SEQ ID NO: 1805196 - RNA, 13 nt, Human
cuuagauguauau

SEQ ID NO: 1805197 - RNA, 18 nt, Human
cuuagucacugagacagc

SEQ ID NO: 1805198 - RNA, 19 nt, Human
cuuagucacugagacagcc

SEQ ID NO: 1805199 - RNA, 13 nt, Human
cuuauauuaugga

SEQ ID NO: 1805200 - RNA, 14 nt, Human
cuuauagacaacau

SEQ ID NO: 1805201 - RNA, 23 nt, Human
cuucccgcucagcccucccugcc

SEQ ID NO: 1805202 - RNA, 19 nt, Human
cuucccgcucagcccuccc

SEQ ID NO: 1805203 - RNA, 17 nt, Human
cuucccuacaguugaaa

SEQ ID NO: 1805204 - RNA, 13 nt, Human
cuuccucccucau

SEQ ID NO: 1805205 - RNA, 13 nt, Human
cuuccuaauucca

SEQ ID NO: 1805206 - RNA, 17 nt, Human
cuuccuaauuccacagc

SEQ ID NO: 1805207 - RNA, 18 nt, Human
cuuccuaauuccacagcu

SEQ ID NO: 1805208 - RNA, 19 nt, Human
cuuccuaauuccacagcug

SEQ ID NO: 1805209 - RNA, 15 nt, Human
cuuccaggcugggag

SEQ ID NO: 1805210 - RNA, 16 nt, Human
cuuccaggcugggaga

SEQ ID NO: 1805211 - RNA, 19 nt, Human
cuuccaggcugggagagcc

SEQ ID NO: 1805212 - RNA, 14 nt, Human
cuuccagggguggg

SEQ ID NO: 1805213 - RNA, 15 nt, Human
cuuccagggguggga

SEQ ID NO: 1805214 - RNA, 17 nt, Human
cuuccaggggugggaca

SEQ ID NO: 1805215 - RNA, 21 nt, Human
cuuccaggggugggacacccu

SEQ ID NO: 1805216 - RNA, 16 nt, Human
cuucaguggcagcugc

SEQ ID NO: 1805217 - RNA, 15 nt, Human
cuucaguggcagcug

SEQ ID NO: 1805218 - RNA, 14 nt, Human
cuucaguggcagcu

SEQ ID NO: 1805219 - RNA, 13 nt, Human
cuucaguggcagc

SEQ ID NO: 1805220 - RNA, 18 nt, Human
cuucagugccuuauggaa

SEQ ID NO: 1805221 - RNA, 22 nt, Human
cuucagugccuuauggaacacu

SEQ ID NO: 1805222 - RNA, 19 nt, Human
cuucaggcucuucuccuuu

SEQ ID NO: 1805223 - RNA, 22 nt, Human
cuucaggcucuucuccuuucac

SEQ ID NO: 1805224 - RNA, 15 nt, Human
cuucagggagugagg

SEQ ID NO: 1805225 - RNA, 16 nt, Human
cuucaguaagccguga

SEQ ID NO: 1805226 - RNA, 23 nt, Human
cuucaguaagccgugauuuucau

SEQ ID NO: 1805227 - RNA, 17 nt, Human
cuucaguggcagcugcu

SEQ ID NO: 1805228 - RNA, 20 nt, Human
cuucauucaacccaccugcg

SEQ ID NO: 1805229 - RNA, 17 nt, Human
cuuccacaagagcccag

SEQ ID NO: 1805230 - RNA, 19 nt, Human
cuuccacaagagcccaggc

SEQ ID NO: 1805231 - RNA, 21 nt, Human
cuuccacaagagcccaggccu

SEQ ID NO: 1805232 - RNA, 12 nt, Human
cuuccaggcugg

SEQ ID NO: 1805233 - RNA, 14 nt, Human
cuuccaggcuggga

SEQ ID NO: 1805234 - RNA, 15 nt, Human
cuucuguugcugccu

SEQ ID NO: 1805235 - RNA, 13 nt, Human
cuucuguggcuca

SEQ ID NO: 1805236 - RNA, 15 nt, Human
cuucuguggcucaca

SEQ ID NO: 1805237 - RNA, 22 nt, Human
cuucuguggcucacagaacccu

SEQ ID NO: 1805238 - RNA, 13 nt, Human
cuucuguggguuu

SEQ ID NO: 1805239 - RNA, 14 nt, Human
cuucuguggguuuc

SEQ ID NO: 1805240 - RNA, 21 nt, Human
cuucuguggguuucuaaagcu

SEQ ID NO: 1805241 - RNA, 22 nt, Human
cuucuuuauaauucuacuuuga

SEQ ID NO: 1805242 - RNA, 12 nt, Human
cuugaaaaaugc

SEQ ID NO: 1805243 - RNA, 18 nt, Human
cuugaaaaaugcauguug

SEQ ID NO: 1805244 - RNA, 14 nt, Human
cuugaaaacacugu

SEQ ID NO: 1805245 - RNA, 23 nt, Human
cuugaaaacacuguucucugccc

SEQ ID NO: 1805246 - RNA, 12 nt, Human
cuugaaaauuaa

SEQ ID NO: 1805247 - RNA, 13 nt, Human
cuugaaaauuaac

SEQ ID NO: 1805248 - RNA, 18 nt, Human
cuugaaaauuaacaugaa

SEQ ID NO: 1805249 - RNA, 13 nt, Human
cuugaacuccugg

SEQ ID NO: 1805250 - RNA, 13 nt, Human
cuugaacuccuga

SEQ ID NO: 1805251 - RNA, 16 nt, Human
cuugaacuccugaccu

SEQ ID NO: 1805252 - RNA, 18 nt, Human
cuugaacuccugaccuca

SEQ ID NO: 1805253 - RNA, 21 nt, Human
cuugaacuuugaccucugcag

SEQ ID NO: 1805254 - RNA, 17 nt, Human
cuugaacuuugaccucu

SEQ ID NO: 1805255 - RNA, 13 nt, Human
cuugaccucaggu

SEQ ID NO: 1805256 - RNA, 21 nt, Human
cuugaccgugaggccagagac

SEQ ID NO: 1805257 - RNA, 18 nt, Human
cuugaccgugaggccaga

SEQ ID NO: 1805258 - RNA, 20 nt, Human
cuugaccgugaggccagaga

SEQ ID NO: 1805259 - RNA, 16 nt, Human
cuugaagacuuuucuu

SEQ ID NO: 1805260 - RNA, 17 nt, Human
cuugaccgugaggccag

SEQ ID NO: 1805261 - RNA, 22 nt, Human
cuugaccauucuccaccugcca

SEQ ID NO: 1805262 - RNA, 23 nt, Human
cuugaccauucuccaccugccag

SEQ ID NO: 1805263 - RNA, 20 nt, Human
cuugaggguugggcuggugu

SEQ ID NO: 1805264 - RNA, 19 nt, Human
cuugaggguugggcuggug

SEQ ID NO: 1805265 - RNA, 21 nt, Human
cuugaggguugggcugguguc

SEQ ID NO: 1805266 - RNA, 15 nt, Human
cuugagccuugaacu

SEQ ID NO: 1805267 - RNA, 18 nt, Human
cuugagccuugaacuuug

SEQ ID NO: 1805268 - RNA, 17 nt, Human
cuugagccuugaacuuu

SEQ ID NO: 1805269 - RNA, 16 nt, Human
cuugagccugggaggu

SEQ ID NO: 1805270 - RNA, 21 nt, Human
cuucuguccuacucuguguca

SEQ ID NO: 1805271 - RNA, 19 nt, Human
cuucuguccuacucugugu

SEQ ID NO: 1805272 - RNA, 18 nt, Human
cuucuguccuacucugug

SEQ ID NO: 1805273 - RNA, 17 nt, Human
cuucuguccuacucugu

SEQ ID NO: 1805274 - RNA, 16 nt, Human
cuucuguccuacucug

SEQ ID NO: 1805275 - RNA, 20 nt, Human
cuucuguacgucugacaggc

SEQ ID NO: 1805276 - RNA, 18 nt, Human
cuucuguacgucugacag

SEQ ID NO: 1805277 - RNA, 15 nt, Human
cuucuguacgucuga

SEQ ID NO: 1805278 - RNA, 14 nt, Human
cuucuguacgucug

SEQ ID NO: 1805279 - RNA, 21 nt, Human
cuucuguacgucugacaggca

SEQ ID NO: 1805280 - RNA, 13 nt, Human
cuucugcuucagc

SEQ ID NO: 1805281 - RNA, 14 nt, Human
cuucugguugaugc

SEQ ID NO: 1805282 - RNA, 16 nt, Human
cuucuggguuccuucc

SEQ ID NO: 1805283 - RNA, 17 nt, Human
cuucuggguuccuuccu

SEQ ID NO: 1805284 - RNA, 23 nt, Human
cuucuggguuccuuccucugagc

SEQ ID NO: 1805285 - RNA, 15 nt, Human
cuuccucccucauuc

SEQ ID NO: 1805286 - RNA, 14 nt, Human
cuucuccacuggau

SEQ ID NO: 1805287 - RNA, 15 nt, Human
cuucuccacuggaug

SEQ ID NO: 1805288 - RNA, 13 nt, Human
cuucuccacugga

SEQ ID NO: 1805289 - RNA, 11 nt, Human
cuucuccacuu

SEQ ID NO: 1805290 - RNA, 20 nt, Human
cuucuccacuuucuagccag

SEQ ID NO: 1805291 - RNA, 14 nt, Human
cuucuccaggcugu

SEQ ID NO: 1805292 - RNA, 13 nt, Human
cuucuccaggcug

SEQ ID NO: 1805293 - RNA, 12 nt, Human
cuucuccaggcu

SEQ ID NO: 1805294 - RNA, 17 nt, Human
cuucuccacuggaugga

SEQ ID NO: 1805295 - RNA, 13 nt, Human
cuucucugaagga

SEQ ID NO: 1805296 - RNA, 20 nt, Human
cuucuccuuagaaguggaag

SEQ ID NO: 1805297 - RNA, 19 nt, Human
cuucuccuucaccuuuguc

SEQ ID NO: 1805298 - RNA, 12 nt, Human
cuucucuccagc

SEQ ID NO: 1805299 - RNA, 13 nt, Human
cuucucuccagcc

SEQ ID NO: 1805300 - RNA, 15 nt, Human
cuucucuccagcccc

SEQ ID NO: 1805301 - RNA, 17 nt, Human
cuucucuccagccccug

SEQ ID NO: 1805302 - RNA, 19 nt, Human
cuucucuccagccccugga

SEQ ID NO: 1805303 - RNA, 19 nt, Human
cuuuggcuauuagagauca

SEQ ID NO: 1805304 - RNA, 14 nt, Human
cuuuguccccaccg

SEQ ID NO: 1805305 - RNA, 15 nt, Human
cuuugugaggaagcc

SEQ ID NO: 1805306 - RNA, 23 nt, Human
cuuugucuacuucaaaaguuugu

SEQ ID NO: 1805307 - RNA, 15 nt, Human
cuuuguccccaccgc

SEQ ID NO: 1805308 - RNA, 20 nt, Human
cuuugcagacaggcaagcac

SEQ ID NO: 1805309 - RNA, 13 nt, Human
cuuugaccucugc

SEQ ID NO: 1805310 - RNA, 16 nt, Human
cuuugcagacaggcaa

SEQ ID NO: 1805311 - RNA, 22 nt, Human
cuuugcauaacguauaaaagcc

SEQ ID NO: 1805312 - RNA, 24 nt, Human
cuuugaccucugcagcaauaaagc

SEQ ID NO: 1805313 - RNA, 20 nt, Human
cuuugaccucugcagcaaua

SEQ ID NO: 1805314 - RNA, 18 nt, Human
cuuugaccucugcagcaa

SEQ ID NO: 1805315 - RNA, 17 nt, Human
cuuugaccucugcagca

SEQ ID NO: 1805316 - RNA, 12 nt, Human
cuuucuuccucu

SEQ ID NO: 1805317 - RNA, 13 nt, Human
cuuucuuccucug

SEQ ID NO: 1805318 - RNA, 14 nt, Human
cuuucuuccucugc

SEQ ID NO: 1805319 - RNA, 15 nt, Human
cuuucuuccucugcu

SEQ ID NO: 1805320 - RNA, 15 nt, Human
cuuugaccucugcag

SEQ ID NO: 1805321 - RNA, 14 nt, Human
cuuugaccucugca

SEQ ID NO: 1805322 - RNA, 15 nt, Human
cuuuccaucuacccu

SEQ ID NO: 1805323 - RNA, 15 nt, Human
cuuuccaggaaggcu

SEQ ID NO: 1805324 - RNA, 12 nt, Human
cuuuccugaggc

SEQ ID NO: 1805325 - RNA, 11 nt, Human
cuuucccuccc

SEQ ID NO: 1805326 - RNA, 13 nt, Human
cuuucccucccuu

SEQ ID NO: 1805327 - RNA, 14 nt, Human
cuuucccucccuuc

SEQ ID NO: 1805328 - RNA, 16 nt, Human
cuuucccucccuuccu

SEQ ID NO: 1805329 - RNA, 15 nt, Human
cuuucucugaggaca

SEQ ID NO: 1805330 - RNA, 14 nt, Human
cuuucucugaggac

SEQ ID NO: 1805331 - RNA, 12 nt, Human
cuuucucugagg

SEQ ID NO: 1805332 - RNA, 13 nt, Human
cuuuccugaggcu

SEQ ID NO: 1805333 - RNA, 15 nt, Human
cuuuccugaggcugg

SEQ ID NO: 1805334 - RNA, 11 nt, Human
cuuucuuccuc

SEQ ID NO: 1805335 - RNA, 20 nt, Human
cuuucugggcaccggggccu

SEQ ID NO: 1805336 - RNA, 20 nt, Human
cuuucuggcuaugcauuuga

SEQ ID NO: 1805337 - RNA, 19 nt, Human
cuuucuggcuaugcauuug

SEQ ID NO: 1805338 - RNA, 18 nt, Human
cuuucuggcuaugcauuu

SEQ ID NO: 1805339 - RNA, 17 nt, Human
cuuucuggcuaugcauu

SEQ ID NO: 1805340 - RNA, 19 nt, Human
cuugaguuuaaauuguaau

SEQ ID NO: 1805341 - RNA, 23 nt, Human
cuuggggggcugaggugggagga

SEQ ID NO: 1805342 - RNA, 16 nt, Human
cuuguaaauagcucag

SEQ ID NO: 1805343 - RNA, 21 nt, Human
cuuguaaauagcucagguguc

SEQ ID NO: 1805344 - RNA, 22 nt, Human
cuuguacauaaugcgugcauac

SEQ ID NO: 1805345 - RNA, 21 nt, Human
cuuguacauaaugcgugcaua

SEQ ID NO: 1805346 - RNA, 19 nt, Human
cuuguacauaaugcgugca

SEQ ID NO: 1805347 - RNA, 18 nt, Human
cuuguaaauagcucaggu

SEQ ID NO: 1805348 - RNA, 17 nt, Human
cuuguaaauagcucagg

SEQ ID NO: 1805349 - RNA, 12 nt, Human
cuuguacauaau

SEQ ID NO: 1805350 - RNA, 15 nt, Human
cuuguacauaaugcg

SEQ ID NO: 1805351 - RNA, 17 nt, Human
cuuguacuuuauuuucu

SEQ ID NO: 1805352 - RNA, 13 nt, Human
cuuuacuauggcc

SEQ ID NO: 1805353 - RNA, 22 nt, Human
cuuuaccuuuuuuauacauaaa

SEQ ID NO: 1805354 - RNA, 15 nt, Human
cuuuagcgcccaguu

SEQ ID NO: 1805355 - RNA, 14 nt, Human
cuuuagcgcccagu

SEQ ID NO: 1805356 - RNA, 13 nt, Human
cuuuauaauucua

SEQ ID NO: 1805357 - RNA, 19 nt, Human
cuuuauaauucuacuuuga

SEQ ID NO: 1805358 - RNA, 23 nt, Human
cuuuaucuugaauaauguaagac

SEQ ID NO: 1805359 - RNA, 15 nt, Human
cuuuaugcacaaaau

SEQ ID NO: 1805360 - RNA, 18 nt, Human
cuuuaucuugaauaaugu

SEQ ID NO: 1805361 - RNA, 21 nt, Human
cuuuaucuugaauaauguaag

SEQ ID NO: 1805362 - RNA, 17 nt, Human
cuuuuuauggccuguga

SEQ ID NO: 1805363 - RNA, 20 nt, Human
cuuuuguucuugguuuguaa

SEQ ID NO: 1805364 - RNA, 18 nt, Human
cuuuguuaguuucuccaa

SEQ ID NO: 1805365 - RNA, 12 nt, Human
cuuuuguucuug

SEQ ID NO: 1805366 - RNA, 11 nt, Human
cuuuuguucuu

SEQ ID NO: 1805367 - RNA, 18 nt, Human
gaaaacacuguucucugc

SEQ ID NO: 1805368 - RNA, 19 nt, Human
gaaaacacauuuuucuuag

SEQ ID NO: 1805369 - RNA, 18 nt, Human
gaaaacacauuuuucuua

SEQ ID NO: 1805370 - RNA, 12 nt, Human
gaaaaaggagga

SEQ ID NO: 1805371 - RNA, 15 nt, Human
gaaaaaggaggaaga

SEQ ID NO: 1805372 - RNA, 16 nt, Human
cuuuuuuggcugcuga

SEQ ID NO: 1805373 - RNA, 17 nt, Human
cuuuuuuggcugcugaa

SEQ ID NO: 1805374 - RNA, 20 nt, Human
cuuuuuuggcugcugaaggc

SEQ ID NO: 1805375 - RNA, 22 nt, Human
cuuuuuuggcugcugaaggcuc

SEQ ID NO: 1805376 - RNA, 18 nt, Human
gaaaaucuuauaauuuaa

SEQ ID NO: 1805377 - RNA, 22 nt, Human
gaaaaucuacacuccagugaga

SEQ ID NO: 1805378 - RNA, 20 nt, Human
gaaaaucagccugcuccagc

SEQ ID NO: 1805379 - RNA, 22 nt, Human
gaaaaucagccugcuccagcug

SEQ ID NO: 1805380 - RNA, 19 nt, Human
gaaaaguuuuguaaauuuc

SEQ ID NO: 1805381 - RNA, 18 nt, Human
gaaaagggaacugaacau

SEQ ID NO: 1805382 - RNA, 19 nt, Human
gaaaagcugcugacagugu

SEQ ID NO: 1805383 - RNA, 20 nt, Human
gaaaacguggcugcuucaag

SEQ ID NO: 1805384 - RNA, 22 nt, Human
gaaaacguggcugcuucaagga

SEQ ID NO: 1805385 - RNA, 24 nt, Human
gaaaacacuguucucugcccucca

SEQ ID NO: 1805386 - RNA, 22 nt, Human
gaaaacacuguucucugcccuc

SEQ ID NO: 1805387 - RNA, 19 nt, Human
gaaacuaggugcauauuua

SEQ ID NO: 1805388 - RNA, 15 nt, Human
gaaacuccagaugcc

SEQ ID NO: 1805389 - RNA, 14 nt, Human
gaaacccugucucu

SEQ ID NO: 1805390 - RNA, 19 nt, Human
gaaaccccuguaggccuca

SEQ ID NO: 1805391 - RNA, 23 nt, Human
gaaacccagcucugguccauaga

SEQ ID NO: 1805392 - RNA, 13 nt, Human
gaaacccagcucu

SEQ ID NO: 1805393 - RNA, 14 nt, Human
gaaacccagcucug

SEQ ID NO: 1805394 - RNA, 15 nt, Human
gaaacccagcucugg

SEQ ID NO: 1805395 - RNA, 16 nt, Human
gaaacccagcucuggu

SEQ ID NO: 1805396 - RNA, 18 nt, Human
gaaacccagcucuggucc

SEQ ID NO: 1805397 - RNA, 19 nt, Human
gaaacccagcucuggucca

SEQ ID NO: 1805398 - RNA, 17 nt, Human
gaaagcccugagcuuuc

SEQ ID NO: 1805399 - RNA, 21 nt, Human
gaaagcccugagcuuucugcu

SEQ ID NO: 1805400 - RNA, 22 nt, Human
gaaagcccugagcuuucugcua

SEQ ID NO: 1805401 - RNA, 14 nt, Human
gaaagcagggacuu

SEQ ID NO: 1805402 - RNA, 19 nt, Human
gaaagacuuuuccaacccu

SEQ ID NO: 1805403 - RNA, 21 nt, Human
gaaagaggaaugaaguacuca

SEQ ID NO: 1805404 - RNA, 21 nt, Human
gaaagaguacucuuguuuccu

SEQ ID NO: 1805405 - RNA, 15 nt, Human
gaaagaguaggaaga

SEQ ID NO: 1805406 - RNA, 16 nt, Human
gaaagaguaggaagac

SEQ ID NO: 1805407 - RNA, 17 nt, Human
gaaagcagaacagugau

SEQ ID NO: 1805408 - RNA, 22 nt, Human
gaaagcagaacagugauuacca

SEQ ID NO: 1805409 - RNA, 13 nt, Human
ccuguagcccuaa

SEQ ID NO: 1805410 - RNA, 15 nt, Human
ccuguagagugggag

SEQ ID NO: 1805411 - RNA, 16 nt, Human
ccuguagagugggagc

SEQ ID NO: 1805412 - RNA, 14 nt, Human
ccugguggcagugg

SEQ ID NO: 1805413 - RNA, 13 nt, Human
ccugguggcagug

SEQ ID NO: 1805414 - RNA, 15 nt, Human
ccugguggcaguggg

SEQ ID NO: 1805415 - RNA, 12 nt, Human
ccuguaccucuu

SEQ ID NO: 1805416 - RNA, 10 nt, Human
ccuguaccuc

SEQ ID NO: 1805417 - RNA, 12 nt, Human
ccugucccccug

SEQ ID NO: 1805418 - RNA, 13 nt, Human
ccugucccccuga

SEQ ID NO: 1805419 - RNA, 14 nt, Human
ccugucccccugac

SEQ ID NO: 1805420 - RNA, 15 nt, Human
ccugucccccugaca

SEQ ID NO: 1805421 - RNA, 16 nt, Human
ccugucccccugacaa

SEQ ID NO: 1805422 - RNA, 18 nt, Human
ccugguggcagcugcggu

SEQ ID NO: 1805423 - RNA, 17 nt, Human
ccugguggcagcugcgg

SEQ ID NO: 1805424 - RNA, 16 nt, Human
ccugguggcagcugcg

SEQ ID NO: 1805425 - RNA, 15 nt, Human
ccugguggcagcugc

SEQ ID NO: 1805426 - RNA, 14 nt, Human
ccugguggcagcug

SEQ ID NO: 1805427 - RNA, 22 nt, Human
ccugguggcagcucaccucucc

SEQ ID NO: 1805428 - RNA, 19 nt, Human
ccugguggcagcucaccuc

SEQ ID NO: 1805429 - RNA, 21 nt, Human
ccugguggcagcucaccucuc

SEQ ID NO: 1805430 - RNA, 18 nt, Human
ccugggagugagcugguu

SEQ ID NO: 1805431 - RNA, 16 nt, Human
ccugggcagaaggaag

SEQ ID NO: 1805432 - RNA, 16 nt, Human
ccugggagugagcugg

SEQ ID NO: 1805433 - RNA, 22 nt, Human
ccugggaggucaaggcugcagu

SEQ ID NO: 1805434 - RNA, 20 nt, Human
ccugggggcugggcagagga

SEQ ID NO: 1805435 - RNA, 21 nt, Human
ccugggggcugggcagaggaa

SEQ ID NO: 1805436 - RNA, 19 nt, Human
ccugggggcugggcagagg

SEQ ID NO: 1805437 - RNA, 17 nt, Human
ccuggcuuuucacugcu

SEQ ID NO: 1805438 - RNA, 16 nt, Human
ccuggcuuuucacugc

SEQ ID NO: 1805439 - RNA, 16 nt, Human
ccuggcccacugcauc

SEQ ID NO: 1805440 - RNA, 20 nt, Human
ccuggccagaugcaccagcc

SEQ ID NO: 1805441 - RNA, 23 nt, Human
ccuggccagaugcaccagcccuu

SEQ ID NO: 1805442 - RNA, 21 nt, Human
ccuggccagaugcaccagccc

SEQ ID NO: 1805443 - RNA, 13 nt, Human
ccuggccacgccc

SEQ ID NO: 1805444 - RNA, 13 nt, Human
ccuggcccacugc

SEQ ID NO: 1805445 - RNA, 14 nt, Human
ccuggcccacugca

SEQ ID NO: 1805446 - RNA, 13 nt, Human
ccuggcacugcuu

SEQ ID NO: 1805447 - RNA, 16 nt, Human
ccuggcacugcuucca

SEQ ID NO: 1805448 - RNA, 13 nt, Human
ccuggcaugggaa

SEQ ID NO: 1805449 - RNA, 21 nt, Human
ccuggcacccggccccugcug

SEQ ID NO: 1805450 - RNA, 20 nt, Human
ccuggcacccggccccugcu

SEQ ID NO: 1805451 - RNA, 12 nt, Human
ccuggcacugcu

SEQ ID NO: 1805452 - RNA, 19 nt, Human
ccuggcacccggccccugc

SEQ ID NO: 1805453 - RNA, 16 nt, Human
ccuggagaacuagaga

SEQ ID NO: 1805454 - RNA, 12 nt, Human
ccuggagaacua

SEQ ID NO: 1805455 - RNA, 13 nt, Human
ccuggagaacuag

SEQ ID NO: 1805456 - RNA, 21 nt, Human
ccugcuaauuccccagauugc

SEQ ID NO: 1805457 - RNA, 20 nt, Human
ccugccuguugggccaggag

SEQ ID NO: 1805458 - RNA, 18 nt, Human
ccugccuguugggccagg

SEQ ID NO: 1805459 - RNA, 19 nt, Human
ccugccuguugggccagga

SEQ ID NO: 1805460 - RNA, 14 nt, Human
ccuggcaugggaau

SEQ ID NO: 1805461 - RNA, 11 nt, Human
ccucuuccuga

SEQ ID NO: 1805462 - RNA, 13 nt, Human
ccugaaagaggaa

SEQ ID NO: 1805463 - RNA, 13 nt, Human
ccugaaagcccug

SEQ ID NO: 1805464 - RNA, 14 nt, Human
ccugaaagcccuga

SEQ ID NO: 1805465 - RNA, 18 nt, Human
ccugaaagcccugagcuu

SEQ ID NO: 1805466 - RNA, 14 nt, Human
ccugaaggccccgc

SEQ ID NO: 1805467 - RNA, 18 nt, Human
ccugaaggccccgcccag

SEQ ID NO: 1805468 - RNA, 19 nt, Human
ccugaaggccccgcccagg

SEQ ID NO: 1805469 - RNA, 22 nt, Human
ccugaaggccccgcccaggcuu

SEQ ID NO: 1805470 - RNA, 20 nt, Human
ccugaaggccccgcccaggc

SEQ ID NO: 1805471 - RNA, 21 nt, Human
ccugaaggccccgcccaggcu

SEQ ID NO: 1805472 - RNA, 15 nt, Human
ccugagcugggauga

SEQ ID NO: 1805473 - RNA, 17 nt, Human
ccugaggcuccacuugg

SEQ ID NO: 1805474 - RNA, 14 nt, Human
ccugaggcuccacu

SEQ ID NO: 1805475 - RNA, 13 nt, Human
ccugaggcuccac

SEQ ID NO: 1805476 - RNA, 13 nt, Human
ccugaggcugggc

SEQ ID NO: 1805477 - RNA, 14 nt, Human
ccugaggcugggcu

SEQ ID NO: 1805478 - RNA, 15 nt, Human
ccugaggcugggcuc

SEQ ID NO: 1805479 - RNA, 16 nt, Human
ccugaggcugggcucc

SEQ ID NO: 1805480 - RNA, 12 nt, Human
ccugagcuggga

SEQ ID NO: 1805481 - RNA, 15 nt, Human
ccugaggcccagagg

SEQ ID NO: 1805482 - RNA, 16 nt, Human
ccugaggcccagaggg

SEQ ID NO: 1805483 - RNA, 17 nt, Human
ccugaggcccagagggc

SEQ ID NO: 1805484 - RNA, 18 nt, Human
ccugaggcccagagggcc

SEQ ID NO: 1805485 - RNA, 15 nt, Human
ccugagccagauuuc

SEQ ID NO: 1805486 - RNA, 16 nt, Human
ccugagccagauuuca

SEQ ID NO: 1805487 - RNA, 18 nt, Human
ccugagccagauuucacu

SEQ ID NO: 1805488 - RNA, 20 nt, Human
ccugaagucacacagugagu

SEQ ID NO: 1805489 - RNA, 19 nt, Human
ccugaaguaagcaaagacu

SEQ ID NO: 1805490 - RNA, 22 nt, Human
ccugaagucuuuguacagacaa

SEQ ID NO: 1805491 - RNA, 20 nt, Human
ccugagccagauuucacucu

SEQ ID NO: 1805492 - RNA, 15 nt, Human
ccugccaccacgccc

SEQ ID NO: 1805493 - RNA, 19 nt, Human
ccugccaccacgcccggcu

SEQ ID NO: 1805494 - RNA, 19 nt, Human
ccugccaauggacuaacuu

SEQ ID NO: 1805495 - RNA, 23 nt, Human
ccugcauuugugaaaugauggug

SEQ ID NO: 1805496 - RNA, 13 nt, Human
ccugccacccugg

SEQ ID NO: 1805497 - RNA, 12 nt, Human
ccugccacccug

SEQ ID NO: 1805498 - RNA, 14 nt, Human
ccugccacccuggg

SEQ ID NO: 1805499 - RNA, 22 nt, Human
ccugccacccuggggagaaagu

SEQ ID NO: 1805500 - RNA, 16 nt, Human
ccugccacccugggga

SEQ ID NO: 1805501 - RNA, 17 nt, Human
ccugcaaagcccagcuu

SEQ ID NO: 1805502 - RNA, 18 nt, Human
ccugcaaagcccagcuug

SEQ ID NO: 1805503 - RNA, 22 nt, Human
ccugcacaaagcccuuccaugu

SEQ ID NO: 1805504 - RNA, 20 nt, Human
ccugcacaaagcccuuccau

SEQ ID NO: 1805505 - RNA, 15 nt, Human
ccugcaaagcccagc

SEQ ID NO: 1805506 - RNA, 16 nt, Human
ccugcaaagcccagcu

SEQ ID NO: 1805507 - RNA, 14 nt, Human
ccugcaaagcccag

SEQ ID NO: 1805508 - RNA, 23 nt, Human
ccugcacaaagcccuuccauguc

SEQ ID NO: 1805509 - RNA, 21 nt, Human
ccugcacacgcuccuuccucu

SEQ ID NO: 1805510 - RNA, 16 nt, Human
ccugcccggcugcgga

SEQ ID NO: 1805511 - RNA, 14 nt, Human
ccugcccggcugcg

SEQ ID NO: 1805512 - RNA, 15 nt, Human
ccugccccucccuuc

SEQ ID NO: 1805513 - RNA, 16 nt, Human
ccugccccucccuuca

SEQ ID NO: 1805514 - RNA, 18 nt, Human
ccugccccucccuucaac

SEQ ID NO: 1805515 - RNA, 18 nt, Human
ccugccccuccucucugc

SEQ ID NO: 1805516 - RNA, 14 nt, Human
ccugccccucccuu

SEQ ID NO: 1805517 - RNA, 19 nt, Human
ccugccccuccucucugcc

SEQ ID NO: 1805518 - RNA, 20 nt, Human
ccugccccuccucucugccc

SEQ ID NO: 1805519 - RNA, 21 nt, Human
ccugccccuccucucugcccu

SEQ ID NO: 1805520 - RNA, 22 nt, Human
ccugccccuccucucugcccua

SEQ ID NO: 1805521 - RNA, 17 nt, Human
ccugccccugagcccau

SEQ ID NO: 1805522 - RNA, 15 nt, Human
ccugccaggcauggu

SEQ ID NO: 1805523 - RNA, 14 nt, Human
ccugccccccagcc

SEQ ID NO: 1805524 - RNA, 12 nt, Human
ccugccaggcau

SEQ ID NO: 1805525 - RNA, 22 nt, Human
ccugccuguucccauucuugca

SEQ ID NO: 1805526 - RNA, 14 nt, Human
ccugccuguugggc

SEQ ID NO: 1805527 - RNA, 14 nt, Human
ccugccucagccuc

SEQ ID NO: 1805528 - RNA, 13 nt, Human
ccugccucagccu

SEQ ID NO: 1805529 - RNA, 12 nt, Human
ccugccucagcc

SEQ ID NO: 1805530 - RNA, 15 nt, Human
ccugcccugugggcc

SEQ ID NO: 1805531 - RNA, 19 nt, Human
ccugcccuuaccugccagg

SEQ ID NO: 1805532 - RNA, 21 nt, Human
ccugcccuuaccugccaggaa

SEQ ID NO: 1805533 - RNA, 22 nt, Human
ccugcccuuaccugccaggaag

SEQ ID NO: 1805534 - RNA, 10 nt, Human
ccugcccugg

SEQ ID NO: 1805535 - RNA, 12 nt, Human
ccugcccuggga

SEQ ID NO: 1805536 - RNA, 14 nt, Human
ccugcccugggagg

SEQ ID NO: 1805537 - RNA, 15 nt, Human
ccugcccugggaggc

SEQ ID NO: 1805538 - RNA, 20 nt, Human
ccugcccugggaggcaguga

SEQ ID NO: 1805539 - RNA, 22 nt, Human
ccugcccugggaggcagugaug

SEQ ID NO: 1805540 - RNA, 14 nt, Human
ccugcccugguuuc

SEQ ID NO: 1805541 - RNA, 19 nt, Human
ccugcccugguuuccugcc

SEQ ID NO: 1805542 - RNA, 20 nt, Human
ccugcccugguuuccugccc

SEQ ID NO: 1805543 - RNA, 21 nt, Human
ccugcccugguuuccugcccu

SEQ ID NO: 1805544 - RNA, 22 nt, Human
ccugcccugguuuccugcccug

SEQ ID NO: 1805545 - RNA, 23 nt, Human
ccugcccugguuuccugcccugg

SEQ ID NO: 1805546 - RNA, 11 nt, Human
ccugcccugug

SEQ ID NO: 1805547 - RNA, 12 nt, Human
ccugcccugugg

SEQ ID NO: 1805548 - RNA, 14 nt, Human
ccugcccugugggc

SEQ ID NO: 1805549 - RNA, 22 nt, Human
ccugccuguugggccaggagcc

SEQ ID NO: 1805550 - RNA, 15 nt, Human
ccuuuuuuggcugcu

SEQ ID NO: 1805551 - RNA, 15 nt, Human
ccuuugugaggaagc

SEQ ID NO: 1805552 - RNA, 16 nt, Human
ccuuugugaggaagcc

SEQ ID NO: 1805553 - RNA, 17 nt, Human
ccuuugugaggaagccg

SEQ ID NO: 1805554 - RNA, 23 nt, Human
ccuuugugaggaagccgcugggg

SEQ ID NO: 1805555 - RNA, 22 nt, Human
ccuuuguccccaccgcagacag

SEQ ID NO: 1805556 - RNA, 23 nt, Human
ccuuuguccccaccgcagacagg

SEQ ID NO: 1805557 - RNA, 14 nt, Human
ccuuugugaggaag

SEQ ID NO: 1805558 - RNA, 21 nt, Human
ccuuuguaaauugucagaugc

SEQ ID NO: 1805559 - RNA, 23 nt, Human
ccuuuguauucucuccuguaccu

SEQ ID NO: 1805560 - RNA, 22 nt, Human
ccuuuguauucucuccuguacc

SEQ ID NO: 1805561 - RNA, 23 nt, Human
ccuuuguaaauugucagaugcug

SEQ ID NO: 1805562 - RNA, 24 nt, Human
ccuuuguauucucuccuguaccuc

SEQ ID NO: 1805563 - RNA, 16 nt, Human
ccuuuguccccaccgc

SEQ ID NO: 1805564 - RNA, 18 nt, Human
ccuuuguccccaccgcag

SEQ ID NO: 1805565 - RNA, 14 nt, Human
ccuuuguccccacc

SEQ ID NO: 1805566 - RNA, 23 nt, Human
cgaaagggacuuggaagcuccgc

SEQ ID NO: 1805567 - RNA, 17 nt, Human
ccuuuuuuggcugcuga

SEQ ID NO: 1805568 - RNA, 18 nt, Human
ccuuuuuuggcugcugaa

SEQ ID NO: 1805569 - RNA, 20 nt, Human
ccuuuuuuggcugcugaagg

SEQ ID NO: 1805570 - RNA, 22 nt, Human
ccuuuuuuggcugcugaaggcu

SEQ ID NO: 1805571 - RNA, 21 nt, Human
cgaacauguuuuucuucuccc

SEQ ID NO: 1805572 - RNA, 23 nt, Human
cgaacauguuuuucuucucccuc

SEQ ID NO: 1805573 - RNA, 15 nt, Human
cgaauagcugggacu

SEQ ID NO: 1805574 - RNA, 16 nt, Human
cgaauagcugggacua

SEQ ID NO: 1805575 - RNA, 11 nt, Human
cgaauauugcu

SEQ ID NO: 1805576 - RNA, 12 nt, Human
cgaauauugcug

SEQ ID NO: 1805577 - RNA, 14 nt, Human
cgaauauugcugau

SEQ ID NO: 1805578 - RNA, 15 nt, Human
cgaauauugcugaug

SEQ ID NO: 1805579 - RNA, 17 nt, Human
cgaauauugcugauggu

SEQ ID NO: 1805580 - RNA, 18 nt, Human
ccuucggccuccauccug

SEQ ID NO: 1805581 - RNA, 17 nt, Human
ccuucggccuccauccu

SEQ ID NO: 1805582 - RNA, 18 nt, Human
ccuuccaugucgccucug

SEQ ID NO: 1805583 - RNA, 17 nt, Human
ccuuccauggacuuugu

SEQ ID NO: 1805584 - RNA, 13 nt, Human
ccuuccaggggug

SEQ ID NO: 1805585 - RNA, 12 nt, Human
ccuucucuccag

SEQ ID NO: 1805586 - RNA, 13 nt, Human
ccuucucuccagc

SEQ ID NO: 1805587 - RNA, 15 nt, Human
ccuucucuccagccc

SEQ ID NO: 1805588 - RNA, 16 nt, Human
ccuucucuccagcccc

SEQ ID NO: 1805589 - RNA, 20 nt, Human
ccugugccucugggacugga

SEQ ID NO: 1805590 - RNA, 18 nt, Human
ccuguggaucaaauccag

SEQ ID NO: 1805591 - RNA, 20 nt, Human
ccuguggaugauaaaacaca

SEQ ID NO: 1805592 - RNA, 20 nt, Human
ccugugggcccccaaaugga

SEQ ID NO: 1805593 - RNA, 22 nt, Human
ccuuggcucaaguccucuuuuc

SEQ ID NO: 1805594 - RNA, 19 nt, Human
ccuuggauuguccccgacc

SEQ ID NO: 1805595 - RNA, 15 nt, Human
ccuuggauugucccc

SEQ ID NO: 1805596 - RNA, 21 nt, Human
ccuugacagggcacaccgggc

SEQ ID NO: 1805597 - RNA, 18 nt, Human
ccuugacagggcacaccg

SEQ ID NO: 1805598 - RNA, 17 nt, Human
ccuucucuccagccccu

SEQ ID NO: 1805599 - RNA, 18 nt, Human
ccuucucuccagccccug

SEQ ID NO: 1805600 - RNA, 23 nt, Human
ccuugacauuguagagcuucugg

SEQ ID NO: 1805601 - RNA, 16 nt, Human
ccuuggcugcagggag

SEQ ID NO: 1805602 - RNA, 14 nt, Human
ccuuggggagcagg

SEQ ID NO: 1805603 - RNA, 21 nt, Human
ccuuggugucgggcaugacac

SEQ ID NO: 1805604 - RNA, 19 nt, Human
ccuuggugucgggcaugac

SEQ ID NO: 1805605 - RNA, 20 nt, Human
ccuuggugucgggcaugaca

SEQ ID NO: 1805606 - RNA, 19 nt, Human
ccuucucuccagccccugg

SEQ ID NO: 1805607 - RNA, 18 nt, Human
cgcuacccgggaaggggg

SEQ ID NO: 1805608 - RNA, 21 nt, Human
cgcuacccgggaagggggcug

SEQ ID NO: 1805609 - RNA, 24 nt, Human
cgcuacccgggaagggggcuggga

SEQ ID NO: 1805610 - RNA, 15 nt, Human
cgcgacaaugcaaac

SEQ ID NO: 1805611 - RNA, 19 nt, Human
cgcgguggcucacgccugu

SEQ ID NO: 1805612 - RNA, 14 nt, Human
cgcgacaaugcaaa

SEQ ID NO: 1805613 - RNA, 21 nt, Human
cgcccagucuggaaugcagug

SEQ ID NO: 1805614 - RNA, 18 nt, Human
cgcccggcuaauuuuugu

SEQ ID NO: 1805615 - RNA, 19 nt, Human
cgcccagucuggaaugcag

SEQ ID NO: 1805616 - RNA, 13 nt, Human
cgcccagucugga

SEQ ID NO: 1805617 - RNA, 18 nt, Human
cgcccaacuaauuuuugu

SEQ ID NO: 1805618 - RNA, 13 nt, Human
cgcagcccugcuu

SEQ ID NO: 1805619 - RNA, 15 nt, Human
cgcagcccugcuuug

SEQ ID NO: 1805620 - RNA, 24 nt, Human
cgcagcccugcuuugggcugcccu

SEQ ID NO: 1805621 - RNA, 18 nt, Human
cgcagcccugcagagggc

SEQ ID NO: 1805622 - RNA, 19 nt, Human
cgcagcccugcagagggca

SEQ ID NO: 1805623 - RNA, 21 nt, Human
cgcugugcugcccugcccacc

SEQ ID NO: 1805624 - RNA, 23 nt, Human
cgcugugcugcccugcccaccug

SEQ ID NO: 1805625 - RNA, 19 nt, Human
cgcugugcugcccugccca

SEQ ID NO: 1805626 - RNA, 11 nt, Human
cgcugugcugc

SEQ ID NO: 1805627 - RNA, 13 nt, Human
cgcugugcugccc

SEQ ID NO: 1805628 - RNA, 14 nt, Human
cgcugugcugcccu

SEQ ID NO: 1805629 - RNA, 17 nt, Human
cggaauaguuggcuagg

SEQ ID NO: 1805630 - RNA, 16 nt, Human
cggaauaguuggcuag

SEQ ID NO: 1805631 - RNA, 14 nt, Human
cgcuuucuacccag

SEQ ID NO: 1805632 - RNA, 16 nt, Human
cgcuuucuacccagcg

SEQ ID NO: 1805633 - RNA, 22 nt, Human
cggacagccacggccaggccag

SEQ ID NO: 1805634 - RNA, 21 nt, Human
cggacagccacggccaggcca

SEQ ID NO: 1805635 - RNA, 16 nt, Human
cggacuuagcugggag

SEQ ID NO: 1805636 - RNA, 17 nt, Human
cggacuuagcugggaga

SEQ ID NO: 1805637 - RNA, 15 nt, Human
cggagaaaggaaggg

SEQ ID NO: 1805638 - RNA, 17 nt, Human
cggagaaaggaagggcu

SEQ ID NO: 1805639 - RNA, 20 nt, Human
cggccaggccagagggagug

SEQ ID NO: 1805640 - RNA, 12 nt, Human
cggccaggccag

SEQ ID NO: 1805641 - RNA, 11 nt, Human
cggccaggcca

SEQ ID NO: 1805642 - RNA, 14 nt, Human
cggcuggcagccca

SEQ ID NO: 1805643 - RNA, 14 nt, Human
cggcuggccuggcc

SEQ ID NO: 1805644 - RNA, 23 nt, Human
cggcuggcagcccaccccucaac

SEQ ID NO: 1805645 - RNA, 13 nt, Human
cggcuggccuggc

SEQ ID NO: 1805646 - RNA, 18 nt, Human
cgggaauuuucaucuagg

SEQ ID NO: 1805647 - RNA, 16 nt, Human
cgggaagggggcuggg

SEQ ID NO: 1805648 - RNA, 19 nt, Human
cgggaagggggcugggaca

SEQ ID NO: 1805649 - RNA, 20 nt, Human
cgggaagggggcugggacau

SEQ ID NO: 1805650 - RNA, 20 nt, Human
cgggaauuuucaucuaggau

SEQ ID NO: 1805651 - RNA, 16 nt, Human
cgaggacagggaggug

SEQ ID NO: 1805652 - RNA, 19 nt, Human
cgagcccugguggcagugg

SEQ ID NO: 1805653 - RNA, 13 nt, Human
cgagccuggcucc

SEQ ID NO: 1805654 - RNA, 23 nt, Human
cgcacuucgggaggucgaggcag

SEQ ID NO: 1805655 - RNA, 17 nt, Human
cgcacugggcuugggga

SEQ ID NO: 1805656 - RNA, 19 nt, Human
cgcagcauauucaggaagc

SEQ ID NO: 1805657 - RNA, 20 nt, Human
cgcagcauauucaggaagcu

SEQ ID NO: 1805658 - RNA, 15 nt, Human
cgcagcccugcagag

SEQ ID NO: 1805659 - RNA, 17 nt, Human
cgcagcccugcagaggg

SEQ ID NO: 1805660 - RNA, 13 nt, Human
cgcacugggcuug

SEQ ID NO: 1805661 - RNA, 23 nt, Human
cucagcggggacagcuccuucug

SEQ ID NO: 1805662 - RNA, 19 nt, Human
cucagcucccaaggcucug

SEQ ID NO: 1805663 - RNA, 15 nt, Human
cucagcucccaaggc

SEQ ID NO: 1805664 - RNA, 21 nt, Human
cucagcggggacagcuccuuc

SEQ ID NO: 1805665 - RNA, 20 nt, Human
cucagcggggacagcuccuu

SEQ ID NO: 1805666 - RNA, 19 nt, Human
cucagcggggacagcuccu

SEQ ID NO: 1805667 - RNA, 18 nt, Human
cucagcggggacagcucc

SEQ ID NO: 1805668 - RNA, 16 nt, Human
cucagcggggacagcu

SEQ ID NO: 1805669 - RNA, 15 nt, Human
cucagcggggacagc

SEQ ID NO: 1805670 - RNA, 14 nt, Human
cucagcggggacag

SEQ ID NO: 1805671 - RNA, 22 nt, Human
cucagcauccuggcacccggcc

SEQ ID NO: 1805672 - RNA, 21 nt, Human
cucagcauccuggcacccggc

SEQ ID NO: 1805673 - RNA, 13 nt, Human
cucagcauccugg

SEQ ID NO: 1805674 - RNA, 19 nt, Human
cucagcaaaagaugcuucu

SEQ ID NO: 1805675 - RNA, 20 nt, Human
cucagcaaaagaugcuucuc

SEQ ID NO: 1805676 - RNA, 16 nt, Human
cucagcaggggagggu

SEQ ID NO: 1805677 - RNA, 21 nt, Human
cucagcaaaagaugcuucuca

SEQ ID NO: 1805678 - RNA, 15 nt, Human
cucagcauccuggca

SEQ ID NO: 1805679 - RNA, 14 nt, Human
cucagcccucccug

SEQ ID NO: 1805680 - RNA, 19 nt, Human
cucagcccucccugccccu

SEQ ID NO: 1805681 - RNA, 20 nt, Human
cucagcccucccugccccuc

SEQ ID NO: 1805682 - RNA, 21 nt, Human
cucagcccucccugccccucc

SEQ ID NO: 1805683 - RNA, 19 nt, Human
cucacuguugcccaggcug

SEQ ID NO: 1805684 - RNA, 18 nt, Human
cucacuguugcccaggcu

SEQ ID NO: 1805685 - RNA, 17 nt, Human
cucacuguugcccaggc

SEQ ID NO: 1805686 - RNA, 16 nt, Human
cucacuguugcccagg

SEQ ID NO: 1805687 - RNA, 15 nt, Human
cucagagccaccccu

SEQ ID NO: 1805688 - RNA, 23 nt, Human
cucagagagggugggagugggcc

SEQ ID NO: 1805689 - RNA, 19 nt, Human
cucagagagggugggagug

SEQ ID NO: 1805690 - RNA, 16 nt, Human
cucagaucuucugugg

SEQ ID NO: 1805691 - RNA, 16 nt, Human
cucacugcagccucaa

SEQ ID NO: 1805692 - RNA, 15 nt, Human
cucacugcagccuca

SEQ ID NO: 1805693 - RNA, 20 nt, Human
cucacugcauccuccgccuc

SEQ ID NO: 1805694 - RNA, 15 nt, Human
cucacuguugcccag

SEQ ID NO: 1805695 - RNA, 14 nt, Human
cucacuguugccca

SEQ ID NO: 1805696 - RNA, 18 nt, Human
cucagcugucaaggcuca

SEQ ID NO: 1805697 - RNA, 19 nt, Human
cucagcugucaaggcucag

SEQ ID NO: 1805698 - RNA, 12 nt, Human
cucaggagcccu

SEQ ID NO: 1805699 - RNA, 13 nt, Human
cucaggagcccug

SEQ ID NO: 1805700 - RNA, 14 nt, Human
cucaggagcccugg

SEQ ID NO: 1805701 - RNA, 15 nt, Human
cucaggagcccuggg

SEQ ID NO: 1805702 - RNA, 16 nt, Human
cucaggagcccuggga

SEQ ID NO: 1805703 - RNA, 17 nt, Human
cucaggagcccugggag

SEQ ID NO: 1805704 - RNA, 20 nt, Human
cucaggagcccugggaggcu

SEQ ID NO: 1805705 - RNA, 21 nt, Human
cucaggagcccugggaggcuc

SEQ ID NO: 1805706 - RNA, 22 nt, Human
cucaggagcccugggaggcucu

SEQ ID NO: 1805707 - RNA, 23 nt, Human
cucaggagcccugggaggcucug

SEQ ID NO: 1805708 - RNA, 24 nt, Human
cucaggagcccugggaggcucugg

SEQ ID NO: 1805709 - RNA, 15 nt, Human
cucaggcagguggga

SEQ ID NO: 1805710 - RNA, 18 nt, Human
cucaggcaggugggaugg

SEQ ID NO: 1805711 - RNA, 18 nt, Human
cucagggccuggcucagg

SEQ ID NO: 1805712 - RNA, 19 nt, Human
cucagggccuggcucaggu

SEQ ID NO: 1805713 - RNA, 20 nt, Human
cucagggccuggcucaggug

SEQ ID NO: 1805714 - RNA, 23 nt, Human
cucaggugauccacccaccucag

SEQ ID NO: 1805715 - RNA, 19 nt, Human
cucagguggggucacucug

SEQ ID NO: 1805716 - RNA, 20 nt, Human
cucagguggggucacucugg

SEQ ID NO: 1805717 - RNA, 21 nt, Human
cucagguggggucacucuggc

SEQ ID NO: 1805718 - RNA, 20 nt, Human
cucagguaaucgaccugccu

SEQ ID NO: 1805719 - RNA, 22 nt, Human
cucagguaaucgaccugccucg

SEQ ID NO: 1805720 - RNA, 24 nt, Human
cucagguaaucgaccugccucggc

SEQ ID NO: 1805721 - RNA, 24 nt, Human
cucagggucccugguggcagcuca

SEQ ID NO: 1805722 - RNA, 14 nt, Human
cucagggccugguc

SEQ ID NO: 1805723 - RNA, 20 nt, Human
cucagggucccugguggcag

SEQ ID NO: 1805724 - RNA, 21 nt, Human
cucagggucccugguggcagc

SEQ ID NO: 1805725 - RNA, 22 nt, Human
cucagggucccugguggcagcu

SEQ ID NO: 1805726 - RNA, 17 nt, Human
cucccaggcgccccuuc

SEQ ID NO: 1805727 - RNA, 19 nt, Human
cucccaggcgccccuuccc

SEQ ID NO: 1805728 - RNA, 20 nt, Human
cucccaggcgccccuucccc

SEQ ID NO: 1805729 - RNA, 22 nt, Human
cucccaggcgccccuucccccu

SEQ ID NO: 1805730 - RNA, 16 nt, Human
cucccaucacuucccu

SEQ ID NO: 1805731 - RNA, 23 nt, Human
cucccaaagugcugggauuacag

SEQ ID NO: 1805732 - RNA, 16 nt, Human
cucccaaagugcuggg

SEQ ID NO: 1805733 - RNA, 16 nt, Human
cucccaacucacccca

SEQ ID NO: 1805734 - RNA, 15 nt, Human
cucccacaaaggaga

SEQ ID NO: 1805735 - RNA, 14 nt, Human
cucccaacucaccc

SEQ ID NO: 1805736 - RNA, 15 nt, Human
cucccaacucacccc

SEQ ID NO: 1805737 - RNA, 22 nt, Human
cuccagcuggccgggagccuga

SEQ ID NO: 1805738 - RNA, 23 nt, Human
cuccagcuggccgggagccugau

SEQ ID NO: 1805739 - RNA, 13 nt, Human
cuccaugcugccu

SEQ ID NO: 1805740 - RNA, 14 nt, Human
cuccaugcugccuc

SEQ ID NO: 1805741 - RNA, 15 nt, Human
cuccaugcugccucc

SEQ ID NO: 1805742 - RNA, 16 nt, Human
cuccaugcugccucca

SEQ ID NO: 1805743 - RNA, 17 nt, Human
cuccaugcugccuccag

SEQ ID NO: 1805744 - RNA, 23 nt, Human
cucccgaauagcugggacuacag

SEQ ID NO: 1805745 - RNA, 20 nt, Human
cucccgaauagcugggacua

SEQ ID NO: 1805746 - RNA, 21 nt, Human
cucccuucaaccauuccccau

SEQ ID NO: 1805747 - RNA, 22 nt, Human
cucccuucaaccauuccccaug

SEQ ID NO: 1805748 - RNA, 23 nt, Human
cucccuucaaccauuccccaugg

SEQ ID NO: 1805749 - RNA, 15 nt, Human
cucccuucauccuuc

SEQ ID NO: 1805750 - RNA, 18 nt, Human
cucccucagucuggcccu

SEQ ID NO: 1805751 - RNA, 20 nt, Human
cuccccagccccaucccaaa

SEQ ID NO: 1805752 - RNA, 21 nt, Human
cuccccugcuggguguggcgc

SEQ ID NO: 1805753 - RNA, 23 nt, Human
cuccccugcuggguguggcgcag

SEQ ID NO: 1805754 - RNA, 21 nt, Human
cucauuugucacacacuuugg

SEQ ID NO: 1805755 - RNA, 21 nt, Human
cuccaaacccucgaggcggau

SEQ ID NO: 1805756 - RNA, 15 nt, Human
cuccaaacccucgag

SEQ ID NO: 1805757 - RNA, 17 nt, Human
cuccaaacccucgaggc

SEQ ID NO: 1805758 - RNA, 12 nt, Human
cucauucuucug

SEQ ID NO: 1805759 - RNA, 17 nt, Human
cucauugaccugaggcc

SEQ ID NO: 1805760 - RNA, 22 nt, Human
cucauucuccuuguguuacuaa

SEQ ID NO: 1805761 - RNA, 18 nt, Human
cucauucuccuuguguua

SEQ ID NO: 1805762 - RNA, 19 nt, Human
cucauugaccugaggcccu

SEQ ID NO: 1805763 - RNA, 21 nt, Human
cucauugaccugaggcccuuc

SEQ ID NO: 1805764 - RNA, 16 nt, Human
cuccagagucagaagu

SEQ ID NO: 1805765 - RNA, 21 nt, Human
cuccagaccccuggcuuuuca

SEQ ID NO: 1805766 - RNA, 14 nt, Human
cuccacuggaugga

SEQ ID NO: 1805767 - RNA, 18 nt, Human
cuccagcucaccagcccc

SEQ ID NO: 1805768 - RNA, 16 nt, Human
cuccagcucaccagcc

SEQ ID NO: 1805769 - RNA, 15 nt, Human
cuccagcucaccagc

SEQ ID NO: 1805770 - RNA, 11 nt, Human
cuccagccccu

SEQ ID NO: 1805771 - RNA, 13 nt, Human
cuccagccccugg

SEQ ID NO: 1805772 - RNA, 14 nt, Human
cuccagccccugga

SEQ ID NO: 1805773 - RNA, 14 nt, Human
cuccacugccuucg

SEQ ID NO: 1805774 - RNA, 15 nt, Human
cuccacugccuucga

SEQ ID NO: 1805775 - RNA, 16 nt, Human
cuccacugccuucgau

SEQ ID NO: 1805776 - RNA, 13 nt, Human
cuccacuggaugg

SEQ ID NO: 1805777 - RNA, 13 nt, Human
cuccacugccuuc

SEQ ID NO: 1805778 - RNA, 22 nt, Human
cuccaaguccacaguggaacca

SEQ ID NO: 1805779 - RNA, 12 nt, Human
cuauaauuuaaa

SEQ ID NO: 1805780 - RNA, 13 nt, Human
cuauaauuuaaau

SEQ ID NO: 1805781 - RNA, 20 nt, Human
cuaggaacacuccuucacag

SEQ ID NO: 1805782 - RNA, 15 nt, Human
cuaggaagacuuugg

SEQ ID NO: 1805783 - RNA, 17 nt, Human
cuaggaagacuuuggaa

SEQ ID NO: 1805784 - RNA, 21 nt, Human
cuauagccuaggugacagagu

SEQ ID NO: 1805785 - RNA, 20 nt, Human
cuauagccuaggugacagag

SEQ ID NO: 1805786 - RNA, 18 nt, Human
cuauagccuaggugacag

SEQ ID NO: 1805787 - RNA, 19 nt, Human
cuauagccuaggugacaga

SEQ ID NO: 1805788 - RNA, 19 nt, Human
cuaugauuuggaaaauaaa

SEQ ID NO: 1805789 - RNA, 20 nt, Human
cuaugauuuaauuugaaaua

SEQ ID NO: 1805790 - RNA, 19 nt, Human
cuaugauuuaauuugaaau

SEQ ID NO: 1805791 - RNA, 15 nt, Human
cuaugauuuggaaaa

SEQ ID NO: 1805792 - RNA, 22 nt, Human
cuaugaaguuuuuuuuauacag

SEQ ID NO: 1805793 - RNA, 19 nt, Human
cuaugggggcacugaggac

SEQ ID NO: 1805794 - RNA, 13 nt, Human
cuauguaucaaug

SEQ ID NO: 1805795 - RNA, 16 nt, Human
cuauguaucaaugagu

SEQ ID NO: 1805796 - RNA, 17 nt, Human
cuauucaguaauaacuc

SEQ ID NO: 1805797 - RNA, 23 nt, Human
cuauucaguaauaacucuacccu

SEQ ID NO: 1805798 - RNA, 14 nt, Human
cucaacucuccucc

SEQ ID NO: 1805799 - RNA, 17 nt, Human
cucaaauuucuaaaucu

SEQ ID NO: 1805800 - RNA, 15 nt, Human
cucaaauuucuaaau

SEQ ID NO: 1805801 - RNA, 14 nt, Human
cucaaauuucuaaa

SEQ ID NO: 1805802 - RNA, 19 nt, Human
cucaacucuccuccagagu

SEQ ID NO: 1805803 - RNA, 16 nt, Human
cucaacucuccuccag

SEQ ID NO: 1805804 - RNA, 18 nt, Human
cucaacucuccuccagag

SEQ ID NO: 1805805 - RNA, 14 nt, Human
cucaaguccucuuu

SEQ ID NO: 1805806 - RNA, 23 nt, Human
cucacacggacacucaaaagcug

SEQ ID NO: 1805807 - RNA, 17 nt, Human
cucacagaacccuugga

SEQ ID NO: 1805808 - RNA, 11 nt, Human
cuauugguaaa

SEQ ID NO: 1805809 - RNA, 16 nt, Human
cuauugcugcuugagg

SEQ ID NO: 1805810 - RNA, 23 nt, Human
cuagaaaugauccccagcuguuu

SEQ ID NO: 1805811 - RNA, 20 nt, Human
cuacuguccuacccacccuc

SEQ ID NO: 1805812 - RNA, 17 nt, Human
cuacuuagcaugucccu

SEQ ID NO: 1805813 - RNA, 22 nt, Human
cuacuuagcaugucccuaccga

SEQ ID NO: 1805814 - RNA, 21 nt, Human
cuagagguucaaagauauuuu

SEQ ID NO: 1805815 - RNA, 18 nt, Human
cuagagguucaaagauau

SEQ ID NO: 1805816 - RNA, 17 nt, Human
cuagagguucaaagaua

SEQ ID NO: 1805817 - RNA, 15 nt, Human
cuacucgaguuacag

SEQ ID NO: 1805818 - RNA, 16 nt, Human
cuacucgaguuacaga

SEQ ID NO: 1805819 - RNA, 19 nt, Human
cuacucgaguuacagacaa

SEQ ID NO: 1805820 - RNA, 17 nt, Human
cuaccgagucucuucuc

SEQ ID NO: 1805821 - RNA, 19 nt, Human
cuaccgagucucuucucca

SEQ ID NO: 1805822 - RNA, 23 nt, Human
cuaccgagucucuucuccacugg

SEQ ID NO: 1805823 - RNA, 21 nt, Human
cuaccgagucucuucuccacu

SEQ ID NO: 1805824 - RNA, 22 nt, Human
cuaccgagucucuucuccacug

SEQ ID NO: 1805825 - RNA, 19 nt, Human
cuacuguccuacccacccu

SEQ ID NO: 1805826 - RNA, 13 nt, Human
cuacucuguguca

SEQ ID NO: 1805827 - RNA, 12 nt, Human
cuacucuguguc

SEQ ID NO: 1805828 - RNA, 23 nt, Human
cuagccuuagaagucacacagua

SEQ ID NO: 1805829 - RNA, 22 nt, Human
cuagccuuagaagucacacagu

SEQ ID NO: 1805830 - RNA, 21 nt, Human
cuagccuuagaagucacacag

SEQ ID NO: 1805831 - RNA, 22 nt, Human
cuagccugugccucugggacug

SEQ ID NO: 1805832 - RNA, 21 nt, Human
cuagccugugccucugggacu

SEQ ID NO: 1805833 - RNA, 19 nt, Human
cuagccugugccucuggga

SEQ ID NO: 1805834 - RNA, 16 nt, Human
cuagauacuguaucau

SEQ ID NO: 1805835 - RNA, 13 nt, Human
cuagauacuguau

SEQ ID NO: 1805836 - RNA, 24 nt, Human
cuagauacuguaucaugacaaaga

SEQ ID NO: 1805837 - RNA, 22 nt, Human
cuacauuauaaaugucucuuua

SEQ ID NO: 1805838 - RNA, 14 nt, Human
cuacauucuguuaa

SEQ ID NO: 1805839 - RNA, 13 nt, Human
cuacauucuguua

SEQ ID NO: 1805840 - RNA, 17 nt, Human
cuacccagcgagcccug

SEQ ID NO: 1805841 - RNA, 15 nt, Human
cuacccagcgagccc

SEQ ID NO: 1805842 - RNA, 13 nt, Human
cuacccacccucc

SEQ ID NO: 1805843 - RNA, 18 nt, Human
cuacccagcgagcccugg

SEQ ID NO: 1805844 - RNA, 13 nt, Human
cuacccaggugcu

SEQ ID NO: 1805845 - RNA, 17 nt, Human
cuacccucuuagaaaaa

SEQ ID NO: 1805846 - RNA, 20 nt, Human
cuacagaggccaugggccuc

SEQ ID NO: 1805847 - RNA, 18 nt, Human
cuacagaggccaugggcc

SEQ ID NO: 1805848 - RNA, 22 nt, Human
cuacagaggccaugggccuccu

SEQ ID NO: 1805849 - RNA, 13 nt, Human
cuacacugugcug

SEQ ID NO: 1805850 - RNA, 14 nt, Human
cuacacugugcuga

SEQ ID NO: 1805851 - RNA, 17 nt, Human
cuacacugugcugaguc

SEQ ID NO: 1805852 - RNA, 21 nt, Human
cuacagcuaaucagcauucuc

SEQ ID NO: 1805853 - RNA, 22 nt, Human
cuacagcuaaucagcauucuca

SEQ ID NO: 1805854 - RNA, 18 nt, Human
cuacagcuaaucagcauu

SEQ ID NO: 1805855 - RNA, 19 nt, Human
cuacagcuaaucagcauuc

SEQ ID NO: 1805856 - RNA, 23 nt, Human
cuacagcuugaccgugaggccag

SEQ ID NO: 1805857 - RNA, 19 nt, Human
cuacagcuugaccgugagg

SEQ ID NO: 1805858 - RNA, 22 nt, Human
cuacagcuugaccgugaggcca

SEQ ID NO: 1805859 - RNA, 13 nt, Human
cuacaguccuccc

SEQ ID NO: 1805860 - RNA, 18 nt, Human
cuacauggaguauauguc

SEQ ID NO: 1805861 - RNA, 20 nt, Human
cuacauggaguauaugucaa

SEQ ID NO: 1805862 - RNA, 16 nt, Human
cuacaggugugaguca

SEQ ID NO: 1805863 - RNA, 14 nt, Human
cuacaggugugagu

SEQ ID NO: 1805864 - RNA, 16 nt, Human
cuacaggagugagcac

SEQ ID NO: 1805865 - RNA, 15 nt, Human
cuacaggagugagca

SEQ ID NO: 1805866 - RNA, 14 nt, Human
cuacaggagugagc

SEQ ID NO: 1805867 - RNA, 17 nt, Human
cuacaggcacccaccau

SEQ ID NO: 1805868 - RNA, 15 nt, Human
cuacaggcacccacc

SEQ ID NO: 1805869 - RNA, 23 nt, Human
cuacacgagauacagaauuuuau

SEQ ID NO: 1805870 - RNA, 15 nt, Human
cuaauuccacagcug

SEQ ID NO: 1805871 - RNA, 16 nt, Human
cuaauuccacagcugc

SEQ ID NO: 1805872 - RNA, 14 nt, Human
cuaauuccacagcu

SEQ ID NO: 1805873 - RNA, 21 nt, Human
cuacacaggggaaaagaggag

SEQ ID NO: 1805874 - RNA, 18 nt, Human
cuaauauguaacaagcca

SEQ ID NO: 1805875 - RNA, 20 nt, Human
cuaaucagcauucucacucc

SEQ ID NO: 1805876 - RNA, 21 nt, Human
cuaaucagcauucucacuccu

SEQ ID NO: 1805877 - RNA, 15 nt, Human
cuaaugcgcaggcug

SEQ ID NO: 1805878 - RNA, 16 nt, Human
cuaaugcgcaggcugg

SEQ ID NO: 1805879 - RNA, 19 nt, Human
cuaaugcgcaggcuggccc

SEQ ID NO: 1805880 - RNA, 20 nt, Human
cuaaugcgcaggcuggcccu

SEQ ID NO: 1805881 - RNA, 13 nt, Human
cuaaugggacacu

SEQ ID NO: 1805882 - RNA, 12 nt, Human
cuaaugggacac

SEQ ID NO: 1805883 - RNA, 22 nt, Human
cuaaugcgcaggcuggcccugc

SEQ ID NO: 1805884 - RNA, 23 nt, Human
cuaaugcgcaggcuggcccugcc

SEQ ID NO: 1805885 - RNA, 22 nt, Human
cuaauuauacccccugcaaagc

SEQ ID NO: 1805886 - RNA, 21 nt, Human
cuaagcuucacuguaaaauaa

SEQ ID NO: 1805887 - RNA, 22 nt, Human
cuaagcuauucaguaauaacuc

SEQ ID NO: 1805888 - RNA, 17 nt, Human
cuaauaacaugugaaaa

SEQ ID NO: 1805889 - RNA, 14 nt, Human
cuaauaaagcugug

SEQ ID NO: 1805890 - RNA, 23 nt, Human
cuaauagacaauuuauuauggca

SEQ ID NO: 1805891 - RNA, 19 nt, Human
cuaauagacaauuuauuau

SEQ ID NO: 1805892 - RNA, 17 nt, Human
cuaauagacaauuuauu

SEQ ID NO: 1805893 - RNA, 12 nt, Human
cuaaacugcccc

SEQ ID NO: 1805894 - RNA, 13 nt, Human
cuaaacugccccc

SEQ ID NO: 1805895 - RNA, 22 nt, Human
cuaaaugaaaaucgugacaaca

SEQ ID NO: 1805896 - RNA, 17 nt, Human
cuaaauauauuuuaaga

SEQ ID NO: 1805897 - RNA, 21 nt, Human
cuaaaucuccaaaauaaaacu

SEQ ID NO: 1805898 - RNA, 21 nt, Human
cuaaacugcccccucugcccu

SEQ ID NO: 1805899 - RNA, 23 nt, Human
cgggaccccgagccuggcuccaa

SEQ ID NO: 1805900 - RNA, 20 nt, Human
cgggaggcagagguugcagu

SEQ ID NO: 1805901 - RNA, 23 nt, Human
cgggaggauguucugggacacag

SEQ ID NO: 1805902 - RNA, 20 nt, Human
cguuuguuccccaagacauu

SEQ ID NO: 1805903 - RNA, 18 nt, Human
cuaaaauaauuuuguaau

SEQ ID NO: 1805904 - RNA, 17 nt, Human
cuaaaauaauuuuguaa

SEQ ID NO: 1805905 - RNA, 15 nt, Human
cuaaaauaauuuugu

SEQ ID NO: 1805906 - RNA, 14 nt, Human
cuaaccacgcugga

SEQ ID NO: 1805907 - RNA, 12 nt, Human
cuaaccacgcug

SEQ ID NO: 1805908 - RNA, 20 nt, Human
cuaacaacauuguagccuca

SEQ ID NO: 1805909 - RNA, 16 nt, Human
cuaaauucaugcugcu

SEQ ID NO: 1805910 - RNA, 19 nt, Human
cuaaauugacacuuaaaaa

SEQ ID NO: 1805911 - RNA, 13 nt, Human
cuaagagggaggg

SEQ ID NO: 1805912 - RNA, 15 nt, Human
cuaagagggagggag

SEQ ID NO: 1805913 - RNA, 22 nt, Human
cuaagagggagggagggcucca

SEQ ID NO: 1805914 - RNA, 23 nt, Human
cuaagagggagggagggcuccag

SEQ ID NO: 1805915 - RNA, 13 nt, Human
cguuuucaaaauu

SEQ ID NO: 1805916 - RNA, 19 nt, Human
cccuguuuguuucugaaag

SEQ ID NO: 1805917 - RNA, 17 nt, Human
cccuuaccugccaggaa

SEQ ID NO: 1805918 - RNA, 20 nt, Human
cccuuaccugccaggaagcc

SEQ ID NO: 1805919 - RNA, 23 nt, Human
cccuuaccugccaggaagccagc

SEQ ID NO: 1805920 - RNA, 13 nt, Human
cccuguucuggca

SEQ ID NO: 1805921 - RNA, 14 nt, Human
cccuguucuggcag

SEQ ID NO: 1805922 - RNA, 15 nt, Human
cccuguaggccucag

SEQ ID NO: 1805923 - RNA, 14 nt, Human
cccuguaggccuca

SEQ ID NO: 1805924 - RNA, 15 nt, Human
cccuggugcugccac

SEQ ID NO: 1805925 - RNA, 15 nt, Human
cccugguggcagugg

SEQ ID NO: 1805926 - RNA, 14 nt, Human
cccugguggcagug

SEQ ID NO: 1805927 - RNA, 13 nt, Human
cccugguggcagu

SEQ ID NO: 1805928 - RNA, 21 nt, Human
cccugguggcagcucaccucu

SEQ ID NO: 1805929 - RNA, 21 nt, Human
cccuggugaccagcaccaucu

SEQ ID NO: 1805930 - RNA, 13 nt, Human
cccuggugcugcc

SEQ ID NO: 1805931 - RNA, 14 nt, Human
cccuggugcugcca

SEQ ID NO: 1805932 - RNA, 14 nt, Human
cccuuagcagggaa

SEQ ID NO: 1805933 - RNA, 20 nt, Human
cccuuagaaguuuguuguga

SEQ ID NO: 1805934 - RNA, 15 nt, Human
cccuuacgugagucc

SEQ ID NO: 1805935 - RNA, 17 nt, Human
cccuuacgugaguccug

SEQ ID NO: 1805936 - RNA, 23 nt, Human
cccuuagcagggaaacagcuaau

SEQ ID NO: 1805937 - RNA, 20 nt, Human
cccuuccaugucgccucugc

SEQ ID NO: 1805938 - RNA, 12 nt, Human
cccuuccaugga

SEQ ID NO: 1805939 - RNA, 14 nt, Human
cccuucaaccauuc

SEQ ID NO: 1805940 - RNA, 18 nt, Human
cccuucaaccauucccca

SEQ ID NO: 1805941 - RNA, 21 nt, Human
cccugcucuccgaccagacac

SEQ ID NO: 1805942 - RNA, 22 nt, Human
cccugcucuccgaccagacacc

SEQ ID NO: 1805943 - RNA, 21 nt, Human
cccugcugagucccaggcuga

SEQ ID NO: 1805944 - RNA, 23 nt, Human
cccugcugagucccaggcugagc

SEQ ID NO: 1805945 - RNA, 15 nt, Human
cccugccucucugca

SEQ ID NO: 1805946 - RNA, 19 nt, Human
cccugcgggucacaggagg

SEQ ID NO: 1805947 - RNA, 21 nt, Human
cccugcgggucacaggaggga

SEQ ID NO: 1805948 - RNA, 12 nt, Human
cccugaggccca

SEQ ID NO: 1805949 - RNA, 13 nt, Human
cccugccucucug

SEQ ID NO: 1805950 - RNA, 14 nt, Human
cccugccucucugc

SEQ ID NO: 1805951 - RNA, 11 nt, Human
cccugccuccu

SEQ ID NO: 1805952 - RNA, 16 nt, Human
cccuggugcugccaca

SEQ ID NO: 1805953 - RNA, 11 nt, Human
cccucugccca

SEQ ID NO: 1805954 - RNA, 15 nt, Human
cccucugcccacucc

SEQ ID NO: 1805955 - RNA, 18 nt, Human
cccucugcccacucccug

SEQ ID NO: 1805956 - RNA, 19 nt, Human
cccucugcccacucccugc

SEQ ID NO: 1805957 - RNA, 12 nt, Human
cccucugcccug

SEQ ID NO: 1805958 - RNA, 13 nt, Human
cccucugcccugc

SEQ ID NO: 1805959 - RNA, 14 nt, Human
cccucugcccugcg

SEQ ID NO: 1805960 - RNA, 12 nt, Human
cccucuuucccu

SEQ ID NO: 1805961 - RNA, 17 nt, Human
cccucuuucccucccuu

SEQ ID NO: 1805962 - RNA, 20 nt, Human
cccucuuucccucccuuccu

SEQ ID NO: 1805963 - RNA, 12 nt, Human
cccucuggcucc

SEQ ID NO: 1805964 - RNA, 16 nt, Human
cccucuggcuccagcu

SEQ ID NO: 1805965 - RNA, 17 nt, Human
cccucuggcuccagcug

SEQ ID NO: 1805966 - RNA, 22 nt, Human
cccucuggcuccagcuggccgg

SEQ ID NO: 1805967 - RNA, 20 nt, Human
cccucuguucugcacacagc

SEQ ID NO: 1805968 - RNA, 21 nt, Human
cccucuguucugcacacagca

SEQ ID NO: 1805969 - RNA, 12 nt, Human
cccucuggggcu

SEQ ID NO: 1805970 - RNA, 14 nt, Human
cccucccacagcgc

SEQ ID NO: 1805971 - RNA, 12 nt, Human
cccgcucagccc

SEQ ID NO: 1805972 - RNA, 13 nt, Human
cccgcucagcccu

SEQ ID NO: 1805973 - RNA, 12 nt, Human
cccucccacagc

SEQ ID NO: 1805974 - RNA, 14 nt, Human
cccgcucagcccuc

SEQ ID NO: 1805975 - RNA, 23 nt, Human
cccucccucuuucccucccuucc

SEQ ID NO: 1805976 - RNA, 14 nt, Human
cccucccugccccu

SEQ ID NO: 1805977 - RNA, 15 nt, Human
cccgcucagcccucc

SEQ ID NO: 1805978 - RNA, 16 nt, Human
ccuaccgagucucuuc

SEQ ID NO: 1805979 - RNA, 17 nt, Human
ccuaccgagucucuucu

SEQ ID NO: 1805980 - RNA, 20 nt, Human
ccuacaguguacagucuugu

SEQ ID NO: 1805981 - RNA, 16 nt, Human
ccuacaguguacaguc

SEQ ID NO: 1805982 - RNA, 21 nt, Human
ccuacaguugaaaaacagcug

SEQ ID NO: 1805983 - RNA, 21 nt, Human
ccuaccgagucucuucuccac

SEQ ID NO: 1805984 - RNA, 19 nt, Human
ccuaccgagucucuucucc

SEQ ID NO: 1805985 - RNA, 20 nt, Human
ccuaccgagucucuucucca

SEQ ID NO: 1805986 - RNA, 18 nt, Human
ccuaggugacagagugag

SEQ ID NO: 1805987 - RNA, 11 nt, Human
ccguggcuucc

SEQ ID NO: 1805988 - RNA, 15 nt, Human
ccuacaguguacagu

SEQ ID NO: 1805989 - RNA, 18 nt, Human
ccuacaggagugagcacu

SEQ ID NO: 1805990 - RNA, 15 nt, Human
ccuaacgaaguaucc

SEQ ID NO: 1805991 - RNA, 14 nt, Human
ccguggcuucccgc

SEQ ID NO: 1805992 - RNA, 13 nt, Human
ccgggccacagag

SEQ ID NO: 1805993 - RNA, 22 nt, Human
ccgggcacucagaagacacuga

SEQ ID NO: 1805994 - RNA, 21 nt, Human
ccggcuccaggcuccuuuagc

SEQ ID NO: 1805995 - RNA, 16 nt, Human
ccggcuccaggcuccu

SEQ ID NO: 1805996 - RNA, 18 nt, Human
ccgugaggccagagacac

SEQ ID NO: 1805997 - RNA, 18 nt, Human
ccgggcucugccucccau

SEQ ID NO: 1805998 - RNA, 14 nt, Human
ccgggcucugccuc

SEQ ID NO: 1805999 - RNA, 15 nt, Human
ccgggcucugccucc

SEQ ID NO: 1806000 - RNA, 15 nt, Human
ccggaggggccuggc

SEQ ID NO: 1806001 - RNA, 16 nt, Human
ccggaggggccuggca

SEQ ID NO: 1806002 - RNA, 14 nt, Human
ccggaggggccugg

SEQ ID NO: 1806003 - RNA, 14 nt, Human
ccgcuggggccagu

SEQ ID NO: 1806004 - RNA, 11 nt, Human
ccgcuggggcc

SEQ ID NO: 1806005 - RNA, 16 nt, Human
ccgaguagcugggacu

SEQ ID NO: 1806006 - RNA, 14 nt, Human
ccgaguagcuggga

SEQ ID NO: 1806007 - RNA, 20 nt, Human
ccgaguagcugagauuauag

SEQ ID NO: 1806008 - RNA, 14 nt, Human
ccgagucucuucuc

SEQ ID NO: 1806009 - RNA, 16 nt, Human
ccgagucucuucucca

SEQ ID NO: 1806010 - RNA, 18 nt, Human
ccgagucucuucuccacu

SEQ ID NO: 1806011 - RNA, 19 nt, Human
ccgagcuuugaaaauucag

SEQ ID NO: 1806012 - RNA, 15 nt, Human
ccgcagacaggacca

SEQ ID NO: 1806013 - RNA, 19 nt, Human
ccgagucucuucuccacug

SEQ ID NO: 1806014 - RNA, 20 nt, Human
ccgagucucuucuccacugg

SEQ ID NO: 1806015 - RNA, 21 nt, Human
ccgagucucuucuccacugga

SEQ ID NO: 1806016 - RNA, 23 nt, Human
ccgcacugggcuuggggaccaga

SEQ ID NO: 1806017 - RNA, 18 nt, Human
ccgagauagccaaggcca

SEQ ID NO: 1806018 - RNA, 21 nt, Human
ccgagauugcaccacugcacu

SEQ ID NO: 1806019 - RNA, 15 nt, Human
ccgagauugcaccac

SEQ ID NO: 1806020 - RNA, 19 nt, Human
ccgagauugcaccacugca

SEQ ID NO: 1806021 - RNA, 14 nt, Human
cccaugagccucag

SEQ ID NO: 1806022 - RNA, 12 nt, Human
cccaucugugaa

SEQ ID NO: 1806023 - RNA, 19 nt, Human
cccaucucuacaaaaagca

SEQ ID NO: 1806024 - RNA, 14 nt, Human
cccaguugggugga

SEQ ID NO: 1806025 - RNA, 14 nt, Human
cccaucucuucugg

SEQ ID NO: 1806026 - RNA, 15 nt, Human
ccccaccgcagacag

SEQ ID NO: 1806027 - RNA, 19 nt, Human
ccccaccgcagacaggacc

SEQ ID NO: 1806028 - RNA, 21 nt, Human
ccccacccaagggccuggccu

SEQ ID NO: 1806029 - RNA, 15 nt, Human
ccccuccucucugcc

SEQ ID NO: 1806030 - RNA, 17 nt, Human
ccccuccucucugcccu

SEQ ID NO: 1806031 - RNA, 22 nt, Human
ccccuccuccuggacuccugca

SEQ ID NO: 1806032 - RNA, 18 nt, Human
ccccuccuccuggacucc

SEQ ID NO: 1806033 - RNA, 12 nt, Human
ccccuccaugug

SEQ ID NO: 1806034 - RNA, 15 nt, Human
ccccucccuucaacc

SEQ ID NO: 1806035 - RNA, 16 nt, Human
ccccucagggucccug

SEQ ID NO: 1806036 - RNA, 23 nt, Human
ccccuccaaucccaccaacccuc

SEQ ID NO: 1806037 - RNA, 20 nt, Human
ccccucauagcccucacccu

SEQ ID NO: 1806038 - RNA, 21 nt, Human
cccccucuggcuccagcuggc

SEQ ID NO: 1806039 - RNA, 17 nt, Human
cccccugacaacacuca

SEQ ID NO: 1806040 - RNA, 12 nt, Human
cccccucuggcu

SEQ ID NO: 1806041 - RNA, 19 nt, Human
cccccucuggcuccagcug

SEQ ID NO: 1806042 - RNA, 21 nt, Human
cccccugcaaagcccagcuug

SEQ ID NO: 1806043 - RNA, 18 nt, Human
cccccugcaaagcccagc

SEQ ID NO: 1806044 - RNA, 19 nt, Human
cccccugcaaagcccagcu

SEQ ID NO: 1806045 - RNA, 19 nt, Human
cccccugacaacacucauu

SEQ ID NO: 1806046 - RNA, 12 nt, Human
cccccagccugc

SEQ ID NO: 1806047 - RNA, 16 nt, Human
ccccucaacaccucug

SEQ ID NO: 1806048 - RNA, 23 nt, Human
ccccucaacucuccuccagaguc

SEQ ID NO: 1806049 - RNA, 15 nt, Human
ccccucaacaccucu

SEQ ID NO: 1806050 - RNA, 20 nt, Human
ccccagugcccacaggauca

SEQ ID NO: 1806051 - RNA, 16 nt, Human
ccccagugcccacagg

SEQ ID NO: 1806052 - RNA, 15 nt, Human
ccccagugcccacag

SEQ ID NO: 1806053 - RNA, 14 nt, Human
ccccagugcccaca

SEQ ID NO: 1806054 - RNA, 22 nt, Human
ccccauaauuuuuuuuuuccuu

SEQ ID NO: 1806055 - RNA, 15 nt, Human
cccccacuggugaca

SEQ ID NO: 1806056 - RNA, 11 nt, Human
cccccacuggu

SEQ ID NO: 1806057 - RNA, 13 nt, Human
cccccacugguga

SEQ ID NO: 1806058 - RNA, 17 nt, Human
ccccaucauugguaccc

SEQ ID NO: 1806059 - RNA, 14 nt, Human
ccccauccucugua

SEQ ID NO: 1806060 - RNA, 24 nt, Human
cccccacccaagggccuggccuga

SEQ ID NO: 1806061 - RNA, 13 nt, Human
cccccacccaagg

SEQ ID NO: 1806062 - RNA, 18 nt, Human
ccccuggaugcagccuca

SEQ ID NO: 1806063 - RNA, 19 nt, Human
ccccuggaugcagccucac

SEQ ID NO: 1806064 - RNA, 15 nt, Human
ccccuggaugcagcc

SEQ ID NO: 1806065 - RNA, 20 nt, Human
ccccugcugguucaggguug

SEQ ID NO: 1806066 - RNA, 15 nt, Human
ccccugcugguucag

SEQ ID NO: 1806067 - RNA, 13 nt, Human
ccccugcugguuc

SEQ ID NO: 1806068 - RNA, 11 nt, Human
ccccugcuggu

SEQ ID NO: 1806069 - RNA, 14 nt, Human
ccccugcugggugu

SEQ ID NO: 1806070 - RNA, 17 nt, Human
ccccugcuggguguggc

SEQ ID NO: 1806071 - RNA, 19 nt, Human
ccccugcccggcugcggaa

SEQ ID NO: 1806072 - RNA, 17 nt, Human
ccccugcccggcugcgg

SEQ ID NO: 1806073 - RNA, 13 nt, Human
ccccucugcccug

SEQ ID NO: 1806074 - RNA, 14 nt, Human
ccccucugcccugc

SEQ ID NO: 1806075 - RNA, 12 nt, Human
ccccucugcccu

SEQ ID NO: 1806076 - RNA, 14 nt, Human
ccccugccucucug

SEQ ID NO: 1806077 - RNA, 15 nt, Human
ccccugccucucugc

SEQ ID NO: 1806078 - RNA, 16 nt, Human
ccccugccucucugca

SEQ ID NO: 1806079 - RNA, 17 nt, Human
ccccugccucucugcag

SEQ ID NO: 1806080 - RNA, 19 nt, Human
ccccugccucucugcaggu

SEQ ID NO: 1806081 - RNA, 20 nt, Human
cccgcccaggcuuagucacu

SEQ ID NO: 1806082 - RNA, 22 nt, Human
cccgcccaggcuuagucacuga

SEQ ID NO: 1806083 - RNA, 23 nt, Human
cccgcuaagagggagggagggcu

SEQ ID NO: 1806084 - RNA, 13 nt, Human
cccgagccuggcu

SEQ ID NO: 1806085 - RNA, 15 nt, Human
cccgagccuggcucc

SEQ ID NO: 1806086 - RNA, 15 nt, Human
cccgacagccuggca

SEQ ID NO: 1806087 - RNA, 18 nt, Human
cccgacagccuggcacag

SEQ ID NO: 1806088 - RNA, 15 nt, Human
ccccuguucacucua

SEQ ID NO: 1806089 - RNA, 14 nt, Human
cccgacagccuggc

SEQ ID NO: 1806090 - RNA, 13 nt, Human
ccccuuccaugga

SEQ ID NO: 1806091 - RNA, 20 nt, Human
ccccuuccauggacuuuguu

SEQ ID NO: 1806092 - RNA, 20 nt, Human
ccccuggcuuuucacugcug

SEQ ID NO: 1806093 - RNA, 22 nt, Human
ccccuggcuuuucacugcuggc

SEQ ID NO: 1806094 - RNA, 18 nt, Human
ccccuggcuuuucacugc

SEQ ID NO: 1806095 - RNA, 17 nt, Human
ccagcaccaucucuccu

SEQ ID NO: 1806096 - RNA, 18 nt, Human
ccagcaccaucucuccuc

SEQ ID NO: 1806097 - RNA, 16 nt, Human
ccagcaggcucucagg

SEQ ID NO: 1806098 - RNA, 17 nt, Human
ccagcaggcucucaggc

SEQ ID NO: 1806099 - RNA, 18 nt, Human
ccagcaggcucucaggcc

SEQ ID NO: 1806100 - RNA, 19 nt, Human
ccagcaagugagagcuggg

SEQ ID NO: 1806101 - RNA, 18 nt, Human
ccagcaagugagagcugg

SEQ ID NO: 1806102 - RNA, 17 nt, Human
ccagcaagugagagcug

SEQ ID NO: 1806103 - RNA, 24 nt, Human
ccagauuuuuuacagcugccugca

SEQ ID NO: 1806104 - RNA, 22 nt, Human
ccagauugcaacaggcugggcu

SEQ ID NO: 1806105 - RNA, 18 nt, Human
ccagauugcaacaggcug

SEQ ID NO: 1806106 - RNA, 23 nt, Human
ccagauugcaacaggcugggcuu

SEQ ID NO: 1806107 - RNA, 18 nt, Human
ccagauuucacucuccuu

SEQ ID NO: 1806108 - RNA, 19 nt, Human
ccagauuucacucuccuug

SEQ ID NO: 1806109 - RNA, 15 nt, Human
ccagauuucacucuc

SEQ ID NO: 1806110 - RNA, 16 nt, Human
ccagauugcaacaggc

SEQ ID NO: 1806111 - RNA, 14 nt, Human
ccagauugcaacag

SEQ ID NO: 1806112 - RNA, 14 nt, Human
ccagagcccaccuu

SEQ ID NO: 1806113 - RNA, 23 nt, Human
ccagagccucaaaugagaaaaug

SEQ ID NO: 1806114 - RNA, 20 nt, Human
ccagagccucaaaugagaaa

SEQ ID NO: 1806115 - RNA, 19 nt, Human
ccagccugagcgacaguga

SEQ ID NO: 1806116 - RNA, 13 nt, Human
ccagccuggguga

SEQ ID NO: 1806117 - RNA, 13 nt, Human
ccagcgagcccug

SEQ ID NO: 1806118 - RNA, 23 nt, Human
ccagccuugaccauucuccaccu

SEQ ID NO: 1806119 - RNA, 23 nt, Human
ccagccgagauagccaaggccaa

SEQ ID NO: 1806120 - RNA, 17 nt, Human
ccagccgagauagccaa

SEQ ID NO: 1806121 - RNA, 20 nt, Human
ccagccgagauagccaaggc

SEQ ID NO: 1806122 - RNA, 22 nt, Human
ccagccgagauagccaaggcca

SEQ ID NO: 1806123 - RNA, 19 nt, Human
ccagccccaaaacucuccu

SEQ ID NO: 1806124 - RNA, 17 nt, Human
ccagcccacuucugcca

SEQ ID NO: 1806125 - RNA, 16 nt, Human
ccagcccacuucugcc

SEQ ID NO: 1806126 - RNA, 19 nt, Human
ccagcaggcucucaggcca

SEQ ID NO: 1806127 - RNA, 20 nt, Human
ccagcaggcucucaggccag

SEQ ID NO: 1806128 - RNA, 21 nt, Human
ccagcaggcucucaggccagc

SEQ ID NO: 1806129 - RNA, 23 nt, Human
ccagcaggcucucaggccagcug

SEQ ID NO: 1806130 - RNA, 24 nt, Human
ccagaccccuggcuuuucacugcu

SEQ ID NO: 1806131 - RNA, 18 nt, Human
ccagaccccuggcuuuuc

SEQ ID NO: 1806132 - RNA, 14 nt, Human
ccagacaucaacag

SEQ ID NO: 1806133 - RNA, 22 nt, Human
ccagacacauguccaagaagcc

SEQ ID NO: 1806134 - RNA, 17 nt, Human
ccagacacauguccaag

SEQ ID NO: 1806135 - RNA, 20 nt, Human
ccagacacauguccaagaag

SEQ ID NO: 1806136 - RNA, 15 nt, Human
ccagacccggcugcg

SEQ ID NO: 1806137 - RNA, 14 nt, Human
ccagacccggcugc

SEQ ID NO: 1806138 - RNA, 16 nt, Human
ccagacccggcugcgu

SEQ ID NO: 1806139 - RNA, 14 nt, Human
ccagagaguggcuc

SEQ ID NO: 1806140 - RNA, 15 nt, Human
ccagagaguggcucc

SEQ ID NO: 1806141 - RNA, 16 nt, Human
ccagagaguggcuccu

SEQ ID NO: 1806142 - RNA, 18 nt, Human
ccagagaguggcuccucc

SEQ ID NO: 1806143 - RNA, 22 nt, Human
ccagagaguggcuccucccggu

SEQ ID NO: 1806144 - RNA, 15 nt, Human
ccacugcucugguua

SEQ ID NO: 1806145 - RNA, 13 nt, Human
ccacugcucuggu

SEQ ID NO: 1806146 - RNA, 12 nt, Human
ccacugcucugg

SEQ ID NO: 1806147 - RNA, 20 nt, Human
ccacugcuuuuggucugugu

SEQ ID NO: 1806148 - RNA, 21 nt, Human
ccacugccuucgauacaccgg

SEQ ID NO: 1806149 - RNA, 22 nt, Human
ccacugcuuuuggucuguguga

SEQ ID NO: 1806150 - RNA, 14 nt, Human
ccacugugaagaga

SEQ ID NO: 1806151 - RNA, 15 nt, Human
ccacugugaagagaa

SEQ ID NO: 1806152 - RNA, 23 nt, Human
ccacuggugacaugucuuuucuu

SEQ ID NO: 1806153 - RNA, 15 nt, Human
ccacugguucuucuu

SEQ ID NO: 1806154 - RNA, 13 nt, Human
ccacugccucuuc

SEQ ID NO: 1806155 - RNA, 16 nt, Human
ccacugccucuuccuc

SEQ ID NO: 1806156 - RNA, 14 nt, Human
ccaccuucccaugc

SEQ ID NO: 1806157 - RNA, 21 nt, Human
ccacugcaucguuucaucuuc

SEQ ID NO: 1806158 - RNA, 23 nt, Human
ccacugcaucguuucaucuucca

SEQ ID NO: 1806159 - RNA, 16 nt, Human
ccacugugccaugugc

SEQ ID NO: 1806160 - RNA, 15 nt, Human
ccacugugccaugug

SEQ ID NO: 1806161 - RNA, 19 nt, Human
ccacugugccaugugccag

SEQ ID NO: 1806162 - RNA, 18 nt, Human
ccagaaaccuuuguuugc

SEQ ID NO: 1806163 - RNA, 22 nt, Human
ccagaagaaaauagugguguga

SEQ ID NO: 1806164 - RNA, 12 nt, Human
ccacccugcucu

SEQ ID NO: 1806165 - RNA, 11 nt, Human
ccacccugcuc

SEQ ID NO: 1806166 - RNA, 14 nt, Human
ccaccucucucacu

SEQ ID NO: 1806167 - RNA, 16 nt, Human
ccaccucucucacucc

SEQ ID NO: 1806168 - RNA, 19 nt, Human
ccaccucucucacuccuug

SEQ ID NO: 1806169 - RNA, 20 nt, Human
ccaccucucucacuccuuga

SEQ ID NO: 1806170 - RNA, 14 nt, Human
ccaccuggccucug

SEQ ID NO: 1806171 - RNA, 13 nt, Human
ccaccuggccucu

SEQ ID NO: 1806172 - RNA, 18 nt, Human
ccaccuggccucugcacu

SEQ ID NO: 1806173 - RNA, 20 nt, Human
ccaccuggccucugcacucc

SEQ ID NO: 1806174 - RNA, 13 nt, Human
ccaccugccaggg

SEQ ID NO: 1806175 - RNA, 14 nt, Human
ccaccugccaggga

SEQ ID NO: 1806176 - RNA, 15 nt, Human
ccaccugccagggac

SEQ ID NO: 1806177 - RNA, 16 nt, Human
ccaccugccagggaca

SEQ ID NO: 1806178 - RNA, 14 nt, Human
ccacccuccuuuca

SEQ ID NO: 1806179 - RNA, 19 nt, Human
ccacccccacccaagggcc

SEQ ID NO: 1806180 - RNA, 13 nt, Human
ccaccuuggcuca

SEQ ID NO: 1806181 - RNA, 23 nt, Human
ccagugugacaaggauugcuacu

SEQ ID NO: 1806182 - RNA, 14 nt, Human
ccagugugacaagg

SEQ ID NO: 1806183 - RNA, 13 nt, Human
ccauaugccuggg

SEQ ID NO: 1806184 - RNA, 12 nt, Human
ccaucaagccac

SEQ ID NO: 1806185 - RNA, 15 nt, Human
ccauaugccugggca

SEQ ID NO: 1806186 - RNA, 13 nt, Human
ccaucaugucugg

SEQ ID NO: 1806187 - RNA, 12 nt, Human
ccaucauugaaa

SEQ ID NO: 1806188 - RNA, 12 nt, Human
ccaucaugucug

SEQ ID NO: 1806189 - RNA, 19 nt, Human
ccauauuaccacagacaua

SEQ ID NO: 1806190 - RNA, 16 nt, Human
ccaucaagccaccaac

SEQ ID NO: 1806191 - RNA, 13 nt, Human
ccaucaagccacc

SEQ ID NO: 1806192 - RNA, 14 nt, Human
ccaucaagccacca

SEQ ID NO: 1806193 - RNA, 14 nt, Human
ccaucucacacaug

SEQ ID NO: 1806194 - RNA, 15 nt, Human
ccaucucacacauga

SEQ ID NO: 1806195 - RNA, 17 nt, Human
ccaucucacacaugagc

SEQ ID NO: 1806196 - RNA, 18 nt, Human
ccaucucacacaugagca

SEQ ID NO: 1806197 - RNA, 20 nt, Human
ccaucucacacaugagcauc

SEQ ID NO: 1806198 - RNA, 21 nt, Human
ccaucucacacaugagcauca

SEQ ID NO: 1806199 - RNA, 15 nt, Human
ccaucucuccuccuu

SEQ ID NO: 1806200 - RNA, 14 nt, Human
ccaucauugaaauc

SEQ ID NO: 1806201 - RNA, 16 nt, Human
ccaucauugaaaucuu

SEQ ID NO: 1806202 - RNA, 17 nt, Human
ccaucauugaaaucuuu

SEQ ID NO: 1806203 - RNA, 18 nt, Human
ccauccugaggcuccacu

SEQ ID NO: 1806204 - RNA, 20 nt, Human
ccauccugaggcuccacuug

SEQ ID NO: 1806205 - RNA, 23 nt, Human
ccaguaaaugggggugcauuuga

SEQ ID NO: 1806206 - RNA, 13 nt, Human
ccagugaggcucu

SEQ ID NO: 1806207 - RNA, 16 nt, Human
ccagguggccacucca

SEQ ID NO: 1806208 - RNA, 21 nt, Human
ccagguggccacuccagaccc

SEQ ID NO: 1806209 - RNA, 16 nt, Human
ccagguuucuaugugu

SEQ ID NO: 1806210 - RNA, 13 nt, Human
ccagguuuaagcu

SEQ ID NO: 1806211 - RNA, 22 nt, Human
ccaguaaaugggggugcauuug

SEQ ID NO: 1806212 - RNA, 21 nt, Human
ccaguaaaugggggugcauuu

SEQ ID NO: 1806213 - RNA, 20 nt, Human
ccaguaaaugggggugcauu

SEQ ID NO: 1806214 - RNA, 23 nt, Human
ccagugcccacaggaucagucug

SEQ ID NO: 1806215 - RNA, 16 nt, Human
ccaggccccugccacc

SEQ ID NO: 1806216 - RNA, 15 nt, Human
ccaggccccugccac

SEQ ID NO: 1806217 - RNA, 14 nt, Human
ccaggccccugcca

SEQ ID NO: 1806218 - RNA, 12 nt, Human
ccaggccagagg

SEQ ID NO: 1806219 - RNA, 19 nt, Human
ccaggccccugccacccug

SEQ ID NO: 1806220 - RNA, 13 nt, Human
ccaggcccucugc

SEQ ID NO: 1806221 - RNA, 14 nt, Human
ccaggcccucugcc

SEQ ID NO: 1806222 - RNA, 15 nt, Human
ccaggaggccagccu

SEQ ID NO: 1806223 - RNA, 18 nt, Human
ccaggaggccagccuuga

SEQ ID NO: 1806224 - RNA, 20 nt, Human
ccaggaggccagccuugacc

SEQ ID NO: 1806225 - RNA, 14 nt, Human
ccaggcuggucuca

SEQ ID NO: 1806226 - RNA, 21 nt, Human
ccaggcuuagucacugagaca

SEQ ID NO: 1806227 - RNA, 22 nt, Human
ccaggcuuagucacugagacag

SEQ ID NO: 1806228 - RNA, 23 nt, Human
ccaggcuuagucacugagacagc

SEQ ID NO: 1806229 - RNA, 21 nt, Human
ccaggcugggucgcccuggac

SEQ ID NO: 1806230 - RNA, 22 nt, Human
ccaggcugggucgcccuggacu

SEQ ID NO: 1806231 - RNA, 23 nt, Human
ccaggcugggucgcccuggacug

SEQ ID NO: 1806232 - RNA, 24 nt, Human
ccaggcugggucgcccuggacugu

SEQ ID NO: 1806233 - RNA, 12 nt, Human
ccaggcuggguc

SEQ ID NO: 1806234 - RNA, 16 nt, Human
ccaggcugggucgccc

SEQ ID NO: 1806235 - RNA, 15 nt, Human
ccaggcccucugccc

SEQ ID NO: 1806236 - RNA, 16 nt, Human
ccaggcccucugccca

SEQ ID NO: 1806237 - RNA, 23 nt, Human
ccaggcugggagagccuuccagg

SEQ ID NO: 1806238 - RNA, 18 nt, Human
ccauguuuuguuuacggu

SEQ ID NO: 1806239 - RNA, 15 nt, Human
ccauucugccugccc

SEQ ID NO: 1806240 - RNA, 16 nt, Human
ccauucugccugccca

SEQ ID NO: 1806241 - RNA, 13 nt, Human
ccauuugcuccuu

SEQ ID NO: 1806242 - RNA, 14 nt, Human
ccauucuccaccug

SEQ ID NO: 1806243 - RNA, 13 nt, Human
cccacaggaucag

SEQ ID NO: 1806244 - RNA, 17 nt, Human
cccacaggaucagucug

SEQ ID NO: 1806245 - RNA, 13 nt, Human
cccacagcgcugg

SEQ ID NO: 1806246 - RNA, 19 nt, Human
cccacauagugaugguucc

SEQ ID NO: 1806247 - RNA, 16 nt, Human
cccacaggcccuuccu

SEQ ID NO: 1806248 - RNA, 18 nt, Human
cccacaggcccuuccucu

SEQ ID NO: 1806249 - RNA, 17 nt, Human
cccaagggccuggccug

SEQ ID NO: 1806250 - RNA, 16 nt, Human
cccaagggccuggccu

SEQ ID NO: 1806251 - RNA, 20 nt, Human
ccauuuugcugucccuuuuc

SEQ ID NO: 1806252 - RNA, 21 nt, Human
ccauuuuguauuuuacuaaua

SEQ ID NO: 1806253 - RNA, 12 nt, Human
cccaagggccug

SEQ ID NO: 1806254 - RNA, 14 nt, Human
cccaagggccuggc

SEQ ID NO: 1806255 - RNA, 21 nt, Human
cccaccucagccucccaaagu

SEQ ID NO: 1806256 - RNA, 13 nt, Human
cccaccucucuca

SEQ ID NO: 1806257 - RNA, 14 nt, Human
cccaccucucucac

SEQ ID NO: 1806258 - RNA, 17 nt, Human
cccaccucucucacucc

SEQ ID NO: 1806259 - RNA, 12 nt, Human
cccaccuuggcu

SEQ ID NO: 1806260 - RNA, 17 nt, Human
cccaccucagccucccg

SEQ ID NO: 1806261 - RNA, 19 nt, Human
cccaccucucucacuccuu

SEQ ID NO: 1806262 - RNA, 15 nt, Human
cccaccucagccucc

SEQ ID NO: 1806263 - RNA, 14 nt, Human
cccaccucagccuc

SEQ ID NO: 1806264 - RNA, 12 nt, Human
cccaccucagcc

SEQ ID NO: 1806265 - RNA, 15 nt, Human
cccaccuuggcugca

SEQ ID NO: 1806266 - RNA, 14 nt, Human
cccaccuuggcugc

SEQ ID NO: 1806267 - RNA, 22 nt, Human
cccaccuuggcucaaguccucu

SEQ ID NO: 1806268 - RNA, 15 nt, Human
cccaccuuggcucaa

SEQ ID NO: 1806269 - RNA, 16 nt, Human
cccaccuuggcugcag

SEQ ID NO: 1806270 - RNA, 17 nt, Human
cccacgcccccacuggu

SEQ ID NO: 1806271 - RNA, 19 nt, Human
cccacgcccccacugguga

SEQ ID NO: 1806272 - RNA, 14 nt, Human
cccacgcuggagug

SEQ ID NO: 1806273 - RNA, 15 nt, Human
caauaggaaaaacug

SEQ ID NO: 1806274 - RNA, 16 nt, Human
caauaggaaaaacuga

SEQ ID NO: 1806275 - RNA, 17 nt, Human
caauaggaaaaacugau

SEQ ID NO: 1806276 - RNA, 18 nt, Human
caauaauaauaccucccu

SEQ ID NO: 1806277 - RNA, 19 nt, Human
caauagauauuuaccuuuu

SEQ ID NO: 1806278 - RNA, 19 nt, Human
caaggguagggugggccuu

SEQ ID NO: 1806279 - RNA, 18 nt, Human
caaggcugggggaagaag

SEQ ID NO: 1806280 - RNA, 18 nt, Human
caaggaaaaaauaacaau

SEQ ID NO: 1806281 - RNA, 23 nt, Human
caagcuggucccacucaguccau

SEQ ID NO: 1806282 - RNA, 22 nt, Human
caagcuggucccacucagucca

SEQ ID NO: 1806283 - RNA, 20 nt, Human
caaggaaaaaauaacaauga

SEQ ID NO: 1806284 - RNA, 16 nt, Human
caaggagauuuacaac

SEQ ID NO: 1806285 - RNA, 18 nt, Human
caaggauccugagccaga

SEQ ID NO: 1806286 - RNA, 19 nt, Human
caaggauccugagccagau

SEQ ID NO: 1806287 - RNA, 22 nt, Human
caaggauccugagccagauuuc

SEQ ID NO: 1806288 - RNA, 20 nt, Human
caaggauccugagccagauu

SEQ ID NO: 1806289 - RNA, 17 nt, Human
caaggcugcagugagcc

SEQ ID NO: 1806290 - RNA, 22 nt, Human
caaggcugcagugagccgagau

SEQ ID NO: 1806291 - RNA, 18 nt, Human
caagcgauucuucugcuu

SEQ ID NO: 1806292 - RNA, 21 nt, Human
caagcugcacccucaggcagg

SEQ ID NO: 1806293 - RNA, 17 nt, Human
caagcgauucuucugcu

SEQ ID NO: 1806294 - RNA, 15 nt, Human
caagcgauucuucug

SEQ ID NO: 1806295 - RNA, 21 nt, Human
caagcuggucccacucagucc

SEQ ID NO: 1806296 - RNA, 22 nt, Human
caagcugcacccucaggcaggu

SEQ ID NO: 1806297 - RNA, 18 nt, Human
caauaggaaaaacugauu

SEQ ID NO: 1806298 - RNA, 18 nt, Human
caauuacaggaaguacug

SEQ ID NO: 1806299 - RNA, 21 nt, Human
caauuuuuuaagugaaaauau

SEQ ID NO: 1806300 - RNA, 20 nt, Human
caauuuuuuaagugaaaaua

SEQ ID NO: 1806301 - RNA, 13 nt, Human
cacaaacagaggc

SEQ ID NO: 1806302 - RNA, 18 nt, Human
cacaaagcccuuccaugu

SEQ ID NO: 1806303 - RNA, 15 nt, Human
cacaaacagaggccg

SEQ ID NO: 1806304 - RNA, 14 nt, Human
cacaaacagaggcc

SEQ ID NO: 1806305 - RNA, 17 nt, Human
caauuacaggaaguacu

SEQ ID NO: 1806306 - RNA, 21 nt, Human
caauaucuuuuuuuuaauaaa

SEQ ID NO: 1806307 - RNA, 22 nt, Human
caaugugaaaagaaaaaugagc

SEQ ID NO: 1806308 - RNA, 22 nt, Human
caaugugacuuaaugccacuaa

SEQ ID NO: 1806309 - RNA, 18 nt, Human
cacaagaaaugaaagcag

SEQ ID NO: 1806310 - RNA, 13 nt, Human
cacaaaggagagc

SEQ ID NO: 1806311 - RNA, 21 nt, Human
cacaagaaaugaaagcaggga

SEQ ID NO: 1806312 - RNA, 20 nt, Human
cacaagaaaugaaagcaggg

SEQ ID NO: 1806313 - RNA, 17 nt, Human
cacacacgcgugcacac

SEQ ID NO: 1806314 - RNA, 14 nt, Human
cacacuccagcugg

SEQ ID NO: 1806315 - RNA, 21 nt, Human
cacagagaaaguacuucucca

SEQ ID NO: 1806316 - RNA, 20 nt, Human
cacagagaaaguacuucucc

SEQ ID NO: 1806317 - RNA, 19 nt, Human
cacagagaaaguacuucuc

SEQ ID NO: 1806318 - RNA, 23 nt, Human
cacagaugggugcuuggaggaag

SEQ ID NO: 1806319 - RNA, 22 nt, Human
cacagaguuguuacauuuuuaa

SEQ ID NO: 1806320 - RNA, 19 nt, Human
cacagaggacacagagaag

SEQ ID NO: 1806321 - RNA, 15 nt, Human
cacagaggacacaga

SEQ ID NO: 1806322 - RNA, 13 nt, Human
cacagaggcugcc

SEQ ID NO: 1806323 - RNA, 14 nt, Human
cacagcugagaggc

SEQ ID NO: 1806324 - RNA, 16 nt, Human
cacagauuugagcuca

SEQ ID NO: 1806325 - RNA, 17 nt, Human
cacagauuugagcucag

SEQ ID NO: 1806326 - RNA, 18 nt, Human
cacagauuugagcucagc

SEQ ID NO: 1806327 - RNA, 22 nt, Human
cacagauuugagcucagcccug

SEQ ID NO: 1806328 - RNA, 21 nt, Human
caaaaucgaugcagugcuucc

SEQ ID NO: 1806329 - RNA, 20 nt, Human
caaaauaaaacuuuuuaaaa

SEQ ID NO: 1806330 - RNA, 16 nt, Human
caaaauaaaacuuuuu

SEQ ID NO: 1806331 - RNA, 14 nt, Human
caaaaguuucucuu

SEQ ID NO: 1806332 - RNA, 18 nt, Human
caaaaguuuguuugcuua

SEQ ID NO: 1806333 - RNA, 19 nt, Human
caaaacucuccucugcugc

SEQ ID NO: 1806334 - RNA, 15 nt, Human
caaaacucuccucug

SEQ ID NO: 1806335 - RNA, 16 nt, Human
caaaacucuccucugc

SEQ ID NO: 1806336 - RNA, 18 nt, Human
auuuuauuuuauuaugca

SEQ ID NO: 1806337 - RNA, 15 nt, Human
caaaacgguuuuacu

SEQ ID NO: 1806338 - RNA, 21 nt, Human
caaaacgguuuuacugcagcu

SEQ ID NO: 1806339 - RNA, 13 nt, Human
caaacagaggccg

SEQ ID NO: 1806340 - RNA, 15 nt, Human
caaacagaggccgcc

SEQ ID NO: 1806341 - RNA, 21 nt, Human
caaaaugagcccuguccugcc

SEQ ID NO: 1806342 - RNA, 11 nt, Human
caaaaugaaac

SEQ ID NO: 1806343 - RNA, 22 nt, Human
caaaaugaaacgcaaccaccac

SEQ ID NO: 1806344 - RNA, 21 nt, Human
caaacucuugaccucagguga

SEQ ID NO: 1806345 - RNA, 19 nt, Human
caaagaaauuuccacucag

SEQ ID NO: 1806346 - RNA, 18 nt, Human
caaagaaauuuccacuca

SEQ ID NO: 1806347 - RNA, 12 nt, Human
caaagaaauuuc

SEQ ID NO: 1806348 - RNA, 20 nt, Human
caaacucuugaccucaggug

SEQ ID NO: 1806349 - RNA, 19 nt, Human
caaacucuugaccucaggu

SEQ ID NO: 1806350 - RNA, 17 nt, Human
caaacucuugaccucag

SEQ ID NO: 1806351 - RNA, 13 nt, Human
caacaggcugggc

SEQ ID NO: 1806352 - RNA, 12 nt, Human
caacaggcuggg

SEQ ID NO: 1806353 - RNA, 17 nt, Human
caacauacucccaucug

SEQ ID NO: 1806354 - RNA, 19 nt, Human
caacauacucccaucugug

SEQ ID NO: 1806355 - RNA, 20 nt, Human
caacauacucccaucuguga

SEQ ID NO: 1806356 - RNA, 21 nt, Human
caaccugcucuccucuugcca

SEQ ID NO: 1806357 - RNA, 23 nt, Human
caaccugcucuccucuugccacu

SEQ ID NO: 1806358 - RNA, 18 nt, Human
caaccugcucuccucuug

SEQ ID NO: 1806359 - RNA, 17 nt, Human
caaccuucuguggcuca

SEQ ID NO: 1806360 - RNA, 19 nt, Human
caaccuucuguggcucaca

SEQ ID NO: 1806361 - RNA, 20 nt, Human
caaccuucuguggcucacag

SEQ ID NO: 1806362 - RNA, 16 nt, Human
caaccuggucacagga

SEQ ID NO: 1806363 - RNA, 16 nt, Human
caaccuucuguggcuc

SEQ ID NO: 1806364 - RNA, 22 nt, Human
caaauuucuaaaucuccaaaau

SEQ ID NO: 1806365 - RNA, 15 nt, Human
caaauuucuaaaucu

SEQ ID NO: 1806366 - RNA, 23 nt, Human
caaauauauucagccuggcuuca

SEQ ID NO: 1806367 - RNA, 23 nt, Human
caaauggaaaugggcagagcaga

SEQ ID NO: 1806368 - RNA, 14 nt, Human
caaauguucaucaa

SEQ ID NO: 1806369 - RNA, 18 nt, Human
caaauguucaucaaugaa

SEQ ID NO: 1806370 - RNA, 19 nt, Human
caaagugcugggauuacaa

SEQ ID NO: 1806371 - RNA, 13 nt, Human
caaagugcuggga

SEQ ID NO: 1806372 - RNA, 20 nt, Human
caaaguucccuacuuccugu

SEQ ID NO: 1806373 - RNA, 23 nt, Human
caaagugcugggauuacaagcgu

SEQ ID NO: 1806374 - RNA, 18 nt, Human
caaagugcugggauuaca

SEQ ID NO: 1806375 - RNA, 19 nt, Human
caagaaaugaaagcaggga

SEQ ID NO: 1806376 - RNA, 17 nt, Human
caagaaaugaaagcagg

SEQ ID NO: 1806377 - RNA, 14 nt, Human
caagaagcccagga

SEQ ID NO: 1806378 - RNA, 13 nt, Human
caagaagcccagg

SEQ ID NO: 1806379 - RNA, 12 nt, Human
caacuugggaac

SEQ ID NO: 1806380 - RNA, 16 nt, Human
caacuuguaaaugugg

SEQ ID NO: 1806381 - RNA, 17 nt, Human
caagagcuuaacagugu

SEQ ID NO: 1806382 - RNA, 13 nt, Human
caagagcccaggc

SEQ ID NO: 1806383 - RNA, 21 nt, Human
caagaccuucuccuucaccuu

SEQ ID NO: 1806384 - RNA, 23 nt, Human
caagaccuucuccuucaccuuug

SEQ ID NO: 1806385 - RNA, 13 nt, Human
caagacgcugugc

SEQ ID NO: 1806386 - RNA, 15 nt, Human
caagacgcugugcug

SEQ ID NO: 1806387 - RNA, 17 nt, Human
cacaguucaauucucau

SEQ ID NO: 1806388 - RNA, 19 nt, Human
cacaguggaaccagcccag

SEQ ID NO: 1806389 - RNA, 13 nt, Human
cacaguggaacca

SEQ ID NO: 1806390 - RNA, 21 nt, Human
cacaggcccuuccucuccacu

SEQ ID NO: 1806391 - RNA, 22 nt, Human
cacaggcccuuccucuccacug

SEQ ID NO: 1806392 - RNA, 18 nt, Human
cacagugcaucucagccc

SEQ ID NO: 1806393 - RNA, 19 nt, Human
cacagugcaucucagccca

SEQ ID NO: 1806394 - RNA, 16 nt, Human
cacaggcccuuccucu

SEQ ID NO: 1806395 - RNA, 17 nt, Human
cacaggcccuuccucuc

SEQ ID NO: 1806396 - RNA, 18 nt, Human
cacaggcccuuccucucc

SEQ ID NO: 1806397 - RNA, 19 nt, Human
cacaggcccuuccucucca

SEQ ID NO: 1806398 - RNA, 13 nt, Human
cacaggaaaccag

SEQ ID NO: 1806399 - RNA, 22 nt, Human
cacagcugcucaauaaaguaca

SEQ ID NO: 1806400 - RNA, 12 nt, Human
cacagcugcuca

SEQ ID NO: 1806401 - RNA, 23 nt, Human
acgucugacaggcaaugcuggcu

SEQ ID NO: 1806402 - RNA, 15 nt, Human
acuaauagacaauuu

SEQ ID NO: 1806403 - RNA, 11 nt, Human
acguggcugcu

SEQ ID NO: 1806404 - RNA, 15 nt, Human
acggaauaguuggcu

SEQ ID NO: 1806405 - RNA, 19 nt, Human
acggacgaaccuugaaaac

SEQ ID NO: 1806406 - RNA, 15 nt, Human
acggaagagccuugc

SEQ ID NO: 1806407 - RNA, 16 nt, Human
acggaagagccuugcg

SEQ ID NO: 1806408 - RNA, 19 nt, Human
acgcuggagugcagugagc

SEQ ID NO: 1806409 - RNA, 19 nt, Human
accuguggccaaguucuua

SEQ ID NO: 1806410 - RNA, 18 nt, Human
accuguggccaaguucuu

SEQ ID NO: 1806411 - RNA, 11 nt, Human
accugugucuc

SEQ ID NO: 1806412 - RNA, 17 nt, Human
acuauugcuugcacaaa

SEQ ID NO: 1806413 - RNA, 16 nt, Human
acuauuguuagucucu

SEQ ID NO: 1806414 - RNA, 17 nt, Human
acuagggaagauaauau

SEQ ID NO: 1806415 - RNA, 14 nt, Human
acuaaucuuucugc

SEQ ID NO: 1806416 - RNA, 17 nt, Human
acccuguuaccauuuug

SEQ ID NO: 1806417 - RNA, 16 nt, Human
acccaugcugcccugu

SEQ ID NO: 1806418 - RNA, 14 nt, Human
acccaugcugcccu

SEQ ID NO: 1806419 - RNA, 15 nt, Human
acccaugcugcccug

SEQ ID NO: 1806420 - RNA, 22 nt, Human
acccugugauggggcccugccu

SEQ ID NO: 1806421 - RNA, 16 nt, Human
accccacacacgccag

SEQ ID NO: 1806422 - RNA, 19 nt, Human
accgggccacagagaaagu

SEQ ID NO: 1806423 - RNA, 15 nt, Human
accgggccacagaga

SEQ ID NO: 1806424 - RNA, 20 nt, Human
accgggccacagagaaagua

SEQ ID NO: 1806425 - RNA, 14 nt, Human
accgugaggccaga

SEQ ID NO: 1806426 - RNA, 20 nt, Human
accgggcacucagaagacac

SEQ ID NO: 1806427 - RNA, 19 nt, Human
accggcuggccuggccccu

SEQ ID NO: 1806428 - RNA, 17 nt, Human
accggcuggccuggccc

SEQ ID NO: 1806429 - RNA, 18 nt, Human
accggcuggccuggcccc

SEQ ID NO: 1806430 - RNA, 14 nt, Human
accggcuggccugg

SEQ ID NO: 1806431 - RNA, 15 nt, Human
accggcuggccuggc

SEQ ID NO: 1806432 - RNA, 22 nt, Human
accucagguaaucgaccugccu

SEQ ID NO: 1806433 - RNA, 14 nt, Human
accucaggccuggg

SEQ ID NO: 1806434 - RNA, 22 nt, Human
accucaggccugggggcugggc

SEQ ID NO: 1806435 - RNA, 16 nt, Human
accgugaggccagaga

SEQ ID NO: 1806436 - RNA, 17 nt, Human
accgugaggccagagac

SEQ ID NO: 1806437 - RNA, 12 nt, Human
accucaggccug

SEQ ID NO: 1806438 - RNA, 13 nt, Human
accucaggccugg

SEQ ID NO: 1806439 - RNA, 23 nt, Human
accucagguaaucgaccugccuc

SEQ ID NO: 1806440 - RNA, 18 nt, Human
accucaggugagaagcag

SEQ ID NO: 1806441 - RNA, 23 nt, Human
accugccccuccucucugcccua

SEQ ID NO: 1806442 - RNA, 13 nt, Human
accugcccaaccu

SEQ ID NO: 1806443 - RNA, 15 nt, Human
accugccagggacag

SEQ ID NO: 1806444 - RNA, 16 nt, Human
accugccagggacaga

SEQ ID NO: 1806445 - RNA, 18 nt, Human
accugccagggacagagg

SEQ ID NO: 1806446 - RNA, 12 nt, Human
accugccaggga

SEQ ID NO: 1806447 - RNA, 13 nt, Human
accugccagggac

SEQ ID NO: 1806448 - RNA, 11 nt, Human
accugccaggg

SEQ ID NO: 1806449 - RNA, 21 nt, Human
accucuugagccuugaacuuu

SEQ ID NO: 1806450 - RNA, 20 nt, Human
accucuugagccuugaacuu

SEQ ID NO: 1806451 - RNA, 19 nt, Human
accucuugagccuugaacu

SEQ ID NO: 1806452 - RNA, 17 nt, Human
accucuugagccuugaa

SEQ ID NO: 1806453 - RNA, 20 nt, Human
acuucugccauauucuguug

SEQ ID NO: 1806454 - RNA, 13 nt, Human
acuucagcucugu

SEQ ID NO: 1806455 - RNA, 13 nt, Human
acuucugccucuu

SEQ ID NO: 1806456 - RNA, 17 nt, Human
acuucuuauacauuuga

SEQ ID NO: 1806457 - RNA, 18 nt, Human
acuucuuauacauuugau

SEQ ID NO: 1806458 - RNA, 14 nt, Human
acuuaaaaaugguu

SEQ ID NO: 1806459 - RNA, 13 nt, Human
acuuaaaaauggu

SEQ ID NO: 1806460 - RNA, 21 nt, Human
acuuaaaaaugguuuaaaugg

SEQ ID NO: 1806461 - RNA, 22 nt, Human
acuuaaaauauuccugcauuug

SEQ ID NO: 1806462 - RNA, 14 nt, Human
acuuaaauaaugug

SEQ ID NO: 1806463 - RNA, 22 nt, Human
acuugggaggcugagaugggag

SEQ ID NO: 1806464 - RNA, 15 nt, Human
acuuuauuuuguguu

SEQ ID NO: 1806465 - RNA, 17 nt, Human
acuuuaugcuaagugaa

SEQ ID NO: 1806466 - RNA, 12 nt, Human
acuuuaugcuaa

SEQ ID NO: 1806467 - RNA, 22 nt, Human
acuuucaggccacauggcuaaa

SEQ ID NO: 1806468 - RNA, 22 nt, Human
acugaugggcaacccccagccu

SEQ ID NO: 1806469 - RNA, 12 nt, Human
acugaugggcaa

SEQ ID NO: 1806470 - RNA, 22 nt, Human
acugauggcuaauguacugcau

SEQ ID NO: 1806471 - RNA, 23 nt, Human
acugaccagccuccaugcugccu

SEQ ID NO: 1806472 - RNA, 13 nt, Human
acugaucucucgu

SEQ ID NO: 1806473 - RNA, 23 nt, Human
acugacauuguuggccaaagcca

SEQ ID NO: 1806474 - RNA, 22 nt, Human
acugacauuguuggccaaagcc

SEQ ID NO: 1806475 - RNA, 21 nt, Human
acugaccaauauuguacaguu

SEQ ID NO: 1806476 - RNA, 20 nt, Human
acugaccaauauuguacagu

SEQ ID NO: 1806477 - RNA, 22 nt, Human
acugaccaauauuguacaguuu

SEQ ID NO: 1806478 - RNA, 15 nt, Human
acugaccagccucca

SEQ ID NO: 1806479 - RNA, 20 nt, Human
acugaccagccuccaugcug

SEQ ID NO: 1806480 - RNA, 13 nt, Human
acugaccagccuc

SEQ ID NO: 1806481 - RNA, 23 nt, Human
acugauuuuuuuuuccuucagug

SEQ ID NO: 1806482 - RNA, 21 nt, Human
acugauuuuuuuuuccuucag

SEQ ID NO: 1806483 - RNA, 22 nt, Human
acugauuuuuuuuuccuucagu

SEQ ID NO: 1806484 - RNA, 19 nt, Human
acucugugucagguggggc

SEQ ID NO: 1806485 - RNA, 21 nt, Human
acucugugucagguggggcag

SEQ ID NO: 1806486 - RNA, 17 nt, Human
acucugucucaguccau

SEQ ID NO: 1806487 - RNA, 15 nt, Human
acucugucucagucc

SEQ ID NO: 1806488 - RNA, 19 nt, Human
acucugucucaaaaaaaca

SEQ ID NO: 1806489 - RNA, 21 nt, Human
acucuacuuagcaugucccua

SEQ ID NO: 1806490 - RNA, 20 nt, Human
acucuacuuagcaugucccu

SEQ ID NO: 1806491 - RNA, 14 nt, Human
acuauuuuucagaa

SEQ ID NO: 1806492 - RNA, 14 nt, Human
acucuaaagucugu

SEQ ID NO: 1806493 - RNA, 15 nt, Human
acugcuuuuggucug

SEQ ID NO: 1806494 - RNA, 22 nt, Human
acugcccggcaggguccuagaa

SEQ ID NO: 1806495 - RNA, 20 nt, Human
acugcuuuuggucuguguga

SEQ ID NO: 1806496 - RNA, 16 nt, Human
acugcuuuuggucugu

SEQ ID NO: 1806497 - RNA, 19 nt, Human
acugccagucccccugccc

SEQ ID NO: 1806498 - RNA, 18 nt, Human
acugccagucccccugcc

SEQ ID NO: 1806499 - RNA, 15 nt, Human
acugcccggcagggu

SEQ ID NO: 1806500 - RNA, 16 nt, Human
aauuuugugcccccau

SEQ ID NO: 1806501 - RNA, 14 nt, Human
aauuuugauguuuu

SEQ ID NO: 1806502 - RNA, 18 nt, Human
aauuuucaucuaggauuu

SEQ ID NO: 1806503 - RNA, 12 nt, Human
acaaagaaauua

SEQ ID NO: 1806504 - RNA, 14 nt, Human
acaaagaaauuaug

SEQ ID NO: 1806505 - RNA, 16 nt, Human
acaaagaaauuaugug

SEQ ID NO: 1806506 - RNA, 13 nt, Human
acaaaaugaaacg

SEQ ID NO: 1806507 - RNA, 22 nt, Human
acaaaaugaaacgcaaccacca

SEQ ID NO: 1806508 - RNA, 18 nt, Human
acaaccuucuguggcuca

SEQ ID NO: 1806509 - RNA, 16 nt, Human
acaagaaaugaaagca

SEQ ID NO: 1806510 - RNA, 15 nt, Human
acaagaaaugaaagc

SEQ ID NO: 1806511 - RNA, 22 nt, Human
acaagaaaugaaagcagggacu

SEQ ID NO: 1806512 - RNA, 20 nt, Human
aauuuauuuaugggauccug

SEQ ID NO: 1806513 - RNA, 19 nt, Human
aaugucacaggcaggucca

SEQ ID NO: 1806514 - RNA, 16 nt, Human
aaugucacaggcaggu

SEQ ID NO: 1806515 - RNA, 16 nt, Human
aauuguaaggaaugau

SEQ ID NO: 1806516 - RNA, 12 nt, Human
aauuguaaggaa

SEQ ID NO: 1806517 - RNA, 13 nt, Human
acaauuuauuaug

SEQ ID NO: 1806518 - RNA, 14 nt, Human
acaauuuauuaugg

SEQ ID NO: 1806519 - RNA, 16 nt, Human
acaaggauugcuacug

SEQ ID NO: 1806520 - RNA, 20 nt, Human
acaaggaugaucuaggaaga

SEQ ID NO: 1806521 - RNA, 21 nt, Human
acacagcucuucuccaggcug

SEQ ID NO: 1806522 - RNA, 20 nt, Human
acacagcucuucuccaggcu

SEQ ID NO: 1806523 - RNA, 22 nt, Human
acacagcucuucuccaggcugu

SEQ ID NO: 1806524 - RNA, 14 nt, Human
acacauuuuuuaaa

SEQ ID NO: 1806525 - RNA, 19 nt, Human
acacaaaaguuucucuuuu

SEQ ID NO: 1806526 - RNA, 19 nt, Human
acacagcucuucuccaggc

SEQ ID NO: 1806527 - RNA, 20 nt, Human
acaccacuacauucuguuaa

SEQ ID NO: 1806528 - RNA, 17 nt, Human
acaccacuacauucugu

SEQ ID NO: 1806529 - RNA, 12 nt, Human
acacgaauauug

SEQ ID NO: 1806530 - RNA, 14 nt, Human
acacgaauauugcu

SEQ ID NO: 1806531 - RNA, 15 nt, Human
acaccacuacauucu

SEQ ID NO: 1806532 - RNA, 19 nt, Human
acacauuuuuuaaaugcac

SEQ ID NO: 1806533 - RNA, 18 nt, Human
acacauuuuuuaaaugca

SEQ ID NO: 1806534 - RNA, 16 nt, Human
acacauuuuuuaaaug

SEQ ID NO: 1806535 - RNA, 21 nt, Human
acaccacuacauucuguuaau

SEQ ID NO: 1806536 - RNA, 15 nt, Human
acacgaauauugcug

SEQ ID NO: 1806537 - RNA, 21 nt, Human
acacgaauauugcugauggug

SEQ ID NO: 1806538 - RNA, 14 nt, Human
acagacaaagcgug

SEQ ID NO: 1806539 - RNA, 23 nt, Human
acagaggccaugggccuccugug

SEQ ID NO: 1806540 - RNA, 21 nt, Human
acagaggccaugggccuccug

SEQ ID NO: 1806541 - RNA, 17 nt, Human
acagaggccaugggccu

SEQ ID NO: 1806542 - RNA, 13 nt, Human
acagaggcagccc

SEQ ID NO: 1806543 - RNA, 16 nt, Human
acagaggacacagaga

SEQ ID NO: 1806544 - RNA, 22 nt, Human
acacugugcugagucugaaggc

SEQ ID NO: 1806545 - RNA, 17 nt, Human
acacugugcugagucug

SEQ ID NO: 1806546 - RNA, 20 nt, Human
acacugggagaaaugaaaaa

SEQ ID NO: 1806547 - RNA, 15 nt, Human
acauccuacaagaca

SEQ ID NO: 1806548 - RNA, 16 nt, Human
acaugcaaggucauuu

SEQ ID NO: 1806549 - RNA, 17 nt, Human
acaugcaaggucauuuu

SEQ ID NO: 1806550 - RNA, 18 nt, Human
acaugcaaggucauuuuu

SEQ ID NO: 1806551 - RNA, 15 nt, Human
acaugccucucucag

SEQ ID NO: 1806552 - RNA, 16 nt, Human
acaugccucucucagg

SEQ ID NO: 1806553 - RNA, 17 nt, Human
acaugccucucucaggc

SEQ ID NO: 1806554 - RNA, 18 nt, Human
acaugccucucucaggcc

SEQ ID NO: 1806555 - RNA, 16 nt, Human
acauaagauaaaugug

SEQ ID NO: 1806556 - RNA, 20 nt, Human
acauaauucaggaagcagcu

SEQ ID NO: 1806557 - RNA, 23 nt, Human
acagugagucgaggacagggagg

SEQ ID NO: 1806558 - RNA, 20 nt, Human
acagugauuaccagggacug

SEQ ID NO: 1806559 - RNA, 21 nt, Human
acagugauuaccagggacuga

SEQ ID NO: 1806560 - RNA, 13 nt, Human
acaguguacaguc

SEQ ID NO: 1806561 - RNA, 12 nt, Human
acaguguacagu

SEQ ID NO: 1806562 - RNA, 18 nt, Human
acaguguacagucuugua

SEQ ID NO: 1806563 - RNA, 17 nt, Human
acaguguacagucuugu

SEQ ID NO: 1806564 - RNA, 15 nt, Human
acaguguacagucuu

SEQ ID NO: 1806565 - RNA, 14 nt, Human
acaggcaaugcugg

SEQ ID NO: 1806566 - RNA, 23 nt, Human
acaggugugagucaccaagccca

SEQ ID NO: 1806567 - RNA, 22 nt, Human
acaggugugagucaccaagccc

SEQ ID NO: 1806568 - RNA, 19 nt, Human
acaggugugaaccaccaca

SEQ ID NO: 1806569 - RNA, 22 nt, Human
acagugagucgaggacagggag

SEQ ID NO: 1806570 - RNA, 14 nt, Human
acagcucuguccug

SEQ ID NO: 1806571 - RNA, 23 nt, Human
acagcuccuucuguccuacucug

SEQ ID NO: 1806572 - RNA, 18 nt, Human
acagcuccuucuguccua

SEQ ID NO: 1806573 - RNA, 16 nt, Human
acagcuccuucugucc

SEQ ID NO: 1806574 - RNA, 17 nt, Human
acagaggggguggccuc

SEQ ID NO: 1806575 - RNA, 18 nt, Human
acagaggggguggccucc

SEQ ID NO: 1806576 - RNA, 19 nt, Human
acagaggggguggccuccc

SEQ ID NO: 1806577 - RNA, 21 nt, Human
acagaggggguggccucccaa

SEQ ID NO: 1806578 - RNA, 17 nt, Human
acagcucuguccuggga

SEQ ID NO: 1806579 - RNA, 16 nt, Human
acagcucuguccuggg

SEQ ID NO: 1806580 - RNA, 23 nt, Human
acaggcaagcaccuccugccucg

SEQ ID NO: 1806581 - RNA, 20 nt, Human
acaggcaagcaccuccugcc

SEQ ID NO: 1806582 - RNA, 12 nt, Human
acagcugccugc

SEQ ID NO: 1806583 - RNA, 16 nt, Human
acagcugccugcagua

SEQ ID NO: 1806584 - RNA, 13 nt, Human
acagcugccuggg

SEQ ID NO: 1806585 - RNA, 19 nt, Human
accaaggcugauuaaacca

SEQ ID NO: 1806586 - RNA, 20 nt, Human
accaaggcugauuaaaccaa

SEQ ID NO: 1806587 - RNA, 12 nt, Human
accaccugccca

SEQ ID NO: 1806588 - RNA, 20 nt, Human
accagccccagugcccacag

SEQ ID NO: 1806589 - RNA, 19 nt, Human
accagccccagugcccaca

SEQ ID NO: 1806590 - RNA, 18 nt, Human
accagccccagugcccac

SEQ ID NO: 1806591 - RNA, 17 nt, Human
accagccccagugccca

SEQ ID NO: 1806592 - RNA, 16 nt, Human
accagccccagugccc

SEQ ID NO: 1806593 - RNA, 13 nt, Human
accagcagccugg

SEQ ID NO: 1806594 - RNA, 14 nt, Human
accagcagaaaugc

SEQ ID NO: 1806595 - RNA, 12 nt, Human
accagcagagca

SEQ ID NO: 1806596 - RNA, 13 nt, Human
accagcagagcac

SEQ ID NO: 1806597 - RNA, 14 nt, Human
acauuuauucugcu

SEQ ID NO: 1806598 - RNA, 16 nt, Human
acauuuccuaaauaua

SEQ ID NO: 1806599 - RNA, 17 nt, Human
acauuuccuaaauauau

SEQ ID NO: 1806600 - RNA, 18 nt, Human
acaugugaaaagaauaga

SEQ ID NO: 1806601 - RNA, 17 nt, Human
acaugugaaaagaauag

SEQ ID NO: 1806602 - RNA, 14 nt, Human
acaugugaaaagaa

SEQ ID NO: 1806603 - RNA, 23 nt, Human
acaugucuuuucuugcaugaggc

SEQ ID NO: 1806604 - RNA, 19 nt, Human
acaugccucucucaggcca

SEQ ID NO: 1806605 - RNA, 20 nt, Human
acaugccucucucaggccaa

SEQ ID NO: 1806606 - RNA, 15 nt, Human
acccacccuccuuuc

SEQ ID NO: 1806607 - RNA, 13 nt, Human
acccaugcugccc

SEQ ID NO: 1806608 - RNA, 17 nt, Human
acccacccccacccaag

SEQ ID NO: 1806609 - RNA, 15 nt, Human
acccacccccaccca

SEQ ID NO: 1806610 - RNA, 13 nt, Human
accauacuaauua

SEQ ID NO: 1806611 - RNA, 16 nt, Human
accauacuaauuauac

SEQ ID NO: 1806612 - RNA, 21 nt, Human
accauacuaauuauacccccu

SEQ ID NO: 1806613 - RNA, 17 nt, Human
accauaggucaccuuua

SEQ ID NO: 1806614 - RNA, 14 nt, Human
accaucaagccacc

SEQ ID NO: 1806615 - RNA, 15 nt, Human
accaucauugaaauc

SEQ ID NO: 1806616 - RNA, 15 nt, Human
accaucaagccacca

SEQ ID NO: 1806617 - RNA, 16 nt, Human
accaucccugaaggcc

SEQ ID NO: 1806618 - RNA, 23 nt, Human
accaucauugaaaucuuuuugcu

SEQ ID NO: 1806619 - RNA, 20 nt, Human
aagauucauauuuacuucuu

SEQ ID NO: 1806620 - RNA, 17 nt, Human
aagauucaaucccagga

SEQ ID NO: 1806621 - RNA, 19 nt, Human
aagauuuugaaauuuuuau

SEQ ID NO: 1806622 - RNA, 19 nt, Human
aagccaccaacauacuccc

SEQ ID NO: 1806623 - RNA, 15 nt, Human
aagcagggacuugaa

SEQ ID NO: 1806624 - RNA, 23 nt, Human
aagacagugaaagaaaauaacaa

SEQ ID NO: 1806625 - RNA, 16 nt, Human
aagacuuuggaaagag

SEQ ID NO: 1806626 - RNA, 14 nt, Human
aacuuacuuagugu

SEQ ID NO: 1806627 - RNA, 15 nt, Human
aagacuuuuaugaua

SEQ ID NO: 1806628 - RNA, 17 nt, Human
aagacuuuuccaacccu

SEQ ID NO: 1806629 - RNA, 20 nt, Human
aagggacuuggaagcuccgc

SEQ ID NO: 1806630 - RNA, 15 nt, Human
aagggacugagaaau

SEQ ID NO: 1806631 - RNA, 17 nt, Human
aagggacugagaaauuu

SEQ ID NO: 1806632 - RNA, 12 nt, Human
aaguagaggagg

SEQ ID NO: 1806633 - RNA, 22 nt, Human
aaggacccggaggggccuggca

SEQ ID NO: 1806634 - RNA, 12 nt, Human
aaggaauuuuau

SEQ ID NO: 1806635 - RNA, 13 nt, Human
aaggacuaggguc

SEQ ID NO: 1806636 - RNA, 14 nt, Human
aagcugcugacagu

SEQ ID NO: 1806637 - RNA, 22 nt, Human
aagcugccagccgagauagcca

SEQ ID NO: 1806638 - RNA, 11 nt, Human
aagcugccagc

SEQ ID NO: 1806639 - RNA, 12 nt, Human
aagcugccagcc

SEQ ID NO: 1806640 - RNA, 20 nt, Human
aagcgugagccacugcaccg

SEQ ID NO: 1806641 - RNA, 17 nt, Human
aagcgugagccacugca

SEQ ID NO: 1806642 - RNA, 21 nt, Human
aagcgugagccacugcaccgg

SEQ ID NO: 1806643 - RNA, 23 nt, Human
aaggaaugauuaauuaaaacaca

SEQ ID NO: 1806644 - RNA, 16 nt, Human
aagcugcugacagugu

SEQ ID NO: 1806645 - RNA, 17 nt, Human
aagcgauucuucugcuu

SEQ ID NO: 1806646 - RNA, 16 nt, Human
aagcgauucuucugcu

SEQ ID NO: 1806647 - RNA, 14 nt, Human
aagcgauucuucug

SEQ ID NO: 1806648 - RNA, 15 nt, Human
aagcgauucuucugc

SEQ ID NO: 1806649 - RNA, 15 nt, Human
aagccagcaggcucu

SEQ ID NO: 1806650 - RNA, 19 nt, Human
aagccagcaggcucucagg

SEQ ID NO: 1806651 - RNA, 18 nt, Human
aagccagcaggcucucag

SEQ ID NO: 1806652 - RNA, 21 nt, Human
aagccaccaacauacucccau

SEQ ID NO: 1806653 - RNA, 19 nt, Human
aauccaccugccucggccu

SEQ ID NO: 1806654 - RNA, 18 nt, Human
aauccaccugccucggcc

SEQ ID NO: 1806655 - RNA, 15 nt, Human
aaucuggacuccucu

SEQ ID NO: 1806656 - RNA, 16 nt, Human
aaucuggacuccucug

SEQ ID NO: 1806657 - RNA, 17 nt, Human
aaucuggacuccucugu

SEQ ID NO: 1806658 - RNA, 18 nt, Human
aaucuggacuccucuguc

SEQ ID NO: 1806659 - RNA, 20 nt, Human
aaucuggacuccucugucca

SEQ ID NO: 1806660 - RNA, 18 nt, Human
aaucucggcucacugcau

SEQ ID NO: 1806661 - RNA, 23 nt, Human
aaucucgcucugucgcccaggcu

SEQ ID NO: 1806662 - RNA, 15 nt, Human
aaugauagcuacugu

SEQ ID NO: 1806663 - RNA, 17 nt, Human
aaugauaugcuuguaac

SEQ ID NO: 1806664 - RNA, 15 nt, Human
aaugauaugcuugua

SEQ ID NO: 1806665 - RNA, 18 nt, Human
aaugauaugcuuguaacu

SEQ ID NO: 1806666 - RNA, 19 nt, Human
aaugauaugcuuguaacua

SEQ ID NO: 1806667 - RNA, 23 nt, Human
aaugauguauguugaagccuuug

SEQ ID NO: 1806668 - RNA, 16 nt, Human
aaugauuaauuaaaac

SEQ ID NO: 1806669 - RNA, 12 nt, Human
aaugauuaauua

SEQ ID NO: 1806670 - RNA, 13 nt, Human
aaugauuaauuaa

SEQ ID NO: 1806671 - RNA, 23 nt, Human
aaugcucuuuacuucauggacuu

SEQ ID NO: 1806672 - RNA, 13 nt, Human
aaugggacacuaa

SEQ ID NO: 1806673 - RNA, 14 nt, Human
aaugggagcucaug

SEQ ID NO: 1806674 - RNA, 17 nt, Human
aaugggggugcauuuga

SEQ ID NO: 1806675 - RNA, 15 nt, Human
aaugggggugcauuu

SEQ ID NO: 1806676 - RNA, 17 nt, Human
aaugcgcaggcuggccc

SEQ ID NO: 1806677 - RNA, 18 nt, Human
aaugcgcaggcuggcccu

SEQ ID NO: 1806678 - RNA, 19 nt, Human
aaugcgcaggcuggcccug

SEQ ID NO: 1806679 - RNA, 20 nt, Human
aaugcgcaggcuggcccugc

SEQ ID NO: 1806680 - RNA, 15 nt, Human
aaugcgcaggcuggc

SEQ ID NO: 1806681 - RNA, 14 nt, Human
aaugcgcaggcugg

SEQ ID NO: 1806682 - RNA, 23 nt, Human
aaugcgugcauaccacuuuuguu

SEQ ID NO: 1806683 - RNA, 21 nt, Human
aaugcgugcauaccacuuuug

SEQ ID NO: 1806684 - RNA, 16 nt, Human
aauagaaauccaauug

SEQ ID NO: 1806685 - RNA, 17 nt, Human
aauagaaauggggaacu

SEQ ID NO: 1806686 - RNA, 22 nt, Human
aauagaagcuaagguuuagaua

SEQ ID NO: 1806687 - RNA, 16 nt, Human
aauauaggaacuuaaa

SEQ ID NO: 1806688 - RNA, 13 nt, Human
aagugcugcauuu

SEQ ID NO: 1806689 - RNA, 14 nt, Human
aagugcugcauuua

SEQ ID NO: 1806690 - RNA, 15 nt, Human
aaguucuuaguugcu

SEQ ID NO: 1806691 - RNA, 22 nt, Human
aaguucuuaguugcuguauguc

SEQ ID NO: 1806692 - RNA, 15 nt, Human
aaguggggacagagc

SEQ ID NO: 1806693 - RNA, 11 nt, Human
aauaaagcugu

SEQ ID NO: 1806694 - RNA, 19 nt, Human
aauaaagcuguguggcagu

SEQ ID NO: 1806695 - RNA, 10 nt, Human
aauaaaccau

SEQ ID NO: 1806696 - RNA, 12 nt, Human
aauaaaauuuuu

SEQ ID NO: 1806697 - RNA, 18 nt, Human
aaguugauggugaugaaa

SEQ ID NO: 1806698 - RNA, 18 nt, Human
aaaucugcuuuuuaaaga

SEQ ID NO: 1806699 - RNA, 22 nt, Human
aaaucuccaaaauaaaacuuuu

SEQ ID NO: 1806700 - RNA, 15 nt, Human
aaauggacguguuau

SEQ ID NO: 1806701 - RNA, 17 nt, Human
aaauggacguguuauga

SEQ ID NO: 1806702 - RNA, 14 nt, Human
aaauggacguguua

SEQ ID NO: 1806703 - RNA, 22 nt, Human
aacaaaggccuaauucuaugcc

SEQ ID NO: 1806704 - RNA, 22 nt, Human
aacaaaccuguuucugcagcca

SEQ ID NO: 1806705 - RNA, 21 nt, Human
aacacauacaggaagguagaa

SEQ ID NO: 1806706 - RNA, 17 nt, Human
aacacuaacaugauuug

SEQ ID NO: 1806707 - RNA, 19 nt, Human
aacaccucugcacaagcug

SEQ ID NO: 1806708 - RNA, 22 nt, Human
aaauguuuuuuuuuaaagacuu

SEQ ID NO: 1806709 - RNA, 12 nt, Human
aaauuaacuuuu

SEQ ID NO: 1806710 - RNA, 19 nt, Human
aaauuaacuuuuauaaacu

SEQ ID NO: 1806711 - RNA, 22 nt, Human
aaauugacacuuaaaaaugguu

SEQ ID NO: 1806712 - RNA, 14 nt, Human
aaauuaacuuuuau

SEQ ID NO: 1806713 - RNA, 13 nt, Human
aaauuaacuuuua

SEQ ID NO: 1806714 - RNA, 18 nt, Human
aaauugaugggauuuggu

SEQ ID NO: 1806715 - RNA, 18 nt, Human
aaauguuuuuuuuuaaag

SEQ ID NO: 1806716 - RNA, 21 nt, Human
aaauguuuuuuuuuaaagacu

SEQ ID NO: 1806717 - RNA, 20 nt, Human
aaauguucaucaaugaauga

SEQ ID NO: 1806718 - RNA, 13 nt, Human
aacccuucagugc

SEQ ID NO: 1806719 - RNA, 19 nt, Human
aaccaguguuguggauuua

SEQ ID NO: 1806720 - RNA, 15 nt, Human
aacauggaaguacua

SEQ ID NO: 1806721 - RNA, 22 nt, Human
aacaugcuacacacugcauguu

SEQ ID NO: 1806722 - RNA, 16 nt, Human
aacagcuaaugggaca

SEQ ID NO: 1806723 - RNA, 15 nt, Human
aacagauuuggaaag

SEQ ID NO: 1806724 - RNA, 14 nt, Human
aacagauuuggaaa

SEQ ID NO: 1806725 - RNA, 13 nt, Human
aacagauuuggaa

SEQ ID NO: 1806726 - RNA, 15 nt, Human
aacauccuacaagac

SEQ ID NO: 1806727 - RNA, 22 nt, Human
aacauccuacaagacacaguga

SEQ ID NO: 1806728 - RNA, 15 nt, Human
aacguauaaaagccu

SEQ ID NO: 1806729 - RNA, 13 nt, Human
aacgucugugcca

SEQ ID NO: 1806730 - RNA, 17 nt, Human
aacucaaacucuuaaaa

SEQ ID NO: 1806731 - RNA, 16 nt, Human
aacucaccccagcccc

SEQ ID NO: 1806732 - RNA, 17 nt, Human
aacucaccccagcccca

SEQ ID NO: 1806733 - RNA, 18 nt, Human
aacucaccccagccccaa

SEQ ID NO: 1806734 - RNA, 11 nt, Human
aaauaaauuau

SEQ ID NO: 1806735 - RNA, 19 nt, Human
aaaggcagaagcaacccaa

SEQ ID NO: 1806736 - RNA, 18 nt, Human
aaagcccaaagugguaua

SEQ ID NO: 1806737 - RNA, 14 nt, Human
aaaggcuccaggag

SEQ ID NO: 1806738 - RNA, 14 nt, Human
aaaggcuaccuuug

SEQ ID NO: 1806739 - RNA, 17 nt, Human
aaaggcuaccuuuguau

SEQ ID NO: 1806740 - RNA, 22 nt, Human
aaaggcuccaggagcagccaca

SEQ ID NO: 1806741 - RNA, 21 nt, Human
aaaggcuccaggagcagccac

SEQ ID NO: 1806742 - RNA, 15 nt, Human
aaagccaaagcuagg

SEQ ID NO: 1806743 - RNA, 21 nt, Human
aaagcauuuuguaauaauaaa

SEQ ID NO: 1806744 - RNA, 13 nt, Human
aaagcauuuugua

SEQ ID NO: 1806745 - RNA, 15 nt, Human
aaagcauuuuguaau

SEQ ID NO: 1806746 - RNA, 14 nt, Human
aaagcauuuuguaa

SEQ ID NO: 1806747 - RNA, 17 nt, Human
aaacucuugaccucagg

SEQ ID NO: 1806748 - RNA, 14 nt, Human
aaacccuucagugc

SEQ ID NO: 1806749 - RNA, 21 nt, Human
aaacccugucucuacuaaaaa

SEQ ID NO: 1806750 - RNA, 17 nt, Human
aaaccccaucucuacaa

SEQ ID NO: 1806751 - RNA, 20 nt, Human
aaacugauuuuuuuuuccuu

SEQ ID NO: 1806752 - RNA, 13 nt, Human
aaacugauuuuuu

SEQ ID NO: 1806753 - RNA, 19 nt, Human
aaacugauuuuuuuuuccu

SEQ ID NO: 1806754 - RNA, 18 nt, Human
aaagaacgcugauuuaaa

SEQ ID NO: 1806755 - RNA, 15 nt, Human
aaagaacgcugauuu

SEQ ID NO: 1806756 - RNA, 20 nt, Human
aaagaacgcugauuuaaaga

SEQ ID NO: 1806757 - RNA, 15 nt, Human
aaagauacaguuacu

SEQ ID NO: 1806758 - RNA, 18 nt, Human
aaagaggucgcuugggaa

SEQ ID NO: 1806759 - RNA, 11 nt, Human
aaagagguuuu

SEQ ID NO: 1806760 - RNA, 15 nt, Human
aaaauuagccaagug

SEQ ID NO: 1806761 - RNA, 19 nt, Human
aaaauuaggauuucaugau

SEQ ID NO: 1806762 - RNA, 13 nt, Human
aaaauuaagaaag

SEQ ID NO: 1806763 - RNA, 20 nt, Human
aaaauuaagaaaggauaaag

SEQ ID NO: 1806764 - RNA, 23 nt, Human
aaaauuaaucugggccagaauuu

SEQ ID NO: 1806765 - RNA, 22 nt, Human
aaaauuaacaugaauauuuagu

SEQ ID NO: 1806766 - RNA, 12 nt, Human
aaaauuaagaaa

SEQ ID NO: 1806767 - RNA, 21 nt, Human
aaaauccacuuuaucuugaau

SEQ ID NO: 1806768 - RNA, 15 nt, Human
aaaauaaaaaacacu

SEQ ID NO: 1806769 - RNA, 17 nt, Human
aaacagcuaaugggaca

SEQ ID NO: 1806770 - RNA, 18 nt, Human
aggacccggaggggccug

SEQ ID NO: 1806771 - RNA, 20 nt, Human
aggacccggaggggccuggc

SEQ ID NO: 1806772 - RNA, 21 nt, Human
aggacccggaggggccuggca

SEQ ID NO: 1806773 - RNA, 22 nt, Human
aggacccggaggggccuggcag

SEQ ID NO: 1806774 - RNA, 16 nt, Human
aggaccuguggccaag

SEQ ID NO: 1806775 - RNA, 21 nt, Human
aggaccuguggccaaguucuu

SEQ ID NO: 1806776 - RNA, 18 nt, Human
agcuucacuguaaaauaa

SEQ ID NO: 1806777 - RNA, 18 nt, Human
agcuucauuuccuguguc

SEQ ID NO: 1806778 - RNA, 19 nt, Human
agcuucauuuccugugucu

SEQ ID NO: 1806779 - RNA, 16 nt, Human
agcuuuuaaacccuau

SEQ ID NO: 1806780 - RNA, 23 nt, Human
agcuuuguuuguugucagcugaa

SEQ ID NO: 1806781 - RNA, 22 nt, Human
aggaaggcugagaggagagaga

SEQ ID NO: 1806782 - RNA, 23 nt, Human
aggaacuuaaauaaugugaaacu

SEQ ID NO: 1806783 - RNA, 20 nt, Human
aggaauaaauugcuccuuga

SEQ ID NO: 1806784 - RNA, 19 nt, Human
aggaauaaauugcuccuug

SEQ ID NO: 1806785 - RNA, 22 nt, Human
aggaauaccugucccccugaca

SEQ ID NO: 1806786 - RNA, 15 nt, Human
aggaauaccuguccc

SEQ ID NO: 1806787 - RNA, 18 nt, Human
aggaauaccugucccccu

SEQ ID NO: 1806788 - RNA, 21 nt, Human
aggaacuuaaauaaugugaaa

SEQ ID NO: 1806789 - RNA, 20 nt, Human
aggaacaaggcaaggcuguc

SEQ ID NO: 1806790 - RNA, 23 nt, Human
aggaacaaggcaaggcugucaau

SEQ ID NO: 1806791 - RNA, 15 nt, Human
agcuuuuaugugaaa

SEQ ID NO: 1806792 - RNA, 12 nt, Human
aggaacaaggca

SEQ ID NO: 1806793 - RNA, 13 nt, Human
aggaacaaggcaa

SEQ ID NO: 1806794 - RNA, 16 nt, Human
aggaacaaggcaaggc

SEQ ID NO: 1806795 - RNA, 17 nt, Human
aggaacaaggcaaggcu

SEQ ID NO: 1806796 - RNA, 19 nt, Human
aggaacaaggcaaggcugu

SEQ ID NO: 1806797 - RNA, 16 nt, Human
agcucaccagccccag

SEQ ID NO: 1806798 - RNA, 18 nt, Human
agcuaauaacaugugaaa

SEQ ID NO: 1806799 - RNA, 21 nt, Human
agcuaaucagcauucucacuc

SEQ ID NO: 1806800 - RNA, 16 nt, Human
agcuaaucagcauucu

SEQ ID NO: 1806801 - RNA, 20 nt, Human
agcucaccagccccagugcc

SEQ ID NO: 1806802 - RNA, 19 nt, Human
agcucaccagccccagugc

SEQ ID NO: 1806803 - RNA, 12 nt, Human
agcucaccucuc

SEQ ID NO: 1806804 - RNA, 15 nt, Human
agcucaccucucccu

SEQ ID NO: 1806805 - RNA, 18 nt, Human
agcucaccucucccuugg

SEQ ID NO: 1806806 - RNA, 19 nt, Human
agcucaccucucccuugga

SEQ ID NO: 1806807 - RNA, 12 nt, Human
agcucagagagg

SEQ ID NO: 1806808 - RNA, 18 nt, Human
agcucagagaggguggga

SEQ ID NO: 1806809 - RNA, 14 nt, Human
agcucagagagggu

SEQ ID NO: 1806810 - RNA, 19 nt, Human
agcgagcccugguggcagu

SEQ ID NO: 1806811 - RNA, 13 nt, Human
agcgagcccuggu

SEQ ID NO: 1806812 - RNA, 15 nt, Human
agccuuuggaaacag

SEQ ID NO: 1806813 - RNA, 15 nt, Human
agcccucccugcccc

SEQ ID NO: 1806814 - RNA, 16 nt, Human
agcccucccugccccu

SEQ ID NO: 1806815 - RNA, 17 nt, Human
agcccucccugccccuc

SEQ ID NO: 1806816 - RNA, 19 nt, Human
agcccucccugccccuccc

SEQ ID NO: 1806817 - RNA, 13 nt, Human
agccuggcuccaa

SEQ ID NO: 1806818 - RNA, 20 nt, Human
agccuggcuccaaacccucg

SEQ ID NO: 1806819 - RNA, 22 nt, Human
agcccucccugccccucccuuc

SEQ ID NO: 1806820 - RNA, 23 nt, Human
agcccucccugccccucccuuca

SEQ ID NO: 1806821 - RNA, 22 nt, Human
agccuggcuccaaacccucgag

SEQ ID NO: 1806822 - RNA, 17 nt, Human
agccuggcuucaaauug

SEQ ID NO: 1806823 - RNA, 18 nt, Human
agccuggcuucaaauugu

SEQ ID NO: 1806824 - RNA, 12 nt, Human
agccugggaggu

SEQ ID NO: 1806825 - RNA, 20 nt, Human
agccugggaggucaaggcug

SEQ ID NO: 1806826 - RNA, 15 nt, Human
agcugaaccugggua

SEQ ID NO: 1806827 - RNA, 18 nt, Human
agcugcgguccacccagg

SEQ ID NO: 1806828 - RNA, 17 nt, Human
agcugcgguccacccag

SEQ ID NO: 1806829 - RNA, 16 nt, Human
agcugcgguccaccca

SEQ ID NO: 1806830 - RNA, 13 nt, Human
agcugcgguccac

SEQ ID NO: 1806831 - RNA, 20 nt, Human
agcugcgguccacccaggag

SEQ ID NO: 1806832 - RNA, 19 nt, Human
agcugcgguccacccagga

SEQ ID NO: 1806833 - RNA, 12 nt, Human
agcugcugacag

SEQ ID NO: 1806834 - RNA, 21 nt, Human
agcugcgguccacccaggagc

SEQ ID NO: 1806835 - RNA, 17 nt, Human
agcuggucccacucagu

SEQ ID NO: 1806836 - RNA, 16 nt, Human
agcuggucccacucag

SEQ ID NO: 1806837 - RNA, 14 nt, Human
agcugcugacagug

SEQ ID NO: 1806838 - RNA, 13 nt, Human
agcugcugacagu

SEQ ID NO: 1806839 - RNA, 19 nt, Human
agcuggucccacucagucc

SEQ ID NO: 1806840 - RNA, 18 nt, Human
agcuggucccacucaguc

SEQ ID NO: 1806841 - RNA, 22 nt, Human
agcugguuuuuagcggagacgg

SEQ ID NO: 1806842 - RNA, 14 nt, Human
agguaacaggcaga

SEQ ID NO: 1806843 - RNA, 13 nt, Human
agguaacaggcag

SEQ ID NO: 1806844 - RNA, 16 nt, Human
agguaacaggcagaua

SEQ ID NO: 1806845 - RNA, 13 nt, Human
agguacucuccug

SEQ ID NO: 1806846 - RNA, 14 nt, Human
agguacucuccugg

SEQ ID NO: 1806847 - RNA, 23 nt, Human
aggucccuaauaaagcugugugg

SEQ ID NO: 1806848 - RNA, 23 nt, Human
aggguuuugccauguuggccagg

SEQ ID NO: 1806849 - RNA, 22 nt, Human
aggguuuugccauguuggccag

SEQ ID NO: 1806850 - RNA, 20 nt, Human
agggucucacuauguugccc

SEQ ID NO: 1806851 - RNA, 14 nt, Human
agggccugcaaggg

SEQ ID NO: 1806852 - RNA, 15 nt, Human
agggccugcaaggga

SEQ ID NO: 1806853 - RNA, 12 nt, Human
agggccuggccu

SEQ ID NO: 1806854 - RNA, 13 nt, Human
agggccuggccug

SEQ ID NO: 1806855 - RNA, 16 nt, Human
agggauacccauccca

SEQ ID NO: 1806856 - RNA, 12 nt, Human
agggucccuggu

SEQ ID NO: 1806857 - RNA, 14 nt, Human
agggucccuggugg

SEQ ID NO: 1806858 - RNA, 13 nt, Human
aggggccuggcag

SEQ ID NO: 1806859 - RNA, 12 nt, Human
aggggccuggca

SEQ ID NO: 1806860 - RNA, 21 nt, Human
aggguaucuggugacuuuccu

SEQ ID NO: 1806861 - RNA, 13 nt, Human
aggguauuccaga

SEQ ID NO: 1806862 - RNA, 16 nt, Human
agggucccugguggca

SEQ ID NO: 1806863 - RNA, 17 nt, Human
agggucccugguggcag

SEQ ID NO: 1806864 - RNA, 20 nt, Human
agggucccugguggcagcuc

SEQ ID NO: 1806865 - RNA, 22 nt, Human
agggucccugguggcagcucac

SEQ ID NO: 1806866 - RNA, 22 nt, Human
aggggcccaaauucuuucagug

SEQ ID NO: 1806867 - RNA, 14 nt, Human
agggccuggccuga

SEQ ID NO: 1806868 - RNA, 22 nt, Human
aggcccucugcccacucccugc

SEQ ID NO: 1806869 - RNA, 23 nt, Human
aggcccucugcccacucccugca

SEQ ID NO: 1806870 - RNA, 22 nt, Human
aggcccuuccucuccacugccu

SEQ ID NO: 1806871 - RNA, 12 nt, Human
aggcccuucucu

SEQ ID NO: 1806872 - RNA, 15 nt, Human
aggcccuucucucca

SEQ ID NO: 1806873 - RNA, 19 nt, Human
aggcccuucucuccagccc

SEQ ID NO: 1806874 - RNA, 15 nt, Human
aggccaggcccucug

SEQ ID NO: 1806875 - RNA, 19 nt, Human
aggcauuccccaggaggcc

SEQ ID NO: 1806876 - RNA, 20 nt, Human
aggcauuccccaggaggcca

SEQ ID NO: 1806877 - RNA, 13 nt, Human
aggccaggcccuc

SEQ ID NO: 1806878 - RNA, 14 nt, Human
aggccaggcccucu

SEQ ID NO: 1806879 - RNA, 19 nt, Human
aggcauguucucugaggac

SEQ ID NO: 1806880 - RNA, 18 nt, Human
aggcauguucucugagga

SEQ ID NO: 1806881 - RNA, 18 nt, Human
aggcauuccccaggaggc

SEQ ID NO: 1806882 - RNA, 17 nt, Human
aggcauuccccaggagg

SEQ ID NO: 1806883 - RNA, 17 nt, Human
aggcauguucucugagg

SEQ ID NO: 1806884 - RNA, 21 nt, Human
aggcaugugaugagaggaaau

SEQ ID NO: 1806885 - RNA, 19 nt, Human
aggcaugugaugagaggaa

SEQ ID NO: 1806886 - RNA, 20 nt, Human
aggcaugugaugagaggaaa

SEQ ID NO: 1806887 - RNA, 17 nt, Human
aggcaugugaugagagg

SEQ ID NO: 1806888 - RNA, 15 nt, Human
aggcaugguggccca

SEQ ID NO: 1806889 - RNA, 14 nt, Human
aggagaggggcaca

SEQ ID NO: 1806890 - RNA, 22 nt, Human
aggcuguaucccaugagccuca

SEQ ID NO: 1806891 - RNA, 17 nt, Human
aggcuuagucacugaga

SEQ ID NO: 1806892 - RNA, 21 nt, Human
aggcuguaucccaugagccuc

SEQ ID NO: 1806893 - RNA, 20 nt, Human
aggcuguaucccaugagccu

SEQ ID NO: 1806894 - RNA, 22 nt, Human
aggcuggucucaaacuccugac

SEQ ID NO: 1806895 - RNA, 23 nt, Human
aggcuggucucgaacuccugacc

SEQ ID NO: 1806896 - RNA, 18 nt, Human
aggcuuagucacugagac

SEQ ID NO: 1806897 - RNA, 15 nt, Human
agggacccuccacca

SEQ ID NO: 1806898 - RNA, 23 nt, Human
agggacugccagucccccugccc

SEQ ID NO: 1806899 - RNA, 15 nt, Human
agggacugaggggag

SEQ ID NO: 1806900 - RNA, 14 nt, Human
aggcuaccuuugua

SEQ ID NO: 1806901 - RNA, 13 nt, Human
aggcuaccuuugu

SEQ ID NO: 1806902 - RNA, 15 nt, Human
aggcuaccuuuguau

SEQ ID NO: 1806903 - RNA, 18 nt, Human
aggcuggguucugauccu

SEQ ID NO: 1806904 - RNA, 14 nt, Human
agaugagugagcau

SEQ ID NO: 1806905 - RNA, 19 nt, Human
agauguagaggagaaacug

SEQ ID NO: 1806906 - RNA, 16 nt, Human
agauguagaggagaaa

SEQ ID NO: 1806907 - RNA, 23 nt, Human
agaggggguggccucccaacuca

SEQ ID NO: 1806908 - RNA, 18 nt, Human
agcaaaagaugcuucuca

SEQ ID NO: 1806909 - RNA, 21 nt, Human
agauugcaacaggcugggcuu

SEQ ID NO: 1806910 - RNA, 20 nt, Human
agauugcaacaggcugggcu

SEQ ID NO: 1806911 - RNA, 23 nt, Human
agauugcaacaggcugggcuuca

SEQ ID NO: 1806912 - RNA, 20 nt, Human
agauugaaccugaauauugc

SEQ ID NO: 1806913 - RNA, 19 nt, Human
agauucuuuccugaggcug

SEQ ID NO: 1806914 - RNA, 21 nt, Human
agauucuuuccugaggcuggg

SEQ ID NO: 1806915 - RNA, 17 nt, Human
agcaaaugucuuccugg

SEQ ID NO: 1806916 - RNA, 20 nt, Human
agcaaaugucuuccuggauu

SEQ ID NO: 1806917 - RNA, 16 nt, Human
agcaaauguggcuccu

SEQ ID NO: 1806918 - RNA, 20 nt, Human
agcaaauggccucaugucaa

SEQ ID NO: 1806919 - RNA, 15 nt, Human
agcaaauggccucau

SEQ ID NO: 1806920 - RNA, 20 nt, Human
agcaaaggagauuggaagga

SEQ ID NO: 1806921 - RNA, 14 nt, Human
agcacagacccugc

SEQ ID NO: 1806922 - RNA, 15 nt, Human
agcacagacccugcc

SEQ ID NO: 1806923 - RNA, 12 nt, Human
agcacagacccu

SEQ ID NO: 1806924 - RNA, 21 nt, Human
agcacgauuucuguuuagaua

SEQ ID NO: 1806925 - RNA, 19 nt, Human
agcacgauuucuguuuaga

SEQ ID NO: 1806926 - RNA, 17 nt, Human
agcacgauuucuguuua

SEQ ID NO: 1806927 - RNA, 16 nt, Human
agcacagacccugccc

SEQ ID NO: 1806928 - RNA, 18 nt, Human
agcauccuggcacccggc

SEQ ID NO: 1806929 - RNA, 17 nt, Human
agcauccuggcacccgg

SEQ ID NO: 1806930 - RNA, 14 nt, Human
agcauccuggcacc

SEQ ID NO: 1806931 - RNA, 18 nt, Human
agccaaagcuaggccugg

SEQ ID NO: 1806932 - RNA, 16 nt, Human
agccaaagcuaggccu

SEQ ID NO: 1806933 - RNA, 20 nt, Human
agccaaggccaaaggaagca

SEQ ID NO: 1806934 - RNA, 13 nt, Human
agccagaggagag

SEQ ID NO: 1806935 - RNA, 15 nt, Human
agccagaggagagag

SEQ ID NO: 1806936 - RNA, 14 nt, Human
agccagcaggcucu

SEQ ID NO: 1806937 - RNA, 17 nt, Human
agccagaggagagagga

SEQ ID NO: 1806938 - RNA, 18 nt, Human
agccagaggagagaggac

SEQ ID NO: 1806939 - RNA, 23 nt, Human
agcccacgcccccacuggugaca

SEQ ID NO: 1806940 - RNA, 14 nt, Human
agcccacgccccca

SEQ ID NO: 1806941 - RNA, 15 nt, Human
agcccacgcccccac

SEQ ID NO: 1806942 - RNA, 14 nt, Human
agcccaccuuggcu

SEQ ID NO: 1806943 - RNA, 16 nt, Human
agcccaccuuggcuca

SEQ ID NO: 1806944 - RNA, 15 nt, Human
agcccaccccucaac

SEQ ID NO: 1806945 - RNA, 16 nt, Human
agccagcaggcucuca

SEQ ID NO: 1806946 - RNA, 17 nt, Human
agccagcaggcucucag

SEQ ID NO: 1806947 - RNA, 13 nt, Human
agcauccuggcac

SEQ ID NO: 1806948 - RNA, 20 nt, Human
agccccauucugccugccca

SEQ ID NO: 1806949 - RNA, 21 nt, Human
agcccuccaucuaaacugccc

SEQ ID NO: 1806950 - RNA, 23 nt, Human
agcccuccaucuaaacugccccc

SEQ ID NO: 1806951 - RNA, 12 nt, Human
agcccucccugc

SEQ ID NO: 1806952 - RNA, 13 nt, Human
agcccucccugcc

SEQ ID NO: 1806953 - RNA, 17 nt, Human
agcccgggcucugccuc

SEQ ID NO: 1806954 - RNA, 18 nt, Human
agcccgggcucugccucc

SEQ ID NO: 1806955 - RNA, 20 nt, Human
agcccgggcucugccuccca

SEQ ID NO: 1806956 - RNA, 21 nt, Human
agcccgggcucugccucccau

SEQ ID NO: 1806957 - RNA, 19 nt, Human
agccccauucugccugccc

SEQ ID NO: 1806958 - RNA, 18 nt, Human
agccccauucugccugcc

SEQ ID NO: 1806959 - RNA, 17 nt, Human
agccccauucugccugc

SEQ ID NO: 1806960 - RNA, 15 nt, Human
agccccauccucugu

SEQ ID NO: 1806961 - RNA, 17 nt, Human
agccccauccucuguac

SEQ ID NO: 1806962 - RNA, 23 nt, Human
agccccauccucuguacagagcc

SEQ ID NO: 1806963 - RNA, 19 nt, Human
agacccaaaaggcagaagc

SEQ ID NO: 1806964 - RNA, 21 nt, Human
agacagagucucacuguugcc

SEQ ID NO: 1806965 - RNA, 23 nt, Human
agacagagucucacuguugccca

SEQ ID NO: 1806966 - RNA, 22 nt, Human
agacagauacuccuccaagguu

SEQ ID NO: 1806967 - RNA, 22 nt, Human
agacagccaacuauggccugug

SEQ ID NO: 1806968 - RNA, 15 nt, Human
agaccacguuucuaa

SEQ ID NO: 1806969 - RNA, 20 nt, Human
agacagagucucacuguugc

SEQ ID NO: 1806970 - RNA, 19 nt, Human
agacagagucucacuguug

SEQ ID NO: 1806971 - RNA, 11 nt, Human
agacagagucu

SEQ ID NO: 1806972 - RNA, 23 nt, Human
agacaaugacuuacuguacauga

SEQ ID NO: 1806973 - RNA, 15 nt, Human
agacagagcuacaca

SEQ ID NO: 1806974 - RNA, 22 nt, Human
agacaaugacuuacuguacaug

SEQ ID NO: 1806975 - RNA, 21 nt, Human
agacaaugacuuacuguacau

SEQ ID NO: 1806976 - RNA, 20 nt, Human
agacaaugacuuacuguaca

SEQ ID NO: 1806977 - RNA, 18 nt, Human
agaaugaaagggcccaga

SEQ ID NO: 1806978 - RNA, 21 nt, Human
agaagugaaaaucuacacucc

SEQ ID NO: 1806979 - RNA, 19 nt, Human
agaaugcacaaacagaggc

SEQ ID NO: 1806980 - RNA, 22 nt, Human
agaaugcacaaacagaggccgc

SEQ ID NO: 1806981 - RNA, 21 nt, Human
agaagagauugugguuucauu

SEQ ID NO: 1806982 - RNA, 21 nt, Human
acuuuccucuuagucgagcca

SEQ ID NO: 1806983 - RNA, 21 nt, Human
acuuuccucuuuggucuacac

SEQ ID NO: 1806984 - RNA, 21 nt, Human
agaagacacugaugggcaacc

SEQ ID NO: 1806985 - RNA, 13 nt, Human
agaagacacugau

SEQ ID NO: 1806986 - RNA, 18 nt, Human
agaagguuucagaaagaa

SEQ ID NO: 1806987 - RNA, 14 nt, Human
agaaguaacuuacu

SEQ ID NO: 1806988 - RNA, 13 nt, Human
agaggaaugaagu

SEQ ID NO: 1806989 - RNA, 17 nt, Human
agaggggguggccuccc

SEQ ID NO: 1806990 - RNA, 19 nt, Human
agaggggguggccucccaa

SEQ ID NO: 1806991 - RNA, 13 nt, Human
agagggccugcaa

SEQ ID NO: 1806992 - RNA, 16 nt, Human
agagggccugcaaggg

SEQ ID NO: 1806993 - RNA, 23 nt, Human
agaggacuuuucuuuguggcuuc

SEQ ID NO: 1806994 - RNA, 23 nt, Human
agaggagggagcaucagugcccu

SEQ ID NO: 1806995 - RNA, 22 nt, Human
agaggacuuuucuuuguggcuu

SEQ ID NO: 1806996 - RNA, 21 nt, Human
agaggacuuuucuuuguggcu

SEQ ID NO: 1806997 - RNA, 22 nt, Human
agacugaguacguugugcauuu

SEQ ID NO: 1806998 - RNA, 22 nt, Human
agacugaccaauauuguacagu

SEQ ID NO: 1806999 - RNA, 20 nt, Human
agacugaguacguugugcau

SEQ ID NO: 1807000 - RNA, 18 nt, Human
agacucugucucagucca

SEQ ID NO: 1807001 - RNA, 18 nt, Human
agacucugucucaaaaaa

SEQ ID NO: 1807002 - RNA, 16 nt, Human
agacgcugugcugccc

SEQ ID NO: 1807003 - RNA, 16 nt, Human
agagagaccacuuuuc

SEQ ID NO: 1807004 - RNA, 13 nt, Human
agagccagggucu

SEQ ID NO: 1807005 - RNA, 13 nt, Human
agagcccaccuug

SEQ ID NO: 1807006 - RNA, 17 nt, Human
agagccucaaaugagaa

SEQ ID NO: 1807007 - RNA, 14 nt, Human
agagccucaaauga

SEQ ID NO: 1807008 - RNA, 15 nt, Human
agagcccuucauuug

SEQ ID NO: 1807009 - RNA, 21 nt, Human
aguaugaggcauuuguuugaa

SEQ ID NO: 1807010 - RNA, 20 nt, Human
aguaugaggcauuuguuuga

SEQ ID NO: 1807011 - RNA, 15 nt, Human
aguaucucagggccu

SEQ ID NO: 1807012 - RNA, 17 nt, Human
aguaugaggcauuuguu

SEQ ID NO: 1807013 - RNA, 23 nt, Human
aguaugaggcauuuguuugaacu

SEQ ID NO: 1807014 - RNA, 22 nt, Human
agucacacaguauuacuucugc

SEQ ID NO: 1807015 - RNA, 13 nt, Human
aguacucauacau

SEQ ID NO: 1807016 - RNA, 12 nt, Human
aguacuauguau

SEQ ID NO: 1807017 - RNA, 14 nt, Human
aguacuauguauca

SEQ ID NO: 1807018 - RNA, 12 nt, Human
aguacuucuuuu

SEQ ID NO: 1807019 - RNA, 17 nt, Human
aguacuucuccacccug

SEQ ID NO: 1807020 - RNA, 14 nt, Human
aguacuauaauuua

SEQ ID NO: 1807021 - RNA, 19 nt, Human
aguacuacaguccucccau

SEQ ID NO: 1807022 - RNA, 22 nt, Human
aguacuacaguccucccaucuc

SEQ ID NO: 1807023 - RNA, 18 nt, Human
aguacguugugcauuugg

SEQ ID NO: 1807024 - RNA, 17 nt, Human
aguacguugugcauuug

SEQ ID NO: 1807025 - RNA, 16 nt, Human
aguacguugugcauuu

SEQ ID NO: 1807026 - RNA, 14 nt, Human
aguacguugugcau

SEQ ID NO: 1807027 - RNA, 15 nt, Human
aguacguugugcauu

SEQ ID NO: 1807028 - RNA, 16 nt, Human
aggucuguucuuucca

SEQ ID NO: 1807029 - RNA, 15 nt, Human
aggucuguucuuucc

SEQ ID NO: 1807030 - RNA, 13 nt, Human
aggucuguucuuu

SEQ ID NO: 1807031 - RNA, 18 nt, Human
aguaaaugggggugcauu

SEQ ID NO: 1807032 - RNA, 19 nt, Human
aguccuuaccagcagagca

SEQ ID NO: 1807033 - RNA, 16 nt, Human
agucuguugauuaaag

SEQ ID NO: 1807034 - RNA, 17 nt, Human
agugaccucagcuuuga

SEQ ID NO: 1807035 - RNA, 18 nt, Human
agugaccucagcuuugau

SEQ ID NO: 1807036 - RNA, 19 nt, Human
aguccucuuuucugagagg

SEQ ID NO: 1807037 - RNA, 20 nt, Human
aguccuuaccagcagagcac

SEQ ID NO: 1807038 - RNA, 22 nt, Human
aguccucuuuucugagaggacu

SEQ ID NO: 1807039 - RNA, 19 nt, Human
agucaugcguuuaaucaca

SEQ ID NO: 1807040 - RNA, 19 nt, Human
agugucaaugcagccccca

SEQ ID NO: 1807041 - RNA, 19 nt, Human
agugggacagggcauggcc

SEQ ID NO: 1807042 - RNA, 21 nt, Human
agugggacagggcauggccag

SEQ ID NO: 1807043 - RNA, 24 nt, Human
agugauccucccaccucagccucc

SEQ ID NO: 1807044 - RNA, 18 nt, Human
agugauccucccaccuca

SEQ ID NO: 1807045 - RNA, 15 nt, Human
agugauccucccacc

SEQ ID NO: 1807046 - RNA, 14 nt, Human
agugauccucccac

SEQ ID NO: 1807047 - RNA, 17 nt, Human
agugauucuccugccuc

SEQ ID NO: 1807048 - RNA, 15 nt, Human
agugauucuccugcc

SEQ ID NO: 1807049 - RNA, 18 nt, Human
agugccuuacacaauggu

SEQ ID NO: 1807050 - RNA, 14 nt, Human
agugauucuccugc

SEQ ID NO: 1807051 - RNA, 20 nt, Human
agugauggguuaguggaugg

SEQ ID NO: 1807052 - RNA, 21 nt, Human
agugauucucaugccucagcc

SEQ ID NO: 1807053 - RNA, 18 nt, Human
agugccuuauggaacacu

SEQ ID NO: 1807054 - RNA, 16 nt, Human
agugccuuauggaaca

SEQ ID NO: 1807055 - RNA, 15 nt, Human
agugcuaauuuugaa

SEQ ID NO: 1807056 - RNA, 10 nt, Human
agugccuuau

SEQ ID NO: 1807057 - RNA, 13 nt, Human
agugccuuaugga

SEQ ID NO: 1807058 - RNA, 14 nt, Human
agugccuuauggaa

SEQ ID NO: 1807059 - RNA, 15 nt, Human
agugccuuauggaac

SEQ ID NO: 1807060 - RNA, 18 nt, Human
agugcuaauuuugaaaaa

SEQ ID NO: 1807061 - RNA, 20 nt, Human
agugcuaauuuugaaaaacu

SEQ ID NO: 1807062 - RNA, 18 nt, Human
aguucagguaacaggcag

SEQ ID NO: 1807063 - RNA, 13 nt, Human
aguucaucuugaa

SEQ ID NO: 1807064 - RNA, 15 nt, Human
aguucaucuugaauu

SEQ ID NO: 1807065 - RNA, 19 nt, Human
aguucaucuugaauuguaa

SEQ ID NO: 1807066 - RNA, 14 nt, Human
aguugauagcacag

SEQ ID NO: 1807067 - RNA, 16 nt, Human
aguugauacuacaguu

SEQ ID NO: 1807068 - RNA, 22 nt, Human
aguucaucuugaauuguaagga

SEQ ID NO: 1807069 - RNA, 18 nt, Human
auaaggguaucuggugac

SEQ ID NO: 1807070 - RNA, 13 nt, Human
auaauggucagag

SEQ ID NO: 1807071 - RNA, 15 nt, Human
auaauguaaauaaag

SEQ ID NO: 1807072 - RNA, 14 nt, Human
auaauguaagcucu

SEQ ID NO: 1807073 - RNA, 22 nt, Human
auaagccagacaucaacagaua

SEQ ID NO: 1807074 - RNA, 21 nt, Human
auaagccagacaucaacagau

SEQ ID NO: 1807075 - RNA, 17 nt, Human
auacaaugcugugcccu

SEQ ID NO: 1807076 - RNA, 14 nt, Human
auacaaugcugugc

SEQ ID NO: 1807077 - RNA, 13 nt, Human
auacacuuacacu

SEQ ID NO: 1807078 - RNA, 22 nt, Human
auacacuuacacuuuaugcaca

SEQ ID NO: 1807079 - RNA, 13 nt, Human
auacccaccccca

SEQ ID NO: 1807080 - RNA, 14 nt, Human
auacccacccccac

SEQ ID NO: 1807081 - RNA, 16 nt, Human
auacccacccccaccc

SEQ ID NO: 1807082 - RNA, 17 nt, Human
auacccccugcaaagcc

SEQ ID NO: 1807083 - RNA, 19 nt, Human
auacccccugcaaagccca

SEQ ID NO: 1807084 - RNA, 17 nt, Human
auacccacccccaccca

SEQ ID NO: 1807085 - RNA, 21 nt, Human
auacccccugcaaagcccagc

SEQ ID NO: 1807086 - RNA, 14 nt, Human
auaccugucccccu

SEQ ID NO: 1807087 - RNA, 15 nt, Human
auaccugucccccug

SEQ ID NO: 1807088 - RNA, 16 nt, Human
auaccugucccccuga

SEQ ID NO: 1807089 - RNA, 20 nt, Human
auacccccugcaaagcccag

SEQ ID NO: 1807090 - RNA, 17 nt, Human
auaccugucccccugac

SEQ ID NO: 1807091 - RNA, 14 nt, Human
auaacaaugaaagu

SEQ ID NO: 1807092 - RNA, 20 nt, Human
auaacauguaauuaaguacu

SEQ ID NO: 1807093 - RNA, 12 nt, Human
auaacauguaau

SEQ ID NO: 1807094 - RNA, 13 nt, Human
auaacauguaauu

SEQ ID NO: 1807095 - RNA, 18 nt, Human
auaacauguaauuaagua

SEQ ID NO: 1807096 - RNA, 23 nt, Human
aguuugauuaaauucuugcaaag

SEQ ID NO: 1807097 - RNA, 16 nt, Human
aguuugauuaaauucu

SEQ ID NO: 1807098 - RNA, 20 nt, Human
aguuugagaucagccugggc

SEQ ID NO: 1807099 - RNA, 18 nt, Human
aguuugagaucagccugg

SEQ ID NO: 1807100 - RNA, 19 nt, Human
aguuugagaucagccuggg

SEQ ID NO: 1807101 - RNA, 22 nt, Human
aguuugauuaaauucuugcaaa

SEQ ID NO: 1807102 - RNA, 20 nt, Human
aguuugauuaaauucuugca

SEQ ID NO: 1807103 - RNA, 18 nt, Human
aguuugauuaaauucuug

SEQ ID NO: 1807104 - RNA, 17 nt, Human
aguuugauuaaauucuu

SEQ ID NO: 1807105 - RNA, 15 nt, Human
aguuguuagauuaag

SEQ ID NO: 1807106 - RNA, 22 nt, Human
aguuguuacauuuuuaagugcu

SEQ ID NO: 1807107 - RNA, 20 nt, Human
aguuguuacauuuuuaagug

SEQ ID NO: 1807108 - RNA, 19 nt, Human
aguuguuacauuuuuaagu

SEQ ID NO: 1807109 - RNA, 22 nt, Human
auacuuugcagcacagcugaga

SEQ ID NO: 1807110 - RNA, 17 nt, Human
auagcacagacccugcc

SEQ ID NO: 1807111 - RNA, 18 nt, Human
auagcacagacccugccc

SEQ ID NO: 1807112 - RNA, 15 nt, Human
auagcacagacccug

SEQ ID NO: 1807113 - RNA, 15 nt, Human
auagcauuguaaaag

SEQ ID NO: 1807114 - RNA, 15 nt, Human
auagcagcuuauuca

SEQ ID NO: 1807115 - RNA, 18 nt, Human
auagcagcuuauucacaa

SEQ ID NO: 1807116 - RNA, 17 nt, Human
auagccuaggugacaga

SEQ ID NO: 1807117 - RNA, 15 nt, Human
auagccuaggugaca

SEQ ID NO: 1807118 - RNA, 13 nt, Human
auaguaaaaauaa

SEQ ID NO: 1807119 - RNA, 14 nt, Human
auaguaaaaauaaa

SEQ ID NO: 1807120 - RNA, 16 nt, Human
auaugcucugcauguu

SEQ ID NO: 1807121 - RNA, 17 nt, Human
auaugcucugcauguua

SEQ ID NO: 1807122 - RNA, 16 nt, Human
auaugcaguuuuccuu

SEQ ID NO: 1807123 - RNA, 20 nt, Human
auaugcucugcauguuacau

SEQ ID NO: 1807124 - RNA, 19 nt, Human
auauucaggaagcucaggg

SEQ ID NO: 1807125 - RNA, 15 nt, Human
auauuauuuuauguu

SEQ ID NO: 1807126 - RNA, 22 nt, Human
auauuauuuuauguugcauaga

SEQ ID NO: 1807127 - RNA, 17 nt, Human
auccucauacccacccc

SEQ ID NO: 1807128 - RNA, 19 nt, Human
auccucaguuuuugugaaa

SEQ ID NO: 1807129 - RNA, 15 nt, Human
aucccggcugcccuu

SEQ ID NO: 1807130 - RNA, 19 nt, Human
aucccaugagccucagcau

SEQ ID NO: 1807131 - RNA, 18 nt, Human
auccccaagccuggcaag

SEQ ID NO: 1807132 - RNA, 19 nt, Human
auccagacccggcugcgug

SEQ ID NO: 1807133 - RNA, 13 nt, Human
auccacucgccuu

SEQ ID NO: 1807134 - RNA, 14 nt, Human
aucaugucuggcua

SEQ ID NO: 1807135 - RNA, 12 nt, Human
aucaugugaaau

SEQ ID NO: 1807136 - RNA, 23 nt, Human
aucacccgcuaagagggagggag

SEQ ID NO: 1807137 - RNA, 13 nt, Human
aucaccagacagg

SEQ ID NO: 1807138 - RNA, 20 nt, Human
aucaccaacgucugugccau

SEQ ID NO: 1807139 - RNA, 22 nt, Human
aucaaauauauucagccuggcu

SEQ ID NO: 1807140 - RNA, 13 nt, Human
aucacagccucug

SEQ ID NO: 1807141 - RNA, 14 nt, Human
aucaaauauauuca

SEQ ID NO: 1807142 - RNA, 20 nt, Human
aucaaagagguuuuaaaaaa

SEQ ID NO: 1807143 - RNA, 23 nt, Human
aucaaagagguuuuaaaaaaauc

SEQ ID NO: 1807144 - RNA, 21 nt, Human
aucucccuuuuccaugacugu

SEQ ID NO: 1807145 - RNA, 21 nt, Human
aucuauaggaagauugaaccu

SEQ ID NO: 1807146 - RNA, 18 nt, Human
aucugggggccucuucug

SEQ ID NO: 1807147 - RNA, 22 nt, Human
aucuggacuccucuguccaggc

SEQ ID NO: 1807148 - RNA, 16 nt, Human
aucucugcuuuggaaa

SEQ ID NO: 1807149 - RNA, 21 nt, Human
augaaguacucauacauguua

SEQ ID NO: 1807150 - RNA, 18 nt, Human
augaccacacuccagcug

SEQ ID NO: 1807151 - RNA, 15 nt, Human
augaccacacuccag

SEQ ID NO: 1807152 - RNA, 22 nt, Human
augaggcauuuguuugaacuga

SEQ ID NO: 1807153 - RNA, 21 nt, Human
augaggcauuuguuugaacug

SEQ ID NO: 1807154 - RNA, 14 nt, Human
augaggcauuuguu

SEQ ID NO: 1807155 - RNA, 13 nt, Human
augaggcauuugu

SEQ ID NO: 1807156 - RNA, 15 nt, Human
augaaaacacauuuu

SEQ ID NO: 1807157 - RNA, 14 nt, Human
augaaaacacauuu

SEQ ID NO: 1807158 - RNA, 16 nt, Human
augaaaacacauuuuu

SEQ ID NO: 1807159 - RNA, 18 nt, Human
augaugaaaugaggucag

SEQ ID NO: 1807160 - RNA, 23 nt, Human
augaugaaaugaggucagagccu

SEQ ID NO: 1807161 - RNA, 15 nt, Human
augaugauccuaggc

SEQ ID NO: 1807162 - RNA, 18 nt, Human
augcacaaacagaggccg

SEQ ID NO: 1807163 - RNA, 15 nt, Human
augcacaaauucugu

SEQ ID NO: 1807164 - RNA, 22 nt, Human
augcacaaauucugucucugga

SEQ ID NO: 1807165 - RNA, 23 nt, Human
augcacaaauucugucucuggau

SEQ ID NO: 1807166 - RNA, 17 nt, Human
augaucuuugcagacag

SEQ ID NO: 1807167 - RNA, 21 nt, Human
augaucuuugcagacaggcaa

SEQ ID NO: 1807168 - RNA, 19 nt, Human
augaucuuugcagacaggc

SEQ ID NO: 1807169 - RNA, 18 nt, Human
augaucuuugcagacagg

SEQ ID NO: 1807170 - RNA, 19 nt, Human
augccuggauggggcugca

SEQ ID NO: 1807171 - RNA, 20 nt, Human
augccuggauggggcugcac

SEQ ID NO: 1807172 - RNA, 23 nt, Human
augcacagaguuguuacauuuuu

SEQ ID NO: 1807173 - RNA, 22 nt, Human
augcacagaguuguuacauuuu

SEQ ID NO: 1807174 - RNA, 21 nt, Human
augcacagaguuguuacauuu

SEQ ID NO: 1807175 - RNA, 19 nt, Human
augcacagaguuguuacau

SEQ ID NO: 1807176 - RNA, 15 nt, Human
augcacacauuuuuu

SEQ ID NO: 1807177 - RNA, 14 nt, Human
augcacacauuuuu

SEQ ID NO: 1807178 - RNA, 13 nt, Human
augcacacauuuu

SEQ ID NO: 1807179 - RNA, 19 nt, Human
augccugucuuaauuuucu

SEQ ID NO: 1807180 - RNA, 18 nt, Human
auggauaggcacaggaaa

SEQ ID NO: 1807181 - RNA, 17 nt, Human
auggauaggcacaggaa

SEQ ID NO: 1807182 - RNA, 15 nt, Human
auggcugugccucug

SEQ ID NO: 1807183 - RNA, 16 nt, Human
auggcugugccucugc

SEQ ID NO: 1807184 - RNA, 17 nt, Human
auggcugugccucugcc

SEQ ID NO: 1807185 - RNA, 18 nt, Human
augcuuuaggauguacag

SEQ ID NO: 1807186 - RNA, 15 nt, Human
augcuuguacauaau

SEQ ID NO: 1807187 - RNA, 16 nt, Human
augcuuguacauaaug

SEQ ID NO: 1807188 - RNA, 21 nt, Human
augcuuuaggauguacaguua

SEQ ID NO: 1807189 - RNA, 17 nt, Human
auggcuuuugugcauua

SEQ ID NO: 1807190 - RNA, 16 nt, Human
auggcuuuugugcauu

SEQ ID NO: 1807191 - RNA, 18 nt, Human
auggcuuuugugcauuau

SEQ ID NO: 1807192 - RNA, 12 nt, Human
augcugccucca

SEQ ID NO: 1807193 - RNA, 15 nt, Human
augcugccuccagaa

SEQ ID NO: 1807194 - RNA, 16 nt, Human
augcugcccugugagu

SEQ ID NO: 1807195 - RNA, 13 nt, Human
augcugcccugug

SEQ ID NO: 1807196 - RNA, 14 nt, Human
augcugcccuguga

SEQ ID NO: 1807197 - RNA, 15 nt, Human
augcugcccugugag

SEQ ID NO: 1807198 - RNA, 20 nt, Human
augcugacuguacuccuccc

SEQ ID NO: 1807199 - RNA, 21 nt, Human
augcugacuguacuccuccca

SEQ ID NO: 1807200 - RNA, 19 nt, Human
augcugacuguacuccucc

SEQ ID NO: 1807201 - RNA, 13 nt, Human
augucacaggcag

SEQ ID NO: 1807202 - RNA, 23 nt, Human
auguaauuuuguguaagaaauac

SEQ ID NO: 1807203 - RNA, 22 nt, Human
auguaauuuuguguaagaaaua

SEQ ID NO: 1807204 - RNA, 17 nt, Human
auguaauuuuguguaag

SEQ ID NO: 1807205 - RNA, 16 nt, Human
auguaauuuuguguaa

SEQ ID NO: 1807206 - RNA, 15 nt, Human
auguaauuuugugua

SEQ ID NO: 1807207 - RNA, 12 nt, Human
auguaauuuugu

SEQ ID NO: 1807208 - RNA, 17 nt, Human
augugaaaucauucauu

SEQ ID NO: 1807209 - RNA, 18 nt, Human
augugaaaucauucauuu

SEQ ID NO: 1807210 - RNA, 19 nt, Human
augucacaggcagguccag

SEQ ID NO: 1807211 - RNA, 14 nt, Human
augugaaacauguu

SEQ ID NO: 1807212 - RNA, 20 nt, Human
augggugcuuggaggaagga

SEQ ID NO: 1807213 - RNA, 21 nt, Human
augggugcuuggaggaaggaa

SEQ ID NO: 1807214 - RNA, 23 nt, Human
augggugcuuggaggaaggaaac

SEQ ID NO: 1807215 - RNA, 13 nt, Human
auguguaaguauu

SEQ ID NO: 1807216 - RNA, 13 nt, Human
auguucucugagg

SEQ ID NO: 1807217 - RNA, 17 nt, Human
auguucucucuucucca

SEQ ID NO: 1807218 - RNA, 16 nt, Human
auguucucucuucucc

SEQ ID NO: 1807219 - RNA, 14 nt, Human
auguucugggacac

SEQ ID NO: 1807220 - RNA, 17 nt, Human
auguucucugaggacac

SEQ ID NO: 1807221 - RNA, 15 nt, Human
auguucugggacaca

SEQ ID NO: 1807222 - RNA, 14 nt, Human
auguuugccucugc

SEQ ID NO: 1807223 - RNA, 17 nt, Human
auguuugccucugccuc

SEQ ID NO: 1807224 - RNA, 15 nt, Human
auguuugccucugcc

SEQ ID NO: 1807225 - RNA, 14 nt, Human
auguucuuaauucu

SEQ ID NO: 1807226 - RNA, 20 nt, Human
augaaugucagugugacuga

SEQ ID NO: 1807227 - RNA, 13 nt, Human
augaaugaauggc

SEQ ID NO: 1807228 - RNA, 18 nt, Human
augaagauguagaggaga

SEQ ID NO: 1807229 - RNA, 15 nt, Human
augaaagggcccaga

SEQ ID NO: 1807230 - RNA, 22 nt, Human
uuggggggcugaggugggagga

SEQ ID NO: 1807231 - RNA, 18 nt, Human
uugggccccagaggcugg

SEQ ID NO: 1807232 - RNA, 14 nt, Human
uuggggauauuuuu

SEQ ID NO: 1807233 - RNA, 18 nt, Human
uuggcuagagguucaaag

SEQ ID NO: 1807234 - RNA, 23 nt, Human
uuggcgcugccccuggcagcccc

SEQ ID NO: 1807235 - RNA, 15 nt, Human
augaaagcagggacu

SEQ ID NO: 1807236 - RNA, 23 nt, Human
aucuuuggacagaagcagcucuu

SEQ ID NO: 1807237 - RNA, 13 nt, Human
aucuuuuuauuca

SEQ ID NO: 1807238 - RNA, 13 nt, Human
uuggcugcaggga

SEQ ID NO: 1807239 - RNA, 22 nt, Human
aucuuuaauuuuacauuuccua

SEQ ID NO: 1807240 - RNA, 16 nt, Human
aucuuuaauuuuacau

SEQ ID NO: 1807241 - RNA, 21 nt, Human
aucuuuaauuuuacauuuccu

SEQ ID NO: 1807242 - RNA, 22 nt, Human
aucuuuggacagaagcagcucu

SEQ ID NO: 1807243 - RNA, 14 nt, Human
augacuuacuguac

SEQ ID NO: 1807244 - RNA, 22 nt, Human
augacuuaagcacacuugacau

SEQ ID NO: 1807245 - RNA, 18 nt, Human
augacacgaauauugcug

SEQ ID NO: 1807246 - RNA, 17 nt, Human
augacuuacuguacaug

SEQ ID NO: 1807247 - RNA, 16 nt, Human
augacuuacuguacau

SEQ ID NO: 1807248 - RNA, 17 nt, Human
augagaaaaugucuuua

SEQ ID NO: 1807249 - RNA, 22 nt, Human
augagaaagguugaagcaccaa

SEQ ID NO: 1807250 - RNA, 21 nt, Human
augagaaagguugaagcacca

SEQ ID NO: 1807251 - RNA, 15 nt, Human
augagaaaucuaaaa

SEQ ID NO: 1807252 - RNA, 18 nt, Human
augagaaaucuaaaaaac

SEQ ID NO: 1807253 - RNA, 23 nt, Human
augagaaaucuaaaaaacgaaaa

SEQ ID NO: 1807254 - RNA, 22 nt, Human
augacacaugcaaggucauuuu

SEQ ID NO: 1807255 - RNA, 14 nt, Human
augacacaugcaag

SEQ ID NO: 1807256 - RNA, 14 nt, Human
aucucagggccugg

SEQ ID NO: 1807257 - RNA, 11 nt, Human
aucucagccca

SEQ ID NO: 1807258 - RNA, 15 nt, Human
auccuaguuccacca

SEQ ID NO: 1807259 - RNA, 19 nt, Human
auccuaguuccaccaucaa

SEQ ID NO: 1807260 - RNA, 16 nt, Human
aucucacacaugagca

SEQ ID NO: 1807261 - RNA, 15 nt, Human
aucucacacaugagc

SEQ ID NO: 1807262 - RNA, 13 nt, Human
aucuccaaaauaa

SEQ ID NO: 1807263 - RNA, 15 nt, Human
aucuccacuccagau

SEQ ID NO: 1807264 - RNA, 16 nt, Human
aucuccccaucauugg

SEQ ID NO: 1807265 - RNA, 14 nt, Human
aucucccccagccc

SEQ ID NO: 1807266 - RNA, 12 nt, Human
aucucccccagc

SEQ ID NO: 1807267 - RNA, 13 nt, Human
aucucccccagcc

SEQ ID NO: 1807268 - RNA, 19 nt, Human
uugcacaaaccaauuaaac

SEQ ID NO: 1807269 - RNA, 15 nt, Human
uugauucagacagcu

SEQ ID NO: 1807270 - RNA, 16 nt, Human
uugauucagacagcug

SEQ ID NO: 1807271 - RNA, 12 nt, Human
uugcaugaggcu

SEQ ID NO: 1807272 - RNA, 14 nt, Human
uugcaccacugcac

SEQ ID NO: 1807273 - RNA, 14 nt, Human
uugcaucugaaaau

SEQ ID NO: 1807274 - RNA, 19 nt, Human
aucucuucuggguuccuuc

SEQ ID NO: 1807275 - RNA, 12 nt, Human
uugaugccuggc

SEQ ID NO: 1807276 - RNA, 15 nt, Human
uugaugggauuuggu

SEQ ID NO: 1807277 - RNA, 23 nt, Human
uugauguaaagauguucuggaua

SEQ ID NO: 1807278 - RNA, 14 nt, Human
uugauguaaagaug

SEQ ID NO: 1807279 - RNA, 23 nt, Human
uugauggugaugaaauguaaaua

SEQ ID NO: 1807280 - RNA, 14 nt, Human
uugauucagacagc

SEQ ID NO: 1807281 - RNA, 16 nt, Human
uugaugugugucuagg

SEQ ID NO: 1807282 - RNA, 18 nt, Human
aucugaugcaagcaagaa

SEQ ID NO: 1807283 - RNA, 13 nt, Human
uugccgucuaccu

SEQ ID NO: 1807284 - RNA, 14 nt, Human
uugccguuauuaaa

SEQ ID NO: 1807285 - RNA, 19 nt, Human
uugccgucuaccugagggg

SEQ ID NO: 1807286 - RNA, 15 nt, Human
uugccgucuaccuga

SEQ ID NO: 1807287 - RNA, 18 nt, Human
uugccgucuaccugaggg

SEQ ID NO: 1807288 - RNA, 19 nt, Human
aucuggguucacugcaacc

SEQ ID NO: 1807289 - RNA, 17 nt, Human
aucuggguucacugcaa

SEQ ID NO: 1807290 - RNA, 19 nt, Human
aucuugcucugcugacaga

SEQ ID NO: 1807291 - RNA, 17 nt, Human
aucuugcucugcugaca

SEQ ID NO: 1807292 - RNA, 18 nt, Human
aucuugaauuguaaggaa

SEQ ID NO: 1807293 - RNA, 20 nt, Human
uuuauggcuuuugugcauua

SEQ ID NO: 1807294 - RNA, 22 nt, Human
uuuaugggucagaguuccgacu

SEQ ID NO: 1807295 - RNA, 24 nt, Human
uuuauggcuuuugugcauuaucua

SEQ ID NO: 1807296 - RNA, 17 nt, Human
uuuagauguaauuuugu

SEQ ID NO: 1807297 - RNA, 16 nt, Human
uuuaguaucuuuuuau

SEQ ID NO: 1807298 - RNA, 15 nt, Human
uuuaguagagacagg

SEQ ID NO: 1807299 - RNA, 19 nt, Human
augcuagaacucccuuuca

SEQ ID NO: 1807300 - RNA, 16 nt, Human
augcuagaacucccuu

SEQ ID NO: 1807301 - RNA, 15 nt, Human
augcuagaacucccu

SEQ ID NO: 1807302 - RNA, 15 nt, Human
augcucugcauguua

SEQ ID NO: 1807303 - RNA, 13 nt, Human
augcugguuuuuc

SEQ ID NO: 1807304 - RNA, 22 nt, Human
augcuguaacuuucugaaauaa

SEQ ID NO: 1807305 - RNA, 15 nt, Human
auggaagacagcucu

SEQ ID NO: 1807306 - RNA, 16 nt, Human
auggaacacucugaga

SEQ ID NO: 1807307 - RNA, 11 nt, Human
auggaacacuc

SEQ ID NO: 1807308 - RNA, 14 nt, Human
auggaacacucuga

SEQ ID NO: 1807309 - RNA, 15 nt, Human
auggaacacucugag

SEQ ID NO: 1807310 - RNA, 19 nt, Human
augcugucccuuacgugag

SEQ ID NO: 1807311 - RNA, 23 nt, Human
augcugucccuuacgugaguccu

SEQ ID NO: 1807312 - RNA, 19 nt, Human
auggacaugaucuucuuua

SEQ ID NO: 1807313 - RNA, 14 nt, Human
auggacaugaucuu

SEQ ID NO: 1807314 - RNA, 13 nt, Human
uuucagaaaugug

SEQ ID NO: 1807315 - RNA, 20 nt, Human
uuucacugcuggcugccuua

SEQ ID NO: 1807316 - RNA, 22 nt, Human
uuucacugcuggcugccuuaga

SEQ ID NO: 1807317 - RNA, 17 nt, Human
uuucacugcuggcugcc

SEQ ID NO: 1807318 - RNA, 18 nt, Human
uuucacugcuggcugccu

SEQ ID NO: 1807319 - RNA, 14 nt, Human
uuucacugcuggcu

SEQ ID NO: 1807320 - RNA, 16 nt, Human
auggaagacagcucuu

SEQ ID NO: 1807321 - RNA, 17 nt, Human
uuucauauuuuaaacag

SEQ ID NO: 1807322 - RNA, 20 nt, Human
auggccuuugcuugaaagaa

SEQ ID NO: 1807323 - RNA, 20 nt, Human
auggcuaguaucaaaagaaa

SEQ ID NO: 1807324 - RNA, 22 nt, Human
auggccagguggccacuccaga

SEQ ID NO: 1807325 - RNA, 16 nt, Human
auggccagguggccac

SEQ ID NO: 1807326 - RNA, 21 nt, Human
auggccgggcgcgguggcuca

SEQ ID NO: 1807327 - RNA, 23 nt, Human
auggcacaucagcacgauuucug

SEQ ID NO: 1807328 - RNA, 17 nt, Human
auggcacaucagcacga

SEQ ID NO: 1807329 - RNA, 19 nt, Human
auggcaaggacugcaggga

SEQ ID NO: 1807330 - RNA, 22 nt, Human
auggcacaaucucggcucacug

SEQ ID NO: 1807331 - RNA, 19 nt, Human
auggacguguuaugacucc

SEQ ID NO: 1807332 - RNA, 20 nt, Human
auggacguguuaugacucca

SEQ ID NO: 1807333 - RNA, 18 nt, Human
auggauuuccagccaaag

SEQ ID NO: 1807334 - RNA, 23 nt, Human
auggacguguuaugacuccagaa

SEQ ID NO: 1807335 - RNA, 17 nt, Human
augcagccucacagucc

SEQ ID NO: 1807336 - RNA, 14 nt, Human
augcagccucacag

SEQ ID NO: 1807337 - RNA, 15 nt, Human
augcagccucacagu

SEQ ID NO: 1807338 - RNA, 13 nt, Human
augcagccucaca

SEQ ID NO: 1807339 - RNA, 15 nt, Human
augcaguuuuccuua

SEQ ID NO: 1807340 - RNA, 11 nt, Human
augcccagccc

SEQ ID NO: 1807341 - RNA, 17 nt, Human
augccacuaaauugaca

SEQ ID NO: 1807342 - RNA, 15 nt, Human
augccacuaaauuga

SEQ ID NO: 1807343 - RNA, 16 nt, Human
augcacuuuguucugg

SEQ ID NO: 1807344 - RNA, 15 nt, Human
augcacuuuguucug

SEQ ID NO: 1807345 - RNA, 13 nt, Human
uuguuuucagugu

SEQ ID NO: 1807346 - RNA, 16 nt, Human
uuguuuucaguguaca

SEQ ID NO: 1807347 - RNA, 14 nt, Human
uuuaaauguuuuuu

SEQ ID NO: 1807348 - RNA, 15 nt, Human
uuguuuuacugucuu

SEQ ID NO: 1807349 - RNA, 12 nt, Human
uuuaauuuuaca

SEQ ID NO: 1807350 - RNA, 16 nt, Human
uuuaagugcugcauuu

SEQ ID NO: 1807351 - RNA, 15 nt, Human
uuuaagugcugcauu

SEQ ID NO: 1807352 - RNA, 19 nt, Human
uuuaagugcugcauuuaaa

SEQ ID NO: 1807353 - RNA, 17 nt, Human
uuuaagugcugcauuua

SEQ ID NO: 1807354 - RNA, 21 nt, Human
augauucaacagguuuuccug

SEQ ID NO: 1807355 - RNA, 17 nt, Human
augauuucagcucacug

SEQ ID NO: 1807356 - RNA, 20 nt, Human
augauuaaccacuucagcug

SEQ ID NO: 1807357 - RNA, 21 nt, Human
augauuaaccacuucagcuga

SEQ ID NO: 1807358 - RNA, 19 nt, Human
augauuaaccacuucagcu

SEQ ID NO: 1807359 - RNA, 14 nt, Human
augcaccagcccuu

SEQ ID NO: 1807360 - RNA, 12 nt, Human
augcacuuuguu

SEQ ID NO: 1807361 - RNA, 13 nt, Human
augcaccagcccu

SEQ ID NO: 1807362 - RNA, 16 nt, Human
augauuuuuaaagaaa

SEQ ID NO: 1807363 - RNA, 14 nt, Human
augauuuuuaaaga

SEQ ID NO: 1807364 - RNA, 19 nt, Human
augauuucagcucacugca

SEQ ID NO: 1807365 - RNA, 18 nt, Human
uuguguaagaaauacaga

SEQ ID NO: 1807366 - RNA, 14 nt, Human
uuguguaagaaaua

SEQ ID NO: 1807367 - RNA, 13 nt, Human
uugugguuaaucu

SEQ ID NO: 1807368 - RNA, 20 nt, Human
uuguucuggcucuuccaggc

SEQ ID NO: 1807369 - RNA, 22 nt, Human
uuguucuggcucuuccaggcug

SEQ ID NO: 1807370 - RNA, 17 nt, Human
uuguguguuuauuguca

SEQ ID NO: 1807371 - RNA, 19 nt, Human
uuguucuggcucuuccagg

SEQ ID NO: 1807372 - RNA, 21 nt, Human
uugugaggaagccgcuggggc

SEQ ID NO: 1807373 - RNA, 18 nt, Human
uugugauacaaugcugug

SEQ ID NO: 1807374 - RNA, 19 nt, Human
uugugauacaaugcugugc

SEQ ID NO: 1807375 - RNA, 17 nt, Human
uuccccuguucacucua

SEQ ID NO: 1807376 - RNA, 14 nt, Human
uuccccuguucacu

SEQ ID NO: 1807377 - RNA, 22 nt, Human
uuccccuuccuaauuccacagc

SEQ ID NO: 1807378 - RNA, 17 nt, Human
uucccuacuuccuguga

SEQ ID NO: 1807379 - RNA, 14 nt, Human
uucccuacuuccug

SEQ ID NO: 1807380 - RNA, 16 nt, Human
uucccuacuuccugug

SEQ ID NO: 1807381 - RNA, 18 nt, Human
uucccuuuuuuggcugcu

SEQ ID NO: 1807382 - RNA, 19 nt, Human
uucccuuuuuuggcugcug

SEQ ID NO: 1807383 - RNA, 20 nt, Human
uucccuuuuuuggcugcuga

SEQ ID NO: 1807384 - RNA, 22 nt, Human
uucccccuguuucagaggcuca

SEQ ID NO: 1807385 - RNA, 22 nt, Human
aucaaccccuucgcuccugugu

SEQ ID NO: 1807386 - RNA, 20 nt, Human
aucaaccccuucgcuccugu

SEQ ID NO: 1807387 - RNA, 19 nt, Human
aucaaccccuucgcuccug

SEQ ID NO: 1807388 - RNA, 22 nt, Human
aucaaguuggcuucuaaucaaa

SEQ ID NO: 1807389 - RNA, 23 nt, Human
aucaaguuggcuucuaaucaaag

SEQ ID NO: 1807390 - RNA, 20 nt, Human
uuccuucaaagcaaaugucu

SEQ ID NO: 1807391 - RNA, 13 nt, Human
uuccucuccacug

SEQ ID NO: 1807392 - RNA, 14 nt, Human
uuccucuccacugc

SEQ ID NO: 1807393 - RNA, 15 nt, Human
uuccucuccacugcc

SEQ ID NO: 1807394 - RNA, 16 nt, Human
uuccucuccacugccu

SEQ ID NO: 1807395 - RNA, 12 nt, Human
uuccucuccacu

SEQ ID NO: 1807396 - RNA, 13 nt, Human
uucuauaauuuaa

SEQ ID NO: 1807397 - RNA, 14 nt, Human
uucuauaauuuaaa

SEQ ID NO: 1807398 - RNA, 21 nt, Human
uucucacugccaugccagcuu

SEQ ID NO: 1807399 - RNA, 13 nt, Human
aucaggccaggcc

SEQ ID NO: 1807400 - RNA, 14 nt, Human
aucaggccaggccc

SEQ ID NO: 1807401 - RNA, 19 nt, Human
aucagacuaugaaguuuuu

SEQ ID NO: 1807402 - RNA, 13 nt, Human
uucucagcuccca

SEQ ID NO: 1807403 - RNA, 13 nt, Human
uucucagaaucuc

SEQ ID NO: 1807404 - RNA, 20 nt, Human
uucgauacaccgggccugga

SEQ ID NO: 1807405 - RNA, 21 nt, Human
uucgcaggauucuuccucccu

SEQ ID NO: 1807406 - RNA, 19 nt, Human
uucuaaaucuccaaaauaa

SEQ ID NO: 1807407 - RNA, 13 nt, Human
uucgcuccugugu

SEQ ID NO: 1807408 - RNA, 15 nt, Human
uucuaaaguaaaaac

SEQ ID NO: 1807409 - RNA, 12 nt, Human
uucuugcaaagu

SEQ ID NO: 1807410 - RNA, 13 nt, Human
uucuugcaaagua

SEQ ID NO: 1807411 - RNA, 13 nt, Human
uucuuucuuccuc

SEQ ID NO: 1807412 - RNA, 15 nt, Human
uucuuucuuccucug

SEQ ID NO: 1807413 - RNA, 22 nt, Human
uucuuucuggcuaugcauuuga

SEQ ID NO: 1807414 - RNA, 21 nt, Human
uucuguuggccagugugacaa

SEQ ID NO: 1807415 - RNA, 17 nt, Human
uucuguugcugccucau

SEQ ID NO: 1807416 - RNA, 20 nt, Human
uucuguuuuucuaggccugg

SEQ ID NO: 1807417 - RNA, 15 nt, Human
uucuguugcugccuc

SEQ ID NO: 1807418 - RNA, 16 nt, Human
uucuguugcugccuca

SEQ ID NO: 1807419 - RNA, 18 nt, Human
uucuguucuuucuggcua

SEQ ID NO: 1807420 - RNA, 11 nt, Human
uucuuccucug

SEQ ID NO: 1807421 - RNA, 12 nt, Human
uucuuccucugc

SEQ ID NO: 1807422 - RNA, 13 nt, Human
uucuuccucugcu

SEQ ID NO: 1807423 - RNA, 23 nt, Human
uucuuccucccucccucuuuccc

SEQ ID NO: 1807424 - RNA, 13 nt, Human
uucuuaauucuua

SEQ ID NO: 1807425 - RNA, 21 nt, Human
auccuaggcauuugcugaaua

SEQ ID NO: 1807426 - RNA, 13 nt, Human
auccuaguuccac

SEQ ID NO: 1807427 - RNA, 12 nt, Human
auccuaaugaau

SEQ ID NO: 1807428 - RNA, 13 nt, Human
auccuaaugaaug

SEQ ID NO: 1807429 - RNA, 14 nt, Human
auccuacaagacac

SEQ ID NO: 1807430 - RNA, 19 nt, Human
auccuaaugaaugcauaaa

SEQ ID NO: 1807431 - RNA, 18 nt, Human
uugaacccgggaggcaga

SEQ ID NO: 1807432 - RNA, 21 nt, Human
uugaaauuuuuauuaaauuau

SEQ ID NO: 1807433 - RNA, 21 nt, Human
uugaaauauggucuuuugguu

SEQ ID NO: 1807434 - RNA, 11 nt, Human
uugaaaucuuu

SEQ ID NO: 1807435 - RNA, 20 nt, Human
uugaaauauaggaacuuaaa

SEQ ID NO: 1807436 - RNA, 16 nt, Human
uugaaaguuuacagga

SEQ ID NO: 1807437 - RNA, 17 nt, Human
uucucuacucuagggaa

SEQ ID NO: 1807438 - RNA, 16 nt, Human
uucucuuuucaaaaca

SEQ ID NO: 1807439 - RNA, 15 nt, Human
uucugcacacagcac

SEQ ID NO: 1807440 - RNA, 16 nt, Human
uucugacccaugcugc

SEQ ID NO: 1807441 - RNA, 14 nt, Human
uucugacccaugcu

SEQ ID NO: 1807442 - RNA, 19 nt, Human
uucugcagccacuauuguu

SEQ ID NO: 1807443 - RNA, 13 nt, Human
uucugccgcagcc

SEQ ID NO: 1807444 - RNA, 14 nt, Human
uucuccugccucag

SEQ ID NO: 1807445 - RNA, 12 nt, Human
uucuccugccuc

SEQ ID NO: 1807446 - RNA, 13 nt, Human
uucuccugccuca

SEQ ID NO: 1807447 - RNA, 21 nt, Human
aucauugaaaucuuuuugcuu

SEQ ID NO: 1807448 - RNA, 21 nt, Human
aucaggccaggcccucugccc

SEQ ID NO: 1807449 - RNA, 22 nt, Human
aucaggccaggcccucugccca

SEQ ID NO: 1807450 - RNA, 23 nt, Human
aucaggccaggcccucugcccac

SEQ ID NO: 1807451 - RNA, 22 nt, Human
uucugguugaugccugugaacu

SEQ ID NO: 1807452 - RNA, 20 nt, Human
uucuggcuaugcauuugaaa

SEQ ID NO: 1807453 - RNA, 18 nt, Human
uucuggcuaugcauuuga

SEQ ID NO: 1807454 - RNA, 14 nt, Human
uucugccgcagccc

SEQ ID NO: 1807455 - RNA, 15 nt, Human
uucugccgcagcccu

SEQ ID NO: 1807456 - RNA, 16 nt, Human
uucugccgcagcccug

SEQ ID NO: 1807457 - RNA, 15 nt, Human
uucuggcucuuccag

SEQ ID NO: 1807458 - RNA, 15 nt, Human
aucccaccaacccuc

SEQ ID NO: 1807459 - RNA, 17 nt, Human
uuauuuuuuucugaauu

SEQ ID NO: 1807460 - RNA, 13 nt, Human
uuauuuuuuucug

SEQ ID NO: 1807461 - RNA, 17 nt, Human
uuauuuuuagacagagu

SEQ ID NO: 1807462 - RNA, 18 nt, Human
uuauuuuuagacagaguc

SEQ ID NO: 1807463 - RNA, 21 nt, Human
uucaagcgauucuucugcuuc

SEQ ID NO: 1807464 - RNA, 21 nt, Human
uucaaaauuguuacaaauugu

SEQ ID NO: 1807465 - RNA, 20 nt, Human
uucaaaaguuuguuugcuua

SEQ ID NO: 1807466 - RNA, 17 nt, Human
uucaaaauaaaaaugag

SEQ ID NO: 1807467 - RNA, 17 nt, Human
uucaagugauucucaug

SEQ ID NO: 1807468 - RNA, 23 nt, Human
uucacaagacccaaaaggcagaa

SEQ ID NO: 1807469 - RNA, 20 nt, Human
uucacagaugggugcuugga

SEQ ID NO: 1807470 - RNA, 15 nt, Human
uucacaguucucucc

SEQ ID NO: 1807471 - RNA, 20 nt, Human
uucacaguucucuccuucuu

SEQ ID NO: 1807472 - RNA, 17 nt, Human
auaggcguaacuaauuu

SEQ ID NO: 1807473 - RNA, 22 nt, Human
auagcuuuucccuuuuuuuaag

SEQ ID NO: 1807474 - RNA, 12 nt, Human
auaggaaaaacu

SEQ ID NO: 1807475 - RNA, 14 nt, Human
auaggaaaaacuga

SEQ ID NO: 1807476 - RNA, 16 nt, Human
auaggaaaaacugauu

SEQ ID NO: 1807477 - RNA, 17 nt, Human
auaggaaaaacugauuu

SEQ ID NO: 1807478 - RNA, 15 nt, Human
uucacuuacagcacc

SEQ ID NO: 1807479 - RNA, 22 nt, Human
uucacuuaaguuaguuccacug

SEQ ID NO: 1807480 - RNA, 12 nt, Human
auauauaaccag

SEQ ID NO: 1807481 - RNA, 13 nt, Human
auauauaaccagu

SEQ ID NO: 1807482 - RNA, 16 nt, Human
auauaaaagacugacc

SEQ ID NO: 1807483 - RNA, 17 nt, Human
auaguggcuuaaaacaa

SEQ ID NO: 1807484 - RNA, 15 nt, Human
auaguggugugauuu

SEQ ID NO: 1807485 - RNA, 21 nt, Human
auagugaggcaucgcaaugua

SEQ ID NO: 1807486 - RNA, 22 nt, Human
auaguuggcuaggaccccucca

SEQ ID NO: 1807487 - RNA, 20 nt, Human
auaguuguaccgcaauguga

SEQ ID NO: 1807488 - RNA, 22 nt, Human
auaguuaagcgugcauaaguua

SEQ ID NO: 1807489 - RNA, 23 nt, Human
uucccaaagcagugcaugcuguc

SEQ ID NO: 1807490 - RNA, 19 nt, Human
uuccauaaucuggacuccu

SEQ ID NO: 1807491 - RNA, 22 nt, Human
uuccauaaucuggacuccucug

SEQ ID NO: 1807492 - RNA, 23 nt, Human
uuccauaaucuggacuccucugu

SEQ ID NO: 1807493 - RNA, 21 nt, Human
uuccaggggugggacacccug

SEQ ID NO: 1807494 - RNA, 17 nt, Human
uuccagugaggcucugc

SEQ ID NO: 1807495 - RNA, 19 nt, Human
uuccagugaggcucugccc

SEQ ID NO: 1807496 - RNA, 20 nt, Human
uuccagugaggcucugcccu

SEQ ID NO: 1807497 - RNA, 21 nt, Human
uuccagugaggcucugcccuu

SEQ ID NO: 1807498 - RNA, 22 nt, Human
uuccagugaggcucugcccuug

SEQ ID NO: 1807499 - RNA, 15 nt, Human
uucccaacacaaaga

SEQ ID NO: 1807500 - RNA, 13 nt, Human
uucccaacacaaa

SEQ ID NO: 1807501 - RNA, 16 nt, Human
uucccaagcucugcuc

SEQ ID NO: 1807502 - RNA, 15 nt, Human
uucccaagcucugcu

SEQ ID NO: 1807503 - RNA, 14 nt, Human
uucccaagcucugc

SEQ ID NO: 1807504 - RNA, 13 nt, Human
uucccaagcucug

SEQ ID NO: 1807505 - RNA, 18 nt, Human
uucccaagcucugcuccu

SEQ ID NO: 1807506 - RNA, 12 nt, Human
uucccaccucuc

SEQ ID NO: 1807507 - RNA, 22 nt, Human
uucccaccucucucacuccuug

SEQ ID NO: 1807508 - RNA, 22 nt, Human
uuccacaagagcccaggccucc

SEQ ID NO: 1807509 - RNA, 19 nt, Human
uuccaccaucaagccacca

SEQ ID NO: 1807510 - RNA, 17 nt, Human
uuccaggggugggacac

SEQ ID NO: 1807511 - RNA, 13 nt, Human
uuccacagaggac

SEQ ID NO: 1807512 - RNA, 16 nt, Human
auauguggaguucauc

SEQ ID NO: 1807513 - RNA, 15 nt, Human
auauguggaguucau

SEQ ID NO: 1807514 - RNA, 18 nt, Human
uucauuuaggugaggaag

SEQ ID NO: 1807515 - RNA, 15 nt, Human
uuccaaggguacuaa

SEQ ID NO: 1807516 - RNA, 17 nt, Human
uuccaaggguacuaagg

SEQ ID NO: 1807517 - RNA, 22 nt, Human
auaugcacacauuuuuuaaaug

SEQ ID NO: 1807518 - RNA, 16 nt, Human
auaugcacacauuuuu

SEQ ID NO: 1807519 - RNA, 15 nt, Human
auaugcacacauuuu

SEQ ID NO: 1807520 - RNA, 14 nt, Human
auaugcacacauuu

SEQ ID NO: 1807521 - RNA, 16 nt, Human
auauguaacaagccac

SEQ ID NO: 1807522 - RNA, 17 nt, Human
auauguaacaagccacc

SEQ ID NO: 1807523 - RNA, 22 nt, Human
auauguaaaugguaugucauuc

SEQ ID NO: 1807524 - RNA, 16 nt, Human
auaucugaaaauguau

SEQ ID NO: 1807525 - RNA, 17 nt, Human
auaucugaaaauguaug

SEQ ID NO: 1807526 - RNA, 20 nt, Human
auaucugaaaauguaugugu

SEQ ID NO: 1807527 - RNA, 14 nt, Human
auauauuuuaagac

SEQ ID NO: 1807528 - RNA, 12 nt, Human
auauauuuuaag

SEQ ID NO: 1807529 - RNA, 13 nt, Human
auauauuuuaaga

SEQ ID NO: 1807530 - RNA, 21 nt, Human
uucaucccucuggggcuguuc

SEQ ID NO: 1807531 - RNA, 17 nt, Human
uucaucccucuggggcu

SEQ ID NO: 1807532 - RNA, 19 nt, Human
uucauaauuauuauuuggc

SEQ ID NO: 1807533 - RNA, 18 nt, Human
uucagugccuuauggaac

SEQ ID NO: 1807534 - RNA, 16 nt, Human
uucagugccaaaaaca

SEQ ID NO: 1807535 - RNA, 12 nt, Human
uucagugccuua

SEQ ID NO: 1807536 - RNA, 13 nt, Human
uucagugccuuau

SEQ ID NO: 1807537 - RNA, 13 nt, Human
uucagaaaugugu

SEQ ID NO: 1807538 - RNA, 11 nt, Human
uucagaaaugu

SEQ ID NO: 1807539 - RNA, 15 nt, Human
auugcaacaggcugg

SEQ ID NO: 1807540 - RNA, 17 nt, Human
auugaccugaggcccuu

SEQ ID NO: 1807541 - RNA, 13 nt, Human
auugaccugaggc

SEQ ID NO: 1807542 - RNA, 18 nt, Human
auugacaggauuauugga

SEQ ID NO: 1807543 - RNA, 21 nt, Human
auugacccacaagaaaugaaa

SEQ ID NO: 1807544 - RNA, 21 nt, Human
auugcaacaggcugggcuuca

SEQ ID NO: 1807545 - RNA, 16 nt, Human
auugcaacaggcuggg

SEQ ID NO: 1807546 - RNA, 12 nt, Human
auugcaauagaa

SEQ ID NO: 1807547 - RNA, 23 nt, Human
auugccauuucuuccacaagagc

SEQ ID NO: 1807548 - RNA, 17 nt, Human
auugcauuuccugacag

SEQ ID NO: 1807549 - RNA, 21 nt, Human
auugcccacgcuggagugcag

SEQ ID NO: 1807550 - RNA, 17 nt, Human
auugcccacgcuggagu

SEQ ID NO: 1807551 - RNA, 19 nt, Human
auugcggacagccacggcc

SEQ ID NO: 1807552 - RNA, 18 nt, Human
auugcggacagccacggc

SEQ ID NO: 1807553 - RNA, 16 nt, Human
auugcggacagccacg

SEQ ID NO: 1807554 - RNA, 14 nt, Human
auucucagaaucuc

SEQ ID NO: 1807555 - RNA, 13 nt, Human
auucuacuuugag

SEQ ID NO: 1807556 - RNA, 16 nt, Human
auucuacuuugagugc

SEQ ID NO: 1807557 - RNA, 18 nt, Human
auucucagaaucucaaau

SEQ ID NO: 1807558 - RNA, 20 nt, Human
auucucagaaucucaaauaa

SEQ ID NO: 1807559 - RNA, 13 nt, Human
auucuccaccugc

SEQ ID NO: 1807560 - RNA, 16 nt, Human
auucuccaccugccag

SEQ ID NO: 1807561 - RNA, 17 nt, Human
auucuccaccugccagg

SEQ ID NO: 1807562 - RNA, 20 nt, Human
auugacacuuaaaaaugguu

SEQ ID NO: 1807563 - RNA, 18 nt, Human
auucuccaccugccaggg

SEQ ID NO: 1807564 - RNA, 14 nt, Human
auugcuacuguccu

SEQ ID NO: 1807565 - RNA, 21 nt, Human
auuuaaaacauuaaaauauaa

SEQ ID NO: 1807566 - RNA, 20 nt, Human
auuuaaaacauuaaaauaua

SEQ ID NO: 1807567 - RNA, 19 nt, Human
auuuaaaacauuaaaauau

SEQ ID NO: 1807568 - RNA, 16 nt, Human
auuuaacagaaaugua

SEQ ID NO: 1807569 - RNA, 15 nt, Human
auuuaacagaaaugu

SEQ ID NO: 1807570 - RNA, 19 nt, Human
auuuaacagaaauguacag

SEQ ID NO: 1807571 - RNA, 17 nt, Human
auuuaacagaaauguac

SEQ ID NO: 1807572 - RNA, 20 nt, Human
auuuaacagaaauguacagc

SEQ ID NO: 1807573 - RNA, 22 nt, Human
auuuacaacugggggaggguga

SEQ ID NO: 1807574 - RNA, 19 nt, Human
auuuacccuucuuuucuga

SEQ ID NO: 1807575 - RNA, 16 nt, Human
auuuacaaaugggaaa

SEQ ID NO: 1807576 - RNA, 23 nt, Human
auuuaauuuuuuugagacagagu

SEQ ID NO: 1807577 - RNA, 19 nt, Human
auuuaauuuuuuugagaca

SEQ ID NO: 1807578 - RNA, 14 nt, Human
auuguauuacaaau

SEQ ID NO: 1807579 - RNA, 15 nt, Human
auuguauuacaaauc

SEQ ID NO: 1807580 - RNA, 15 nt, Human
auugugaaauuauuc

SEQ ID NO: 1807581 - RNA, 13 nt, Human
auugugccccugc

SEQ ID NO: 1807582 - RNA, 23 nt, Human
auuggcuuuggguugcaggaccu

SEQ ID NO: 1807583 - RNA, 17 nt, Human
auuugagcagggcucag

SEQ ID NO: 1807584 - RNA, 23 nt, Human
auuugaggucuguucuuuccaaa

SEQ ID NO: 1807585 - RNA, 15 nt, Human
auuugaggucuguuc

SEQ ID NO: 1807586 - RNA, 20 nt, Human
auuucuuuugccguuauuaa

SEQ ID NO: 1807587 - RNA, 20 nt, Human
auuuggugguuucagaaaug

SEQ ID NO: 1807588 - RNA, 18 nt, Human
auuuggugguuucagaaa

SEQ ID NO: 1807589 - RNA, 17 nt, Human
auuuggugguuucagaa

SEQ ID NO: 1807590 - RNA, 13 nt, Human
auuuauuauggca

SEQ ID NO: 1807591 - RNA, 22 nt, Human
auuuauuaaaugcccagccccu

SEQ ID NO: 1807592 - RNA, 20 nt, Human
auuuauuaaaugcccagccc

SEQ ID NO: 1807593 - RNA, 14 nt, Human
auuuccugugucuu

SEQ ID NO: 1807594 - RNA, 16 nt, Human
auuuauuauggcacau

SEQ ID NO: 1807595 - RNA, 13 nt, Human
auuucuaaaucuc

SEQ ID NO: 1807596 - RNA, 12 nt, Human
auuucuaaaucu

SEQ ID NO: 1807597 - RNA, 21 nt, Human
auuucuaaaucuccaaaauaa

SEQ ID NO: 1807598 - RNA, 21 nt, Human
auuuuacuuuaaaaggagcca

SEQ ID NO: 1807599 - RNA, 18 nt, Human
auuuuauguugcauagaa

SEQ ID NO: 1807600 - RNA, 21 nt, Human
auuuuauguugcauagaauaa

SEQ ID NO: 1807601 - RNA, 14 nt, Human
auuuuauguugcau

SEQ ID NO: 1807602 - RNA, 13 nt, Human
auuuuauuaugca

SEQ ID NO: 1807603 - RNA, 15 nt, Human
auuuuauuaugcaug

SEQ ID NO: 1807604 - RNA, 14 nt, Human
auuuuauuaugcau

SEQ ID NO: 1807605 - RNA, 17 nt, Human
auuuuauuaugcaugaa

SEQ ID NO: 1807606 - RNA, 22 nt, Human
auuuuacuguacagacagaaaa

SEQ ID NO: 1807607 - RNA, 20 nt, Human
auuuuacuguacagacagaa

SEQ ID NO: 1807608 - RNA, 23 nt, Human
auuucuuuugccguuauuaaaaa

SEQ ID NO: 1807609 - RNA, 22 nt, Human
uuuuuguuccacaaguuaaaua

SEQ ID NO: 1807610 - RNA, 19 nt, Human
auuaccacagacauacuaa

SEQ ID NO: 1807611 - RNA, 22 nt, Human
auuaccugaauuuuggcugugu

SEQ ID NO: 1807612 - RNA, 12 nt, Human
auuaccagggac

SEQ ID NO: 1807613 - RNA, 16 nt, Human
auuauauuuacaaaug

SEQ ID NO: 1807614 - RNA, 17 nt, Human
auuauauuuacaaaugg

SEQ ID NO: 1807615 - RNA, 23 nt, Human
auuauuuauuaaaugcccagccc

SEQ ID NO: 1807616 - RNA, 16 nt, Human
auuauuuuauguugca

SEQ ID NO: 1807617 - RNA, 18 nt, Human
auuauuuuauguugcaua

SEQ ID NO: 1807618 - RNA, 16 nt, Human
auucaaaaugauguau

SEQ ID NO: 1807619 - RNA, 14 nt, Human
auucagcucaugga

SEQ ID NO: 1807620 - RNA, 21 nt, Human
auucaguuguuagugugucuu

SEQ ID NO: 1807621 - RNA, 23 nt, Human
auucaggaagcucagggccuggc

SEQ ID NO: 1807622 - RNA, 16 nt, Human
auucaguuguuagugu

SEQ ID NO: 1807623 - RNA, 14 nt, Human
auucagcucugcaa

SEQ ID NO: 1807624 - RNA, 18 nt, Human
auucagcucugcaagaau

SEQ ID NO: 1807625 - RNA, 21 nt, Human
auucaggaagcucagggccug

SEQ ID NO: 1807626 - RNA, 22 nt, Human
auucaggaagcucagggccugg

SEQ ID NO: 1807627 - RNA, 19 nt, Human
auuccccaggaggccagcc

SEQ ID NO: 1807628 - RNA, 20 nt, Human
auuccccagauugcaacagg

SEQ ID NO: 1807629 - RNA, 16 nt, Human
auuccccaggaggcca

SEQ ID NO: 1807630 - RNA, 20 nt, Human
auuccacuuauaggaauuga

SEQ ID NO: 1807631 - RNA, 22 nt, Human
uuuuaaguuacacauuuuucag

SEQ ID NO: 1807632 - RNA, 21 nt, Human
uuuuaaguuacacauuuuuca

SEQ ID NO: 1807633 - RNA, 21 nt, Human
uuuuaagugcugcauuuaaaa

SEQ ID NO: 1807634 - RNA, 17 nt, Human
uuuuaagugcugcauuu

SEQ ID NO: 1807635 - RNA, 16 nt, Human
uuuuaagugcugcauu

SEQ ID NO: 1807636 - RNA, 21 nt, Human
auguucaucauccuaagcuau

SEQ ID NO: 1807637 - RNA, 19 nt, Human
auguucaucaaugaaugaa

SEQ ID NO: 1807638 - RNA, 16 nt, Human
auguugaagccuuugu

SEQ ID NO: 1807639 - RNA, 15 nt, Human
auguugaagccuuug

SEQ ID NO: 1807640 - RNA, 23 nt, Human
uuuuagaguugauacuacaguuu

SEQ ID NO: 1807641 - RNA, 19 nt, Human
uuuuaguugcaacuuugua

SEQ ID NO: 1807642 - RNA, 13 nt, Human
uuuuauaaacuuu

SEQ ID NO: 1807643 - RNA, 12 nt, Human
uuuuauaaacuu

SEQ ID NO: 1807644 - RNA, 16 nt, Human
auguuggccaggcugg

SEQ ID NO: 1807645 - RNA, 16 nt, Human
auguuggccaggcugc

SEQ ID NO: 1807646 - RNA, 14 nt, Human
auguuggccaggcu

SEQ ID NO: 1807647 - RNA, 15 nt, Human
auguugcauagaaua

SEQ ID NO: 1807648 - RNA, 13 nt, Human
auguuggccaggc

SEQ ID NO: 1807649 - RNA, 17 nt, Human
uuuuauaaacuuuaccu

SEQ ID NO: 1807650 - RNA, 14 nt, Human
uuuuauaaacuuua

SEQ ID NO: 1807651 - RNA, 19 nt, Human
uuuuauaaacuuuaccuuu

SEQ ID NO: 1807652 - RNA, 22 nt, Human
uuuuauguugcauagaauaaaa

SEQ ID NO: 1807653 - RNA, 19 nt, Human
uuuuaugugaaacauguuu

SEQ ID NO: 1807654 - RNA, 18 nt, Human
uuuuaugugaaacauguu

SEQ ID NO: 1807655 - RNA, 19 nt, Human
uuuuccagguuuaagcugu

SEQ ID NO: 1807656 - RNA, 21 nt, Human
uuuucagauauaaaagacuga

SEQ ID NO: 1807657 - RNA, 19 nt, Human
uuuucagauauaaaagacu

SEQ ID NO: 1807658 - RNA, 22 nt, Human
uuuucagauauaaaagacugac

SEQ ID NO: 1807659 - RNA, 21 nt, Human
uuuuauucagcucauggacuu

SEQ ID NO: 1807660 - RNA, 18 nt, Human
auuaaccacuucagcuga

SEQ ID NO: 1807661 - RNA, 20 nt, Human
auuaaccacuucagcugacu

SEQ ID NO: 1807662 - RNA, 17 nt, Human
auuaaccacuucagcug

SEQ ID NO: 1807663 - RNA, 21 nt, Human
auuaaacuuaaucuaaaugga

SEQ ID NO: 1807664 - RNA, 19 nt, Human
auuaaacuuaaucuaaaug

SEQ ID NO: 1807665 - RNA, 16 nt, Human
auuaaacuuaaucuaa

SEQ ID NO: 1807666 - RNA, 17 nt, Human
auuaaacuuaaucuaaa

SEQ ID NO: 1807667 - RNA, 12 nt, Human
auuaacuuuuau

SEQ ID NO: 1807668 - RNA, 20 nt, Human
auuaacuuuuauaaacuuua

SEQ ID NO: 1807669 - RNA, 19 nt, Human
auuaacuuuuauaaacuuu

SEQ ID NO: 1807670 - RNA, 17 nt, Human
auuaacuuuuauaaacu

SEQ ID NO: 1807671 - RNA, 16 nt, Human
auuaacuuuuauaaac

SEQ ID NO: 1807672 - RNA, 23 nt, Human
auuaacuuuuauaaacuuuaccu

SEQ ID NO: 1807673 - RNA, 13 nt, Human
auuaagaaagacu

SEQ ID NO: 1807674 - RNA, 14 nt, Human
auuaagaaagacua

SEQ ID NO: 1807675 - RNA, 12 nt, Human
auuaagaaauag

SEQ ID NO: 1807676 - RNA, 11 nt, Human
auuaagaaaua

SEQ ID NO: 1807677 - RNA, 14 nt, Human
auguuuuccaugag

SEQ ID NO: 1807678 - RNA, 18 nt, Human
auguuuuucuucucccuc

SEQ ID NO: 1807679 - RNA, 17 nt, Human
auguuuuucuucucccu

SEQ ID NO: 1807680 - RNA, 18 nt, Human
auuaaaauauaaucucua

SEQ ID NO: 1807681 - RNA, 13 nt, Human
auuaaaauauaau

SEQ ID NO: 1807682 - RNA, 21 nt, Human
uuugcuguagaagauggcacu

SEQ ID NO: 1807683 - RNA, 15 nt, Human
uuugcuucaaaaaca

SEQ ID NO: 1807684 - RNA, 14 nt, Human
uuuggggauauuuu

SEQ ID NO: 1807685 - RNA, 22 nt, Human
uuugggaggccaaggugggagg

SEQ ID NO: 1807686 - RNA, 22 nt, Human
uuugccauguuggccaggcugg

SEQ ID NO: 1807687 - RNA, 22 nt, Human
uuugggggaaaauuuagaaaua

SEQ ID NO: 1807688 - RNA, 15 nt, Human
auguaucaaugagua

SEQ ID NO: 1807689 - RNA, 15 nt, Human
auguaucugagcagg

SEQ ID NO: 1807690 - RNA, 12 nt, Human
auguauguguaa

SEQ ID NO: 1807691 - RNA, 24 nt, Human
augucccuaccgagucucuucucc

SEQ ID NO: 1807692 - RNA, 16 nt, Human
auguccacugguucuu

SEQ ID NO: 1807693 - RNA, 20 nt, Human
augucccaacuuguaaaaau

SEQ ID NO: 1807694 - RNA, 21 nt, Human
augucagugugacugaucucu

SEQ ID NO: 1807695 - RNA, 15 nt, Human
augucagugugacug

SEQ ID NO: 1807696 - RNA, 16 nt, Human
augucagugugacuga

SEQ ID NO: 1807697 - RNA, 19 nt, Human
auguccaagaagcccagga

SEQ ID NO: 1807698 - RNA, 18 nt, Human
auguccaagaagcccagg

SEQ ID NO: 1807699 - RNA, 23 nt, Human
auguccaagaagcccaggaaagg

SEQ ID NO: 1807700 - RNA, 16 nt, Human
uuugugagcaggcugu

SEQ ID NO: 1807701 - RNA, 14 nt, Human
uuuguuugaacuga

SEQ ID NO: 1807702 - RNA, 13 nt, Human
uuuguuugaacug

SEQ ID NO: 1807703 - RNA, 12 nt, Human
uuuguuugaacu

SEQ ID NO: 1807704 - RNA, 17 nt, Human
uuuguuucuuucucuga

SEQ ID NO: 1807705 - RNA, 18 nt, Human
uuugugaggaagccgcug

SEQ ID NO: 1807706 - RNA, 19 nt, Human
uuugugaggaagccgcugg

SEQ ID NO: 1807707 - RNA, 13 nt, Human
uuuguagagccag

SEQ ID NO: 1807708 - RNA, 13 nt, Human
uuuguaaauuguc

SEQ ID NO: 1807709 - RNA, 22 nt, Human
uuuuaaaacacuuccauaaucu

SEQ ID NO: 1807710 - RNA, 16 nt, Human
uuuuaaaacacuucca

SEQ ID NO: 1807711 - RNA, 18 nt, Human
uuuguuugaacugauaaa

SEQ ID NO: 1807712 - RNA, 15 nt, Human
uuuuaagaggcaggg

SEQ ID NO: 1807713 - RNA, 16 nt, Human
uuuuaagaggcagggu

SEQ ID NO: 1807714 - RNA, 20 nt, Human
uuuuaaggguuuguggaaaa

SEQ ID NO: 1807715 - RNA, 23 nt, Human
uuuuaaggguuuguggaaaauga

SEQ ID NO: 1807716 - RNA, 16 nt, Human
uuuuaaguaaggaauu

SEQ ID NO: 1807717 - RNA, 15 nt, Human
uuuuaagugcugcau

SEQ ID NO: 1807718 - RNA, 14 nt, Human
uuagcggagacgga

SEQ ID NO: 1807719 - RNA, 18 nt, Human
uuagccaagugugguaga

SEQ ID NO: 1807720 - RNA, 18 nt, Human
auaauuuaccugaagucu

SEQ ID NO: 1807721 - RNA, 12 nt, Human
uuagcaccaggg

SEQ ID NO: 1807722 - RNA, 18 nt, Human
uuagcaaauucuguuuuu

SEQ ID NO: 1807723 - RNA, 20 nt, Human
uuagggaaggauacaaaagc

SEQ ID NO: 1807724 - RNA, 16 nt, Human
uuaggugugacugaau

SEQ ID NO: 1807725 - RNA, 16 nt, Human
uuaggugaggaagcaa

SEQ ID NO: 1807726 - RNA, 21 nt, Human
uuaggugugacugaauuucuu

SEQ ID NO: 1807727 - RNA, 15 nt, Human
uuaguuucuccaagc

SEQ ID NO: 1807728 - RNA, 22 nt, Human
uuaguuugcaguuacacuaaaa

SEQ ID NO: 1807729 - RNA, 18 nt, Human
auaauccuaaacauauga

SEQ ID NO: 1807730 - RNA, 18 nt, Human
auaaucucuccauucccg

SEQ ID NO: 1807731 - RNA, 18 nt, Human
auaaucuggacuccucug

SEQ ID NO: 1807732 - RNA, 19 nt, Human
auaaucuggacuccucugu

SEQ ID NO: 1807733 - RNA, 20 nt, Human
auaaucuggacuccucuguc

SEQ ID NO: 1807734 - RNA, 15 nt, Human
auaaugcgugcauac

SEQ ID NO: 1807735 - RNA, 15 nt, Human
auaaugaaugaaaca

SEQ ID NO: 1807736 - RNA, 22 nt, Human
auaauugacaggauuauuggaa

SEQ ID NO: 1807737 - RNA, 14 nt, Human
uuagacagucccug

SEQ ID NO: 1807738 - RNA, 14 nt, Human
auaauaaagaauag

SEQ ID NO: 1807739 - RNA, 13 nt, Human
auaauaaagaaua

SEQ ID NO: 1807740 - RNA, 23 nt, Human
auaauaaagaauagcuuuaauga

SEQ ID NO: 1807741 - RNA, 19 nt, Human
auaauacuugcuuuggaaa

SEQ ID NO: 1807742 - RNA, 20 nt, Human
auaauacaccacuacauucu

SEQ ID NO: 1807743 - RNA, 18 nt, Human
auaauacaccacuacauu

SEQ ID NO: 1807744 - RNA, 12 nt, Human
auaauacaccac

SEQ ID NO: 1807745 - RNA, 19 nt, Human
uuacccucauguucuuaau

SEQ ID NO: 1807746 - RNA, 16 nt, Human
uuacaggcuccugcca

SEQ ID NO: 1807747 - RNA, 18 nt, Human
uuacaggcuccugccacc

SEQ ID NO: 1807748 - RNA, 24 nt, Human
uuacaggcgugagccaccgugccu

SEQ ID NO: 1807749 - RNA, 13 nt, Human
uuaccuuugacaa

SEQ ID NO: 1807750 - RNA, 20 nt, Human
uuaccuuugacaaagguaaa

SEQ ID NO: 1807751 - RNA, 20 nt, Human
uuagacagagucucacuguu

SEQ ID NO: 1807752 - RNA, 13 nt, Human
uuagacagucccu

SEQ ID NO: 1807753 - RNA, 13 nt, Human
uuagacagagucu

SEQ ID NO: 1807754 - RNA, 17 nt, Human
uuagaaauugcauuucc

SEQ ID NO: 1807755 - RNA, 23 nt, Human
uuacucuucaguuaagccuuugg

SEQ ID NO: 1807756 - RNA, 11 nt, Human
auaaauuauuu

SEQ ID NO: 1807757 - RNA, 22 nt, Human
auaacgauaaaagacagugaaa

SEQ ID NO: 1807758 - RNA, 14 nt, Human
auaacguauaaaag

SEQ ID NO: 1807759 - RNA, 16 nt, Human
auaacuaaaagguaug

SEQ ID NO: 1807760 - RNA, 13 nt, Human
auaaauaaaaaua

SEQ ID NO: 1807761 - RNA, 17 nt, Human
auaaagguucaugcaaa

SEQ ID NO: 1807762 - RNA, 15 nt, Human
auaaagguucaugca

SEQ ID NO: 1807763 - RNA, 14 nt, Human
auaaauaaaaauaa

SEQ ID NO: 1807764 - RNA, 15 nt, Human
auaaauaguuuauga

SEQ ID NO: 1807765 - RNA, 17 nt, Human
uuaaaaaucucaaauuu

SEQ ID NO: 1807766 - RNA, 16 nt, Human
uuaaaaaucucaaauu

SEQ ID NO: 1807767 - RNA, 15 nt, Human
uuaaaaaucucaaau

SEQ ID NO: 1807768 - RNA, 14 nt, Human
uuaaaaaucucaaa

SEQ ID NO: 1807769 - RNA, 13 nt, Human
uuaaacagaggau

SEQ ID NO: 1807770 - RNA, 15 nt, Human
uuaaauaaugugaaa

SEQ ID NO: 1807771 - RNA, 18 nt, Human
uuaaauaaugugaaacug

SEQ ID NO: 1807772 - RNA, 16 nt, Human
uuaaauaaugugaaac

SEQ ID NO: 1807773 - RNA, 20 nt, Human
uuaacagaaauguacagcaa

SEQ ID NO: 1807774 - RNA, 19 nt, Human
uuaacagaaauguacagca

SEQ ID NO: 1807775 - RNA, 14 nt, Human
aguuuaaauuguaa

SEQ ID NO: 1807776 - RNA, 17 nt, Human
aguuggucccccuucca

SEQ ID NO: 1807777 - RNA, 11 nt, Human
aguuggucccc

SEQ ID NO: 1807778 - RNA, 13 nt, Human
aguuggucccccu

SEQ ID NO: 1807779 - RNA, 13 nt, Human
uuaaaaaaaaucc

SEQ ID NO: 1807780 - RNA, 18 nt, Human
aguuuaauugacuuauuu

SEQ ID NO: 1807781 - RNA, 15 nt, Human
aguuuaauugacuua

SEQ ID NO: 1807782 - RNA, 14 nt, Human
aguuuaauugacuu

SEQ ID NO: 1807783 - RNA, 13 nt, Human
aguugggcuuccu

SEQ ID NO: 1807784 - RNA, 19 nt, Human
aguugggcuuccucauagu

SEQ ID NO: 1807785 - RNA, 17 nt, Human
aguuggguggaugccug

SEQ ID NO: 1807786 - RNA, 23 nt, Human
aguugccagucaccccggccacc

SEQ ID NO: 1807787 - RNA, 14 nt, Human
uuaagugcugcauu

SEQ ID NO: 1807788 - RNA, 19 nt, Human
uuaagugcugcauuuaaaa

SEQ ID NO: 1807789 - RNA, 16 nt, Human
uuaagugcugcauuua

SEQ ID NO: 1807790 - RNA, 15 nt, Human
uuaagugcugcauuu

SEQ ID NO: 1807791 - RNA, 22 nt, Human
uuaagaaauagacagcaugaga

SEQ ID NO: 1807792 - RNA, 22 nt, Human
uuaagaaagacuaucuaaaugu

SEQ ID NO: 1807793 - RNA, 9 nt, Human
uuaaggugg

SEQ ID NO: 1807794 - RNA, 13 nt, Human
uuaaucauuaggu

SEQ ID NO: 1807795 - RNA, 22 nt, Human
uuaauauuuauaggucacuuug

SEQ ID NO: 1807796 - RNA, 17 nt, Human
uuaaucucuaacagugg

SEQ ID NO: 1807797 - RNA, 21 nt, Human
uuaaucugggccagaauuuca

SEQ ID NO: 1807798 - RNA, 23 nt, Human
uuaaucauuaggugugacugaau

SEQ ID NO: 1807799 - RNA, 22 nt, Human
uuaaucauuaggugugacugaa

SEQ ID NO: 1807800 - RNA, 19 nt, Human
uuaaugaaagacuguacaa

SEQ ID NO: 1807801 - RNA, 21 nt, Human
uuaauugacuuauuuauauaa

SEQ ID NO: 1807802 - RNA, 18 nt, Human
uuaaucucuaacagugga

SEQ ID NO: 1807803 - RNA, 22 nt, Human
uuaaucugguuuauuuuuguuc

SEQ ID NO: 1807804 - RNA, 18 nt, Human
uuaaugaaagacuguaca

SEQ ID NO: 1807805 - RNA, 15 nt, Human
aguuuuguaaauuuc

SEQ ID NO: 1807806 - RNA, 12 nt, Human
aguuuuguaaau

SEQ ID NO: 1807807 - RNA, 23 nt, Human
aguuuuuauggcuuuugugcauu

SEQ ID NO: 1807808 - RNA, 13 nt, Human
auaaaagccuguu

SEQ ID NO: 1807809 - RNA, 20 nt, Human
aguuuuuauugcuuguugga

SEQ ID NO: 1807810 - RNA, 15 nt, Human
aguuuuuauugcuug

SEQ ID NO: 1807811 - RNA, 18 nt, Human
auaaaagccuguuuaaga

SEQ ID NO: 1807812 - RNA, 20 nt, Human
uuaagaaaaaggaugcacag

SEQ ID NO: 1807813 - RNA, 21 nt, Human
uuaagaaaaaggaugcacaga

SEQ ID NO: 1807814 - RNA, 16 nt, Human
aguggaaccagcccag

SEQ ID NO: 1807815 - RNA, 18 nt, Human
uguucuagcauggcugcc

SEQ ID NO: 1807816 - RNA, 18 nt, Human
uguucuuaguuugcaguu

SEQ ID NO: 1807817 - RNA, 21 nt, Human
aguuacucuucaguuaagccu

SEQ ID NO: 1807818 - RNA, 15 nt, Human
uguugcccaggcugg

SEQ ID NO: 1807819 - RNA, 21 nt, Human
uguugcccaggcuggagugca

SEQ ID NO: 1807820 - RNA, 14 nt, Human
uguugcccaggcug

SEQ ID NO: 1807821 - RNA, 13 nt, Human
uguugcccaggcu

SEQ ID NO: 1807822 - RNA, 19 nt, Human
uguucuuucacccuuuucu

SEQ ID NO: 1807823 - RNA, 20 nt, Human
uguucuugguuuguaaauua

SEQ ID NO: 1807824 - RNA, 22 nt, Human
uguucuugguuuguaaauuaac

SEQ ID NO: 1807825 - RNA, 19 nt, Human
aguguguguuuuucauaaa

SEQ ID NO: 1807826 - RNA, 21 nt, Human
aguguucauaaauaaaguuug

SEQ ID NO: 1807827 - RNA, 20 nt, Human
aguucggugagcuacaaaug

SEQ ID NO: 1807828 - RNA, 19 nt, Human
aguucggugagcuacaaau

SEQ ID NO: 1807829 - RNA, 16 nt, Human
aguucaauucucauuu

SEQ ID NO: 1807830 - RNA, 15 nt, Human
aguucccuacuuccu

SEQ ID NO: 1807831 - RNA, 23 nt, Human
aguuccucauuagcauuuugcua

SEQ ID NO: 1807832 - RNA, 20 nt, Human
uguuuagauaauacaccacu

SEQ ID NO: 1807833 - RNA, 13 nt, Human
uguuuaguaauca

SEQ ID NO: 1807834 - RNA, 14 nt, Human
uguuuaguaaucau

SEQ ID NO: 1807835 - RNA, 17 nt, Human
uguuuaguaaucauauu

SEQ ID NO: 1807836 - RNA, 14 nt, Human
uguuuauugucaaa

SEQ ID NO: 1807837 - RNA, 17 nt, Human
uguuuauugucaaagug

SEQ ID NO: 1807838 - RNA, 19 nt, Human
agugcugggauuacaggug

SEQ ID NO: 1807839 - RNA, 17 nt, Human
agugcugggauuacagg

SEQ ID NO: 1807840 - RNA, 20 nt, Human
agugcugggauuacaggcgu

SEQ ID NO: 1807841 - RNA, 20 nt, Human
agugcugggauuacaagcgu

SEQ ID NO: 1807842 - RNA, 22 nt, Human
agugcugcauuuaaaagauaca

SEQ ID NO: 1807843 - RNA, 20 nt, Human
agugcugcauuuaaaagaua

SEQ ID NO: 1807844 - RNA, 17 nt, Human
agugccuuacacaaugg

SEQ ID NO: 1807845 - RNA, 15 nt, Human
agugccuuacacaau

SEQ ID NO: 1807846 - RNA, 21 nt, Human
agugccuguaaucacagcuac

SEQ ID NO: 1807847 - RNA, 16 nt, Human
agugcuuccaaggaug

SEQ ID NO: 1807848 - RNA, 19 nt, Human
ugugucagcauagaaguaa

SEQ ID NO: 1807849 - RNA, 12 nt, Human
ugugguuucauu

SEQ ID NO: 1807850 - RNA, 21 nt, Human
uguuaacauggacaugaucuu

SEQ ID NO: 1807851 - RNA, 19 nt, Human
uguuaaugauagcuacugu

SEQ ID NO: 1807852 - RNA, 11 nt, Human
aguggaaaaau

SEQ ID NO: 1807853 - RNA, 18 nt, Human
aguggaaaaauagccugc

SEQ ID NO: 1807854 - RNA, 19 nt, Human
aguggaaaaauagccugcc

SEQ ID NO: 1807855 - RNA, 19 nt, Human
ugugucagguggggcagcu

SEQ ID NO: 1807856 - RNA, 17 nt, Human
ugugucagguggggcag

SEQ ID NO: 1807857 - RNA, 20 nt, Human
ugugucagguggggcagcuu

SEQ ID NO: 1807858 - RNA, 19 nt, Human
ugugucuaggcaggaccug

SEQ ID NO: 1807859 - RNA, 13 nt, Human
ugugucucuuggu

SEQ ID NO: 1807860 - RNA, 20 nt, Human
ugugucuaggcaggaccugu

SEQ ID NO: 1807861 - RNA, 16 nt, Human
ugugucucuugguccu

SEQ ID NO: 1807862 - RNA, 14 nt, Human
uguguuaugaagca

SEQ ID NO: 1807863 - RNA, 18 nt, Human
agugcaaugacacagucu

SEQ ID NO: 1807864 - RNA, 16 nt, Human
agugcaaugacacagu

SEQ ID NO: 1807865 - RNA, 24 nt, Human
agugauucuccugccucagccucc

SEQ ID NO: 1807866 - RNA, 22 nt, Human
agugauucuccugccucagccu

SEQ ID NO: 1807867 - RNA, 16 nt, Human
agugagucgaggacag

SEQ ID NO: 1807868 - RNA, 14 nt, Human
agugcccacaggau

SEQ ID NO: 1807869 - RNA, 16 nt, Human
agugccaaaaacaaca

SEQ ID NO: 1807870 - RNA, 15 nt, Human
agugcaucucagccc

SEQ ID NO: 1807871 - RNA, 14 nt, Human
agugcaucucagcc

SEQ ID NO: 1807872 - RNA, 16 nt, Human
agugcaucucagccca

SEQ ID NO: 1807873 - RNA, 17 nt, Human
agugcaucucagcccac

SEQ ID NO: 1807874 - RNA, 15 nt, Human
ugugcucuggacagg

SEQ ID NO: 1807875 - RNA, 23 nt, Human
ugugcucugaucauccacugugc

SEQ ID NO: 1807876 - RNA, 22 nt, Human
ugugcucugaucauccacugug

SEQ ID NO: 1807877 - RNA, 12 nt, Human
ugugccucugcc

SEQ ID NO: 1807878 - RNA, 13 nt, Human
ugugccucugccu

SEQ ID NO: 1807879 - RNA, 19 nt, Human
agucucacuguugcccagg

SEQ ID NO: 1807880 - RNA, 18 nt, Human
agucucacuguugcccag

SEQ ID NO: 1807881 - RNA, 20 nt, Human
agucucacuguugcccaggc

SEQ ID NO: 1807882 - RNA, 21 nt, Human
agucucacuguugcccaggcu

SEQ ID NO: 1807883 - RNA, 21 nt, Human
ugugcccuaaaguguauuuuu

SEQ ID NO: 1807884 - RNA, 20 nt, Human
ugugcccuaaaguguauuuu

SEQ ID NO: 1807885 - RNA, 19 nt, Human
ugugcucuggacaggcaug

SEQ ID NO: 1807886 - RNA, 18 nt, Human
ugugcucuggacaggcau

SEQ ID NO: 1807887 - RNA, 16 nt, Human
ugugcucuggacaggc

SEQ ID NO: 1807888 - RNA, 13 nt, Human
ugugcugcccugc

SEQ ID NO: 1807889 - RNA, 14 nt, Human
ugugcugcccugcc

SEQ ID NO: 1807890 - RNA, 15 nt, Human
ugugcugcccugccc

SEQ ID NO: 1807891 - RNA, 19 nt, Human
ugucaagagggucugagga

SEQ ID NO: 1807892 - RNA, 15 nt, Human
ugucaagccauaauu

SEQ ID NO: 1807893 - RNA, 21 nt, Human
ugucaagaauagcauuguaaa

SEQ ID NO: 1807894 - RNA, 16 nt, Human
uguauuuuuuuacuaa

SEQ ID NO: 1807895 - RNA, 14 nt, Human
uguauuuuuuuacu

SEQ ID NO: 1807896 - RNA, 17 nt, Human
aguaggaagacuuugga

SEQ ID NO: 1807897 - RNA, 18 nt, Human
aguaggaagacuuuggaa

SEQ ID NO: 1807898 - RNA, 19 nt, Human
aguaggaagacuuuggaaa

SEQ ID NO: 1807899 - RNA, 22 nt, Human
aguaggaagacuuuggaaagac

SEQ ID NO: 1807900 - RNA, 16 nt, Human
aguaggaagacuuugg

SEQ ID NO: 1807901 - RNA, 23 nt, Human
ugucauuugcuggagcucugccc

SEQ ID NO: 1807902 - RNA, 16 nt, Human
ugucagguggggcagc

SEQ ID NO: 1807903 - RNA, 19 nt, Human
ugucagcugaaccugggua

SEQ ID NO: 1807904 - RNA, 19 nt, Human
agucacugagacagcccgg

SEQ ID NO: 1807905 - RNA, 18 nt, Human
agucacugagacagcccg

SEQ ID NO: 1807906 - RNA, 13 nt, Human
agucacugcacag

SEQ ID NO: 1807907 - RNA, 16 nt, Human
ugucagcugaaccugg

SEQ ID NO: 1807908 - RNA, 14 nt, Human
agucaccaagccca

SEQ ID NO: 1807909 - RNA, 13 nt, Human
agucaccaagccc

SEQ ID NO: 1807910 - RNA, 16 nt, Human
agucagacagaugugg

SEQ ID NO: 1807911 - RNA, 15 nt, Human
ugucgcccagucugg

SEQ ID NO: 1807912 - RNA, 14 nt, Human
ugucgcccagucug

SEQ ID NO: 1807913 - RNA, 13 nt, Human
ugucgccucugca

SEQ ID NO: 1807914 - RNA, 12 nt, Human
ugucgggcauga

SEQ ID NO: 1807915 - RNA, 17 nt, Human
ugucguuaaaaacagau

SEQ ID NO: 1807916 - RNA, 14 nt, Human
ugucgggcaugaca

SEQ ID NO: 1807917 - RNA, 15 nt, Human
ugucgggcaugacac

SEQ ID NO: 1807918 - RNA, 16 nt, Human
uguccuacccacccuc

SEQ ID NO: 1807919 - RNA, 15 nt, Human
ugucgcccaggcugg

SEQ ID NO: 1807920 - RNA, 16 nt, Human
ugucgcccaggcugga

SEQ ID NO: 1807921 - RNA, 13 nt, Human
uguccgagcuuug

SEQ ID NO: 1807922 - RNA, 14 nt, Human
uguccgagcuuuga

SEQ ID NO: 1807923 - RNA, 23 nt, Human
aguccgaaagggacuuggaagcu

SEQ ID NO: 1807924 - RNA, 17 nt, Human
agucucacuguugccca

SEQ ID NO: 1807925 - RNA, 16 nt, Human
agucucacuguugccc

SEQ ID NO: 1807926 - RNA, 12 nt, Human
agucccugccaa

SEQ ID NO: 1807927 - RNA, 22 nt, Human
aguccaggcuuuuuuaucaugu

SEQ ID NO: 1807928 - RNA, 17 nt, Human
aggugguuauggagagg

SEQ ID NO: 1807929 - RNA, 17 nt, Human
uguaacuuucugaaaua

SEQ ID NO: 1807930 - RNA, 14 nt, Human
agguuggugggggc

SEQ ID NO: 1807931 - RNA, 20 nt, Human
uguaagaucguucucugccu

SEQ ID NO: 1807932 - RNA, 19 nt, Human
uguaagaucguucucugcc

SEQ ID NO: 1807933 - RNA, 23 nt, Human
uguaauuaaguacuauguaucaa

SEQ ID NO: 1807934 - RNA, 23 nt, Human
aggucuugaacuccuggccucaa

SEQ ID NO: 1807935 - RNA, 10 nt, Human
aggucccuaa

SEQ ID NO: 1807936 - RNA, 16 nt, Human
aggugcacaagcucca

SEQ ID NO: 1807937 - RNA, 17 nt, Human
aggugcacaagcuccaa

SEQ ID NO: 1807938 - RNA, 18 nt, Human
aggugcacaagcuccaag

SEQ ID NO: 1807939 - RNA, 20 nt, Human
aggugcacaagcuccaagcu

SEQ ID NO: 1807940 - RNA, 15 nt, Human
aggugcacaagcucc

SEQ ID NO: 1807941 - RNA, 21 nt, Human
aggugcacaagcuccaagcuc

SEQ ID NO: 1807942 - RNA, 17 nt, Human
agguggccacuccagac

SEQ ID NO: 1807943 - RNA, 14 nt, Human
agguggccacucca

SEQ ID NO: 1807944 - RNA, 20 nt, Human
aggugggauccuccaggugc

SEQ ID NO: 1807945 - RNA, 12 nt, Human
aguagagacagg

SEQ ID NO: 1807946 - RNA, 17 nt, Human
aguagaagucuuagaug

SEQ ID NO: 1807947 - RNA, 18 nt, Human
uguaggaagguuaauguu

SEQ ID NO: 1807948 - RNA, 20 nt, Human
uguaggaagguuaauguuca

SEQ ID NO: 1807949 - RNA, 14 nt, Human
aguacacuguuuca

SEQ ID NO: 1807950 - RNA, 20 nt, Human
aguacacuguuucaaacuuu

SEQ ID NO: 1807951 - RNA, 16 nt, Human
aguacacuguuucaaa

SEQ ID NO: 1807952 - RNA, 19 nt, Human
aguacuuuuggcauuuuac

SEQ ID NO: 1807953 - RNA, 15 nt, Human
aguaauccaagcaaa

SEQ ID NO: 1807954 - RNA, 14 nt, Human
aguaauccaccugc

SEQ ID NO: 1807955 - RNA, 21 nt, Human
aguaauccaagcaaaugugaa

SEQ ID NO: 1807956 - RNA, 23 nt, Human
aguaaggaauuuuauuuuuuucu

SEQ ID NO: 1807957 - RNA, 20 nt, Human
aguaauaugcacacauuuuu

SEQ ID NO: 1807958 - RNA, 17 nt, Human
aguaauaugcacacauu

SEQ ID NO: 1807959 - RNA, 19 nt, Human
aguaauaugcacacauuuu

SEQ ID NO: 1807960 - RNA, 18 nt, Human
aguaauaugcacacauuu

SEQ ID NO: 1807961 - RNA, 12 nt, Human
aguaaaaauaaa

SEQ ID NO: 1807962 - RNA, 15 nt, Human
aguaaaaauaaaauu

SEQ ID NO: 1807963 - RNA, 20 nt, Human
aguaagccgugauuuucauu

SEQ ID NO: 1807964 - RNA, 11 nt, Human
agguuuuccug

SEQ ID NO: 1807965 - RNA, 14 nt, Human
uguaauuugugaua

SEQ ID NO: 1807966 - RNA, 13 nt, Human
uguagagugggag

SEQ ID NO: 1807967 - RNA, 14 nt, Human
uguagagugggagc

SEQ ID NO: 1807968 - RNA, 18 nt, Human
uguagaggagaaacugga

SEQ ID NO: 1807969 - RNA, 13 nt, Human
aggguugggcugg

SEQ ID NO: 1807970 - RNA, 23 nt, Human
aggguuggccccugcccggcugc

SEQ ID NO: 1807971 - RNA, 18 nt, Human
aggguuggccccugcccg

SEQ ID NO: 1807972 - RNA, 17 nt, Human
agguagaaauaucugaa

SEQ ID NO: 1807973 - RNA, 19 nt, Human
agguagaaauaucugaaaa

SEQ ID NO: 1807974 - RNA, 23 nt, Human
agguacuuucauauuuuaaacag

SEQ ID NO: 1807975 - RNA, 23 nt, Human
agguagaaauaucugaaaaugua

SEQ ID NO: 1807976 - RNA, 19 nt, Human
agguauaaguggugugugu

SEQ ID NO: 1807977 - RNA, 20 nt, Human
agguauaaguggugugugua

SEQ ID NO: 1807978 - RNA, 23 nt, Human
agguauaauucacauuguauuca

SEQ ID NO: 1807979 - RNA, 21 nt, Human
agguaugcaaucaaaucugcu

SEQ ID NO: 1807980 - RNA, 12 nt, Human
aggucagagccu

SEQ ID NO: 1807981 - RNA, 20 nt, Human
aggucauuuuuuuuaagaaa

SEQ ID NO: 1807982 - RNA, 17 nt, Human
aggucauuuuuuuuaag

SEQ ID NO: 1807983 - RNA, 19 nt, Human
aggucaccuuuauucuggc

SEQ ID NO: 1807984 - RNA, 18 nt, Human
aggucaccuuuauucugg

SEQ ID NO: 1807985 - RNA, 13 nt, Human
aggguuauaauaa

SEQ ID NO: 1807986 - RNA, 22 nt, Human
aggguguccggucccuguccca

SEQ ID NO: 1807987 - RNA, 17 nt, Human
uggucugacccacugcu

SEQ ID NO: 1807988 - RNA, 16 nt, Human
uggucugacccacugc

SEQ ID NO: 1807989 - RNA, 14 nt, Human
uggucccaccccac

SEQ ID NO: 1807990 - RNA, 15 nt, Human
uggucccaccccaca

SEQ ID NO: 1807991 - RNA, 18 nt, Human
uggucaccaaaucagcug

SEQ ID NO: 1807992 - RNA, 22 nt, Human
uggucagauuugaacucuucaa

SEQ ID NO: 1807993 - RNA, 20 nt, Human
uggucaccaaaucagcugcu

SEQ ID NO: 1807994 - RNA, 13 nt, Human
uggucccacucag

SEQ ID NO: 1807995 - RNA, 16 nt, Human
uggucccaccccacac

SEQ ID NO: 1807996 - RNA, 16 nt, Human
uggucucaaacucuug

SEQ ID NO: 1807997 - RNA, 19 nt, Human
uggucuaucuuugagcgcc

SEQ ID NO: 1807998 - RNA, 23 nt, Human
uggucucaaacucuugaccucag

SEQ ID NO: 1807999 - RNA, 17 nt, Human
uggucucaaacucuuga

SEQ ID NO: 1808000 - RNA, 18 nt, Human
uggucucaaacuccugac

SEQ ID NO: 1808001 - RNA, 22 nt, Human
agggucucacucugucgcccag

SEQ ID NO: 1808002 - RNA, 21 nt, Human
ugggucgcccuggacugugug

SEQ ID NO: 1808003 - RNA, 15 nt, Human
agggugggagugggc

SEQ ID NO: 1808004 - RNA, 22 nt, Human
ugggugcuuggaggaaggaaac

SEQ ID NO: 1808005 - RNA, 15 nt, Human
ugggugcuuggagga

SEQ ID NO: 1808006 - RNA, 19 nt, Human
ugggugcuuggaggaagga

SEQ ID NO: 1808007 - RNA, 22 nt, Human
uggucacaggacucugccuccu

SEQ ID NO: 1808008 - RNA, 23 nt, Human
uggucacaggacucugccuccuc

SEQ ID NO: 1808009 - RNA, 20 nt, Human
uggucacaggacucugccuc

SEQ ID NO: 1808010 - RNA, 21 nt, Human
ugguagcuuuucccuucuuuu

SEQ ID NO: 1808011 - RNA, 20 nt, Human
ugguagcuuuucccuucuuu

SEQ ID NO: 1808012 - RNA, 17 nt, Human
ugguacucauuaaaaaa

SEQ ID NO: 1808013 - RNA, 16 nt, Human
ugguacuaacuuuccu

SEQ ID NO: 1808014 - RNA, 23 nt, Human
agggucucacuauguugcccagg

SEQ ID NO: 1808015 - RNA, 22 nt, Human
agggucucacuauguugcccag

SEQ ID NO: 1808016 - RNA, 21 nt, Human
agggucucacuauguugccca

SEQ ID NO: 1808017 - RNA, 24 nt, Human
agggguucccuuuuuuggcugcug

SEQ ID NO: 1808018 - RNA, 20 nt, Human
aggggugggacacccuguga

SEQ ID NO: 1808019 - RNA, 22 nt, Human
aggggugggacacccugugaug

SEQ ID NO: 1808020 - RNA, 15 nt, Human
aggggguggccuccc

SEQ ID NO: 1808021 - RNA, 17 nt, Human
aggggguggccucccaa

SEQ ID NO: 1808022 - RNA, 18 nt, Human
aggggguggccucccaac

SEQ ID NO: 1808023 - RNA, 20 nt, Human
uggggucacucuggcagcuc

SEQ ID NO: 1808024 - RNA, 19 nt, Human
uggggucacucuggcagcu

SEQ ID NO: 1808025 - RNA, 18 nt, Human
aggggccuggcagccgug

SEQ ID NO: 1808026 - RNA, 23 nt, Human
aggggccuggcagccgugccuuc

SEQ ID NO: 1808027 - RNA, 15 nt, Human
aggggccuggcagcc

SEQ ID NO: 1808028 - RNA, 23 nt, Human
aggggagcaaaaucgaugcagug

SEQ ID NO: 1808029 - RNA, 16 nt, Human
ugggcaacccccagcc

SEQ ID NO: 1808030 - RNA, 18 nt, Human
ugggaggucaaggcugca

SEQ ID NO: 1808031 - RNA, 19 nt, Human
ugggaggucaaggcugcag

SEQ ID NO: 1808032 - RNA, 20 nt, Human
ugggaggucaaggcugcagu

SEQ ID NO: 1808033 - RNA, 23 nt, Human
ugggaggucaaggcugcagugag

SEQ ID NO: 1808034 - RNA, 17 nt, Human
ugggaggucaaggcugc

SEQ ID NO: 1808035 - RNA, 21 nt, Human
ugggcaacccccagccugcua

SEQ ID NO: 1808036 - RNA, 20 nt, Human
ugggcaacccccagccugcu

SEQ ID NO: 1808037 - RNA, 17 nt, Human
ugggcaacccccagccu

SEQ ID NO: 1808038 - RNA, 17 nt, Human
ugggccagaauuucaaa

SEQ ID NO: 1808039 - RNA, 18 nt, Human
ugggccagaauuucaaac

SEQ ID NO: 1808040 - RNA, 13 nt, Human
ugggccaggagcc

SEQ ID NO: 1808041 - RNA, 20 nt, Human
ugggcccaaugcacuuuguu

SEQ ID NO: 1808042 - RNA, 14 nt, Human
ugggccaggagccu

SEQ ID NO: 1808043 - RNA, 16 nt, Human
ugggccaggagccucc

SEQ ID NO: 1808044 - RNA, 23 nt, Human
agggcccagagaggguggugacc

SEQ ID NO: 1808045 - RNA, 15 nt, Human
agggagggcuucugc

SEQ ID NO: 1808046 - RNA, 19 nt, Human
agggagugacagaggcagc

SEQ ID NO: 1808047 - RNA, 18 nt, Human
agggagugacagaggcag

SEQ ID NO: 1808048 - RNA, 17 nt, Human
agggagugacagaggca

SEQ ID NO: 1808049 - RNA, 17 nt, Human
agggaggugaccccagg

SEQ ID NO: 1808050 - RNA, 23 nt, Human
agggcuucugccauuucugagau

SEQ ID NO: 1808051 - RNA, 18 nt, Human
ugggcucccuucccaccu

SEQ ID NO: 1808052 - RNA, 19 nt, Human
ugggcucccuucccaccuc

SEQ ID NO: 1808053 - RNA, 17 nt, Human
ugggcugcccuggugcu

SEQ ID NO: 1808054 - RNA, 19 nt, Human
ugggcugcccuggugcugc

SEQ ID NO: 1808055 - RNA, 20 nt, Human
ugggcugcccuggugcugcc

SEQ ID NO: 1808056 - RNA, 21 nt, Human
ugggcugcccuggugcugcca

SEQ ID NO: 1808057 - RNA, 20 nt, Human
ugggcucccuucccaccucu

SEQ ID NO: 1808058 - RNA, 21 nt, Human
ugggcucccuucccaccucuc

SEQ ID NO: 1808059 - RNA, 18 nt, Human
ugggcuggguucuaccca

SEQ ID NO: 1808060 - RNA, 19 nt, Human
ugggcuggguucuacccag

SEQ ID NO: 1808061 - RNA, 13 nt, Human
uggggaccucagg

SEQ ID NO: 1808062 - RNA, 17 nt, Human
uggggaccagagcugcc

SEQ ID NO: 1808063 - RNA, 18 nt, Human
uggggaccagagcugcca

SEQ ID NO: 1808064 - RNA, 17 nt, Human
uggggacagagcagaac

SEQ ID NO: 1808065 - RNA, 14 nt, Human
uggggaccagagcu

SEQ ID NO: 1808066 - RNA, 15 nt, Human
uggggaccagagcug

SEQ ID NO: 1808067 - RNA, 14 nt, Human
ugggguacccacug

SEQ ID NO: 1808068 - RNA, 20 nt, Human
uggggcugcaccggcuggcc

SEQ ID NO: 1808069 - RNA, 16 nt, Human
ugggguacccacugcu

SEQ ID NO: 1808070 - RNA, 15 nt, Human
ugggguacccacugc

SEQ ID NO: 1808071 - RNA, 17 nt, Human
uggggucacucuggcag

SEQ ID NO: 1808072 - RNA, 18 nt, Human
uggggucacucuggcagc

SEQ ID NO: 1808073 - RNA, 15 nt, Human
ugggguaugggagag

SEQ ID NO: 1808074 - RNA, 18 nt, Human
uggggcggugagagggga

SEQ ID NO: 1808075 - RNA, 23 nt, Human
uggggcuaggaaauccagggugg

SEQ ID NO: 1808076 - RNA, 15 nt, Human
uggggcccugccucc

SEQ ID NO: 1808077 - RNA, 16 nt, Human
uggggcccugccuccu

SEQ ID NO: 1808078 - RNA, 12 nt, Human
uggggagaaagu

SEQ ID NO: 1808079 - RNA, 23 nt, Human
uggggaccucaggccugggggcu

SEQ ID NO: 1808080 - RNA, 14 nt, Human
uggggcccugccuc

SEQ ID NO: 1808081 - RNA, 22 nt, Human
ugcggacagccacggccaggcc

SEQ ID NO: 1808082 - RNA, 23 nt, Human
ugcggacagccacggccaggcca

SEQ ID NO: 1808083 - RNA, 18 nt, Human
ugcgguccacccaggagc

SEQ ID NO: 1808084 - RNA, 17 nt, Human
ugcggugcuaucucccc

SEQ ID NO: 1808085 - RNA, 21 nt, Human
ugcggugcuaucucccccagc

SEQ ID NO: 1808086 - RNA, 17 nt, Human
ugcgguccacccaggag

SEQ ID NO: 1808087 - RNA, 17 nt, Human
ugcgggucacaggaggg

SEQ ID NO: 1808088 - RNA, 14 nt, Human
ugcgggucacagga

SEQ ID NO: 1808089 - RNA, 16 nt, Human
ugcgggucacaggagg

SEQ ID NO: 1808090 - RNA, 17 nt, Human
ugcggccuuuggcuuca

SEQ ID NO: 1808091 - RNA, 19 nt, Human
ugcggccuuuggcuucacg

SEQ ID NO: 1808092 - RNA, 20 nt, Human
ugcgggcuuccuccuggugu

SEQ ID NO: 1808093 - RNA, 11 nt, Human
ugcuacacacu

SEQ ID NO: 1808094 - RNA, 19 nt, Human
agcuugaccgugaggccag

SEQ ID NO: 1808095 - RNA, 18 nt, Human
agcuuguaaauagcucag

SEQ ID NO: 1808096 - RNA, 22 nt, Human
agcuugaggguugggcuggugu

SEQ ID NO: 1808097 - RNA, 18 nt, Human
agcuugaggguugggcug

SEQ ID NO: 1808098 - RNA, 14 nt, Human
agcuugaggguugg

SEQ ID NO: 1808099 - RNA, 20 nt, Human
agcugccuguucagcuccag

SEQ ID NO: 1808100 - RNA, 14 nt, Human
ugccuggauggggc

SEQ ID NO: 1808101 - RNA, 15 nt, Human
ugccuggauggggcu

SEQ ID NO: 1808102 - RNA, 22 nt, Human
agcugccuguucagcuccagcu

SEQ ID NO: 1808103 - RNA, 21 nt, Human
agcugccuguucagcuccagc

SEQ ID NO: 1808104 - RNA, 21 nt, Human
agcugcuugggcuucauccuc

SEQ ID NO: 1808105 - RNA, 21 nt, Human
agcugcuuuugucuaugggac

SEQ ID NO: 1808106 - RNA, 22 nt, Human
agcuggaucuccauucucucag

SEQ ID NO: 1808107 - RNA, 15 nt, Human
ugccucugccucuga

SEQ ID NO: 1808108 - RNA, 14 nt, Human
ugccucugccucug

SEQ ID NO: 1808109 - RNA, 13 nt, Human
ugccucugccucu

SEQ ID NO: 1808110 - RNA, 14 nt, Human
ugcccaggcagguc

SEQ ID NO: 1808111 - RNA, 13 nt, Human
ugcccaggcaggu

SEQ ID NO: 1808112 - RNA, 12 nt, Human
ugcccaggcagg

SEQ ID NO: 1808113 - RNA, 16 nt, Human
ugccugcccaggcccc

SEQ ID NO: 1808114 - RNA, 15 nt, Human
ugccugcccaggccc

SEQ ID NO: 1808115 - RNA, 14 nt, Human
ugccugcccaggcc

SEQ ID NO: 1808116 - RNA, 15 nt, Human
ugccugcccuauucu

SEQ ID NO: 1808117 - RNA, 20 nt, Human
ugccuguucagcuccagcuc

SEQ ID NO: 1808118 - RNA, 18 nt, Human
ugccuguucagcuccagc

SEQ ID NO: 1808119 - RNA, 13 nt, Human
agcuguucagcug

SEQ ID NO: 1808120 - RNA, 14 nt, Human
agcuguucagcugg

SEQ ID NO: 1808121 - RNA, 14 nt, Human
agcuguuacugucu

SEQ ID NO: 1808122 - RNA, 15 nt, Human
ugccuuauggaacac

SEQ ID NO: 1808123 - RNA, 16 nt, Human
ugccuuauggaacacu

SEQ ID NO: 1808124 - RNA, 21 nt, Human
ugccuguucagcuccagcuca

SEQ ID NO: 1808125 - RNA, 19 nt, Human
ugccuguugggccaggagc

SEQ ID NO: 1808126 - RNA, 20 nt, Human
ugccuguugggccaggagcc

SEQ ID NO: 1808127 - RNA, 15 nt, Human
agcugggacuacagg

SEQ ID NO: 1808128 - RNA, 20 nt, Human
agcugugcucuggacaggca

SEQ ID NO: 1808129 - RNA, 23 nt, Human
agcugugcucuggacaggcaugu

SEQ ID NO: 1808130 - RNA, 21 nt, Human
agcugugcucuggacaggcau

SEQ ID NO: 1808131 - RNA, 14 nt, Human
agcuguguggcagu

SEQ ID NO: 1808132 - RNA, 16 nt, Human
agcuguguggcagucu

SEQ ID NO: 1808133 - RNA, 12 nt, Human
aggaagcucagg

SEQ ID NO: 1808134 - RNA, 23 nt, Human
aggaaggaaacccagcucugguc

SEQ ID NO: 1808135 - RNA, 20 nt, Human
aggaaggaaacccagcucug

SEQ ID NO: 1808136 - RNA, 22 nt, Human
aggaaggaaacccagcucuggu

SEQ ID NO: 1808137 - RNA, 18 nt, Human
aggaagccgcuggggcca

SEQ ID NO: 1808138 - RNA, 19 nt, Human
aggaagccgcuggggccag

SEQ ID NO: 1808139 - RNA, 20 nt, Human
aggaagccgcuggggccagu

SEQ ID NO: 1808140 - RNA, 22 nt, Human
aggaagcacaugccucucucag

SEQ ID NO: 1808141 - RNA, 21 nt, Human
aggaagccagcaggcucucag

SEQ ID NO: 1808142 - RNA, 22 nt, Human
aggaagccagcaggcucucagg

SEQ ID NO: 1808143 - RNA, 23 nt, Human
aggaagccagcaggcucucaggc

SEQ ID NO: 1808144 - RNA, 21 nt, Human
ugcugacuguacuccucccag

SEQ ID NO: 1808145 - RNA, 22 nt, Human
ugcugacuguacuccucccagg

SEQ ID NO: 1808146 - RNA, 16 nt, Human
ugcugacuguuuucuc

SEQ ID NO: 1808147 - RNA, 13 nt, Human
aggaaaggcucca

SEQ ID NO: 1808148 - RNA, 14 nt, Human
aggaaaggcuccag

SEQ ID NO: 1808149 - RNA, 15 nt, Human
aggaaaggcuccagg

SEQ ID NO: 1808150 - RNA, 16 nt, Human
aggaaaggcuccagga

SEQ ID NO: 1808151 - RNA, 14 nt, Human
aggaaauccagggu

SEQ ID NO: 1808152 - RNA, 11 nt, Human
aggaagcacau

SEQ ID NO: 1808153 - RNA, 16 nt, Human
aggaagcacaugccuc

SEQ ID NO: 1808154 - RNA, 17 nt, Human
aggaagcacaugccucu

SEQ ID NO: 1808155 - RNA, 15 nt, Human
aggaaaucaccgaaa

SEQ ID NO: 1808156 - RNA, 19 nt, Human
aggaaaucaccgaaaacgu

SEQ ID NO: 1808157 - RNA, 14 nt, Human
ugcucuggacaggc

SEQ ID NO: 1808158 - RNA, 16 nt, Human
ugcucuggacaggcau

SEQ ID NO: 1808159 - RNA, 15 nt, Human
ugcucuggacaggca

SEQ ID NO: 1808160 - RNA, 16 nt, Human
ugcugacuguacuccu

SEQ ID NO: 1808161 - RNA, 19 nt, Human
ugcugacuguacuccuccc

SEQ ID NO: 1808162 - RNA, 20 nt, Human
ugcuaucucccccagcccca

SEQ ID NO: 1808163 - RNA, 21 nt, Human
agcuuuaaugauaugcuugua

SEQ ID NO: 1808164 - RNA, 19 nt, Human
ugcuaucucccccagcccc

SEQ ID NO: 1808165 - RNA, 13 nt, Human
ugcugcccugccc

SEQ ID NO: 1808166 - RNA, 16 nt, Human
ugcugcccugcccacc

SEQ ID NO: 1808167 - RNA, 17 nt, Human
ugcugcccugcccaccu

SEQ ID NO: 1808168 - RNA, 18 nt, Human
ugcugcccugcccaccug

SEQ ID NO: 1808169 - RNA, 11 nt, Human
ugcugcccugu

SEQ ID NO: 1808170 - RNA, 19 nt, Human
ugcugcccugcccaccugg

SEQ ID NO: 1808171 - RNA, 21 nt, Human
ugcugcccugcccaccuggcc

SEQ ID NO: 1808172 - RNA, 17 nt, Human
ugcugggauuacaggug

SEQ ID NO: 1808173 - RNA, 21 nt, Human
ugcugggauuacaagcgugag

SEQ ID NO: 1808174 - RNA, 21 nt, Human
ugcuggcuguuggcugggggc

SEQ ID NO: 1808175 - RNA, 19 nt, Human
ugcuggcuguuggcugggg

SEQ ID NO: 1808176 - RNA, 19 nt, Human
ugcugggauuacaagcgug

SEQ ID NO: 1808177 - RNA, 13 nt, Human
ugcuggcugccuu

SEQ ID NO: 1808178 - RNA, 17 nt, Human
aggacagccccuccucc

SEQ ID NO: 1808179 - RNA, 18 nt, Human
aggacacuaaccacgcug

SEQ ID NO: 1808180 - RNA, 16 nt, Human
ugcuuccagugaggcu

SEQ ID NO: 1808181 - RNA, 12 nt, Human
ugcuucaaggau

SEQ ID NO: 1808182 - RNA, 20 nt, Human
ugcuucaaggauccugagcc

SEQ ID NO: 1808183 - RNA, 21 nt, Human
ugcuucaaggauccugagcca

SEQ ID NO: 1808184 - RNA, 23 nt, Human
ugcuucaaggauccugagccaga

SEQ ID NO: 1808185 - RNA, 17 nt, Human
ugcugucccuuacguga

SEQ ID NO: 1808186 - RNA, 19 nt, Human
ugcugucccuuacgugagu

SEQ ID NO: 1808187 - RNA, 15 nt, Human
ugcugucccuuuucc

SEQ ID NO: 1808188 - RNA, 13 nt, Human
ugcugugcaaaug

SEQ ID NO: 1808189 - RNA, 17 nt, Human
ugcugucccuuuuccuu

SEQ ID NO: 1808190 - RNA, 21 nt, Human
ugcuucaaaaacauucuuaca

SEQ ID NO: 1808191 - RNA, 13 nt, Human
ugcuucaaaaaca

SEQ ID NO: 1808192 - RNA, 12 nt, Human
aggccccugcca

SEQ ID NO: 1808193 - RNA, 17 nt, Human
aggccccgcccaggcuu

SEQ ID NO: 1808194 - RNA, 23 nt, Human
uggccagugugacaaggauugcu

SEQ ID NO: 1808195 - RNA, 16 nt, Human
uggccagguggccacu

SEQ ID NO: 1808196 - RNA, 17 nt, Human
uggccagguggccacuc

SEQ ID NO: 1808197 - RNA, 19 nt, Human
uggccagguggccacucca

SEQ ID NO: 1808198 - RNA, 23 nt, Human
uggccaaagccaaagcuaggccu

SEQ ID NO: 1808199 - RNA, 21 nt, Human
uggccaaagccaaagcuaggc

SEQ ID NO: 1808200 - RNA, 11 nt, Human
uggccaggugg

SEQ ID NO: 1808201 - RNA, 15 nt, Human
uggccagguggccac

SEQ ID NO: 1808202 - RNA, 14 nt, Human
uggccuucggccuc

SEQ ID NO: 1808203 - RNA, 20 nt, Human
aggccugggggcugggcaga

SEQ ID NO: 1808204 - RNA, 12 nt, Human
aggccuggggac

SEQ ID NO: 1808205 - RNA, 18 nt, Human
aggccugggggcugggca

SEQ ID NO: 1808206 - RNA, 18 nt, Human
uggccuggccccucaggg

SEQ ID NO: 1808207 - RNA, 21 nt, Human
uggccuggccccucagggucc

SEQ ID NO: 1808208 - RNA, 18 nt, Human
uggccugagcugggauga

SEQ ID NO: 1808209 - RNA, 13 nt, Human
uggccucuucaga

SEQ ID NO: 1808210 - RNA, 23 nt, Human
uggccgggcgcgguggcucacgc

SEQ ID NO: 1808211 - RNA, 14 nt, Human
uggcccugcccugg

SEQ ID NO: 1808212 - RNA, 13 nt, Human
uggcccacgcacu

SEQ ID NO: 1808213 - RNA, 18 nt, Human
uggcacagggcaguggga

SEQ ID NO: 1808214 - RNA, 14 nt, Human
aggccagagggagu

SEQ ID NO: 1808215 - RNA, 19 nt, Human
aggccacaagacccuugug

SEQ ID NO: 1808216 - RNA, 17 nt, Human
aggccacaagacccuug

SEQ ID NO: 1808217 - RNA, 18 nt, Human
aggccacaagacccuugu

SEQ ID NO: 1808218 - RNA, 17 nt, Human
uggcagccuuggcaaac

SEQ ID NO: 1808219 - RNA, 15 nt, Human
uggcagcucaccucu

SEQ ID NO: 1808220 - RNA, 16 nt, Human
aggccacaagacccuu

SEQ ID NO: 1808221 - RNA, 19 nt, Human
uggcagcucaccucucccu

SEQ ID NO: 1808222 - RNA, 20 nt, Human
aggccagagggagugacaga

SEQ ID NO: 1808223 - RNA, 21 nt, Human
aggcccagagggccugcaagg

SEQ ID NO: 1808224 - RNA, 16 nt, Human
aggccccgcccaggcu

SEQ ID NO: 1808225 - RNA, 17 nt, Human
aggcagccccauucugc

SEQ ID NO: 1808226 - RNA, 16 nt, Human
aggcagccccauucug

SEQ ID NO: 1808227 - RNA, 16 nt, Human
aggccaaaggaagcac

SEQ ID NO: 1808228 - RNA, 18 nt, Human
aggccaaaggaagcacau

SEQ ID NO: 1808229 - RNA, 19 nt, Human
aggccaaaggaagcacaug

SEQ ID NO: 1808230 - RNA, 20 nt, Human
aggccaaaggaagcacaugc

SEQ ID NO: 1808231 - RNA, 16 nt, Human
aggccaaggugggagg

SEQ ID NO: 1808232 - RNA, 20 nt, Human
uggagguacgaaaagagggg

SEQ ID NO: 1808233 - RNA, 15 nt, Human
uggauggaaggggcu

SEQ ID NO: 1808234 - RNA, 14 nt, Human
uggaguauauguca

SEQ ID NO: 1808235 - RNA, 17 nt, Human
uggauuauauuaugaag

SEQ ID NO: 1808236 - RNA, 13 nt, Human
uggauuggauuug

SEQ ID NO: 1808237 - RNA, 21 nt, Human
uggauuguccccgacccuugc

SEQ ID NO: 1808238 - RNA, 13 nt, Human
uggauuguccccg

SEQ ID NO: 1808239 - RNA, 19 nt, Human
aggaucucuugagccuggg

SEQ ID NO: 1808240 - RNA, 17 nt, Human
aggaucucuugagccug

SEQ ID NO: 1808241 - RNA, 18 nt, Human
aggaucucuugagccugg

SEQ ID NO: 1808242 - RNA, 14 nt, Human
uggacacagcucuu

SEQ ID NO: 1808243 - RNA, 13 nt, Human
uggacacagcucu

SEQ ID NO: 1808244 - RNA, 22 nt, Human
uggacacagcucuucuccaggc

SEQ ID NO: 1808245 - RNA, 15 nt, Human
uggacccugaggccc

SEQ ID NO: 1808246 - RNA, 20 nt, Human
uggaccuugaacuggguacu

SEQ ID NO: 1808247 - RNA, 23 nt, Human
uggacacagcucuucuccaggcu

SEQ ID NO: 1808248 - RNA, 16 nt, Human
uggacccugaggccca

SEQ ID NO: 1808249 - RNA, 18 nt, Human
uggacccugaggcccaga

SEQ ID NO: 1808250 - RNA, 19 nt, Human
uggacccugaggcccagag

SEQ ID NO: 1808251 - RNA, 20 nt, Human
uggacccugaggcccagagg

SEQ ID NO: 1808252 - RNA, 21 nt, Human
uggacccugaggcccagaggg

SEQ ID NO: 1808253 - RNA, 23 nt, Human
uggacccuguggaugauaaaaca

SEQ ID NO: 1808254 - RNA, 13 nt, Human
aggcaaucauggu

SEQ ID NO: 1808255 - RNA, 22 nt, Human
aggcacccaccaucaugucugg

SEQ ID NO: 1808256 - RNA, 21 nt, Human
aggcacccaccaucaugucug

SEQ ID NO: 1808257 - RNA, 20 nt, Human
aggcacccaccaucaugucu

SEQ ID NO: 1808258 - RNA, 14 nt, Human
aggcaaugcuggcu

SEQ ID NO: 1808259 - RNA, 20 nt, Human
aggcaccuaccaccacgccc

SEQ ID NO: 1808260 - RNA, 13 nt, Human
uggagaagcggcu

SEQ ID NO: 1808261 - RNA, 22 nt, Human
uggagaagcggcuggcagccca

SEQ ID NO: 1808262 - RNA, 15 nt, Human
uggacugugugcuca

SEQ ID NO: 1808263 - RNA, 14 nt, Human
uggagaacuagaga

SEQ ID NO: 1808264 - RNA, 16 nt, Human
uggaagcacagcuuca

SEQ ID NO: 1808265 - RNA, 17 nt, Human
uggaaaugggcagagca

SEQ ID NO: 1808266 - RNA, 18 nt, Human
uggaaaugggcagagcag

SEQ ID NO: 1808267 - RNA, 23 nt, Human
uggaaggggacacgugacagccg

SEQ ID NO: 1808268 - RNA, 18 nt, Human
uggaaguacuauaauuua

SEQ ID NO: 1808269 - RNA, 13 nt, Human
aggauccugagcc

SEQ ID NO: 1808270 - RNA, 14 nt, Human
aggauccugagcca

SEQ ID NO: 1808271 - RNA, 21 nt, Human
ugcuugaggcaacucaucuua

SEQ ID NO: 1808272 - RNA, 14 nt, Human
ugcuuggaggaagg

SEQ ID NO: 1808273 - RNA, 15 nt, Human
ugcuuggaggaagga

SEQ ID NO: 1808274 - RNA, 16 nt, Human
ugcuuggaggaaggaa

SEQ ID NO: 1808275 - RNA, 15 nt, Human
ugcuuguaacuaaaa

SEQ ID NO: 1808276 - RNA, 13 nt, Human
ugcuuguacauaa

SEQ ID NO: 1808277 - RNA, 12 nt, Human
ugcuuguacaua

SEQ ID NO: 1808278 - RNA, 17 nt, Human
ugcuuuuggucugugug

SEQ ID NO: 1808279 - RNA, 14 nt, Human
ugcuuuuggucugu

SEQ ID NO: 1808280 - RNA, 16 nt, Human
ugcuuugugauuuuug

SEQ ID NO: 1808281 - RNA, 14 nt, Human
ugcuuugugauuuu

SEQ ID NO: 1808282 - RNA, 12 nt, Human
ugcuuugugauu

SEQ ID NO: 1808283 - RNA, 22 nt, Human
ugcuuguacauaaugcgugcau

SEQ ID NO: 1808284 - RNA, 16 nt, Human
ugcuuguacauaaugc

SEQ ID NO: 1808285 - RNA, 14 nt, Human
ugcuuguacauaau

SEQ ID NO: 1808286 - RNA, 23 nt, Human
ugcacuauagccuaggugacaga

SEQ ID NO: 1808287 - RNA, 23 nt, Human
agcccuucuaccuuccugcaaca

SEQ ID NO: 1808288 - RNA, 19 nt, Human
agccguuuguuccccaaga

SEQ ID NO: 1808289 - RNA, 22 nt, Human
agccguggcuucccgcucagcc

SEQ ID NO: 1808290 - RNA, 23 nt, Human
agccguggcuucccgcucagccc

SEQ ID NO: 1808291 - RNA, 14 nt, Human
agccguggcuuccc

SEQ ID NO: 1808292 - RNA, 21 nt, Human
agccguggcuucccgcucagc

SEQ ID NO: 1808293 - RNA, 13 nt, Human
agccguggcuucc

SEQ ID NO: 1808294 - RNA, 16 nt, Human
agccucccaaagugcu

SEQ ID NO: 1808295 - RNA, 18 nt, Human
agccuccaugcugccucc

SEQ ID NO: 1808296 - RNA, 20 nt, Human
agccuccaugcugccuccag

SEQ ID NO: 1808297 - RNA, 20 nt, Human
agccucauguccacugguuc

SEQ ID NO: 1808298 - RNA, 23 nt, Human
agccucagcauccuggcacccgg

SEQ ID NO: 1808299 - RNA, 22 nt, Human
agccucagcauccuggcacccg

SEQ ID NO: 1808300 - RNA, 12 nt, Human
agccucaucucu

SEQ ID NO: 1808301 - RNA, 15 nt, Human
agccucauguccacu

SEQ ID NO: 1808302 - RNA, 21 nt, Human
agccucagcauccuggcaccc

SEQ ID NO: 1808303 - RNA, 20 nt, Human
agccucagcauccuggcacc

SEQ ID NO: 1808304 - RNA, 19 nt, Human
agccucagcauccuggcac

SEQ ID NO: 1808305 - RNA, 17 nt, Human
agccucagcauccuggc

SEQ ID NO: 1808306 - RNA, 17 nt, Human
agccucccaaagugcug

SEQ ID NO: 1808307 - RNA, 22 nt, Human
agccugaaagaggaaugaagua

SEQ ID NO: 1808308 - RNA, 16 nt, Human
ugcagccucacagucc

SEQ ID NO: 1808309 - RNA, 13 nt, Human
ugcagccucacag

SEQ ID NO: 1808310 - RNA, 15 nt, Human
ugcagccucacaguc

SEQ ID NO: 1808311 - RNA, 22 nt, Human
ugcauaacguauaaaagccugu

SEQ ID NO: 1808312 - RNA, 23 nt, Human
ugcauaacguauaaaagccuguu

SEQ ID NO: 1808313 - RNA, 14 nt, Human
ugcauaaguuaacu

SEQ ID NO: 1808314 - RNA, 17 nt, Human
ugcauaaguuaacuucc

SEQ ID NO: 1808315 - RNA, 18 nt, Human
ugcaguacuuuaccuccu

SEQ ID NO: 1808316 - RNA, 12 nt, Human
ugcaggucccua

SEQ ID NO: 1808317 - RNA, 14 nt, Human
ugcaggucccuaau

SEQ ID NO: 1808318 - RNA, 15 nt, Human
ugcaggucccuaaua

SEQ ID NO: 1808319 - RNA, 16 nt, Human
ugcaggucccuaauaa

SEQ ID NO: 1808320 - RNA, 22 nt, Human
agccccuggaugcagccucaca

SEQ ID NO: 1808321 - RNA, 19 nt, Human
agccccuggaugcagccuc

SEQ ID NO: 1808322 - RNA, 17 nt, Human
agccccuggaugcagcc

SEQ ID NO: 1808323 - RNA, 18 nt, Human
agccccuggaugcagccu

SEQ ID NO: 1808324 - RNA, 16 nt, Human
agccccgaggccuucu

SEQ ID NO: 1808325 - RNA, 22 nt, Human
agccccgaggccuucucugaag

SEQ ID NO: 1808326 - RNA, 17 nt, Human
agccccgaggccuucuc

SEQ ID NO: 1808327 - RNA, 24 nt, Human
agccccaaaacucuccucugcugc

SEQ ID NO: 1808328 - RNA, 21 nt, Human
agccccaaaacucuccucugc

SEQ ID NO: 1808329 - RNA, 22 nt, Human
agccccaaaacucuccucugcu

SEQ ID NO: 1808330 - RNA, 20 nt, Human
agccccaaaacucuccucug

SEQ ID NO: 1808331 - RNA, 18 nt, Human
agcccauggcacucuaug

SEQ ID NO: 1808332 - RNA, 20 nt, Human
ugauucuccugccucagccu

SEQ ID NO: 1808333 - RNA, 19 nt, Human
ugauucuccugccucagcc

SEQ ID NO: 1808334 - RNA, 15 nt, Human
ugauucuccugccuc

SEQ ID NO: 1808335 - RNA, 23 nt, Human
agcccugguggcagugggagcug

SEQ ID NO: 1808336 - RNA, 22 nt, Human
agcccugguggcagugggagcu

SEQ ID NO: 1808337 - RNA, 15 nt, Human
ugcacaagcugcacc

SEQ ID NO: 1808338 - RNA, 12 nt, Human
ugcacacagcac

SEQ ID NO: 1808339 - RNA, 24 nt, Human
ugcacacagcacgggggccaagga

SEQ ID NO: 1808340 - RNA, 18 nt, Human
ugcacaagcugcacccuc

SEQ ID NO: 1808341 - RNA, 21 nt, Human
ugcacaagcugcacccucagg

SEQ ID NO: 1808342 - RNA, 21 nt, Human
agcccugguggcagugggagc

SEQ ID NO: 1808343 - RNA, 22 nt, Human
agcccugcuuugggcugcccug

SEQ ID NO: 1808344 - RNA, 23 nt, Human
agcccugcuuugggcugcccugg

SEQ ID NO: 1808345 - RNA, 21 nt, Human
agcccugcuuugggcugcccu

SEQ ID NO: 1808346 - RNA, 20 nt, Human
agccccuucugacccaugcu

SEQ ID NO: 1808347 - RNA, 24 nt, Human
agccccuucugacccaugcugccc

SEQ ID NO: 1808348 - RNA, 15 nt, Human
ugcacgugugugcac

SEQ ID NO: 1808349 - RNA, 14 nt, Human
ugcacgugugugca

SEQ ID NO: 1808350 - RNA, 16 nt, Human
ugcacccucaggcagg

SEQ ID NO: 1808351 - RNA, 17 nt, Human
ugcacccucaggcaggu

SEQ ID NO: 1808352 - RNA, 20 nt, Human
ugcacacauuuuuuaaaugc

SEQ ID NO: 1808353 - RNA, 10 nt, Human
ugcacacauu

SEQ ID NO: 1808354 - RNA, 16 nt, Human
ugcccacaggaucagu

SEQ ID NO: 1808355 - RNA, 19 nt, Human
ugcccacaggaucagucug

SEQ ID NO: 1808356 - RNA, 20 nt, Human
ugcccacaggaucagucuga

SEQ ID NO: 1808357 - RNA, 21 nt, Human
ugcccagccccuucugaccca

SEQ ID NO: 1808358 - RNA, 20 nt, Human
ugcccagccccuucugaccc

SEQ ID NO: 1808359 - RNA, 22 nt, Human
ugcccaagaauagaugcugacu

SEQ ID NO: 1808360 - RNA, 23 nt, Human
ugcccaagaauagaugcugacug

SEQ ID NO: 1808361 - RNA, 21 nt, Human
ugcccaagaauagaugcugac

SEQ ID NO: 1808362 - RNA, 21 nt, Human
agcucauucuccuuguguuac

SEQ ID NO: 1808363 - RNA, 20 nt, Human
agcucauucuccuuguguua

SEQ ID NO: 1808364 - RNA, 21 nt, Human
agcucaggugucccugcacuu

SEQ ID NO: 1808365 - RNA, 20 nt, Human
agcucaggugucccugcacu

SEQ ID NO: 1808366 - RNA, 22 nt, Human
agcucaggugucccugcacuug

SEQ ID NO: 1808367 - RNA, 18 nt, Human
agcucaggugucccugca

SEQ ID NO: 1808368 - RNA, 15 nt, Human
agcuaggccuggcca

SEQ ID NO: 1808369 - RNA, 14 nt, Human
agcuaggccuggcc

SEQ ID NO: 1808370 - RNA, 16 nt, Human
agcuaggccuggccag

SEQ ID NO: 1808371 - RNA, 12 nt, Human
agcuaggccugg

SEQ ID NO: 1808372 - RNA, 18 nt, Human
agcuaggaauuguguuua

SEQ ID NO: 1808373 - RNA, 19 nt, Human
agcuacuaauuuuaaaaug

SEQ ID NO: 1808374 - RNA, 22 nt, Human
agcgugagccacugcaccgggc

SEQ ID NO: 1808375 - RNA, 15 nt, Human
agcgugcauaaguua

SEQ ID NO: 1808376 - RNA, 19 nt, Human
agcgugagccacugcaccg

SEQ ID NO: 1808377 - RNA, 22 nt, Human
ugccacacuucaggcucuucuc

SEQ ID NO: 1808378 - RNA, 23 nt, Human
ugccacacuucaggcucuucucc

SEQ ID NO: 1808379 - RNA, 18 nt, Human
agcuagacgagcaggcuu

SEQ ID NO: 1808380 - RNA, 12 nt, Human
agcuagaaauga

SEQ ID NO: 1808381 - RNA, 11 nt, Human
agcuagaaaug

SEQ ID NO: 1808382 - RNA, 18 nt, Human
agcuacuugggaggcuga

SEQ ID NO: 1808383 - RNA, 17 nt, Human
agcuacuugggaggcug

SEQ ID NO: 1808384 - RNA, 12 nt, Human
ugcauaccacuu

SEQ ID NO: 1808385 - RNA, 14 nt, Human
ugcauaccacuuuu

SEQ ID NO: 1808386 - RNA, 15 nt, Human
agccugcuccagcug

SEQ ID NO: 1808387 - RNA, 16 nt, Human
agccugcuccagcugu

SEQ ID NO: 1808388 - RNA, 17 nt, Human
agccugcuccagcuguu

SEQ ID NO: 1808389 - RNA, 22 nt, Human
agccugggugacagagcaagug

SEQ ID NO: 1808390 - RNA, 19 nt, Human
agccugcuccagcuguuca

SEQ ID NO: 1808391 - RNA, 22 nt, Human
agccugcuccagcuguucagcu

SEQ ID NO: 1808392 - RNA, 13 nt, Human
agccuguuuaaga

SEQ ID NO: 1808393 - RNA, 21 nt, Human
agccugugccucugggacugg

SEQ ID NO: 1808394 - RNA, 22 nt, Human
ugcauuaucuagauacuguauc

SEQ ID NO: 1808395 - RNA, 21 nt, Human
ugcauuaucuagauacuguau

SEQ ID NO: 1808396 - RNA, 13 nt, Human
ugccacacuucag

SEQ ID NO: 1808397 - RNA, 14 nt, Human
ugccacacuucagg

SEQ ID NO: 1808398 - RNA, 15 nt, Human
ugccacacuucaggc

SEQ ID NO: 1808399 - RNA, 16 nt, Human
ugccacacuucaggcu

SEQ ID NO: 1808400 - RNA, 21 nt, Human
ugccaauaauaauaccucccu

SEQ ID NO: 1808401 - RNA, 22 nt, Human
ugccaauaauaauaccucccuu

SEQ ID NO: 1808402 - RNA, 11 nt, Human
agccuuccagg

SEQ ID NO: 1808403 - RNA, 14 nt, Human
agccuuccaggggu

SEQ ID NO: 1808404 - RNA, 16 nt, Human
agccuuccaggggugg

SEQ ID NO: 1808405 - RNA, 17 nt, Human
agccuuccagggguggg

SEQ ID NO: 1808406 - RNA, 18 nt, Human
agcggagacggaguccca

SEQ ID NO: 1808407 - RNA, 20 nt, Human
agcggagaaaggaagggcug

SEQ ID NO: 1808408 - RNA, 20 nt, Human
ugcauuaucuagauacugua

SEQ ID NO: 1808409 - RNA, 16 nt, Human
agcggagaaaggaagg

SEQ ID NO: 1808410 - RNA, 23 nt, Human
agccaguaaaugggggugcauuu

SEQ ID NO: 1808411 - RNA, 12 nt, Human
agccagggucuc

SEQ ID NO: 1808412 - RNA, 21 nt, Human
agccaggccacaagacccuug

SEQ ID NO: 1808413 - RNA, 22 nt, Human
agccaggccacaagacccuugu

SEQ ID NO: 1808414 - RNA, 12 nt, Human
agccaggccaca

SEQ ID NO: 1808415 - RNA, 14 nt, Human
agccaggccacaag

SEQ ID NO: 1808416 - RNA, 22 nt, Human
agcccacuucugccauauucug

SEQ ID NO: 1808417 - RNA, 19 nt, Human
agcccaggaaaggcuccag

SEQ ID NO: 1808418 - RNA, 20 nt, Human
agcccaggaaaggcuccagg

SEQ ID NO: 1808419 - RNA, 21 nt, Human
agcccaggaaaggcuccagga

SEQ ID NO: 1808420 - RNA, 15 nt, Human
ugauucauaaugacu

SEQ ID NO: 1808421 - RNA, 13 nt, Human
ugauucagcucug

SEQ ID NO: 1808422 - RNA, 14 nt, Human
ugauucagcucugc

SEQ ID NO: 1808423 - RNA, 24 nt, Human
agcccaggaaaggcuccaggagca

SEQ ID NO: 1808424 - RNA, 22 nt, Human
agcccaggaaaggcuccaggag

SEQ ID NO: 1808425 - RNA, 23 nt, Human
agcccaggaaaggcuccaggagc

SEQ ID NO: 1808426 - RNA, 18 nt, Human
ugauucccaagcucugcu

SEQ ID NO: 1808427 - RNA, 16 nt, Human
ugauucccaagcucug

SEQ ID NO: 1808428 - RNA, 15 nt, Human
ugauucccaagcucu

SEQ ID NO: 1808429 - RNA, 21 nt, Human
ugauucccaagcucugcuccu

SEQ ID NO: 1808430 - RNA, 19 nt, Human
ugauucccaagcucugcuc

SEQ ID NO: 1808431 - RNA, 18 nt, Human
ugauguuuuaaggaugcu

SEQ ID NO: 1808432 - RNA, 17 nt, Human
ugauguuuuaaggaugc

SEQ ID NO: 1808433 - RNA, 14 nt, Human
ugaugauccuaggc

SEQ ID NO: 1808434 - RNA, 20 nt, Human
ugaugauccuaggcauuugc

SEQ ID NO: 1808435 - RNA, 17 nt, Human
ugauggugcaaugaccu

SEQ ID NO: 1808436 - RNA, 23 nt, Human
ugauggugcaaugaccuuucaau

SEQ ID NO: 1808437 - RNA, 16 nt, Human
ugauggugcaaugacc

SEQ ID NO: 1808438 - RNA, 22 nt, Human
agccacugcaccgggccacaga

SEQ ID NO: 1808439 - RNA, 21 nt, Human
agccacugcaccgggccacag

SEQ ID NO: 1808440 - RNA, 13 nt, Human
agccacugcaccg

SEQ ID NO: 1808441 - RNA, 22 nt, Human
ugauuaaagaugagcuuugucu

SEQ ID NO: 1808442 - RNA, 15 nt, Human
ugauuaaagaugagc

SEQ ID NO: 1808443 - RNA, 15 nt, Human
ugauuaauuaaaaca

SEQ ID NO: 1808444 - RNA, 12 nt, Human
ugauuaaaccaa

SEQ ID NO: 1808445 - RNA, 14 nt, Human
ugauuaccagggac

SEQ ID NO: 1808446 - RNA, 15 nt, Human
agccacggccaggcc

SEQ ID NO: 1808447 - RNA, 18 nt, Human
ugauccuuuuggagucag

SEQ ID NO: 1808448 - RNA, 13 nt, Human
ugaugaagaggag

SEQ ID NO: 1808449 - RNA, 14 nt, Human
ugaugaagaggagu

SEQ ID NO: 1808450 - RNA, 14 nt, Human
agccacauuccuga

SEQ ID NO: 1808451 - RNA, 18 nt, Human
agccacauuccugaugcu

SEQ ID NO: 1808452 - RNA, 19 nt, Human
agccaccaacauacuccca

SEQ ID NO: 1808453 - RNA, 20 nt, Human
agccaccaacauacucccau

SEQ ID NO: 1808454 - RNA, 23 nt, Human
agccaccaacauacucccaucug

SEQ ID NO: 1808455 - RNA, 14 nt, Human
agccacggccaggc

SEQ ID NO: 1808456 - RNA, 18 nt, Human
agccaccgugccuggcca

SEQ ID NO: 1808457 - RNA, 22 nt, Human
ugaguaacugauuuguaacaag

SEQ ID NO: 1808458 - RNA, 15 nt, Human
ugaguacuacagucc

SEQ ID NO: 1808459 - RNA, 14 nt, Human
agcauauucaggaa

SEQ ID NO: 1808460 - RNA, 13 nt, Human
ugaguagcuggau

SEQ ID NO: 1808461 - RNA, 13 nt, Human
ugaguagcuggga

SEQ ID NO: 1808462 - RNA, 17 nt, Human
ugaguacuacaguccuc

SEQ ID NO: 1808463 - RNA, 21 nt, Human
ugaguacuacaguccucccau

SEQ ID NO: 1808464 - RNA, 22 nt, Human
ugaguacuacaguccucccauc

SEQ ID NO: 1808465 - RNA, 23 nt, Human
ugaguacuacaguccucccaucu

SEQ ID NO: 1808466 - RNA, 12 nt, Human
ugagaauuaccc

SEQ ID NO: 1808467 - RNA, 21 nt, Human
agcauaauacuugcuuuggaa

SEQ ID NO: 1808468 - RNA, 15 nt, Human
agcauacguacacau

SEQ ID NO: 1808469 - RNA, 21 nt, Human
agcauacguacacauuuuauu

SEQ ID NO: 1808470 - RNA, 20 nt, Human
agcauacguacacauuuuau

SEQ ID NO: 1808471 - RNA, 19 nt, Human
agcauacguacacauuuua

SEQ ID NO: 1808472 - RNA, 18 nt, Human
agcauacguacacauuuu

SEQ ID NO: 1808473 - RNA, 17 nt, Human
agcauacguacacauuu

SEQ ID NO: 1808474 - RNA, 16 nt, Human
agcauacguacacauu

SEQ ID NO: 1808475 - RNA, 17 nt, Human
ugaguucauacccuguu

SEQ ID NO: 1808476 - RNA, 20 nt, Human
ugauaagaaccuuuugagug

SEQ ID NO: 1808477 - RNA, 21 nt, Human
ugauacaaugcugugcccuaa

SEQ ID NO: 1808478 - RNA, 20 nt, Human
ugauacaaugcugugcccua

SEQ ID NO: 1808479 - RNA, 17 nt, Human
ugauacuacaguuuguu

SEQ ID NO: 1808480 - RNA, 14 nt, Human
ugauacuacaguuu

SEQ ID NO: 1808481 - RNA, 21 nt, Human
ugagugggugaauaauacagu

SEQ ID NO: 1808482 - RNA, 17 nt, Human
ugagucaccaagcccag

SEQ ID NO: 1808483 - RNA, 16 nt, Human
ugagucaccaagccca

SEQ ID NO: 1808484 - RNA, 17 nt, Human
ugagugccuuacacaau

SEQ ID NO: 1808485 - RNA, 20 nt, Human
ugagugccuuacacaauggu

SEQ ID NO: 1808486 - RNA, 14 nt, Human
ugagucaccaagcc

SEQ ID NO: 1808487 - RNA, 17 nt, Human
agcaugucgucaaagcu

SEQ ID NO: 1808488 - RNA, 20 nt, Human
agcaugucgucaaagcugaa

SEQ ID NO: 1808489 - RNA, 12 nt, Human
agcauggcugcc

SEQ ID NO: 1808490 - RNA, 14 nt, Human
agcaucaggccagg

SEQ ID NO: 1808491 - RNA, 16 nt, Human
agcaucaggccaggcc

SEQ ID NO: 1808492 - RNA, 17 nt, Human
agcaucaggccaggccc

SEQ ID NO: 1808493 - RNA, 18 nt, Human
agcaucaggccaggcccu

SEQ ID NO: 1808494 - RNA, 19 nt, Human
agcaucaggccaggcccuc

SEQ ID NO: 1808495 - RNA, 20 nt, Human
agcaucaggccaggcccucu

SEQ ID NO: 1808496 - RNA, 17 nt, Human
agcauuguaaaagcauu

SEQ ID NO: 1808497 - RNA, 19 nt, Human
ugaucacggcucacugcag

SEQ ID NO: 1808498 - RNA, 20 nt, Human
agcaucacaugaacuuguaa

SEQ ID NO: 1808499 - RNA, 13 nt, Human
agcaucaggccag

SEQ ID NO: 1808500 - RNA, 21 nt, Human
ugaucacggcucacugcagcc

SEQ ID NO: 1808501 - RNA, 20 nt, Human
ugaucacggcucacugcagc

SEQ ID NO: 1808502 - RNA, 22 nt, Human
agcauauucaggaagcucaggg

SEQ ID NO: 1808503 - RNA, 19 nt, Human
ugauauguugguagauucu

SEQ ID NO: 1808504 - RNA, 19 nt, Human
ugauauuuucaacgcagcc

SEQ ID NO: 1808505 - RNA, 21 nt, Human
ugauauuuucaacgcagcccu

SEQ ID NO: 1808506 - RNA, 22 nt, Human
ugauauuuucaacgcagcccug

SEQ ID NO: 1808507 - RNA, 23 nt, Human
ugauauuuucaacgcagcccugc

SEQ ID NO: 1808508 - RNA, 18 nt, Human
ugaccugaggcccuucuc

SEQ ID NO: 1808509 - RNA, 19 nt, Human
ugaccugaggcccuucucu

SEQ ID NO: 1808510 - RNA, 16 nt, Human
ugaccuuaaaugcaac

SEQ ID NO: 1808511 - RNA, 14 nt, Human
ugaccuuaaaugca

SEQ ID NO: 1808512 - RNA, 16 nt, Human
ugacuuacuguacaug

SEQ ID NO: 1808513 - RNA, 15 nt, Human
ugacuuacuguacau

SEQ ID NO: 1808514 - RNA, 13 nt, Human
ugacuuacuguac

SEQ ID NO: 1808515 - RNA, 14 nt, Human
ugacccaugcugcc

SEQ ID NO: 1808516 - RNA, 15 nt, Human
ugacccaugcugccc

SEQ ID NO: 1808517 - RNA, 21 nt, Human
ugacccaugcugcccugugag

SEQ ID NO: 1808518 - RNA, 13 nt, Human
agauuaagaaaua

SEQ ID NO: 1808519 - RNA, 16 nt, Human
ugacccaugcugcccu

SEQ ID NO: 1808520 - RNA, 16 nt, Human
agaugccgcauuugga

SEQ ID NO: 1808521 - RNA, 20 nt, Human
agaugcugacuguacuccuc

SEQ ID NO: 1808522 - RNA, 23 nt, Human
agaugcugacuguacuccuccca

SEQ ID NO: 1808523 - RNA, 16 nt, Human
ugacacuuaaaaaugg

SEQ ID NO: 1808524 - RNA, 17 nt, Human
ugacacuuaaaaauggu

SEQ ID NO: 1808525 - RNA, 21 nt, Human
agauuuugaaauuuuuauuaa

SEQ ID NO: 1808526 - RNA, 17 nt, Human
agauuugaacucuucaa

SEQ ID NO: 1808527 - RNA, 20 nt, Human
agauuucucauuugccaaua

SEQ ID NO: 1808528 - RNA, 18 nt, Human
agauuccagagaguggcu

SEQ ID NO: 1808529 - RNA, 22 nt, Human
agauucauauuuacuucuuaua

SEQ ID NO: 1808530 - RNA, 19 nt, Human
ugacuuacuguacaugaaa

SEQ ID NO: 1808531 - RNA, 19 nt, Human
agauuccagagaguggcuc

SEQ ID NO: 1808532 - RNA, 13 nt, Human
agauuggaaggaa

SEQ ID NO: 1808533 - RNA, 13 nt, Human
agcaagacgcugu

SEQ ID NO: 1808534 - RNA, 16 nt, Human
agcaagacgcugugcu

SEQ ID NO: 1808535 - RNA, 20 nt, Human
ugagaagcagaggaaggaga

SEQ ID NO: 1808536 - RNA, 14 nt, Human
agcaagauuucaga

SEQ ID NO: 1808537 - RNA, 23 nt, Human
agcaagacgcugugcugcccugc

SEQ ID NO: 1808538 - RNA, 17 nt, Human
agcaagacgcugugcug

SEQ ID NO: 1808539 - RNA, 20 nt, Human
agcaagacgcugugcugccc

SEQ ID NO: 1808540 - RNA, 21 nt, Human
agcaagacgcugugcugcccu

SEQ ID NO: 1808541 - RNA, 22 nt, Human
agcaagacgcugugcugcccug

SEQ ID NO: 1808542 - RNA, 23 nt, Human
ugaauuugugaagguggaaauaa

SEQ ID NO: 1808543 - RNA, 23 nt, Human
ugaauuucuuuugccguuauuaa

SEQ ID NO: 1808544 - RNA, 13 nt, Human
ugaauuugugaag

SEQ ID NO: 1808545 - RNA, 21 nt, Human
ugaauuugugaagguggaaau

SEQ ID NO: 1808546 - RNA, 20 nt, Human
ugacacaugcaaggucauuu

SEQ ID NO: 1808547 - RNA, 12 nt, Human
ugacacaugcaa

SEQ ID NO: 1808548 - RNA, 18 nt, Human
ugacacacagcucugucc

SEQ ID NO: 1808549 - RNA, 16 nt, Human
ugacacacagcucugu

SEQ ID NO: 1808550 - RNA, 19 nt, Human
ugacaaagacugaguacgu

SEQ ID NO: 1808551 - RNA, 20 nt, Human
ugacacacagcucuguccug

SEQ ID NO: 1808552 - RNA, 19 nt, Human
ugacacacagcucuguccu

SEQ ID NO: 1808553 - RNA, 23 nt, Human
ugacacagucuuggcucacugca

SEQ ID NO: 1808554 - RNA, 22 nt, Human
ugacacagucuuggcucacugc

SEQ ID NO: 1808555 - RNA, 17 nt, Human
agauaaggguaucuggu

SEQ ID NO: 1808556 - RNA, 20 nt, Human
agaguuguuacauuuuuaag

SEQ ID NO: 1808557 - RNA, 19 nt, Human
agaguuguuacauuuuuaa

SEQ ID NO: 1808558 - RNA, 17 nt, Human
agaguuguuacauuuuu

SEQ ID NO: 1808559 - RNA, 22 nt, Human
agagucagaaguuucugccgca

SEQ ID NO: 1808560 - RNA, 15 nt, Human
agagucacuggaaca

SEQ ID NO: 1808561 - RNA, 22 nt, Human
agauacaguuacucagaauucu

SEQ ID NO: 1808562 - RNA, 11 nt, Human
agauacuguau

SEQ ID NO: 1808563 - RNA, 20 nt, Human
agauacaggaaaagcugcug

SEQ ID NO: 1808564 - RNA, 13 nt, Human
agauacaguuacu

SEQ ID NO: 1808565 - RNA, 18 nt, Human
agauaauauuaaggaaga

SEQ ID NO: 1808566 - RNA, 22 nt, Human
agauaauauuaaggaagacaau

SEQ ID NO: 1808567 - RNA, 16 nt, Human
agauacuguaucauga

SEQ ID NO: 1808568 - RNA, 15 nt, Human
agauacuguaucaug

SEQ ID NO: 1808569 - RNA, 18 nt, Human
agaucaaaagguuaauaa

SEQ ID NO: 1808570 - RNA, 21 nt, Human
agauauuuugcuuugugauuu

SEQ ID NO: 1808571 - RNA, 20 nt, Human
agauauuuugcuuugugauu

SEQ ID NO: 1808572 - RNA, 14 nt, Human
ugaagucacacagu

SEQ ID NO: 1808573 - RNA, 14 nt, Human
ugaagucacugcac

SEQ ID NO: 1808574 - RNA, 15 nt, Human
ugaagucacugcaca

SEQ ID NO: 1808575 - RNA, 16 nt, Human
ugaagucacugcacag

SEQ ID NO: 1808576 - RNA, 21 nt, Human
ugaagucacugcacagugcau

SEQ ID NO: 1808577 - RNA, 16 nt, Human
ugaauaaagacaccua

SEQ ID NO: 1808578 - RNA, 15 nt, Human
ugaauacuuuauaaa

SEQ ID NO: 1808579 - RNA, 18 nt, Human
ugaauauugccauuaugc

SEQ ID NO: 1808580 - RNA, 16 nt, Human
ugaauauugccauuau

SEQ ID NO: 1808581 - RNA, 15 nt, Human
agagguuaagguggg

SEQ ID NO: 1808582 - RNA, 16 nt, Human
agagguggggagcaga

SEQ ID NO: 1808583 - RNA, 20 nt, Human
ugaagcuaucguaaaauuaa

SEQ ID NO: 1808584 - RNA, 12 nt, Human
ugaagccuuugu

SEQ ID NO: 1808585 - RNA, 14 nt, Human
agaggcugucuguu

SEQ ID NO: 1808586 - RNA, 20 nt, Human
agagggagggagggcuccag

SEQ ID NO: 1808587 - RNA, 16 nt, Human
agagggagggagggcu

SEQ ID NO: 1808588 - RNA, 21 nt, Human
ucuuccaggcugggagagccu

SEQ ID NO: 1808589 - RNA, 20 nt, Human
ucuucagagacuccugcagg

SEQ ID NO: 1808590 - RNA, 15 nt, Human
ucuuccaggcuggga

SEQ ID NO: 1808591 - RNA, 17 nt, Human
ucuuccaggcugggaga

SEQ ID NO: 1808592 - RNA, 20 nt, Human
ucuuccaggcugggagagcc

SEQ ID NO: 1808593 - RNA, 17 nt, Human
ucuucagagacuccugc

SEQ ID NO: 1808594 - RNA, 18 nt, Human
ucuucagagacuccugca

SEQ ID NO: 1808595 - RNA, 12 nt, Human
ucuucagagacu

SEQ ID NO: 1808596 - RNA, 16 nt, Human
ucuucaacugaccagc

SEQ ID NO: 1808597 - RNA, 19 nt, Human
ucuucaacugaccagccuc

SEQ ID NO: 1808598 - RNA, 15 nt, Human
ucuucaacucccugc

SEQ ID NO: 1808599 - RNA, 14 nt, Human
agaaucacuugaac

SEQ ID NO: 1808600 - RNA, 11 nt, Human
ucuuccucugc

SEQ ID NO: 1808601 - RNA, 12 nt, Human
ucuuccucugcu

SEQ ID NO: 1808602 - RNA, 14 nt, Human
ucuuccucugcuga

SEQ ID NO: 1808603 - RNA, 15 nt, Human
ucuuccucccucccu

SEQ ID NO: 1808604 - RNA, 14 nt, Human
ucuuccucccuccc

SEQ ID NO: 1808605 - RNA, 19 nt, Human
ucuucccuacaguugaaaa

SEQ ID NO: 1808606 - RNA, 22 nt, Human
ucuucccuacaguugaaaaaca

SEQ ID NO: 1808607 - RNA, 18 nt, Human
agacaucaacagauaaau

SEQ ID NO: 1808608 - RNA, 17 nt, Human
agacaucaacagauaaa

SEQ ID NO: 1808609 - RNA, 19 nt, Human
agacauacuaaccagcaga

SEQ ID NO: 1808610 - RNA, 21 nt, Human
agacauagaauuaacacauga

SEQ ID NO: 1808611 - RNA, 20 nt, Human
ucuucuguacgucugacagg

SEQ ID NO: 1808612 - RNA, 15 nt, Human
ucuucuguacgucug

SEQ ID NO: 1808613 - RNA, 18 nt, Human
ucuucuggguuccuuccu

SEQ ID NO: 1808614 - RNA, 20 nt, Human
ucuucuguggguuucuaaag

SEQ ID NO: 1808615 - RNA, 19 nt, Human
ucuucugcuucagccuccc

SEQ ID NO: 1808616 - RNA, 12 nt, Human
ucuucugcuuca

SEQ ID NO: 1808617 - RNA, 21 nt, Human
ucuucugaacuuggcgcugcc

SEQ ID NO: 1808618 - RNA, 23 nt, Human
ucuugcaauggcagccuuggcaa

SEQ ID NO: 1808619 - RNA, 22 nt, Human
ucuugcaauggcagccuuggca

SEQ ID NO: 1808620 - RNA, 18 nt, Human
ucuugcaauggcagccuu

SEQ ID NO: 1808621 - RNA, 19 nt, Human
ucuugcaauggcagccuug

SEQ ID NO: 1808622 - RNA, 17 nt, Human
ucuuggucagauuugaa

SEQ ID NO: 1808623 - RNA, 14 nt, Human
ucuugguccugcug

SEQ ID NO: 1808624 - RNA, 21 nt, Human
ucuuuauuaaauguagaaagu

SEQ ID NO: 1808625 - RNA, 17 nt, Human
ucuuuauuaaauguaga

SEQ ID NO: 1808626 - RNA, 16 nt, Human
ucuuuaugauuuuuaa

SEQ ID NO: 1808627 - RNA, 18 nt, Human
ucuuucuaaugugugaau

SEQ ID NO: 1808628 - RNA, 15 nt, Human
ucuuucucugaggac

SEQ ID NO: 1808629 - RNA, 13 nt, Human
ucuuucucugagg

SEQ ID NO: 1808630 - RNA, 19 nt, Human
ucuuucuaaugugugaauc

SEQ ID NO: 1808631 - RNA, 17 nt, Human
ucuuuccugaggcuggg

SEQ ID NO: 1808632 - RNA, 15 nt, Human
ucuugguccugcugc

SEQ ID NO: 1808633 - RNA, 17 nt, Human
ucuugguccugcugcag

SEQ ID NO: 1808634 - RNA, 19 nt, Human
ucuugguccugcugcaguu

SEQ ID NO: 1808635 - RNA, 16 nt, Human
ucuugagccuugaacu

SEQ ID NO: 1808636 - RNA, 13 nt, Human
ucuugagccuggg

SEQ ID NO: 1808637 - RNA, 16 nt, Human
ucuugagccugggagg

SEQ ID NO: 1808638 - RNA, 13 nt, Human
ucuugauucauaa

SEQ ID NO: 1808639 - RNA, 21 nt, Human
ucuugaugccuggcggggugg

SEQ ID NO: 1808640 - RNA, 11 nt, Human
agaccuucucc

SEQ ID NO: 1808641 - RNA, 15 nt, Human
agaccuucuccuuca

SEQ ID NO: 1808642 - RNA, 18 nt, Human
agaccuucuccuucaccu

SEQ ID NO: 1808643 - RNA, 21 nt, Human
agaccuucuccuucaccuuug

SEQ ID NO: 1808644 - RNA, 23 nt, Human
agaccuucuccuucaccuuuguc

SEQ ID NO: 1808645 - RNA, 17 nt, Human
ugaaacuccagaugcca

SEQ ID NO: 1808646 - RNA, 19 nt, Human
ugaaacuccagaugccaca

SEQ ID NO: 1808647 - RNA, 18 nt, Human
ugaaacuccagaugccac

SEQ ID NO: 1808648 - RNA, 20 nt, Human
ugaaaaucuuauaauuuaaa

SEQ ID NO: 1808649 - RNA, 19 nt, Human
ugaaaaucgugacaacacu

SEQ ID NO: 1808650 - RNA, 17 nt, Human
ugaaaauguauguguaa

SEQ ID NO: 1808651 - RNA, 16 nt, Human
ugaaacgcaaccacca

SEQ ID NO: 1808652 - RNA, 16 nt, Human
ugaaaaucgugacaac

SEQ ID NO: 1808653 - RNA, 20 nt, Human
ugaaaaaggaggaagagaaa

SEQ ID NO: 1808654 - RNA, 22 nt, Human
ugaaaaaggaggaagagaaaaa

SEQ ID NO: 1808655 - RNA, 22 nt, Human
ugaaaaaguauccugcuucuga

SEQ ID NO: 1808656 - RNA, 22 nt, Human
ugaaaaaguucugcagauaaac

SEQ ID NO: 1808657 - RNA, 23 nt, Human
ugaaaaaauauauaucaaauaua

SEQ ID NO: 1808658 - RNA, 16 nt, Human
ugaaaaaggaggaaga

SEQ ID NO: 1808659 - RNA, 21 nt, Human
ucuuucugcagaaacagaaag

SEQ ID NO: 1808660 - RNA, 21 nt, Human
ucuuucuggcuaugcauuuga

SEQ ID NO: 1808661 - RNA, 20 nt, Human
ucuuucuggcuaugcauuug

SEQ ID NO: 1808662 - RNA, 22 nt, Human
ucuuuggugaacauugcaauag

SEQ ID NO: 1808663 - RNA, 16 nt, Human
ucuuuggugaacauug

SEQ ID NO: 1808664 - RNA, 22 nt, Human
ucuuuggucuacacugugcuga

SEQ ID NO: 1808665 - RNA, 22 nt, Human
agagaucaaccccuucgcuccu

SEQ ID NO: 1808666 - RNA, 23 nt, Human
agagacuccugcaggcagccagg

SEQ ID NO: 1808667 - RNA, 19 nt, Human
agagcaagacgcugugcug

SEQ ID NO: 1808668 - RNA, 23 nt, Human
agagcaagacgcugugcugcccu

SEQ ID NO: 1808669 - RNA, 13 nt, Human
ugaaagacuguac

SEQ ID NO: 1808670 - RNA, 15 nt, Human
ugaaagacuguacaa

SEQ ID NO: 1808671 - RNA, 16 nt, Human
agagacuccagcuggg

SEQ ID NO: 1808672 - RNA, 11 nt, Human
agagacuccug

SEQ ID NO: 1808673 - RNA, 17 nt, Human
agagacuccugcaggca

SEQ ID NO: 1808674 - RNA, 18 nt, Human
agagacuccugcaggcag

SEQ ID NO: 1808675 - RNA, 19 nt, Human
agagacuccugcaggcagc

SEQ ID NO: 1808676 - RNA, 20 nt, Human
agagacuccugcaggcagcc

SEQ ID NO: 1808677 - RNA, 21 nt, Human
agagacuccugcaggcagcca

SEQ ID NO: 1808678 - RNA, 22 nt, Human
agagacuccugcaggcagccag

SEQ ID NO: 1808679 - RNA, 22 nt, Human
agagcaccuuagacagucccug

SEQ ID NO: 1808680 - RNA, 21 nt, Human
agagcaccuuagacagucccu

SEQ ID NO: 1808681 - RNA, 23 nt, Human
agagcaccuuagacagucccugc

SEQ ID NO: 1808682 - RNA, 14 nt, Human
agagcugccaccug

SEQ ID NO: 1808683 - RNA, 20 nt, Human
agagcuagcagcagggaggg

SEQ ID NO: 1808684 - RNA, 13 nt, Human
agagccuuccagg

SEQ ID NO: 1808685 - RNA, 15 nt, Human
agagccuuccagggg

SEQ ID NO: 1808686 - RNA, 17 nt, Human
agagccuuccaggggug

SEQ ID NO: 1808687 - RNA, 22 nt, Human
agagccuuccaggggugggaca

SEQ ID NO: 1808688 - RNA, 21 nt, Human
ucugcaggucccuaauaaagc

SEQ ID NO: 1808689 - RNA, 19 nt, Human
ucugcaggucccuaauaaa

SEQ ID NO: 1808690 - RNA, 22 nt, Human
ucugcaggucccuaauaaagcu

SEQ ID NO: 1808691 - RNA, 23 nt, Human
ucugcaggucccuaauaaagcug

SEQ ID NO: 1808692 - RNA, 12 nt, Human
agaaauuaugug

SEQ ID NO: 1808693 - RNA, 21 nt, Human
agaacugaauuuugucuuuau

SEQ ID NO: 1808694 - RNA, 16 nt, Human
agaacucccuuucaac

SEQ ID NO: 1808695 - RNA, 17 nt, Human
agaacucccuuucaaca

SEQ ID NO: 1808696 - RNA, 19 nt, Human
agaaccuuuugagugccuu

SEQ ID NO: 1808697 - RNA, 23 nt, Human
agaaccuuuugagugccuuacac

SEQ ID NO: 1808698 - RNA, 16 nt, Human
agaacgcugauuuaaa

SEQ ID NO: 1808699 - RNA, 22 nt, Human
ucugcccugcgggucacaggag

SEQ ID NO: 1808700 - RNA, 12 nt, Human
ucugcccuuggu

SEQ ID NO: 1808701 - RNA, 23 nt, Human
ucugcccuugguuaggcauugug

SEQ ID NO: 1808702 - RNA, 23 nt, Human
ucugcccacucccugcaaccuga

SEQ ID NO: 1808703 - RNA, 20 nt, Human
ucugcccauccugccccuga

SEQ ID NO: 1808704 - RNA, 23 nt, Human
agaagcccaggaaaggcuccagg

SEQ ID NO: 1808705 - RNA, 19 nt, Human
agaagcaacccaaauguuc

SEQ ID NO: 1808706 - RNA, 16 nt, Human
agaagcagaggaagga

SEQ ID NO: 1808707 - RNA, 12 nt, Human
agaagcagcucu

SEQ ID NO: 1808708 - RNA, 13 nt, Human
agaagcagcucuu

SEQ ID NO: 1808709 - RNA, 10 nt, Human
ucuggccuuc

SEQ ID NO: 1808710 - RNA, 18 nt, Human
ucuggcagcucagagagg

SEQ ID NO: 1808711 - RNA, 21 nt, Human
ucuggcagcucagagagggug

SEQ ID NO: 1808712 - RNA, 17 nt, Human
ucuggcagcucagagag

SEQ ID NO: 1808713 - RNA, 20 nt, Human
ucuggcagaguugaagacag

SEQ ID NO: 1808714 - RNA, 23 nt, Human
ucuggcagaguugaagacagagc

SEQ ID NO: 1808715 - RNA, 12 nt, Human
ucugccugucuc

SEQ ID NO: 1808716 - RNA, 14 nt, Human
ucugccugucuccc

SEQ ID NO: 1808717 - RNA, 22 nt, Human
ucugcuuugggguuuaucagaa

SEQ ID NO: 1808718 - RNA, 23 nt, Human
ucugcuuuuuaaagaaugcucuu

SEQ ID NO: 1808719 - RNA, 13 nt, Human
agaaguuucuguc

SEQ ID NO: 1808720 - RNA, 22 nt, Human
agaaguuugagaucagccuggg

SEQ ID NO: 1808721 - RNA, 23 nt, Human
agaagcucccugaaguaagcaaa

SEQ ID NO: 1808722 - RNA, 19 nt, Human
ucucugcaggucccuaaua

SEQ ID NO: 1808723 - RNA, 20 nt, Human
ucucugcaggucccuaauaa

SEQ ID NO: 1808724 - RNA, 21 nt, Human
ucucugcaggucccuaauaaa

SEQ ID NO: 1808725 - RNA, 22 nt, Human
ucucugcaggucccuaauaaag

SEQ ID NO: 1808726 - RNA, 16 nt, Human
ucucuugguccugcug

SEQ ID NO: 1808727 - RNA, 17 nt, Human
ucucuugguccugcugc

SEQ ID NO: 1808728 - RNA, 18 nt, Human
ucucuugguccugcugca

SEQ ID NO: 1808729 - RNA, 19 nt, Human
agaaaaaauauuuucccua

SEQ ID NO: 1808730 - RNA, 17 nt, Human
agaaaaaauauuuuccu

SEQ ID NO: 1808731 - RNA, 23 nt, Human
agaaaaaauauuuuccugccagg

SEQ ID NO: 1808732 - RNA, 18 nt, Human
agaaaaaugagccuggca

SEQ ID NO: 1808733 - RNA, 12 nt, Human
agaaaugaaaaa

SEQ ID NO: 1808734 - RNA, 13 nt, Human
agaaaugaaaaaa

SEQ ID NO: 1808735 - RNA, 16 nt, Human
agaaaugaaaaaauau

SEQ ID NO: 1808736 - RNA, 21 nt, Human
agaaaugcugguuuuucaguu

SEQ ID NO: 1808737 - RNA, 20 nt, Human
agaaaugcugguuuuucagu

SEQ ID NO: 1808738 - RNA, 15 nt, Human
agaaaugccuuaccc

SEQ ID NO: 1808739 - RNA, 18 nt, Human
ucugaaggcuggguucug

SEQ ID NO: 1808740 - RNA, 20 nt, Human
agaaagcagaacagugauua

SEQ ID NO: 1808741 - RNA, 18 nt, Human
agaaagcagaacagugau

SEQ ID NO: 1808742 - RNA, 17 nt, Human
agaaagcagaacaguga

SEQ ID NO: 1808743 - RNA, 20 nt, Human
agaaagacuaucuaaauguu

SEQ ID NO: 1808744 - RNA, 22 nt, Human
agaaagacuaucuaaauguuga

SEQ ID NO: 1808745 - RNA, 14 nt, Human
acuuguggacacag

SEQ ID NO: 1808746 - RNA, 16 nt, Human
acuuuaaaaggagcca

SEQ ID NO: 1808747 - RNA, 15 nt, Human
acuuguggacacagc

SEQ ID NO: 1808748 - RNA, 16 nt, Human
acuuguuuucugggaa

SEQ ID NO: 1808749 - RNA, 13 nt, Human
acuuuagggaagu

SEQ ID NO: 1808750 - RNA, 19 nt, Human
acuuuguauaaaagggacu

SEQ ID NO: 1808751 - RNA, 23 nt, Human
acuuuggaaagaguaggaagacu

SEQ ID NO: 1808752 - RNA, 12 nt, Human
acuuuggaaaga

SEQ ID NO: 1808753 - RNA, 13 nt, Human
acuuuggaaagag

SEQ ID NO: 1808754 - RNA, 14 nt, Human
acuuuggaaagagu

SEQ ID NO: 1808755 - RNA, 22 nt, Human
acuuugcagcacagcugagagg

SEQ ID NO: 1808756 - RNA, 23 nt, Human
acuuugaggguguauauuuucug

SEQ ID NO: 1808757 - RNA, 16 nt, Human
acuuuguguucaccuu

SEQ ID NO: 1808758 - RNA, 18 nt, Human
acuuuguguucaccuugu

SEQ ID NO: 1808759 - RNA, 21 nt, Human
ucuccuuagaaguggaaguag

SEQ ID NO: 1808760 - RNA, 15 nt, Human
ucuccuuagaagugg

SEQ ID NO: 1808761 - RNA, 21 nt, Human
ucuccuuggugucgggcauga

SEQ ID NO: 1808762 - RNA, 23 nt, Human
ucuccuuggugucgggcaugaca

SEQ ID NO: 1808763 - RNA, 17 nt, Human
ucucgcucuguugccca

SEQ ID NO: 1808764 - RNA, 20 nt, Human
ucucgcuauugucaccaggg

SEQ ID NO: 1808765 - RNA, 17 nt, Human
ucucgaacuccugaccu

SEQ ID NO: 1808766 - RNA, 15 nt, Human
ucucggcucacugca

SEQ ID NO: 1808767 - RNA, 12 nt, Human
ucucucaggcca

SEQ ID NO: 1808768 - RNA, 14 nt, Human
ucucuccauucccg

SEQ ID NO: 1808769 - RNA, 21 nt, Human
ucucucaggccaaacucaccu

SEQ ID NO: 1808770 - RNA, 23 nt, Human
ucgucacugcuuaacuucacaua

SEQ ID NO: 1808771 - RNA, 13 nt, Human
ucguucucugccu

SEQ ID NO: 1808772 - RNA, 19 nt, Human
ucggggagaggcugaggac

SEQ ID NO: 1808773 - RNA, 21 nt, Human
acuguuaauaguucagguaac

SEQ ID NO: 1808774 - RNA, 17 nt, Human
acuguuaauaguucagg

SEQ ID NO: 1808775 - RNA, 21 nt, Human
ucuacccucuuagaaaaacca

SEQ ID NO: 1808776 - RNA, 13 nt, Human
ucuaaacugcccc

SEQ ID NO: 1808777 - RNA, 16 nt, Human
ucuaaacugcccccuc

SEQ ID NO: 1808778 - RNA, 22 nt, Human
ucuaaacugcccccucugcccu

SEQ ID NO: 1808779 - RNA, 23 nt, Human
ucuaaacugcccccucugcccug

SEQ ID NO: 1808780 - RNA, 17 nt, Human
ucuaaagcugccagccg

SEQ ID NO: 1808781 - RNA, 16 nt, Human
ucuaaaggcuaccuuu

SEQ ID NO: 1808782 - RNA, 13 nt, Human
ucuaaaggcuacc

SEQ ID NO: 1808783 - RNA, 20 nt, Human
acuguaucaugacaaagacu

SEQ ID NO: 1808784 - RNA, 16 nt, Human
acuguaucaugacaaa

SEQ ID NO: 1808785 - RNA, 18 nt, Human
acuggguacuuguggaca

SEQ ID NO: 1808786 - RNA, 17 nt, Human
acuggguacuuguggac

SEQ ID NO: 1808787 - RNA, 16 nt, Human
acuguacaaaguagaa

SEQ ID NO: 1808788 - RNA, 22 nt, Human
acuguacaaaguagaagucuua

SEQ ID NO: 1808789 - RNA, 18 nt, Human
acuguacagacagaaaaa

SEQ ID NO: 1808790 - RNA, 16 nt, Human
acuguacaugaaaaca

SEQ ID NO: 1808791 - RNA, 19 nt, Human
acuguacaugaaaacacau

SEQ ID NO: 1808792 - RNA, 23 nt, Human
acuguacuugcucuugaugccug

SEQ ID NO: 1808793 - RNA, 14 nt, Human
acuguaucaugaca

SEQ ID NO: 1808794 - RNA, 20 nt, Human
acuguacuccucccaggcgc

SEQ ID NO: 1808795 - RNA, 15 nt, Human
acuguacuugcucuu

SEQ ID NO: 1808796 - RNA, 21 nt, Human
acuguacaugaaaacacauuu

SEQ ID NO: 1808797 - RNA, 20 nt, Human
acuguacaugaaaacacauu

SEQ ID NO: 1808798 - RNA, 23 nt, Human
ucgcugugucagcauagaaguaa

SEQ ID NO: 1808799 - RNA, 21 nt, Human
ucgcucuguugcccaggcugg

SEQ ID NO: 1808800 - RNA, 21 nt, Human
acugggcuuggggaccagagc

SEQ ID NO: 1808801 - RNA, 22 nt, Human
acugggcuuggggaccagagcu

SEQ ID NO: 1808802 - RNA, 15 nt, Human
acuggguacuugugg

SEQ ID NO: 1808803 - RNA, 14 nt, Human
ucgcuccugugucu

SEQ ID NO: 1808804 - RNA, 18 nt, Human
ucgcccuggacugugugc

SEQ ID NO: 1808805 - RNA, 16 nt, Human
acuucaggcucuucuc

SEQ ID NO: 1808806 - RNA, 16 nt, Human
acuuacuguacaugaa

SEQ ID NO: 1808807 - RNA, 12 nt, Human
ucuaccugaggg

SEQ ID NO: 1808808 - RNA, 19 nt, Human
ucuaccugaggggccucuu

SEQ ID NO: 1808809 - RNA, 15 nt, Human
acuuacuguacauga

SEQ ID NO: 1808810 - RNA, 20 nt, Human
acuuagagguggggagcaga

SEQ ID NO: 1808811 - RNA, 14 nt, Human
acuuacuguacaug

SEQ ID NO: 1808812 - RNA, 13 nt, Human
acuuacuguacau

SEQ ID NO: 1808813 - RNA, 17 nt, Human
acuucaggcucuucucc

SEQ ID NO: 1808814 - RNA, 18 nt, Human
acuucaggcucuucuccu

SEQ ID NO: 1808815 - RNA, 20 nt, Human
acuucaggcucuucuccuuu

SEQ ID NO: 1808816 - RNA, 17 nt, Human
acuuccauaaucuggac

SEQ ID NO: 1808817 - RNA, 18 nt, Human
acuuccaauuuacauacu

SEQ ID NO: 1808818 - RNA, 17 nt, Human
acuuccacugccauccu

SEQ ID NO: 1808819 - RNA, 13 nt, Human
ucuauaauuuaaa

SEQ ID NO: 1808820 - RNA, 23 nt, Human
ucuaguuugauuaaauucuugca

SEQ ID NO: 1808821 - RNA, 24 nt, Human
ucuagauacuguaucaugacaaag

SEQ ID NO: 1808822 - RNA, 19 nt, Human
acuugagaauuacccuuuu

SEQ ID NO: 1808823 - RNA, 17 nt, Human
acuugaaaauuaacaug

SEQ ID NO: 1808824 - RNA, 18 nt, Human
acuugaaaauuaacauga

SEQ ID NO: 1808825 - RNA, 23 nt, Human
acuugaacccgggaggcagaggu

SEQ ID NO: 1808826 - RNA, 14 nt, Human
acuuggaagcuccg

SEQ ID NO: 1808827 - RNA, 14 nt, Human
acuuguaugaaaga

SEQ ID NO: 1808828 - RNA, 13 nt, Human
acuuguauuaugu

SEQ ID NO: 1808829 - RNA, 14 nt, Human
acuuguauuaugug

SEQ ID NO: 1808830 - RNA, 15 nt, Human
acuuguauuaugugu

SEQ ID NO: 1808831 - RNA, 14 nt, Human
acuugucuuuggac

SEQ ID NO: 1808832 - RNA, 22 nt, Human
acuucgggaggucgaggcagga

SEQ ID NO: 1808833 - RNA, 17 nt, Human
acuucgggaggucgagg

SEQ ID NO: 1808834 - RNA, 20 nt, Human
acuucgggaggucgaggcag

SEQ ID NO: 1808835 - RNA, 16 nt, Human
ucucacuccuaccugg

SEQ ID NO: 1808836 - RNA, 17 nt, Human
ucucacuccuaccuggu

SEQ ID NO: 1808837 - RNA, 18 nt, Human
ucucacuccuaccuggua

SEQ ID NO: 1808838 - RNA, 13 nt, Human
ucucacuccuacc

SEQ ID NO: 1808839 - RNA, 16 nt, Human
ucuauuguuucuuuca

SEQ ID NO: 1808840 - RNA, 16 nt, Human
ucucaaaaaaagaaaa

SEQ ID NO: 1808841 - RNA, 21 nt, Human
ucacuauguugcccaggcagg

SEQ ID NO: 1808842 - RNA, 22 nt, Human
ucaccagccccagugcccacag

SEQ ID NO: 1808843 - RNA, 23 nt, Human
ucacugagacagcccgggcucug

SEQ ID NO: 1808844 - RNA, 18 nt, Human
ucacugcaaccuccgccu

SEQ ID NO: 1808845 - RNA, 21 nt, Human
ucacugcaaccuucgccaccu

SEQ ID NO: 1808846 - RNA, 14 nt, Human
ucacuguugcccag

SEQ ID NO: 1808847 - RNA, 18 nt, Human
ucacugcaacuucugccu

SEQ ID NO: 1808848 - RNA, 17 nt, Human
ucacugcaacuucugcc

SEQ ID NO: 1808849 - RNA, 15 nt, Human
ucacugcacagugca

SEQ ID NO: 1808850 - RNA, 15 nt, Human
ucacuguugcccagg

SEQ ID NO: 1808851 - RNA, 22 nt, Human
ucacuuaaguuaguuccacuga

SEQ ID NO: 1808852 - RNA, 22 nt, Human
accauuuugggguacccacugc

SEQ ID NO: 1808853 - RNA, 20 nt, Human
acccaaauguucaucaauga

SEQ ID NO: 1808854 - RNA, 16 nt, Human
acccaaauguucauca

SEQ ID NO: 1808855 - RNA, 20 nt, Human
acccacugcuuuuggucugu

SEQ ID NO: 1808856 - RNA, 14 nt, Human
acccacuggacuca

SEQ ID NO: 1808857 - RNA, 17 nt, Human
acccacuggacucaccu

SEQ ID NO: 1808858 - RNA, 21 nt, Human
acccacuggacucaccucccc

SEQ ID NO: 1808859 - RNA, 21 nt, Human
acccagauaaagguucaugca

SEQ ID NO: 1808860 - RNA, 21 nt, Human
accauuuugggguacccacug

SEQ ID NO: 1808861 - RNA, 23 nt, Human
accauuuugcugucccuuuuccu

SEQ ID NO: 1808862 - RNA, 22 nt, Human
accauuuugcugucccuuuucc

SEQ ID NO: 1808863 - RNA, 18 nt, Human
accauguuggccaggcug

SEQ ID NO: 1808864 - RNA, 19 nt, Human
accauucuccaccugccag

SEQ ID NO: 1808865 - RNA, 20 nt, Human
accauucuccaccugccagg

SEQ ID NO: 1808866 - RNA, 21 nt, Human
accauucuccaccugccaggg

SEQ ID NO: 1808867 - RNA, 17 nt, Human
acccagcgagcccuggu

SEQ ID NO: 1808868 - RNA, 16 nt, Human
acccagcgagcccugg

SEQ ID NO: 1808869 - RNA, 13 nt, Human
acccagcgagccc

SEQ ID NO: 1808870 - RNA, 15 nt, Human
acccaggagccccga

SEQ ID NO: 1808871 - RNA, 13 nt, Human
acccaggagcccc

SEQ ID NO: 1808872 - RNA, 11 nt, Human
acccaggugcu

SEQ ID NO: 1808873 - RNA, 23 nt, Human
acccaggugcuaggaacacuccu

SEQ ID NO: 1808874 - RNA, 19 nt, Human
accccagcuggggccaggc

SEQ ID NO: 1808875 - RNA, 22 nt, Human
accccagcuggggccaggcugg

SEQ ID NO: 1808876 - RNA, 13 nt, Human
accccagguuucu

SEQ ID NO: 1808877 - RNA, 16 nt, Human
ucagaucucuaacuuc

SEQ ID NO: 1808878 - RNA, 21 nt, Human
ucagaugcugugcaaauguua

SEQ ID NO: 1808879 - RNA, 21 nt, Human
ucagagccaccccuaaagaga

SEQ ID NO: 1808880 - RNA, 16 nt, Human
ucagagacuccugcag

SEQ ID NO: 1808881 - RNA, 23 nt, Human
ucagagacuccugcaggcagcca

SEQ ID NO: 1808882 - RNA, 15 nt, Human
acccagcccacuucu

SEQ ID NO: 1808883 - RNA, 23 nt, Human
ucagaaguuucugccgcagcccu

SEQ ID NO: 1808884 - RNA, 16 nt, Human
ucagaauagaaauuag

SEQ ID NO: 1808885 - RNA, 22 nt, Human
ucagagacuccugcaggcagcc

SEQ ID NO: 1808886 - RNA, 20 nt, Human
ucagaauucucagaaucuca

SEQ ID NO: 1808887 - RNA, 10 nt, Human
ucagaauucu

SEQ ID NO: 1808888 - RNA, 12 nt, Human
ucagaauucuca

SEQ ID NO: 1808889 - RNA, 15 nt, Human
ucagugcuucgcaga

SEQ ID NO: 1808890 - RNA, 16 nt, Human
ucaguggcagcugcuu

SEQ ID NO: 1808891 - RNA, 15 nt, Human
ucaguggcagcugcu

SEQ ID NO: 1808892 - RNA, 14 nt, Human
ucaguggcagcugc

SEQ ID NO: 1808893 - RNA, 19 nt, Human
ucagugccuuauggaacac

SEQ ID NO: 1808894 - RNA, 20 nt, Human
ucagugccuuauggaacacu

SEQ ID NO: 1808895 - RNA, 22 nt, Human
ucagugccuuauggaacacucu

SEQ ID NO: 1808896 - RNA, 23 nt, Human
ucagugccuuauggaacacucug

SEQ ID NO: 1808897 - RNA, 15 nt, Human
ucauaacuagaacug

SEQ ID NO: 1808898 - RNA, 24 nt, Human
ucauaaagcaggcagaacucaucu

SEQ ID NO: 1808899 - RNA, 13 nt, Human
ucauaacuagaac

SEQ ID NO: 1808900 - RNA, 18 nt, Human
ucauaaauaaaguuuguu

SEQ ID NO: 1808901 - RNA, 19 nt, Human
ucaguuguuagugugucuu

SEQ ID NO: 1808902 - RNA, 22 nt, Human
ucaggugucccugcacuugcag

SEQ ID NO: 1808903 - RNA, 22 nt, Human
ucagguugucugaagucacugc

SEQ ID NO: 1808904 - RNA, 13 nt, Human
ucaguaauaacuc

SEQ ID NO: 1808905 - RNA, 13 nt, Human
ucaguaagccgug

SEQ ID NO: 1808906 - RNA, 20 nt, Human
accgaaaacguggcugcuuc

SEQ ID NO: 1808907 - RNA, 15 nt, Human
acccuugugguccca

SEQ ID NO: 1808908 - RNA, 20 nt, Human
acccuugccgucuaccugag

SEQ ID NO: 1808909 - RNA, 18 nt, Human
ucaggugucccugcacuu

SEQ ID NO: 1808910 - RNA, 17 nt, Human
ucaggugucccugcacu

SEQ ID NO: 1808911 - RNA, 15 nt, Human
ucaggugucccugca

SEQ ID NO: 1808912 - RNA, 23 nt, Human
ucagguggggucacucuggcagc

SEQ ID NO: 1808913 - RNA, 22 nt, Human
ucagguggggucacucuggcag

SEQ ID NO: 1808914 - RNA, 21 nt, Human
accgaaaacguggcugcuuca

SEQ ID NO: 1808915 - RNA, 22 nt, Human
accgaaaacguggcugcuucaa

SEQ ID NO: 1808916 - RNA, 21 nt, Human
acccuccuuucaccacaugug

SEQ ID NO: 1808917 - RNA, 15 nt, Human
acccgggaggcagag

SEQ ID NO: 1808918 - RNA, 17 nt, Human
acccucauguucuuaau

SEQ ID NO: 1808919 - RNA, 15 nt, Human
acccucauguucuua

SEQ ID NO: 1808920 - RNA, 14 nt, Human
acccucauguucuu

SEQ ID NO: 1808921 - RNA, 22 nt, Human
acccgggaagggggcugggaca

SEQ ID NO: 1808922 - RNA, 15 nt, Human
acccggaggggccug

SEQ ID NO: 1808923 - RNA, 19 nt, Human
acccgggaagggggcuggg

SEQ ID NO: 1808924 - RNA, 20 nt, Human
acccgggaagggggcuggga

SEQ ID NO: 1808925 - RNA, 14 nt, Human
acccucgaggcgga

SEQ ID NO: 1808926 - RNA, 18 nt, Human
acccucgaggcggaucuu

SEQ ID NO: 1808927 - RNA, 11 nt, Human
acccugaggcc

SEQ ID NO: 1808928 - RNA, 13 nt, Human
acccugaggccca

SEQ ID NO: 1808929 - RNA, 19 nt, Human
acccugaggcccagagggc

SEQ ID NO: 1808930 - RNA, 21 nt, Human
acccugaggcccagagggccu

SEQ ID NO: 1808931 - RNA, 23 nt, Human
acccugaggcccagagggccugc

SEQ ID NO: 1808932 - RNA, 13 nt, Human
acccccagccugc

SEQ ID NO: 1808933 - RNA, 12 nt, Human
acccccagccug

SEQ ID NO: 1808934 - RNA, 17 nt, Human
ucaggcaggugggaugg

SEQ ID NO: 1808935 - RNA, 18 nt, Human
ucaggcaggugggaugga

SEQ ID NO: 1808936 - RNA, 13 nt, Human
ucaggccacuuga

SEQ ID NO: 1808937 - RNA, 13 nt, Human
ucaggccagcugc

SEQ ID NO: 1808938 - RNA, 14 nt, Human
ucaggccagcugcu

SEQ ID NO: 1808939 - RNA, 13 nt, Human
ucaggccaggccc

SEQ ID NO: 1808940 - RNA, 14 nt, Human
ucaggccaggcccu

SEQ ID NO: 1808941 - RNA, 15 nt, Human
ucaggccaggcccuc

SEQ ID NO: 1808942 - RNA, 16 nt, Human
ucaggccaggcccucu

SEQ ID NO: 1808943 - RNA, 19 nt, Human
ucaggguuggccccugccc

SEQ ID NO: 1808944 - RNA, 18 nt, Human
ucaggguuggccccugcc

SEQ ID NO: 1808945 - RNA, 23 nt, Human
ucaggguuggccccugcccggcu

SEQ ID NO: 1808946 - RNA, 18 nt, Human
ucagguaaucgaccugcc

SEQ ID NO: 1808947 - RNA, 19 nt, Human
ucagguaaucgaccugccu

SEQ ID NO: 1808948 - RNA, 20 nt, Human
ucagguaaucgaccugccuc

SEQ ID NO: 1808949 - RNA, 21 nt, Human
ucagguaaucgaccugccucg

SEQ ID NO: 1808950 - RNA, 19 nt, Human
acccgcuaagagggaggga

SEQ ID NO: 1808951 - RNA, 19 nt, Human
ucaggccaggcccucugcc

SEQ ID NO: 1808952 - RNA, 17 nt, Human
ucaggccaggcccucug

SEQ ID NO: 1808953 - RNA, 18 nt, Human
ucaggccaggcccucugc

SEQ ID NO: 1808954 - RNA, 12 nt, Human
ucaggggugugc

SEQ ID NO: 1808955 - RNA, 19 nt, Human
ucaggggugugcggccuuu

SEQ ID NO: 1808956 - RNA, 23 nt, Human
ucaggggugugcggccuuuggcu

SEQ ID NO: 1808957 - RNA, 17 nt, Human
ucaggguuggccccugc

SEQ ID NO: 1808958 - RNA, 17 nt, Human
ucaagagggucugagga

SEQ ID NO: 1808959 - RNA, 20 nt, Human
ucaagagggcacugguggcc

SEQ ID NO: 1808960 - RNA, 21 nt, Human
ucaagagggcacugguggccc

SEQ ID NO: 1808961 - RNA, 17 nt, Human
ucaagcaagauuucaga

SEQ ID NO: 1808962 - RNA, 11 nt, Human
ucaaggcucag

SEQ ID NO: 1808963 - RNA, 22 nt, Human
ucaauaggaaaaacugauuuuu

SEQ ID NO: 1808964 - RNA, 17 nt, Human
ucaagugauucuccugc

SEQ ID NO: 1808965 - RNA, 18 nt, Human
ucaauaggaaaaacugau

SEQ ID NO: 1808966 - RNA, 19 nt, Human
ucaauaggaaaaacugauu

SEQ ID NO: 1808967 - RNA, 16 nt, Human
ucaagugauucuccug

SEQ ID NO: 1808968 - RNA, 21 nt, Human
ucaagugauucucaugccuca

SEQ ID NO: 1808969 - RNA, 22 nt, Human
ucaagugauucucaugccucag

SEQ ID NO: 1808970 - RNA, 19 nt, Human
ucaaguaauccaccugccu

SEQ ID NO: 1808971 - RNA, 23 nt, Human
acauuuuucuuagggaaggauac

SEQ ID NO: 1808972 - RNA, 13 nt, Human
acauuuuucuuag

SEQ ID NO: 1808973 - RNA, 21 nt, Human
acauuuuucagauauaaaaga

SEQ ID NO: 1808974 - RNA, 19 nt, Human
acauuuuuaagugcugcau

SEQ ID NO: 1808975 - RNA, 18 nt, Human
acauuuuuaagugcugca

SEQ ID NO: 1808976 - RNA, 15 nt, Human
acauuuuuaagugcu

SEQ ID NO: 1808977 - RNA, 22 nt, Human
acauuuaaaacauuaaaauaua

SEQ ID NO: 1808978 - RNA, 18 nt, Human
acauuuuacuuuuuccug

SEQ ID NO: 1808979 - RNA, 22 nt, Human
acauugcggacagccacggcca

SEQ ID NO: 1808980 - RNA, 21 nt, Human
acauugcggacagccacggcc

SEQ ID NO: 1808981 - RNA, 18 nt, Human
acauuuaaaacauuaaaa

SEQ ID NO: 1808982 - RNA, 14 nt, Human
acauuuaaaacauu

SEQ ID NO: 1808983 - RNA, 22 nt, Human
acauugguucuuucauuugcuu

SEQ ID NO: 1808984 - RNA, 20 nt, Human
accaaccacugcgaccacaa

SEQ ID NO: 1808985 - RNA, 17 nt, Human
accaacauacucccauc

SEQ ID NO: 1808986 - RNA, 16 nt, Human
accaacauacucccau

SEQ ID NO: 1808987 - RNA, 16 nt, Human
accaaaucagcugcua

SEQ ID NO: 1808988 - RNA, 19 nt, Human
accaaaucagcugcuacua

SEQ ID NO: 1808989 - RNA, 15 nt, Human
accaacccucagagc

SEQ ID NO: 1808990 - RNA, 23 nt, Human
accacacccagcccacuucugcc

SEQ ID NO: 1808991 - RNA, 21 nt, Human
accacacccagcccacuucug

SEQ ID NO: 1808992 - RNA, 20 nt, Human
accacacccagcccacuucu

SEQ ID NO: 1808993 - RNA, 16 nt, Human
accacacccagcccac

SEQ ID NO: 1808994 - RNA, 15 nt, Human
accacacccagccca

SEQ ID NO: 1808995 - RNA, 17 nt, Human
accacacagaggcugcc

SEQ ID NO: 1808996 - RNA, 17 nt, Human
ucaccagccccagugcc

SEQ ID NO: 1808997 - RNA, 20 nt, Human
ucacauauugauuuccguua

SEQ ID NO: 1808998 - RNA, 18 nt, Human
ucacauauugauuuccgu

SEQ ID NO: 1808999 - RNA, 16 nt, Human
ucacauauugauuucc

SEQ ID NO: 1809000 - RNA, 15 nt, Human
ucacagaugggugcu

SEQ ID NO: 1809001 - RNA, 14 nt, Human
ucacagaugggugc

SEQ ID NO: 1809002 - RNA, 16 nt, Human
ucacagccacuuggga

SEQ ID NO: 1809003 - RNA, 21 nt, Human
ucacagaacccuuggagccaa

SEQ ID NO: 1809004 - RNA, 13 nt, Human
ucaauuuaaaaaa

SEQ ID NO: 1809005 - RNA, 12 nt, Human
ucaauuuaaaaa

SEQ ID NO: 1809006 - RNA, 13 nt, Human
acaugagcaucag

SEQ ID NO: 1809007 - RNA, 22 nt, Human
acaugaaaacacauuuuucuua

SEQ ID NO: 1809008 - RNA, 23 nt, Human
acaugaaaacacauuuuucuuag

SEQ ID NO: 1809009 - RNA, 13 nt, Human
ucaaauauauuca

SEQ ID NO: 1809010 - RNA, 15 nt, Human
ucaaagcaaaugucu

SEQ ID NO: 1809011 - RNA, 23 nt, Human
ucaaagcaaaugucuuccuggau

SEQ ID NO: 1809012 - RNA, 22 nt, Human
ucaaagauauuuugcuuuguga

SEQ ID NO: 1809013 - RNA, 20 nt, Human
ucaaagauauuuugcuuugu

SEQ ID NO: 1809014 - RNA, 13 nt, Human
ucaaagauauuuu

SEQ ID NO: 1809015 - RNA, 16 nt, Human
ucaaaagcugggcagg

SEQ ID NO: 1809016 - RNA, 21 nt, Human
acaugucuuuucuugcaugag

SEQ ID NO: 1809017 - RNA, 14 nt, Human
acauggccuuugcu

SEQ ID NO: 1809018 - RNA, 15 nt, Human
acauggaguauaugu

SEQ ID NO: 1809019 - RNA, 19 nt, Human
acauggaguauaugucaag

SEQ ID NO: 1809020 - RNA, 23 nt, Human
acaugagcaucaggccaggcccu

SEQ ID NO: 1809021 - RNA, 20 nt, Human
acauggaauaacauguaauu

SEQ ID NO: 1809022 - RNA, 18 nt, Human
acauggaauaacauguaa

SEQ ID NO: 1809023 - RNA, 16 nt, Human
acaugagguacugaga

SEQ ID NO: 1809024 - RNA, 14 nt, Human
uauuuuaagacgaa

SEQ ID NO: 1809025 - RNA, 22 nt, Human
uauuuuaagacgaaacauuugu

SEQ ID NO: 1809026 - RNA, 16 nt, Human
acaugaaaacacauuu

SEQ ID NO: 1809027 - RNA, 15 nt, Human
acaugaaaacacauu

SEQ ID NO: 1809028 - RNA, 16 nt, Human
acaucuugcucugcug

SEQ ID NO: 1809029 - RNA, 15 nt, Human
acaucuugcucugcu

SEQ ID NO: 1809030 - RNA, 14 nt, Human
uaugugccagauuu

SEQ ID NO: 1809031 - RNA, 19 nt, Human
uaugugccagauuuaugca

SEQ ID NO: 1809032 - RNA, 17 nt, Human
acaucuugcucugcuga

SEQ ID NO: 1809033 - RNA, 22 nt, Human
acaucuugcucugcugacagac

SEQ ID NO: 1809034 - RNA, 19 nt, Human
acaucuuggucagauuuga

SEQ ID NO: 1809035 - RNA, 17 nt, Human
uauuuuguguuuaggaa

SEQ ID NO: 1809036 - RNA, 20 nt, Human
uauuuuguguuuaggaacua

SEQ ID NO: 1809037 - RNA, 17 nt, Human
uauuuuuguagagccag

SEQ ID NO: 1809038 - RNA, 17 nt, Human
uauuuugauguaaagau

SEQ ID NO: 1809039 - RNA, 15 nt, Human
uauuuugcuuuguga

SEQ ID NO: 1809040 - RNA, 13 nt, Human
uauuuugcuuugu

SEQ ID NO: 1809041 - RNA, 20 nt, Human
uauuuugcuuugugauuuuu

SEQ ID NO: 1809042 - RNA, 14 nt, Human
uauuuuaauaaaca

SEQ ID NO: 1809043 - RNA, 17 nt, Human
uauuuuaauaaacacuc

SEQ ID NO: 1809044 - RNA, 15 nt, Human
ucccaaagugcuggg

SEQ ID NO: 1809045 - RNA, 16 nt, Human
ucccaaagugcuggga

SEQ ID NO: 1809046 - RNA, 20 nt, Human
ucccaaagugcugggauuac

SEQ ID NO: 1809047 - RNA, 21 nt, Human
ucccaaagugcugggauuaca

SEQ ID NO: 1809048 - RNA, 14 nt, Human
ucccacaaaggaga

SEQ ID NO: 1809049 - RNA, 15 nt, Human
ucccacaggcccuuc

SEQ ID NO: 1809050 - RNA, 17 nt, Human
ucccacaggcccuuccu

SEQ ID NO: 1809051 - RNA, 21 nt, Human
ucccacaggcccuuccucucc

SEQ ID NO: 1809052 - RNA, 22 nt, Human
ucccacaggcccuuccucucca

SEQ ID NO: 1809053 - RNA, 19 nt, Human
ucccaccaacccucagagc

SEQ ID NO: 1809054 - RNA, 11 nt, Human
ucccaccccac

SEQ ID NO: 1809055 - RNA, 14 nt, Human
ucccaccccacaca

SEQ ID NO: 1809056 - RNA, 15 nt, Human
uccaugaguccccug

SEQ ID NO: 1809057 - RNA, 16 nt, Human
uccaugaguccccugu

SEQ ID NO: 1809058 - RNA, 17 nt, Human
uccaugaguccccuguu

SEQ ID NO: 1809059 - RNA, 22 nt, Human
uccaugaagauguagaggagaa

SEQ ID NO: 1809060 - RNA, 20 nt, Human
uccaucucuuguuuaaauuc

SEQ ID NO: 1809061 - RNA, 11 nt, Human
uccauccugag

SEQ ID NO: 1809062 - RNA, 14 nt, Human
acggcucacugcag

SEQ ID NO: 1809063 - RNA, 15 nt, Human
acggcucacugcagc

SEQ ID NO: 1809064 - RNA, 20 nt, Human
uccagugaggcucugcccuu

SEQ ID NO: 1809065 - RNA, 18 nt, Human
uccagugaggcucugccc

SEQ ID NO: 1809066 - RNA, 19 nt, Human
uccagugaggcucugcccu

SEQ ID NO: 1809067 - RNA, 17 nt, Human
uccagugaggcucugcc

SEQ ID NO: 1809068 - RNA, 14 nt, Human
uccagugagacagc

SEQ ID NO: 1809069 - RNA, 23 nt, Human
acgcgugcacacaccagagccca

SEQ ID NO: 1809070 - RNA, 14 nt, Human
acgcccccacuggu

SEQ ID NO: 1809071 - RNA, 18 nt, Human
acgcuacccgggaagggg

SEQ ID NO: 1809072 - RNA, 16 nt, Human
acgcucucuggccuuc

SEQ ID NO: 1809073 - RNA, 15 nt, Human
acgcucucuggccuu

SEQ ID NO: 1809074 - RNA, 13 nt, Human
acgcuacccggga

SEQ ID NO: 1809075 - RNA, 17 nt, Human
acgcuacccgggaaggg

SEQ ID NO: 1809076 - RNA, 21 nt, Human
acggagucccaccuuggcugc

SEQ ID NO: 1809077 - RNA, 16 nt, Human
acggccaggccagagg

SEQ ID NO: 1809078 - RNA, 17 nt, Human
acgcucucuggccuucg

SEQ ID NO: 1809079 - RNA, 19 nt, Human
acggagucccaccuuggcu

SEQ ID NO: 1809080 - RNA, 14 nt, Human
acgaauauugcuga

SEQ ID NO: 1809081 - RNA, 18 nt, Human
uccaggcugggagagccu

SEQ ID NO: 1809082 - RNA, 14 nt, Human
uccaggcugggaga

SEQ ID NO: 1809083 - RNA, 17 nt, Human
uccaggcugggagagcc

SEQ ID NO: 1809084 - RNA, 15 nt, Human
acgacugcccggcag

SEQ ID NO: 1809085 - RNA, 18 nt, Human
acgccaggggaaaaucag

SEQ ID NO: 1809086 - RNA, 23 nt, Human
acgccaggggaaaaucagccugc

SEQ ID NO: 1809087 - RNA, 11 nt, Human
acgccauccca

SEQ ID NO: 1809088 - RNA, 14 nt, Human
acgccaucccagcc

SEQ ID NO: 1809089 - RNA, 15 nt, Human
acgccaucccagccc

SEQ ID NO: 1809090 - RNA, 16 nt, Human
acgccaucccagcccc

SEQ ID NO: 1809091 - RNA, 17 nt, Human
acgccaucccagcccca

SEQ ID NO: 1809092 - RNA, 18 nt, Human
acgccaucccagccccaa

SEQ ID NO: 1809093 - RNA, 16 nt, Human
ucauaauaaguugcau

SEQ ID NO: 1809094 - RNA, 12 nt, Human
ucauaaugacuu

SEQ ID NO: 1809095 - RNA, 18 nt, Human
accugaagacucauucuu

SEQ ID NO: 1809096 - RNA, 19 nt, Human
accugaauuuuggcugugu

SEQ ID NO: 1809097 - RNA, 22 nt, Human
accugaagcuaucguaaaauua

SEQ ID NO: 1809098 - RNA, 17 nt, Human
accugaccccugacccc

SEQ ID NO: 1809099 - RNA, 23 nt, Human
accugaggcccuucucuccagcc

SEQ ID NO: 1809100 - RNA, 17 nt, Human
accugagccccaaaagg

SEQ ID NO: 1809101 - RNA, 12 nt, Human
accugagcccca

SEQ ID NO: 1809102 - RNA, 14 nt, Human
accugauugugucu

SEQ ID NO: 1809103 - RNA, 16 nt, Human
accugaggggccucuu

SEQ ID NO: 1809104 - RNA, 14 nt, Human
accugaggggccuc

SEQ ID NO: 1809105 - RNA, 17 nt, Human
accugccucggccuccc

SEQ ID NO: 1809106 - RNA, 18 nt, Human
accugccaggaagccagc

SEQ ID NO: 1809107 - RNA, 19 nt, Human
accugccaggaagccagca

SEQ ID NO: 1809108 - RNA, 16 nt, Human
accugccaggaagcca

SEQ ID NO: 1809109 - RNA, 17 nt, Human
accugccaggaagccag

SEQ ID NO: 1809110 - RNA, 19 nt, Human
ucauuuuuaguagagacag

SEQ ID NO: 1809111 - RNA, 14 nt, Human
ucauuuuugaauac

SEQ ID NO: 1809112 - RNA, 18 nt, Human
ucauuuuuuuuaagaaaa

SEQ ID NO: 1809113 - RNA, 17 nt, Human
ucauuuuuuuuaagaaa

SEQ ID NO: 1809114 - RNA, 14 nt, Human
ucauuugucacaca

SEQ ID NO: 1809115 - RNA, 16 nt, Human
ucauuugcuuuggaag

SEQ ID NO: 1809116 - RNA, 15 nt, Human
ucauuugcuuuggaa

SEQ ID NO: 1809117 - RNA, 16 nt, Human
ucauuugucacacacu

SEQ ID NO: 1809118 - RNA, 20 nt, Human
accuggaauauauaaccagu

SEQ ID NO: 1809119 - RNA, 12 nt, Human
accugcucuccu

SEQ ID NO: 1809120 - RNA, 23 nt, Human
accugccuguugggccaggagcc

SEQ ID NO: 1809121 - RNA, 16 nt, Human
accugcggugcuaucu

SEQ ID NO: 1809122 - RNA, 21 nt, Human
accugcgucucauacucaccu

SEQ ID NO: 1809123 - RNA, 18 nt, Human
uccaaggguacuaaggaa

SEQ ID NO: 1809124 - RNA, 19 nt, Human
uccaaaugcagcuuuaaaa

SEQ ID NO: 1809125 - RNA, 20 nt, Human
uccacccaggagccccgagg

SEQ ID NO: 1809126 - RNA, 17 nt, Human
uccacccaggagccccg

SEQ ID NO: 1809127 - RNA, 13 nt, Human
uccacccaccuca

SEQ ID NO: 1809128 - RNA, 12 nt, Human
uccacccaccuc

SEQ ID NO: 1809129 - RNA, 18 nt, Human
uccaccaucaagccacca

SEQ ID NO: 1809130 - RNA, 12 nt, Human
accuggccucug

SEQ ID NO: 1809131 - RNA, 13 nt, Human
accuggccucugc

SEQ ID NO: 1809132 - RNA, 18 nt, Human
accuuuuuuauacauaaa

SEQ ID NO: 1809133 - RNA, 17 nt, Human
accuuuuuuauacauaa

SEQ ID NO: 1809134 - RNA, 16 nt, Human
accuuuuuuauacaua

SEQ ID NO: 1809135 - RNA, 14 nt, Human
accuuuguccccac

SEQ ID NO: 1809136 - RNA, 15 nt, Human
accuuuguccccacc

SEQ ID NO: 1809137 - RNA, 16 nt, Human
accuuuguccccaccg

SEQ ID NO: 1809138 - RNA, 14 nt, Human
accuuuuuuauaca

SEQ ID NO: 1809139 - RNA, 14 nt, Human
accuucuccuucac

SEQ ID NO: 1809140 - RNA, 22 nt, Human
accuucuccuucaccuuugucc

SEQ ID NO: 1809141 - RNA, 13 nt, Human
accuuugucccca

SEQ ID NO: 1809142 - RNA, 21 nt, Human
accuggguaacuagggaagau

SEQ ID NO: 1809143 - RNA, 15 nt, Human
accuucgccaccugg

SEQ ID NO: 1809144 - RNA, 17 nt, Human
accuucgccaccugggu

SEQ ID NO: 1809145 - RNA, 17 nt, Human
accuucccaugcccugg

SEQ ID NO: 1809146 - RNA, 13 nt, Human
uccguuaaaauac

SEQ ID NO: 1809147 - RNA, 15 nt, Human
uccguuaaaauacca

SEQ ID NO: 1809148 - RNA, 12 nt, Human
uccuacucugug

SEQ ID NO: 1809149 - RNA, 21 nt, Human
uccuagccugugccucuggga

SEQ ID NO: 1809150 - RNA, 16 nt, Human
acucgaguuacagaca

SEQ ID NO: 1809151 - RNA, 21 nt, Human
acucuuauugcccacgcugga

SEQ ID NO: 1809152 - RNA, 19 nt, Human
acucuggcagcucagagag

SEQ ID NO: 1809153 - RNA, 20 nt, Human
acucuggcagcucagagagg

SEQ ID NO: 1809154 - RNA, 16 nt, Human
acucuggcagcucaga

SEQ ID NO: 1809155 - RNA, 17 nt, Human
acucuggcagcucagag

SEQ ID NO: 1809156 - RNA, 20 nt, Human
acucuucaguuaagccuuug

SEQ ID NO: 1809157 - RNA, 21 nt, Human
acucuucaguuaagccuuugg

SEQ ID NO: 1809158 - RNA, 13 nt, Human
acucuugaaaaau

SEQ ID NO: 1809159 - RNA, 18 nt, Human
acucugacaacagacuuc

SEQ ID NO: 1809160 - RNA, 20 nt, Human
acucugacaacagacuucug

SEQ ID NO: 1809161 - RNA, 22 nt, Human
acucugacaacagacuucugaa

SEQ ID NO: 1809162 - RNA, 23 nt, Human
acucugacaacagacuucugaaa

SEQ ID NO: 1809163 - RNA, 13 nt, Human
acucugacaacag

SEQ ID NO: 1809164 - RNA, 17 nt, Human
acucugacaacagacuu

SEQ ID NO: 1809165 - RNA, 14 nt, Human
acucguauaugucu

SEQ ID NO: 1809166 - RNA, 17 nt, Human
acucgcgacaaugcaaa

SEQ ID NO: 1809167 - RNA, 15 nt, Human
acucgcgacaaugca

SEQ ID NO: 1809168 - RNA, 16 nt, Human
acucgcgacaaugcaa

SEQ ID NO: 1809169 - RNA, 12 nt, Human
uccucucugccc

SEQ ID NO: 1809170 - RNA, 13 nt, Human
uccucucugcccu

SEQ ID NO: 1809171 - RNA, 14 nt, Human
uccucucugcccua

SEQ ID NO: 1809172 - RNA, 15 nt, Human
uccucucugcccuaa

SEQ ID NO: 1809173 - RNA, 12 nt, Human
uccucugagccu

SEQ ID NO: 1809174 - RNA, 13 nt, Human
uccucugagccuu

SEQ ID NO: 1809175 - RNA, 17 nt, Human
uccucugagccuuggga

SEQ ID NO: 1809176 - RNA, 17 nt, Human
uccucuccacugccuuc

SEQ ID NO: 1809177 - RNA, 18 nt, Human
uccucuccacugccuucg

SEQ ID NO: 1809178 - RNA, 21 nt, Human
uccucccaccucagccucccg

SEQ ID NO: 1809179 - RNA, 20 nt, Human
uccucccaccucagccuccc

SEQ ID NO: 1809180 - RNA, 18 nt, Human
uccucccaccucagccuc

SEQ ID NO: 1809181 - RNA, 16 nt, Human
uccucccaccucagcc

SEQ ID NO: 1809182 - RNA, 15 nt, Human
uccucccaccucagc

SEQ ID NO: 1809183 - RNA, 14 nt, Human
uccucccaccucag

SEQ ID NO: 1809184 - RNA, 21 nt, Human
acucuugaaaaaugcauguug

SEQ ID NO: 1809185 - RNA, 14 nt, Human
acucuugaaaaaug

SEQ ID NO: 1809186 - RNA, 19 nt, Human
acucuugaaaaaugcaugu

SEQ ID NO: 1809187 - RNA, 23 nt, Human
uccucuuuggucuacacugugcu

SEQ ID NO: 1809188 - RNA, 14 nt, Human
uccucugaggcuga

SEQ ID NO: 1809189 - RNA, 19 nt, Human
uccucuugccacugccucu

SEQ ID NO: 1809190 - RNA, 12 nt, Human
uccucugcugcu

SEQ ID NO: 1809191 - RNA, 15 nt, Human
uccugaagaauugaa

SEQ ID NO: 1809192 - RNA, 18 nt, Human
acuacggaauaguuggcu

SEQ ID NO: 1809193 - RNA, 22 nt, Human
acuaccuguaaugacaggccug

SEQ ID NO: 1809194 - RNA, 16 nt, Human
acuagaacugaauuuu

SEQ ID NO: 1809195 - RNA, 14 nt, Human
acuacuagggaaau

SEQ ID NO: 1809196 - RNA, 23 nt, Human
acuagaacugaauuuugucuuua

SEQ ID NO: 1809197 - RNA, 19 nt, Human
acuagaacugaauuuuguc

SEQ ID NO: 1809198 - RNA, 18 nt, Human
acuagaacugaauuuugu

SEQ ID NO: 1809199 - RNA, 17 nt, Human
acuagaacugaauuuug

SEQ ID NO: 1809200 - RNA, 13 nt, Human
acguacacacaca

SEQ ID NO: 1809201 - RNA, 12 nt, Human
acguacacauuu

SEQ ID NO: 1809202 - RNA, 14 nt, Human
acguacacauuuua

SEQ ID NO: 1809203 - RNA, 13 nt, Human
acguacacauuuu

SEQ ID NO: 1809204 - RNA, 22 nt, Human
uccccacuugagaauuacccuu

SEQ ID NO: 1809205 - RNA, 15 nt, Human
uccccuaaagccuca

SEQ ID NO: 1809206 - RNA, 22 nt, Human
uccccuaaagccucaaaacaaa

SEQ ID NO: 1809207 - RNA, 14 nt, Human
acucaaugcacuga

SEQ ID NO: 1809208 - RNA, 20 nt, Human
acucacauuuauucugcuca

SEQ ID NO: 1809209 - RNA, 19 nt, Human
acucacauuuauucugcuc

SEQ ID NO: 1809210 - RNA, 21 nt, Human
acucacauuuauucugcucac

SEQ ID NO: 1809211 - RNA, 13 nt, Human
acuauguugauaa

SEQ ID NO: 1809212 - RNA, 12 nt, Human
acuauguaucaa

SEQ ID NO: 1809213 - RNA, 12 nt, Human
acuauaauguaa

SEQ ID NO: 1809214 - RNA, 13 nt, Human
acuauaauguaag

SEQ ID NO: 1809215 - RNA, 14 nt, Human
acuauaauguaagc

SEQ ID NO: 1809216 - RNA, 16 nt, Human
acuaugauuuggaaaa

SEQ ID NO: 1809217 - RNA, 19 nt, Human
acuaugauuuaauuugaaa

SEQ ID NO: 1809218 - RNA, 15 nt, Human
acuaugauuuggaaa

SEQ ID NO: 1809219 - RNA, 21 nt, Human
acuauaauguaagcucuacug

SEQ ID NO: 1809220 - RNA, 14 nt, Human
acucagaauucucu

SEQ ID NO: 1809221 - RNA, 22 nt, Human
acucagaauucucuaguuugau

SEQ ID NO: 1809222 - RNA, 21 nt, Human
acucagaauucucuaguuuga

SEQ ID NO: 1809223 - RNA, 18 nt, Human
acucagaagacacugaug

SEQ ID NO: 1809224 - RNA, 17 nt, Human
acucagaagacacugau

SEQ ID NO: 1809225 - RNA, 16 nt, Human
acucagaagacacuga

SEQ ID NO: 1809226 - RNA, 15 nt, Human
acucagaagacacug

SEQ ID NO: 1809227 - RNA, 14 nt, Human
acucagaagacacu

SEQ ID NO: 1809228 - RNA, 21 nt, Human
acucaccugccccucaacucu

SEQ ID NO: 1809229 - RNA, 14 nt, Human
acucaccugccccu

SEQ ID NO: 1809230 - RNA, 19 nt, Human
acucaccugccccucaacu

SEQ ID NO: 1809231 - RNA, 23 nt, Human
acucaucuagguaaauuacaguu

SEQ ID NO: 1809232 - RNA, 12 nt, Human
acucaucuuagg

SEQ ID NO: 1809233 - RNA, 21 nt, Human
acucaucuagguaaauuacag

SEQ ID NO: 1809234 - RNA, 16 nt, Human
acucauugaccugagg

SEQ ID NO: 1809235 - RNA, 17 nt, Human
acucauugaccugaggc

SEQ ID NO: 1809236 - RNA, 18 nt, Human
acucauugaccugaggcc

SEQ ID NO: 1809237 - RNA, 22 nt, Human
acucauugaccugaggcccuuc

SEQ ID NO: 1809238 - RNA, 18 nt, Human
ucccucagucuggcccuu

SEQ ID NO: 1809239 - RNA, 20 nt, Human
ucccucagucuggcccuucc

SEQ ID NO: 1809240 - RNA, 11 nt, Human
ucccucuuucc

SEQ ID NO: 1809241 - RNA, 13 nt, Human
ucccucuuucccu

SEQ ID NO: 1809242 - RNA, 23 nt, Human
ucccugaaggccccgcccaggcu

SEQ ID NO: 1809243 - RNA, 17 nt, Human
acucaccccagccccaa

SEQ ID NO: 1809244 - RNA, 19 nt, Human
acucaccucccccaucucu

SEQ ID NO: 1809245 - RNA, 20 nt, Human
acucaccucccccaucucuu

SEQ ID NO: 1809246 - RNA, 18 nt, Human
ucccugaaggccccgccc

SEQ ID NO: 1809247 - RNA, 21 nt, Human
ucccugaaggccccgcccagg

SEQ ID NO: 1809248 - RNA, 22 nt, Human
ucccugaaggccccgcccaggc

SEQ ID NO: 1809249 - RNA, 17 nt, Human
uagcgcccaguugggug

SEQ ID NO: 1809250 - RNA, 14 nt, Human
uagcgcccaguugg

SEQ ID NO: 1809251 - RNA, 21 nt, Human
uagccuuagaagucacacagu

SEQ ID NO: 1809252 - RNA, 20 nt, Human
uagccuuagaagucacacag

SEQ ID NO: 1809253 - RNA, 13 nt, Human
uagcuuuucccuu

SEQ ID NO: 1809254 - RNA, 13 nt, Human
uaggaaaaacuga

SEQ ID NO: 1809255 - RNA, 14 nt, Human
uaggaaaaacugau

SEQ ID NO: 1809256 - RNA, 23 nt, Human
uagcuuuaaugauaugcuuguaa

SEQ ID NO: 1809257 - RNA, 19 nt, Human
uagggauggggcugugggg

SEQ ID NO: 1809258 - RNA, 21 nt, Human
uagggaaggauacaaaagcau

SEQ ID NO: 1809259 - RNA, 13 nt, Human
uagggaagauaau

SEQ ID NO: 1809260 - RNA, 16 nt, Human
uaggaaaaacugauuu

SEQ ID NO: 1809261 - RNA, 17 nt, Human
uaggaaaaacugauuuu

SEQ ID NO: 1809262 - RNA, 15 nt, Human
uaggcaggaccugug

SEQ ID NO: 1809263 - RNA, 14 nt, Human
uaggcaggaccugu

SEQ ID NO: 1809264 - RNA, 13 nt, Human
uaggauguugaaa

SEQ ID NO: 1809265 - RNA, 23 nt, Human
acaaugcaaaccaucauugaaau

SEQ ID NO: 1809266 - RNA, 19 nt, Human
acaaugcaaaccaucauug

SEQ ID NO: 1809267 - RNA, 21 nt, Human
acaaugcaaaccaucauugaa

SEQ ID NO: 1809268 - RNA, 15 nt, Human
uagggugggccuuca

SEQ ID NO: 1809269 - RNA, 15 nt, Human
uaggguuauaauaau

SEQ ID NO: 1809270 - RNA, 17 nt, Human
uaggguuauaauaaugu

SEQ ID NO: 1809271 - RNA, 13 nt, Human
uaggguccugggg

SEQ ID NO: 1809272 - RNA, 19 nt, Human
uaggguaagugagagaggg

SEQ ID NO: 1809273 - RNA, 22 nt, Human
acaaugacuuacuguacaugaa

SEQ ID NO: 1809274 - RNA, 20 nt, Human
acaaugacuuacuguacaug

SEQ ID NO: 1809275 - RNA, 11 nt, Human
acaaugcaaac

SEQ ID NO: 1809276 - RNA, 16 nt, Human
acaaugcaaaccauca

SEQ ID NO: 1809277 - RNA, 17 nt, Human
acaaugcaaaccaucau

SEQ ID NO: 1809278 - RNA, 18 nt, Human
acaaugcaaaccaucauu

SEQ ID NO: 1809279 - RNA, 22 nt, Human
acacaggcccggcuccaggcuc

SEQ ID NO: 1809280 - RNA, 21 nt, Human
acacaggcccggcuccaggcu

SEQ ID NO: 1809281 - RNA, 20 nt, Human
acacaggcccggcuccaggc

SEQ ID NO: 1809282 - RNA, 19 nt, Human
acacaggcccggcuccagg

SEQ ID NO: 1809283 - RNA, 24 nt, Human
acacaggcccggcuccaggcuccu

SEQ ID NO: 1809284 - RNA, 23 nt, Human
acacaggcccggcuccaggcucc

SEQ ID NO: 1809285 - RNA, 18 nt, Human
acacaggcccggcuccag

SEQ ID NO: 1809286 - RNA, 17 nt, Human
acacaggcccggcucca

SEQ ID NO: 1809287 - RNA, 16 nt, Human
acacaggcccggcucc

SEQ ID NO: 1809288 - RNA, 23 nt, Human
acacacagauuugagcucagccc

SEQ ID NO: 1809289 - RNA, 16 nt, Human
acacaguauuacuucu

SEQ ID NO: 1809290 - RNA, 19 nt, Human
acacaguaccauuuaaugg

SEQ ID NO: 1809291 - RNA, 13 nt, Human
uaguaaaaauaaa

SEQ ID NO: 1809292 - RNA, 16 nt, Human
uaguaaaaauaaaauu

SEQ ID NO: 1809293 - RNA, 22 nt, Human
uaguagagacaggguuuugcca

SEQ ID NO: 1809294 - RNA, 15 nt, Human
uaguagagacagggu

SEQ ID NO: 1809295 - RNA, 13 nt, Human
uaguagagacggg

SEQ ID NO: 1809296 - RNA, 14 nt, Human
uagucacugagaca

SEQ ID NO: 1809297 - RNA, 14 nt, Human
uaguagagacaggg

SEQ ID NO: 1809298 - RNA, 12 nt, Human
uaguaaucauau

SEQ ID NO: 1809299 - RNA, 21 nt, Human
uagacagagucucacuguugc

SEQ ID NO: 1809300 - RNA, 17 nt, Human
uagacagucccugccaa

SEQ ID NO: 1809301 - RNA, 21 nt, Human
uagacagucccugccaaugga

SEQ ID NO: 1809302 - RNA, 20 nt, Human
aauuugugauacaaugcugu

SEQ ID NO: 1809303 - RNA, 18 nt, Human
aauuugugauacaaugcu

SEQ ID NO: 1809304 - RNA, 17 nt, Human
aauuugugauacaaugc

SEQ ID NO: 1809305 - RNA, 14 nt, Human
aauuugugauacaa

SEQ ID NO: 1809306 - RNA, 18 nt, Human
aauuugggggaaaauuua

SEQ ID NO: 1809307 - RNA, 10 nt, Human
uagacagagu

SEQ ID NO: 1809308 - RNA, 16 nt, Human
uagacagucccugcca

SEQ ID NO: 1809309 - RNA, 18 nt, Human
uagacaauuuauuauggc

SEQ ID NO: 1809310 - RNA, 16 nt, Human
uagaacucccuuucaa

SEQ ID NO: 1809311 - RNA, 18 nt, Human
uagaacucccuuucaaca

SEQ ID NO: 1809312 - RNA, 17 nt, Human
uagaacucccuuucaac

SEQ ID NO: 1809313 - RNA, 12 nt, Human
aauuccacagcu

SEQ ID NO: 1809314 - RNA, 13 nt, Human
aauuccacagcug

SEQ ID NO: 1809315 - RNA, 14 nt, Human
aauuccacagcugc

SEQ ID NO: 1809316 - RNA, 22 nt, Human
uagcacagacccugcccugugg

SEQ ID NO: 1809317 - RNA, 24 nt, Human
uagcacagacccugcccugugggc

SEQ ID NO: 1809318 - RNA, 12 nt, Human
uagccaaggcca

SEQ ID NO: 1809319 - RNA, 14 nt, Human
uagccaaggccaaa

SEQ ID NO: 1809320 - RNA, 13 nt, Human
uagccaaggccaa

SEQ ID NO: 1809321 - RNA, 14 nt, Human
uagcacagacccug

SEQ ID NO: 1809322 - RNA, 20 nt, Human
uagcacagacccugcccugu

SEQ ID NO: 1809323 - RNA, 21 nt, Human
uagcacagacccugcccugug

SEQ ID NO: 1809324 - RNA, 15 nt, Human
uagcacagacccugc

SEQ ID NO: 1809325 - RNA, 14 nt, Human
uagagccagggucu

SEQ ID NO: 1809326 - RNA, 22 nt, Human
uagagcggagaaaggaagggcu

SEQ ID NO: 1809327 - RNA, 12 nt, Human
aauuuuacauuu

SEQ ID NO: 1809328 - RNA, 23 nt, Human
uaugggacucaaugcacugacau

SEQ ID NO: 1809329 - RNA, 16 nt, Human
uaugggacucaaugca

SEQ ID NO: 1809330 - RNA, 10 nt, Human
uaugggagag

SEQ ID NO: 1809331 - RNA, 22 nt, Human
uauggcccuggccuagcauacg

SEQ ID NO: 1809332 - RNA, 21 nt, Human
uauggcccuggccuagcauac

SEQ ID NO: 1809333 - RNA, 20 nt, Human
uauggcccuggccuagcaua

SEQ ID NO: 1809334 - RNA, 22 nt, Human
acagcuaaucagcauucucacu

SEQ ID NO: 1809335 - RNA, 24 nt, Human
uaugauagguuauuuugauguaaa

SEQ ID NO: 1809336 - RNA, 17 nt, Human
uaugauacuugaaaauu

SEQ ID NO: 1809337 - RNA, 22 nt, Human
uaugcaugaaguaauaugcaca

SEQ ID NO: 1809338 - RNA, 14 nt, Human
uaugcucugcaugu

SEQ ID NO: 1809339 - RNA, 21 nt, Human
acagauuuggaaagacuggac

SEQ ID NO: 1809340 - RNA, 15 nt, Human
acagauuuggaaaga

SEQ ID NO: 1809341 - RNA, 14 nt, Human
acagauuuggaaag

SEQ ID NO: 1809342 - RNA, 22 nt, Human
acagauuugagcucagcccugg

SEQ ID NO: 1809343 - RNA, 19 nt, Human
acagcacgggggccaagga

SEQ ID NO: 1809344 - RNA, 17 nt, Human
acagcagccccugcaca

SEQ ID NO: 1809345 - RNA, 14 nt, Human
acagccccuccucc

SEQ ID NO: 1809346 - RNA, 16 nt, Human
acagccccuccuccau

SEQ ID NO: 1809347 - RNA, 15 nt, Human
acagcccgggcucug

SEQ ID NO: 1809348 - RNA, 23 nt, Human
acagcccuccaucuaaacugccc

SEQ ID NO: 1809349 - RNA, 16 nt, Human
acagcccgggcucugc

SEQ ID NO: 1809350 - RNA, 20 nt, Human
uaugaagcuuuuaugugaaa

SEQ ID NO: 1809351 - RNA, 22 nt, Human
uaugaagcuuuuaugugaaaca

SEQ ID NO: 1809352 - RNA, 23 nt, Human
uaugaagcuuuuaugugaaacau

SEQ ID NO: 1809353 - RNA, 23 nt, Human
uaugaggcauuuguuugaacuga

SEQ ID NO: 1809354 - RNA, 21 nt, Human
uaugaggcauuuguuugaacu

SEQ ID NO: 1809355 - RNA, 15 nt, Human
uaugaggcauuuguu

SEQ ID NO: 1809356 - RNA, 14 nt, Human
uaugaggcauuugu

SEQ ID NO: 1809357 - RNA, 19 nt, Human
acagcuaaugggacacuaa

SEQ ID NO: 1809358 - RNA, 17 nt, Human
acagcuaaugggacacu

SEQ ID NO: 1809359 - RNA, 16 nt, Human
acagcuaaugggacac

SEQ ID NO: 1809360 - RNA, 15 nt, Human
acagcuaaugggaca

SEQ ID NO: 1809361 - RNA, 21 nt, Human
acagcuucauuuccugugucu

SEQ ID NO: 1809362 - RNA, 19 nt, Human
acagcuucauuuccugugu

SEQ ID NO: 1809363 - RNA, 17 nt, Human
acagcuucauuuccugu

SEQ ID NO: 1809364 - RNA, 17 nt, Human
acagcuugaccgugagg

SEQ ID NO: 1809365 - RNA, 20 nt, Human
acagcuugaccgugaggcca

SEQ ID NO: 1809366 - RNA, 21 nt, Human
acagcuugaccgugaggccag

SEQ ID NO: 1809367 - RNA, 21 nt, Human
acaggaaaagcugcugacagu

SEQ ID NO: 1809368 - RNA, 20 nt, Human
acaggaaaagcugcugacag

SEQ ID NO: 1809369 - RNA, 19 nt, Human
acaggaaaagcugcugaca

SEQ ID NO: 1809370 - RNA, 22 nt, Human
acagcuugaccgugaggccaga

SEQ ID NO: 1809371 - RNA, 23 nt, Human
acagcuugaccgugaggccagag

SEQ ID NO: 1809372 - RNA, 15 nt, Human
acaggcagauacagg

SEQ ID NO: 1809373 - RNA, 16 nt, Human
acaggacucugccucc

SEQ ID NO: 1809374 - RNA, 15 nt, Human
acaggacucugccuc

SEQ ID NO: 1809375 - RNA, 20 nt, Human
acaggaaaauuuuaaaaaua

SEQ ID NO: 1809376 - RNA, 17 nt, Human
acaggcccggcuccagg

SEQ ID NO: 1809377 - RNA, 16 nt, Human
acaggcccggcuccag

SEQ ID NO: 1809378 - RNA, 13 nt, Human
acaggcaggucca

SEQ ID NO: 1809379 - RNA, 22 nt, Human
acaggcccggcuccaggcuccu

SEQ ID NO: 1809380 - RNA, 21 nt, Human
acaggcccggcuccaggcucc

SEQ ID NO: 1809381 - RNA, 20 nt, Human
acaggcccggcuccaggcuc

SEQ ID NO: 1809382 - RNA, 18 nt, Human
acaggcccggcuccaggc

SEQ ID NO: 1809383 - RNA, 13 nt, Human
acaggcccuuccu

SEQ ID NO: 1809384 - RNA, 15 nt, Human
acaggcccuuccucu

SEQ ID NO: 1809385 - RNA, 22 nt, Human
acaggcccuuccucuccacugc

SEQ ID NO: 1809386 - RNA, 21 nt, Human
uaugucucgugguaggacugu

SEQ ID NO: 1809387 - RNA, 18 nt, Human
uauagccuaggugacaga

SEQ ID NO: 1809388 - RNA, 15 nt, Human
uauaggcaccuacca

SEQ ID NO: 1809389 - RNA, 23 nt, Human
uauaggaacuuaaauaaugugaa

SEQ ID NO: 1809390 - RNA, 12 nt, Human
uauaggaauuga

SEQ ID NO: 1809391 - RNA, 16 nt, Human
acacucauugaccuga

SEQ ID NO: 1809392 - RNA, 18 nt, Human
uauaauuuaccugaaguc

SEQ ID NO: 1809393 - RNA, 21 nt, Human
uauaauuuaccugaagucuuu

SEQ ID NO: 1809394 - RNA, 22 nt, Human
uauacacuuacacuuuaugcac

SEQ ID NO: 1809395 - RNA, 17 nt, Human
uagucacugagacagcc

SEQ ID NO: 1809396 - RNA, 20 nt, Human
uagucacugagacagcccgg

SEQ ID NO: 1809397 - RNA, 15 nt, Human
acacuaaugaggaaa

SEQ ID NO: 1809398 - RNA, 22 nt, Human
acacuaaugaggaaacugcacu

SEQ ID NO: 1809399 - RNA, 21 nt, Human
acacucaaaagcugggcaggu

SEQ ID NO: 1809400 - RNA, 19 nt, Human
uauaagugauugcugguuu

SEQ ID NO: 1809401 - RNA, 13 nt, Human
acagaaauguaca

SEQ ID NO: 1809402 - RNA, 19 nt, Human
acagacauacuaaccagca

SEQ ID NO: 1809403 - RNA, 18 nt, Human
acagacauacuaaccagc

SEQ ID NO: 1809404 - RNA, 16 nt, Human
acagaaagguuuucuu

SEQ ID NO: 1809405 - RNA, 18 nt, Human
acacuuacacuuuaugca

SEQ ID NO: 1809406 - RNA, 21 nt, Human
acacuuacacuuuaugcacaa

SEQ ID NO: 1809407 - RNA, 15 nt, Human
acacuucaggcucuu

SEQ ID NO: 1809408 - RNA, 19 nt, Human
acacuucaggcucuucucc

SEQ ID NO: 1809409 - RNA, 22 nt, Human
acacuucaggcucuucuccuuu

SEQ ID NO: 1809410 - RNA, 14 nt, Human
acacuuccauaauc

SEQ ID NO: 1809411 - RNA, 18 nt, Human
acacuguuucaaacuuua

SEQ ID NO: 1809412 - RNA, 17 nt, Human
acacuguuucaaacuuu

SEQ ID NO: 1809413 - RNA, 17 nt, Human
acacucauugaccugag

SEQ ID NO: 1809414 - RNA, 19 nt, Human
acacucauugaccugaggc

SEQ ID NO: 1809415 - RNA, 20 nt, Human
acacuguuucaaacuuuacu

SEQ ID NO: 1809416 - RNA, 16 nt, Human
acacuuacacuuuaug

SEQ ID NO: 1809417 - RNA, 22 nt, Human
uaucacccagaagaaaauagug

SEQ ID NO: 1809418 - RNA, 19 nt, Human
uaucacccagaagaaaaua

SEQ ID NO: 1809419 - RNA, 23 nt, Human
uaucaaauacauuuaaaacauua

SEQ ID NO: 1809420 - RNA, 17 nt, Human
uaucagaauucucagaa

SEQ ID NO: 1809421 - RNA, 19 nt, Human
uauccaacaucaacaucuu

SEQ ID NO: 1809422 - RNA, 15 nt, Human
uaucccggcugcccu

SEQ ID NO: 1809423 - RNA, 22 nt, Human
aauuaugugccagauuuaugca

SEQ ID NO: 1809424 - RNA, 21 nt, Human
aauuauuuauuaaaugcccag

SEQ ID NO: 1809425 - RNA, 22 nt, Human
aauuauuuauuaaaugcccagc

SEQ ID NO: 1809426 - RNA, 17 nt, Human
aauucaguuguuagugu

SEQ ID NO: 1809427 - RNA, 22 nt, Human
aauucaguuguuagugugucuu

SEQ ID NO: 1809428 - RNA, 11 nt, Human
aauucaguugu

SEQ ID NO: 1809429 - RNA, 16 nt, Human
uaccugaagucuuugu

SEQ ID NO: 1809430 - RNA, 13 nt, Human
uaccugaggggcc

SEQ ID NO: 1809431 - RNA, 15 nt, Human
uaccugaggggccuc

SEQ ID NO: 1809432 - RNA, 23 nt, Human
uaccugaagcuaucguaaaauua

SEQ ID NO: 1809433 - RNA, 13 nt, Human
uaccugaagucuu

SEQ ID NO: 1809434 - RNA, 14 nt, Human
uaccugaagucuuu

SEQ ID NO: 1809435 - RNA, 23 nt, Human
uacccgggaagggggcugggaca

SEQ ID NO: 1809436 - RNA, 23 nt, Human
uaccucuugagccuugaacuuug

SEQ ID NO: 1809437 - RNA, 22 nt, Human
uaccucuugagccuugaacuuu

SEQ ID NO: 1809438 - RNA, 15 nt, Human
uacccucauguucuu

SEQ ID NO: 1809439 - RNA, 17 nt, Human
aauuacaggaaguacug

SEQ ID NO: 1809440 - RNA, 19 nt, Human
aauuacaggaaguacugga

SEQ ID NO: 1809441 - RNA, 20 nt, Human
aauuacaggaaguacuggag

SEQ ID NO: 1809442 - RNA, 16 nt, Human
uaccugaggggccucu

SEQ ID NO: 1809443 - RNA, 16 nt, Human
uaccugccaggaagcc

SEQ ID NO: 1809444 - RNA, 13 nt, Human
aauguucaucaau

SEQ ID NO: 1809445 - RNA, 23 nt, Human
uacagagcccacgcccccacugg

SEQ ID NO: 1809446 - RNA, 21 nt, Human
aaugugcugaaugguuuucaa

SEQ ID NO: 1809447 - RNA, 20 nt, Human
aauguucaucaaugaaugaa

SEQ ID NO: 1809448 - RNA, 16 nt, Human
aauguucaucaaugaa

SEQ ID NO: 1809449 - RNA, 21 nt, Human
aauguucucucuucuccaccu

SEQ ID NO: 1809450 - RNA, 16 nt, Human
aauuaacuuuuauaaa

SEQ ID NO: 1809451 - RNA, 15 nt, Human
aauuaacuuuuauaa

SEQ ID NO: 1809452 - RNA, 16 nt, Human
aauuaaguacuaugua

SEQ ID NO: 1809453 - RNA, 17 nt, Human
aauuaaguacuauguau

SEQ ID NO: 1809454 - RNA, 13 nt, Human
aauuaacuuuuau

SEQ ID NO: 1809455 - RNA, 12 nt, Human
aauuaacuuuua

SEQ ID NO: 1809456 - RNA, 19 nt, Human
uaccagggacugaggggag

SEQ ID NO: 1809457 - RNA, 15 nt, Human
uacccccugcaaagc

SEQ ID NO: 1809458 - RNA, 19 nt, Human
uacccccugcaaagcccag

SEQ ID NO: 1809459 - RNA, 23 nt, Human
uacccccugcaaagcccagcuug

SEQ ID NO: 1809460 - RNA, 18 nt, Human
uaccagccaguaaauggg

SEQ ID NO: 1809461 - RNA, 22 nt, Human
uaccagcagagcaccuuagaca

SEQ ID NO: 1809462 - RNA, 13 nt, Human
uaccagcagagca

SEQ ID NO: 1809463 - RNA, 14 nt, Human
uaccagcagagcac

SEQ ID NO: 1809464 - RNA, 12 nt, Human
uaccagcagagc

SEQ ID NO: 1809465 - RNA, 13 nt, Human
uacauuuccuaaa

SEQ ID NO: 1809466 - RNA, 12 nt, Human
uacauucuguua

SEQ ID NO: 1809467 - RNA, 22 nt, Human
uaauuccguagguuauuuucag

SEQ ID NO: 1809468 - RNA, 14 nt, Human
aaugcaaaccauca

SEQ ID NO: 1809469 - RNA, 12 nt, Human
aaugcaaaccau

SEQ ID NO: 1809470 - RNA, 11 nt, Human
aaugcaaacca

SEQ ID NO: 1809471 - RNA, 16 nt, Human
aaugauuucauucaau

SEQ ID NO: 1809472 - RNA, 13 nt, Human
aaugcaccuggaa

SEQ ID NO: 1809473 - RNA, 12 nt, Human
aaugagaaaucu

SEQ ID NO: 1809474 - RNA, 22 nt, Human
aaugagaaaucuaaaaaacgaa

SEQ ID NO: 1809475 - RNA, 11 nt, Human
aaugagccugg

SEQ ID NO: 1809476 - RNA, 20 nt, Human
aaugagaaaaugucuuuauu

SEQ ID NO: 1809477 - RNA, 21 nt, Human
aaugaccuuucaauaggaaaa

SEQ ID NO: 1809478 - RNA, 18 nt, Human
aaugaggucagagccugc

SEQ ID NO: 1809479 - RNA, 16 nt, Human
aaugaggucagagccu

SEQ ID NO: 1809480 - RNA, 14 nt, Human
aaugagccuggcaa

SEQ ID NO: 1809481 - RNA, 12 nt, Human
aaugagccuggc

SEQ ID NO: 1809482 - RNA, 13 nt, Human
aaugagccuggca

SEQ ID NO: 1809483 - RNA, 24 nt, Human
aaugauuucagcucacugcaaccu

SEQ ID NO: 1809484 - RNA, 15 nt, Human
uacaccgggccugga

SEQ ID NO: 1809485 - RNA, 17 nt, Human
uacaccgggccuggaga

SEQ ID NO: 1809486 - RNA, 13 nt, Human
uacagacaaagcg

SEQ ID NO: 1809487 - RNA, 14 nt, Human
uacagacaaagcgu

SEQ ID NO: 1809488 - RNA, 15 nt, Human
uacagacaaagcgug

SEQ ID NO: 1809489 - RNA, 23 nt, Human
uacagagcagacaguuaagagaa

SEQ ID NO: 1809490 - RNA, 19 nt, Human
uacagagcccacgccccca

SEQ ID NO: 1809491 - RNA, 22 nt, Human
uacagagcccacgcccccacug

SEQ ID NO: 1809492 - RNA, 19 nt, Human
uacagacaaagcguggugg

SEQ ID NO: 1809493 - RNA, 17 nt, Human
uacagagacagaaagca

SEQ ID NO: 1809494 - RNA, 16 nt, Human
aaugguuuucaaaaua

SEQ ID NO: 1809495 - RNA, 16 nt, Human
aaugguuuucuugugu

SEQ ID NO: 1809496 - RNA, 12 nt, Human
aauguaaauaaa

SEQ ID NO: 1809497 - RNA, 14 nt, Human
aaugguuuucaaaa

SEQ ID NO: 1809498 - RNA, 18 nt, Human
aauggaagacagcucuua

SEQ ID NO: 1809499 - RNA, 16 nt, Human
aauggaagacagcucu

SEQ ID NO: 1809500 - RNA, 13 nt, Human
aauggaagacagc

SEQ ID NO: 1809501 - RNA, 18 nt, Human
aaugcugguuuuucaguu

SEQ ID NO: 1809502 - RNA, 22 nt, Human
aaugcuggcuguuggcuggggg

SEQ ID NO: 1809503 - RNA, 21 nt, Human
aaugcuggcuguuggcugggg

SEQ ID NO: 1809504 - RNA, 18 nt, Human
uaauuuuuuugagacaga

SEQ ID NO: 1809505 - RNA, 22 nt, Human
uaauuuuuuuuuuccuuuuaaa

SEQ ID NO: 1809506 - RNA, 21 nt, Human
uacaaaaaaaaaaaaaaauua

SEQ ID NO: 1809507 - RNA, 15 nt, Human
uaauuuuuguauuuu

SEQ ID NO: 1809508 - RNA, 16 nt, Human
uacaaugcugugcccu

SEQ ID NO: 1809509 - RNA, 14 nt, Human
uacaaugcugugcc

SEQ ID NO: 1809510 - RNA, 13 nt, Human
uacaaugcugugc

SEQ ID NO: 1809511 - RNA, 20 nt, Human
aauccucaguuuuugugaaa

SEQ ID NO: 1809512 - RNA, 12 nt, Human
aaucccaggaug

SEQ ID NO: 1809513 - RNA, 17 nt, Human
aaucccauuuaaaaaaa

SEQ ID NO: 1809514 - RNA, 13 nt, Human
aaucucaaauaac

SEQ ID NO: 1809515 - RNA, 18 nt, Human
aaucugggccagaauuuc

SEQ ID NO: 1809516 - RNA, 17 nt, Human
uaaguguguguuuuuca

SEQ ID NO: 1809517 - RNA, 19 nt, Human
uaaguuaguuccacugaga

SEQ ID NO: 1809518 - RNA, 17 nt, Human
uaaguuaguuccacuga

SEQ ID NO: 1809519 - RNA, 21 nt, Human
uaaguuacacauuuuucagau

SEQ ID NO: 1809520 - RNA, 21 nt, Human
uaaguauucuuauuuaaugaa

SEQ ID NO: 1809521 - RNA, 20 nt, Human
uaaguuaguuccacugagac

SEQ ID NO: 1809522 - RNA, 20 nt, Human
aaucacguaaagcuagaaau

SEQ ID NO: 1809523 - RNA, 21 nt, Human
aaucacguaaagcuagaaaug

SEQ ID NO: 1809524 - RNA, 15 nt, Human
aauauuuauagguca

SEQ ID NO: 1809525 - RNA, 11 nt, Human
aaucagccugc

SEQ ID NO: 1809526 - RNA, 18 nt, Human
aaucagcauucucacucc

SEQ ID NO: 1809527 - RNA, 19 nt, Human
aaucagcauucucacuccu

SEQ ID NO: 1809528 - RNA, 19 nt, Human
aaucagccugcuccagcug

SEQ ID NO: 1809529 - RNA, 13 nt, Human
aaucagccugcuc

SEQ ID NO: 1809530 - RNA, 18 nt, Human
aaucagccugcuccagcu

SEQ ID NO: 1809531 - RNA, 22 nt, Human
uaaggaauuuuauuuuuuucug

SEQ ID NO: 1809532 - RNA, 17 nt, Human
uaaggaauaccuguccc

SEQ ID NO: 1809533 - RNA, 18 nt, Human
uaaggaauaccugucccc

SEQ ID NO: 1809534 - RNA, 13 nt, Human
uaaggaagacaau

SEQ ID NO: 1809535 - RNA, 9 nt, Human
uaaggaaua

SEQ ID NO: 1809536 - RNA, 14 nt, Human
uaagauucauauuu

SEQ ID NO: 1809537 - RNA, 14 nt, Human
uaagcaaaauguga

SEQ ID NO: 1809538 - RNA, 21 nt, Human
uaagcaaaaugugauauguac

SEQ ID NO: 1809539 - RNA, 15 nt, Human
uaagcaaaaugugau

SEQ ID NO: 1809540 - RNA, 21 nt, Human
uaagcuauucaguaauaacuc

SEQ ID NO: 1809541 - RNA, 18 nt, Human
aauagcgucauaacuaga

SEQ ID NO: 1809542 - RNA, 15 nt, Human
aauaccugucccccu

SEQ ID NO: 1809543 - RNA, 18 nt, Human
aauaccugucccccugac

SEQ ID NO: 1809544 - RNA, 19 nt, Human
aauaccugucccccugaca

SEQ ID NO: 1809545 - RNA, 21 nt, Human
aauaccugucccccugacaac

SEQ ID NO: 1809546 - RNA, 15 nt, Human
aauacagacuggaug

SEQ ID NO: 1809547 - RNA, 17 nt, Human
aauaccagccaguaaau

SEQ ID NO: 1809548 - RNA, 19 nt, Human
aauaccagccaguaaaugg

SEQ ID NO: 1809549 - RNA, 23 nt, Human
aauacauuuaaaacauuaaaaua

SEQ ID NO: 1809550 - RNA, 22 nt, Human
aauacauuuaaaacauuaaaau

SEQ ID NO: 1809551 - RNA, 21 nt, Human
aauacauuuaaaacauuaaaa

SEQ ID NO: 1809552 - RNA, 20 nt, Human
aauacauuuaaaacauuaaa

SEQ ID NO: 1809553 - RNA, 17 nt, Human
aauacauuuaaaacauu

SEQ ID NO: 1809554 - RNA, 14 nt, Human
aauacauuuaaaac

SEQ ID NO: 1809555 - RNA, 12 nt, Human
aauaccaaggaa

SEQ ID NO: 1809556 - RNA, 13 nt, Human
aauacagaggcaa

SEQ ID NO: 1809557 - RNA, 22 nt, Human
uaaauuaacuuuuauaaacuuu

SEQ ID NO: 1809558 - RNA, 21 nt, Human
uaaauuaacuuuuauaaacuu

SEQ ID NO: 1809559 - RNA, 18 nt, Human
uaaaugaaaaucgugaca

SEQ ID NO: 1809560 - RNA, 21 nt, Human
aaguguauuuuuuuacuaaua

SEQ ID NO: 1809561 - RNA, 18 nt, Human
aaguguauuuuuuuacua

SEQ ID NO: 1809562 - RNA, 13 nt, Human
uaaaugugguaaa

SEQ ID NO: 1809563 - RNA, 20 nt, Human
uaaauuaacuuuuauaaacu

SEQ ID NO: 1809564 - RNA, 19 nt, Human
uaaauuaacuuuuauaaac

SEQ ID NO: 1809565 - RNA, 13 nt, Human
uaacguauaaaag

SEQ ID NO: 1809566 - RNA, 17 nt, Human
uaacguauaaaagccug

SEQ ID NO: 1809567 - RNA, 13 nt, Human
uaacuucacauau

SEQ ID NO: 1809568 - RNA, 16 nt, Human
uaacuugucuuuggac

SEQ ID NO: 1809569 - RNA, 20 nt, Human
uaacuugucuuuggacccug

SEQ ID NO: 1809570 - RNA, 13 nt, Human
uaagaagugaaaa

SEQ ID NO: 1809571 - RNA, 21 nt, Human
aauaguucagguaacaggcag

SEQ ID NO: 1809572 - RNA, 21 nt, Human
aauauauucagccuggcuuca

SEQ ID NO: 1809573 - RNA, 21 nt, Human
aauauauuuuaagacgaaaca

SEQ ID NO: 1809574 - RNA, 19 nt, Human
uaacaugugaaaagaauag

SEQ ID NO: 1809575 - RNA, 20 nt, Human
uaacaugaauauuuaguguu

SEQ ID NO: 1809576 - RNA, 21 nt, Human
uaacaugaauauuuaguguuc

SEQ ID NO: 1809577 - RNA, 14 nt, Human
uaacaugaauauuu

SEQ ID NO: 1809578 - RNA, 19 nt, Human
uaacauguaauuaaguacu

SEQ ID NO: 1809579 - RNA, 19 nt, Human
uaacaugaauauuuagugu

SEQ ID NO: 1809580 - RNA, 15 nt, Human
aagaccuucuccuuc

SEQ ID NO: 1809581 - RNA, 18 nt, Human
aagaccuucuccuucacc

SEQ ID NO: 1809582 - RNA, 19 nt, Human
aagaccuucuccuucaccu

SEQ ID NO: 1809583 - RNA, 13 nt, Human
aagacgcugugcu

SEQ ID NO: 1809584 - RNA, 15 nt, Human
aagacgcugugcugc

SEQ ID NO: 1809585 - RNA, 17 nt, Human
aagacgcugugcugccc

SEQ ID NO: 1809586 - RNA, 18 nt, Human
aagacgcugugcugcccu

SEQ ID NO: 1809587 - RNA, 19 nt, Human
aagacgcugugcugcccug

SEQ ID NO: 1809588 - RNA, 20 nt, Human
aagacgcugugcugcccugc

SEQ ID NO: 1809589 - RNA, 22 nt, Human
aagacgugauuuugcuguagaa

SEQ ID NO: 1809590 - RNA, 16 nt, Human
aagacgugauuuugcu

SEQ ID NO: 1809591 - RNA, 23 nt, Human
aagacgugauuuugcuguagaag

SEQ ID NO: 1809592 - RNA, 23 nt, Human
aagacugaguacguugugcauuu

SEQ ID NO: 1809593 - RNA, 18 nt, Human
aagacuuccagagccuca

SEQ ID NO: 1809594 - RNA, 16 nt, Human
aagacuuccagagccu

SEQ ID NO: 1809595 - RNA, 16 nt, Human
aagacuuuggaaagac

SEQ ID NO: 1809596 - RNA, 21 nt, Human
guggccucccaacucacccca

SEQ ID NO: 1809597 - RNA, 22 nt, Human
guggccucccaacucaccccag

SEQ ID NO: 1809598 - RNA, 23 nt, Human
aagaggaaugaaguacucauaca

SEQ ID NO: 1809599 - RNA, 17 nt, Human
gugggaagggcuacacc

SEQ ID NO: 1809600 - RNA, 23 nt, Human
gugggaggaucucuugagccugg

SEQ ID NO: 1809601 - RNA, 18 nt, Human
gugggagcugccuguuca

SEQ ID NO: 1809602 - RNA, 15 nt, Human
gugggagcugccugu

SEQ ID NO: 1809603 - RNA, 15 nt, Human
guggggucacucugg

SEQ ID NO: 1809604 - RNA, 14 nt, Human
gugggagcugccug

SEQ ID NO: 1809605 - RNA, 15 nt, Human
gugggacacccugug

SEQ ID NO: 1809606 - RNA, 13 nt, Human
gugggacacccug

SEQ ID NO: 1809607 - RNA, 22 nt, Human
guggcgcagcauauucaggaag

SEQ ID NO: 1809608 - RNA, 21 nt, Human
gugugaccacugcagaagaca

SEQ ID NO: 1809609 - RNA, 22 nt, Human
gugugacaaggauugcuacugu

SEQ ID NO: 1809610 - RNA, 16 nt, Human
gugugguagagugugc

SEQ ID NO: 1809611 - RNA, 20 nt, Human
gugugugaaaaugugugugu

SEQ ID NO: 1809612 - RNA, 13 nt, Human
aagauguagagga

SEQ ID NO: 1809613 - RNA, 20 nt, Human
gugucaagagggucugagga

SEQ ID NO: 1809614 - RNA, 23 nt, Human
guguauuuuuuuacuaauagaca

SEQ ID NO: 1809615 - RNA, 17 nt, Human
guguauuuuuuuacuaa

SEQ ID NO: 1809616 - RNA, 16 nt, Human
gugucagcauagaagu

SEQ ID NO: 1809617 - RNA, 17 nt, Human
aagaucguucucugccu

SEQ ID NO: 1809618 - RNA, 16 nt, Human
aagaucguucucugcc

SEQ ID NO: 1809619 - RNA, 13 nt, Human
aagaguaggaaga

SEQ ID NO: 1809620 - RNA, 14 nt, Human
aagaguaggaagac

SEQ ID NO: 1809621 - RNA, 20 nt, Human
aagauggcugugccucugcc

SEQ ID NO: 1809622 - RNA, 21 nt, Human
aagauggcugugccucugccu

SEQ ID NO: 1809623 - RNA, 23 nt, Human
aagauggcugugccucugccugu

SEQ ID NO: 1809624 - RNA, 19 nt, Human
aagaugcuucucacugcca

SEQ ID NO: 1809625 - RNA, 18 nt, Human
aagauggcugugccucug

SEQ ID NO: 1809626 - RNA, 17 nt, Human
aagaugcuucucacugc

SEQ ID NO: 1809627 - RNA, 16 nt, Human
aagaugcuucucacug

SEQ ID NO: 1809628 - RNA, 17 nt, Human
guggggucacucuggca

SEQ ID NO: 1809629 - RNA, 20 nt, Human
guggggucacucuggcagcu

SEQ ID NO: 1809630 - RNA, 21 nt, Human
guggggucacucuggcagcuc

SEQ ID NO: 1809631 - RNA, 22 nt, Human
guggggucacucuggcagcuca

SEQ ID NO: 1809632 - RNA, 22 nt, Human
aagagggucugaggaauccaga

SEQ ID NO: 1809633 - RNA, 12 nt, Human
aagaguaggaag

SEQ ID NO: 1809634 - RNA, 23 nt, Human
aagagggagggagggcuccagac

SEQ ID NO: 1809635 - RNA, 23 nt, Human
guuauuuuuauuuauuuaaauuu

SEQ ID NO: 1809636 - RNA, 20 nt, Human
guuauuuugauguaaagaug

SEQ ID NO: 1809637 - RNA, 20 nt, Human
guucaaagauauuuugcuuu

SEQ ID NO: 1809638 - RNA, 22 nt, Human
guucaaagauauuuugcuuugu

SEQ ID NO: 1809639 - RNA, 21 nt, Human
guucaaagauauuuugcuuug

SEQ ID NO: 1809640 - RNA, 18 nt, Human
guucaagcgauucuucug

SEQ ID NO: 1809641 - RNA, 19 nt, Human
guuaggcauugugggaagg

SEQ ID NO: 1809642 - RNA, 20 nt, Human
guuaggcauugugggaaggg

SEQ ID NO: 1809643 - RNA, 18 nt, Human
guuaagagaaaugagcuu

SEQ ID NO: 1809644 - RNA, 11 nt, Human
guuaagagaaa

SEQ ID NO: 1809645 - RNA, 12 nt, Human
guuaagagaaau

SEQ ID NO: 1809646 - RNA, 16 nt, Human
aagcuaggccuggcca

SEQ ID NO: 1809647 - RNA, 12 nt, Human
aagcuaggccug

SEQ ID NO: 1809648 - RNA, 20 nt, Human
aagccugaguuugcuuucaa

SEQ ID NO: 1809649 - RNA, 13 nt, Human
guucagcuccagc

SEQ ID NO: 1809650 - RNA, 15 nt, Human
guucagcuccagcuc

SEQ ID NO: 1809651 - RNA, 18 nt, Human
aagccucaaaacaaaggc

SEQ ID NO: 1809652 - RNA, 16 nt, Human
aagccucaaaacaaag

SEQ ID NO: 1809653 - RNA, 15 nt, Human
aagccucaaaacaaa

SEQ ID NO: 1809654 - RNA, 12 nt, Human
aagcucagggcc

SEQ ID NO: 1809655 - RNA, 13 nt, Human
aagcucagggccu

SEQ ID NO: 1809656 - RNA, 16 nt, Human
aagcucagggccuggc

SEQ ID NO: 1809657 - RNA, 17 nt, Human
aagcucagggccuggcu

SEQ ID NO: 1809658 - RNA, 20 nt, Human
aagcucagggccuggcucag

SEQ ID NO: 1809659 - RNA, 18 nt, Human
aagcucagggccuggcuc

SEQ ID NO: 1809660 - RNA, 19 nt, Human
aagcucagggccuggcuca

SEQ ID NO: 1809661 - RNA, 17 nt, Human
aagcuccaagcucccag

SEQ ID NO: 1809662 - RNA, 18 nt, Human
aagcuccaagcucccagg

SEQ ID NO: 1809663 - RNA, 21 nt, Human
gugugugcgccuacaggagug

SEQ ID NO: 1809664 - RNA, 12 nt, Human
aagcagugcaug

SEQ ID NO: 1809665 - RNA, 14 nt, Human
aagcagugcaugcu

SEQ ID NO: 1809666 - RNA, 15 nt, Human
aagcagugcaugcug

SEQ ID NO: 1809667 - RNA, 20 nt, Human
aagcagugcaugcugucccu

SEQ ID NO: 1809668 - RNA, 16 nt, Human
aagcauuuacuuugug

SEQ ID NO: 1809669 - RNA, 14 nt, Human
aagcauuuuguaau

SEQ ID NO: 1809670 - RNA, 17 nt, Human
aagcauuuuguaauaau

SEQ ID NO: 1809671 - RNA, 22 nt, Human
aagccaaagcuaggccuggcca

SEQ ID NO: 1809672 - RNA, 14 nt, Human
aagcccaggaaagg

SEQ ID NO: 1809673 - RNA, 17 nt, Human
aagcccaggaaaggcuc

SEQ ID NO: 1809674 - RNA, 19 nt, Human
aagcccaggaaaggcucca

SEQ ID NO: 1809675 - RNA, 22 nt, Human
aagcccaggaaaggcuccagga

SEQ ID NO: 1809676 - RNA, 19 nt, Human
aagcccugagcuuucugcu

SEQ ID NO: 1809677 - RNA, 15 nt, Human
aagcccuuccauguc

SEQ ID NO: 1809678 - RNA, 20 nt, Human
aagcccuuccaugucgccuc

SEQ ID NO: 1809679 - RNA, 23 nt, Human
aagcccuuccaugucgccucugc

SEQ ID NO: 1809680 - RNA, 20 nt, Human
aagccgcuggggccaguugg

SEQ ID NO: 1809681 - RNA, 20 nt, Human
uaaaagacagugaaagaaaa

SEQ ID NO: 1809682 - RNA, 13 nt, Human
uaaaagacuuuuu

SEQ ID NO: 1809683 - RNA, 21 nt, Human
uaaaauaauuuuguaauguau

SEQ ID NO: 1809684 - RNA, 16 nt, Human
uaaaauaauuuuguaa

SEQ ID NO: 1809685 - RNA, 15 nt, Human
uaaaauaauuuugua

SEQ ID NO: 1809686 - RNA, 22 nt, Human
uaaaauaccagccaguaaaugg

SEQ ID NO: 1809687 - RNA, 14 nt, Human
uaaaauaauuuugu

SEQ ID NO: 1809688 - RNA, 13 nt, Human
uaaaauaauuuug

SEQ ID NO: 1809689 - RNA, 18 nt, Human
aagugauucuccugccuc

SEQ ID NO: 1809690 - RNA, 17 nt, Human
aagugauucuccugccu

SEQ ID NO: 1809691 - RNA, 16 nt, Human
aagugauucuccugcc

SEQ ID NO: 1809692 - RNA, 15 nt, Human
aagugauucuccugc

SEQ ID NO: 1809693 - RNA, 19 nt, Human
aagugauucuccugccuca

SEQ ID NO: 1809694 - RNA, 20 nt, Human
aagugauucuccugccucag

SEQ ID NO: 1809695 - RNA, 21 nt, Human
aagugauucucaugccucagc

SEQ ID NO: 1809696 - RNA, 13 nt, Human
uaaaauauuccug

SEQ ID NO: 1809697 - RNA, 22 nt, Human
uaaaauauuccugcauuuguga

SEQ ID NO: 1809698 - RNA, 20 nt, Human
aagugauucucaugccucag

SEQ ID NO: 1809699 - RNA, 16 nt, Human
aagugaggaugaaaaa

SEQ ID NO: 1809700 - RNA, 15 nt, Human
uaaaaaucucaaauu

SEQ ID NO: 1809701 - RNA, 17 nt, Human
uaaaaaucucaaauuuc

SEQ ID NO: 1809702 - RNA, 16 nt, Human
uaaaaaucucaaauuu

SEQ ID NO: 1809703 - RNA, 21 nt, Human
uaaaaauaaaaaacacuggga

SEQ ID NO: 1809704 - RNA, 18 nt, Human
uaaaaauaaaaaacacug

SEQ ID NO: 1809705 - RNA, 19 nt, Human
uaaaaauaaaaaacacugg

SEQ ID NO: 1809706 - RNA, 15 nt, Human
uaaaaaguggaaaaa

SEQ ID NO: 1809707 - RNA, 15 nt, Human
guuuuucuucucccu

SEQ ID NO: 1809708 - RNA, 20 nt, Human
uaaaacuugauguguuaucu

SEQ ID NO: 1809709 - RNA, 22 nt, Human
uaaaacuugauguguuaucucu

SEQ ID NO: 1809710 - RNA, 21 nt, Human
uaaaaaucucaaauuucuaaa

SEQ ID NO: 1809711 - RNA, 20 nt, Human
uaaaaaucucaaauuucuaa

SEQ ID NO: 1809712 - RNA, 19 nt, Human
uaaaaaucucaaauuucua

SEQ ID NO: 1809713 - RNA, 16 nt, Human
aagucuuucacauuua

SEQ ID NO: 1809714 - RNA, 21 nt, Human
aagucaugcguuuaaucacau

SEQ ID NO: 1809715 - RNA, 14 nt, Human
aagugagagcuggg

SEQ ID NO: 1809716 - RNA, 12 nt, Human
aagugagagagg

SEQ ID NO: 1809717 - RNA, 15 nt, Human
aagugagagcugggu

SEQ ID NO: 1809718 - RNA, 15 nt, Human
guuuuucauaaagca

SEQ ID NO: 1809719 - RNA, 19 nt, Human
guuuuuccuguucuuaaga

SEQ ID NO: 1809720 - RNA, 18 nt, Human
aagugagacuuugagggu

SEQ ID NO: 1809721 - RNA, 19 nt, Human
aagugaagacaaugacuua

SEQ ID NO: 1809722 - RNA, 17 nt, Human
aagugaagacaaugacu

SEQ ID NO: 1809723 - RNA, 14 nt, Human
aagugaaaauauag

SEQ ID NO: 1809724 - RNA, 12 nt, Human
aagugaaaauau

SEQ ID NO: 1809725 - RNA, 12 nt, Human
aagugaaaacuu

SEQ ID NO: 1809726 - RNA, 21 nt, Human
aagugaaaaaggaggaagaga

SEQ ID NO: 1809727 - RNA, 20 nt, Human
aaguacacuguuucaaacuu

SEQ ID NO: 1809728 - RNA, 19 nt, Human
aaguacacuguuucaaacu

SEQ ID NO: 1809729 - RNA, 23 nt, Human
aaguacacuguuucaaacuuuac

SEQ ID NO: 1809730 - RNA, 22 nt, Human
guuuugccauguuggccaggcu

SEQ ID NO: 1809731 - RNA, 21 nt, Human
guuuugccauguuggccaggc

SEQ ID NO: 1809732 - RNA, 20 nt, Human
guuuugccauguuggccagg

SEQ ID NO: 1809733 - RNA, 16 nt, Human
guuuugccauguuggc

SEQ ID NO: 1809734 - RNA, 14 nt, Human
guuucugccgcagc

SEQ ID NO: 1809735 - RNA, 18 nt, Human
guuucugccgcagcccug

SEQ ID NO: 1809736 - RNA, 15 nt, Human
guuucugccgcagcc

SEQ ID NO: 1809737 - RNA, 21 nt, Human
aaguaauccaccugccucggc

SEQ ID NO: 1809738 - RNA, 18 nt, Human
aaguacacuguuucaaac

SEQ ID NO: 1809739 - RNA, 13 nt, Human
aaguacacuguuu

SEQ ID NO: 1809740 - RNA, 22 nt, Human
aaggggcccaaauucuuucagu

SEQ ID NO: 1809741 - RNA, 23 nt, Human
aaggcucugagcaaauguggcuc

SEQ ID NO: 1809742 - RNA, 20 nt, Human
aagguagaaauaucugaaaa

SEQ ID NO: 1809743 - RNA, 22 nt, Human
aagguacuuucauauuuuaaac

SEQ ID NO: 1809744 - RNA, 19 nt, Human
aagguacuuucauauuuua

SEQ ID NO: 1809745 - RNA, 18 nt, Human
aagguacuuucauauuuu

SEQ ID NO: 1809746 - RNA, 19 nt, Human
guuucuauguguagggcgg

SEQ ID NO: 1809747 - RNA, 14 nt, Human
guuucucaaagaaa

SEQ ID NO: 1809748 - RNA, 18 nt, Human
guuucucaaagaaauuuc

SEQ ID NO: 1809749 - RNA, 17 nt, Human
guuucucaaagaaauuu

SEQ ID NO: 1809750 - RNA, 18 nt, Human
guuucugaaagggacgcu

SEQ ID NO: 1809751 - RNA, 12 nt, Human
aaggucauuuuu

SEQ ID NO: 1809752 - RNA, 13 nt, Human
aaguaagcaaaga

SEQ ID NO: 1809753 - RNA, 16 nt, Human
aaguaaggaauuuuau

SEQ ID NO: 1809754 - RNA, 15 nt, Human
guugggcugguguca

SEQ ID NO: 1809755 - RNA, 13 nt, Human
guugggcuggugu

SEQ ID NO: 1809756 - RNA, 15 nt, Human
guugggccaggagcc

SEQ ID NO: 1809757 - RNA, 17 nt, Human
guugggccaggagccuc

SEQ ID NO: 1809758 - RNA, 13 nt, Human
guuuauugucaaa

SEQ ID NO: 1809759 - RNA, 22 nt, Human
aaggcucgagcaugccuggaug

SEQ ID NO: 1809760 - RNA, 19 nt, Human
aaggcucgagcaugccugg

SEQ ID NO: 1809761 - RNA, 20 nt, Human
aaggcucgagcaugccugga

SEQ ID NO: 1809762 - RNA, 19 nt, Human
aaggcuccaggagcagcca

SEQ ID NO: 1809763 - RNA, 22 nt, Human
aaggcuccaggagcagccacau

SEQ ID NO: 1809764 - RNA, 16 nt, Human
aaggcucgagcaugcc

SEQ ID NO: 1809765 - RNA, 18 nt, Human
aaggcucgagcaugccug

SEQ ID NO: 1809766 - RNA, 13 nt, Human
guuucaaacuuua

SEQ ID NO: 1809767 - RNA, 16 nt, Human
guuucaaacuuuacua

SEQ ID NO: 1809768 - RNA, 14 nt, Human
guuucaaacuuuac

SEQ ID NO: 1809769 - RNA, 16 nt, Human
aaggcuccaggagcag

SEQ ID NO: 1809770 - RNA, 18 nt, Human
aaggcuccaggagcagcc

SEQ ID NO: 1809771 - RNA, 15 nt, Human
aaggcuccaggagca

SEQ ID NO: 1809772 - RNA, 17 nt, Human
guuucaaacuuuacuau

SEQ ID NO: 1809773 - RNA, 13 nt, Human
guugcccaggcug

SEQ ID NO: 1809774 - RNA, 12 nt, Human
guugcccaggcu

SEQ ID NO: 1809775 - RNA, 23 nt, Human
guugcccaggcaggucuugaacu

SEQ ID NO: 1809776 - RNA, 22 nt, Human
aaggccuaauucuaugccuguc

SEQ ID NO: 1809777 - RNA, 16 nt, Human
aaggccaaaggaagca

SEQ ID NO: 1809778 - RNA, 21 nt, Human
aaggauacaaaagcaugugag

SEQ ID NO: 1809779 - RNA, 13 nt, Human
aaggauacaaaag

SEQ ID NO: 1809780 - RNA, 18 nt, Human
aaggaauaccuguccccc

SEQ ID NO: 1809781 - RNA, 11 nt, Human
aaggagagcua

SEQ ID NO: 1809782 - RNA, 14 nt, Human
aaggagauuuacaa

SEQ ID NO: 1809783 - RNA, 17 nt, Human
aaggagauuuacaacug

SEQ ID NO: 1809784 - RNA, 20 nt, Human
aaggaggggauagagagaga

SEQ ID NO: 1809785 - RNA, 18 nt, Human
aaggaggaagagaaaaaa

SEQ ID NO: 1809786 - RNA, 14 nt, Human
aaggaagacuucau

SEQ ID NO: 1809787 - RNA, 15 nt, Human
aaggaagacuucauc

SEQ ID NO: 1809788 - RNA, 13 nt, Human
aaggaagcacaug

SEQ ID NO: 1809789 - RNA, 16 nt, Human
aaggaagcacaugccu

SEQ ID NO: 1809790 - RNA, 21 nt, Human
aaggaauaaauugcuccuuga

SEQ ID NO: 1809791 - RNA, 17 nt, Human
aaggaauaccugucccc

SEQ ID NO: 1809792 - RNA, 14 nt, Human
aagcuccaucucca

SEQ ID NO: 1809793 - RNA, 20 nt, Human
aagcuccaucuccacuccag

SEQ ID NO: 1809794 - RNA, 15 nt, Human
aaggaaagagggagg

SEQ ID NO: 1809795 - RNA, 16 nt, Human
aacaaggcaaggcugu

SEQ ID NO: 1809796 - RNA, 23 nt, Human
aaauuuugauguuuuaaggaugc

SEQ ID NO: 1809797 - RNA, 18 nt, Human
aaauuuugauguuuuaag

SEQ ID NO: 1809798 - RNA, 12 nt, Human
aacaauaaaaga

SEQ ID NO: 1809799 - RNA, 18 nt, Human
aacaaggcaaggcuguca

SEQ ID NO: 1809800 - RNA, 21 nt, Human
aacaaggcaaggcugucaauu

SEQ ID NO: 1809801 - RNA, 22 nt, Human
gucacacaguauuacuucugcu

SEQ ID NO: 1809802 - RNA, 21 nt, Human
gucacacaguauuacuucugc

SEQ ID NO: 1809803 - RNA, 17 nt, Human
gucagaauagaaauuag

SEQ ID NO: 1809804 - RNA, 13 nt, Human
gucagaauagaaa

SEQ ID NO: 1809805 - RNA, 18 nt, Human
aaauuuguuauaaugaau

SEQ ID NO: 1809806 - RNA, 13 nt, Human
gucauaacuagaa

SEQ ID NO: 1809807 - RNA, 16 nt, Human
gucccaccuuggcugc

SEQ ID NO: 1809808 - RNA, 15 nt, Human
gucccaccuuggcug

SEQ ID NO: 1809809 - RNA, 14 nt, Human
gucccaccuuggcu

SEQ ID NO: 1809810 - RNA, 13 nt, Human
guccauagagagc

SEQ ID NO: 1809811 - RNA, 14 nt, Human
guccauagagagca

SEQ ID NO: 1809812 - RNA, 21 nt, Human
gucccaccccacacacgccag

SEQ ID NO: 1809813 - RNA, 13 nt, Human
guccaagaagccc

SEQ ID NO: 1809814 - RNA, 15 nt, Human
guccaagaagcccag

SEQ ID NO: 1809815 - RNA, 16 nt, Human
guccaagaagcccagg

SEQ ID NO: 1809816 - RNA, 20 nt, Human
guccaagaagcccaggaaag

SEQ ID NO: 1809817 - RNA, 17 nt, Human
guccaagaagcccagga

SEQ ID NO: 1809818 - RNA, 18 nt, Human
guccaagaagcccaggaa

SEQ ID NO: 1809819 - RNA, 21 nt, Human
gucauuuuuuuuaagaaaaag

SEQ ID NO: 1809820 - RNA, 19 nt, Human
gucauuuuuuuuaagaaaa

SEQ ID NO: 1809821 - RNA, 16 nt, Human
aacagauaaauaguuu

SEQ ID NO: 1809822 - RNA, 22 nt, Human
aacagugauuaccagggacuga

SEQ ID NO: 1809823 - RNA, 15 nt, Human
aacagugauuaccag

SEQ ID NO: 1809824 - RNA, 12 nt, Human
guccuacucugu

SEQ ID NO: 1809825 - RNA, 15 nt, Human
guccuacccacccuc

SEQ ID NO: 1809826 - RNA, 16 nt, Human
guccuacccacccucc

SEQ ID NO: 1809827 - RNA, 15 nt, Human
aacagaaauguacag

SEQ ID NO: 1809828 - RNA, 14 nt, Human
aacagaaauguaca

SEQ ID NO: 1809829 - RNA, 13 nt, Human
aacagaaauguac

SEQ ID NO: 1809830 - RNA, 12 nt, Human
aacagaaaugua

SEQ ID NO: 1809831 - RNA, 14 nt, Human
gucccccuuccaug

SEQ ID NO: 1809832 - RNA, 16 nt, Human
gucccccuuccaugga

SEQ ID NO: 1809833 - RNA, 18 nt, Human
gucccccuuccauggacu

SEQ ID NO: 1809834 - RNA, 18 nt, Human
guaucaggugcugccauc

SEQ ID NO: 1809835 - RNA, 16 nt, Human
guaucaggugcugcca

SEQ ID NO: 1809836 - RNA, 14 nt, Human
guaucaaauacauu

SEQ ID NO: 1809837 - RNA, 13 nt, Human
guaucaaauacau

SEQ ID NO: 1809838 - RNA, 22 nt, Human
guauauuuguauuuaaaugaaa

SEQ ID NO: 1809839 - RNA, 16 nt, Human
guauauuuuauaucaa

SEQ ID NO: 1809840 - RNA, 15 nt, Human
guauaaguggugugu

SEQ ID NO: 1809841 - RNA, 14 nt, Human
guaugguggcuggg

SEQ ID NO: 1809842 - RNA, 16 nt, Human
guaugguggcuggguu

SEQ ID NO: 1809843 - RNA, 15 nt, Human
guaugguggcugggu

SEQ ID NO: 1809844 - RNA, 21 nt, Human
guaucccaugagccucagcau

SEQ ID NO: 1809845 - RNA, 15 nt, Human
guaugcgugugugug

SEQ ID NO: 1809846 - RNA, 22 nt, Human
guaucaggugcugccauccagg

SEQ ID NO: 1809847 - RNA, 19 nt, Human
guaucccaugagccucagc

SEQ ID NO: 1809848 - RNA, 12 nt, Human
guaacaggcaga

SEQ ID NO: 1809849 - RNA, 22 nt, Human
guaacaggaaaauuuuaaaaau

SEQ ID NO: 1809850 - RNA, 22 nt, Human
aaauguaagaucguucucugcc

SEQ ID NO: 1809851 - RNA, 14 nt, Human
aaauguaagaucgu

SEQ ID NO: 1809852 - RNA, 19 nt, Human
guauaaaagggacugagaa

SEQ ID NO: 1809853 - RNA, 16 nt, Human
aaauucugucucugga

SEQ ID NO: 1809854 - RNA, 19 nt, Human
aaauuguaagcaugcacaa

SEQ ID NO: 1809855 - RNA, 18 nt, Human
aaauucugucucuggauu

SEQ ID NO: 1809856 - RNA, 20 nt, Human
aaauuguaagcaugcacaaa

SEQ ID NO: 1809857 - RNA, 22 nt, Human
guauuuuguuuuugucuuaaaa

SEQ ID NO: 1809858 - RNA, 15 nt, Human
gucaaacgugaaaau

SEQ ID NO: 1809859 - RNA, 17 nt, Human
gucaaacgugaaaaugc

SEQ ID NO: 1809860 - RNA, 14 nt, Human
gucaaacgugaaaa

SEQ ID NO: 1809861 - RNA, 21 nt, Human
gucaacaaguaugaauaaaga

SEQ ID NO: 1809862 - RNA, 17 nt, Human
gucaacacuaacaugau

SEQ ID NO: 1809863 - RNA, 24 nt, Human
aaaugucuaguuguaacaccauga

SEQ ID NO: 1809864 - RNA, 19 nt, Human
aaaugucuaguuguaacac

SEQ ID NO: 1809865 - RNA, 14 nt, Human
aaauuaagaaagga

SEQ ID NO: 1809866 - RNA, 12 nt, Human
aaaugugugugu

SEQ ID NO: 1809867 - RNA, 20 nt, Human
aacuacuaccuguaaugaca

SEQ ID NO: 1809868 - RNA, 12 nt, Human
aaccugugucuc

SEQ ID NO: 1809869 - RNA, 18 nt, Human
aaccuugaaaacuuuaug

SEQ ID NO: 1809870 - RNA, 23 nt, Human
aacuagacucccaagcuggacua

SEQ ID NO: 1809871 - RNA, 20 nt, Human
aacuagacucccaagcugga

SEQ ID NO: 1809872 - RNA, 16 nt, Human
aacuaugauuuggaaa

SEQ ID NO: 1809873 - RNA, 21 nt, Human
aacuaugauuuggaaaauaaa

SEQ ID NO: 1809874 - RNA, 22 nt, Human
aacucaucuagguaaauuacag

SEQ ID NO: 1809875 - RNA, 12 nt, Human
aacuccuggccu

SEQ ID NO: 1809876 - RNA, 23 nt, Human
gugaaccaccacacccagcccac

SEQ ID NO: 1809877 - RNA, 22 nt, Human
gugaaccaccacacccagccca

SEQ ID NO: 1809878 - RNA, 17 nt, Human
aacucuccucugcugcu

SEQ ID NO: 1809879 - RNA, 16 nt, Human
aacucuccucugcugc

SEQ ID NO: 1809880 - RNA, 15 nt, Human
aacucuccuccagag

SEQ ID NO: 1809881 - RNA, 18 nt, Human
aacucuccuccagaguca

SEQ ID NO: 1809882 - RNA, 16 nt, Human
gucuuucacauuuaaa

SEQ ID NO: 1809883 - RNA, 16 nt, Human
gucuuuggugaacauu

SEQ ID NO: 1809884 - RNA, 16 nt, Human
gucuuuugguuaugaa

SEQ ID NO: 1809885 - RNA, 14 nt, Human
gucuggcccuuccu

SEQ ID NO: 1809886 - RNA, 20 nt, Human
aaccugagccccaaaaggua

SEQ ID NO: 1809887 - RNA, 15 nt, Human
aaccaagucaaguga

SEQ ID NO: 1809888 - RNA, 19 nt, Human
aaccaccacacccagccca

SEQ ID NO: 1809889 - RNA, 20 nt, Human
aaccacauuggagauguuua

SEQ ID NO: 1809890 - RNA, 13 nt, Human
gucucgaacuccu

SEQ ID NO: 1809891 - RNA, 18 nt, Human
gucucgaacuccugaccu

SEQ ID NO: 1809892 - RNA, 19 nt, Human
gucucgaacuccugaccuu

SEQ ID NO: 1809893 - RNA, 16 nt, Human
aaccaagccguggcuu

SEQ ID NO: 1809894 - RNA, 18 nt, Human
aaccaagccguggcuucc

SEQ ID NO: 1809895 - RNA, 21 nt, Human
aaccaccacacccagcccacu

SEQ ID NO: 1809896 - RNA, 12 nt, Human
aaccaucauuga

SEQ ID NO: 1809897 - RNA, 17 nt, Human
aaccaucauugaaaucu

SEQ ID NO: 1809898 - RNA, 18 nt, Human
aaccaucauugaaaucuu

SEQ ID NO: 1809899 - RNA, 13 nt, Human
aacccaauaguug

SEQ ID NO: 1809900 - RNA, 23 nt, Human
aaccauuuugcugucccuuuucc

SEQ ID NO: 1809901 - RNA, 23 nt, Human
aacccaaauguucaucaaugaau

SEQ ID NO: 1809902 - RNA, 19 nt, Human
aaccauuugaaaccccugu

SEQ ID NO: 1809903 - RNA, 22 nt, Human
aaccucgagguuucucaaagaa

SEQ ID NO: 1809904 - RNA, 21 nt, Human
aaccucgagguuucucaaaga

SEQ ID NO: 1809905 - RNA, 11 nt, Human
aaccugacccc

SEQ ID NO: 1809906 - RNA, 18 nt, Human
aaccugagccccaaaagg

SEQ ID NO: 1809907 - RNA, 17 nt, Human
aaccccuguaggccuca

SEQ ID NO: 1809908 - RNA, 16 nt, Human
aacccgggaggcagag

SEQ ID NO: 1809909 - RNA, 14 nt, Human
aacccagauaaagg

SEQ ID NO: 1809910 - RNA, 10 nt, Human
aacccagcuc

SEQ ID NO: 1809911 - RNA, 21 nt, Human
aacuggguacuuguggacaca

SEQ ID NO: 1809912 - RNA, 16 nt, Human
aacuggguacuugugg

SEQ ID NO: 1809913 - RNA, 22 nt, Human
aacugggggagggugaagugaa

SEQ ID NO: 1809914 - RNA, 21 nt, Human
aacugggggagggugaaguga

SEQ ID NO: 1809915 - RNA, 15 nt, Human
aacuggauuaaacuu

SEQ ID NO: 1809916 - RNA, 11 nt, Human
aacuggcugca

SEQ ID NO: 1809917 - RNA, 16 nt, Human
aacuggauuaaacuua

SEQ ID NO: 1809918 - RNA, 23 nt, Human
aacugcugacuguuuucucuuga

SEQ ID NO: 1809919 - RNA, 20 nt, Human
aacugcugacuguuuucucu

SEQ ID NO: 1809920 - RNA, 21 nt, Human
aacugcugacuguuuucucuu

SEQ ID NO: 1809921 - RNA, 15 nt, Human
aacugcugacuguuu

SEQ ID NO: 1809922 - RNA, 17 nt, Human
gugaacuugggccacug

SEQ ID NO: 1809923 - RNA, 19 nt, Human
gugaacuugggccacugug

SEQ ID NO: 1809924 - RNA, 21 nt, Human
gugagaugcuagaacucccuu

SEQ ID NO: 1809925 - RNA, 18 nt, Human
gugaggguaaguauuuuc

SEQ ID NO: 1809926 - RNA, 15 nt, Human
gugagcaauccugca

SEQ ID NO: 1809927 - RNA, 17 nt, Human
gugaggccagagacaca

SEQ ID NO: 1809928 - RNA, 22 nt, Human
gugaggccagagacacaagccu

SEQ ID NO: 1809929 - RNA, 22 nt, Human
gugagucgaggacagggaggug

SEQ ID NO: 1809930 - RNA, 22 nt, Human
aacucugacaacagacuucuga

SEQ ID NO: 1809931 - RNA, 23 nt, Human
aacucugacaacagacuucugaa

SEQ ID NO: 1809932 - RNA, 20 nt, Human
aacucugacaacagacuucu

SEQ ID NO: 1809933 - RNA, 23 nt, Human
aacucuguuacacuuuuuggaag

SEQ ID NO: 1809934 - RNA, 22 nt, Human
aacucuguuacacuuuuuggaa

SEQ ID NO: 1809935 - RNA, 21 nt, Human
aacucuucaaucucuugcacu

SEQ ID NO: 1809936 - RNA, 22 nt, Human
gugcaugcugucccuuacguga

SEQ ID NO: 1809937 - RNA, 21 nt, Human
gugcacacaccagagcccacc

SEQ ID NO: 1809938 - RNA, 22 nt, Human
gugaugguuccccuguucacuc

SEQ ID NO: 1809939 - RNA, 14 nt, Human
gugaugguuccccu

SEQ ID NO: 1809940 - RNA, 16 nt, Human
gugaugguuccccugu

SEQ ID NO: 1809941 - RNA, 19 nt, Human
gugauggggcccugccucc

SEQ ID NO: 1809942 - RNA, 12 nt, Human
gugccucugccu

SEQ ID NO: 1809943 - RNA, 19 nt, Human
gugcauuaucuagauacug

SEQ ID NO: 1809944 - RNA, 15 nt, Human
gugcauuaucuagau

SEQ ID NO: 1809945 - RNA, 19 nt, Human
gugcauguguguucaugca

SEQ ID NO: 1809946 - RNA, 23 nt, Human
gugcauuaucuagauacuguauc

SEQ ID NO: 1809947 - RNA, 13 nt, Human
aacuuccaauuua

SEQ ID NO: 1809948 - RNA, 22 nt, Human
gugaugcgcaugucacggaggg

SEQ ID NO: 1809949 - RNA, 14 nt, Human
gugauggggcccug

SEQ ID NO: 1809950 - RNA, 16 nt, Human
gugauggggcccugcc

SEQ ID NO: 1809951 - RNA, 17 nt, Human
gugauggggcccugccu

SEQ ID NO: 1809952 - RNA, 18 nt, Human
gugauggggcccugccuc

SEQ ID NO: 1809953 - RNA, 16 nt, Human
gugaugagaggaaauc

SEQ ID NO: 1809954 - RNA, 14 nt, Human
gugaugagaggaaa

SEQ ID NO: 1809955 - RNA, 23 nt, Human
cugccauauucuguuggccagug

SEQ ID NO: 1809956 - RNA, 22 nt, Human
cugccauauucuguuggccagu

SEQ ID NO: 1809957 - RNA, 21 nt, Human
cugccauauucuguuggccag

SEQ ID NO: 1809958 - RNA, 20 nt, Human
cugccauauucuguuggcca

SEQ ID NO: 1809959 - RNA, 11 nt, Human
cugccagggac

SEQ ID NO: 1809960 - RNA, 12 nt, Human
cugccagggaca

SEQ ID NO: 1809961 - RNA, 15 nt, Human
cugccagggacagag

SEQ ID NO: 1809962 - RNA, 12 nt, Human
cugccauccagg

SEQ ID NO: 1809963 - RNA, 14 nt, Human
cugcccccucugcc

SEQ ID NO: 1809964 - RNA, 15 nt, Human
cugcccccucugccc

SEQ ID NO: 1809965 - RNA, 19 nt, Human
cugccccagggcucccggc

SEQ ID NO: 1809966 - RNA, 17 nt, Human
cugcccuggugcugcca

SEQ ID NO: 1809967 - RNA, 16 nt, Human
cugcccuggugcugcc

SEQ ID NO: 1809968 - RNA, 18 nt, Human
cugcccuggugcugccac

SEQ ID NO: 1809969 - RNA, 19 nt, Human
cugcccuggugcugccaca

SEQ ID NO: 1809970 - RNA, 16 nt, Human
cugcccccucugcccu

SEQ ID NO: 1809971 - RNA, 17 nt, Human
cugcccccucugcccug

SEQ ID NO: 1809972 - RNA, 18 nt, Human
cugcccccucugcccugc

SEQ ID NO: 1809973 - RNA, 19 nt, Human
cugcccccucugcccugcg

SEQ ID NO: 1809974 - RNA, 14 nt, Human
cugccccucaacuc

SEQ ID NO: 1809975 - RNA, 22 nt, Human
cugccccucaacucuccuccag

SEQ ID NO: 1809976 - RNA, 20 nt, Human
cugcccuggugcugccacac

SEQ ID NO: 1809977 - RNA, 21 nt, Human
cugcccuggugcugccacacu

SEQ ID NO: 1809978 - RNA, 22 nt, Human
cugcccugguuuccugcccugg

SEQ ID NO: 1809979 - RNA, 23 nt, Human
cugcccugguuuccugcccuggg

SEQ ID NO: 1809980 - RNA, 12 nt, Human
cugcccugugag

SEQ ID NO: 1809981 - RNA, 13 nt, Human
cugcccugugagu

SEQ ID NO: 1809982 - RNA, 15 nt, Human
cugcccugugggccc

SEQ ID NO: 1809983 - RNA, 16 nt, Human
cugcccugugggcccc

SEQ ID NO: 1809984 - RNA, 18 nt, Human
cugcccugugggccccca

SEQ ID NO: 1809985 - RNA, 14 nt, Human
cugcauuugugaaa

SEQ ID NO: 1809986 - RNA, 15 nt, Human
cugcauuugugaaau

SEQ ID NO: 1809987 - RNA, 17 nt, Human
cugcauuugugaaauga

SEQ ID NO: 1809988 - RNA, 22 nt, Human
cugcauuugugaaaugauggug

SEQ ID NO: 1809989 - RNA, 15 nt, Human
cugccaaugggagcu

SEQ ID NO: 1809990 - RNA, 17 nt, Human
cugccaaugggagcuca

SEQ ID NO: 1809991 - RNA, 15 nt, Human
cugcauguuugugau

SEQ ID NO: 1809992 - RNA, 13 nt, Human
cugcauguuacau

SEQ ID NO: 1809993 - RNA, 20 nt, Human
cugcauucaggaucaaaccc

SEQ ID NO: 1809994 - RNA, 13 nt, Human
cugcauuugugaa

SEQ ID NO: 1809995 - RNA, 22 nt, Human
cugcauuuaaaagauacaguua

SEQ ID NO: 1809996 - RNA, 20 nt, Human
cugcauuuaaaagauacagu

SEQ ID NO: 1809997 - RNA, 20 nt, Human
cugagacucgcgacaaugca

SEQ ID NO: 1809998 - RNA, 17 nt, Human
cugagacucgcgacaau

SEQ ID NO: 1809999 - RNA, 19 nt, Human
cugagacucgcgacaaugc

SEQ ID NO: 1810000 - RNA, 16 nt, Human
cugcuaauuccccaga

SEQ ID NO: 1810001 - RNA, 16 nt, Human
cugccuguugggccag

SEQ ID NO: 1810002 - RNA, 14 nt, Human
cugccuguugggcc

SEQ ID NO: 1810003 - RNA, 18 nt, Human
cugccuguugggccagga

SEQ ID NO: 1810004 - RNA, 19 nt, Human
cugccuguugggccaggag

SEQ ID NO: 1810005 - RNA, 15 nt, Human
cugcuacagagcaga

SEQ ID NO: 1810006 - RNA, 23 nt, Human
cugccugggaucccucauccuca

SEQ ID NO: 1810007 - RNA, 15 nt, Human
cugccuguucagcuc

SEQ ID NO: 1810008 - RNA, 14 nt, Human
cugccuguucagcu

SEQ ID NO: 1810009 - RNA, 19 nt, Human
cugccucgaacuggcugca

SEQ ID NO: 1810010 - RNA, 18 nt, Human
cugccucgaacuggcugc

SEQ ID NO: 1810011 - RNA, 17 nt, Human
cugccucgaacuggcug

SEQ ID NO: 1810012 - RNA, 15 nt, Human
cugccucgaacuggc

SEQ ID NO: 1810013 - RNA, 11 nt, Human
cugcugacagu

SEQ ID NO: 1810014 - RNA, 23 nt, Human
cugcugacagacacaggcccggc

SEQ ID NO: 1810015 - RNA, 21 nt, Human
cugcugacagacacaggcccg

SEQ ID NO: 1810016 - RNA, 20 nt, Human
cugcugacagacacaggccc

SEQ ID NO: 1810017 - RNA, 19 nt, Human
cugcugacagacacaggcc

SEQ ID NO: 1810018 - RNA, 18 nt, Human
cugcugacagacacaggc

SEQ ID NO: 1810019 - RNA, 15 nt, Human
cugcugacagacaca

SEQ ID NO: 1810020 - RNA, 23 nt, Human
cugcuucagccucccgaguagcu

SEQ ID NO: 1810021 - RNA, 18 nt, Human
cugcuuuuuauggccugu

SEQ ID NO: 1810022 - RNA, 16 nt, Human
cuggaaauauuaagaa

SEQ ID NO: 1810023 - RNA, 17 nt, Human
cuggaacacuaaugagg

SEQ ID NO: 1810024 - RNA, 13 nt, Human
cuggacugugugc

SEQ ID NO: 1810025 - RNA, 13 nt, Human
cugcuucagccuc

SEQ ID NO: 1810026 - RNA, 17 nt, Human
cugcuuaacuucacaua

SEQ ID NO: 1810027 - RNA, 15 nt, Human
cugcuuaacuucaca

SEQ ID NO: 1810028 - RNA, 16 nt, Human
cugcuucagccucccg

SEQ ID NO: 1810029 - RNA, 14 nt, Human
cugcuucagccucc

SEQ ID NO: 1810030 - RNA, 17 nt, Human
cugcuuuuuauggccug

SEQ ID NO: 1810031 - RNA, 22 nt, Human
cugcuuuuuaaagaaugcucuu

SEQ ID NO: 1810032 - RNA, 13 nt, Human
cugcuuaacuuca

SEQ ID NO: 1810033 - RNA, 13 nt, Human
cugucgcccaguc

SEQ ID NO: 1810034 - RNA, 16 nt, Human
cugucgcccaggcugg

SEQ ID NO: 1810035 - RNA, 15 nt, Human
cugugcucuggacag

SEQ ID NO: 1810036 - RNA, 14 nt, Human
cugugcucuggaca

SEQ ID NO: 1810037 - RNA, 21 nt, Human
cugugagaugcuagaacuccc

SEQ ID NO: 1810038 - RNA, 16 nt, Human
cugugagaugcuagaa

SEQ ID NO: 1810039 - RNA, 15 nt, Human
cugugaagagaacca

SEQ ID NO: 1810040 - RNA, 22 nt, Human
cuguaggccucaggugaaacuc

SEQ ID NO: 1810041 - RNA, 13 nt, Human
cuguaggccucag

SEQ ID NO: 1810042 - RNA, 12 nt, Human
cuguaggccuca

SEQ ID NO: 1810043 - RNA, 21 nt, Human
cuguaggaagguuaauguuca

SEQ ID NO: 1810044 - RNA, 22 nt, Human
cuguacuugcucuugaugccug

SEQ ID NO: 1810045 - RNA, 23 nt, Human
cuguacuugcucuugaugccugg

SEQ ID NO: 1810046 - RNA, 16 nt, Human
cugucauuugagcagg

SEQ ID NO: 1810047 - RNA, 18 nt, Human
cugucauuugagcagggc

SEQ ID NO: 1810048 - RNA, 17 nt, Human
cugucauuugagcaggg

SEQ ID NO: 1810049 - RNA, 20 nt, Human
cugucauuugagcagggcuc

SEQ ID NO: 1810050 - RNA, 12 nt, Human
cuguccugccua

SEQ ID NO: 1810051 - RNA, 18 nt, Human
cugucagccauuccuguu

SEQ ID NO: 1810052 - RNA, 18 nt, Human
cugguuuccugcccuggg

SEQ ID NO: 1810053 - RNA, 21 nt, Human
cugguuuccugcccugggagg

SEQ ID NO: 1810054 - RNA, 22 nt, Human
cugguuuccugcccugggaggc

SEQ ID NO: 1810055 - RNA, 13 nt, Human
cugggacacaguu

SEQ ID NO: 1810056 - RNA, 12 nt, Human
cugggacacagu

SEQ ID NO: 1810057 - RNA, 15 nt, Human
cuggcucccacaggc

SEQ ID NO: 1810058 - RNA, 13 nt, Human
cuggcuccagcug

SEQ ID NO: 1810059 - RNA, 14 nt, Human
cuggcuccagcugg

SEQ ID NO: 1810060 - RNA, 18 nt, Human
cuggcuccagcuggccgg

SEQ ID NO: 1810061 - RNA, 20 nt, Human
cuggcuccagcuggccggga

SEQ ID NO: 1810062 - RNA, 13 nt, Human
cuggcucaucucu

SEQ ID NO: 1810063 - RNA, 19 nt, Human
cuggcuccaaacccucgag

SEQ ID NO: 1810064 - RNA, 20 nt, Human
cuggcuccaaacccucgagg

SEQ ID NO: 1810065 - RNA, 17 nt, Human
cuggccccucagggucc

SEQ ID NO: 1810066 - RNA, 18 nt, Human
cuggccccucaggguccc

SEQ ID NO: 1810067 - RNA, 20 nt, Human
cuggccccucagggucccug

SEQ ID NO: 1810068 - RNA, 21 nt, Human
cuggccccucagggucccugg

SEQ ID NO: 1810069 - RNA, 12 nt, Human
cuggcagcucag

SEQ ID NO: 1810070 - RNA, 13 nt, Human
cuggcagcucaga

SEQ ID NO: 1810071 - RNA, 14 nt, Human
cuggcagcucagag

SEQ ID NO: 1810072 - RNA, 16 nt, Human
cuggacugugugcuca

SEQ ID NO: 1810073 - RNA, 13 nt, Human
cuggccccucagg

SEQ ID NO: 1810074 - RNA, 15 nt, Human
cuggcagcucagaga

SEQ ID NO: 1810075 - RNA, 18 nt, Human
cuggggccaggcuggguc

SEQ ID NO: 1810076 - RNA, 16 nt, Human
cuggggccgaaagaac

SEQ ID NO: 1810077 - RNA, 18 nt, Human
cugggcagaaggaagacu

SEQ ID NO: 1810078 - RNA, 16 nt, Human
cugggcagaaggaaga

SEQ ID NO: 1810079 - RNA, 15 nt, Human
cuggggaaccugacc

SEQ ID NO: 1810080 - RNA, 16 nt, Human
cuggggaaccugaccc

SEQ ID NO: 1810081 - RNA, 17 nt, Human
cuggggaaccugacccc

SEQ ID NO: 1810082 - RNA, 17 nt, Human
cugggcagaaggaagac

SEQ ID NO: 1810083 - RNA, 14 nt, Human
cuggguucacugca

SEQ ID NO: 1810084 - RNA, 22 nt, Human
cuggguuccagcaauucuccug

SEQ ID NO: 1810085 - RNA, 18 nt, Human
cuggguuccuuccucuga

SEQ ID NO: 1810086 - RNA, 22 nt, Human
cuggguuccuuccucugagccu

SEQ ID NO: 1810087 - RNA, 23 nt, Human
cuggguuccuuccucugagccuu

SEQ ID NO: 1810088 - RNA, 15 nt, Human
cuggugacuuuccuc

SEQ ID NO: 1810089 - RNA, 20 nt, Human
cuggugacuuuccucuuugg

SEQ ID NO: 1810090 - RNA, 21 nt, Human
cuggugacuuuccucuuuggu

SEQ ID NO: 1810091 - RNA, 23 nt, Human
cuggguggcaccagcagccugga

SEQ ID NO: 1810092 - RNA, 22 nt, Human
cuggguggcaccagcagccugg

SEQ ID NO: 1810093 - RNA, 16 nt, Human
cuggguguggcgcagc

SEQ ID NO: 1810094 - RNA, 17 nt, Human
cuggguguggcgcagca

SEQ ID NO: 1810095 - RNA, 23 nt, Human
cuggugacuuuccucuuuggucu

SEQ ID NO: 1810096 - RNA, 14 nt, Human
cuuucacaaccuuc

SEQ ID NO: 1810097 - RNA, 23 nt, Human
cuuucaauaggaaaaacugauuu

SEQ ID NO: 1810098 - RNA, 16 nt, Human
cuuucacaaccuucug

SEQ ID NO: 1810099 - RNA, 23 nt, Human
cuuucagccaagaauucuuaaau

SEQ ID NO: 1810100 - RNA, 20 nt, Human
cuuucagccaagaauucuua

SEQ ID NO: 1810101 - RNA, 22 nt, Human
cuuuccugaggcugggcucccu

SEQ ID NO: 1810102 - RNA, 14 nt, Human
cuuuuaugugaaac

SEQ ID NO: 1810103 - RNA, 18 nt, Human
cuuuuaugugaaacaugu

SEQ ID NO: 1810104 - RNA, 14 nt, Human
cuuuuauaaacuuu

SEQ ID NO: 1810105 - RNA, 13 nt, Human
cuuuuauaaacuu

SEQ ID NO: 1810106 - RNA, 17 nt, Human
cuuucuacccagcgagc

SEQ ID NO: 1810107 - RNA, 15 nt, Human
cuuucuagccagagg

SEQ ID NO: 1810108 - RNA, 22 nt, Human
cuuugauauuuucaacgcagcc

SEQ ID NO: 1810109 - RNA, 16 nt, Human
cuuucuagccagagga

SEQ ID NO: 1810110 - RNA, 14 nt, Human
cuuugggcugcccu

SEQ ID NO: 1810111 - RNA, 15 nt, Human
cuuugggcugcccug

SEQ ID NO: 1810112 - RNA, 19 nt, Human
cuuugggcugcccuggugc

SEQ ID NO: 1810113 - RNA, 20 nt, Human
cuuugggcugcccuggugcu

SEQ ID NO: 1810114 - RNA, 21 nt, Human
cuuugggcugcccuggugcug

SEQ ID NO: 1810115 - RNA, 15 nt, Human
cuuuguaaauuguca

SEQ ID NO: 1810116 - RNA, 13 nt, Human
cuuuguaaugaaa

SEQ ID NO: 1810117 - RNA, 23 nt, Human
gaaaaugcuguauuagucacaga

SEQ ID NO: 1810118 - RNA, 21 nt, Human
gaaaauggaagacagcucuua

SEQ ID NO: 1810119 - RNA, 18 nt, Human
gaaaagaaaaaugagccu

SEQ ID NO: 1810120 - RNA, 14 nt, Human
gaaaaacugauuuu

SEQ ID NO: 1810121 - RNA, 19 nt, Human
gaaaauggacguguuauga

SEQ ID NO: 1810122 - RNA, 23 nt, Human
gaaaauggacguguuaugacucc

SEQ ID NO: 1810123 - RNA, 15 nt, Human
gaaaauguaugugua

SEQ ID NO: 1810124 - RNA, 20 nt, Human
cuuuuuuuuuuuugagacag

SEQ ID NO: 1810125 - RNA, 13 nt, Human
cuuuugugcauua

SEQ ID NO: 1810126 - RNA, 12 nt, Human
cuuuugugcauu

SEQ ID NO: 1810127 - RNA, 23 nt, Human
cuuuuuuggcugcugaaggcucg

SEQ ID NO: 1810128 - RNA, 23 nt, Human
cuuuuuuuuuuuuuaaagacaga

SEQ ID NO: 1810129 - RNA, 22 nt, Human
cuuuuuuuuuuuuuaaagacag

SEQ ID NO: 1810130 - RNA, 21 nt, Human
cuuuuuuuuuuuugagacaga

SEQ ID NO: 1810131 - RNA, 18 nt, Human
cuuuugucuaugggacuc

SEQ ID NO: 1810132 - RNA, 21 nt, Human
cuuuugguuaugaauacuuug

SEQ ID NO: 1810133 - RNA, 15 nt, Human
cuuuuggcauuuuac

SEQ ID NO: 1810134 - RNA, 23 nt, Human
cuuuugcccacacuugggagcaa

SEQ ID NO: 1810135 - RNA, 16 nt, Human
cuuuugccguuauuaa

SEQ ID NO: 1810136 - RNA, 13 nt, Human
cuuuuggagucag

SEQ ID NO: 1810137 - RNA, 13 nt, Human
cuuuugccauuga

SEQ ID NO: 1810138 - RNA, 22 nt, Human
gaaagggacuuggaagcuccgc

SEQ ID NO: 1810139 - RNA, 19 nt, Human
gaaagggacuuggaagcuc

SEQ ID NO: 1810140 - RNA, 20 nt, Human
gaaagggacgcuacccggga

SEQ ID NO: 1810141 - RNA, 19 nt, Human
gaaaucaccgaaaacgugg

SEQ ID NO: 1810142 - RNA, 21 nt, Human
gaaagaaaauaccaaggaaca

SEQ ID NO: 1810143 - RNA, 20 nt, Human
gaaagacuaucuaaauguug

SEQ ID NO: 1810144 - RNA, 21 nt, Human
gaaaggcuccaggagcagcca

SEQ ID NO: 1810145 - RNA, 22 nt, Human
gaaaggcuccaggagcagccac

SEQ ID NO: 1810146 - RNA, 17 nt, Human
cuuccugcaacaccuug

SEQ ID NO: 1810147 - RNA, 17 nt, Human
cuucuagaaccaggcaa

SEQ ID NO: 1810148 - RNA, 13 nt, Human
cuucuagaaccag

SEQ ID NO: 1810149 - RNA, 17 nt, Human
cuucuguugcugccuca

SEQ ID NO: 1810150 - RNA, 18 nt, Human
cuucuguugcugccucau

SEQ ID NO: 1810151 - RNA, 19 nt, Human
cuucuguugcugccucaug

SEQ ID NO: 1810152 - RNA, 20 nt, Human
cuucuguugcugccucaugc

SEQ ID NO: 1810153 - RNA, 23 nt, Human
cuucuucagagacuccugcaggc

SEQ ID NO: 1810154 - RNA, 21 nt, Human
cuucuguugcugccucaugcu

SEQ ID NO: 1810155 - RNA, 20 nt, Human
cuucugacccaugcugcccu

SEQ ID NO: 1810156 - RNA, 21 nt, Human
cuucugacccaugcugcccug

SEQ ID NO: 1810157 - RNA, 22 nt, Human
cuucugacccaugcugcccugu

SEQ ID NO: 1810158 - RNA, 23 nt, Human
cuucugacccaugcugcccugug

SEQ ID NO: 1810159 - RNA, 20 nt, Human
cuugacagggcacaccgggc

SEQ ID NO: 1810160 - RNA, 13 nt, Human
cuugacagggcac

SEQ ID NO: 1810161 - RNA, 15 nt, Human
cuugacagggcacac

SEQ ID NO: 1810162 - RNA, 14 nt, Human
cuugacagggcaca

SEQ ID NO: 1810163 - RNA, 19 nt, Human
cuugaauuguaaggaauga

SEQ ID NO: 1810164 - RNA, 12 nt, Human
cuugaugccugg

SEQ ID NO: 1810165 - RNA, 13 nt, Human
cuugaugccuggc

SEQ ID NO: 1810166 - RNA, 20 nt, Human
cuuggcgcugccccuggcag

SEQ ID NO: 1810167 - RNA, 12 nt, Human
cuuggcgcugcc

SEQ ID NO: 1810168 - RNA, 14 nt, Human
cuuggcgcugcccc

SEQ ID NO: 1810169 - RNA, 17 nt, Human
cuuggcgcugccccugg

SEQ ID NO: 1810170 - RNA, 17 nt, Human
cuuauggaacacucuga

SEQ ID NO: 1810171 - RNA, 19 nt, Human
cuuauggaacacucugaga

SEQ ID NO: 1810172 - RNA, 20 nt, Human
cuuauggaacacucugagac

SEQ ID NO: 1810173 - RNA, 21 nt, Human
cuuauggaacacucugagacu

SEQ ID NO: 1810174 - RNA, 21 nt, Human
cuucaccuuuguccccaccgc

SEQ ID NO: 1810175 - RNA, 22 nt, Human
cuucaccuuuguccccaccgca

SEQ ID NO: 1810176 - RNA, 15 nt, Human
cuucacggaagagcc

SEQ ID NO: 1810177 - RNA, 19 nt, Human
cuucacggaagagccuugc

SEQ ID NO: 1810178 - RNA, 13 nt, Human
cuuauggaacacu

SEQ ID NO: 1810179 - RNA, 16 nt, Human
cuuauggaacacucug

SEQ ID NO: 1810180 - RNA, 12 nt, Human
cugugcugaguc

SEQ ID NO: 1810181 - RNA, 14 nt, Human
cugugcugagucug

SEQ ID NO: 1810182 - RNA, 19 nt, Human
cugugcugagucugaaggc

SEQ ID NO: 1810183 - RNA, 15 nt, Human
cuucacuguaaaaua

SEQ ID NO: 1810184 - RNA, 17 nt, Human
cuucagagacuccugca

SEQ ID NO: 1810185 - RNA, 20 nt, Human
cuucagagacuccugcaggc

SEQ ID NO: 1810186 - RNA, 18 nt, Human
cuucagagacuccugcag

SEQ ID NO: 1810187 - RNA, 19 nt, Human
cuucagagacuccugcagg

SEQ ID NO: 1810188 - RNA, 21 nt, Human
cuuccagugaggcucugcccu

SEQ ID NO: 1810189 - RNA, 22 nt, Human
cuuccagugaggcucugcccuu

SEQ ID NO: 1810190 - RNA, 23 nt, Human
cuuccagugaggcucugcccuug

SEQ ID NO: 1810191 - RNA, 11 nt, Human
cuucccaccuc

SEQ ID NO: 1810192 - RNA, 11 nt, Human
cuuccauaauc

SEQ ID NO: 1810193 - RNA, 21 nt, Human
cuuccauaaucuggacuccuc

SEQ ID NO: 1810194 - RNA, 21 nt, Human
cuucccaccucucucacuccu

SEQ ID NO: 1810195 - RNA, 23 nt, Human
cuucccaccucucucacuccuug

SEQ ID NO: 1810196 - RNA, 12 nt, Human
gagugagcuggu

SEQ ID NO: 1810197 - RNA, 21 nt, Human
gagucccaccuuggcugcagg

SEQ ID NO: 1810198 - RNA, 24 nt, Human
gagugagcacuaaggugugcucug

SEQ ID NO: 1810199 - RNA, 12 nt, Human
gagugcagugag

SEQ ID NO: 1810200 - RNA, 11 nt, Human
gagugcaguga

SEQ ID NO: 1810201 - RNA, 14 nt, Human
gagucaccaagccc

SEQ ID NO: 1810202 - RNA, 13 nt, Human
gagucaccaagcc

SEQ ID NO: 1810203 - RNA, 15 nt, Human
gagucaccaagccca

SEQ ID NO: 1810204 - RNA, 20 nt, Human
gagucccaccuuggcugcag

SEQ ID NO: 1810205 - RNA, 16 nt, Human
gagucccaccuuggcu

SEQ ID NO: 1810206 - RNA, 14 nt, Human
gaggucuguucuuu

SEQ ID NO: 1810207 - RNA, 13 nt, Human
gaggucuguucuu

SEQ ID NO: 1810208 - RNA, 12 nt, Human
gaggugggaucc

SEQ ID NO: 1810209 - RNA, 11 nt, Human
gaggugggagg

SEQ ID NO: 1810210 - RNA, 20 nt, Human
gaguuguuacauuuuuaagu

SEQ ID NO: 1810211 - RNA, 16 nt, Human
gaguuguuacauuuuu

SEQ ID NO: 1810212 - RNA, 20 nt, Human
gaguuugggguaugggagag

SEQ ID NO: 1810213 - RNA, 20 nt, Human
gauauguaccuaacgaagua

SEQ ID NO: 1810214 - RNA, 16 nt, Human
gauacuugaaaauuaa

SEQ ID NO: 1810215 - RNA, 22 nt, Human
gauaugcuuguaacuaaaauaa

SEQ ID NO: 1810216 - RNA, 12 nt, Human
gauaugcuugua

SEQ ID NO: 1810217 - RNA, 18 nt, Human
gauaugcaguuuuccuua

SEQ ID NO: 1810218 - RNA, 17 nt, Human
gauacuugaaaauuaac

SEQ ID NO: 1810219 - RNA, 17 nt, Human
gauacgacaacuugcac

SEQ ID NO: 1810220 - RNA, 11 nt, Human
gauacuacagu

SEQ ID NO: 1810221 - RNA, 16 nt, Human
gauacuacaguuuguu

SEQ ID NO: 1810222 - RNA, 13 nt, Human
gauacccauccca

SEQ ID NO: 1810223 - RNA, 14 nt, Human
gauacccaucccau

SEQ ID NO: 1810224 - RNA, 14 nt, Human
gaugaucuuugcag

SEQ ID NO: 1810225 - RNA, 21 nt, Human
gaugaucuuugcagacaggca

SEQ ID NO: 1810226 - RNA, 20 nt, Human
gaugaucuuugcagacaggc

SEQ ID NO: 1810227 - RNA, 21 nt, Human
gaugaugaaaugaggucagag

SEQ ID NO: 1810228 - RNA, 15 nt, Human
gaucucuaacuucac

SEQ ID NO: 1810229 - RNA, 15 nt, Human
gauauuuuuuucuuu

SEQ ID NO: 1810230 - RNA, 16 nt, Human
gauauuuugcuuugug

SEQ ID NO: 1810231 - RNA, 12 nt, Human
gaucucuugagc

SEQ ID NO: 1810232 - RNA, 16 nt, Human
gaucucuugagccugg

SEQ ID NO: 1810233 - RNA, 17 nt, Human
gaucucuugagccuggg

SEQ ID NO: 1810234 - RNA, 14 nt, Human
gauuaccagggacu

SEQ ID NO: 1810235 - RNA, 18 nt, Human
gauuacugccuauuuuaa

SEQ ID NO: 1810236 - RNA, 20 nt, Human
gauuacaggugugaaccacc

SEQ ID NO: 1810237 - RNA, 20 nt, Human
gauuacaggugugagccacc

SEQ ID NO: 1810238 - RNA, 16 nt, Human
gcagccaggccacaag

SEQ ID NO: 1810239 - RNA, 13 nt, Human
gcagccaggccac

SEQ ID NO: 1810240 - RNA, 14 nt, Human
gcagccaggccaca

SEQ ID NO: 1810241 - RNA, 12 nt, Human
gcagccaggcca

SEQ ID NO: 1810242 - RNA, 14 nt, Human
gcagccacuauugu

SEQ ID NO: 1810243 - RNA, 16 nt, Human
gcagccacauuccuga

SEQ ID NO: 1810244 - RNA, 13 nt, Human
gcagggaaacagc

SEQ ID NO: 1810245 - RNA, 19 nt, Human
gcagggacuugaacccaua

SEQ ID NO: 1810246 - RNA, 10 nt, Human
gcagggaggg

SEQ ID NO: 1810247 - RNA, 13 nt, Human
gcagggagggccu

SEQ ID NO: 1810248 - RNA, 19 nt, Human
gcagcugcgguccacccag

SEQ ID NO: 1810249 - RNA, 17 nt, Human
gcagcugcgguccaccc

SEQ ID NO: 1810250 - RNA, 20 nt, Human
gcaggcucucaggccagcug

SEQ ID NO: 1810251 - RNA, 22 nt, Human
gcaggcucucaggccagcugcu

SEQ ID NO: 1810252 - RNA, 19 nt, Human
gcaggcuggcccugcccug

SEQ ID NO: 1810253 - RNA, 20 nt, Human
gcaggcuggcccugcccugg

SEQ ID NO: 1810254 - RNA, 21 nt, Human
gcaggcuggcccugcccuggu

SEQ ID NO: 1810255 - RNA, 15 nt, Human
gcaggcuggcccugc

SEQ ID NO: 1810256 - RNA, 16 nt, Human
gcaggcuggcccugcc

SEQ ID NO: 1810257 - RNA, 17 nt, Human
gcaggcuggcccugccc

SEQ ID NO: 1810258 - RNA, 18 nt, Human
gcaggcuggcccugcccu

SEQ ID NO: 1810259 - RNA, 14 nt, Human
gcaggcuggcccug

SEQ ID NO: 1810260 - RNA, 23 nt, Human
gcaggcucucaggccagcugcuu

SEQ ID NO: 1810261 - RNA, 20 nt, Human
gcauaccacuuuuguucuug

SEQ ID NO: 1810262 - RNA, 17 nt, Human
gcauaccacuuuuguuc

SEQ ID NO: 1810263 - RNA, 22 nt, Human
gcauaacguauaaaagccuguu

SEQ ID NO: 1810264 - RNA, 14 nt, Human
gcauacguacacau

SEQ ID NO: 1810265 - RNA, 13 nt, Human
gcacaugccucuc

SEQ ID NO: 1810266 - RNA, 21 nt, Human
gcacaucagcacgauuucugu

SEQ ID NO: 1810267 - RNA, 20 nt, Human
gcacaucagcacgauuucug

SEQ ID NO: 1810268 - RNA, 19 nt, Human
gcacaucagcacgauuucu

SEQ ID NO: 1810269 - RNA, 22 nt, Human
gcacaaucucggcucacugcau

SEQ ID NO: 1810270 - RNA, 21 nt, Human
gcacaaucucggcucacugca

SEQ ID NO: 1810271 - RNA, 22 nt, Human
gcacaugccucucucaggccaa

SEQ ID NO: 1810272 - RNA, 20 nt, Human
gcacaugccucucucaggcc

SEQ ID NO: 1810273 - RNA, 21 nt, Human
gcacaugccucucucaggcca

SEQ ID NO: 1810274 - RNA, 14 nt, Human
gcacaugccucucu

SEQ ID NO: 1810275 - RNA, 17 nt, Human
gcacaugccucucucag

SEQ ID NO: 1810276 - RNA, 18 nt, Human
gcacaugccucucucagg

SEQ ID NO: 1810277 - RNA, 19 nt, Human
gcacaugccucucucaggc

SEQ ID NO: 1810278 - RNA, 21 nt, Human
gcaccggcuggccuggccccu

SEQ ID NO: 1810279 - RNA, 23 nt, Human
gcaccggcuggccuggccccuca

SEQ ID NO: 1810280 - RNA, 19 nt, Human
gcaccggcuggccuggccc

SEQ ID NO: 1810281 - RNA, 13 nt, Human
gcaagugagagcu

SEQ ID NO: 1810282 - RNA, 23 nt, Human
gcaauaaggggagaguaacccug

SEQ ID NO: 1810283 - RNA, 22 nt, Human
gcacaagcuccaagcucccagg

SEQ ID NO: 1810284 - RNA, 23 nt, Human
gcacaagcuccaagcucccaggc

SEQ ID NO: 1810285 - RNA, 14 nt, Human
gcacaagcugcacc

SEQ ID NO: 1810286 - RNA, 21 nt, Human
gauucugaccuuaaaugcaac

SEQ ID NO: 1810287 - RNA, 20 nt, Human
gauucugaccuuaaaugcaa

SEQ ID NO: 1810288 - RNA, 23 nt, Human
gauucugaccuuaaaugcaacca

SEQ ID NO: 1810289 - RNA, 12 nt, Human
gcacugacauug

SEQ ID NO: 1810290 - RNA, 19 nt, Human
gcagagcagagaccauccc

SEQ ID NO: 1810291 - RNA, 20 nt, Human
gcagagcagagaccaucccu

SEQ ID NO: 1810292 - RNA, 24 nt, Human
gcagagcaccuuagacagucccug

SEQ ID NO: 1810293 - RNA, 12 nt, Human
gcagagcagaga

SEQ ID NO: 1810294 - RNA, 14 nt, Human
gcagagcagagacc

SEQ ID NO: 1810295 - RNA, 15 nt, Human
gcagagcagagacca

SEQ ID NO: 1810296 - RNA, 19 nt, Human
gcagagcaccuuagacagu

SEQ ID NO: 1810297 - RNA, 22 nt, Human
gcagagcaccuuagacaguccc

SEQ ID NO: 1810298 - RNA, 23 nt, Human
gcagagcaccuuagacagucccu

SEQ ID NO: 1810299 - RNA, 11 nt, Human
gaaugaauguc

SEQ ID NO: 1810300 - RNA, 14 nt, Human
gaaugaaugucagu

SEQ ID NO: 1810301 - RNA, 18 nt, Human
gaaugaaugucaguguga

SEQ ID NO: 1810302 - RNA, 22 nt, Human
gaaugaaugucagugugacuga

SEQ ID NO: 1810303 - RNA, 16 nt, Human
gaaggcucgagcaugc

SEQ ID NO: 1810304 - RNA, 17 nt, Human
gaaggcucgagcaugcc

SEQ ID NO: 1810305 - RNA, 19 nt, Human
gaaggcucgagcaugccug

SEQ ID NO: 1810306 - RNA, 19 nt, Human
gaagucuuuguacagacaa

SEQ ID NO: 1810307 - RNA, 20 nt, Human
gaagucuuuguacagacaac

SEQ ID NO: 1810308 - RNA, 18 nt, Human
gaagucuuuguacagaca

SEQ ID NO: 1810309 - RNA, 15 nt, Human
gaaguggggacagag

SEQ ID NO: 1810310 - RNA, 14 nt, Human
gaagcucagggccu

SEQ ID NO: 1810311 - RNA, 15 nt, Human
gaagcucagggccug

SEQ ID NO: 1810312 - RNA, 23 nt, Human
gaagcucagggccuggcucaggu

SEQ ID NO: 1810313 - RNA, 20 nt, Human
gaagcucagggccuggcuca

SEQ ID NO: 1810314 - RNA, 21 nt, Human
gaagcucagggccuggcucag

SEQ ID NO: 1810315 - RNA, 16 nt, Human
gaagcucagggccugg

SEQ ID NO: 1810316 - RNA, 17 nt, Human
gaagcucagggccuggc

SEQ ID NO: 1810317 - RNA, 18 nt, Human
gaagcucagggccuggcu

SEQ ID NO: 1810318 - RNA, 19 nt, Human
gaagcucagggccuggcuc

SEQ ID NO: 1810319 - RNA, 13 nt, Human
gaaauccagggug

SEQ ID NO: 1810320 - RNA, 18 nt, Human
gaaauccagggugguggu

SEQ ID NO: 1810321 - RNA, 14 nt, Human
gacacacagcucug

SEQ ID NO: 1810322 - RNA, 19 nt, Human
gacacacagcucuguccug

SEQ ID NO: 1810323 - RNA, 18 nt, Human
gacacacagcucuguccu

SEQ ID NO: 1810324 - RNA, 17 nt, Human
gacacacagcucugucc

SEQ ID NO: 1810325 - RNA, 15 nt, Human
gacacacagcucugu

SEQ ID NO: 1810326 - RNA, 23 nt, Human
gaauuuuggcugugucucccuuc

SEQ ID NO: 1810327 - RNA, 20 nt, Human
gaauuuugugcccccaugua

SEQ ID NO: 1810328 - RNA, 21 nt, Human
gaauuuugugcccccauguaa

SEQ ID NO: 1810329 - RNA, 18 nt, Human
gaauuuuauugacacagu

SEQ ID NO: 1810330 - RNA, 21 nt, Human
gaauuuuauuuuuugggaaaa

SEQ ID NO: 1810331 - RNA, 19 nt, Human
gaauuuuggcugugucucc

SEQ ID NO: 1810332 - RNA, 21 nt, Human
gacacacagcucuguccuggg

SEQ ID NO: 1810333 - RNA, 14 nt, Human
gacagugaaagaaa

SEQ ID NO: 1810334 - RNA, 11 nt, Human
gacagcuccuu

SEQ ID NO: 1810335 - RNA, 13 nt, Human
gacagcccuccau

SEQ ID NO: 1810336 - RNA, 13 nt, Human
gacagccuggcac

SEQ ID NO: 1810337 - RNA, 19 nt, Human
gacagccuggcacagggca

SEQ ID NO: 1810338 - RNA, 22 nt, Human
gacaggguuuugccauguuggc

SEQ ID NO: 1810339 - RNA, 20 nt, Human
gacaggguuuugccauguug

SEQ ID NO: 1810340 - RNA, 12 nt, Human
gacagacacagg

SEQ ID NO: 1810341 - RNA, 21 nt, Human
gacagcccgggcucugccucc

SEQ ID NO: 1810342 - RNA, 22 nt, Human
gacagcccgggcucugccuccc

SEQ ID NO: 1810343 - RNA, 23 nt, Human
gacagcccgggcucugccuccca

SEQ ID NO: 1810344 - RNA, 15 nt, Human
gacacugaugggcaa

SEQ ID NO: 1810345 - RNA, 16 nt, Human
gacacuuaaaaauggu

SEQ ID NO: 1810346 - RNA, 13 nt, Human
gacacugaugggc

SEQ ID NO: 1810347 - RNA, 12 nt, Human
gacucugucuca

SEQ ID NO: 1810348 - RNA, 15 nt, Human
gacuaggguccuggg

SEQ ID NO: 1810349 - RNA, 16 nt, Human
gacuaggguccugggg

SEQ ID NO: 1810350 - RNA, 18 nt, Human
gacuaggguccuggggaa

SEQ ID NO: 1810351 - RNA, 22 nt, Human
gacuaucuaaauguugaaagau

SEQ ID NO: 1810352 - RNA, 15 nt, Human
gagaaucacuugaac

SEQ ID NO: 1810353 - RNA, 14 nt, Human
gagaaucacuugaa

SEQ ID NO: 1810354 - RNA, 21 nt, Human
gagacccugucucaaaaaaag

SEQ ID NO: 1810355 - RNA, 11 nt, Human
gagaccugccc

SEQ ID NO: 1810356 - RNA, 12 nt, Human
gagaccugcccc

SEQ ID NO: 1810357 - RNA, 13 nt, Human
gagaccugccccu

SEQ ID NO: 1810358 - RNA, 22 nt, Human
gagaaggacccggaggggccug

SEQ ID NO: 1810359 - RNA, 23 nt, Human
gagaaggacccggaggggccugg

SEQ ID NO: 1810360 - RNA, 20 nt, Human
gagaaggacccggaggggcc

SEQ ID NO: 1810361 - RNA, 12 nt, Human
gagaaggaagcc

SEQ ID NO: 1810362 - RNA, 16 nt, Human
gagaagcggcuggcag

SEQ ID NO: 1810363 - RNA, 13 nt, Human
gagaagcggcugg

SEQ ID NO: 1810364 - RNA, 15 nt, Human
gagaagcggcuggca

SEQ ID NO: 1810365 - RNA, 11 nt, Human
gacuuuccucu

SEQ ID NO: 1810366 - RNA, 21 nt, Human
gacuuuucuuuguggcuuccu

SEQ ID NO: 1810367 - RNA, 23 nt, Human
gacuuuucuuucagccaagaauu

SEQ ID NO: 1810368 - RNA, 21 nt, Human
gagcagggcucagcggggaca

SEQ ID NO: 1810369 - RNA, 12 nt, Human
gagcaucaggcc

SEQ ID NO: 1810370 - RNA, 13 nt, Human
gagcaucaggcca

SEQ ID NO: 1810371 - RNA, 22 nt, Human
gagcaugccuggauggggcugc

SEQ ID NO: 1810372 - RNA, 14 nt, Human
gagcagggcucagc

SEQ ID NO: 1810373 - RNA, 22 nt, Human
gagcugccuguucagcuccagc

SEQ ID NO: 1810374 - RNA, 21 nt, Human
gagcugccuguucagcuccag

SEQ ID NO: 1810375 - RNA, 18 nt, Human
gagcggagaaaggaaggg

SEQ ID NO: 1810376 - RNA, 21 nt, Human
gagcggagaaaggaagggcug

SEQ ID NO: 1810377 - RNA, 22 nt, Human
gagccuugaacuuugaccucug

SEQ ID NO: 1810378 - RNA, 14 nt, Human
gagccuuccagggg

SEQ ID NO: 1810379 - RNA, 15 nt, Human
gagccuuccaggggu

SEQ ID NO: 1810380 - RNA, 16 nt, Human
gagccuuccaggggug

SEQ ID NO: 1810381 - RNA, 17 nt, Human
gagccuuccaggggugg

SEQ ID NO: 1810382 - RNA, 18 nt, Human
gagcugggugucaagagg

SEQ ID NO: 1810383 - RNA, 21 nt, Human
gagauugcaccacugcacucc

SEQ ID NO: 1810384 - RNA, 18 nt, Human
gagauugcaccacugcac

SEQ ID NO: 1810385 - RNA, 14 nt, Human
gagauguagccccu

SEQ ID NO: 1810386 - RNA, 13 nt, Human
gagauuuacaacu

SEQ ID NO: 1810387 - RNA, 14 nt, Human
gagaggcauccagu

SEQ ID NO: 1810388 - RNA, 17 nt, Human
gagacuccugcaggcag

SEQ ID NO: 1810389 - RNA, 18 nt, Human
gagacuccugcaggcagc

SEQ ID NO: 1810390 - RNA, 15 nt, Human
gagacuccugcaggc

SEQ ID NO: 1810391 - RNA, 16 nt, Human
gagacuccugcaggca

SEQ ID NO: 1810392 - RNA, 21 nt, Human
gagaugaugccaugggcccuc

SEQ ID NO: 1810393 - RNA, 22 nt, Human
gagaggcauccaguaucuugaa

SEQ ID NO: 1810394 - RNA, 23 nt, Human
gccugcuaauuccccagauugca

SEQ ID NO: 1810395 - RNA, 17 nt, Human
gccugcuaauuccccag

SEQ ID NO: 1810396 - RNA, 13 nt, Human
gccucggacuuag

SEQ ID NO: 1810397 - RNA, 13 nt, Human
gccugcuccagcu

SEQ ID NO: 1810398 - RNA, 17 nt, Human
gccuccaagcuccaucu

SEQ ID NO: 1810399 - RNA, 22 nt, Human
gccuccaauuuuuuaagugaaa

SEQ ID NO: 1810400 - RNA, 11 nt, Human
gccuccaugcu

SEQ ID NO: 1810401 - RNA, 19 nt, Human
gccuccuuugugaggaagc

SEQ ID NO: 1810402 - RNA, 20 nt, Human
gccuccuuugugaggaagcc

SEQ ID NO: 1810403 - RNA, 21 nt, Human
gccuccuuugugaggaagccg

SEQ ID NO: 1810404 - RNA, 20 nt, Human
gccuccauccugaggcucca

SEQ ID NO: 1810405 - RNA, 16 nt, Human
gccuccauccugaggc

SEQ ID NO: 1810406 - RNA, 13 nt, Human
gcgauucuucugc

SEQ ID NO: 1810407 - RNA, 14 nt, Human
gcgauucuucugcu

SEQ ID NO: 1810408 - RNA, 17 nt, Human
gcgauucuucugcuuca

SEQ ID NO: 1810409 - RNA, 16 nt, Human
gcuaauuuuucauuuu

SEQ ID NO: 1810410 - RNA, 18 nt, Human
gcuaauuuugaaaaacug

SEQ ID NO: 1810411 - RNA, 17 nt, Human
gcguuucuaugacacau

SEQ ID NO: 1810412 - RNA, 20 nt, Human
gcuacuguccuacccacccu

SEQ ID NO: 1810413 - RNA, 19 nt, Human
gcuacuguccuacccaccc

SEQ ID NO: 1810414 - RNA, 18 nt, Human
gcuacuguaaggcaauca

SEQ ID NO: 1810415 - RNA, 19 nt, Human
gcuacuguaaggcaaucau

SEQ ID NO: 1810416 - RNA, 11 nt, Human
gcuagaaauga

SEQ ID NO: 1810417 - RNA, 17 nt, Human
gcuacuugggaggcuga

SEQ ID NO: 1810418 - RNA, 14 nt, Human
gcgugcacacacca

SEQ ID NO: 1810419 - RNA, 18 nt, Human
gcgugcacacaccagagc

SEQ ID NO: 1810420 - RNA, 19 nt, Human
gcgugcacacaccagagcc

SEQ ID NO: 1810421 - RNA, 20 nt, Human
gcgugguggacaugcacagc

SEQ ID NO: 1810422 - RNA, 22 nt, Human
gccccugcugguucaggguugg

SEQ ID NO: 1810423 - RNA, 17 nt, Human
gccccugccucucugca

SEQ ID NO: 1810424 - RNA, 18 nt, Human
gccccugccucucugcag

SEQ ID NO: 1810425 - RNA, 15 nt, Human
gccccugccucucug

SEQ ID NO: 1810426 - RNA, 16 nt, Human
gccccugccucucugc

SEQ ID NO: 1810427 - RNA, 15 nt, Human
gccccuggaugcagc

SEQ ID NO: 1810428 - RNA, 16 nt, Human
gcccucacccuggggc

SEQ ID NO: 1810429 - RNA, 17 nt, Human
gcccucacccuggggcu

SEQ ID NO: 1810430 - RNA, 14 nt, Human
gccaugugccaggu

SEQ ID NO: 1810431 - RNA, 16 nt, Human
gccauguguuccaagg

SEQ ID NO: 1810432 - RNA, 15 nt, Human
gccauguguuccaag

SEQ ID NO: 1810433 - RNA, 13 nt, Human
gcccaggccccug

SEQ ID NO: 1810434 - RNA, 15 nt, Human
gcccaggccccugcc

SEQ ID NO: 1810435 - RNA, 16 nt, Human
gcccaggcaggucuug

SEQ ID NO: 1810436 - RNA, 14 nt, Human
gcccaggcaggucu

SEQ ID NO: 1810437 - RNA, 13 nt, Human
gcccaggcagguc

SEQ ID NO: 1810438 - RNA, 18 nt, Human
gcccaggccccugccacc

SEQ ID NO: 1810439 - RNA, 17 nt, Human
gcccaggccccugccac

SEQ ID NO: 1810440 - RNA, 22 nt, Human
gccaggccagagggagugacag

SEQ ID NO: 1810441 - RNA, 15 nt, Human
gccaggccagaggga

SEQ ID NO: 1810442 - RNA, 21 nt, Human
gccaggccacaagacccuugu

SEQ ID NO: 1810443 - RNA, 13 nt, Human
gccaggccacaag

SEQ ID NO: 1810444 - RNA, 18 nt, Human
gccaggccacaagacccu

SEQ ID NO: 1810445 - RNA, 15 nt, Human
gccaggcccucugcc

SEQ ID NO: 1810446 - RNA, 13 nt, Human
gccaggcccucug

SEQ ID NO: 1810447 - RNA, 14 nt, Human
gccaggcccucugc

SEQ ID NO: 1810448 - RNA, 16 nt, Human
gccauaugaaaaggcu

SEQ ID NO: 1810449 - RNA, 22 nt, Human
gccaguuggucccccuuccaug

SEQ ID NO: 1810450 - RNA, 23 nt, Human
gccaguuggucccccuuccaugg

SEQ ID NO: 1810451 - RNA, 16 nt, Human
gccaguuggucccccu

SEQ ID NO: 1810452 - RNA, 18 nt, Human
gccaguuggucccccuuc

SEQ ID NO: 1810453 - RNA, 20 nt, Human
gccaguuggucccccuucca

SEQ ID NO: 1810454 - RNA, 21 nt, Human
gccaguuggucccccuuccau

SEQ ID NO: 1810455 - RNA, 13 nt, Human
gccagugugacaa

SEQ ID NO: 1810456 - RNA, 13 nt, Human
gccaguugguccc

SEQ ID NO: 1810457 - RNA, 18 nt, Human
gcuuuugucuaugggacu

SEQ ID NO: 1810458 - RNA, 15 nt, Human
gcuuuuggucugugu

SEQ ID NO: 1810459 - RNA, 18 nt, Human
ggaaaauuuuaaaaauac

SEQ ID NO: 1810460 - RNA, 16 nt, Human
ggaaacccagcucugg

SEQ ID NO: 1810461 - RNA, 15 nt, Human
gcuuuuuuaucaugu

SEQ ID NO: 1810462 - RNA, 18 nt, Human
gcuuuuuuaucaugugaa

SEQ ID NO: 1810463 - RNA, 20 nt, Human
gcuuuuuuaucaugugaaau

SEQ ID NO: 1810464 - RNA, 12 nt, Human
gcuuuugugcau

SEQ ID NO: 1810465 - RNA, 14 nt, Human
gcuuugaucccuuc

SEQ ID NO: 1810466 - RNA, 17 nt, Human
gcuuugaucccuucuua

SEQ ID NO: 1810467 - RNA, 14 nt, Human
ggaaaugggcagag

SEQ ID NO: 1810468 - RNA, 16 nt, Human
ggaaaugggcagagca

SEQ ID NO: 1810469 - RNA, 17 nt, Human
ggaaaugggcagagcag

SEQ ID NO: 1810470 - RNA, 18 nt, Human
ggaaaugggcagagcaga

SEQ ID NO: 1810471 - RNA, 22 nt, Human
ggaaaugggcagagcagagacc

SEQ ID NO: 1810472 - RNA, 17 nt, Human
ggaaaugucaacaagua

SEQ ID NO: 1810473 - RNA, 15 nt, Human
ggaacaaggcaaggc

SEQ ID NO: 1810474 - RNA, 17 nt, Human
ggaacaaggcaaggcug

SEQ ID NO: 1810475 - RNA, 21 nt, Human
ggaacaaggcaaggcugucaa

SEQ ID NO: 1810476 - RNA, 14 nt, Human
ggaagacaauguga

SEQ ID NO: 1810477 - RNA, 16 nt, Human
ggaagacaaugugaaa

SEQ ID NO: 1810478 - RNA, 17 nt, Human
ggaacaccauaggucac

SEQ ID NO: 1810479 - RNA, 13 nt, Human
ggaacaccuccuc

SEQ ID NO: 1810480 - RNA, 23 nt, Human
ggaacaaggcaaggcugucaauu

SEQ ID NO: 1810481 - RNA, 15 nt, Human
ggaacacuccuucac

SEQ ID NO: 1810482 - RNA, 17 nt, Human
ggaacugaacauuccag

SEQ ID NO: 1810483 - RNA, 19 nt, Human
ggaacacuccuucacagau

SEQ ID NO: 1810484 - RNA, 22 nt, Human
ggaagacaaugugaaaagaaaa

SEQ ID NO: 1810485 - RNA, 17 nt, Human
ggaagacuucaucccuc

SEQ ID NO: 1810486 - RNA, 20 nt, Human
ggaagacuucaucccucugg

SEQ ID NO: 1810487 - RNA, 17 nt, Human
gcuuguaaauagcucag

SEQ ID NO: 1810488 - RNA, 16 nt, Human
gcuugaccgugaggcc

SEQ ID NO: 1810489 - RNA, 22 nt, Human
gcuugaccuuuaagagaaauga

SEQ ID NO: 1810490 - RNA, 23 nt, Human
gcuugaccgugaggccagagaca

SEQ ID NO: 1810491 - RNA, 18 nt, Human
gcuugaccuuuaagagaa

SEQ ID NO: 1810492 - RNA, 19 nt, Human
gcuuguaaauagcucaggu

SEQ ID NO: 1810493 - RNA, 18 nt, Human
gcuuguaaauagcucagg

SEQ ID NO: 1810494 - RNA, 22 nt, Human
gcuuuccccaugucucgacuca

SEQ ID NO: 1810495 - RNA, 21 nt, Human
gcuuuccccaugucucgacuc

SEQ ID NO: 1810496 - RNA, 16 nt, Human
gcuuuccucuuccuga

SEQ ID NO: 1810497 - RNA, 20 nt, Human
gcuugaccgugaggccagag

SEQ ID NO: 1810498 - RNA, 15 nt, Human
gcuucuucagagacu

SEQ ID NO: 1810499 - RNA, 12 nt, Human
gcuucuucagag

SEQ ID NO: 1810500 - RNA, 23 nt, Human
gcuuccagugaggcucugcccuu

SEQ ID NO: 1810501 - RNA, 22 nt, Human
gcuuccagugaggcucugcccu

SEQ ID NO: 1810502 - RNA, 12 nt, Human
gcugugccucug

SEQ ID NO: 1810503 - RNA, 14 nt, Human
gcuguuggcugggg

SEQ ID NO: 1810504 - RNA, 13 nt, Human
gcuguuggcuggg

SEQ ID NO: 1810505 - RNA, 22 nt, Human
gcuuacaagccagcuggagaaa

SEQ ID NO: 1810506 - RNA, 19 nt, Human
gcuuacaagccagcuggag

SEQ ID NO: 1810507 - RNA, 13 nt, Human
gcuuacaagccag

SEQ ID NO: 1810508 - RNA, 14 nt, Human
gcuucaguggcagc

SEQ ID NO: 1810509 - RNA, 15 nt, Human
gcuucaguggcagcu

SEQ ID NO: 1810510 - RNA, 16 nt, Human
gcuucaaauuguaagc

SEQ ID NO: 1810511 - RNA, 18 nt, Human
gcuucaaggauccugagc

SEQ ID NO: 1810512 - RNA, 14 nt, Human
gcuucaaggauccu

SEQ ID NO: 1810513 - RNA, 23 nt, Human
gcugguucaggguuggccccugc

SEQ ID NO: 1810514 - RNA, 19 nt, Human
gcuguauuagucacagaga

SEQ ID NO: 1810515 - RNA, 19 nt, Human
gcuccucuccccagcaagu

SEQ ID NO: 1810516 - RNA, 16 nt, Human
gcuccucuccccagca

SEQ ID NO: 1810517 - RNA, 19 nt, Human
gcucuacugaggugcuaug

SEQ ID NO: 1810518 - RNA, 18 nt, Human
gcucucaaguuaucaggg

SEQ ID NO: 1810519 - RNA, 20 nt, Human
gcucucaggccagcugcuug

SEQ ID NO: 1810520 - RNA, 19 nt, Human
gcucucaggccagcugcuu

SEQ ID NO: 1810521 - RNA, 17 nt, Human
gcucucaggccagcugc

SEQ ID NO: 1810522 - RNA, 18 nt, Human
gcucucaggccagcugcu

SEQ ID NO: 1810523 - RNA, 14 nt, Human
gcuccagcucacca

SEQ ID NO: 1810524 - RNA, 13 nt, Human
gcuccagcucacc

SEQ ID NO: 1810525 - RNA, 17 nt, Human
gcuccagcucaccagcc

SEQ ID NO: 1810526 - RNA, 15 nt, Human
gcuccucuccccagc

SEQ ID NO: 1810527 - RNA, 19 nt, Human
gcuccucccggugcccaag

SEQ ID NO: 1810528 - RNA, 16 nt, Human
gcuccucccggugccc

SEQ ID NO: 1810529 - RNA, 23 nt, Human
gcuccagacacauguccaagaag

SEQ ID NO: 1810530 - RNA, 18 nt, Human
gcuccagacacaugucca

SEQ ID NO: 1810531 - RNA, 21 nt, Human
gcuccagacacauguccaaga

SEQ ID NO: 1810532 - RNA, 9 nt, Human
gcuccagac

SEQ ID NO: 1810533 - RNA, 20 nt, Human
gcuccacuuggucugugaga

SEQ ID NO: 1810534 - RNA, 14 nt, Human
gcucuguccuggga

SEQ ID NO: 1810535 - RNA, 23 nt, Human
gcucugucgcccaggcuggagug

SEQ ID NO: 1810536 - RNA, 17 nt, Human
gcucuggagcccacugu

SEQ ID NO: 1810537 - RNA, 13 nt, Human
gcugacagacaca

SEQ ID NO: 1810538 - RNA, 12 nt, Human
gcugagccucag

SEQ ID NO: 1810539 - RNA, 16 nt, Human
gcugagccucagucuc

SEQ ID NO: 1810540 - RNA, 20 nt, Human
gcugaacuuguuuucuggga

SEQ ID NO: 1810541 - RNA, 23 nt, Human
gcugaaggcucgagcaugccugg

SEQ ID NO: 1810542 - RNA, 17 nt, Human
gcugaauacagaggcaa

SEQ ID NO: 1810543 - RNA, 22 nt, Human
gcucugaucauccacugugcca

SEQ ID NO: 1810544 - RNA, 21 nt, Human
gcucugaucauccacugugcc

SEQ ID NO: 1810545 - RNA, 15 nt, Human
gcucugcccauccug

SEQ ID NO: 1810546 - RNA, 15 nt, Human
gcucuggagcccacu

SEQ ID NO: 1810547 - RNA, 16 nt, Human
gcucuggagcccacug

SEQ ID NO: 1810548 - RNA, 21 nt, Human
gcucugcccauccugccccug

SEQ ID NO: 1810549 - RNA, 20 nt, Human
gcucugaucauccacugugc

SEQ ID NO: 1810550 - RNA, 13 nt, Human
gcugccauccagg

SEQ ID NO: 1810551 - RNA, 12 nt, Human
gcugccauccag

SEQ ID NO: 1810552 - RNA, 16 nt, Human
gcugcacccucaggca

SEQ ID NO: 1810553 - RNA, 13 nt, Human
gcugcacccucag

SEQ ID NO: 1810554 - RNA, 15 nt, Human
gcugcacccucaggc

SEQ ID NO: 1810555 - RNA, 12 nt, Human
gcugcugacagu

SEQ ID NO: 1810556 - RNA, 17 nt, Human
gcugccauccagguuca

SEQ ID NO: 1810557 - RNA, 13 nt, Human
gcugccccuggca

SEQ ID NO: 1810558 - RNA, 15 nt, Human
gcugccccuggcagc

SEQ ID NO: 1810559 - RNA, 16 nt, Human
gcugccccuggcagcc

SEQ ID NO: 1810560 - RNA, 17 nt, Human
gcugccccuggcagccc

SEQ ID NO: 1810561 - RNA, 17 nt, Human
ggccaaacucaccugcc

SEQ ID NO: 1810562 - RNA, 21 nt, Human
ggccaaacucaccugccccuc

SEQ ID NO: 1810563 - RNA, 14 nt, Human
ggccaggcuggucu

SEQ ID NO: 1810564 - RNA, 18 nt, Human
ggccaggcuggucucaaa

SEQ ID NO: 1810565 - RNA, 16 nt, Human
ggccaggcuggucuca

SEQ ID NO: 1810566 - RNA, 16 nt, Human
ggccagugugacaagg

SEQ ID NO: 1810567 - RNA, 24 nt, Human
ggcacugcuuccagugaggcucug

SEQ ID NO: 1810568 - RNA, 15 nt, Human
ggcaccagcagccug

SEQ ID NO: 1810569 - RNA, 16 nt, Human
ggcaccagcagccugg

SEQ ID NO: 1810570 - RNA, 17 nt, Human
ggcagugggagcugccu

SEQ ID NO: 1810571 - RNA, 18 nt, Human
ggcauuuuacuguacaga

SEQ ID NO: 1810572 - RNA, 19 nt, Human
ggcagugggagcugccugu

SEQ ID NO: 1810573 - RNA, 18 nt, Human
ggcagugggagcugccug

SEQ ID NO: 1810574 - RNA, 18 nt, Human
ggcauccaguaucuugaa

SEQ ID NO: 1810575 - RNA, 15 nt, Human
ggcccgacagccugg

SEQ ID NO: 1810576 - RNA, 13 nt, Human
ggcccuuccucuc

SEQ ID NO: 1810577 - RNA, 15 nt, Human
ggcccuuccucucca

SEQ ID NO: 1810578 - RNA, 18 nt, Human
ggcccuuccucuccacug

SEQ ID NO: 1810579 - RNA, 16 nt, Human
ggcccuucucuccagc

SEQ ID NO: 1810580 - RNA, 17 nt, Human
ggcccuucucuccagcc

SEQ ID NO: 1810581 - RNA, 17 nt, Human
ggcccuuccucuccacu

SEQ ID NO: 1810582 - RNA, 19 nt, Human
ggcccuucucuccagcccc

SEQ ID NO: 1810583 - RNA, 18 nt, Human
ggcccuucucuccagccc

SEQ ID NO: 1810584 - RNA, 23 nt, Human
ggcucagcggggacagcuccuuc

SEQ ID NO: 1810585 - RNA, 22 nt, Human
ggcucagcggggacagcuccuu

SEQ ID NO: 1810586 - RNA, 21 nt, Human
ggcucagcggggacagcuccu

SEQ ID NO: 1810587 - RNA, 23 nt, Human
ggcucagcaaaagaugcuucuca

SEQ ID NO: 1810588 - RNA, 19 nt, Human
ggcgugcaguggugcgauc

SEQ ID NO: 1810589 - RNA, 14 nt, Human
ggcgugcaguggug

SEQ ID NO: 1810590 - RNA, 16 nt, Human
ggcucacugcagccuc

SEQ ID NO: 1810591 - RNA, 17 nt, Human
ggcucacugcagccuca

SEQ ID NO: 1810592 - RNA, 16 nt, Human
ggcucacugcauccuc

SEQ ID NO: 1810593 - RNA, 19 nt, Human
ggcucacugcauccuccgc

SEQ ID NO: 1810594 - RNA, 12 nt, Human
ggccuucucuga

SEQ ID NO: 1810595 - RNA, 23 nt, Human
ggccuucggccuccauccugagg

SEQ ID NO: 1810596 - RNA, 20 nt, Human
ggccuguggaucaaauccag

SEQ ID NO: 1810597 - RNA, 21 nt, Human
ggccugugucuaguuguuuga

SEQ ID NO: 1810598 - RNA, 21 nt, Human
ggccuggccagaugcaccagc

SEQ ID NO: 1810599 - RNA, 14 nt, Human
ggccuuuggcuuca

SEQ ID NO: 1810600 - RNA, 13 nt, Human
ggccuuuggcuuc

SEQ ID NO: 1810601 - RNA, 16 nt, Human
ggccuucucugaagga

SEQ ID NO: 1810602 - RNA, 15 nt, Human
ggccuucucugaagg

SEQ ID NO: 1810603 - RNA, 23 nt, Human
ggccuccaaguccacaguggaac

SEQ ID NO: 1810604 - RNA, 13 nt, Human
ggccuccauccug

SEQ ID NO: 1810605 - RNA, 15 nt, Human
ggccugagcugggau

SEQ ID NO: 1810606 - RNA, 21 nt, Human
ggagcugccuguucagcucca

SEQ ID NO: 1810607 - RNA, 12 nt, Human
ggagcugccugu

SEQ ID NO: 1810608 - RNA, 22 nt, Human
ggagccccgaggccuucucuga

SEQ ID NO: 1810609 - RNA, 16 nt, Human
ggagccccgaggccuu

SEQ ID NO: 1810610 - RNA, 16 nt, Human
ggagccaauggagacu

SEQ ID NO: 1810611 - RNA, 20 nt, Human
ggaggaaggaaacccagcuc

SEQ ID NO: 1810612 - RNA, 23 nt, Human
ggaggaaggaaacccagcucugg

SEQ ID NO: 1810613 - RNA, 19 nt, Human
ggaggaaggaaacccagcu

SEQ ID NO: 1810614 - RNA, 12 nt, Human
ggaggccagccu

SEQ ID NO: 1810615 - RNA, 11 nt, Human
ggaggccagcc

SEQ ID NO: 1810616 - RNA, 14 nt, Human
ggaggugaccccag

SEQ ID NO: 1810617 - RNA, 14 nt, Human
ggaggucgaggcag

SEQ ID NO: 1810618 - RNA, 20 nt, Human
ggaggucaaggcugcaguga

SEQ ID NO: 1810619 - RNA, 16 nt, Human
ggaggggggagguggg

SEQ ID NO: 1810620 - RNA, 16 nt, Human
ggagcaucagugcccu

SEQ ID NO: 1810621 - RNA, 16 nt, Human
ggcacagggcaguggg

SEQ ID NO: 1810622 - RNA, 22 nt, Human
ggcacaaucucggcucacugca

SEQ ID NO: 1810623 - RNA, 24 nt, Human
ggcacagaaaauggaagacagcuc

SEQ ID NO: 1810624 - RNA, 16 nt, Human
ggauguucugggacac

SEQ ID NO: 1810625 - RNA, 22 nt, Human
ggauguugaaaaaguucugcag

SEQ ID NO: 1810626 - RNA, 15 nt, Human
ggauguucugggaca

SEQ ID NO: 1810627 - RNA, 21 nt, Human
ggaguuggaagugugugaucu

SEQ ID NO: 1810628 - RNA, 15 nt, Human
ggaguucugguuccu

SEQ ID NO: 1810629 - RNA, 14 nt, Human
ggaguggccacaga

SEQ ID NO: 1810630 - RNA, 18 nt, Human
ggauggauuuccagccaa

SEQ ID NO: 1810631 - RNA, 21 nt, Human
ggauguacaaggacagccccu

SEQ ID NO: 1810632 - RNA, 16 nt, Human
ggauggggcugcaccg

SEQ ID NO: 1810633 - RNA, 15 nt, Human
ggauccuccaggugc

SEQ ID NO: 1810634 - RNA, 14 nt, Human
ggauccuccaggug

SEQ ID NO: 1810635 - RNA, 13 nt, Human
ggauccugagcca

SEQ ID NO: 1810636 - RNA, 14 nt, Human
ggauccugagccag

SEQ ID NO: 1810637 - RNA, 15 nt, Human
ggagugcagugagcc

SEQ ID NO: 1810638 - RNA, 13 nt, Human
aaagcaaaugucu

SEQ ID NO: 1810639 - RNA, 21 nt, Human
gguccugcugcaguugccagu

SEQ ID NO: 1810640 - RNA, 23 nt, Human
gguccugcugcaguugccaguca

SEQ ID NO: 1810641 - RNA, 22 nt, Human
aaagauucugaccuuaaaugca

SEQ ID NO: 1810642 - RNA, 13 nt, Human
aaagcaaaggaga

SEQ ID NO: 1810643 - RNA, 13 nt, Human
ggucggaaaacau

SEQ ID NO: 1810644 - RNA, 17 nt, Human
ggucuacacugugcuga

SEQ ID NO: 1810645 - RNA, 18 nt, Human
ggucgcuugggaauuuua

SEQ ID NO: 1810646 - RNA, 14 nt, Human
ggucggaaaacaug

SEQ ID NO: 1810647 - RNA, 21 nt, Human
gguggaugccugguggcagcu

SEQ ID NO: 1810648 - RNA, 14 nt, Human
gguggaugccuggu

SEQ ID NO: 1810649 - RNA, 22 nt, Human
aaagcagcguuucuaugacaca

SEQ ID NO: 1810650 - RNA, 18 nt, Human
aaagcagcguuucuauga

SEQ ID NO: 1810651 - RNA, 16 nt, Human
aaagcagcguuucuau

SEQ ID NO: 1810652 - RNA, 17 nt, Human
aaagcaggcagaacuca

SEQ ID NO: 1810653 - RNA, 19 nt, Human
aaagcaggcagaacucauc

SEQ ID NO: 1810654 - RNA, 17 nt, Human
aaagcagggacuugaac

SEQ ID NO: 1810655 - RNA, 19 nt, Human
ggugcugggccccugccuc

SEQ ID NO: 1810656 - RNA, 20 nt, Human
ggugcugggccccugccucu

SEQ ID NO: 1810657 - RNA, 18 nt, Human
ggugcaaugaccuuucaa

SEQ ID NO: 1810658 - RNA, 19 nt, Human
ggugcaaugaccuuucaau

SEQ ID NO: 1810659 - RNA, 20 nt, Human
ggugcaaugaccuuucaaua

SEQ ID NO: 1810660 - RNA, 20 nt, Human
gguaacaggcagauacagga

SEQ ID NO: 1810661 - RNA, 14 nt, Human
gguaacaggcagau

SEQ ID NO: 1810662 - RNA, 18 nt, Human
gguaacuagggaagauaa

SEQ ID NO: 1810663 - RNA, 17 nt, Human
ggguuucuaaagcugcc

SEQ ID NO: 1810664 - RNA, 14 nt, Human
gguaaucgaccugc

SEQ ID NO: 1810665 - RNA, 17 nt, Human
gguaaucgaccugccuc

SEQ ID NO: 1810666 - RNA, 18 nt, Human
gguaaucgaccugccucg

SEQ ID NO: 1810667 - RNA, 24 nt, Human
gguacaaccuguucugcuuuccuc

SEQ ID NO: 1810668 - RNA, 23 nt, Human
gguacaaccuguucugcuuuccu

SEQ ID NO: 1810669 - RNA, 17 nt, Human
ggguggaugccuggugg

SEQ ID NO: 1810670 - RNA, 15 nt, Human
ggguggcaccagcag

SEQ ID NO: 1810671 - RNA, 13 nt, Human
ggguggaugccug

SEQ ID NO: 1810672 - RNA, 11 nt, Human
ggggccuggca

SEQ ID NO: 1810673 - RNA, 12 nt, Human
ggggccuggcag

SEQ ID NO: 1810674 - RNA, 19 nt, Human
ggguggcaccagcagccug

SEQ ID NO: 1810675 - RNA, 20 nt, Human
ggguggggaccucaggccug

SEQ ID NO: 1810676 - RNA, 17 nt, Human
ggguguggcgcagcaua

SEQ ID NO: 1810677 - RNA, 12 nt, Human
ggguggugaccu

SEQ ID NO: 1810678 - RNA, 18 nt, Human
ggguggggggggugcugg

SEQ ID NO: 1810679 - RNA, 15 nt, Human
gguccauagagagca

SEQ ID NO: 1810680 - RNA, 22 nt, Human
aaacuuuaccuuuuuuauacau

SEQ ID NO: 1810681 - RNA, 17 nt, Human
aaacuuuaccuuuuuua

SEQ ID NO: 1810682 - RNA, 18 nt, Human
aaacuuuacuauggcccu

SEQ ID NO: 1810683 - RNA, 12 nt, Human
aaacuuuacuau

SEQ ID NO: 1810684 - RNA, 18 nt, Human
aaagaaguggggacagag

SEQ ID NO: 1810685 - RNA, 16 nt, Human
aaagaauagaagcuaa

SEQ ID NO: 1810686 - RNA, 13 nt, Human
aaagacaccuacu

SEQ ID NO: 1810687 - RNA, 19 nt, Human
aaagacaccuacugagugg

SEQ ID NO: 1810688 - RNA, 17 nt, Human
aaagacuaucuaaaugu

SEQ ID NO: 1810689 - RNA, 16 nt, Human
gguccacccaggagcc

SEQ ID NO: 1810690 - RNA, 15 nt, Human
gguccacccaggagc

SEQ ID NO: 1810691 - RNA, 13 nt, Human
gguccacccagga

SEQ ID NO: 1810692 - RNA, 12 nt, Human
gguccacccagg

SEQ ID NO: 1810693 - RNA, 17 nt, Human
gguccacccaggagccc

SEQ ID NO: 1810694 - RNA, 22 nt, Human
gguaugaucacggcucacugca

SEQ ID NO: 1810695 - RNA, 14 nt, Human
gguaugcaaucaaa

SEQ ID NO: 1810696 - RNA, 16 nt, Human
gguccacaacacacag

SEQ ID NO: 1810697 - RNA, 14 nt, Human
gguagcuuuucccu

SEQ ID NO: 1810698 - RNA, 16 nt, Human
gguuuagaaagcuugc

SEQ ID NO: 1810699 - RNA, 19 nt, Human
gguuccuuccucugagccu

SEQ ID NO: 1810700 - RNA, 20 nt, Human
gguuccuuccucugagccuu

SEQ ID NO: 1810701 - RNA, 19 nt, Human
gguuucaccauguuggcca

SEQ ID NO: 1810702 - RNA, 13 nt, Human
gguuucagaaaug

SEQ ID NO: 1810703 - RNA, 12 nt, Human
gguuucagaaau

SEQ ID NO: 1810704 - RNA, 15 nt, Human
gguuucagaaaugug

SEQ ID NO: 1810705 - RNA, 14 nt, Human
gguuucagaaaugu

SEQ ID NO: 1810706 - RNA, 21 nt, Human
gguucccuuugacgccauccc

SEQ ID NO: 1810707 - RNA, 16 nt, Human
gguuccuccccuccuc

SEQ ID NO: 1810708 - RNA, 22 nt, Human
gguucccuuugacgccauccca

SEQ ID NO: 1810709 - RNA, 23 nt, Human
gguuccagcaauucuccugccuc

SEQ ID NO: 1810710 - RNA, 15 nt, Human
gguuccccuguucac

SEQ ID NO: 1810711 - RNA, 24 nt, Human
gguuccagcaauucuccugccuca

SEQ ID NO: 1810712 - RNA, 21 nt, Human
gguucaggguuggccccugcc

SEQ ID NO: 1810713 - RNA, 18 nt, Human
gguucaggguuggccccu

SEQ ID NO: 1810714 - RNA, 22 nt, Human
gguucaggguuggccccugccc

SEQ ID NO: 1810715 - RNA, 13 nt, Human
ggugugcucugau

SEQ ID NO: 1810716 - RNA, 21 nt, Human
ggugugcggccuuuggcuuca

SEQ ID NO: 1810717 - RNA, 12 nt, Human
gguguggaagag

SEQ ID NO: 1810718 - RNA, 18 nt, Human
ggugugagucaccaagcc

SEQ ID NO: 1810719 - RNA, 16 nt, Human
ggugugacugaauuuc

SEQ ID NO: 1810720 - RNA, 16 nt, Human
ggugugaccacugcag

SEQ ID NO: 1810721 - RNA, 13 nt, Human
ggugucgggcaug

SEQ ID NO: 1810722 - RNA, 16 nt, Human
ggugucgggcaugaca

SEQ ID NO: 1810723 - RNA, 17 nt, Human
gguggggggggugcugg

SEQ ID NO: 1810724 - RNA, 15 nt, Human
gguggggucacucug

SEQ ID NO: 1810725 - RNA, 23 nt, Human
gguggggucacucuggcagcuca

SEQ ID NO: 1810726 - RNA, 17 nt, Human
gguggggcagcuugagg

SEQ ID NO: 1810727 - RNA, 13 nt, Human
gguggggcagcuu

SEQ ID NO: 1810728 - RNA, 19 nt, Human
ggugggauccuccaggugc

SEQ ID NO: 1810729 - RNA, 16 nt, Human
aaagccuguuuaagag

SEQ ID NO: 1810730 - RNA, 18 nt, Human
aaagccuguuuaagagac

SEQ ID NO: 1810731 - RNA, 20 nt, Human
ggugggaggauugcuugagc

SEQ ID NO: 1810732 - RNA, 14 nt, Human
ggugggauccucca

SEQ ID NO: 1810733 - RNA, 15 nt, Human
ggugggauccuccag

SEQ ID NO: 1810734 - RNA, 12 nt, Human
aaauaaugugaa

SEQ ID NO: 1810735 - RNA, 13 nt, Human
aaauaaugugaaa

SEQ ID NO: 1810736 - RNA, 23 nt, Human
aaaguuucucuuuucaaaacauu

SEQ ID NO: 1810737 - RNA, 21 nt, Human
aaaguuucucuuuucaaaaca

SEQ ID NO: 1810738 - RNA, 14 nt, Human
aaaguuuguuugcu

SEQ ID NO: 1810739 - RNA, 16 nt, Human
aaaguuuguugaaaca

SEQ ID NO: 1810740 - RNA, 23 nt, Human
aaaguucccuacuuccugugacu

SEQ ID NO: 1810741 - RNA, 12 nt, Human
aaaguggugaga

SEQ ID NO: 1810742 - RNA, 21 nt, Human
aaaguucccuacuuccuguga

SEQ ID NO: 1810743 - RNA, 20 nt, Human
ggggacagcuccuucugucc

SEQ ID NO: 1810744 - RNA, 14 nt, Human
ggggacagcuccuu

SEQ ID NO: 1810745 - RNA, 12 nt, Human
ggggacagcucc

SEQ ID NO: 1810746 - RNA, 18 nt, Human
aaacauccuacaagacac

SEQ ID NO: 1810747 - RNA, 22 nt, Human
aaacauccuacaagacacagug

SEQ ID NO: 1810748 - RNA, 20 nt, Human
aaacaagcacuaaacaaaga

SEQ ID NO: 1810749 - RNA, 16 nt, Human
aaacacauuuuucuua

SEQ ID NO: 1810750 - RNA, 20 nt, Human
aaacaagaccacguuucuaa

SEQ ID NO: 1810751 - RNA, 12 nt, Human
aaaaugugugug

SEQ ID NO: 1810752 - RNA, 13 nt, Human
aaaaugucuuuau

SEQ ID NO: 1810753 - RNA, 22 nt, Human
gggcuggguucuacccaggugc

SEQ ID NO: 1810754 - RNA, 15 nt, Human
aaaaugugauaugua

SEQ ID NO: 1810755 - RNA, 21 nt, Human
gggcugcaugcgggcuuccuc

SEQ ID NO: 1810756 - RNA, 18 nt, Human
gggcugcaugcgggcuuc

SEQ ID NO: 1810757 - RNA, 10 nt, Human
gggcucagca

SEQ ID NO: 1810758 - RNA, 22 nt, Human
gggcugcaccggcuggccuggc

SEQ ID NO: 1810759 - RNA, 18 nt, Human
gggcucagcaaaagaugc

SEQ ID NO: 1810760 - RNA, 13 nt, Human
gggcugcccuggu

SEQ ID NO: 1810761 - RNA, 14 nt, Human
gggcugcccuggug

SEQ ID NO: 1810762 - RNA, 15 nt, Human
gggcugcccuggugc

SEQ ID NO: 1810763 - RNA, 21 nt, Human
gggcugcccuggugcugccac

SEQ ID NO: 1810764 - RNA, 16 nt, Human
gggcugggagcucugc

SEQ ID NO: 1810765 - RNA, 18 nt, Human
gggcugggagcucugcag

SEQ ID NO: 1810766 - RNA, 12 nt, Human
gggcugggcaga

SEQ ID NO: 1810767 - RNA, 20 nt, Human
gggcuggguucuacccaggu

SEQ ID NO: 1810768 - RNA, 14 nt, Human
gggccaggcugggu

SEQ ID NO: 1810769 - RNA, 15 nt, Human
gggccaggcuggguc

SEQ ID NO: 1810770 - RNA, 21 nt, Human
gggccaggcugggucgcccug

SEQ ID NO: 1810771 - RNA, 13 nt, Human
gggccaggcuggg

SEQ ID NO: 1810772 - RNA, 11 nt, Human
gggccaggagc

SEQ ID NO: 1810773 - RNA, 14 nt, Human
aaaaugagccuggc

SEQ ID NO: 1810774 - RNA, 21 nt, Human
aaaaugagccuggcaagaaug

SEQ ID NO: 1810775 - RNA, 14 nt, Human
gggccaguuggucc

SEQ ID NO: 1810776 - RNA, 18 nt, Human
gggccaguuggucccccu

SEQ ID NO: 1810777 - RNA, 22 nt, Human
gggccaguuggucccccuucca

SEQ ID NO: 1810778 - RNA, 23 nt, Human
gggccaguuggucccccuuccau

SEQ ID NO: 1810779 - RNA, 20 nt, Human
gggccucuuaugggcugggu

SEQ ID NO: 1810780 - RNA, 13 nt, Human
gggccuccugugu

SEQ ID NO: 1810781 - RNA, 15 nt, Human
gggccuccugugugu

SEQ ID NO: 1810782 - RNA, 22 nt, Human
gggccucggacuuagcugggag

SEQ ID NO: 1810783 - RNA, 15 nt, Human
gggcgggaggauguu

SEQ ID NO: 1810784 - RNA, 23 nt, Human
gggcuacaccuuagccugcccuc

SEQ ID NO: 1810785 - RNA, 22 nt, Human
gggaggcucuggagcccacugu

SEQ ID NO: 1810786 - RNA, 14 nt, Human
gggagggcuccaga

SEQ ID NO: 1810787 - RNA, 15 nt, Human
gggagggcuccagac

SEQ ID NO: 1810788 - RNA, 17 nt, Human
gggagggcuccagacac

SEQ ID NO: 1810789 - RNA, 18 nt, Human
gggagggcuccagacaca

SEQ ID NO: 1810790 - RNA, 17 nt, Human
gggaggucgaggcagga

SEQ ID NO: 1810791 - RNA, 18 nt, Human
gggaggucgaggcaggag

SEQ ID NO: 1810792 - RNA, 19 nt, Human
gggaggucgaggcaggagg

SEQ ID NO: 1810793 - RNA, 16 nt, Human
gggcagagcagagacc

SEQ ID NO: 1810794 - RNA, 18 nt, Human
gggcaacccccagccugc

SEQ ID NO: 1810795 - RNA, 16 nt, Human
gggcaacccccagccu

SEQ ID NO: 1810796 - RNA, 17 nt, Human
gggcagagcagagacca

SEQ ID NO: 1810797 - RNA, 22 nt, Human
gggcagagcagagaccaucccu

SEQ ID NO: 1810798 - RNA, 14 nt, Human
gggcagaggaaagc

SEQ ID NO: 1810799 - RNA, 23 nt, Human
gggcagagcagagaccaucccug

SEQ ID NO: 1810800 - RNA, 17 nt, Human
gggauuguaaaauggug

SEQ ID NO: 1810801 - RNA, 16 nt, Human
gggauuguaaaauggu

SEQ ID NO: 1810802 - RNA, 15 nt, Human
gggauuacaggugug

SEQ ID NO: 1810803 - RNA, 12 nt, Human
gggauuacaggu

SEQ ID NO: 1810804 - RNA, 14 nt, Human
gggauuacaggcgu

SEQ ID NO: 1810805 - RNA, 13 nt, Human
gggauuacaggcu

SEQ ID NO: 1810806 - RNA, 16 nt, Human
gggauuacaggcuccu

SEQ ID NO: 1810807 - RNA, 21 nt, Human
gggauuacaggcuccugccac

SEQ ID NO: 1810808 - RNA, 19 nt, Human
aaaagguaugcaaucaaau

SEQ ID NO: 1810809 - RNA, 19 nt, Human
aaaagggacugagaaauuu

SEQ ID NO: 1810810 - RNA, 17 nt, Human
aaaaaucucaaauuucu

SEQ ID NO: 1810811 - RNA, 14 nt, Human
aaaaaucucaaauu

SEQ ID NO: 1810812 - RNA, 15 nt, Human
aaaacaugcuacaca

SEQ ID NO: 1810813 - RNA, 21 nt, Human
aaaaccaauguucucucuucu

SEQ ID NO: 1810814 - RNA, 15 nt, Human
aaaacccagauaaag

SEQ ID NO: 1810815 - RNA, 22 nt, Human
aaaacugcugacuguuuucucu

SEQ ID NO: 1810816 - RNA, 23 nt, Human
aaaacugcugacuguuuucucuu

SEQ ID NO: 1810817 - RNA, 13 nt, Human
aaaagaugcuucu

SEQ ID NO: 1810818 - RNA, 21 nt, Human
aaaaauaugaccacacuccag

SEQ ID NO: 1810819 - RNA, 23 nt, Human
aaaaauaugaccacacuccagcu

SEQ ID NO: 1810820 - RNA, 21 nt, Human
gggacagcuccuucuguccua

SEQ ID NO: 1810821 - RNA, 16 nt, Human
gggaaggauacaaaag

SEQ ID NO: 1810822 - RNA, 13 nt, Human
gggaaggauacaa

SEQ ID NO: 1810823 - RNA, 13 nt, Human
gggacagaggggg

SEQ ID NO: 1810824 - RNA, 22 nt, Human
gggacagaggggguggccuccc

SEQ ID NO: 1810825 - RNA, 23 nt, Human
gggacagaggggguggccuccca

SEQ ID NO: 1810826 - RNA, 16 nt, Human
gggacagcuccuucug

SEQ ID NO: 1810827 - RNA, 23 nt, Human
cagguuuuuggucugacccacug

SEQ ID NO: 1810828 - RNA, 21 nt, Human
caggguuggccccugcccggc

SEQ ID NO: 1810829 - RNA, 17 nt, Human
caggguuggccccugcc

SEQ ID NO: 1810830 - RNA, 14 nt, Human
caggugcugccauc

SEQ ID NO: 1810831 - RNA, 13 nt, Human
caggugcugccau

SEQ ID NO: 1810832 - RNA, 18 nt, Human
caguaaaugggggugcau

SEQ ID NO: 1810833 - RNA, 20 nt, Human
caguaaaugggggugcauuu

SEQ ID NO: 1810834 - RNA, 19 nt, Human
caguaaaugggggugcauu

SEQ ID NO: 1810835 - RNA, 14 nt, Human
cagucaccccggcc

SEQ ID NO: 1810836 - RNA, 16 nt, Human
cagucaccccggccac

SEQ ID NO: 1810837 - RNA, 17 nt, Human
cagucaccccggccacc

SEQ ID NO: 1810838 - RNA, 23 nt, Human
cagggucucacucugucgcccag

SEQ ID NO: 1810839 - RNA, 16 nt, Human
caggguuggccccugc

SEQ ID NO: 1810840 - RNA, 15 nt, Human
caggguuggccccug

SEQ ID NO: 1810841 - RNA, 21 nt, Human
cagggucucuaccauccccug

SEQ ID NO: 1810842 - RNA, 15 nt, Human
caggcugggcuucag

SEQ ID NO: 1810843 - RNA, 22 nt, Human
cagggaggacgcucucuggccu

SEQ ID NO: 1810844 - RNA, 14 nt, Human
caggcugggcuuca

SEQ ID NO: 1810845 - RNA, 15 nt, Human
cagggcucagcgggg

SEQ ID NO: 1810846 - RNA, 12 nt, Human
cagggcucagcg

SEQ ID NO: 1810847 - RNA, 20 nt, Human
cagggcucagcggggacagc

SEQ ID NO: 1810848 - RNA, 17 nt, Human
cagggagggccugggcc

SEQ ID NO: 1810849 - RNA, 18 nt, Human
cagggagggccugggccc

SEQ ID NO: 1810850 - RNA, 16 nt, Human
cagggagggcuucugc

SEQ ID NO: 1810851 - RNA, 19 nt, Human
caggcuggcgugcaguggu

SEQ ID NO: 1810852 - RNA, 18 nt, Human
caggcuggcgugcagugg

SEQ ID NO: 1810853 - RNA, 17 nt, Human
caggcuggcgugcagug

SEQ ID NO: 1810854 - RNA, 23 nt, Human
caggccugggggcugggcagagg

SEQ ID NO: 1810855 - RNA, 16 nt, Human
caggcugggagagccu

SEQ ID NO: 1810856 - RNA, 18 nt, Human
caggcugggagagccuuc

SEQ ID NO: 1810857 - RNA, 19 nt, Human
caggcugggagagccuucc

SEQ ID NO: 1810858 - RNA, 20 nt, Human
caggcugggagagccuucca

SEQ ID NO: 1810859 - RNA, 20 nt, Human
caggccugggggcugggcag

SEQ ID NO: 1810860 - RNA, 22 nt, Human
caggccugggggcugggcagag

SEQ ID NO: 1810861 - RNA, 13 nt, Human
caggaccucaggu

SEQ ID NO: 1810862 - RNA, 13 nt, Human
caggaccagggau

SEQ ID NO: 1810863 - RNA, 21 nt, Human
caggaccagggauuuccauga

SEQ ID NO: 1810864 - RNA, 20 nt, Human
caggcaaugcuggcuguugg

SEQ ID NO: 1810865 - RNA, 19 nt, Human
caggcaaugcuggcuguug

SEQ ID NO: 1810866 - RNA, 12 nt, Human
caggaggccagc

SEQ ID NO: 1810867 - RNA, 13 nt, Human
caggaggccagcc

SEQ ID NO: 1810868 - RNA, 21 nt, Human
caggcaaugcuggcuguuggc

SEQ ID NO: 1810869 - RNA, 16 nt, Human
caggcacugcugccca

SEQ ID NO: 1810870 - RNA, 17 nt, Human
caggcacugcugcccag

SEQ ID NO: 1810871 - RNA, 23 nt, Human
caggcacugcugcccagccucca

SEQ ID NO: 1810872 - RNA, 13 nt, Human
caggccagcugcu

SEQ ID NO: 1810873 - RNA, 15 nt, Human
caggccagcugcuug

SEQ ID NO: 1810874 - RNA, 13 nt, Human
caggccaggcccu

SEQ ID NO: 1810875 - RNA, 14 nt, Human
caggccaggcccuc

SEQ ID NO: 1810876 - RNA, 15 nt, Human
caggccaggcccucu

SEQ ID NO: 1810877 - RNA, 16 nt, Human
caggccaggcccucug

SEQ ID NO: 1810878 - RNA, 19 nt, Human
cagcuguucagcugguuga

SEQ ID NO: 1810879 - RNA, 16 nt, Human
cagcuguucagcuggu

SEQ ID NO: 1810880 - RNA, 15 nt, Human
cagcuguucagcugg

SEQ ID NO: 1810881 - RNA, 17 nt, Human
cagcuuauucacaagac

SEQ ID NO: 1810882 - RNA, 16 nt, Human
cagcuuauucacaaga

SEQ ID NO: 1810883 - RNA, 20 nt, Human
caggaaaagcugcugacagu

SEQ ID NO: 1810884 - RNA, 19 nt, Human
caggaaaagcugcugacag

SEQ ID NO: 1810885 - RNA, 23 nt, Human
caggaaaggcuccaggagcagcc

SEQ ID NO: 1810886 - RNA, 21 nt, Human
caggaaaggcuccaggagcag

SEQ ID NO: 1810887 - RNA, 22 nt, Human
caggaaaggcuccaggagcagc

SEQ ID NO: 1810888 - RNA, 23 nt, Human
cagauacaggaaaagcugcugac

SEQ ID NO: 1810889 - RNA, 22 nt, Human
cagaucauugugaaauuauuca

SEQ ID NO: 1810890 - RNA, 16 nt, Human
cagaucauugugaaau

SEQ ID NO: 1810891 - RNA, 14 nt, Human
cagagccugcaguu

SEQ ID NO: 1810892 - RNA, 20 nt, Human
cagagagggugggagugggc

SEQ ID NO: 1810893 - RNA, 22 nt, Human
cagagagggugggagugggccc

SEQ ID NO: 1810894 - RNA, 16 nt, Human
cagagagggugggagu

SEQ ID NO: 1810895 - RNA, 17 nt, Human
cagagcuacacagggga

SEQ ID NO: 1810896 - RNA, 22 nt, Human
cagagcuacacaggggaaaaga

SEQ ID NO: 1810897 - RNA, 23 nt, Human
cagagacuccugcaggcagccag

SEQ ID NO: 1810898 - RNA, 21 nt, Human
cagagacuccugcaggcagcc

SEQ ID NO: 1810899 - RNA, 22 nt, Human
cagagacuccugcaggcagcca

SEQ ID NO: 1810900 - RNA, 20 nt, Human
cagagacuccugcaggcagc

SEQ ID NO: 1810901 - RNA, 19 nt, Human
cagccccgugggguuccuc

SEQ ID NO: 1810902 - RNA, 13 nt, Human
cagccccugcaca

SEQ ID NO: 1810903 - RNA, 22 nt, Human
cagccccauucugccugcccag

SEQ ID NO: 1810904 - RNA, 20 nt, Human
cagccccauucugccugccc

SEQ ID NO: 1810905 - RNA, 19 nt, Human
cagccccauucugccugcc

SEQ ID NO: 1810906 - RNA, 24 nt, Human
cagccccauucugccugcccaggc

SEQ ID NO: 1810907 - RNA, 23 nt, Human
cagccccauucugccugcccagg

SEQ ID NO: 1810908 - RNA, 23 nt, Human
cagccgccaugcuccuggcccac

SEQ ID NO: 1810909 - RNA, 13 nt, Human
cagcccuuagcag

SEQ ID NO: 1810910 - RNA, 23 nt, Human
cagccugagcgacagugagacuc

SEQ ID NO: 1810911 - RNA, 14 nt, Human
cagcggggacagcu

SEQ ID NO: 1810912 - RNA, 14 nt, Human
cagcguuucuauga

SEQ ID NO: 1810913 - RNA, 16 nt, Human
cagcguuucuaugaca

SEQ ID NO: 1810914 - RNA, 19 nt, Human
cagcguuucuaugacacau

SEQ ID NO: 1810915 - RNA, 16 nt, Human
cagcauauucaggaag

SEQ ID NO: 1810916 - RNA, 17 nt, Human
cagcauauucaggaagc

SEQ ID NO: 1810917 - RNA, 18 nt, Human
cagcauauucaggaagcu

SEQ ID NO: 1810918 - RNA, 21 nt, Human
cagauugcaacaggcugggcu

SEQ ID NO: 1810919 - RNA, 13 nt, Human
cagauuuggaaag

SEQ ID NO: 1810920 - RNA, 16 nt, Human
cagauuugagcucagc

SEQ ID NO: 1810921 - RNA, 13 nt, Human
cagauuugagcuc

SEQ ID NO: 1810922 - RNA, 14 nt, Human
cagauuugagcuca

SEQ ID NO: 1810923 - RNA, 15 nt, Human
cagauuucacucucc

SEQ ID NO: 1810924 - RNA, 16 nt, Human
cagauuucacucuccu

SEQ ID NO: 1810925 - RNA, 18 nt, Human
cagauuucacucuccuug

SEQ ID NO: 1810926 - RNA, 17 nt, Human
ccaaaacucuccucugc

SEQ ID NO: 1810927 - RNA, 17 nt, Human
ccaaaaaaugcuugcuu

SEQ ID NO: 1810928 - RNA, 18 nt, Human
cauuuuugaauacaggca

SEQ ID NO: 1810929 - RNA, 20 nt, Human
cauuuuugaauacaggcaua

SEQ ID NO: 1810930 - RNA, 23 nt, Human
cauuuggugguuucagaaaugug

SEQ ID NO: 1810931 - RNA, 22 nt, Human
cauuuggugguuucagaaaugu

SEQ ID NO: 1810932 - RNA, 16 nt, Human
cauuuauucugcucac

SEQ ID NO: 1810933 - RNA, 18 nt, Human
cauuucauuugugccaga

SEQ ID NO: 1810934 - RNA, 21 nt, Human
cauugcggacagccacggcca

SEQ ID NO: 1810935 - RNA, 17 nt, Human
cauugcggacagccacg

SEQ ID NO: 1810936 - RNA, 15 nt, Human
cauugcggacagcca

SEQ ID NO: 1810937 - RNA, 14 nt, Human
cauugcggacagcc

SEQ ID NO: 1810938 - RNA, 18 nt, Human
cauugcugggcuugucug

SEQ ID NO: 1810939 - RNA, 17 nt, Human
cauucucacuccuaccu

SEQ ID NO: 1810940 - RNA, 16 nt, Human
cauucucacuccuacc

SEQ ID NO: 1810941 - RNA, 13 nt, Human
cauuaugaugugu

SEQ ID NO: 1810942 - RNA, 18 nt, Human
cauuaucuagauacugua

SEQ ID NO: 1810943 - RNA, 16 nt, Human
cauucuccuuguguua

SEQ ID NO: 1810944 - RNA, 15 nt, Human
cauguucucugagga

SEQ ID NO: 1810945 - RNA, 17 nt, Human
cauuaucuagauacugu

SEQ ID NO: 1810946 - RNA, 16 nt, Human
cauuaucuagauacug

SEQ ID NO: 1810947 - RNA, 12 nt, Human
cauuaucuagau

SEQ ID NO: 1810948 - RNA, 15 nt, Human
cauuaggauggcuag

SEQ ID NO: 1810949 - RNA, 22 nt, Human
cauggcugccaaugggagcuca

SEQ ID NO: 1810950 - RNA, 23 nt, Human
ccaaugcacuuuguucuggcucu

SEQ ID NO: 1810951 - RNA, 20 nt, Human
ccaaugcacuuuguucuggc

SEQ ID NO: 1810952 - RNA, 22 nt, Human
ccaaugcacuuuguucuggcuc

SEQ ID NO: 1810953 - RNA, 20 nt, Human
ccaauguucucucuucucca

SEQ ID NO: 1810954 - RNA, 22 nt, Human
ccaaagugguauagaaaugcug

SEQ ID NO: 1810955 - RNA, 19 nt, Human
ccaaagugguauagaaaug

SEQ ID NO: 1810956 - RNA, 22 nt, Human
ccaaagugcugggauuacaggu

SEQ ID NO: 1810957 - RNA, 11 nt, Human
ccaacuuguaa

SEQ ID NO: 1810958 - RNA, 19 nt, Human
ccaaagugcugggauuaca

SEQ ID NO: 1810959 - RNA, 22 nt, Human
ccaaagugcugggauuacaggg

SEQ ID NO: 1810960 - RNA, 22 nt, Human
ccaaagugcugggauuacaggc

SEQ ID NO: 1810961 - RNA, 13 nt, Human
ccacccugcucuc

SEQ ID NO: 1810962 - RNA, 18 nt, Human
ccaccaucaccagacagg

SEQ ID NO: 1810963 - RNA, 20 nt, Human
ccaccaucaagccaccaaca

SEQ ID NO: 1810964 - RNA, 14 nt, Human
ccaccgcagacagg

SEQ ID NO: 1810965 - RNA, 17 nt, Human
ccaccgcagacaggacc

SEQ ID NO: 1810966 - RNA, 15 nt, Human
ccaccuuggcucaag

SEQ ID NO: 1810967 - RNA, 14 nt, Human
ccaccuuggcucaa

SEQ ID NO: 1810968 - RNA, 23 nt, Human
ccaccgggcugggagcucugcag

SEQ ID NO: 1810969 - RNA, 19 nt, Human
ccaccgcagacaggaccag

SEQ ID NO: 1810970 - RNA, 18 nt, Human
ccaccgcagacaggacca

SEQ ID NO: 1810971 - RNA, 22 nt, Human
ccacacuucaggcucuucuccu

SEQ ID NO: 1810972 - RNA, 16 nt, Human
ccaccaucaagccacc

SEQ ID NO: 1810973 - RNA, 17 nt, Human
ccaccaucaagccacca

SEQ ID NO: 1810974 - RNA, 18 nt, Human
caucugugaaaggaaaga

SEQ ID NO: 1810975 - RNA, 19 nt, Human
caucugugaaaggaaagag

SEQ ID NO: 1810976 - RNA, 12 nt, Human
caucgcaaugua

SEQ ID NO: 1810977 - RNA, 21 nt, Human
caucuuagguuggcaaaaagg

SEQ ID NO: 1810978 - RNA, 22 nt, Human
caucuuagguuggcaaaaaggc

SEQ ID NO: 1810979 - RNA, 17 nt, Human
caucccagccccaauga

SEQ ID NO: 1810980 - RNA, 16 nt, Human
caucccagccccaaug

SEQ ID NO: 1810981 - RNA, 13 nt, Human
caucccagcccca

SEQ ID NO: 1810982 - RNA, 14 nt, Human
caucccagccccaa

SEQ ID NO: 1810983 - RNA, 14 nt, Human
caucaggccaggcc

SEQ ID NO: 1810984 - RNA, 21 nt, Human
caucaggccaggcccucugcc

SEQ ID NO: 1810985 - RNA, 22 nt, Human
caucaggccaggcccucugccc

SEQ ID NO: 1810986 - RNA, 23 nt, Human
caucaggccaggcccucugccca

SEQ ID NO: 1810987 - RNA, 18 nt, Human
caucagcacgauuucugu

SEQ ID NO: 1810988 - RNA, 17 nt, Human
caucagcacgauuucug

SEQ ID NO: 1810989 - RNA, 13 nt, Human
caucaggccaggc

SEQ ID NO: 1810990 - RNA, 19 nt, Human
caucagcacgauuucuguu

SEQ ID NO: 1810991 - RNA, 22 nt, Human
caugcaaggucauuuuuuuuaa

SEQ ID NO: 1810992 - RNA, 18 nt, Human
caugcaaggucauuuuuu

SEQ ID NO: 1810993 - RNA, 17 nt, Human
caugcaaggucauuuuu

SEQ ID NO: 1810994 - RNA, 12 nt, Human
caugcugccucc

SEQ ID NO: 1810995 - RNA, 14 nt, Human
caugcugccuccag

SEQ ID NO: 1810996 - RNA, 22 nt, Human
cauggccuuugcuugaaagaaa

SEQ ID NO: 1810997 - RNA, 19 nt, Human
cauggccuuugcuugaaag

SEQ ID NO: 1810998 - RNA, 16 nt, Human
caugcugcccugugag

SEQ ID NO: 1810999 - RNA, 18 nt, Human
caugcugcccugugagua

SEQ ID NO: 1811000 - RNA, 17 nt, Human
caugacacgaauauugc

SEQ ID NO: 1811001 - RNA, 18 nt, Human
caugacacgaauauugcu

SEQ ID NO: 1811002 - RNA, 14 nt, Human
caugaauuugugaa

SEQ ID NO: 1811003 - RNA, 14 nt, Human
caugacacgaauau

SEQ ID NO: 1811004 - RNA, 22 nt, Human
cauauuaccacagacauacuaa

SEQ ID NO: 1811005 - RNA, 21 nt, Human
cauauuaccacagacauacua

SEQ ID NO: 1811006 - RNA, 20 nt, Human
cauauuaccacagacauacu

SEQ ID NO: 1811007 - RNA, 17 nt, Human
cauauuaccacagacau

SEQ ID NO: 1811008 - RNA, 15 nt, Human
cauagcccucacccu

SEQ ID NO: 1811009 - RNA, 19 nt, Human
cauagcccucacccugggg

SEQ ID NO: 1811010 - RNA, 12 nt, Human
cauagcccucac

SEQ ID NO: 1811011 - RNA, 21 nt, Human
cauaaugcgugcauaccacuu

SEQ ID NO: 1811012 - RNA, 15 nt, Human
cauacaauuccaaac

SEQ ID NO: 1811013 - RNA, 12 nt, Human
caguuugcuuug

SEQ ID NO: 1811014 - RNA, 14 nt, Human
caguuugcuuugua

SEQ ID NO: 1811015 - RNA, 21 nt, Human
caguuugcuuuguaugcacuu

SEQ ID NO: 1811016 - RNA, 23 nt, Human
cauaaucuggacuccucugucca

SEQ ID NO: 1811017 - RNA, 17 nt, Human
cauaaugcgugcauacc

SEQ ID NO: 1811018 - RNA, 14 nt, Human
cauaaugcgugcau

SEQ ID NO: 1811019 - RNA, 21 nt, Human
cauaaucuggacuccucuguc

SEQ ID NO: 1811020 - RNA, 22 nt, Human
cauaaucuggacuccucugucc

SEQ ID NO: 1811021 - RNA, 20 nt, Human
cauaaucuggacuccucugu

SEQ ID NO: 1811022 - RNA, 19 nt, Human
cauaaucuggacuccucug

SEQ ID NO: 1811023 - RNA, 18 nt, Human
cagucaccccggccaccu

SEQ ID NO: 1811024 - RNA, 15 nt, Human
caauucuugccaaau

SEQ ID NO: 1811025 - RNA, 12 nt, Human
caauggcagccu

SEQ ID NO: 1811026 - RNA, 11 nt, Human
caauggcagcc

SEQ ID NO: 1811027 - RNA, 20 nt, Human
caauggagacugucucaaga

SEQ ID NO: 1811028 - RNA, 17 nt, Human
cacaagagcccaggccu

SEQ ID NO: 1811029 - RNA, 17 nt, Human
cacaagcuccaagcucc

SEQ ID NO: 1811030 - RNA, 23 nt, Human
cacaagcuccaagcucccaggca

SEQ ID NO: 1811031 - RNA, 17 nt, Human
cacaagcugcacccuca

SEQ ID NO: 1811032 - RNA, 23 nt, Human
cacaagcugcacccucaggcagg

SEQ ID NO: 1811033 - RNA, 16 nt, Human
cacaagagcccaggcc

SEQ ID NO: 1811034 - RNA, 13 nt, Human
cacaagcuccaag

SEQ ID NO: 1811035 - RNA, 14 nt, Human
cacaagcuccaagc

SEQ ID NO: 1811036 - RNA, 15 nt, Human
cacaagcuccaagcu

SEQ ID NO: 1811037 - RNA, 13 nt, Human
caauuuauuaugg

SEQ ID NO: 1811038 - RNA, 14 nt, Human
cacaagagcccagg

SEQ ID NO: 1811039 - RNA, 20 nt, Human
cacacagcucuguccuggga

SEQ ID NO: 1811040 - RNA, 17 nt, Human
cacacagcucuguccug

SEQ ID NO: 1811041 - RNA, 23 nt, Human
cacacagugagucgaggacaggg

SEQ ID NO: 1811042 - RNA, 21 nt, Human
cacacagugagucgaggacag

SEQ ID NO: 1811043 - RNA, 15 nt, Human
cacacauacacacac

SEQ ID NO: 1811044 - RNA, 20 nt, Human
cacacaugagcaucaggcca

SEQ ID NO: 1811045 - RNA, 23 nt, Human
cacacaguauuacuucugcuaca

SEQ ID NO: 1811046 - RNA, 20 nt, Human
cacacaguauuacuucugcu

SEQ ID NO: 1811047 - RNA, 18 nt, Human
cacacagugagucgagga

SEQ ID NO: 1811048 - RNA, 21 nt, Human
cacagacauacuaaccagcag

SEQ ID NO: 1811049 - RNA, 19 nt, Human
cacagacauacuaaccagc

SEQ ID NO: 1811050 - RNA, 11 nt, Human
cacagccucug

SEQ ID NO: 1811051 - RNA, 13 nt, Human
cacagacccugcc

SEQ ID NO: 1811052 - RNA, 23 nt, Human
cacagaaaauggaagacagcucu

SEQ ID NO: 1811053 - RNA, 19 nt, Human
cacagaaaauucuucucca

SEQ ID NO: 1811054 - RNA, 21 nt, Human
cacacaugagcaucaggccag

SEQ ID NO: 1811055 - RNA, 22 nt, Human
cacacaugagcaucaggccagg

SEQ ID NO: 1811056 - RNA, 18 nt, Human
cacagaaaauggaagaca

SEQ ID NO: 1811057 - RNA, 19 nt, Human
cacagaaaauggaagacag

SEQ ID NO: 1811058 - RNA, 20 nt, Human
cacagaaaauggaagacagc

SEQ ID NO: 1811059 - RNA, 22 nt, Human
cacagaaaauggaagacagcuc

SEQ ID NO: 1811060 - RNA, 21 nt, Human
cacaguauuacuucugcuaca

SEQ ID NO: 1811061 - RNA, 20 nt, Human
cacaguauuacuucugcuac

SEQ ID NO: 1811062 - RNA, 19 nt, Human
cacaggggaaaagaggagu

SEQ ID NO: 1811063 - RNA, 17 nt, Human
cacaggggaaaagagga

SEQ ID NO: 1811064 - RNA, 18 nt, Human
cacaggggaaaagaggag

SEQ ID NO: 1811065 - RNA, 19 nt, Human
cacagcgcuggccgggacc

SEQ ID NO: 1811066 - RNA, 22 nt, Human
cacagcgcuggccgggaccccg

SEQ ID NO: 1811067 - RNA, 23 nt, Human
cacaggcccuuccucuccacugc

SEQ ID NO: 1811068 - RNA, 17 nt, Human
caaguccacaguggaac

SEQ ID NO: 1811069 - RNA, 19 nt, Human
caaguaugaauaaagacac

SEQ ID NO: 1811070 - RNA, 21 nt, Human
caaguaugaauaaagacaccu

SEQ ID NO: 1811071 - RNA, 13 nt, Human
caagucaagugaa

SEQ ID NO: 1811072 - RNA, 17 nt, Human
caagucaagugaaaaag

SEQ ID NO: 1811073 - RNA, 16 nt, Human
caaguaugaauaaaga

SEQ ID NO: 1811074 - RNA, 17 nt, Human
caaggccaaaggaagca

SEQ ID NO: 1811075 - RNA, 18 nt, Human
caaggccaaaggaagcac

SEQ ID NO: 1811076 - RNA, 15 nt, Human
caaggccaaaggaag

SEQ ID NO: 1811077 - RNA, 16 nt, Human
caaggccaaaggaagc

SEQ ID NO: 1811078 - RNA, 14 nt, Human
caagcucugcuccu

SEQ ID NO: 1811079 - RNA, 13 nt, Human
caagcugcacccu

SEQ ID NO: 1811080 - RNA, 14 nt, Human
caagcugcacccuc

SEQ ID NO: 1811081 - RNA, 18 nt, Human
caagcugcacccucaggc

SEQ ID NO: 1811082 - RNA, 20 nt, Human
caagcugcacccucaggcag

SEQ ID NO: 1811083 - RNA, 13 nt, Human
caagcucugcucc

SEQ ID NO: 1811084 - RNA, 19 nt, Human
caagcucuaucaccaagga

SEQ ID NO: 1811085 - RNA, 12 nt, Human
caagcuccaagc

SEQ ID NO: 1811086 - RNA, 19 nt, Human
caauaaagcagcguuucua

SEQ ID NO: 1811087 - RNA, 12 nt, Human
cacugcagccuc

SEQ ID NO: 1811088 - RNA, 21 nt, Human
cacugcagaagacaguauggc

SEQ ID NO: 1811089 - RNA, 20 nt, Human
cacugcacuccagccugggu

SEQ ID NO: 1811090 - RNA, 15 nt, Human
cacugcacuccagcc

SEQ ID NO: 1811091 - RNA, 16 nt, Human
cacugcacuccagccu

SEQ ID NO: 1811092 - RNA, 18 nt, Human
cacugcacuccagccugg

SEQ ID NO: 1811093 - RNA, 19 nt, Human
cacugcacuccagccuggg

SEQ ID NO: 1811094 - RNA, 19 nt, Human
cacugcacuauagccuagg

SEQ ID NO: 1811095 - RNA, 13 nt, Human
cacugcagccuca

SEQ ID NO: 1811096 - RNA, 14 nt, Human
cacugcauccuccg

SEQ ID NO: 1811097 - RNA, 16 nt, Human
cacugcauccuccgcc

SEQ ID NO: 1811098 - RNA, 16 nt, Human
cacugcauguuuguga

SEQ ID NO: 1811099 - RNA, 18 nt, Human
cacugcauccuccgccuc

SEQ ID NO: 1811100 - RNA, 18 nt, Human
cacugggagaaaugaaaa

SEQ ID NO: 1811101 - RNA, 23 nt, Human
cacuuaggaacguaaucgugucc

SEQ ID NO: 1811102 - RNA, 24 nt, Human
cacuuagaaauugcauuuccugac

SEQ ID NO: 1811103 - RNA, 16 nt, Human
cacuuacacuuuaugc

SEQ ID NO: 1811104 - RNA, 18 nt, Human
cacuuacacuuuaugcac

SEQ ID NO: 1811105 - RNA, 23 nt, Human
cacugguggcccgacagccuggc

SEQ ID NO: 1811106 - RNA, 22 nt, Human
cacugguucuucuuggucucag

SEQ ID NO: 1811107 - RNA, 12 nt, Human
cacuccccugcu

SEQ ID NO: 1811108 - RNA, 13 nt, Human
cacuccccugcug

SEQ ID NO: 1811109 - RNA, 14 nt, Human
cacuccccugcugg

SEQ ID NO: 1811110 - RNA, 15 nt, Human
cacuccccugcuggg

SEQ ID NO: 1811111 - RNA, 14 nt, Human
cacuaggcuucugg

SEQ ID NO: 1811112 - RNA, 11 nt, Human
cacuccagcug

SEQ ID NO: 1811113 - RNA, 12 nt, Human
cacuccagcugg

SEQ ID NO: 1811114 - RNA, 15 nt, Human
cacuccagcugggau

SEQ ID NO: 1811115 - RNA, 16 nt, Human
cacuccagccugggug

SEQ ID NO: 1811116 - RNA, 13 nt, Human
caccuuggcugca

SEQ ID NO: 1811117 - RNA, 15 nt, Human
caccuuggcucaagu

SEQ ID NO: 1811118 - RNA, 14 nt, Human
caccuuggcugcag

SEQ ID NO: 1811119 - RNA, 17 nt, Human
caccugccuguugggcc

SEQ ID NO: 1811120 - RNA, 19 nt, Human
caccugccuguugggccag

SEQ ID NO: 1811121 - RNA, 24 nt, Human
caccugccuguugggccaggagcc

SEQ ID NO: 1811122 - RNA, 16 nt, Human
cacccuggggagaaag

SEQ ID NO: 1811123 - RNA, 15 nt, Human
cacccuggggagaaa

SEQ ID NO: 1811124 - RNA, 17 nt, Human
cacccugaaagcccuga

SEQ ID NO: 1811125 - RNA, 14 nt, Human
cacccucaggcagg

SEQ ID NO: 1811126 - RNA, 13 nt, Human
caccucagccucc

SEQ ID NO: 1811127 - RNA, 23 nt, Human
caccuacaguguacagucuugua

SEQ ID NO: 1811128 - RNA, 20 nt, Human
caccuacaguguacagucuu

SEQ ID NO: 1811129 - RNA, 14 nt, Human
caccucagccuccc

SEQ ID NO: 1811130 - RNA, 17 nt, Human
cacccuggggagaaagu

SEQ ID NO: 1811131 - RNA, 17 nt, Human
caccuacaguguacagu

SEQ ID NO: 1811132 - RNA, 16 nt, Human
caccuacaguguacag

SEQ ID NO: 1811133 - RNA, 13 nt, Human
caccuacagugua

SEQ ID NO: 1811134 - RNA, 23 nt, Human
caccugccucggccucccaaagu

SEQ ID NO: 1811135 - RNA, 14 nt, Human
caccugccccucaa

SEQ ID NO: 1811136 - RNA, 15 nt, Human
caccugccccucaac

SEQ ID NO: 1811137 - RNA, 16 nt, Human
caccugccccucaacu

SEQ ID NO: 1811138 - RNA, 11 nt, Human
caccccagccc

SEQ ID NO: 1811139 - RNA, 16 nt, Human
caaaagaugcuucuca

SEQ ID NO: 1811140 - RNA, 20 nt, Human
caaaaaaaaaaaaaaauuag

SEQ ID NO: 1811141 - RNA, 18 nt, Human
caaaagaugcuucucacu

SEQ ID NO: 1811142 - RNA, 15 nt, Human
caaaaggcagaagca

SEQ ID NO: 1811143 - RNA, 21 nt, Human
caaaccaucauugaaaucuuu

SEQ ID NO: 1811144 - RNA, 19 nt, Human
caaaccaucauugaaaucu

SEQ ID NO: 1811145 - RNA, 20 nt, Human
caaagauauuuugcuuugug

SEQ ID NO: 1811146 - RNA, 20 nt, Human
caaauggaaaugggcagagc

SEQ ID NO: 1811147 - RNA, 21 nt, Human
caaauggaaaugggcagagca

SEQ ID NO: 1811148 - RNA, 22 nt, Human
caaauggaaaugggcagagcag

SEQ ID NO: 1811149 - RNA, 20 nt, Human
caacaccucugcacaagcug

SEQ ID NO: 1811150 - RNA, 14 nt, Human
caacacuaacauga

SEQ ID NO: 1811151 - RNA, 23 nt, Human
caaagauauuuugcuuugugauu

SEQ ID NO: 1811152 - RNA, 22 nt, Human
caaagauauuuugcuuugugau

SEQ ID NO: 1811153 - RNA, 21 nt, Human
caaagucucuggaauuugaaa

SEQ ID NO: 1811154 - RNA, 14 nt, Human
caaaguagaagucu

SEQ ID NO: 1811155 - RNA, 21 nt, Human
caaaguagaagucuuagaugu

SEQ ID NO: 1811156 - RNA, 22 nt, Human
caaaguacacuguuucaaacuu

SEQ ID NO: 1811157 - RNA, 15 nt, Human
caaagcagugcaugc

SEQ ID NO: 1811158 - RNA, 17 nt, Human
caaagcagugcaugcug

SEQ ID NO: 1811159 - RNA, 16 nt, Human
auuugccaauaauaau

SEQ ID NO: 1811160 - RNA, 15 nt, Human
auuugccaauaauaa

SEQ ID NO: 1811161 - RNA, 17 nt, Human
auuuuauagcuacuaau

SEQ ID NO: 1811162 - RNA, 19 nt, Human
auuuuauagcuacuaauuu

SEQ ID NO: 1811163 - RNA, 18 nt, Human
auuuguuucuuucucuga

SEQ ID NO: 1811164 - RNA, 23 nt, Human
auuuguuugaacugauaaagaug

SEQ ID NO: 1811165 - RNA, 22 nt, Human
auuuguuugaacugauaaagau

SEQ ID NO: 1811166 - RNA, 13 nt, Human
auuugcuccuuuc

SEQ ID NO: 1811167 - RNA, 13 nt, Human
auuugcuuuggaa

SEQ ID NO: 1811168 - RNA, 15 nt, Human
auuugcuuuggaagu

SEQ ID NO: 1811169 - RNA, 14 nt, Human
auuugcuuuggaag

SEQ ID NO: 1811170 - RNA, 13 nt, Human
auuuggaaaauaa

SEQ ID NO: 1811171 - RNA, 12 nt, Human
auuuggaaaaua

SEQ ID NO: 1811172 - RNA, 14 nt, Human
auuugugccagaau

SEQ ID NO: 1811173 - RNA, 20 nt, Human
auuugugauacaaugcugug

SEQ ID NO: 1811174 - RNA, 17 nt, Human
auuugugauacaaugcu

SEQ ID NO: 1811175 - RNA, 15 nt, Human
auuugugauacaaug

SEQ ID NO: 1811176 - RNA, 23 nt, Human
auuagauuucucauuugccaaua

SEQ ID NO: 1811177 - RNA, 19 nt, Human
auuagcauuugucaacaaa

SEQ ID NO: 1811178 - RNA, 17 nt, Human
auuagcaguuugcuuug

SEQ ID NO: 1811179 - RNA, 17 nt, Human
auuacaggaaguacugg

SEQ ID NO: 1811180 - RNA, 16 nt, Human
auuacaggugugaacc

SEQ ID NO: 1811181 - RNA, 22 nt, Human
auuacaagcgugagccacugca

SEQ ID NO: 1811182 - RNA, 18 nt, Human
auguuugccucugccucu

SEQ ID NO: 1811183 - RNA, 23 nt, Human
auguuugggagacugcugaguca

SEQ ID NO: 1811184 - RNA, 18 nt, Human
auuaggugugacugaauu

SEQ ID NO: 1811185 - RNA, 16 nt, Human
auuaggugugacugaa

SEQ ID NO: 1811186 - RNA, 21 nt, Human
auuaggugugacugaauuucu

SEQ ID NO: 1811187 - RNA, 19 nt, Human
auucacaagacccaaaagg

SEQ ID NO: 1811188 - RNA, 23 nt, Human
auuaugcaugaaguaauaugcac

SEQ ID NO: 1811189 - RNA, 14 nt, Human
auucauaaugacuu

SEQ ID NO: 1811190 - RNA, 15 nt, Human
auucauaaugacuua

SEQ ID NO: 1811191 - RNA, 21 nt, Human
auucauaauuauuauuuggcc

SEQ ID NO: 1811192 - RNA, 19 nt, Human
auucauaaugacuuaagca

SEQ ID NO: 1811193 - RNA, 22 nt, Human
auucauagcagcuuauucacaa

SEQ ID NO: 1811194 - RNA, 19 nt, Human
auucauagcagcuuauuca

SEQ ID NO: 1811195 - RNA, 16 nt, Human
auuguuagucucuuga

SEQ ID NO: 1811196 - RNA, 21 nt, Human
auugugucucuugguccugcu

SEQ ID NO: 1811197 - RNA, 23 nt, Human
auugugucucuugguccugcugc

SEQ ID NO: 1811198 - RNA, 18 nt, Human
auugcuugagcucaggag

SEQ ID NO: 1811199 - RNA, 14 nt, Human
auuguaaaauggug

SEQ ID NO: 1811200 - RNA, 12 nt, Human
auugcugcuuga

SEQ ID NO: 1811201 - RNA, 23 nt, Human
auugcugauggugcaaugaccuu

SEQ ID NO: 1811202 - RNA, 14 nt, Human
auugcuugagcuca

SEQ ID NO: 1811203 - RNA, 12 nt, Human
auugcuccuuga

SEQ ID NO: 1811204 - RNA, 15 nt, Human
auugcugauggugca

SEQ ID NO: 1811205 - RNA, 16 nt, Human
auugcugauggugcaa

SEQ ID NO: 1811206 - RNA, 18 nt, Human
auugcugauggugcaaug

SEQ ID NO: 1811207 - RNA, 19 nt, Human
auugcugauggugcaauga

SEQ ID NO: 1811208 - RNA, 14 nt, Human
auucuucugcuuca

SEQ ID NO: 1811209 - RNA, 11 nt, Human
auucuuuccug

SEQ ID NO: 1811210 - RNA, 12 nt, Human
auucuucugcuu

SEQ ID NO: 1811211 - RNA, 11 nt, Human
auucuucugcu

SEQ ID NO: 1811212 - RNA, 14 nt, Human
auucugaccuuaaa

SEQ ID NO: 1811213 - RNA, 13 nt, Human
auucuuuccugag

SEQ ID NO: 1811214 - RNA, 21 nt, Human
auugauaagaaccuuuugagu

SEQ ID NO: 1811215 - RNA, 15 nt, Human
auugcuacuguccua

SEQ ID NO: 1811216 - RNA, 17 nt, Human
auugauaugcuuauaca

SEQ ID NO: 1811217 - RNA, 22 nt, Human
auugcuacuguccuacccaccc

SEQ ID NO: 1811218 - RNA, 20 nt, Human
auugcuacuguccuacccac

SEQ ID NO: 1811219 - RNA, 16 nt, Human
ccguagguuauuuuca

SEQ ID NO: 1811220 - RNA, 22 nt, Human
ccggcuaugggggcacugagga

SEQ ID NO: 1811221 - RNA, 23 nt, Human
ccggcuaugggggcacugaggac

SEQ ID NO: 1811222 - RNA, 17 nt, Human
ccggcuaugggggcacu

SEQ ID NO: 1811223 - RNA, 19 nt, Human
ccggcuaauuuuuguauuu

SEQ ID NO: 1811224 - RNA, 23 nt, Human
ccuaauaaagcuguguggcaguc

SEQ ID NO: 1811225 - RNA, 14 nt, Human
ccuaauaaagcugu

SEQ ID NO: 1811226 - RNA, 18 nt, Human
ccgucucugguuccuccc

SEQ ID NO: 1811227 - RNA, 23 nt, Human
ccuaggcauuugcugaauacaga

SEQ ID NO: 1811228 - RNA, 22 nt, Human
ccucagccucccgaauagcugg

SEQ ID NO: 1811229 - RNA, 23 nt, Human
ccucagccucccaaagugcuggg

SEQ ID NO: 1811230 - RNA, 13 nt, Human
ccucagccuccug

SEQ ID NO: 1811231 - RNA, 15 nt, Human
ccucauguccacugg

SEQ ID NO: 1811232 - RNA, 13 nt, Human
ccucauguucuua

SEQ ID NO: 1811233 - RNA, 14 nt, Human
ccucagccuccuga

SEQ ID NO: 1811234 - RNA, 20 nt, Human
ccucauguccacugguucuu

SEQ ID NO: 1811235 - RNA, 19 nt, Human
ccucauguucuuaauucuu

SEQ ID NO: 1811236 - RNA, 21 nt, Human
ccuccaagcuccaucuccacu

SEQ ID NO: 1811237 - RNA, 22 nt, Human
ccuccaagcuccaucuccacuc

SEQ ID NO: 1811238 - RNA, 18 nt, Human
ccucauuagcauuuugcu

SEQ ID NO: 1811239 - RNA, 21 nt, Human
ccuccaaguccacaguggaac

SEQ ID NO: 1811240 - RNA, 18 nt, Human
ccuccaaguccacagugg

SEQ ID NO: 1811241 - RNA, 22 nt, Human
ccuccaaucccaccaacccuca

SEQ ID NO: 1811242 - RNA, 22 nt, Human
ccucccaaggggcccaaauucu

SEQ ID NO: 1811243 - RNA, 14 nt, Human
ccucccaggcgccc

SEQ ID NO: 1811244 - RNA, 20 nt, Human
ccucccaggcgccccuuccc

SEQ ID NO: 1811245 - RNA, 22 nt, Human
ccucagccucccaaagugcugg

SEQ ID NO: 1811246 - RNA, 11 nt, Human
ccucagccucc

SEQ ID NO: 1811247 - RNA, 15 nt, Human
ccucaacucuccucc

SEQ ID NO: 1811248 - RNA, 15 nt, Human
ccucaagagaaggca

SEQ ID NO: 1811249 - RNA, 15 nt, Human
ccuauuuuaauaaac

SEQ ID NO: 1811250 - RNA, 14 nt, Human
cccuggcagccccu

SEQ ID NO: 1811251 - RNA, 16 nt, Human
cccuggcagccccugu

SEQ ID NO: 1811252 - RNA, 17 nt, Human
cccuggcucccacaggc

SEQ ID NO: 1811253 - RNA, 19 nt, Human
cccuggcucccacaggccc

SEQ ID NO: 1811254 - RNA, 13 nt, Human
cccuggcuuuuca

SEQ ID NO: 1811255 - RNA, 17 nt, Human
cccuggcuuuucacugc

SEQ ID NO: 1811256 - RNA, 13 nt, Human
cccugcccugugg

SEQ ID NO: 1811257 - RNA, 12 nt, Human
cccugcccugug

SEQ ID NO: 1811258 - RNA, 11 nt, Human
cccugcccugu

SEQ ID NO: 1811259 - RNA, 14 nt, Human
cccugcccuguggg

SEQ ID NO: 1811260 - RNA, 15 nt, Human
cccugcccugugggc

SEQ ID NO: 1811261 - RNA, 16 nt, Human
cccugcccugugggcc

SEQ ID NO: 1811262 - RNA, 20 nt, Human
cccugcccugugggccccca

SEQ ID NO: 1811263 - RNA, 21 nt, Human
cccugcccugugggcccccaa

SEQ ID NO: 1811264 - RNA, 12 nt, Human
cccuggcagccc

SEQ ID NO: 1811265 - RNA, 13 nt, Human
cccuggcagcccc

SEQ ID NO: 1811266 - RNA, 20 nt, Human
ccgaauagcugggacuacag

SEQ ID NO: 1811267 - RNA, 16 nt, Human
ccgacccuugccgucu

SEQ ID NO: 1811268 - RNA, 17 nt, Human
ccgccaaggcuggggga

SEQ ID NO: 1811269 - RNA, 16 nt, Human
ccgccaugcuccuggc

SEQ ID NO: 1811270 - RNA, 20 nt, Human
ccgcccaggcuuagucacug

SEQ ID NO: 1811271 - RNA, 18 nt, Human
cccuucgcuccugugucu

SEQ ID NO: 1811272 - RNA, 16 nt, Human
cccuucgcuccugugu

SEQ ID NO: 1811273 - RNA, 16 nt, Human
cccuucuaccuuccug

SEQ ID NO: 1811274 - RNA, 21 nt, Human
cccuucugacccaugcugccc

SEQ ID NO: 1811275 - RNA, 22 nt, Human
cccuucugacccaugcugcccu

SEQ ID NO: 1811276 - RNA, 23 nt, Human
cccuucugacccaugcugcccug

SEQ ID NO: 1811277 - RNA, 22 nt, Human
ccucugccugaagucacacagu

SEQ ID NO: 1811278 - RNA, 12 nt, Human
ccucugccuguc

SEQ ID NO: 1811279 - RNA, 12 nt, Human
ccucucugcccu

SEQ ID NO: 1811280 - RNA, 23 nt, Human
ccucucugcaggucccuaauaaa

SEQ ID NO: 1811281 - RNA, 21 nt, Human
ccucucugcaggucccuaaua

SEQ ID NO: 1811282 - RNA, 22 nt, Human
ccucucugcaggucccuaauaa

SEQ ID NO: 1811283 - RNA, 15 nt, Human
ccucugcugauccuc

SEQ ID NO: 1811284 - RNA, 18 nt, Human
ccucugcugauccuccca

SEQ ID NO: 1811285 - RNA, 13 nt, Human
ccucugcugcugg

SEQ ID NO: 1811286 - RNA, 14 nt, Human
ccucugcugcuggc

SEQ ID NO: 1811287 - RNA, 15 nt, Human
ccucugcugcuggcu

SEQ ID NO: 1811288 - RNA, 16 nt, Human
ccucugcugcuggcug

SEQ ID NO: 1811289 - RNA, 17 nt, Human
ccucugcugcuggcugg

SEQ ID NO: 1811290 - RNA, 18 nt, Human
ccucugcugcuggcuggu

SEQ ID NO: 1811291 - RNA, 13 nt, Human
ccucucugcaggu

SEQ ID NO: 1811292 - RNA, 15 nt, Human
ccucucugcaggucc

SEQ ID NO: 1811293 - RNA, 20 nt, Human
ccucucugcaggucccuaau

SEQ ID NO: 1811294 - RNA, 14 nt, Human
ccucucucaggcca

SEQ ID NO: 1811295 - RNA, 13 nt, Human
ccucucucacucc

SEQ ID NO: 1811296 - RNA, 14 nt, Human
ccucucucacuccu

SEQ ID NO: 1811297 - RNA, 15 nt, Human
ccucucucacuccuu

SEQ ID NO: 1811298 - RNA, 17 nt, Human
ccucucucacuccuuga

SEQ ID NO: 1811299 - RNA, 12 nt, Human
ccucucucaggc

SEQ ID NO: 1811300 - RNA, 22 nt, Human
ccugcacuugcagacucuacag

SEQ ID NO: 1811301 - RNA, 19 nt, Human
ccugaguagcuggauuaca

SEQ ID NO: 1811302 - RNA, 15 nt, Human
ccugaguagcuggau

SEQ ID NO: 1811303 - RNA, 20 nt, Human
ccugaguagcuggauuacag

SEQ ID NO: 1811304 - RNA, 13 nt, Human
ccucuuggguuca

SEQ ID NO: 1811305 - RNA, 19 nt, Human
ccucuugagccuugaacuu

SEQ ID NO: 1811306 - RNA, 13 nt, Human
ccucuugagccuu

SEQ ID NO: 1811307 - RNA, 18 nt, Human
ccuggcacccggccccug

SEQ ID NO: 1811308 - RNA, 16 nt, Human
ccuggcacagggcagu

SEQ ID NO: 1811309 - RNA, 17 nt, Human
ccuggcacagggcagug

SEQ ID NO: 1811310 - RNA, 18 nt, Human
ccuggcacagggcagugg

SEQ ID NO: 1811311 - RNA, 15 nt, Human
ccuggaguucugguu

SEQ ID NO: 1811312 - RNA, 16 nt, Human
ccuggaguucugguuc

SEQ ID NO: 1811313 - RNA, 17 nt, Human
ccuggaguucugguucc

SEQ ID NO: 1811314 - RNA, 19 nt, Human
ccuggaugcagccucacag

SEQ ID NO: 1811315 - RNA, 14 nt, Human
ccuggaugcagccu

SEQ ID NO: 1811316 - RNA, 17 nt, Human
ccuggaugcagccucac

SEQ ID NO: 1811317 - RNA, 21 nt, Human
ccuggauccaucaggccacuu

SEQ ID NO: 1811318 - RNA, 13 nt, Human
ccuggaugcagcc

SEQ ID NO: 1811319 - RNA, 18 nt, Human
ccugcccaggccccugcc

SEQ ID NO: 1811320 - RNA, 16 nt, Human
ccugcccaggccccug

SEQ ID NO: 1811321 - RNA, 15 nt, Human
ccugcccaggccccu

SEQ ID NO: 1811322 - RNA, 14 nt, Human
ccugcccaggcccc

SEQ ID NO: 1811323 - RNA, 12 nt, Human
ccugcugggugu

SEQ ID NO: 1811324 - RNA, 21 nt, Human
ccugcuggguguggcgcagca

SEQ ID NO: 1811325 - RNA, 14 nt, Human
ccugcugggugugg

SEQ ID NO: 1811326 - RNA, 20 nt, Human
ccugcuggguguggcgcagc

SEQ ID NO: 1811327 - RNA, 12 nt, Human
ccuggccucugc

SEQ ID NO: 1811328 - RNA, 16 nt, Human
ccuggccucugcacuc

SEQ ID NO: 1811329 - RNA, 13 nt, Human
ccuggccugagcu

SEQ ID NO: 1811330 - RNA, 14 nt, Human
ccuggccucugcac

SEQ ID NO: 1811331 - RNA, 15 nt, Human
ccuggccucugcacu

SEQ ID NO: 1811332 - RNA, 22 nt, Human
ccccagcaagugagagcugggu

SEQ ID NO: 1811333 - RNA, 13 nt, Human
ccccagaggcugg

SEQ ID NO: 1811334 - RNA, 23 nt, Human
ccccgacccuugccgucuaccug

SEQ ID NO: 1811335 - RNA, 22 nt, Human
cccccaaauggaaaugggcaga

SEQ ID NO: 1811336 - RNA, 22 nt, Human
ccccaaaacucuccucugcugc

SEQ ID NO: 1811337 - RNA, 23 nt, Human
cccauuguggucacaggaaguag

SEQ ID NO: 1811338 - RNA, 22 nt, Human
cccauuguggucacaggaagua

SEQ ID NO: 1811339 - RNA, 23 nt, Human
ccccaaaacucuccucugcugcu

SEQ ID NO: 1811340 - RNA, 23 nt, Human
ccccgaggccuucucugaaggac

SEQ ID NO: 1811341 - RNA, 17 nt, Human
cccuauugguaaagaau

SEQ ID NO: 1811342 - RNA, 18 nt, Human
cccuauuagagaagagau

SEQ ID NO: 1811343 - RNA, 23 nt, Human
cccgggaggcagagguugcagug

SEQ ID NO: 1811344 - RNA, 17 nt, Human
cccggccaccugcggug

SEQ ID NO: 1811345 - RNA, 16 nt, Human
cccggcuccaggcucc

SEQ ID NO: 1811346 - RNA, 15 nt, Human
cccggcuccaggcuc

SEQ ID NO: 1811347 - RNA, 14 nt, Human
cccggcuccaggcu

SEQ ID NO: 1811348 - RNA, 13 nt, Human
cccggcuccaggc

SEQ ID NO: 1811349 - RNA, 12 nt, Human
cccggcuccagg

SEQ ID NO: 1811350 - RNA, 11 nt, Human
cccggcuccag

SEQ ID NO: 1811351 - RNA, 13 nt, Human
cccggccaccugc

SEQ ID NO: 1811352 - RNA, 14 nt, Human
cccggccaccugcg

SEQ ID NO: 1811353 - RNA, 14 nt, Human
cccgaauagcuggg

SEQ ID NO: 1811354 - RNA, 19 nt, Human
ccccucuggcuccagcugg

SEQ ID NO: 1811355 - RNA, 20 nt, Human
cccauauuuguacaccaaua

SEQ ID NO: 1811356 - RNA, 17 nt, Human
cccaggcuggcgugcag

SEQ ID NO: 1811357 - RNA, 13 nt, Human
cccaggcuggcgu

SEQ ID NO: 1811358 - RNA, 15 nt, Human
cccagcuugaaaccu

SEQ ID NO: 1811359 - RNA, 13 nt, Human
cccauccucugua

SEQ ID NO: 1811360 - RNA, 23 nt, Human
cccagcucugguccauagagagc

SEQ ID NO: 1811361 - RNA, 18 nt, Human
cccacuagacccacugga

SEQ ID NO: 1811362 - RNA, 13 nt, Human
cccacugcucugg

SEQ ID NO: 1811363 - RNA, 12 nt, Human
cccacugcucug

SEQ ID NO: 1811364 - RNA, 19 nt, Human
cccacugcuuuuggucugu

SEQ ID NO: 1811365 - RNA, 22 nt, Human
cccacugcuuuuggucugugug

SEQ ID NO: 1811366 - RNA, 18 nt, Human
cccacccugaaagcccug

SEQ ID NO: 1811367 - RNA, 17 nt, Human
cccacccccacccaagg

SEQ ID NO: 1811368 - RNA, 15 nt, Human
cccacccccacccaa

SEQ ID NO: 1811369 - RNA, 20 nt, Human
cccacccaagggccuggccu

SEQ ID NO: 1811370 - RNA, 21 nt, Human
cccacccaagggccuggccug

SEQ ID NO: 1811371 - RNA, 22 nt, Human
cccacccaagggccuggccuga

SEQ ID NO: 1811372 - RNA, 20 nt, Human
ccauggucggaaaacaugcu

SEQ ID NO: 1811373 - RNA, 23 nt, Human
ccaugagccucagcauccuggca

SEQ ID NO: 1811374 - RNA, 21 nt, Human
ccaugagccucagcauccugg

SEQ ID NO: 1811375 - RNA, 21 nt, Human
ccaguuguuagauuaagaaau

SEQ ID NO: 1811376 - RNA, 23 nt, Human
ccaguuggucccccuuccaugga

SEQ ID NO: 1811377 - RNA, 14 nt, Human
ccaucccagcccca

SEQ ID NO: 1811378 - RNA, 15 nt, Human
ccaucccagccccaa

SEQ ID NO: 1811379 - RNA, 13 nt, Human
ccaucccagcccc

SEQ ID NO: 1811380 - RNA, 14 nt, Human
ccaucccugaaggc

SEQ ID NO: 1811381 - RNA, 15 nt, Human
ccaucccugaaggcc

SEQ ID NO: 1811382 - RNA, 17 nt, Human
ccaucccugaaggcccc

SEQ ID NO: 1811383 - RNA, 20 nt, Human
ccaucccugaaggccccgcc

SEQ ID NO: 1811384 - RNA, 20 nt, Human
ccaguuggguggaugccugg

SEQ ID NO: 1811385 - RNA, 19 nt, Human
ccaguuggguggaugccug

SEQ ID NO: 1811386 - RNA, 17 nt, Human
ccaguuggguggaugcc

SEQ ID NO: 1811387 - RNA, 18 nt, Human
ccaggcuggcgugcagug

SEQ ID NO: 1811388 - RNA, 17 nt, Human
ccaggcuggcgugcagu

SEQ ID NO: 1811389 - RNA, 19 nt, Human
ccaggcuggcgugcagugg

SEQ ID NO: 1811390 - RNA, 21 nt, Human
ccaggcuccuuuagcgcccag

SEQ ID NO: 1811391 - RNA, 20 nt, Human
ccaggcuccuuuagcgccca

SEQ ID NO: 1811392 - RNA, 19 nt, Human
ccaggggaaaaucagccug

SEQ ID NO: 1811393 - RNA, 20 nt, Human
ccaggggaaaaucagccugc

SEQ ID NO: 1811394 - RNA, 13 nt, Human
ccaggggugggac

SEQ ID NO: 1811395 - RNA, 19 nt, Human
ccaggggugggacacccug

SEQ ID NO: 1811396 - RNA, 14 nt, Human
ccaggggugggaca

SEQ ID NO: 1811397 - RNA, 17 nt, Human
ccaggggugggacaccc

SEQ ID NO: 1811398 - RNA, 16 nt, Human
ccaggcacugcugccc

SEQ ID NO: 1811399 - RNA, 18 nt, Human
ccaggcacugcugcccag

SEQ ID NO: 1811400 - RNA, 13 nt, Human
ccagcaggcucuc

SEQ ID NO: 1811401 - RNA, 15 nt, Human
ccagcaggcucucag

SEQ ID NO: 1811402 - RNA, 22 nt, Human
ccagcucaccagccccagugcc

SEQ ID NO: 1811403 - RNA, 16 nt, Human
ccagcuguucagcugg

SEQ ID NO: 1811404 - RNA, 16 nt, Human
ccagcucaccagcccc

SEQ ID NO: 1811405 - RNA, 15 nt, Human
ccagcucaccagccc

SEQ ID NO: 1811406 - RNA, 17 nt, Human
ccagcuguucagcuggu

SEQ ID NO: 1811407 - RNA, 16 nt, Human
ccagcuuaucucaggg

SEQ ID NO: 1811408 - RNA, 19 nt, Human
ccagcuuaaaggggcuaga

SEQ ID NO: 1811409 - RNA, 11 nt, Human
ccagccccugg

SEQ ID NO: 1811410 - RNA, 12 nt, Human
ccagccccugga

SEQ ID NO: 1811411 - RNA, 16 nt, Human
ccaggaaaggcuccag

SEQ ID NO: 1811412 - RNA, 14 nt, Human
ccaggaaaggcucc

SEQ ID NO: 1811413 - RNA, 15 nt, Human
ccaggaaaggcucca

SEQ ID NO: 1811414 - RNA, 12 nt, Human
ccaggaagccag

SEQ ID NO: 1811415 - RNA, 14 nt, Human
ccaggaagccagca

SEQ ID NO: 1811416 - RNA, 13 nt, Human
ccaggaagccagc

SEQ ID NO: 1811417 - RNA, 16 nt, Human
ccaccuuggcucaagu

SEQ ID NO: 1811418 - RNA, 17 nt, Human
ccagagggccugcaagg

SEQ ID NO: 1811419 - RNA, 18 nt, Human
ccagagggccugcaaggg

SEQ ID NO: 1811420 - RNA, 19 nt, Human
ccagagggccugcaaggga

SEQ ID NO: 1811421 - RNA, 20 nt, Human
ccagagggccugcaagggag

SEQ ID NO: 1811422 - RNA, 15 nt, Human
ccagaugcaccagcc

SEQ ID NO: 1811423 - RNA, 17 nt, Human
ccagaugcaccagcccu

SEQ ID NO: 1811424 - RNA, 18 nt, Human
ccagaugcaccagcccuu

SEQ ID NO: 1811425 - RNA, 23 nt, Human
ccagaugcaccagcccuuagcag

SEQ ID NO: 1811426 - RNA, 12 nt, Human
ccuuuuuuauac

SEQ ID NO: 1811427 - RNA, 23 nt, Human
cgaccagacaccuugacagggca

SEQ ID NO: 1811428 - RNA, 12 nt, Human
cgaccaccugcc

SEQ ID NO: 1811429 - RNA, 14 nt, Human
cgaccaccugccca

SEQ ID NO: 1811430 - RNA, 19 nt, Human
ccuuuuuuauacauaaaca

SEQ ID NO: 1811431 - RNA, 18 nt, Human
ccuuuuuuauacauaaac

SEQ ID NO: 1811432 - RNA, 17 nt, Human
ccuuuuuuauacauaaa

SEQ ID NO: 1811433 - RNA, 16 nt, Human
cgacagugagacucug

SEQ ID NO: 1811434 - RNA, 15 nt, Human
cgacagugagacucu

SEQ ID NO: 1811435 - RNA, 20 nt, Human
ccuuuagcgcccaguugggu

SEQ ID NO: 1811436 - RNA, 14 nt, Human
ccuuuagcgcccag

SEQ ID NO: 1811437 - RNA, 17 nt, Human
ccuugccgucuaccuga

SEQ ID NO: 1811438 - RNA, 20 nt, Human
ccuugccgucuaccugaggg

SEQ ID NO: 1811439 - RNA, 20 nt, Human
ccuucugaaaaaguauccug

SEQ ID NO: 1811440 - RNA, 20 nt, Human
ccuggccugagcugggauga

SEQ ID NO: 1811441 - RNA, 14 nt, Human
ccuggccugagcug

SEQ ID NO: 1811442 - RNA, 15 nt, Human
ccuggccugagcugg

SEQ ID NO: 1811443 - RNA, 12 nt, Human
ccuucugaccca

SEQ ID NO: 1811444 - RNA, 16 nt, Human
ccuucugacccaugcu

SEQ ID NO: 1811445 - RNA, 17 nt, Human
ccuucugacccaugcug

SEQ ID NO: 1811446 - RNA, 20 nt, Human
ccuucugacccaugcugccc

SEQ ID NO: 1811447 - RNA, 22 nt, Human
ccuucuggaauaaggagaauga

SEQ ID NO: 1811448 - RNA, 23 nt, Human
ccuucugacccaugcugcccugu

SEQ ID NO: 1811449 - RNA, 21 nt, Human
ccuucugacccaugcugcccu

SEQ ID NO: 1811450 - RNA, 22 nt, Human
ccuucugacccaugcugcccug

SEQ ID NO: 1811451 - RNA, 18 nt, Human
cggcucacugcagccuca

SEQ ID NO: 1811452 - RNA, 19 nt, Human
cggcucacugcagccucaa

SEQ ID NO: 1811453 - RNA, 17 nt, Human
cggcucacugcauccuc

SEQ ID NO: 1811454 - RNA, 21 nt, Human
cggcucacugcauccuccgcc

SEQ ID NO: 1811455 - RNA, 14 nt, Human
cggagucccaccuu

SEQ ID NO: 1811456 - RNA, 16 nt, Human
cggaggggccuggcag

SEQ ID NO: 1811457 - RNA, 18 nt, Human
cggaggggccuggcagcc

SEQ ID NO: 1811458 - RNA, 16 nt, Human
cgaguagcugggacua

SEQ ID NO: 1811459 - RNA, 15 nt, Human
cgaguagcugggacu

SEQ ID NO: 1811460 - RNA, 14 nt, Human
cgaguagcugggac

SEQ ID NO: 1811461 - RNA, 13 nt, Human
cgaguagcuggga

SEQ ID NO: 1811462 - RNA, 17 nt, Human
cgaguuacagacaaagc

SEQ ID NO: 1811463 - RNA, 18 nt, Human
cgaguuacagacaaagcg

SEQ ID NO: 1811464 - RNA, 14 nt, Human
cgccuacaggagug

SEQ ID NO: 1811465 - RNA, 23 nt, Human
cgccaaggcugggggaagaagcu

SEQ ID NO: 1811466 - RNA, 13 nt, Human
cgccaaggcuggg

SEQ ID NO: 1811467 - RNA, 16 nt, Human
cgccaaggcuggggga

SEQ ID NO: 1811468 - RNA, 14 nt, Human
cgcaggcuggcccu

SEQ ID NO: 1811469 - RNA, 15 nt, Human
cgcaggcuggcccug

SEQ ID NO: 1811470 - RNA, 17 nt, Human
cgcaggcuggcccugcc

SEQ ID NO: 1811471 - RNA, 18 nt, Human
cgcaggcuggcccugccc

SEQ ID NO: 1811472 - RNA, 19 nt, Human
cgcaggcuggcccugcccu

SEQ ID NO: 1811473 - RNA, 20 nt, Human
cgcaggcuggcccugcccug

SEQ ID NO: 1811474 - RNA, 12 nt, Human
cgccaaggcugg

SEQ ID NO: 1811475 - RNA, 16 nt, Human
cgaccugccucggccu

SEQ ID NO: 1811476 - RNA, 22 nt, Human
cuaguuccaccaucaagccacc

SEQ ID NO: 1811477 - RNA, 18 nt, Human
cuaguuccaccaucaagc

SEQ ID NO: 1811478 - RNA, 20 nt, Human
cuaguuccaccaucaagcca

SEQ ID NO: 1811479 - RNA, 21 nt, Human
cuagggaaaaaccagcgugug

SEQ ID NO: 1811480 - RNA, 19 nt, Human
cuagggaaaaaccagcgug

SEQ ID NO: 1811481 - RNA, 15 nt, Human
cuaccugaggggccu

SEQ ID NO: 1811482 - RNA, 11 nt, Human
cuaccugaggg

SEQ ID NO: 1811483 - RNA, 14 nt, Human
cuaccugaggggcc

SEQ ID NO: 1811484 - RNA, 19 nt, Human
cuagaaauuccccacccug

SEQ ID NO: 1811485 - RNA, 19 nt, Human
cuagcauuucccaacacaa

SEQ ID NO: 1811486 - RNA, 23 nt, Human
cuagcagcagggagggcuucugc

SEQ ID NO: 1811487 - RNA, 17 nt, Human
cuagcauggcugccaau

SEQ ID NO: 1811488 - RNA, 15 nt, Human
cuagaacugaauuuu

SEQ ID NO: 1811489 - RNA, 22 nt, Human
cuagcagcagggagggcuucug

SEQ ID NO: 1811490 - RNA, 19 nt, Human
cuagaacucccuuucaaca

SEQ ID NO: 1811491 - RNA, 18 nt, Human
cuagaacucccuuucaac

SEQ ID NO: 1811492 - RNA, 17 nt, Human
cuagaacucccuuucaa

SEQ ID NO: 1811493 - RNA, 16 nt, Human
cuagaacucccuuuca

SEQ ID NO: 1811494 - RNA, 22 nt, Human
cuaagugauccucccaccucag

SEQ ID NO: 1811495 - RNA, 20 nt, Human
cuaagugauccucccaccuc

SEQ ID NO: 1811496 - RNA, 18 nt, Human
cuaagugaggaugaaaaa

SEQ ID NO: 1811497 - RNA, 15 nt, Human
cuacaguccucccau

SEQ ID NO: 1811498 - RNA, 16 nt, Human
cuacaguccucccauc

SEQ ID NO: 1811499 - RNA, 17 nt, Human
cuacaguccucccaucu

SEQ ID NO: 1811500 - RNA, 18 nt, Human
cuacaguccucccaucuc

SEQ ID NO: 1811501 - RNA, 17 nt, Human
cuacaguguacagucuu

SEQ ID NO: 1811502 - RNA, 16 nt, Human
cuacaguguacagucu

SEQ ID NO: 1811503 - RNA, 15 nt, Human
cuacaguguacaguc

SEQ ID NO: 1811504 - RNA, 13 nt, Human
cuacaguugaaaa

SEQ ID NO: 1811505 - RNA, 20 nt, Human
cuacaguguacagucuugua

SEQ ID NO: 1811506 - RNA, 19 nt, Human
cuacaguugaaaaacagcu

SEQ ID NO: 1811507 - RNA, 15 nt, Human
cuacaugagguacug

SEQ ID NO: 1811508 - RNA, 18 nt, Human
cuacauacaauuccaaac

SEQ ID NO: 1811509 - RNA, 23 nt, Human
cuaagugaaauaagccagacauc

SEQ ID NO: 1811510 - RNA, 20 nt, Human
cuaagugaaauaagccagac

SEQ ID NO: 1811511 - RNA, 22 nt, Human
cuaaacugcccccucugcccug

SEQ ID NO: 1811512 - RNA, 23 nt, Human
cuaaacugcccccucugcccugc

SEQ ID NO: 1811513 - RNA, 13 nt, Human
cgugagaccugcc

SEQ ID NO: 1811514 - RNA, 14 nt, Human
cgugagaccugccc

SEQ ID NO: 1811515 - RNA, 16 nt, Human
cgugagaccugccccu

SEQ ID NO: 1811516 - RNA, 23 nt, Human
cgugagccaccgugccuggccac

SEQ ID NO: 1811517 - RNA, 17 nt, Human
cggcucuggccuccaag

SEQ ID NO: 1811518 - RNA, 16 nt, Human
cuaacuucaccauauu

SEQ ID NO: 1811519 - RNA, 15 nt, Human
cuaacuucaccauau

SEQ ID NO: 1811520 - RNA, 13 nt, Human
cucagcggggaca

SEQ ID NO: 1811521 - RNA, 14 nt, Human
cucagcgaaugaau

SEQ ID NO: 1811522 - RNA, 13 nt, Human
cucaggccagcug

SEQ ID NO: 1811523 - RNA, 14 nt, Human
cucaggccagcugc

SEQ ID NO: 1811524 - RNA, 15 nt, Human
cucaggccagcugcu

SEQ ID NO: 1811525 - RNA, 21 nt, Human
cucaggccagcugcuugggcu

SEQ ID NO: 1811526 - RNA, 22 nt, Human
cucaggccagcugcuugggcuu

SEQ ID NO: 1811527 - RNA, 22 nt, Human
cucagccuccugaguagcugga

SEQ ID NO: 1811528 - RNA, 14 nt, Human
cucagccuccugag

SEQ ID NO: 1811529 - RNA, 12 nt, Human
cucagccuccug

SEQ ID NO: 1811530 - RNA, 13 nt, Human
cucagccuccuga

SEQ ID NO: 1811531 - RNA, 13 nt, Human
cucagccucccaa

SEQ ID NO: 1811532 - RNA, 15 nt, Human
cuaucccggcugccc

SEQ ID NO: 1811533 - RNA, 16 nt, Human
cuaucccggcugcccu

SEQ ID NO: 1811534 - RNA, 16 nt, Human
cucagccucccaaagu

SEQ ID NO: 1811535 - RNA, 14 nt, Human
cucagccucccaaa

SEQ ID NO: 1811536 - RNA, 21 nt, Human
cucagccucccaaagugcugg

SEQ ID NO: 1811537 - RNA, 17 nt, Human
cuaucccggcugcccuu

SEQ ID NO: 1811538 - RNA, 23 nt, Human
cucagccucccgaauagcuggga

SEQ ID NO: 1811539 - RNA, 13 nt, Human
cucagccucccga

SEQ ID NO: 1811540 - RNA, 22 nt, Human
cucagccucccaaagugcuggg

SEQ ID NO: 1811541 - RNA, 14 nt, Human
cucaggccuggggg

SEQ ID NO: 1811542 - RNA, 20 nt, Human
cucaggccugggggcugggc

SEQ ID NO: 1811543 - RNA, 21 nt, Human
cucaggccugggggcugggca

SEQ ID NO: 1811544 - RNA, 17 nt, Human
cucagucuggcccuucc

SEQ ID NO: 1811545 - RNA, 18 nt, Human
cucagucuggcccuuccu

SEQ ID NO: 1811546 - RNA, 13 nt, Human
cucagugccacua

SEQ ID NO: 1811547 - RNA, 16 nt, Human
cuccaaagucucugga

SEQ ID NO: 1811548 - RNA, 18 nt, Human
cucaugccucagccuccu

SEQ ID NO: 1811549 - RNA, 20 nt, Human
cucaugccucagccuccuga

SEQ ID NO: 1811550 - RNA, 19 nt, Human
cucauguucuuaauucuua

SEQ ID NO: 1811551 - RNA, 18 nt, Human
cucauguucuuaauucuu

SEQ ID NO: 1811552 - RNA, 14 nt, Human
cucauguucuuaau

SEQ ID NO: 1811553 - RNA, 12 nt, Human
cucauguucuua

SEQ ID NO: 1811554 - RNA, 11 nt, Human
cuccaggugca

SEQ ID NO: 1811555 - RNA, 14 nt, Human
cuccagaccccugg

SEQ ID NO: 1811556 - RNA, 16 nt, Human
cuccaagaccuucucc

SEQ ID NO: 1811557 - RNA, 17 nt, Human
cuccaagaccuucuccu

SEQ ID NO: 1811558 - RNA, 18 nt, Human
cuccaagaccuucuccuu

SEQ ID NO: 1811559 - RNA, 21 nt, Human
cuccaagaccuucuccuucac

SEQ ID NO: 1811560 - RNA, 22 nt, Human
cuccacuuucuagccagaggag

SEQ ID NO: 1811561 - RNA, 15 nt, Human
cuccagaauuuccca

SEQ ID NO: 1811562 - RNA, 18 nt, Human
cuccagaauuucccaaag

SEQ ID NO: 1811563 - RNA, 17 nt, Human
cuccagacacaugucca

SEQ ID NO: 1811564 - RNA, 19 nt, Human
cuccagacacauguccaag

SEQ ID NO: 1811565 - RNA, 21 nt, Human
cuccagugagacagcucugca

SEQ ID NO: 1811566 - RNA, 13 nt, Human
cucccaccucagc

SEQ ID NO: 1811567 - RNA, 12 nt, Human
cucccaccucag

SEQ ID NO: 1811568 - RNA, 19 nt, Human
cuccgcuuucuacccagcg

SEQ ID NO: 1811569 - RNA, 15 nt, Human
cuccgccucccgggu

SEQ ID NO: 1811570 - RNA, 15 nt, Human
cucugaaggacauug

SEQ ID NO: 1811571 - RNA, 11 nt, Human
cucucuggccu

SEQ ID NO: 1811572 - RNA, 12 nt, Human
cucucuggccuu

SEQ ID NO: 1811573 - RNA, 15 nt, Human
cucucacuccuugaa

SEQ ID NO: 1811574 - RNA, 19 nt, Human
cucucagauuguaccauug

SEQ ID NO: 1811575 - RNA, 12 nt, Human
cucucacuccuu

SEQ ID NO: 1811576 - RNA, 14 nt, Human
cucucacuccuuga

SEQ ID NO: 1811577 - RNA, 20 nt, Human
cucgggauuaguacacacuu

SEQ ID NO: 1811578 - RNA, 17 nt, Human
cucuguacagagcccac

SEQ ID NO: 1811579 - RNA, 21 nt, Human
cucuguacagagcccacgccc

SEQ ID NO: 1811580 - RNA, 15 nt, Human
cucugguccauagag

SEQ ID NO: 1811581 - RNA, 19 nt, Human
cucugcugacagacacagg

SEQ ID NO: 1811582 - RNA, 18 nt, Human
cucugcugacagacacag

SEQ ID NO: 1811583 - RNA, 17 nt, Human
cucugcugacagacaca

SEQ ID NO: 1811584 - RNA, 14 nt, Human
cucugguuccuccc

SEQ ID NO: 1811585 - RNA, 19 nt, Human
cucugguccauagagagca

SEQ ID NO: 1811586 - RNA, 16 nt, Human
cucugguccauagaga

SEQ ID NO: 1811587 - RNA, 18 nt, Human
cucugguccauagagagc

SEQ ID NO: 1811588 - RNA, 19 nt, Human
cucugcagcaauaaagcag

SEQ ID NO: 1811589 - RNA, 18 nt, Human
cucugcagcaauaaagca

SEQ ID NO: 1811590 - RNA, 23 nt, Human
cucugcagcaauaaagcagcguu

SEQ ID NO: 1811591 - RNA, 14 nt, Human
cucugcacuccccu

SEQ ID NO: 1811592 - RNA, 21 nt, Human
cugaaggacauugcggacagc

SEQ ID NO: 1811593 - RNA, 20 nt, Human
cugaaggacauugcggacag

SEQ ID NO: 1811594 - RNA, 19 nt, Human
cugaaggacauugcggaca

SEQ ID NO: 1811595 - RNA, 13 nt, Human
cugaaggccccgc

SEQ ID NO: 1811596 - RNA, 14 nt, Human
cugaaggccccgcc

SEQ ID NO: 1811597 - RNA, 17 nt, Human
cugaaggccccgcccag

SEQ ID NO: 1811598 - RNA, 18 nt, Human
cugaaggccccgcccagg

SEQ ID NO: 1811599 - RNA, 22 nt, Human
cugaaggaauaaauugcuccuu

SEQ ID NO: 1811600 - RNA, 16 nt, Human
cugaaaauguaugugu

SEQ ID NO: 1811601 - RNA, 16 nt, Human
cucuugccacugccuc

SEQ ID NO: 1811602 - RNA, 17 nt, Human
cucuugccacugccucu

SEQ ID NO: 1811603 - RNA, 18 nt, Human
cucuugccacugccucuu

SEQ ID NO: 1811604 - RNA, 19 nt, Human
cucuugccacugccucuuc

SEQ ID NO: 1811605 - RNA, 20 nt, Human
cucuugccacugccucuucc

SEQ ID NO: 1811606 - RNA, 14 nt, Human
cugacagacacagg

SEQ ID NO: 1811607 - RNA, 12 nt, Human
cugacagacaca

SEQ ID NO: 1811608 - RNA, 15 nt, Human
cugacagacacaggc

SEQ ID NO: 1811609 - RNA, 14 nt, Human
cugacagaaggacu

SEQ ID NO: 1811610 - RNA, 23 nt, Human
cugacccugcuucaaauauuucc

SEQ ID NO: 1811611 - RNA, 18 nt, Human
cugacccaugcugcccug

SEQ ID NO: 1811612 - RNA, 17 nt, Human
cugacccaugcugcccu

SEQ ID NO: 1811613 - RNA, 19 nt, Human
cugacccaugcugcccugu

SEQ ID NO: 1811614 - RNA, 20 nt, Human
cugacccaugcugcccugug

SEQ ID NO: 1811615 - RNA, 19 nt, Human
cugaccuuaaaugcaacca

SEQ ID NO: 1811616 - RNA, 15 nt, Human
cugaccuuaaaugca

SEQ ID NO: 1811617 - RNA, 20 nt, Human
uguuaguaugaggcauuugu

SEQ ID NO: 1811618 - RNA, 19 nt, Human
uguuaguaugaggcauuug

SEQ ID NO: 1811619 - RNA, 17 nt, Human
uguuaguaugaggcauu

SEQ ID NO: 1811620 - RNA, 22 nt, Human
uguucagcuccagcucaccagc

SEQ ID NO: 1811621 - RNA, 21 nt, Human
uguucagcuccagcucaccag

SEQ ID NO: 1811622 - RNA, 20 nt, Human
uguucagcuccagcucacca

SEQ ID NO: 1811623 - RNA, 17 nt, Human
uguucauaaauaaaguu

SEQ ID NO: 1811624 - RNA, 14 nt, Human
uguuacuaaguuuu

SEQ ID NO: 1811625 - RNA, 17 nt, Human
uguuagccccauaauuu

SEQ ID NO: 1811626 - RNA, 19 nt, Human
ugugugcacguacacacac

SEQ ID NO: 1811627 - RNA, 15 nt, Human
ugugugcuuauguau

SEQ ID NO: 1811628 - RNA, 18 nt, Human
uguguaugcgugugugug

SEQ ID NO: 1811629 - RNA, 17 nt, Human
ugugugugaaaaugugu

SEQ ID NO: 1811630 - RNA, 22 nt, Human
ugugugucuaggcaggaccugu

SEQ ID NO: 1811631 - RNA, 20 nt, Human
ugugugugcuuauguaugag

SEQ ID NO: 1811632 - RNA, 19 nt, Human
ugugugugcuuauguauga

SEQ ID NO: 1811633 - RNA, 16 nt, Human
uguguuuauugucaaa

SEQ ID NO: 1811634 - RNA, 15 nt, Human
uguguuuuuaauaaa

SEQ ID NO: 1811635 - RNA, 15 nt, Human
uguguuuuucauaaa

SEQ ID NO: 1811636 - RNA, 20 nt, Human
uguguuuuuaauaaagacag

SEQ ID NO: 1811637 - RNA, 18 nt, Human
uguguuuuucauaaagca

SEQ ID NO: 1811638 - RNA, 15 nt, Human
uguucucucuucucc

SEQ ID NO: 1811639 - RNA, 16 nt, Human
uguucucucuucucca

SEQ ID NO: 1811640 - RNA, 19 nt, Human
uguucaucauccuaagcua

SEQ ID NO: 1811641 - RNA, 13 nt, Human
uguucucugagga

SEQ ID NO: 1811642 - RNA, 12 nt, Human
uguucuggcucu

SEQ ID NO: 1811643 - RNA, 13 nt, Human
uguucuggcucuu

SEQ ID NO: 1811644 - RNA, 16 nt, Human
uguucuggcucuucca

SEQ ID NO: 1811645 - RNA, 13 nt, Human
uguucucugcccu

SEQ ID NO: 1811646 - RNA, 14 nt, Human
uguucucugcccuc

SEQ ID NO: 1811647 - RNA, 15 nt, Human
uguucucugcccucc

SEQ ID NO: 1811648 - RNA, 16 nt, Human
uguucucugcccucca

SEQ ID NO: 1811649 - RNA, 15 nt, Human
uguugaagccuuugu

SEQ ID NO: 1811650 - RNA, 12 nt, Human
uguucugggaca

SEQ ID NO: 1811651 - RNA, 15 nt, Human
uguucugcuuuccuc

SEQ ID NO: 1811652 - RNA, 21 nt, Human
uguucuggcucuuccaggcug

SEQ ID NO: 1811653 - RNA, 17 nt, Human
uguucuggcucuuccag

SEQ ID NO: 1811654 - RNA, 20 nt, Human
uguucuggcucuuccaggcu

SEQ ID NO: 1811655 - RNA, 23 nt, Human
uguucuuucuggcuaugcauuug

SEQ ID NO: 1811656 - RNA, 16 nt, Human
uguuggccaggcuggu

SEQ ID NO: 1811657 - RNA, 15 nt, Human
uguuggccaggcugg

SEQ ID NO: 1811658 - RNA, 15 nt, Human
uguuggccaaagcca

SEQ ID NO: 1811659 - RNA, 14 nt, Human
uguuggcagccucu

SEQ ID NO: 1811660 - RNA, 16 nt, Human
uguugauuaaagauga

SEQ ID NO: 1811661 - RNA, 15 nt, Human
uguugauuaaagaug

SEQ ID NO: 1811662 - RNA, 19 nt, Human
uguuggcugggggccucag

SEQ ID NO: 1811663 - RNA, 17 nt, Human
uguuggcugggggccuc

SEQ ID NO: 1811664 - RNA, 12 nt, Human
uguuuaagagac

SEQ ID NO: 1811665 - RNA, 22 nt, Human
uuaauuaaaacacaacaucuuu

SEQ ID NO: 1811666 - RNA, 15 nt, Human
uuacacauuuuucag

SEQ ID NO: 1811667 - RNA, 17 nt, Human
uuacauuuuuaagugcu

SEQ ID NO: 1811668 - RNA, 12 nt, Human
uuacauuuuuaa

SEQ ID NO: 1811669 - RNA, 23 nt, Human
uuacacauuuuucagauauaaaa

SEQ ID NO: 1811670 - RNA, 17 nt, Human
uuacacauuuuucagau

SEQ ID NO: 1811671 - RNA, 13 nt, Human
uuacacuuuaugc

SEQ ID NO: 1811672 - RNA, 20 nt, Human
uuacacuuuaugcacaaaau

SEQ ID NO: 1811673 - RNA, 16 nt, Human
uuacacuuuuuggaag

SEQ ID NO: 1811674 - RNA, 20 nt, Human
uuaauagcgucauaacuaga

SEQ ID NO: 1811675 - RNA, 13 nt, Human
uuaacuuuuauaa

SEQ ID NO: 1811676 - RNA, 12 nt, Human
uuaacuuuuaua

SEQ ID NO: 1811677 - RNA, 20 nt, Human
uuaaaugcaaccauuugaaa

SEQ ID NO: 1811678 - RNA, 17 nt, Human
uuaaaugcccagccccu

SEQ ID NO: 1811679 - RNA, 15 nt, Human
uuaaauguagaaagu

SEQ ID NO: 1811680 - RNA, 12 nt, Human
uuaagaguaaaa

SEQ ID NO: 1811681 - RNA, 14 nt, Human
uuaacuuuuauaaa

SEQ ID NO: 1811682 - RNA, 15 nt, Human
uguuuccuggcacug

SEQ ID NO: 1811683 - RNA, 16 nt, Human
uguuuuaagaggcagg

SEQ ID NO: 1811684 - RNA, 17 nt, Human
uguuuuaagaggcaggg

SEQ ID NO: 1811685 - RNA, 23 nt, Human
uguuuuaaggaugcuuguacaua

SEQ ID NO: 1811686 - RNA, 22 nt, Human
uguuuuaaggaugcuuguacau

SEQ ID NO: 1811687 - RNA, 22 nt, Human
uuaaaaaaaaaccugagcccca

SEQ ID NO: 1811688 - RNA, 14 nt, Human
uuaaaacccaagug

SEQ ID NO: 1811689 - RNA, 11 nt, Human
uuaaaugcacc

SEQ ID NO: 1811690 - RNA, 14 nt, Human
uuaaaugcccagcc

SEQ ID NO: 1811691 - RNA, 15 nt, Human
uuaaaugcccagccc

SEQ ID NO: 1811692 - RNA, 16 nt, Human
uuaaaugcccagcccc

SEQ ID NO: 1811693 - RNA, 18 nt, Human
uuaaagaaaaguuuugua

SEQ ID NO: 1811694 - RNA, 16 nt, Human
ugucauuugagcaggg

SEQ ID NO: 1811695 - RNA, 19 nt, Human
ugucauuugagcagggcuc

SEQ ID NO: 1811696 - RNA, 16 nt, Human
ugucccaacuuguaaa

SEQ ID NO: 1811697 - RNA, 13 nt, Human
ugucaccugaaga

SEQ ID NO: 1811698 - RNA, 18 nt, Human
uguccccaccgcagacag

SEQ ID NO: 1811699 - RNA, 19 nt, Human
uguccccaccgcagacagg

SEQ ID NO: 1811700 - RNA, 22 nt, Human
uguccccaccgcagacaggacc

SEQ ID NO: 1811701 - RNA, 20 nt, Human
uguccuacccacccuccuuu

SEQ ID NO: 1811702 - RNA, 17 nt, Human
uguccccgacccuugcc

SEQ ID NO: 1811703 - RNA, 16 nt, Human
uguccccgacccuugc

SEQ ID NO: 1811704 - RNA, 17 nt, Human
uguccuacucuguguca

SEQ ID NO: 1811705 - RNA, 12 nt, Human
uguccuacucug

SEQ ID NO: 1811706 - RNA, 22 nt, Human
uguauucucuccuguaccucuu

SEQ ID NO: 1811707 - RNA, 22 nt, Human
uguauaaaagggacugagaaau

SEQ ID NO: 1811708 - RNA, 17 nt, Human
ugucacacacuuuggcu

SEQ ID NO: 1811709 - RNA, 12 nt, Human
ugucacaggcag

SEQ ID NO: 1811710 - RNA, 13 nt, Human
ugucacaggcagg

SEQ ID NO: 1811711 - RNA, 20 nt, Human
uguauuuauuuaguauuuau

SEQ ID NO: 1811712 - RNA, 15 nt, Human
uguauuuaaaugaaa

SEQ ID NO: 1811713 - RNA, 14 nt, Human
uguaaucacagcua

SEQ ID NO: 1811714 - RNA, 17 nt, Human
uggucacaggaaguaga

SEQ ID NO: 1811715 - RNA, 16 nt, Human
uguacaaggacagccc

SEQ ID NO: 1811716 - RNA, 20 nt, Human
uguacaaggacagccccucc

SEQ ID NO: 1811717 - RNA, 23 nt, Human
uguacaaggacagccccuccucc

SEQ ID NO: 1811718 - RNA, 17 nt, Human
uguaauuaaguacuaug

SEQ ID NO: 1811719 - RNA, 16 nt, Human
uguacagagcccacgc

SEQ ID NO: 1811720 - RNA, 17 nt, Human
uguacagagcccacgcc

SEQ ID NO: 1811721 - RNA, 18 nt, Human
uguacagagcccacgccc

SEQ ID NO: 1811722 - RNA, 21 nt, Human
uguacagucuuguauuaaguu

SEQ ID NO: 1811723 - RNA, 16 nt, Human
uguaccgcaaugugac

SEQ ID NO: 1811724 - RNA, 23 nt, Human
uguagccucaaucgagugagaca

SEQ ID NO: 1811725 - RNA, 18 nt, Human
uguagccccucuccugga

SEQ ID NO: 1811726 - RNA, 15 nt, Human
uguacgucugacagg

SEQ ID NO: 1811727 - RNA, 19 nt, Human
uguacugcauaugaaagga

SEQ ID NO: 1811728 - RNA, 19 nt, Human
ugugcgccuacaggaguga

SEQ ID NO: 1811729 - RNA, 14 nt, Human
ugugcgccuacagg

SEQ ID NO: 1811730 - RNA, 14 nt, Human
ugugcuuguuaacu

SEQ ID NO: 1811731 - RNA, 20 nt, Human
ugugcucaggagcccuggga

SEQ ID NO: 1811732 - RNA, 17 nt, Human
ugugcucaggagcccug

SEQ ID NO: 1811733 - RNA, 15 nt, Human
ugugcucaggagccc

SEQ ID NO: 1811734 - RNA, 16 nt, Human
ugugcucaggagcccu

SEQ ID NO: 1811735 - RNA, 14 nt, Human
ugugcacguacaca

SEQ ID NO: 1811736 - RNA, 19 nt, Human
ugugcauuaucuagauacu

SEQ ID NO: 1811737 - RNA, 16 nt, Human
ugugcauuaucuagau

SEQ ID NO: 1811738 - RNA, 14 nt, Human
ugugcauuaucuag

SEQ ID NO: 1811739 - RNA, 23 nt, Human
ugugcauuuggugguuucagaaa

SEQ ID NO: 1811740 - RNA, 23 nt, Human
ugugcauuaucuagauacuguau

SEQ ID NO: 1811741 - RNA, 21 nt, Human
ugugcauuaucuagauacugu

SEQ ID NO: 1811742 - RNA, 20 nt, Human
ugugcauuaucuagauacug

SEQ ID NO: 1811743 - RNA, 12 nt, Human
uguguagggcgg

SEQ ID NO: 1811744 - RNA, 16 nt, Human
uguguagggcgggagg

SEQ ID NO: 1811745 - RNA, 22 nt, Human
ugugggcuaguugggcuuccuc

SEQ ID NO: 1811746 - RNA, 22 nt, Human
ugugggcgugagaccugccccu

SEQ ID NO: 1811747 - RNA, 20 nt, Human
ugugggcgugagaccugccc

SEQ ID NO: 1811748 - RNA, 21 nt, Human
ugugggcgugagaccugcccc

SEQ ID NO: 1811749 - RNA, 23 nt, Human
uguggcgcagcauauucaggaag

SEQ ID NO: 1811750 - RNA, 10 nt, Human
uguggcucac

SEQ ID NO: 1811751 - RNA, 19 nt, Human
uguggacacagcucuucuc

SEQ ID NO: 1811752 - RNA, 18 nt, Human
uguggacacagcucuucu

SEQ ID NO: 1811753 - RNA, 20 nt, Human
ugugaggaagccgcuggggc

SEQ ID NO: 1811754 - RNA, 13 nt, Human
ugugaggaagccg

SEQ ID NO: 1811755 - RNA, 18 nt, Human
ugugaggaagccgcuggg

SEQ ID NO: 1811756 - RNA, 21 nt, Human
ugugagucaccaagcccaguu

SEQ ID NO: 1811757 - RNA, 19 nt, Human
ugugagucaccaagcccag

SEQ ID NO: 1811758 - RNA, 17 nt, Human
ugugagucaccaagccc

SEQ ID NO: 1811759 - RNA, 15 nt, Human
ugugagucaccaagc

SEQ ID NO: 1811760 - RNA, 16 nt, Human
ugugauauaagugugu

SEQ ID NO: 1811761 - RNA, 19 nt, Human
ugucugaagucacugcaca

SEQ ID NO: 1811762 - RNA, 20 nt, Human
ugucugaagucacugcacag

SEQ ID NO: 1811763 - RNA, 17 nt, Human
ugucugaagucacugca

SEQ ID NO: 1811764 - RNA, 18 nt, Human
ugucugaagucacugcac

SEQ ID NO: 1811765 - RNA, 16 nt, Human
ugucugaagucacugc

SEQ ID NO: 1811766 - RNA, 16 nt, Human
ugugaaaaugugugug

SEQ ID NO: 1811767 - RNA, 17 nt, Human
ugugaaaaugugugugu

SEQ ID NO: 1811768 - RNA, 23 nt, Human
ugugaaaagaaaaaugagccugg

SEQ ID NO: 1811769 - RNA, 23 nt, Human
ugucuuuucuugcaugaggcuag

SEQ ID NO: 1811770 - RNA, 14 nt, Human
ugucuuuggacccu

SEQ ID NO: 1811771 - RNA, 16 nt, Human
ugucuuuggacccuga

SEQ ID NO: 1811772 - RNA, 21 nt, Human
ugucuuuucuugcaugaggcu

SEQ ID NO: 1811773 - RNA, 18 nt, Human
ugcuccucuccccagcaa

SEQ ID NO: 1811774 - RNA, 17 nt, Human
ugcuccucuccccagca

SEQ ID NO: 1811775 - RNA, 18 nt, Human
ugcuccuuucuuguuuua

SEQ ID NO: 1811776 - RNA, 16 nt, Human
ugcucuccucuugcca

SEQ ID NO: 1811777 - RNA, 18 nt, Human
ugcucuccucuugccacu

SEQ ID NO: 1811778 - RNA, 21 nt, Human
ugcucuccucuugccacugcc

SEQ ID NO: 1811779 - RNA, 22 nt, Human
ugcucuccucuugccacugccu

SEQ ID NO: 1811780 - RNA, 16 nt, Human
ugcucacauaucuguc

SEQ ID NO: 1811781 - RNA, 15 nt, Human
ugcucacauaucugu

SEQ ID NO: 1811782 - RNA, 17 nt, Human
ugcucagagcaguguuu

SEQ ID NO: 1811783 - RNA, 14 nt, Human
ugcuccucucccca

SEQ ID NO: 1811784 - RNA, 23 nt, Human
ugcugacagacacaggcccggcu

SEQ ID NO: 1811785 - RNA, 22 nt, Human
ugcugacagacacaggcccggc

SEQ ID NO: 1811786 - RNA, 13 nt, Human
ugcugaaggcucg

SEQ ID NO: 1811787 - RNA, 21 nt, Human
ugcugaaggcucgagcaugcc

SEQ ID NO: 1811788 - RNA, 23 nt, Human
ugcugaaggaauaaauugcuccu

SEQ ID NO: 1811789 - RNA, 12 nt, Human
ugcugaaggcuc

SEQ ID NO: 1811790 - RNA, 18 nt, Human
ugcugauggugcaaugac

SEQ ID NO: 1811791 - RNA, 13 nt, Human
ugcugauggugca

SEQ ID NO: 1811792 - RNA, 15 nt, Human
ugcugauggugcaau

SEQ ID NO: 1811793 - RNA, 17 nt, Human
ugcugauggugcaauga

SEQ ID NO: 1811794 - RNA, 23 nt, Human
ugcugcaguugccagucaccccg

SEQ ID NO: 1811795 - RNA, 18 nt, Human
ugcugcaguugccaguca

SEQ ID NO: 1811796 - RNA, 14 nt, Human
ugcugcauuuaaaa

SEQ ID NO: 1811797 - RNA, 13 nt, Human
ugcugcuggcugg

SEQ ID NO: 1811798 - RNA, 16 nt, Human
ugccugguggcagcug

SEQ ID NO: 1811799 - RNA, 18 nt, Human
ugccuguaaucacagcua

SEQ ID NO: 1811800 - RNA, 15 nt, Human
ugccugguggcagcu

SEQ ID NO: 1811801 - RNA, 14 nt, Human
ugccugguggcagc

SEQ ID NO: 1811802 - RNA, 14 nt, Human
ugccugugaacuga

SEQ ID NO: 1811803 - RNA, 21 nt, Human
ugccugggaucccucauccuc

SEQ ID NO: 1811804 - RNA, 18 nt, Human
ugccugggcagaaggaag

SEQ ID NO: 1811805 - RNA, 19 nt, Human
ugccucgaacuggcugcaa

SEQ ID NO: 1811806 - RNA, 18 nt, Human
ugccucgaacuggcugca

SEQ ID NO: 1811807 - RNA, 20 nt, Human
ugccucgaacuggcugcaaa

SEQ ID NO: 1811808 - RNA, 18 nt, Human
ugccccuggcagccccug

SEQ ID NO: 1811809 - RNA, 9 nt, Human
ugccucucu

SEQ ID NO: 1811810 - RNA, 21 nt, Human
ugcgaucuggguucacugcaa

SEQ ID NO: 1811811 - RNA, 20 nt, Human
ugcgaucuggguucacugca

SEQ ID NO: 1811812 - RNA, 19 nt, Human
ugcgaucuggguucacugc

SEQ ID NO: 1811813 - RNA, 15 nt, Human
ugcgaucuggguuca

SEQ ID NO: 1811814 - RNA, 14 nt, Human
ugcgaucuggguuc

SEQ ID NO: 1811815 - RNA, 17 nt, Human
ugccugugaacugaacu

SEQ ID NO: 1811816 - RNA, 18 nt, Human
ugccugugaacugaacuc

SEQ ID NO: 1811817 - RNA, 21 nt, Human
ugccugugaacugaacucuga

SEQ ID NO: 1811818 - RNA, 22 nt, Human
ugcgccuacaggagugagcacu

SEQ ID NO: 1811819 - RNA, 16 nt, Human
ugcgccuacaggagug

SEQ ID NO: 1811820 - RNA, 14 nt, Human
ugcgccuacaggag

SEQ ID NO: 1811821 - RNA, 15 nt, Human
ugcuaaaugugaaug

SEQ ID NO: 1811822 - RNA, 19 nt, Human
ugccaaauauaaauaaaaa

SEQ ID NO: 1811823 - RNA, 22 nt, Human
ugccaaauauaaauaaaaauaa

SEQ ID NO: 1811824 - RNA, 19 nt, Human
ugcaucaagaugugacaug

SEQ ID NO: 1811825 - RNA, 14 nt, Human
ugcaucaagaugug

SEQ ID NO: 1811826 - RNA, 17 nt, Human
ugccaaauauaaauaaa

SEQ ID NO: 1811827 - RNA, 18 nt, Human
ugccaaauauaaauaaaa

SEQ ID NO: 1811828 - RNA, 20 nt, Human
ugcauauuuauaaaaauaaa

SEQ ID NO: 1811829 - RNA, 21 nt, Human
ugcauauuuauaaaaauaaaa

SEQ ID NO: 1811830 - RNA, 20 nt, Human
ugccacccuggggagaaagu

SEQ ID NO: 1811831 - RNA, 22 nt, Human
ugccacuacggaauaguuggcu

SEQ ID NO: 1811832 - RNA, 19 nt, Human
ugccacccuggggagaaag

SEQ ID NO: 1811833 - RNA, 20 nt, Human
ugccacuaaauugacacuua

SEQ ID NO: 1811834 - RNA, 22 nt, Human
ugccagguuuuuggucugaccc

SEQ ID NO: 1811835 - RNA, 19 nt, Human
ugccagguuuuuggucuga

SEQ ID NO: 1811836 - RNA, 18 nt, Human
ugccagguuuuuggucug

SEQ ID NO: 1811837 - RNA, 10 nt, Human
ugccaggcau

SEQ ID NO: 1811838 - RNA, 21 nt, Human
ugccauccagguucagcuugu

SEQ ID NO: 1811839 - RNA, 13 nt, Human
ugcccaccuggcc

SEQ ID NO: 1811840 - RNA, 14 nt, Human
ugcccaccuggccu

SEQ ID NO: 1811841 - RNA, 13 nt, Human
ugcccaggcuggc

SEQ ID NO: 1811842 - RNA, 20 nt, Human
ugcccaggcuggagugcaau

SEQ ID NO: 1811843 - RNA, 18 nt, Human
ugcccaggcuggagugca

SEQ ID NO: 1811844 - RNA, 13 nt, Human
ugcccaggcugga

SEQ ID NO: 1811845 - RNA, 21 nt, Human
ugcccacucccugcaaccuga

SEQ ID NO: 1811846 - RNA, 11 nt, Human
ugcccaggcug

SEQ ID NO: 1811847 - RNA, 16 nt, Human
ugcccacucccugcaa

SEQ ID NO: 1811848 - RNA, 14 nt, Human
ugcccacucccugc

SEQ ID NO: 1811849 - RNA, 15 nt, Human
ugcccacucccugca

SEQ ID NO: 1811850 - RNA, 23 nt, Human
ugccccucaacucuccuccagag

SEQ ID NO: 1811851 - RNA, 15 nt, Human
ugccccagggcuccc

SEQ ID NO: 1811852 - RNA, 13 nt, Human
ugccccucccuuc

SEQ ID NO: 1811853 - RNA, 17 nt, Human
ugccccuggcagccccu

SEQ ID NO: 1811854 - RNA, 15 nt, Human
ugcaguugccaguca

SEQ ID NO: 1811855 - RNA, 13 nt, Human
ugcaguugccagu

SEQ ID NO: 1811856 - RNA, 14 nt, Human
ugcaguugccaguc

SEQ ID NO: 1811857 - RNA, 20 nt, Human
ugcaguggugcgaucugggu

SEQ ID NO: 1811858 - RNA, 22 nt, Human
ugcagugguaugaucacggcuc

SEQ ID NO: 1811859 - RNA, 16 nt, Human
ugcagugcuuccaagg

SEQ ID NO: 1811860 - RNA, 15 nt, Human
ugcaggcagccaggc

SEQ ID NO: 1811861 - RNA, 13 nt, Human
ugcaggcagccag

SEQ ID NO: 1811862 - RNA, 14 nt, Human
ugcaggcagccagg

SEQ ID NO: 1811863 - RNA, 15 nt, Human
ugcaccgggccacag

SEQ ID NO: 1811864 - RNA, 14 nt, Human
ugcaccgggccaca

SEQ ID NO: 1811865 - RNA, 19 nt, Human
ugaguccccuguuuguuuc

SEQ ID NO: 1811866 - RNA, 23 nt, Human
ugcaccggcuggccuggccccuc

SEQ ID NO: 1811867 - RNA, 22 nt, Human
ugcaccgggccacagagaaagu

SEQ ID NO: 1811868 - RNA, 17 nt, Human
ugcaccgggccacagag

SEQ ID NO: 1811869 - RNA, 20 nt, Human
ugaguccccuguuuguuucu

SEQ ID NO: 1811870 - RNA, 21 nt, Human
ugcagagcaggaaacaugacu

SEQ ID NO: 1811871 - RNA, 23 nt, Human
ugcagcacagcugagaggcuguc

SEQ ID NO: 1811872 - RNA, 23 nt, Human
ugcagcaauaaagcagcguuucu

SEQ ID NO: 1811873 - RNA, 20 nt, Human
ugcagcaauaaagcagcguu

SEQ ID NO: 1811874 - RNA, 12 nt, Human
ugcacuuuguuc

SEQ ID NO: 1811875 - RNA, 14 nt, Human
ugcacuuuguucug

SEQ ID NO: 1811876 - RNA, 14 nt, Human
ugggagcugccugu

SEQ ID NO: 1811877 - RNA, 13 nt, Human
ugggagcugccug

SEQ ID NO: 1811878 - RNA, 12 nt, Human
ugggagcugccu

SEQ ID NO: 1811879 - RNA, 13 nt, Human
ugggagcaaaaga

SEQ ID NO: 1811880 - RNA, 13 nt, Human
ugggacacccugu

SEQ ID NO: 1811881 - RNA, 12 nt, Human
ugggacacccug

SEQ ID NO: 1811882 - RNA, 16 nt, Human
ugggauuacaggugug

SEQ ID NO: 1811883 - RNA, 18 nt, Human
ugggauuacaggcuccug

SEQ ID NO: 1811884 - RNA, 18 nt, Human
ugggauccuccaggugca

SEQ ID NO: 1811885 - RNA, 13 nt, Human
ugggauccuggag

SEQ ID NO: 1811886 - RNA, 21 nt, Human
ugggauuacagggaugagcca

SEQ ID NO: 1811887 - RNA, 17 nt, Human
ugggauuacagguguga

SEQ ID NO: 1811888 - RNA, 15 nt, Human
ugggcagaggaaagc

SEQ ID NO: 1811889 - RNA, 22 nt, Human
ugggagcugccuguucagcucc

SEQ ID NO: 1811890 - RNA, 14 nt, Human
ugggaguacaaaag

SEQ ID NO: 1811891 - RNA, 21 nt, Human
ugggagcugccuguucagcuc

SEQ ID NO: 1811892 - RNA, 17 nt, Human
ugggagcugccuguuca

SEQ ID NO: 1811893 - RNA, 15 nt, Human
ugggagugagcuggu

SEQ ID NO: 1811894 - RNA, 15 nt, Human
ugggauccuccaggu

SEQ ID NO: 1811895 - RNA, 21 nt, Human
uggcugggggccucagugcca

SEQ ID NO: 1811896 - RNA, 21 nt, Human
uggcugcuucaaggauccuga

SEQ ID NO: 1811897 - RNA, 21 nt, Human
uggcuugaguuuaaauuguaa

SEQ ID NO: 1811898 - RNA, 14 nt, Human
uggcuuuugugcau

SEQ ID NO: 1811899 - RNA, 17 nt, Human
ugggcuucaguggcagc

SEQ ID NO: 1811900 - RNA, 15 nt, Human
ugggcuucaguggca

SEQ ID NO: 1811901 - RNA, 17 nt, Human
ugggcuggugucaccug

SEQ ID NO: 1811902 - RNA, 23 nt, Human
ugggcuggguucuacccaggugc

SEQ ID NO: 1811903 - RNA, 16 nt, Human
ugggcuaguugggcuu

SEQ ID NO: 1811904 - RNA, 22 nt, Human
ugggcuaagugauccucccacc

SEQ ID NO: 1811905 - RNA, 20 nt, Human
ugggcgugagaccugccccu

SEQ ID NO: 1811906 - RNA, 16 nt, Human
ugggcagaggaaagca

SEQ ID NO: 1811907 - RNA, 15 nt, Human
ugggggugcauuuga

SEQ ID NO: 1811908 - RNA, 12 nt, Human
ugggggugcauu

SEQ ID NO: 1811909 - RNA, 19 nt, Human
ugggggcugggcagaggaa

SEQ ID NO: 1811910 - RNA, 17 nt, Human
ugggggcugggcagagg

SEQ ID NO: 1811911 - RNA, 18 nt, Human
ugggggcugggcagagga

SEQ ID NO: 1811912 - RNA, 21 nt, Human
ugggggaucacagccucugaa

SEQ ID NO: 1811913 - RNA, 20 nt, Human
ugggggaucacagccucuga

SEQ ID NO: 1811914 - RNA, 18 nt, Human
ugguaugaucacggcuca

SEQ ID NO: 1811915 - RNA, 23 nt, Human
ugguauuggcuagagguucaaag

SEQ ID NO: 1811916 - RNA, 13 nt, Human
ugguauagaaaug

SEQ ID NO: 1811917 - RNA, 16 nt, Human
ugguauagaaaugcug

SEQ ID NO: 1811918 - RNA, 14 nt, Human
ugguauagaaaugc

SEQ ID NO: 1811919 - RNA, 22 nt, Human
ugguauagaaaugcugguuuuu

SEQ ID NO: 1811920 - RNA, 21 nt, Human
uggguuucuaaagcugccagc

SEQ ID NO: 1811921 - RNA, 17 nt, Human
uggguuucuaaagcugc

SEQ ID NO: 1811922 - RNA, 18 nt, Human
uggguuucuaaagcugcc

SEQ ID NO: 1811923 - RNA, 16 nt, Human
uggguaacuagggaag

SEQ ID NO: 1811924 - RNA, 19 nt, Human
ugggguuuaucagaauucu

SEQ ID NO: 1811925 - RNA, 14 nt, Human
uggguuaguggaug

SEQ ID NO: 1811926 - RNA, 22 nt, Human
uggguucuacccaggugcuagg

SEQ ID NO: 1811927 - RNA, 15 nt, Human
uggguucuacccagg

SEQ ID NO: 1811928 - RNA, 16 nt, Human
uggguucuacccaggu

SEQ ID NO: 1811929 - RNA, 24 nt, Human
uggauuuaacagaaauguacagca

SEQ ID NO: 1811930 - RNA, 20 nt, Human
uggauuuaacagaaauguac

SEQ ID NO: 1811931 - RNA, 20 nt, Human
uggaggaaggaaacccagcu

SEQ ID NO: 1811932 - RNA, 12 nt, Human
uggaggaaggaa

SEQ ID NO: 1811933 - RNA, 18 nt, Human
uggaggaaggaaacccag

SEQ ID NO: 1811934 - RNA, 15 nt, Human
uggacuccucugucc

SEQ ID NO: 1811935 - RNA, 15 nt, Human
uggacuccugcacac

SEQ ID NO: 1811936 - RNA, 14 nt, Human
uggacucuaaaguc

SEQ ID NO: 1811937 - RNA, 21 nt, Human
uggccagaugcaccagcccuu

SEQ ID NO: 1811938 - RNA, 20 nt, Human
uggccagaugcaccagcccu

SEQ ID NO: 1811939 - RNA, 17 nt, Human
uggccacuccagacccc

SEQ ID NO: 1811940 - RNA, 20 nt, Human
uggccacuccagaccccugg

SEQ ID NO: 1811941 - RNA, 21 nt, Human
uggcacccggccccugcuggu

SEQ ID NO: 1811942 - RNA, 13 nt, Human
uggcagcugcuuu

SEQ ID NO: 1811943 - RNA, 19 nt, Human
uggcaggaguuggaagugu

SEQ ID NO: 1811944 - RNA, 13 nt, Human
uggcagugggagc

SEQ ID NO: 1811945 - RNA, 17 nt, Human
uggaaacagcucgacuu

SEQ ID NO: 1811946 - RNA, 22 nt, Human
uggaaacagcucgacuuuaaaa

SEQ ID NO: 1811947 - RNA, 21 nt, Human
uggaaagacuuuuccaacccu

SEQ ID NO: 1811948 - RNA, 14 nt, Human
uggaaagaguacuc

SEQ ID NO: 1811949 - RNA, 20 nt, Human
uggaaagaguaggaagacuu

SEQ ID NO: 1811950 - RNA, 17 nt, Human
uggaaaaauagccugcc

SEQ ID NO: 1811951 - RNA, 20 nt, Human
uggaaaaauagccugccucu

SEQ ID NO: 1811952 - RNA, 22 nt, Human
uggaauaauccuaaacauauga

SEQ ID NO: 1811953 - RNA, 17 nt, Human
uggaauaaggagaauga

SEQ ID NO: 1811954 - RNA, 16 nt, Human
uggaauauauaaccag

SEQ ID NO: 1811955 - RNA, 15 nt, Human
uggaauauauaacca

SEQ ID NO: 1811956 - RNA, 21 nt, Human
uggaacguuuuuccuguucuu

SEQ ID NO: 1811957 - RNA, 14 nt, Human
uggaauaacaugua

SEQ ID NO: 1811958 - RNA, 15 nt, Human
uggaauaacauguaa

SEQ ID NO: 1811959 - RNA, 19 nt, Human
uggaauaacauguaauuaa

SEQ ID NO: 1811960 - RNA, 13 nt, Human
uggacaugcacag

SEQ ID NO: 1811961 - RNA, 19 nt, Human
uggacaugcacagcuaaca

SEQ ID NO: 1811962 - RNA, 18 nt, Human
uggacucaccucccccau

SEQ ID NO: 1811963 - RNA, 20 nt, Human
uggacucaccucccccaucu

SEQ ID NO: 1811964 - RNA, 17 nt, Human
uggacagaagcagcucu

SEQ ID NO: 1811965 - RNA, 18 nt, Human
uggacagaagcagcucuu

SEQ ID NO: 1811966 - RNA, 15 nt, Human
uggacagaagcagcu

SEQ ID NO: 1811967 - RNA, 16 nt, Human
uggacagaagcagcuc

SEQ ID NO: 1811968 - RNA, 19 nt, Human
ucccuaccgagucucuucu

SEQ ID NO: 1811969 - RNA, 21 nt, Human
ucccuaccgagucucuucucc

SEQ ID NO: 1811970 - RNA, 22 nt, Human
ucccuaccgagucucuucucca

SEQ ID NO: 1811971 - RNA, 23 nt, Human
ucccuaccgagucucuucuccac

SEQ ID NO: 1811972 - RNA, 22 nt, Human
ucccaugagccucagcauccug

SEQ ID NO: 1811973 - RNA, 17 nt, Human
ucccaugagccucagca

SEQ ID NO: 1811974 - RNA, 17 nt, Human
ucccuacuuccugugac

SEQ ID NO: 1811975 - RNA, 18 nt, Human
ucccucccuuccucuuuc

SEQ ID NO: 1811976 - RNA, 13 nt, Human
ucccucccuuggg

SEQ ID NO: 1811977 - RNA, 14 nt, Human
ucccucccuugggg

SEQ ID NO: 1811978 - RNA, 20 nt, Human
ucccugcacuugcagacucu

SEQ ID NO: 1811979 - RNA, 17 nt, Human
ucccucuggggcuguuc

SEQ ID NO: 1811980 - RNA, 13 nt, Human
ucccucuggggcu

SEQ ID NO: 1811981 - RNA, 14 nt, Human
ucccugccaaugga

SEQ ID NO: 1811982 - RNA, 16 nt, Human
ucccugccaauggacu

SEQ ID NO: 1811983 - RNA, 16 nt, Human
ucccugccccccagcc

SEQ ID NO: 1811984 - RNA, 14 nt, Human
ucccugccccuccc

SEQ ID NO: 1811985 - RNA, 18 nt, Human
ucccugccccucccuuca

SEQ ID NO: 1811986 - RNA, 17 nt, Human
ucccuucccaccucucu

SEQ ID NO: 1811987 - RNA, 21 nt, Human
ucccuucccacuggaggcaug

SEQ ID NO: 1811988 - RNA, 16 nt, Human
ucccuucccaccucuc

SEQ ID NO: 1811989 - RNA, 21 nt, Human
uccgcuuucuacccagcgagc

SEQ ID NO: 1811990 - RNA, 21 nt, Human
uccgaaagggacuuggaagcu

SEQ ID NO: 1811991 - RNA, 17 nt, Human
ucccuucuuuuucuucu

SEQ ID NO: 1811992 - RNA, 22 nt, Human
uccgaaagggacuuggaagcuc

SEQ ID NO: 1811993 - RNA, 22 nt, Human
uccuaguuccaccaucaagcca

SEQ ID NO: 1811994 - RNA, 21 nt, Human
uccuaguuccaccaucaagcc

SEQ ID NO: 1811995 - RNA, 16 nt, Human
uccuaagcuauucagu

SEQ ID NO: 1811996 - RNA, 18 nt, Human
uccuaagcuauucaguaa

SEQ ID NO: 1811997 - RNA, 14 nt, Human
uccuaguuccacca

SEQ ID NO: 1811998 - RNA, 17 nt, Human
uccuaguuccaccauca

SEQ ID NO: 1811999 - RNA, 12 nt, Human
uccuccucagau

SEQ ID NO: 1812000 - RNA, 14 nt, Human
uccuccaggugcac

SEQ ID NO: 1812001 - RNA, 18 nt, Human
uccuccaggugcacaagc

SEQ ID NO: 1812002 - RNA, 20 nt, Human
uccuccaggugcacaagcuc

SEQ ID NO: 1812003 - RNA, 22 nt, Human
uccuccaggugcacaagcucca

SEQ ID NO: 1812004 - RNA, 12 nt, Human
uccuccaggugc

SEQ ID NO: 1812005 - RNA, 13 nt, Human
uccuccaggugca

SEQ ID NO: 1812006 - RNA, 20 nt, Human
uccucaaaacuucagacaua

SEQ ID NO: 1812007 - RNA, 21 nt, Human
uccuccuuuucacaguucucu

SEQ ID NO: 1812008 - RNA, 13 nt, Human
uccuccuggacuc

SEQ ID NO: 1812009 - RNA, 21 nt, Human
uccucuaggaggucucuaaga

SEQ ID NO: 1812010 - RNA, 15 nt, Human
uccucuguacagagc

SEQ ID NO: 1812011 - RNA, 13 nt, Human
uccucuguacaga

SEQ ID NO: 1812012 - RNA, 15 nt, Human
uccucuggccugugu

SEQ ID NO: 1812013 - RNA, 15 nt, Human
uccugaggcugggcu

SEQ ID NO: 1812014 - RNA, 16 nt, Human
uccugaggcugggcuc

SEQ ID NO: 1812015 - RNA, 17 nt, Human
uccugaggcugggcucc

SEQ ID NO: 1812016 - RNA, 19 nt, Human
uccugaggcugggcucccu

SEQ ID NO: 1812017 - RNA, 12 nt, Human
uccugaggcugg

SEQ ID NO: 1812018 - RNA, 17 nt, Human
uccugaggcuccacuug

SEQ ID NO: 1812019 - RNA, 16 nt, Human
uccugaggcuccacuu

SEQ ID NO: 1812020 - RNA, 17 nt, Human
uccucuguccaggcacu

SEQ ID NO: 1812021 - RNA, 17 nt, Human
uccugagccagauuuca

SEQ ID NO: 1812022 - RNA, 23 nt, Human
uccucuguacagagcccacgccc

SEQ ID NO: 1812023 - RNA, 18 nt, Human
uccugagccagauuucac

SEQ ID NO: 1812024 - RNA, 19 nt, Human
uccugagccagauuucacu

SEQ ID NO: 1812025 - RNA, 22 nt, Human
uccucuguccaggcacugcugc

SEQ ID NO: 1812026 - RNA, 21 nt, Human
uccugagccagauuucacucu

SEQ ID NO: 1812027 - RNA, 15 nt, Human
uccugaggcuccacu

SEQ ID NO: 1812028 - RNA, 18 nt, Human
uccuuggugucgggcaug

SEQ ID NO: 1812029 - RNA, 21 nt, Human
uccuuggugucgggcaugaca

SEQ ID NO: 1812030 - RNA, 22 nt, Human
uccuuggugucgggcaugacac

SEQ ID NO: 1812031 - RNA, 17 nt, Human
uccuuugugaggaagcc

SEQ ID NO: 1812032 - RNA, 18 nt, Human
uccuuugugaggaagccg

SEQ ID NO: 1812033 - RNA, 22 nt, Human
uccuuugugaggaagccgcugg

SEQ ID NO: 1812034 - RNA, 21 nt, Human
uccuuaccagcagagcaccuu

SEQ ID NO: 1812035 - RNA, 14 nt, Human
uccuuaucaaagga

SEQ ID NO: 1812036 - RNA, 15 nt, Human
uccuuaucaaaggac

SEQ ID NO: 1812037 - RNA, 17 nt, Human
uccuuaucaaaggacac

SEQ ID NO: 1812038 - RNA, 22 nt, Human
uccuugaaaacacuguucucug

SEQ ID NO: 1812039 - RNA, 23 nt, Human
uccuugaaaacacuguucucugc

SEQ ID NO: 1812040 - RNA, 22 nt, Human
uccuuuucgcaggauucuuccu

SEQ ID NO: 1812041 - RNA, 17 nt, Human
ucgcaggauucuuccuc

SEQ ID NO: 1812042 - RNA, 21 nt, Human
ucgcaggauucuuccucccuc

SEQ ID NO: 1812043 - RNA, 23 nt, Human
ucgcaggauucuuccucccuccc

SEQ ID NO: 1812044 - RNA, 17 nt, Human
ucggccuccauccugag

SEQ ID NO: 1812045 - RNA, 16 nt, Human
ucggccuccauccuga

SEQ ID NO: 1812046 - RNA, 15 nt, Human
ucggccuccauccug

SEQ ID NO: 1812047 - RNA, 23 nt, Human
ucgcccagucuggaaugcagugg

SEQ ID NO: 1812048 - RNA, 19 nt, Human
ucgcccagucuggaaugca

SEQ ID NO: 1812049 - RNA, 14 nt, Human
ucgcccagucugga

SEQ ID NO: 1812050 - RNA, 18 nt, Human
ucggaaaacaugcuacac

SEQ ID NO: 1812051 - RNA, 15 nt, Human
ucggaaaacaugcua

SEQ ID NO: 1812052 - RNA, 23 nt, Human
ucucacucugucgcccagucugg

SEQ ID NO: 1812053 - RNA, 21 nt, Human
ucucacacaugagcaucaggc

SEQ ID NO: 1812054 - RNA, 20 nt, Human
ucucacugccaugccagcuu

SEQ ID NO: 1812055 - RNA, 23 nt, Human
ucucacacaugagcaucaggcca

SEQ ID NO: 1812056 - RNA, 16 nt, Human
ucucacacaugagcau

SEQ ID NO: 1812057 - RNA, 18 nt, Human
ucucaaauuucuaaaucu

SEQ ID NO: 1812058 - RNA, 16 nt, Human
ucucaaauuucuaaau

SEQ ID NO: 1812059 - RNA, 14 nt, Human
ucucaaauuucuaa

SEQ ID NO: 1812060 - RNA, 22 nt, Human
ucuaucuuugagcgcccacuag

SEQ ID NO: 1812061 - RNA, 13 nt, Human
ucucaaauuucua

SEQ ID NO: 1812062 - RNA, 15 nt, Human
ucucacuguugccca

SEQ ID NO: 1812063 - RNA, 14 nt, Human
ucucacuguugccc

SEQ ID NO: 1812064 - RNA, 17 nt, Human
ucucacuguugcccagg

SEQ ID NO: 1812065 - RNA, 19 nt, Human
ucuagggaaaaaccagcgu

SEQ ID NO: 1812066 - RNA, 12 nt, Human
ucuagggaaaaa

SEQ ID NO: 1812067 - RNA, 15 nt, Human
ucuagguaaauuaca

SEQ ID NO: 1812068 - RNA, 18 nt, Human
ucuacucuagggaaaaac

SEQ ID NO: 1812069 - RNA, 20 nt, Human
ucuacucgaguuacagacaa

SEQ ID NO: 1812070 - RNA, 21 nt, Human
ucuacucgaguuacagacaaa

SEQ ID NO: 1812071 - RNA, 14 nt, Human
ucuacuauuuaugu

SEQ ID NO: 1812072 - RNA, 19 nt, Human
ucuacuaaaaauacaaaaa

SEQ ID NO: 1812073 - RNA, 15 nt, Human
ucuacuaaaaauaca

SEQ ID NO: 1812074 - RNA, 12 nt, Human
ucuacuaaaaau

SEQ ID NO: 1812075 - RNA, 21 nt, Human
uccacaagagcccaggccucc

SEQ ID NO: 1812076 - RNA, 20 nt, Human
uccacaagagcccaggccuc

SEQ ID NO: 1812077 - RNA, 19 nt, Human
uccacaagagcccaggccu

SEQ ID NO: 1812078 - RNA, 15 nt, Human
uccaagcaaauguga

SEQ ID NO: 1812079 - RNA, 17 nt, Human
uccaagcaaaugugaau

SEQ ID NO: 1812080 - RNA, 14 nt, Human
uccaagcaggacau

SEQ ID NO: 1812081 - RNA, 22 nt, Human
uccaagcaggacauggacaagg

SEQ ID NO: 1812082 - RNA, 19 nt, Human
uccaagaagcccaggaaag

SEQ ID NO: 1812083 - RNA, 20 nt, Human
uccaagaccuucuccuucac

SEQ ID NO: 1812084 - RNA, 23 nt, Human
ucaugucaaauauuuagauguaa

SEQ ID NO: 1812085 - RNA, 14 nt, Human
uccaagaagcccag

SEQ ID NO: 1812086 - RNA, 15 nt, Human
uccaagaagcccagg

SEQ ID NO: 1812087 - RNA, 16 nt, Human
uccaagaagcccagga

SEQ ID NO: 1812088 - RNA, 19 nt, Human
uccagcuggguuggaaaac

SEQ ID NO: 1812089 - RNA, 15 nt, Human
uccagcuggccggga

SEQ ID NO: 1812090 - RNA, 21 nt, Human
uccagcuggccgggagccuga

SEQ ID NO: 1812091 - RNA, 22 nt, Human
uccagcuggccgggagccugau

SEQ ID NO: 1812092 - RNA, 15 nt, Human
uccagaugccacaau

SEQ ID NO: 1812093 - RNA, 22 nt, Human
uccagauuuuuuacagcugccu

SEQ ID NO: 1812094 - RNA, 19 nt, Human
uccagcaauucuccugccu

SEQ ID NO: 1812095 - RNA, 20 nt, Human
uccagcaauucuccugccuc

SEQ ID NO: 1812096 - RNA, 21 nt, Human
uccagcaauucuccugccuca

SEQ ID NO: 1812097 - RNA, 18 nt, Human
uccagcaauucuccugcc

SEQ ID NO: 1812098 - RNA, 14 nt, Human
uccacccugcucuc

SEQ ID NO: 1812099 - RNA, 13 nt, Human
uccacccugcucu

SEQ ID NO: 1812100 - RNA, 21 nt, Human
uccacccugcucuccgaccag

SEQ ID NO: 1812101 - RNA, 22 nt, Human
uccacugugccaugugccaggu

SEQ ID NO: 1812102 - RNA, 21 nt, Human
uccacuuagaaauugcauuuc

SEQ ID NO: 1812103 - RNA, 23 nt, Human
uccacuuagaaauugcauuuccu

SEQ ID NO: 1812104 - RNA, 15 nt, Human
uccacuuuaucuuga

SEQ ID NO: 1812105 - RNA, 22 nt, Human
uccagagaguggcuccucccgg

SEQ ID NO: 1812106 - RNA, 19 nt, Human
uccagagaguggcuccucc

SEQ ID NO: 1812107 - RNA, 17 nt, Human
uccacuuuaucuugaau

SEQ ID NO: 1812108 - RNA, 14 nt, Human
uccacuuucuagcc

SEQ ID NO: 1812109 - RNA, 16 nt, Human
uccaugucgccucugc

SEQ ID NO: 1812110 - RNA, 19 nt, Human
uccaugucgccucugcauu

SEQ ID NO: 1812111 - RNA, 17 nt, Human
uccaugucgccucugca

SEQ ID NO: 1812112 - RNA, 18 nt, Human
uccaugucgccucugcau

SEQ ID NO: 1812113 - RNA, 14 nt, Human
ucccaacuuguaaa

SEQ ID NO: 1812114 - RNA, 19 nt, Human
ucccaacucaccccagccc

SEQ ID NO: 1812115 - RNA, 21 nt, Human
ucccaacucaccccagcccca

SEQ ID NO: 1812116 - RNA, 17 nt, Human
ucccaacucaccccagc

SEQ ID NO: 1812117 - RNA, 18 nt, Human
ucccaacucaccccagcc

SEQ ID NO: 1812118 - RNA, 20 nt, Human
uccauagagagcaagacgcu

SEQ ID NO: 1812119 - RNA, 23 nt, Human
uccauaaucuggacuccucuguc

SEQ ID NO: 1812120 - RNA, 17 nt, Human
uccauagagagcaagac

SEQ ID NO: 1812121 - RNA, 14 nt, Human
ucccacucagucca

SEQ ID NO: 1812122 - RNA, 21 nt, Human
ucccaccuuggcugcagggag

SEQ ID NO: 1812123 - RNA, 19 nt, Human
ucccaccuuggcugcaggg

SEQ ID NO: 1812124 - RNA, 20 nt, Human
ucccaccucucucacuccuu

SEQ ID NO: 1812125 - RNA, 18 nt, Human
ucccaccucagccucccg

SEQ ID NO: 1812126 - RNA, 16 nt, Human
ucccaccucagccucc

SEQ ID NO: 1812127 - RNA, 14 nt, Human
ucccaccucucuca

SEQ ID NO: 1812128 - RNA, 17 nt, Human
ucccaccucucucacuc

SEQ ID NO: 1812129 - RNA, 18 nt, Human
ucccaccucucucacucc

SEQ ID NO: 1812130 - RNA, 16 nt, Human
ucccaugagccucagc

SEQ ID NO: 1812131 - RNA, 15 nt, Human
ucccaugagccucag

SEQ ID NO: 1812132 - RNA, 19 nt, Human
ucccaggcugagccucagu

SEQ ID NO: 1812133 - RNA, 19 nt, Human
ucccaggcauuccccagga

SEQ ID NO: 1812134 - RNA, 17 nt, Human
ucccaggcauuccccag

SEQ ID NO: 1812135 - RNA, 18 nt, Human
ucccaggcauuccccagg

SEQ ID NO: 1812136 - RNA, 16 nt, Human
ucccaggauguacaag

SEQ ID NO: 1812137 - RNA, 15 nt, Human
ucagaucucuaacuu

SEQ ID NO: 1812138 - RNA, 18 nt, Human
ucagcauccuggcacccg

SEQ ID NO: 1812139 - RNA, 17 nt, Human
ucagcauccuggcaccc

SEQ ID NO: 1812140 - RNA, 16 nt, Human
ucagcauccuggcacc

SEQ ID NO: 1812141 - RNA, 15 nt, Human
ucagcauccuggcac

SEQ ID NO: 1812142 - RNA, 13 nt, Human
ucagccucccaaa

SEQ ID NO: 1812143 - RNA, 12 nt, Human
ucagccucccaa

SEQ ID NO: 1812144 - RNA, 17 nt, Human
ucagcacgauuucuguu

SEQ ID NO: 1812145 - RNA, 22 nt, Human
ucagcaccuacaguguacaguc

SEQ ID NO: 1812146 - RNA, 21 nt, Human
ucagcaccuacaguguacagu

SEQ ID NO: 1812147 - RNA, 20 nt, Human
ucagcaccuacaguguacag

SEQ ID NO: 1812148 - RNA, 16 nt, Human
ucagcacgauuucugu

SEQ ID NO: 1812149 - RNA, 15 nt, Human
ucagcacgauuucug

SEQ ID NO: 1812150 - RNA, 15 nt, Human
ucagcugcuacuacu

SEQ ID NO: 1812151 - RNA, 22 nt, Human
ucagcuccagcucaccagcccc

SEQ ID NO: 1812152 - RNA, 21 nt, Human
ucagcuccagcucaccagccc

SEQ ID NO: 1812153 - RNA, 18 nt, Human
ucagcuccagcucaccag

SEQ ID NO: 1812154 - RNA, 20 nt, Human
ucagccucccgaauagcugg

SEQ ID NO: 1812155 - RNA, 12 nt, Human
ucagccucccga

SEQ ID NO: 1812156 - RNA, 22 nt, Human
ucagccucccaaagugcuggga

SEQ ID NO: 1812157 - RNA, 16 nt, Human
ucagccugcuccagcu

SEQ ID NO: 1812158 - RNA, 14 nt, Human
ucaucauccuaagc

SEQ ID NO: 1812159 - RNA, 24 nt, Human
ucauggacuucugccagcauaaua

SEQ ID NO: 1812160 - RNA, 15 nt, Human
ucaguccauagcaga

SEQ ID NO: 1812161 - RNA, 18 nt, Human
ucaguccaugaagaugua

SEQ ID NO: 1812162 - RNA, 18 nt, Human
ucaguccccgugaaggag

SEQ ID NO: 1812163 - RNA, 21 nt, Human
ucagguggggucacucuggca

SEQ ID NO: 1812164 - RNA, 17 nt, Human
ucagguggggucacucu

SEQ ID NO: 1812165 - RNA, 20 nt, Human
ucagguggggucacucuggc

SEQ ID NO: 1812166 - RNA, 17 nt, Human
ucagguggggcagcuug

SEQ ID NO: 1812167 - RNA, 21 nt, Human
ucagguggggcagcuugaggg

SEQ ID NO: 1812168 - RNA, 16 nt, Human
ucagguggggcagcuu

SEQ ID NO: 1812169 - RNA, 15 nt, Human
ucagguggggcagcu

SEQ ID NO: 1812170 - RNA, 20 nt, Human
ucaggugcugccauccaggu

SEQ ID NO: 1812171 - RNA, 18 nt, Human
ucaggugcugccauccag

SEQ ID NO: 1812172 - RNA, 14 nt, Human
ucagguggggcagc

SEQ ID NO: 1812173 - RNA, 19 nt, Human
ucagucugauucccaagcu

SEQ ID NO: 1812174 - RNA, 17 nt, Human
ucagucugauucccaag

SEQ ID NO: 1812175 - RNA, 18 nt, Human
ucagugugacugaucucu

SEQ ID NO: 1812176 - RNA, 16 nt, Human
ucaguuaagccuuugg

SEQ ID NO: 1812177 - RNA, 17 nt, Human
ucaguuaagccuuugga

SEQ ID NO: 1812178 - RNA, 15 nt, Human
ucugccuccucuuca

SEQ ID NO: 1812179 - RNA, 20 nt, Human
ucugccucacauagcuuaca

SEQ ID NO: 1812180 - RNA, 18 nt, Human
ucugccucugacacacag

SEQ ID NO: 1812181 - RNA, 15 nt, Human
ucugccucugacaca

SEQ ID NO: 1812182 - RNA, 16 nt, Human
ucugccucccaucacc

SEQ ID NO: 1812183 - RNA, 17 nt, Human
ucugccucccaucaccc

SEQ ID NO: 1812184 - RNA, 20 nt, Human
ucugccucccaucacccgcu

SEQ ID NO: 1812185 - RNA, 21 nt, Human
ucugccucccaucacccgcua

SEQ ID NO: 1812186 - RNA, 20 nt, Human
ucugccugaagucacacagu

SEQ ID NO: 1812187 - RNA, 19 nt, Human
ucugccugaagucacacag

SEQ ID NO: 1812188 - RNA, 22 nt, Human
ucugccucugacacacagcucu

SEQ ID NO: 1812189 - RNA, 21 nt, Human
ucugccucugacacacagcuc

SEQ ID NO: 1812190 - RNA, 23 nt, Human
ucugccucugacacacagcucug

SEQ ID NO: 1812191 - RNA, 23 nt, Human
ucugccauauucuguuggccagu

SEQ ID NO: 1812192 - RNA, 22 nt, Human
ucugccauauucuguuggccag

SEQ ID NO: 1812193 - RNA, 12 nt, Human
ucugcccacucc

SEQ ID NO: 1812194 - RNA, 13 nt, Human
ucugccucccauc

SEQ ID NO: 1812195 - RNA, 15 nt, Human
ucugccucccaucac

SEQ ID NO: 1812196 - RNA, 12 nt, Human
ucugccucccau

SEQ ID NO: 1812197 - RNA, 13 nt, Human
ucugcccacuccc

SEQ ID NO: 1812198 - RNA, 14 nt, Human
ucugcccacucccu

SEQ ID NO: 1812199 - RNA, 16 nt, Human
ucugcccacucccugc

SEQ ID NO: 1812200 - RNA, 21 nt, Human
ucugaggaauccagacccggc

SEQ ID NO: 1812201 - RNA, 18 nt, Human
ucugaggaauccagaccc

SEQ ID NO: 1812202 - RNA, 22 nt, Human
ucugaggaauccagacccggcu

SEQ ID NO: 1812203 - RNA, 13 nt, Human
ucugcacuccccu

SEQ ID NO: 1812204 - RNA, 19 nt, Human
ucugacccaugcugcccug

SEQ ID NO: 1812205 - RNA, 20 nt, Human
ucugacccaugcugcccugu

SEQ ID NO: 1812206 - RNA, 22 nt, Human
ucugacccaugcugcccuguga

SEQ ID NO: 1812207 - RNA, 23 nt, Human
ucugacccaugcugcccugugag

SEQ ID NO: 1812208 - RNA, 18 nt, Human
ucugagaggacuuuucuu

SEQ ID NO: 1812209 - RNA, 24 nt, Human
ucugagaucaaaacgguuuuacug

SEQ ID NO: 1812210 - RNA, 14 nt, Human
ucugucucagucca

SEQ ID NO: 1812211 - RNA, 13 nt, Human
ucugucuaggaau

SEQ ID NO: 1812212 - RNA, 17 nt, Human
ucugucgcccagucugg

SEQ ID NO: 1812213 - RNA, 12 nt, Human
ucuguccuggga

SEQ ID NO: 1812214 - RNA, 14 nt, Human
ucuguacagagccc

SEQ ID NO: 1812215 - RNA, 15 nt, Human
ucuguacagagccca

SEQ ID NO: 1812216 - RNA, 16 nt, Human
ucuggugacuuuccuc

SEQ ID NO: 1812217 - RNA, 12 nt, Human
ucuggagcccac

SEQ ID NO: 1812218 - RNA, 16 nt, Human
ucuggagcccacugua

SEQ ID NO: 1812219 - RNA, 22 nt, Human
ucuggagcccacuguacuugcu

SEQ ID NO: 1812220 - RNA, 20 nt, Human
ucugccugcccaggccccug

SEQ ID NO: 1812221 - RNA, 18 nt, Human
ucugccugcccaggcccc

SEQ ID NO: 1812222 - RNA, 17 nt, Human
ucugccugcccaggccc

SEQ ID NO: 1812223 - RNA, 13 nt, Human
ucugcugaaggaa

SEQ ID NO: 1812224 - RNA, 11 nt, Human
ucugcugcugg

SEQ ID NO: 1812225 - RNA, 13 nt, Human
ucugcugcuggcu

SEQ ID NO: 1812226 - RNA, 22 nt, Human
ucuggacuccucuguccaggca

SEQ ID NO: 1812227 - RNA, 15 nt, Human
ucuggacuccucugu

SEQ ID NO: 1812228 - RNA, 16 nt, Human
ucuggacuccucuguc

SEQ ID NO: 1812229 - RNA, 18 nt, Human
ucuggacuccucugucca

SEQ ID NO: 1812230 - RNA, 14 nt, Human
ucuggaauuugaaa

SEQ ID NO: 1812231 - RNA, 17 nt, Human
ucugcugcuggcugguu

SEQ ID NO: 1812232 - RNA, 14 nt, Human
ucugcugcuggcug

SEQ ID NO: 1812233 - RNA, 15 nt, Human
ucugcugcuggcugg

SEQ ID NO: 1812234 - RNA, 21 nt, Human
ugaaaacacauuuuucuuagg

SEQ ID NO: 1812235 - RNA, 16 nt, Human
ucuuuuuauacuauua

SEQ ID NO: 1812236 - RNA, 17 nt, Human
ugaaaacacuguucucu

SEQ ID NO: 1812237 - RNA, 20 nt, Human
ugaaaacacuguucucugcc

SEQ ID NO: 1812238 - RNA, 21 nt, Human
ugaaaacacuguucucugccc

SEQ ID NO: 1812239 - RNA, 22 nt, Human
ugaaaacacuguucucugcccu

SEQ ID NO: 1812240 - RNA, 23 nt, Human
ugaaaacacuguucucugcccuc

SEQ ID NO: 1812241 - RNA, 18 nt, Human
ugaaaaccacauuggaga

SEQ ID NO: 1812242 - RNA, 19 nt, Human
ugaaaagaaaaaugagccu

SEQ ID NO: 1812243 - RNA, 20 nt, Human
ugaaaagaaaaaugagccug

SEQ ID NO: 1812244 - RNA, 22 nt, Human
ugaaaagaaaaaugagccuggc

SEQ ID NO: 1812245 - RNA, 20 nt, Human
ugaaaauuaggauuucauga

SEQ ID NO: 1812246 - RNA, 14 nt, Human
ugaaaauucagugg

SEQ ID NO: 1812247 - RNA, 12 nt, Human
ugaaaauuuuga

SEQ ID NO: 1812248 - RNA, 15 nt, Human
ugaaacacuuugcau

SEQ ID NO: 1812249 - RNA, 23 nt, Human
ucuuuccaaaguacacuguuuca

SEQ ID NO: 1812250 - RNA, 13 nt, Human
ucuuguguguuua

SEQ ID NO: 1812251 - RNA, 12 nt, Human
ucuuucccuccc

SEQ ID NO: 1812252 - RNA, 13 nt, Human
ucuuucccucccu

SEQ ID NO: 1812253 - RNA, 23 nt, Human
ucuuucccucccuuccucuuucc

SEQ ID NO: 1812254 - RNA, 13 nt, Human
ucuuuggacccug

SEQ ID NO: 1812255 - RNA, 16 nt, Human
ucuuuggacccugagg

SEQ ID NO: 1812256 - RNA, 14 nt, Human
ucuuuggacccuga

SEQ ID NO: 1812257 - RNA, 15 nt, Human
ucuuuggacccugag

SEQ ID NO: 1812258 - RNA, 13 nt, Human
ucuuugcagacag

SEQ ID NO: 1812259 - RNA, 23 nt, Human
ucuuugagugaagcugggagaac

SEQ ID NO: 1812260 - RNA, 17 nt, Human
ucuuugcagacaggcaa

SEQ ID NO: 1812261 - RNA, 14 nt, Human
ucuuugcagacagg

SEQ ID NO: 1812262 - RNA, 15 nt, Human
ucuucagaucucuaa

SEQ ID NO: 1812263 - RNA, 19 nt, Human
ucuucaguuaagccuuugg

SEQ ID NO: 1812264 - RNA, 20 nt, Human
ucuucaguuaagccuuugga

SEQ ID NO: 1812265 - RNA, 22 nt, Human
ucuucaguuaagccuuuggaaa

SEQ ID NO: 1812266 - RNA, 14 nt, Human
ucuucagaucucua

SEQ ID NO: 1812267 - RNA, 21 nt, Human
ucuucagagacuccugcaggc

SEQ ID NO: 1812268 - RNA, 22 nt, Human
ucuuauccaacaucaacaucuu

SEQ ID NO: 1812269 - RNA, 13 nt, Human
ucuuauaauuuaa

SEQ ID NO: 1812270 - RNA, 14 nt, Human
ucuuauaauuuaaa

SEQ ID NO: 1812271 - RNA, 20 nt, Human
ucuuagguuggcaaaaaggc

SEQ ID NO: 1812272 - RNA, 23 nt, Human
ucuuagguuggcaaaaaggcagg

SEQ ID NO: 1812273 - RNA, 20 nt, Human
ucugugucagguggggcagc

SEQ ID NO: 1812274 - RNA, 17 nt, Human
ucugugucagguggggc

SEQ ID NO: 1812275 - RNA, 22 nt, Human
ucugugucagguggggcagcuu

SEQ ID NO: 1812276 - RNA, 15 nt, Human
ucuuagauguauaua

SEQ ID NO: 1812277 - RNA, 16 nt, Human
ucuucuuggucucagu

SEQ ID NO: 1812278 - RNA, 13 nt, Human
ucuugaagacuuu

SEQ ID NO: 1812279 - RNA, 22 nt, Human
ucuugaagacuuuucuuucagc

SEQ ID NO: 1812280 - RNA, 21 nt, Human
ucuugaaauauaggaacuuaa

SEQ ID NO: 1812281 - RNA, 20 nt, Human
ucuugaaauauaggaacuua

SEQ ID NO: 1812282 - RNA, 19 nt, Human
ucuugccaaauauaaauaa

SEQ ID NO: 1812283 - RNA, 23 nt, Human
ucuugcauggcaaggacugcagg

SEQ ID NO: 1812284 - RNA, 14 nt, Human
ucuugcucugcuga

SEQ ID NO: 1812285 - RNA, 16 nt, Human
ucuugccacugccucu

SEQ ID NO: 1812286 - RNA, 17 nt, Human
ucuugccacugccucuu

SEQ ID NO: 1812287 - RNA, 23 nt, Human
ucuugcucugcugacagacacag

SEQ ID NO: 1812288 - RNA, 15 nt, Human
ucuugcucugcugac

SEQ ID NO: 1812289 - RNA, 22 nt, Human
ugacuuuucuguccgagcuuug

SEQ ID NO: 1812290 - RNA, 15 nt, Human
ugagaaauaaaguuu

SEQ ID NO: 1812291 - RNA, 14 nt, Human
ugagaggggaacag

SEQ ID NO: 1812292 - RNA, 19 nt, Human
ugagaggcugucuguugua

SEQ ID NO: 1812293 - RNA, 18 nt, Human
ugagaggggaacagacug

SEQ ID NO: 1812294 - RNA, 19 nt, Human
ugagaggggaacagacugg

SEQ ID NO: 1812295 - RNA, 13 nt, Human
ugagaccugcccc

SEQ ID NO: 1812296 - RNA, 14 nt, Human
ugagaccugccccu

SEQ ID NO: 1812297 - RNA, 15 nt, Human
ugagaccugccccuc

SEQ ID NO: 1812298 - RNA, 22 nt, Human
ugagaccugccccuccucucug

SEQ ID NO: 1812299 - RNA, 12 nt, Human
ugagaccugccc

SEQ ID NO: 1812300 - RNA, 14 nt, Human
ugagaccaaccugg

SEQ ID NO: 1812301 - RNA, 14 nt, Human
ugaccauucuccac

SEQ ID NO: 1812302 - RNA, 13 nt, Human
ugaccauucucca

SEQ ID NO: 1812303 - RNA, 14 nt, Human
ugacucuuggcaca

SEQ ID NO: 1812304 - RNA, 19 nt, Human
ugacucuuggcacagcaug

SEQ ID NO: 1812305 - RNA, 21 nt, Human
ugacucuuucuauuguuucuu

SEQ ID NO: 1812306 - RNA, 16 nt, Human
ugacuuuccucuuugg

SEQ ID NO: 1812307 - RNA, 20 nt, Human
ugagcucagcccuggugggc

SEQ ID NO: 1812308 - RNA, 11 nt, Human
ugagcucagcc

SEQ ID NO: 1812309 - RNA, 12 nt, Human
ugagcucagccc

SEQ ID NO: 1812310 - RNA, 11 nt, Human
ugagcucagga

SEQ ID NO: 1812311 - RNA, 19 nt, Human
ugagcucaggaguuugaga

SEQ ID NO: 1812312 - RNA, 22 nt, Human
ugagccgagaucacgccacugc

SEQ ID NO: 1812313 - RNA, 23 nt, Human
ugagcagggcucagcggggacag

SEQ ID NO: 1812314 - RNA, 22 nt, Human
ugagcagggcucagcggggaca

SEQ ID NO: 1812315 - RNA, 20 nt, Human
ugagcagggcucagcgggga

SEQ ID NO: 1812316 - RNA, 23 nt, Human
ugagccgagaucacgccacugca

SEQ ID NO: 1812317 - RNA, 13 nt, Human
ugaggaucagagu

SEQ ID NO: 1812318 - RNA, 17 nt, Human
ugaggaucagaguaauc

SEQ ID NO: 1812319 - RNA, 19 nt, Human
ugaggaucagaguaaucca

SEQ ID NO: 1812320 - RNA, 22 nt, Human
ugaggaugaaaaaauaacacug

SEQ ID NO: 1812321 - RNA, 23 nt, Human
ugagcuuaagaauuuugagcagg

SEQ ID NO: 1812322 - RNA, 19 nt, Human
ugaggucagagccugcagu

SEQ ID NO: 1812323 - RNA, 18 nt, Human
ugaggucagagccugcag

SEQ ID NO: 1812324 - RNA, 21 nt, Human
ugaggcugggcucccuuccca

SEQ ID NO: 1812325 - RNA, 20 nt, Human
ugagucccaggcugagccuc

SEQ ID NO: 1812326 - RNA, 21 nt, Human
ugagucccaggcugagccuca

SEQ ID NO: 1812327 - RNA, 16 nt, Human
ugaggcucugcccuug

SEQ ID NO: 1812328 - RNA, 15 nt, Human
ugaggcucugcccuu

SEQ ID NO: 1812329 - RNA, 18 nt, Human
ugaggcucugcccuuggu

SEQ ID NO: 1812330 - RNA, 15 nt, Human
ugaggcugggcuccc

SEQ ID NO: 1812331 - RNA, 16 nt, Human
ugaggcugggcucccu

SEQ ID NO: 1812332 - RNA, 20 nt, Human
ugaagacucauucuucugua

SEQ ID NO: 1812333 - RNA, 19 nt, Human
ugaagacucauucuucugu

SEQ ID NO: 1812334 - RNA, 13 nt, Human
ugaaacauguuuc

SEQ ID NO: 1812335 - RNA, 16 nt, Human
ugaaacacuuugcaua

SEQ ID NO: 1812336 - RNA, 19 nt, Human
ugaaggccccgcccaggcu

SEQ ID NO: 1812337 - RNA, 20 nt, Human
ugaaggccccgcccaggcuu

SEQ ID NO: 1812338 - RNA, 21 nt, Human
ugaagcuuuuaugugaaacau

SEQ ID NO: 1812339 - RNA, 16 nt, Human
ugaagcuuuuauguga

SEQ ID NO: 1812340 - RNA, 18 nt, Human
ugaaggccccgcccaggc

SEQ ID NO: 1812341 - RNA, 20 nt, Human
ugaaugaauggcuaagcaaa

SEQ ID NO: 1812342 - RNA, 15 nt, Human
ugaaugaauggcuaa

SEQ ID NO: 1812343 - RNA, 14 nt, Human
ugaaugcauaaaau

SEQ ID NO: 1812344 - RNA, 16 nt, Human
ugaaucuuggugucua

SEQ ID NO: 1812345 - RNA, 20 nt, Human
ugaaggcuggguucugaucc

SEQ ID NO: 1812346 - RNA, 21 nt, Human
ugaaggcuggguucugauccu

SEQ ID NO: 1812347 - RNA, 23 nt, Human
ugaaucacguaaagcuagaaaug

SEQ ID NO: 1812348 - RNA, 17 nt, Human
ugaaucacguaaagcua

SEQ ID NO: 1812349 - RNA, 18 nt, Human
ugacagacacaggcccgg

SEQ ID NO: 1812350 - RNA, 17 nt, Human
ugacagacacaggcccg

SEQ ID NO: 1812351 - RNA, 22 nt, Human
ugacagagcaagugagacccug

SEQ ID NO: 1812352 - RNA, 23 nt, Human
ugacaucaacugcaucaagaugu

SEQ ID NO: 1812353 - RNA, 15 nt, Human
ugacauauuuuugcu

SEQ ID NO: 1812354 - RNA, 19 nt, Human
ugacauguguuggcagccu

SEQ ID NO: 1812355 - RNA, 21 nt, Human
ugaccagccuccaugcugccu

SEQ ID NO: 1812356 - RNA, 22 nt, Human
ugaccagccuccaugcugccuc

SEQ ID NO: 1812357 - RNA, 23 nt, Human
ugaccagccuccaugcugccucc

SEQ ID NO: 1812358 - RNA, 13 nt, Human
ugacauguuuuau

SEQ ID NO: 1812359 - RNA, 18 nt, Human
ugaccacugcagaagaca

SEQ ID NO: 1812360 - RNA, 17 nt, Human
ugaccacugcagaagac

SEQ ID NO: 1812361 - RNA, 16 nt, Human
ugaccacugcagaaga

SEQ ID NO: 1812362 - RNA, 21 nt, Human
ugaauuguaaggaaugauuaa

SEQ ID NO: 1812363 - RNA, 13 nt, Human
ugaauuguaagga

SEQ ID NO: 1812364 - RNA, 20 nt, Human
ugacaaagguaaaucagacu

SEQ ID NO: 1812365 - RNA, 13 nt, Human
ugacaacacucau

SEQ ID NO: 1812366 - RNA, 18 nt, Human
ugacaacagacuucugaa

SEQ ID NO: 1812367 - RNA, 19 nt, Human
ugacaacagacuucugaaa

SEQ ID NO: 1812368 - RNA, 15 nt, Human
ugacaacagacuucu

SEQ ID NO: 1812369 - RNA, 23 nt, Human
ugacaacacucauugaccugagg

SEQ ID NO: 1812370 - RNA, 23 nt, Human
ugacaaggauugcuacuguccua

SEQ ID NO: 1812371 - RNA, 13 nt, Human
ugacagacacagg

SEQ ID NO: 1812372 - RNA, 16 nt, Human
ugacagacacaggccc

SEQ ID NO: 1812373 - RNA, 14 nt, Human
ugacagacacaggc

SEQ ID NO: 1812374 - RNA, 15 nt, Human
ugacacacagcucug

SEQ ID NO: 1812375 - RNA, 14 nt, Human
ugacacacagcucu

SEQ ID NO: 1812376 - RNA, 23 nt, Human
uacaguucggugagcuacaaaug

SEQ ID NO: 1812377 - RNA, 20 nt, Human
uacaggaugaugacuaugga

SEQ ID NO: 1812378 - RNA, 15 nt, Human
uacaggagugagcac

SEQ ID NO: 1812379 - RNA, 22 nt, Human
uacaggaaguacuggagaaaau

SEQ ID NO: 1812380 - RNA, 14 nt, Human
uacaggaaguacug

SEQ ID NO: 1812381 - RNA, 15 nt, Human
uacaggaaguacugg

SEQ ID NO: 1812382 - RNA, 18 nt, Human
uacaguuuguuaguauga

SEQ ID NO: 1812383 - RNA, 20 nt, Human
uacaguugaaaaacagcuga

SEQ ID NO: 1812384 - RNA, 21 nt, Human
uacagcuugaccgugaggcca

SEQ ID NO: 1812385 - RNA, 17 nt, Human
uacaguugaaaaacagc

SEQ ID NO: 1812386 - RNA, 19 nt, Human
uacaguugaaaaacagcug

SEQ ID NO: 1812387 - RNA, 16 nt, Human
uacagcuaaucagcau

SEQ ID NO: 1812388 - RNA, 18 nt, Human
uacagcuaaucagcauuc

SEQ ID NO: 1812389 - RNA, 22 nt, Human
uacacuguuucaaacuuuacua

SEQ ID NO: 1812390 - RNA, 16 nt, Human
uacacuuacacuuuau

SEQ ID NO: 1812391 - RNA, 20 nt, Human
uacacuguuucaaacuuuac

SEQ ID NO: 1812392 - RNA, 22 nt, Human
uacacugugcugagucugaagg

SEQ ID NO: 1812393 - RNA, 23 nt, Human
uacacugugcugagucugaaggc

SEQ ID NO: 1812394 - RNA, 20 nt, Human
uacagcuugaccgugaggcc

SEQ ID NO: 1812395 - RNA, 18 nt, Human
uacaggaagguagaaaua

SEQ ID NO: 1812396 - RNA, 13 nt, Human
uacaggaaguacu

SEQ ID NO: 1812397 - RNA, 14 nt, Human
uacagcugccugca

SEQ ID NO: 1812398 - RNA, 13 nt, Human
uacagcugccugc

SEQ ID NO: 1812399 - RNA, 16 nt, Human
uacauaaacaaguccu

SEQ ID NO: 1812400 - RNA, 21 nt, Human
uacaguuuguuaguaugaggc

SEQ ID NO: 1812401 - RNA, 19 nt, Human
uacaguuuguuaguaugag

SEQ ID NO: 1812402 - RNA, 23 nt, Human
uacaugaaaacacauuuuucuua

SEQ ID NO: 1812403 - RNA, 19 nt, Human
uacaugaaaacacauuuuu

SEQ ID NO: 1812404 - RNA, 18 nt, Human
uacaugaaaacacauuuu

SEQ ID NO: 1812405 - RNA, 17 nt, Human
uacaugaaaacacauuu

SEQ ID NO: 1812406 - RNA, 16 nt, Human
uacaugaaaacacauu

SEQ ID NO: 1812407 - RNA, 16 nt, Human
uacauaagauaaaugu

SEQ ID NO: 1812408 - RNA, 17 nt, Human
uacauaagauaaaugug

SEQ ID NO: 1812409 - RNA, 14 nt, Human
uacauuuuuaagug

SEQ ID NO: 1812410 - RNA, 22 nt, Human
uacauuuuuaagugcugcauuu

SEQ ID NO: 1812411 - RNA, 19 nt, Human
uacauuuuuaagugcugca

SEQ ID NO: 1812412 - RNA, 14 nt, Human
uacauggaauaaca

SEQ ID NO: 1812413 - RNA, 18 nt, Human
uacauggaauaacaugua

SEQ ID NO: 1812414 - RNA, 19 nt, Human
uacauggaauaacauguaa

SEQ ID NO: 1812415 - RNA, 22 nt, Human
uacauggaauaacauguaauua

SEQ ID NO: 1812416 - RNA, 14 nt, Human
uacaaaguagaagu

SEQ ID NO: 1812417 - RNA, 18 nt, Human
uacaaaguagaagucuua

SEQ ID NO: 1812418 - RNA, 20 nt, Human
uaauuuuguguaagaaauac

SEQ ID NO: 1812419 - RNA, 19 nt, Human
uaauuuuguguaagaaaua

SEQ ID NO: 1812420 - RNA, 13 nt, Human
uaauuuuguguaa

SEQ ID NO: 1812421 - RNA, 15 nt, Human
uaauucuaugccugu

SEQ ID NO: 1812422 - RNA, 11 nt, Human
uacacacacac

SEQ ID NO: 1812423 - RNA, 21 nt, Human
uacacugugcugagucugaag

SEQ ID NO: 1812424 - RNA, 15 nt, Human
uacacacugcauguu

SEQ ID NO: 1812425 - RNA, 16 nt, Human
uacucuacccucuuag

SEQ ID NO: 1812426 - RNA, 21 nt, Human
uacugccuauuuuaauaaaca

SEQ ID NO: 1812427 - RNA, 14 nt, Human
uacugccuauuuua

SEQ ID NO: 1812428 - RNA, 19 nt, Human
uacugcccaggccugccug

SEQ ID NO: 1812429 - RNA, 20 nt, Human
uacugcccaggccugccugu

SEQ ID NO: 1812430 - RNA, 21 nt, Human
uacugcccaggccugccuguu

SEQ ID NO: 1812431 - RNA, 22 nt, Human
uacugcccaggccugccuguuc

SEQ ID NO: 1812432 - RNA, 15 nt, Human
uacuccccuccuuga

SEQ ID NO: 1812433 - RNA, 12 nt, Human
uacuccucccag

SEQ ID NO: 1812434 - RNA, 22 nt, Human
uacucgaguuacagacaaagcg

SEQ ID NO: 1812435 - RNA, 18 nt, Human
uacucgaguuacagacaa

SEQ ID NO: 1812436 - RNA, 14 nt, Human
uacuacaguuuguu

SEQ ID NO: 1812437 - RNA, 13 nt, Human
uacuacaguuugu

SEQ ID NO: 1812438 - RNA, 22 nt, Human
uacuacaguccucccaucucac

SEQ ID NO: 1812439 - RNA, 13 nt, Human
uacuuguggacac

SEQ ID NO: 1812440 - RNA, 20 nt, Human
uacuugcucuugaugccugg

SEQ ID NO: 1812441 - RNA, 13 nt, Human
uacuugcucuuga

SEQ ID NO: 1812442 - RNA, 14 nt, Human
uacuugcucuugau

SEQ ID NO: 1812443 - RNA, 18 nt, Human
uacuugcucuugaugccu

SEQ ID NO: 1812444 - RNA, 19 nt, Human
uacuugcucuugaugccug

SEQ ID NO: 1812445 - RNA, 16 nt, Human
uacuguccuacccacc

SEQ ID NO: 1812446 - RNA, 21 nt, Human
uacugucuucaguaagccgug

SEQ ID NO: 1812447 - RNA, 18 nt, Human
uaccucggugccuuccuc

SEQ ID NO: 1812448 - RNA, 21 nt, Human
uaccucuugagccuugaacuu

SEQ ID NO: 1812449 - RNA, 22 nt, Human
uaccuuuuuuagaguugauacu

SEQ ID NO: 1812450 - RNA, 19 nt, Human
uaccuuuuuuagaguugau

SEQ ID NO: 1812451 - RNA, 13 nt, Human
uaccuuuuuuaga

SEQ ID NO: 1812452 - RNA, 14 nt, Human
uacuaaggaaucuu

SEQ ID NO: 1812453 - RNA, 21 nt, Human
uacuaauagacaauuuauuau

SEQ ID NO: 1812454 - RNA, 20 nt, Human
uacuaauagacaauuuauua

SEQ ID NO: 1812455 - RNA, 17 nt, Human
uaccuuuuuuauacaua

SEQ ID NO: 1812456 - RNA, 16 nt, Human
uaccuuuuuuauacau

SEQ ID NO: 1812457 - RNA, 13 nt, Human
uaccuuuuuuaua

SEQ ID NO: 1812458 - RNA, 18 nt, Human
uacgaaaagaggggaaga

SEQ ID NO: 1812459 - RNA, 21 nt, Human
uacgaaaagaggggaagagac

SEQ ID NO: 1812460 - RNA, 15 nt, Human
uaccuacauacaauu

SEQ ID NO: 1812461 - RNA, 16 nt, Human
uacccagcgagcccug

SEQ ID NO: 1812462 - RNA, 17 nt, Human
uaccgagucucuucucc

SEQ ID NO: 1812463 - RNA, 18 nt, Human
uaccgagucucuucucca

SEQ ID NO: 1812464 - RNA, 21 nt, Human
uaccgagucucuucuccacug

SEQ ID NO: 1812465 - RNA, 22 nt, Human
uaccgagucucuucuccacugg

SEQ ID NO: 1812466 - RNA, 22 nt, Human
uaccuaacgaaguauccuucag

SEQ ID NO: 1812467 - RNA, 15 nt, Human
uacccacugcucugg

SEQ ID NO: 1812468 - RNA, 23 nt, Human
uacauuuuuaagugcugcauuua

SEQ ID NO: 1812469 - RNA, 14 nt, Human
uacuuguggacaca

SEQ ID NO: 1812470 - RNA, 23 nt, Human
uagaauuaguggcacuugcuuuu

SEQ ID NO: 1812471 - RNA, 18 nt, Human
uagaauuaacacaugauc

SEQ ID NO: 1812472 - RNA, 16 nt, Human
uagaauuaacacauga

SEQ ID NO: 1812473 - RNA, 15 nt, Human
uagaauuaacacaug

SEQ ID NO: 1812474 - RNA, 20 nt, Human
uagacccacuggacucaccu

SEQ ID NO: 1812475 - RNA, 17 nt, Human
uagaguugauacuacag

SEQ ID NO: 1812476 - RNA, 14 nt, Human
uagaguugauacua

SEQ ID NO: 1812477 - RNA, 12 nt, Human
uagagugggagc

SEQ ID NO: 1812478 - RNA, 15 nt, Human
uagagguucaaagau

SEQ ID NO: 1812479 - RNA, 14 nt, Human
uagagguucaaaga

SEQ ID NO: 1812480 - RNA, 11 nt, Human
uagagacaggg

SEQ ID NO: 1812481 - RNA, 22 nt, Human
uagagaaggacccggaggggcc

SEQ ID NO: 1812482 - RNA, 13 nt, Human
uagagaaggaccc

SEQ ID NO: 1812483 - RNA, 19 nt, Human
uagcugggacuacaggcac

SEQ ID NO: 1812484 - RNA, 17 nt, Human
uagcugggacuacaggc

SEQ ID NO: 1812485 - RNA, 15 nt, Human
uagcugggacuacag

SEQ ID NO: 1812486 - RNA, 21 nt, Human
uagcucaggugucccugcacu

SEQ ID NO: 1812487 - RNA, 20 nt, Human
uagcucaggugucccugcac

SEQ ID NO: 1812488 - RNA, 12 nt, Human
uagcucauucuc

SEQ ID NO: 1812489 - RNA, 18 nt, Human
uagccugugccucuggga

SEQ ID NO: 1812490 - RNA, 20 nt, Human
uagccugugccucugggacu

SEQ ID NO: 1812491 - RNA, 16 nt, Human
uagccuaggugacaga

SEQ ID NO: 1812492 - RNA, 16 nt, Human
uagccccucuccugga

SEQ ID NO: 1812493 - RNA, 16 nt, Human
uagauacuguaucaug

SEQ ID NO: 1812494 - RNA, 11 nt, Human
uagcagggaaa

SEQ ID NO: 1812495 - RNA, 19 nt, Human
uagcauacguacacauuuu

SEQ ID NO: 1812496 - RNA, 18 nt, Human
uagcauacguacacauuu

SEQ ID NO: 1812497 - RNA, 17 nt, Human
uagcauacguacacauu

SEQ ID NO: 1812498 - RNA, 16 nt, Human
uagcauacguacacau

SEQ ID NO: 1812499 - RNA, 18 nt, Human
uaguaugaggcauuuguu

SEQ ID NO: 1812500 - RNA, 17 nt, Human
uaguaugaggcauuugu

SEQ ID NO: 1812501 - RNA, 23 nt, Human
uaggugugacugaauuucuuuug

SEQ ID NO: 1812502 - RNA, 21 nt, Human
uaggugugacugaauuucuuu

SEQ ID NO: 1812503 - RNA, 19 nt, Human
uaggugugacugaauuucu

SEQ ID NO: 1812504 - RNA, 13 nt, Human
uagguguggggga

SEQ ID NO: 1812505 - RNA, 17 nt, Human
uaggugugggggaagca

SEQ ID NO: 1812506 - RNA, 22 nt, Human
uagguuauuuugauguaaagau

SEQ ID NO: 1812507 - RNA, 16 nt, Human
uaggugacagagugag

SEQ ID NO: 1812508 - RNA, 11 nt, Human
uaggugacaga

SEQ ID NO: 1812509 - RNA, 11 nt, Human
uagggaaaaac

SEQ ID NO: 1812510 - RNA, 22 nt, Human
uagcuggucuuauuuguaaagc

SEQ ID NO: 1812511 - RNA, 20 nt, Human
uaguggcuuaaaacaacacu

SEQ ID NO: 1812512 - RNA, 16 nt, Human
uaguaugguggcuggg

SEQ ID NO: 1812513 - RNA, 15 nt, Human
uaguaugaggcauuu

SEQ ID NO: 1812514 - RNA, 21 nt, Human
uaguuguuugauucagacagc

SEQ ID NO: 1812515 - RNA, 22 nt, Human
uaguuguuugauucagacagcu

SEQ ID NO: 1812516 - RNA, 20 nt, Human
uaguuguuugauucagacag

SEQ ID NO: 1812517 - RNA, 15 nt, Human
uaguuugauuaaauu

SEQ ID NO: 1812518 - RNA, 21 nt, Human
uaguuugauuaaauucuugca

SEQ ID NO: 1812519 - RNA, 16 nt, Human
uaguuugauuaaauuc

SEQ ID NO: 1812520 - RNA, 11 nt, Human
uauaaacuuua

SEQ ID NO: 1812521 - RNA, 14 nt, Human
uauaaacuuuaccu

SEQ ID NO: 1812522 - RNA, 13 nt, Human
uauaaacuuuacc

SEQ ID NO: 1812523 - RNA, 18 nt, Human
uauaaacuuuaccuuuuu

SEQ ID NO: 1812524 - RNA, 17 nt, Human
uauaaacuuuaccuuuu

SEQ ID NO: 1812525 - RNA, 16 nt, Human
uauaaacuuuaccuuu

SEQ ID NO: 1812526 - RNA, 15 nt, Human
uauaaacuuuaccuu

SEQ ID NO: 1812527 - RNA, 21 nt, Human
uauauuuuuuguuaaaugauu

SEQ ID NO: 1812528 - RNA, 19 nt, Human
uaucaggugcugccaucca

SEQ ID NO: 1812529 - RNA, 14 nt, Human
uaucaaaagaaaga

SEQ ID NO: 1812530 - RNA, 20 nt, Human
uaucaggugcugccauccag

SEQ ID NO: 1812531 - RNA, 11 nt, Human
uauagaaaugc

SEQ ID NO: 1812532 - RNA, 11 nt, Human
uaauguuuccu

SEQ ID NO: 1812533 - RNA, 14 nt, Human
uaauuaaguacuau

SEQ ID NO: 1812534 - RNA, 17 nt, Human
uaauuaaguacuaugua

SEQ ID NO: 1812535 - RNA, 20 nt, Human
uaauuaaguacuauguauca

SEQ ID NO: 1812536 - RNA, 15 nt, Human
uaauggggcggugag

SEQ ID NO: 1812537 - RNA, 23 nt, Human
uaaugcgugcauaccacuuuugu

SEQ ID NO: 1812538 - RNA, 22 nt, Human
uaaugcgugcauaccacuuuug

SEQ ID NO: 1812539 - RNA, 19 nt, Human
uaaugcgugcauaccacuu

SEQ ID NO: 1812540 - RNA, 15 nt, Human
uaaugcgugcauacc

SEQ ID NO: 1812541 - RNA, 19 nt, Human
uaauaugcacacauuuuuu

SEQ ID NO: 1812542 - RNA, 18 nt, Human
uaauaugcacacauuuuu

SEQ ID NO: 1812543 - RNA, 17 nt, Human
uaauaugcacacauuuu

SEQ ID NO: 1812544 - RNA, 16 nt, Human
uaauaugcacacauuu

SEQ ID NO: 1812545 - RNA, 15 nt, Human
uaauaugcacacauu

SEQ ID NO: 1812546 - RNA, 20 nt, Human
uaauauuaaggaagacaaug

SEQ ID NO: 1812547 - RNA, 13 nt, Human
uaaucuaaaugga

SEQ ID NO: 1812548 - RNA, 12 nt, Human
uaaucuaaaugg

SEQ ID NO: 1812549 - RNA, 20 nt, Human
uaauccucuaggaggucucu

SEQ ID NO: 1812550 - RNA, 17 nt, Human
uaaucuggacuccucug

SEQ ID NO: 1812551 - RNA, 18 nt, Human
uaaucuggacuccucugu

SEQ ID NO: 1812552 - RNA, 15 nt, Human
uaaucuggacuccuc

SEQ ID NO: 1812553 - RNA, 19 nt, Human
uaaucuggacuccucuguc

SEQ ID NO: 1812554 - RNA, 20 nt, Human
uaaucuggacuccucugucc

SEQ ID NO: 1812555 - RNA, 21 nt, Human
uaaucuggacuccucugucca

SEQ ID NO: 1812556 - RNA, 22 nt, Human
uaaucuggacuccucuguccag

SEQ ID NO: 1812557 - RNA, 18 nt, Human
uaaucugggccagaauuu

SEQ ID NO: 1812558 - RNA, 23 nt, Human
uaaucugggccagaauuucaaac

SEQ ID NO: 1812559 - RNA, 21 nt, Human
uaaguauuuuccuguugucaa

SEQ ID NO: 1812560 - RNA, 20 nt, Human
uaaguauuuuccuguuguca

SEQ ID NO: 1812561 - RNA, 15 nt, Human
uaaggugugcucuga

SEQ ID NO: 1812562 - RNA, 20 nt, Human
uaagguggguacgggagggu

SEQ ID NO: 1812563 - RNA, 17 nt, Human
uaaggguaucuggugac

SEQ ID NO: 1812564 - RNA, 14 nt, Human
uaagcuauucagua

SEQ ID NO: 1812565 - RNA, 16 nt, Human
uaaggauguucuagca

SEQ ID NO: 1812566 - RNA, 14 nt, Human
uaaggcaaucaugg

SEQ ID NO: 1812567 - RNA, 15 nt, Human
uaagaggcagggucu

SEQ ID NO: 1812568 - RNA, 12 nt, Human
uaagaggcaggg

SEQ ID NO: 1812569 - RNA, 15 nt, Human
uaagccaugggagac

SEQ ID NO: 1812570 - RNA, 12 nt, Human
uaauaaagcugu

SEQ ID NO: 1812571 - RNA, 16 nt, Human
uaagugguguguguau

SEQ ID NO: 1812572 - RNA, 15 nt, Human
uaaguggugugugua

SEQ ID NO: 1812573 - RNA, 22 nt, Human
uaagugcugcauuuaaaagaua

SEQ ID NO: 1812574 - RNA, 18 nt, Human
uaagugcugcauuuaaaa

SEQ ID NO: 1812575 - RNA, 16 nt, Human
uaagugcugcauuuaa

SEQ ID NO: 1812576 - RNA, 15 nt, Human
uaagugcugcauuua

SEQ ID NO: 1812577 - RNA, 15 nt, Human
uaagugaaaauauag

SEQ ID NO: 1812578 - RNA, 13 nt, Human
uaagugaaauaag

SEQ ID NO: 1812579 - RNA, 22 nt, Human
uaagugauugcugguuuuaguu

SEQ ID NO: 1812580 - RNA, 12 nt, Human
uaagugagagag

SEQ ID NO: 1812581 - RNA, 23 nt, Human
uaagugaggaugaaaaaauaaca

SEQ ID NO: 1812582 - RNA, 14 nt, Human
uaagugcugcauuu

SEQ ID NO: 1812583 - RNA, 16 nt, Human
uaacuauguugauaaa

SEQ ID NO: 1812584 - RNA, 11 nt, Human
uaacagaaaug

SEQ ID NO: 1812585 - RNA, 12 nt, Human
uaacagaaaugu

SEQ ID NO: 1812586 - RNA, 13 nt, Human
uaaccagaucauu

SEQ ID NO: 1812587 - RNA, 16 nt, Human
uaaccacuucagcuga

SEQ ID NO: 1812588 - RNA, 23 nt, Human
uaaccaguguuguggauuuaaca

SEQ ID NO: 1812589 - RNA, 23 nt, Human
uaagaaaaaggaugcacagaguu

SEQ ID NO: 1812590 - RNA, 19 nt, Human
uaagaaaaaggaugcacag

SEQ ID NO: 1812591 - RNA, 18 nt, Human
uaagaaaaaggaugcaca

SEQ ID NO: 1812592 - RNA, 16 nt, Human
uaagaaaaaggaugca

SEQ ID NO: 1812593 - RNA, 19 nt, Human
uaagaaccuuuugagugcc

SEQ ID NO: 1812594 - RNA, 24 nt, Human
uaagaaagacuaucuaaauguuga

SEQ ID NO: 1812595 - RNA, 11 nt, Human
uaaauuauuuu

SEQ ID NO: 1812596 - RNA, 16 nt, Human
uaaauucuugcaaagu

SEQ ID NO: 1812597 - RNA, 22 nt, Human
uaaauucuugcaaaguaucccu

SEQ ID NO: 1812598 - RNA, 18 nt, Human
uaaauucuugcaaaguau

SEQ ID NO: 1812599 - RNA, 17 nt, Human
uaaauucuugcaaagua

SEQ ID NO: 1812600 - RNA, 23 nt, Human
uaaauugacacuuaaaaaugguu

SEQ ID NO: 1812601 - RNA, 20 nt, Human
uaaauugacacuuaaaaaug

SEQ ID NO: 1812602 - RNA, 18 nt, Human
uaacaccaugauuaacca

SEQ ID NO: 1812603 - RNA, 22 nt, Human
uaaaugucucuuuaaugucaca

SEQ ID NO: 1812604 - RNA, 20 nt, Human
uaaaugucuaguuguaacac

SEQ ID NO: 1812605 - RNA, 15 nt, Human
uaaauguagaaagug

SEQ ID NO: 1812606 - RNA, 17 nt, Human
uaaaugggggugcauuu

SEQ ID NO: 1812607 - RNA, 14 nt, Human
uaaaugggggugca

SEQ ID NO: 1812608 - RNA, 19 nt, Human
uaaaugggggugcauuuga

SEQ ID NO: 1812609 - RNA, 18 nt, Human
uaaaugggggugcauuug

SEQ ID NO: 1812610 - RNA, 17 nt, Human
uaaaguugguaaaccuu

SEQ ID NO: 1812611 - RNA, 16 nt, Human
uaaaguugguaaaccu

SEQ ID NO: 1812612 - RNA, 13 nt, Human
uaaaugcccagcc

SEQ ID NO: 1812613 - RNA, 16 nt, Human
uaaauggaaccacucu

SEQ ID NO: 1812614 - RNA, 14 nt, Human
uaaaugcccagccc

SEQ ID NO: 1812615 - RNA, 15 nt, Human
uaaaugcccagcccc

SEQ ID NO: 1812616 - RNA, 16 nt, Human
uaaaugcccagccccu

SEQ ID NO: 1812617 - RNA, 17 nt, Human
uaaaugcccagccccuu

SEQ ID NO: 1812618 - RNA, 18 nt, Human
uaaacacucuugaaaaau

SEQ ID NO: 1812619 - RNA, 15 nt, Human
uaaacacucuugaaa

SEQ ID NO: 1812620 - RNA, 17 nt, Human
uaaacacucuugaaaaa

SEQ ID NO: 1812621 - RNA, 16 nt, Human
uaaaaucuugaaaaug

SEQ ID NO: 1812622 - RNA, 20 nt, Human
uaaacaagaccacguuucua

SEQ ID NO: 1812623 - RNA, 22 nt, Human
uaaacaagaccacguuucuaaa

SEQ ID NO: 1812624 - RNA, 21 nt, Human
uaaacaagaccacguuucuaa

SEQ ID NO: 1812625 - RNA, 22 nt, Human
uaaacuugguuuuuaaaaaacu

SEQ ID NO: 1812626 - RNA, 14 nt, Human
uaaaguguuugaaa

SEQ ID NO: 1812627 - RNA, 17 nt, Human
uaaaggcuaccuuugua

SEQ ID NO: 1812628 - RNA, 14 nt, Human
uaaagcugaaaacu

SEQ ID NO: 1812629 - RNA, 20 nt, Human
uaaagccugaguuugcuuuc

SEQ ID NO: 1812630 - RNA, 15 nt, Human
uaaaggcuaccuuug

SEQ ID NO: 1812631 - RNA, 11 nt, Human
uaaagccucaa

SEQ ID NO: 1812632 - RNA, 18 nt, Human
uaaagcaggcagaacuca

SEQ ID NO: 1812633 - RNA, 19 nt, Human
uaaagcagcguuucuauga

SEQ ID NO: 1812634 - RNA, 17 nt, Human
uaaagcagcguuucuau

SEQ ID NO: 1812635 - RNA, 16 nt, Human
uaaagcagcguuucua

SEQ ID NO: 1812636 - RNA, 12 nt, Human
uaaagaaaacug

SEQ ID NO: 1812637 - RNA, 22 nt, Human
uaaagaaaaguuuuguaaauuu

SEQ ID NO: 1812638 - RNA, 16 nt, Human
uaaagaaaaguuuugu

SEQ ID NO: 1812639 - RNA, 15 nt, Human
uaaaacaacacucac

SEQ ID NO: 1812640 - RNA, 22 nt, Human
uaaaacaagcacuaaacaaaga

SEQ ID NO: 1812641 - RNA, 17 nt, Human
uaaaacacaacaucuuu

SEQ ID NO: 1812642 - RNA, 22 nt, Human
uaaaacacaacaucuuuuucua

SEQ ID NO: 1812643 - RNA, 23 nt, Human
uaaaacacaacaucuuuuucuac

SEQ ID NO: 1812644 - RNA, 19 nt, Human
uaaaacacuuccauaaucu

SEQ ID NO: 1812645 - RNA, 19 nt, Human
uaaaaaugguuuaaauggu

SEQ ID NO: 1812646 - RNA, 18 nt, Human
uaaaaaugguuuaaaugg

SEQ ID NO: 1812647 - RNA, 22 nt, Human
uaaaaacagauuuggaaagacu

SEQ ID NO: 1812648 - RNA, 20 nt, Human
uaaaaacagauuuggaaaga

SEQ ID NO: 1812649 - RNA, 17 nt, Human
guuuuuaauaaagacag

SEQ ID NO: 1812650 - RNA, 21 nt, Human
guuuuuaaggguuuguggaaa

SEQ ID NO: 1812651 - RNA, 21 nt, Human
uaaaaacaaagaaauuaugug

SEQ ID NO: 1812652 - RNA, 17 nt, Human
uaaaaacaaagaaauua

SEQ ID NO: 1812653 - RNA, 21 nt, Human
uaaaagauacaguuacucaga

SEQ ID NO: 1812654 - RNA, 20 nt, Human
uaaaagauacaguuacucag

SEQ ID NO: 1812655 - RNA, 17 nt, Human
uaaaagauacaguuacu

SEQ ID NO: 1812656 - RNA, 14 nt, Human
uaaaagauacaguu

SEQ ID NO: 1812657 - RNA, 19 nt, Human
uaaaacauuaaaauauaau

SEQ ID NO: 1812658 - RNA, 16 nt, Human
uaaaacauuaaaauau

SEQ ID NO: 1812659 - RNA, 15 nt, Human
uaaaacauuaaaaua

SEQ ID NO: 1812660 - RNA, 12 nt, Human
uaaaacauuaaa

SEQ ID NO: 1812661 - RNA, 21 nt, Human
uaaaagguaugcaaucaaauc

SEQ ID NO: 1812662 - RNA, 12 nt, Human
uaaaaggagcca

SEQ ID NO: 1812663 - RNA, 19 nt, Human
uaaaaggugaccaaugaug

SEQ ID NO: 1812664 - RNA, 12 nt, Human
uaaaaggugacc

SEQ ID NO: 1812665 - RNA, 12 nt, Human
guuuucacucuu

SEQ ID NO: 1812666 - RNA, 11 nt, Human
guuuucacucu

SEQ ID NO: 1812667 - RNA, 24 nt, Human
guuuucaggaguggguugauuuca

SEQ ID NO: 1812668 - RNA, 17 nt, Human
guuuuaaaaugagaaau

SEQ ID NO: 1812669 - RNA, 20 nt, Human
guuuucaaaauuguuacaaa

SEQ ID NO: 1812670 - RNA, 17 nt, Human
guuuucaaaauaaaaau

SEQ ID NO: 1812671 - RNA, 20 nt, Human
guuuguuucugaaagggacg

SEQ ID NO: 1812672 - RNA, 15 nt, Human
guuuuaaaaugagaa

SEQ ID NO: 1812673 - RNA, 16 nt, Human
guuuuaaaaugagaaa

SEQ ID NO: 1812674 - RNA, 14 nt, Human
guuuuguaaauuuc

SEQ ID NO: 1812675 - RNA, 12 nt, Human
guuuuguaaauu

SEQ ID NO: 1812676 - RNA, 13 nt, Human
guuuuccugaaga

SEQ ID NO: 1812677 - RNA, 20 nt, Human
guuuuccagguuuaagcugu

SEQ ID NO: 1812678 - RNA, 19 nt, Human
guuuuccaugaguccccug

SEQ ID NO: 1812679 - RNA, 20 nt, Human
guuuuccaugaguccccugu

SEQ ID NO: 1812680 - RNA, 18 nt, Human
guuuguuucugaaaggga

SEQ ID NO: 1812681 - RNA, 16 nt, Human
guuugauucagacagc

SEQ ID NO: 1812682 - RNA, 20 nt, Human
guuugauucagacagcugcc

SEQ ID NO: 1812683 - RNA, 21 nt, Human
guuugauucagacagcugccu

SEQ ID NO: 1812684 - RNA, 17 nt, Human
guuugagaucagccugg

SEQ ID NO: 1812685 - RNA, 23 nt, Human
guuugauuaaauucuugcaaagu

SEQ ID NO: 1812686 - RNA, 18 nt, Human
guuugagaucagccuggg

SEQ ID NO: 1812687 - RNA, 19 nt, Human
guuucuuuguaaugaaaac

SEQ ID NO: 1812688 - RNA, 16 nt, Human
guuucuuuaguuuuug

SEQ ID NO: 1812689 - RNA, 18 nt, Human
guuucuuuguaaugaaaa

SEQ ID NO: 1812690 - RNA, 12 nt, Human
guuggcuggggg

SEQ ID NO: 1812691 - RNA, 14 nt, Human
guuggccccugccc

SEQ ID NO: 1812692 - RNA, 13 nt, Human
guuggccccugcc

SEQ ID NO: 1812693 - RNA, 20 nt, Human
guuggccccugcccggcugc

SEQ ID NO: 1812694 - RNA, 19 nt, Human
guuggcugggggccucagu

SEQ ID NO: 1812695 - RNA, 23 nt, Human
guuggcugggggccucagugcca

SEQ ID NO: 1812696 - RNA, 18 nt, Human
guugucaagaauagcauu

SEQ ID NO: 1812697 - RNA, 14 nt, Human
guugucaagaauag

SEQ ID NO: 1812698 - RNA, 22 nt, Human
guugucaagaauagcauuguaa

SEQ ID NO: 1812699 - RNA, 12 nt, Human
guugucagcuga

SEQ ID NO: 1812700 - RNA, 15 nt, Human
guuguuaauaaaagu

SEQ ID NO: 1812701 - RNA, 22 nt, Human
guuguggauuuaacagaaaugu

SEQ ID NO: 1812702 - RNA, 14 nt, Human
guugugguuaaucu

SEQ ID NO: 1812703 - RNA, 19 nt, Human
guugucugaagucacugca

SEQ ID NO: 1812704 - RNA, 22 nt, Human
guugucugaagucacugcacag

SEQ ID NO: 1812705 - RNA, 15 nt, Human
guuuagauaauacac

SEQ ID NO: 1812706 - RNA, 14 nt, Human
guuuagauaauaca

SEQ ID NO: 1812707 - RNA, 20 nt, Human
guuguuugauucagacagcu

SEQ ID NO: 1812708 - RNA, 15 nt, Human
guuguuacauuuuua

SEQ ID NO: 1812709 - RNA, 14 nt, Human
guuguuacauuuuu

SEQ ID NO: 1812710 - RNA, 20 nt, Human
guuuaggauguugaaaaagu

SEQ ID NO: 1812711 - RNA, 19 nt, Human
guuuaggaacuacugagga

SEQ ID NO: 1812712 - RNA, 16 nt, Human
guugcaacuuuguaua

SEQ ID NO: 1812713 - RNA, 23 nt, Human
guugauuucagcaccuacagugu

SEQ ID NO: 1812714 - RNA, 14 nt, Human
guugcaacuuugua

SEQ ID NO: 1812715 - RNA, 15 nt, Human
guugcaggaccucag

SEQ ID NO: 1812716 - RNA, 16 nt, Human
guugaagacagagcua

SEQ ID NO: 1812717 - RNA, 13 nt, Human
guugaagccuuug

SEQ ID NO: 1812718 - RNA, 14 nt, Human
guugaagccuuugu

SEQ ID NO: 1812719 - RNA, 14 nt, Human
guugauuaaagaug

SEQ ID NO: 1812720 - RNA, 14 nt, Human
guuggauuuuuguc

SEQ ID NO: 1812721 - RNA, 14 nt, Human
guuggcaaaaaggc

SEQ ID NO: 1812722 - RNA, 20 nt, Human
guuggauuuuugucuugugu

SEQ ID NO: 1812723 - RNA, 18 nt, Human
guuggcaaaaaggcagga

SEQ ID NO: 1812724 - RNA, 23 nt, Human
guuggccaaagccaaagcuaggc

SEQ ID NO: 1812725 - RNA, 14 nt, Human
guuggccaguguga

SEQ ID NO: 1812726 - RNA, 19 nt, Human
guuggccaggcuggucuca

SEQ ID NO: 1812727 - RNA, 17 nt, Human
guuggccaggcuggucu

SEQ ID NO: 1812728 - RNA, 19 nt, Human
guuggccaggcugcucuug

SEQ ID NO: 1812729 - RNA, 18 nt, Human
guuggccaggcuggucuc

SEQ ID NO: 1812730 - RNA, 14 nt, Human
guuggccaggcugg

SEQ ID NO: 1812731 - RNA, 15 nt, Human
guuggccaggcuggu

SEQ ID NO: 1812732 - RNA, 13 nt, Human
guuggccaggcug

SEQ ID NO: 1812733 - RNA, 14 nt, Human
guuggccaggcugc

SEQ ID NO: 1812734 - RNA, 14 nt, Human
guugcccaggcagg

SEQ ID NO: 1812735 - RNA, 15 nt, Human
guugcccaggcaggu

SEQ ID NO: 1812736 - RNA, 12 nt, Human
guugcccaggca

SEQ ID NO: 1812737 - RNA, 13 nt, Human
guugccagucacc

SEQ ID NO: 1812738 - RNA, 14 nt, Human
guugccagucaccc

SEQ ID NO: 1812739 - RNA, 16 nt, Human
guugccagucaccccg

SEQ ID NO: 1812740 - RNA, 17 nt, Human
guugccagucaccccgg

SEQ ID NO: 1812741 - RNA, 18 nt, Human
guugccagucaccccggc

SEQ ID NO: 1812742 - RNA, 23 nt, Human
guugccagucaccccggccaccu

SEQ ID NO: 1812743 - RNA, 15 nt, Human
guucugcacacagca

SEQ ID NO: 1812744 - RNA, 16 nt, Human
guucugcacacagcac

SEQ ID NO: 1812745 - RNA, 19 nt, Human
guucugauccuaguuccac

SEQ ID NO: 1812746 - RNA, 18 nt, Human
guuccuuccucugagccu

SEQ ID NO: 1812747 - RNA, 19 nt, Human
guuccuuccucugagccuu

SEQ ID NO: 1812748 - RNA, 17 nt, Human
guuccuuccucugagcc

SEQ ID NO: 1812749 - RNA, 23 nt, Human
guucuaaagauggaaaaaccacc

SEQ ID NO: 1812750 - RNA, 20 nt, Human
guucuaaagauggaaaaacc

SEQ ID NO: 1812751 - RNA, 17 nt, Human
guucuaaagauggaaaa

SEQ ID NO: 1812752 - RNA, 14 nt, Human
guucuaaagaugga

SEQ ID NO: 1812753 - RNA, 23 nt, Human
guucugggacacaguucaauucu

SEQ ID NO: 1812754 - RNA, 18 nt, Human
guucuuucacccuuuucu

SEQ ID NO: 1812755 - RNA, 16 nt, Human
guucugggacacaguu

SEQ ID NO: 1812756 - RNA, 15 nt, Human
guucugggacacagu

SEQ ID NO: 1812757 - RNA, 14 nt, Human
guucugggacacag

SEQ ID NO: 1812758 - RNA, 12 nt, Human
guucugggacac

SEQ ID NO: 1812759 - RNA, 11 nt, Human
guucugggaca

SEQ ID NO: 1812760 - RNA, 23 nt, Human
guucuggcagaguugaagacaga

SEQ ID NO: 1812761 - RNA, 12 nt, Human
guucuggcucuu

SEQ ID NO: 1812762 - RNA, 16 nt, Human
guucuggcucuuccag

SEQ ID NO: 1812763 - RNA, 20 nt, Human
guucuggcucuuccaggcug

SEQ ID NO: 1812764 - RNA, 16 nt, Human
guucuuucuuccucug

SEQ ID NO: 1812765 - RNA, 17 nt, Human
guucuuucuuccucugc

SEQ ID NO: 1812766 - RNA, 18 nt, Human
guucuuucuuccucugcu

SEQ ID NO: 1812767 - RNA, 19 nt, Human
guucuuucuuccucugcug

SEQ ID NO: 1812768 - RNA, 22 nt, Human
guucuuucauuugcuuuggaag

SEQ ID NO: 1812769 - RNA, 20 nt, Human
guucuuucauuugcuuugga

SEQ ID NO: 1812770 - RNA, 14 nt, Human
guucuuucuuccuc

SEQ ID NO: 1812771 - RNA, 15 nt, Human
guucuuucuuccucu

SEQ ID NO: 1812772 - RNA, 20 nt, Human
guucuuuccaaaguacacug

SEQ ID NO: 1812773 - RNA, 18 nt, Human
guucuuuccaaaguacac

SEQ ID NO: 1812774 - RNA, 14 nt, Human
guucuuuccaaagu

SEQ ID NO: 1812775 - RNA, 13 nt, Human
guucuuuccaaag

SEQ ID NO: 1812776 - RNA, 17 nt, Human
guugaaaaacagcugag

SEQ ID NO: 1812777 - RNA, 23 nt, Human
guuccuccccuccuccuggacuc

SEQ ID NO: 1812778 - RNA, 14 nt, Human
guuccuaauccucu

SEQ ID NO: 1812779 - RNA, 23 nt, Human
guuccuagugauggcuuaugaua

SEQ ID NO: 1812780 - RNA, 22 nt, Human
guuccucauuagcauuuugcua

SEQ ID NO: 1812781 - RNA, 23 nt, Human
guuccagcaauucuccugccuca

SEQ ID NO: 1812782 - RNA, 14 nt, Human
guuccacugagacc

SEQ ID NO: 1812783 - RNA, 20 nt, Human
guuccagcaauucuccugcc

SEQ ID NO: 1812784 - RNA, 21 nt, Human
guuccagcaauucuccugccu

SEQ ID NO: 1812785 - RNA, 13 nt, Human
guuccacugagac

SEQ ID NO: 1812786 - RNA, 12 nt, Human
guuccacugaga

SEQ ID NO: 1812787 - RNA, 14 nt, Human
guuccacagaggac

SEQ ID NO: 1812788 - RNA, 17 nt, Human
guuccaccaucaagcca

SEQ ID NO: 1812789 - RNA, 20 nt, Human
guuccaccaucaagccacca

SEQ ID NO: 1812790 - RNA, 17 nt, Human
guucaucauccuaagcu

SEQ ID NO: 1812791 - RNA, 16 nt, Human
guucaucaaugaauga

SEQ ID NO: 1812792 - RNA, 18 nt, Human
guucaucuugaauuguaa

SEQ ID NO: 1812793 - RNA, 12 nt, Human
guucaucuugaa

SEQ ID NO: 1812794 - RNA, 13 nt, Human
guucaucuugaau

SEQ ID NO: 1812795 - RNA, 19 nt, Human
guucacugcaaccuccgcc

SEQ ID NO: 1812796 - RNA, 24 nt, Human
guucacucuacuuagcaugucccu

SEQ ID NO: 1812797 - RNA, 15 nt, Human
guuacucagaauucu

SEQ ID NO: 1812798 - RNA, 22 nt, Human
guuacuaaguuuuuauggcuuu

SEQ ID NO: 1812799 - RNA, 16 nt, Human
guuaguuccacugaga

SEQ ID NO: 1812800 - RNA, 22 nt, Human
guuaguuucuccaagcaggaca

SEQ ID NO: 1812801 - RNA, 16 nt, Human
guuaguuucuccaagc

SEQ ID NO: 1812802 - RNA, 19 nt, Human
guuaguuucuccaagcagg

SEQ ID NO: 1812803 - RNA, 23 nt, Human
guuaccauuuugggguacccacu

SEQ ID NO: 1812804 - RNA, 21 nt, Human
guuacauuuuuaagugcugca

SEQ ID NO: 1812805 - RNA, 15 nt, Human
guuacagacaaagcg

SEQ ID NO: 1812806 - RNA, 17 nt, Human
guuacagacaaagcgug

SEQ ID NO: 1812807 - RNA, 18 nt, Human
guuacauaagauaaaugu

SEQ ID NO: 1812808 - RNA, 19 nt, Human
guuacauaagauaaaugug

SEQ ID NO: 1812809 - RNA, 17 nt, Human
guuauuauauuuacaaa

SEQ ID NO: 1812810 - RNA, 19 nt, Human
guucaagcgauucuucugc

SEQ ID NO: 1812811 - RNA, 19 nt, Human
guuauuaaaaaucucaaau

SEQ ID NO: 1812812 - RNA, 23 nt, Human
guucaagugauucucaugccuca

SEQ ID NO: 1812813 - RNA, 20 nt, Human
guucaagcgauucuucugcu

SEQ ID NO: 1812814 - RNA, 16 nt, Human
guucaauucucauuug

SEQ ID NO: 1812815 - RNA, 23 nt, Human
guucaauucucauuugucacaca

SEQ ID NO: 1812816 - RNA, 21 nt, Human
guuaugacuccagaauuuccc

SEQ ID NO: 1812817 - RNA, 23 nt, Human
guggguuucuaaagcugccagcc

SEQ ID NO: 1812818 - RNA, 17 nt, Human
guggggcagcuugaggg

SEQ ID NO: 1812819 - RNA, 13 nt, Human
guggggcagcuug

SEQ ID NO: 1812820 - RNA, 15 nt, Human
guggggaccucaggc

SEQ ID NO: 1812821 - RNA, 18 nt, Human
guggggaccucaggccug

SEQ ID NO: 1812822 - RNA, 13 nt, Human
guggggaggggcu

SEQ ID NO: 1812823 - RNA, 15 nt, Human
gugggcuaguugggc

SEQ ID NO: 1812824 - RNA, 12 nt, Human
gugggcuaagca

SEQ ID NO: 1812825 - RNA, 18 nt, Human
gugggcgugagaccugcc

SEQ ID NO: 1812826 - RNA, 21 nt, Human
gugggcgugagaccugccccu

SEQ ID NO: 1812827 - RNA, 22 nt, Human
gugggcgugagaccugccccuc

SEQ ID NO: 1812828 - RNA, 19 nt, Human
gugggccuucagggaguga

SEQ ID NO: 1812829 - RNA, 17 nt, Human
gugggcccaaugcacuu

SEQ ID NO: 1812830 - RNA, 22 nt, Human
guggcuuaaaacaacacucaca

SEQ ID NO: 1812831 - RNA, 18 nt, Human
guggcuucccgcucagcc

SEQ ID NO: 1812832 - RNA, 19 nt, Human
guggcuucccgcucagccc

SEQ ID NO: 1812833 - RNA, 20 nt, Human
guggcuucccgcucagcccu

SEQ ID NO: 1812834 - RNA, 19 nt, Human
guggcuggguuggagggug

SEQ ID NO: 1812835 - RNA, 23 nt, Human
guggcugcuucaaggauccugag

SEQ ID NO: 1812836 - RNA, 15 nt, Human
guggcugcuucaagg

SEQ ID NO: 1812837 - RNA, 16 nt, Human
guggcugcuucaagga

SEQ ID NO: 1812838 - RNA, 19 nt, Human
guggcugcuucaaggaucc

SEQ ID NO: 1812839 - RNA, 22 nt, Human
guggcugcuucaaggauccuga

SEQ ID NO: 1812840 - RNA, 13 nt, Human
guggcuccucccg

SEQ ID NO: 1812841 - RNA, 20 nt, Human
guggcuccucccggugccca

SEQ ID NO: 1812842 - RNA, 12 nt, Human
guggcugcuuca

SEQ ID NO: 1812843 - RNA, 14 nt, Human
guggcugcuucaag

SEQ ID NO: 1812844 - RNA, 13 nt, Human
gugcuaauuuuga

SEQ ID NO: 1812845 - RNA, 15 nt, Human
gugcuaauuuugaaa

SEQ ID NO: 1812846 - RNA, 14 nt, Human
guggcucacgccug

SEQ ID NO: 1812847 - RNA, 18 nt, Human
gugucccugcacuugcag

SEQ ID NO: 1812848 - RNA, 16 nt, Human
gugucccugcacuugc

SEQ ID NO: 1812849 - RNA, 13 nt, Human
gugucccugcacu

SEQ ID NO: 1812850 - RNA, 22 nt, Human
guguacagucuuguauuaaguu

SEQ ID NO: 1812851 - RNA, 16 nt, Human
guguacagucuuguau

SEQ ID NO: 1812852 - RNA, 13 nt, Human
guguacagucuug

SEQ ID NO: 1812853 - RNA, 17 nt, Human
guguacauggaauaaca

SEQ ID NO: 1812854 - RNA, 22 nt, Human
guguacauggaauaacauguaa

SEQ ID NO: 1812855 - RNA, 14 nt, Human
gugguauagaaaug

SEQ ID NO: 1812856 - RNA, 19 nt, Human
gugguaugaucacggcuca

SEQ ID NO: 1812857 - RNA, 17 nt, Human
gugguagagugugccug

SEQ ID NO: 1812858 - RNA, 14 nt, Human
guggucccacccca

SEQ ID NO: 1812859 - RNA, 15 nt, Human
guggucccaccccac

SEQ ID NO: 1812860 - RNA, 16 nt, Human
guggucccaccccaca

SEQ ID NO: 1812861 - RNA, 17 nt, Human
guggucccaccccacac

SEQ ID NO: 1812862 - RNA, 18 nt, Human
gugguccuaaucuucuga

SEQ ID NO: 1812863 - RNA, 17 nt, Human
guggugaccucugccug

SEQ ID NO: 1812864 - RNA, 14 nt, Human
guggugaccucugc

SEQ ID NO: 1812865 - RNA, 21 nt, Human
guggugagaggcauccaguau

SEQ ID NO: 1812866 - RNA, 19 nt, Human
guggugcgaucuggguuca

SEQ ID NO: 1812867 - RNA, 21 nt, Human
guguaaguauucuuauuuaau

SEQ ID NO: 1812868 - RNA, 19 nt, Human
guuaaacuuacuuaguguu

SEQ ID NO: 1812869 - RNA, 18 nt, Human
guuaaaggugaacauugg

SEQ ID NO: 1812870 - RNA, 22 nt, Human
guuaaaauaccagccaguaaau

SEQ ID NO: 1812871 - RNA, 20 nt, Human
guuaaaaacagauuuggaaa

SEQ ID NO: 1812872 - RNA, 18 nt, Human
guuaacugagugccuuuu

SEQ ID NO: 1812873 - RNA, 16 nt, Human
guuacacauuuuucag

SEQ ID NO: 1812874 - RNA, 15 nt, Human
guuacacuaaaaggu

SEQ ID NO: 1812875 - RNA, 16 nt, Human
guuacacuaaaaggug

SEQ ID NO: 1812876 - RNA, 17 nt, Human
guuacacauuuuucaga

SEQ ID NO: 1812877 - RNA, 22 nt, Human
guuacacuuuuuggaagugaaa

SEQ ID NO: 1812878 - RNA, 18 nt, Human
guuacacuuuuuggaagu

SEQ ID NO: 1812879 - RNA, 17 nt, Human
guuacacuuuuuggaag

SEQ ID NO: 1812880 - RNA, 13 nt, Human
guuacagacaaag

SEQ ID NO: 1812881 - RNA, 14 nt, Human
guguuacuaaguuu

SEQ ID NO: 1812882 - RNA, 12 nt, Human
guguuacuaagu

SEQ ID NO: 1812883 - RNA, 18 nt, Human
guguuaugacuccagaau

SEQ ID NO: 1812884 - RNA, 14 nt, Human
guguguuuuucaua

SEQ ID NO: 1812885 - RNA, 13 nt, Human
guguguuuuaaaa

SEQ ID NO: 1812886 - RNA, 16 nt, Human
guguguuuuaaaauga

SEQ ID NO: 1812887 - RNA, 19 nt, Human
guguguuuuaaaaugagaa

SEQ ID NO: 1812888 - RNA, 18 nt, Human
guguuuuucauaaagcag

SEQ ID NO: 1812889 - RNA, 13 nt, Human
guguucugugaua

SEQ ID NO: 1812890 - RNA, 23 nt, Human
gugucccugcacuugcagacucu

SEQ ID NO: 1812891 - RNA, 14 nt, Human
guguccggucccug

SEQ ID NO: 1812892 - RNA, 20 nt, Human
guguccuccugggguucuuu

SEQ ID NO: 1812893 - RNA, 15 nt, Human
gugucgggcaugaca

SEQ ID NO: 1812894 - RNA, 19 nt, Human
gugucuaggcaggaccugu

SEQ ID NO: 1812895 - RNA, 17 nt, Human
gugucucccuucauccu

SEQ ID NO: 1812896 - RNA, 14 nt, Human
gugucucuuggucc

SEQ ID NO: 1812897 - RNA, 20 nt, Human
gugugagucaccaagcccag

SEQ ID NO: 1812898 - RNA, 22 nt, Human
gugucucuugguccugcugcag

SEQ ID NO: 1812899 - RNA, 18 nt, Human
gugucucuugguccugcu

SEQ ID NO: 1812900 - RNA, 19 nt, Human
gugucucuugguccugcug

SEQ ID NO: 1812901 - RNA, 20 nt, Human
gugucucuugguccugcugc

SEQ ID NO: 1812902 - RNA, 21 nt, Human
gugucucuugguccugcugca

SEQ ID NO: 1812903 - RNA, 22 nt, Human
gugugcucugaucauccacugu

SEQ ID NO: 1812904 - RNA, 15 nt, Human
gugugcucugaucau

SEQ ID NO: 1812905 - RNA, 12 nt, Human
gugugcucugau

SEQ ID NO: 1812906 - RNA, 18 nt, Human
gugugcucaggagcccug

SEQ ID NO: 1812907 - RNA, 19 nt, Human
gugugcucaggagcccugg

SEQ ID NO: 1812908 - RNA, 16 nt, Human
gugugcucaggagccc

SEQ ID NO: 1812909 - RNA, 17 nt, Human
gugugcucaggagcccu

SEQ ID NO: 1812910 - RNA, 15 nt, Human
guguguuucugaucu

SEQ ID NO: 1812911 - RNA, 12 nt, Human
guguguuuuaaa

SEQ ID NO: 1812912 - RNA, 21 nt, Human
guguggagaagcggcuggcag

SEQ ID NO: 1812913 - RNA, 13 nt, Human
guguggagaagcg

SEQ ID NO: 1812914 - RNA, 12 nt, Human
gugauuuucauu

SEQ ID NO: 1812915 - RNA, 18 nt, Human
gugauuuuuguaauuuuu

SEQ ID NO: 1812916 - RNA, 13 nt, Human
gugauuuuuguaa

SEQ ID NO: 1812917 - RNA, 24 nt, Human
gugauccacccaccucagccuccc

SEQ ID NO: 1812918 - RNA, 23 nt, Human
gugauccacccaccucagccucc

SEQ ID NO: 1812919 - RNA, 13 nt, Human
gugcaucucagcc

SEQ ID NO: 1812920 - RNA, 14 nt, Human
gugcaucucagccc

SEQ ID NO: 1812921 - RNA, 22 nt, Human
gugcauaccacuuuuguucuug

SEQ ID NO: 1812922 - RNA, 23 nt, Human
gugcaguggugcgaucuggguuc

SEQ ID NO: 1812923 - RNA, 20 nt, Human
gugcaguggugcgaucuggg

SEQ ID NO: 1812924 - RNA, 14 nt, Human
gugcgccuacagga

SEQ ID NO: 1812925 - RNA, 14 nt, Human
gugcggccuuuggc

SEQ ID NO: 1812926 - RNA, 21 nt, Human
gugcgaucuggguucacugca

SEQ ID NO: 1812927 - RNA, 15 nt, Human
gugccuucagcucua

SEQ ID NO: 1812928 - RNA, 16 nt, Human
gugccaugugccaggu

SEQ ID NO: 1812929 - RNA, 14 nt, Human
gugccaugugccag

SEQ ID NO: 1812930 - RNA, 20 nt, Human
gugcccaagaauagaugcug

SEQ ID NO: 1812931 - RNA, 19 nt, Human
gugagccgagaucacgcca

SEQ ID NO: 1812932 - RNA, 18 nt, Human
gugaggagcuugaaaccc

SEQ ID NO: 1812933 - RNA, 17 nt, Human
gugaggaugaaaaaaua

SEQ ID NO: 1812934 - RNA, 20 nt, Human
gugagccacugcaccgggcc

SEQ ID NO: 1812935 - RNA, 15 nt, Human
gugagccacugcacc

SEQ ID NO: 1812936 - RNA, 17 nt, Human
gugauacaaugcugugc

SEQ ID NO: 1812937 - RNA, 15 nt, Human
gugauacaaugcugu

SEQ ID NO: 1812938 - RNA, 17 nt, Human
gugaguugauagcacag

SEQ ID NO: 1812939 - RNA, 19 nt, Human
gugauauaaguguguguuu

SEQ ID NO: 1812940 - RNA, 22 nt, Human
gugauccacccaccucagccuc

SEQ ID NO: 1812941 - RNA, 21 nt, Human
gugaacaaauuuacagagaca

SEQ ID NO: 1812942 - RNA, 20 nt, Human
gugacaaggauugcuacugu

SEQ ID NO: 1812943 - RNA, 21 nt, Human
gugaaugaugauccuaggcau

SEQ ID NO: 1812944 - RNA, 15 nt, Human
gugaccucugccuga

SEQ ID NO: 1812945 - RNA, 14 nt, Human
gugaccucugccug

SEQ ID NO: 1812946 - RNA, 13 nt, Human
gugaccucugccu

SEQ ID NO: 1812947 - RNA, 15 nt, Human
gugacagaggcagcc

SEQ ID NO: 1812948 - RNA, 12 nt, Human
gugaccucugcc

SEQ ID NO: 1812949 - RNA, 14 nt, Human
gugacagaggcagc

SEQ ID NO: 1812950 - RNA, 13 nt, Human
gugacagaggcag

SEQ ID NO: 1812951 - RNA, 12 nt, Human
gugacagaggca

SEQ ID NO: 1812952 - RNA, 19 nt, Human
gucuguugauuaaagauga

SEQ ID NO: 1812953 - RNA, 16 nt, Human
gucuguugauuaaaga

SEQ ID NO: 1812954 - RNA, 13 nt, Human
gucuguugauuaa

SEQ ID NO: 1812955 - RNA, 17 nt, Human
gucuguucuuuccaaag

SEQ ID NO: 1812956 - RNA, 14 nt, Human
gucuguucuuucca

SEQ ID NO: 1812957 - RNA, 21 nt, Human
gucugugagaugcuagaacuc

SEQ ID NO: 1812958 - RNA, 17 nt, Human
gucugugagaugcuaga

SEQ ID NO: 1812959 - RNA, 16 nt, Human
gucugugagaugcuag

SEQ ID NO: 1812960 - RNA, 15 nt, Human
gucugugagaugcua

SEQ ID NO: 1812961 - RNA, 18 nt, Human
gucugugccauuuuguau

SEQ ID NO: 1812962 - RNA, 23 nt, Human
gucugugagaugcuagaacuccc

SEQ ID NO: 1812963 - RNA, 22 nt, Human
gucugugagaugcuagaacucc

SEQ ID NO: 1812964 - RNA, 21 nt, Human
gucuugcaauggcagccuugg

SEQ ID NO: 1812965 - RNA, 20 nt, Human
gucuugcaauggcagccuug

SEQ ID NO: 1812966 - RNA, 23 nt, Human
gucuugcaauggcagccuuggca

SEQ ID NO: 1812967 - RNA, 16 nt, Human
gucuuuuuucacuaca

SEQ ID NO: 1812968 - RNA, 17 nt, Human
gucuugaacuccuggcc

SEQ ID NO: 1812969 - RNA, 16 nt, Human
gucuugaacuccuggc

SEQ ID NO: 1812970 - RNA, 21 nt, Human
gucuuaaaaaguggaaaaaua

SEQ ID NO: 1812971 - RNA, 19 nt, Human
gucuugcaauggcagccuu

SEQ ID NO: 1812972 - RNA, 18 nt, Human
gucuugcaauggcagccu

SEQ ID NO: 1812973 - RNA, 17 nt, Human
gucuugcaauggcagcc

SEQ ID NO: 1812974 - RNA, 16 nt, Human
gucuugcaauggcagc

SEQ ID NO: 1812975 - RNA, 20 nt, Human
gucuugaacuccuggccuca

SEQ ID NO: 1812976 - RNA, 18 nt, Human
gucuugaacuccuggccu

SEQ ID NO: 1812977 - RNA, 21 nt, Human
gucuugaacuccuggccucaa

SEQ ID NO: 1812978 - RNA, 18 nt, Human
gucgucaaagcugaaaug

SEQ ID NO: 1812979 - RNA, 19 nt, Human
gucucacuauguugcccag

SEQ ID NO: 1812980 - RNA, 11 nt, Human
gucucacucug

SEQ ID NO: 1812981 - RNA, 18 nt, Human
gucucacuauguugccca

SEQ ID NO: 1812982 - RNA, 15 nt, Human
gucccugccaaugga

SEQ ID NO: 1812983 - RNA, 11 nt, Human
gucccugccaa

SEQ ID NO: 1812984 - RNA, 14 nt, Human
gucccugccaaugg

SEQ ID NO: 1812985 - RNA, 21 nt, Human
guccuuaccagcagagcaccu

SEQ ID NO: 1812986 - RNA, 18 nt, Human
guccuuaccagcagagca

SEQ ID NO: 1812987 - RNA, 19 nt, Human
guccuuaccagcagagcac

SEQ ID NO: 1812988 - RNA, 21 nt, Human
gucggaaaacaugcuacacac

SEQ ID NO: 1812989 - RNA, 16 nt, Human
gucgggcaugacacga

SEQ ID NO: 1812990 - RNA, 22 nt, Human
gucucacucugucgcccagucu

SEQ ID NO: 1812991 - RNA, 19 nt, Human
gucucacucugucgcccag

SEQ ID NO: 1812992 - RNA, 18 nt, Human
gucucacucugucgccca

SEQ ID NO: 1812993 - RNA, 16 nt, Human
gucucacucugucgcc

SEQ ID NO: 1812994 - RNA, 15 nt, Human
gucucacucugucgc

SEQ ID NO: 1812995 - RNA, 19 nt, Human
gucucgugguaggacugua

SEQ ID NO: 1812996 - RNA, 17 nt, Human
gucucuggaauuugaaa

SEQ ID NO: 1812997 - RNA, 13 nt, Human
gucucugagcauu

SEQ ID NO: 1812998 - RNA, 21 nt, Human
gucucuggauuauauuaugaa

SEQ ID NO: 1812999 - RNA, 18 nt, Human
gucucuucuccacuggau

SEQ ID NO: 1813000 - RNA, 16 nt, Human
gucucugguuccuccc

SEQ ID NO: 1813001 - RNA, 17 nt, Human
gucucugguuccucccc

SEQ ID NO: 1813002 - RNA, 13 nt, Human
gucucuugguccu

SEQ ID NO: 1813003 - RNA, 22 nt, Human
gucagaugcugugcaaauguua

SEQ ID NO: 1813004 - RNA, 14 nt, Human
gucagagccugcag

SEQ ID NO: 1813005 - RNA, 16 nt, Human
gucagagccugcaguu

SEQ ID NO: 1813006 - RNA, 15 nt, Human
gucagagccugcagu

SEQ ID NO: 1813007 - RNA, 22 nt, Human
gucacucuggcagcucagagag

SEQ ID NO: 1813008 - RNA, 17 nt, Human
gucacucuggcagcuca

SEQ ID NO: 1813009 - RNA, 19 nt, Human
gucacucuggcagcucaga

SEQ ID NO: 1813010 - RNA, 12 nt, Human
gucacucuggca

SEQ ID NO: 1813011 - RNA, 13 nt, Human
gucacucuggcag

SEQ ID NO: 1813012 - RNA, 14 nt, Human
gucacucuggcagc

SEQ ID NO: 1813013 - RNA, 16 nt, Human
gucacucuggcagcuc

SEQ ID NO: 1813014 - RNA, 22 nt, Human
gucaccccggccaccugcggug

SEQ ID NO: 1813015 - RNA, 17 nt, Human
gucaccccggccaccug

SEQ ID NO: 1813016 - RNA, 18 nt, Human
gucaccccggccaccugc

SEQ ID NO: 1813017 - RNA, 13 nt, Human
guauuuuaaucac

SEQ ID NO: 1813018 - RNA, 22 nt, Human
guauuaaguuguuaauaaaagu

SEQ ID NO: 1813019 - RNA, 14 nt, Human
guauuuuacuaaua

SEQ ID NO: 1813020 - RNA, 15 nt, Human
gucaaugcagccccc

SEQ ID NO: 1813021 - RNA, 15 nt, Human
gucaagugaaaaagg

SEQ ID NO: 1813022 - RNA, 19 nt, Human
guauuuuguuuuugucuua

SEQ ID NO: 1813023 - RNA, 21 nt, Human
gucauucgcuacuaugauuua

SEQ ID NO: 1813024 - RNA, 21 nt, Human
guccacaguggaaccagccca

SEQ ID NO: 1813025 - RNA, 19 nt, Human
guccacaguggaaccagcc

SEQ ID NO: 1813026 - RNA, 16 nt, Human
guccacaguggaacca

SEQ ID NO: 1813027 - RNA, 21 nt, Human
gucccaccuuggcugcaggga

SEQ ID NO: 1813028 - RNA, 23 nt, Human
guccacccaggagccccgaggcc

SEQ ID NO: 1813029 - RNA, 12 nt, Human
guccacccagga

SEQ ID NO: 1813030 - RNA, 13 nt, Human
guccacccaggag

SEQ ID NO: 1813031 - RNA, 23 nt, Human
gucccaccuuggcugcagggagu

SEQ ID NO: 1813032 - RNA, 15 nt, Human
gucccaggcugagcc

SEQ ID NO: 1813033 - RNA, 16 nt, Human
gucccaggcugagccu

SEQ ID NO: 1813034 - RNA, 17 nt, Human
gucccaggcugagccuc

SEQ ID NO: 1813035 - RNA, 21 nt, Human
gucccaggcugagccucaguc

SEQ ID NO: 1813036 - RNA, 18 nt, Human
gucccaggcugagccuca

SEQ ID NO: 1813037 - RNA, 19 nt, Human
gucccaggcugagccucag

SEQ ID NO: 1813038 - RNA, 16 nt, Human
gucccuaauaaagcug

SEQ ID NO: 1813039 - RNA, 17 nt, Human
gucccuaauaaagcugu

SEQ ID NO: 1813040 - RNA, 17 nt, Human
guccccaccgcagacag

SEQ ID NO: 1813041 - RNA, 21 nt, Human
gucccugcacuugcagacucu

SEQ ID NO: 1813042 - RNA, 19 nt, Human
gucccugcacuugcagacu

SEQ ID NO: 1813043 - RNA, 16 nt, Human
gucccugcacuugcag

SEQ ID NO: 1813044 - RNA, 21 nt, Human
gucccuaccgagucucuucuc

SEQ ID NO: 1813045 - RNA, 22 nt, Human
gucccuaccgagucucuucucc

SEQ ID NO: 1813046 - RNA, 23 nt, Human
gucccuaccgagucucuucucca

SEQ ID NO: 1813047 - RNA, 18 nt, Human
gucccuaauaaagcugug

SEQ ID NO: 1813048 - RNA, 20 nt, Human
gucccuaauaaagcugugug

SEQ ID NO: 1813049 - RNA, 13 nt, Human
guauaugucucag

SEQ ID NO: 1813050 - RNA, 15 nt, Human
guauaugucucaggu

SEQ ID NO: 1813051 - RNA, 21 nt, Human
guauaugucucaggucccugc

SEQ ID NO: 1813052 - RNA, 16 nt, Human
guauauguugggugca

SEQ ID NO: 1813053 - RNA, 22 nt, Human
guauaugucaagccauaauugu

SEQ ID NO: 1813054 - RNA, 23 nt, Human
guauagaaaugcugguuuuucag

SEQ ID NO: 1813055 - RNA, 14 nt, Human
guauagaaaugcug

SEQ ID NO: 1813056 - RNA, 22 nt, Human
guauagaaaugcugguuuuuca

SEQ ID NO: 1813057 - RNA, 15 nt, Human
guauagaaaugcugg

SEQ ID NO: 1813058 - RNA, 15 nt, Human
guaugaggcauuugu

SEQ ID NO: 1813059 - RNA, 13 nt, Human
guaugaggcauuu

SEQ ID NO: 1813060 - RNA, 18 nt, Human
guaugaauaaagacaccu

SEQ ID NO: 1813061 - RNA, 19 nt, Human
guaugaauaaagacaccua

SEQ ID NO: 1813062 - RNA, 12 nt, Human
guaucugagcag

SEQ ID NO: 1813063 - RNA, 12 nt, Human
guaucuggugac

SEQ ID NO: 1813064 - RNA, 19 nt, Human
guaucuggugacuuuccuc

SEQ ID NO: 1813065 - RNA, 22 nt, Human
guaugaaagauggcugugccuc

SEQ ID NO: 1813066 - RNA, 23 nt, Human
guaugaaagauggcugugccucu

SEQ ID NO: 1813067 - RNA, 20 nt, Human
guaugaucacggcucacugc

SEQ ID NO: 1813068 - RNA, 24 nt, Human
guaugauagguuauuuugauguaa

SEQ ID NO: 1813069 - RNA, 20 nt, Human
guaugaggcauuuguuugaa

SEQ ID NO: 1813070 - RNA, 17 nt, Human
guaugaggcauuuguuu

SEQ ID NO: 1813071 - RNA, 21 nt, Human
guaugaucacggcucacugca

SEQ ID NO: 1813072 - RNA, 17 nt, Human
guauguugaagccuuug

SEQ ID NO: 1813073 - RNA, 17 nt, Human
guagggugggccuucag

SEQ ID NO: 1813074 - RNA, 22 nt, Human
guagggugggccuucagggagu

SEQ ID NO: 1813075 - RNA, 16 nt, Human
guaggguuauaauaau

SEQ ID NO: 1813076 - RNA, 14 nt, Human
guagggugggccuu

SEQ ID NO: 1813077 - RNA, 22 nt, Human
guaguaugauagguuauuuuga

SEQ ID NO: 1813078 - RNA, 14 nt, Human
guagucaggugccu

SEQ ID NO: 1813079 - RNA, 17 nt, Human
guauaauucacauugua

SEQ ID NO: 1813080 - RNA, 15 nt, Human
guagagugugccuga

SEQ ID NO: 1813081 - RNA, 16 nt, Human
guagggcgggaggaug

SEQ ID NO: 1813082 - RNA, 22 nt, Human
guagggcgggaggauguucugg

SEQ ID NO: 1813083 - RNA, 21 nt, Human
guagggcgggaggauguucug

SEQ ID NO: 1813084 - RNA, 23 nt, Human
guagggcgggaggauguucuggg

SEQ ID NO: 1813085 - RNA, 17 nt, Human
uuaccacagacauacua

SEQ ID NO: 1813086 - RNA, 14 nt, Human
uuaccacagacaua

SEQ ID NO: 1813087 - RNA, 12 nt, Human
uuuccugcccug

SEQ ID NO: 1813088 - RNA, 13 nt, Human
uuuccugcccugg

SEQ ID NO: 1813089 - RNA, 16 nt, Human
uuuccugaggcugggc

SEQ ID NO: 1813090 - RNA, 23 nt, Human
uuucuacucgaguuacagacaaa

SEQ ID NO: 1813091 - RNA, 12 nt, Human
uuucuaaaguaa

SEQ ID NO: 1813092 - RNA, 14 nt, Human
uuucuaaaguaaaa

SEQ ID NO: 1813093 - RNA, 21 nt, Human
uuucuaaaggcuaccuuugua

SEQ ID NO: 1813094 - RNA, 20 nt, Human
uuucuaaaggcuaccuuugu

SEQ ID NO: 1813095 - RNA, 20 nt, Human
uuucuguucuuucuggcuau

SEQ ID NO: 1813096 - RNA, 18 nt, Human
uuugaaucaucaagucuu

SEQ ID NO: 1813097 - RNA, 22 nt, Human
uuugaagaugccgcauuuggau

SEQ ID NO: 1813098 - RNA, 19 nt, Human
uuugaacugauaaagauga

SEQ ID NO: 1813099 - RNA, 17 nt, Human
uuugaacugauaaagau

SEQ ID NO: 1813100 - RNA, 15 nt, Human
uuugaacugauaaag

SEQ ID NO: 1813101 - RNA, 14 nt, Human
uuugaacucuucaa

SEQ ID NO: 1813102 - RNA, 11 nt, Human
uuucuuccucu

SEQ ID NO: 1813103 - RNA, 13 nt, Human
uuucuuccucugc

SEQ ID NO: 1813104 - RNA, 13 nt, Human
uuucuucucccuc

SEQ ID NO: 1813105 - RNA, 14 nt, Human
uuucuuccucugcu

SEQ ID NO: 1813106 - RNA, 16 nt, Human
uuucuuccucugcuga

SEQ ID NO: 1813107 - RNA, 12 nt, Human
uuucuucucccu

SEQ ID NO: 1813108 - RNA, 23 nt, Human
uuucuuagggaaggauacaaaag

SEQ ID NO: 1813109 - RNA, 18 nt, Human
uuucuuagggaaggauac

SEQ ID NO: 1813110 - RNA, 20 nt, Human
uuuggagucagacagaugug

SEQ ID NO: 1813111 - RNA, 21 nt, Human
uuuggaauuuugugcccccau

SEQ ID NO: 1813112 - RNA, 22 nt, Human
uuuggugaacauugcaauagaa

SEQ ID NO: 1813113 - RNA, 23 nt, Human
uuuggugaacauugcaauagaaa

SEQ ID NO: 1813114 - RNA, 15 nt, Human
uuugcaucugaaaau

SEQ ID NO: 1813115 - RNA, 16 nt, Human
uuugcuuugugauuuu

SEQ ID NO: 1813116 - RNA, 15 nt, Human
uuugcuuugugauuu

SEQ ID NO: 1813117 - RNA, 14 nt, Human
uuuggaauuuugug

SEQ ID NO: 1813118 - RNA, 21 nt, Human
uuuguucuggcucuuccaggc

SEQ ID NO: 1813119 - RNA, 15 nt, Human
uuuuaaagaaaaguu

SEQ ID NO: 1813120 - RNA, 18 nt, Human
uuuuaaagacuuuuauga

SEQ ID NO: 1813121 - RNA, 14 nt, Human
uuuuaaagaaaagu

SEQ ID NO: 1813122 - RNA, 17 nt, Human
uuuuaaagaaugcucuu

SEQ ID NO: 1813123 - RNA, 21 nt, Human
uuuuaaucucuaacaguggac

SEQ ID NO: 1813124 - RNA, 21 nt, Human
uuuuaaaugcaccuggaauau

SEQ ID NO: 1813125 - RNA, 12 nt, Human
uuuuaaaugcac

SEQ ID NO: 1813126 - RNA, 11 nt, Human
uuuuaaaugca

SEQ ID NO: 1813127 - RNA, 11 nt, Human
uuuuuccuuca

SEQ ID NO: 1813128 - RNA, 20 nt, Human
uuuuuaagugaaaauauagc

SEQ ID NO: 1813129 - RNA, 13 nt, Human
uuuuuaagugaaa

SEQ ID NO: 1813130 - RNA, 11 nt, Human
uuuuuaaaugc

SEQ ID NO: 1813131 - RNA, 11 nt, Human
uuuuuccuuuu

SEQ ID NO: 1813132 - RNA, 19 nt, Human
uuuuuccuucagugccuua

SEQ ID NO: 1813133 - RNA, 13 nt, Human
uuuuuuguuucau

SEQ ID NO: 1813134 - RNA, 12 nt, Human
uuuuuuguuuca

SEQ ID NO: 1813135 - RNA, 20 nt, Human
uuuugacaaggggcaguggu

SEQ ID NO: 1813136 - RNA, 15 nt, Human
uuuuggucuguguga

SEQ ID NO: 1813137 - RNA, 14 nt, Human
uuuuggcugcugaa

SEQ ID NO: 1813138 - RNA, 18 nt, Human
uuuucuaaaguaaaaaca

SEQ ID NO: 1813139 - RNA, 19 nt, Human
uuuuguagagccagggucu

SEQ ID NO: 1813140 - RNA, 19 nt, Human
uuuuguaauaauaaagaau

SEQ ID NO: 1813141 - RNA, 17 nt, Human
uuuuguaauaauaaaga

SEQ ID NO: 1813142 - RNA, 16 nt, Human
uuuugucauauaagau

SEQ ID NO: 1813143 - RNA, 13 nt, Human
uuuugucuugugu

SEQ ID NO: 1813144 - RNA, 17 nt, Human
uuuuuaaagacagaguc

SEQ ID NO: 1813145 - RNA, 20 nt, Human
uuuuuaaagaaaaguuuugu

SEQ ID NO: 1813146 - RNA, 12 nt, Human
uuuuuaaagaaa

SEQ ID NO: 1813147 - RNA, 12 nt, Human
uuuuuaaagacu

SEQ ID NO: 1813148 - RNA, 13 nt, Human
uuuuuaaagacuu

SEQ ID NO: 1813149 - RNA, 18 nt, Human
uuuuuaaagacuuuuaug

SEQ ID NO: 1813150 - RNA, 15 nt, Human
gccaggcuggucuca

SEQ ID NO: 1813151 - RNA, 23 nt, Human
gccaguaaaugggggugcauuug

SEQ ID NO: 1813152 - RNA, 13 nt, Human
gccaggcuggucu

SEQ ID NO: 1813153 - RNA, 23 nt, Human
gccaggcugggucgcccuggacu

SEQ ID NO: 1813154 - RNA, 17 nt, Human
gccaggcugggucgccc

SEQ ID NO: 1813155 - RNA, 14 nt, Human
gccauccagguuca

SEQ ID NO: 1813156 - RNA, 14 nt, Human
gccaugcuccuggc

SEQ ID NO: 1813157 - RNA, 16 nt, Human
gccaugggccuccugu

SEQ ID NO: 1813158 - RNA, 15 nt, Human
gccaugggccuccug

SEQ ID NO: 1813159 - RNA, 24 nt, Human
gccaugcuccuggcccacugcauc

SEQ ID NO: 1813160 - RNA, 21 nt, Human
gcccaagaauagaugcugacu

SEQ ID NO: 1813161 - RNA, 22 nt, Human
gcccaagaauagaugcugacug

SEQ ID NO: 1813162 - RNA, 24 nt, Human
gcccaaccugcucuccucuugcca

SEQ ID NO: 1813163 - RNA, 20 nt, Human
gcccacauagugaugguucc

SEQ ID NO: 1813164 - RNA, 17 nt, Human
gcccaccuuggcucaag

SEQ ID NO: 1813165 - RNA, 16 nt, Human
gcccaccuuggcucaa

SEQ ID NO: 1813166 - RNA, 15 nt, Human
gcccaccuuggcuca

SEQ ID NO: 1813167 - RNA, 13 nt, Human
gcccaccuuggcu

SEQ ID NO: 1813168 - RNA, 14 nt, Human
gcccacuucugcca

SEQ ID NO: 1813169 - RNA, 15 nt, Human
gcccaccuggccucu

SEQ ID NO: 1813170 - RNA, 16 nt, Human
gcccaccuggccucug

SEQ ID NO: 1813171 - RNA, 17 nt, Human
gcccaccuggccucugc

SEQ ID NO: 1813172 - RNA, 20 nt, Human
gcccaccuggccucugcacu

SEQ ID NO: 1813173 - RNA, 21 nt, Human
gcccaccuggccucugcacuc

SEQ ID NO: 1813174 - RNA, 24 nt, Human
gcccaccuggccucugcacucccc

SEQ ID NO: 1813175 - RNA, 22 nt, Human
gccacugcaccgggccacagag

SEQ ID NO: 1813176 - RNA, 21 nt, Human
gccagagacacaagccuucgg

SEQ ID NO: 1813177 - RNA, 22 nt, Human
gccagagacacaagccuucggc

SEQ ID NO: 1813178 - RNA, 21 nt, Human
gccacugcaccgggccacaga

SEQ ID NO: 1813179 - RNA, 20 nt, Human
gccacugcaccgggccacag

SEQ ID NO: 1813180 - RNA, 22 nt, Human
gccacuccagaccccuggcuuu

SEQ ID NO: 1813181 - RNA, 20 nt, Human
gccaaggccaaaggaagcac

SEQ ID NO: 1813182 - RNA, 21 nt, Human
gccacuccagaccccuggcuu

SEQ ID NO: 1813183 - RNA, 20 nt, Human
gccacuccagaccccuggcu

SEQ ID NO: 1813184 - RNA, 24 nt, Human
gccaaggccaaaggaagcacaugc

SEQ ID NO: 1813185 - RNA, 15 nt, Human
gccagaugcaccagc

SEQ ID NO: 1813186 - RNA, 20 nt, Human
gccagauucuuuccugaggc

SEQ ID NO: 1813187 - RNA, 24 nt, Human
gccagauucuuuccugaggcuggg

SEQ ID NO: 1813188 - RNA, 13 nt, Human
gccagauuucacu

SEQ ID NO: 1813189 - RNA, 22 nt, Human
gccagccgagauagccaaggcc

SEQ ID NO: 1813190 - RNA, 17 nt, Human
gccagagggagugacag

SEQ ID NO: 1813191 - RNA, 14 nt, Human
gccagaugcaccag

SEQ ID NO: 1813192 - RNA, 17 nt, Human
gccagcugcuugggcuu

SEQ ID NO: 1813193 - RNA, 18 nt, Human
gccagcugcuugggcuuc

SEQ ID NO: 1813194 - RNA, 20 nt, Human
gccagcugcuugggcuucau

SEQ ID NO: 1813195 - RNA, 12 nt, Human
gccaggaagcca

SEQ ID NO: 1813196 - RNA, 13 nt, Human
gccaggaagccag

SEQ ID NO: 1813197 - RNA, 14 nt, Human
gccaggaagccagc

SEQ ID NO: 1813198 - RNA, 13 nt, Human
gccagcuggagaa

SEQ ID NO: 1813199 - RNA, 15 nt, Human
gccaggaagccagca

SEQ ID NO: 1813200 - RNA, 19 nt, Human
gccaggagccuccugcccu

SEQ ID NO: 1813201 - RNA, 20 nt, Human
gccaggagccuccugcccuu

SEQ ID NO: 1813202 - RNA, 14 nt, Human
gccaggagccuccu

SEQ ID NO: 1813203 - RNA, 16 nt, Human
gccaggagccuccugc

SEQ ID NO: 1813204 - RNA, 12 nt, Human
gcccaggcuggc

SEQ ID NO: 1813205 - RNA, 23 nt, Human
gcccaggccccugccacccuggg

SEQ ID NO: 1813206 - RNA, 21 nt, Human
gcccagagaggguggugaccu

SEQ ID NO: 1813207 - RNA, 15 nt, Human
gcccaggcuggagug

SEQ ID NO: 1813208 - RNA, 20 nt, Human
gcccaggcuggagugcaaug

SEQ ID NO: 1813209 - RNA, 13 nt, Human
gcccaggccuccu

SEQ ID NO: 1813210 - RNA, 12 nt, Human
gccccagugccc

SEQ ID NO: 1813211 - RNA, 18 nt, Human
gccccaucccaaacccuu

SEQ ID NO: 1813212 - RNA, 19 nt, Human
gccccaguuguauuuauuu

SEQ ID NO: 1813213 - RNA, 21 nt, Human
gccccauaauuuuuuuuuucc

SEQ ID NO: 1813214 - RNA, 14 nt, Human
gccccagugcccac

SEQ ID NO: 1813215 - RNA, 13 nt, Human
gccccagugccca

SEQ ID NO: 1813216 - RNA, 15 nt, Human
gccccagugcccaca

SEQ ID NO: 1813217 - RNA, 14 nt, Human
gccccauucugccu

SEQ ID NO: 1813218 - RNA, 15 nt, Human
gccccauucugccug

SEQ ID NO: 1813219 - RNA, 13 nt, Human
gccccauccucug

SEQ ID NO: 1813220 - RNA, 14 nt, Human
gccccauccucugu

SEQ ID NO: 1813221 - RNA, 22 nt, Human
gccccauccucuguacagagcc

SEQ ID NO: 1813222 - RNA, 19 nt, Human
gcccuccaagaccuucucc

SEQ ID NO: 1813223 - RNA, 21 nt, Human
gcccuccaagaccuucuccuu

SEQ ID NO: 1813224 - RNA, 20 nt, Human
gcccuccaucuaaacugccc

SEQ ID NO: 1813225 - RNA, 21 nt, Human
gcccuccaucuaaacugcccc

SEQ ID NO: 1813226 - RNA, 22 nt, Human
gcccuccaagaccuucuccuuc

SEQ ID NO: 1813227 - RNA, 23 nt, Human
gcccuccaagaccuucuccuuca

SEQ ID NO: 1813228 - RNA, 21 nt, Human
gcccucccugccccucccuuc

SEQ ID NO: 1813229 - RNA, 13 nt, Human
gcccucugcccac

SEQ ID NO: 1813230 - RNA, 16 nt, Human
gcccucugcccacucc

SEQ ID NO: 1813231 - RNA, 18 nt, Human
gcccucugcccacucccu

SEQ ID NO: 1813232 - RNA, 19 nt, Human
gcccucugcccacucccug

SEQ ID NO: 1813233 - RNA, 14 nt, Human
gcccugagcuuucu

SEQ ID NO: 1813234 - RNA, 16 nt, Human
gcccugcagagggcac

SEQ ID NO: 1813235 - RNA, 15 nt, Human
gcccugcagagggca

SEQ ID NO: 1813236 - RNA, 13 nt, Human
gcccugcagaggg

SEQ ID NO: 1813237 - RNA, 14 nt, Human
gcccugcagagggc

SEQ ID NO: 1813238 - RNA, 22 nt, Human
gccccgaggccuucucugaagg

SEQ ID NO: 1813239 - RNA, 18 nt, Human
gccccgaggccuucucug

SEQ ID NO: 1813240 - RNA, 14 nt, Human
gccccucagggucc

SEQ ID NO: 1813241 - RNA, 15 nt, Human
gccccgaggccuucu

SEQ ID NO: 1813242 - RNA, 16 nt, Human
gccccucagggucccu

SEQ ID NO: 1813243 - RNA, 18 nt, Human
gccccucagggucccugg

SEQ ID NO: 1813244 - RNA, 12 nt, Human
gcccgacagccu

SEQ ID NO: 1813245 - RNA, 14 nt, Human
gcccgacagccugg

SEQ ID NO: 1813246 - RNA, 15 nt, Human
gcccgacagccuggc

SEQ ID NO: 1813247 - RNA, 17 nt, Human
gccccuguucuggcaga

SEQ ID NO: 1813248 - RNA, 21 nt, Human
gccuuccaggggugggacacc

SEQ ID NO: 1813249 - RNA, 15 nt, Human
gccuuccaggggugg

SEQ ID NO: 1813250 - RNA, 16 nt, Human
gccuuccagggguggg

SEQ ID NO: 1813251 - RNA, 23 nt, Human
gccuucgauacaccgggccugga

SEQ ID NO: 1813252 - RNA, 18 nt, Human
gccuucgauacaccgggc

SEQ ID NO: 1813253 - RNA, 22 nt, Human
gccuucgauacaccgggccugg

SEQ ID NO: 1813254 - RNA, 13 nt, Human
gccuucagggagu

SEQ ID NO: 1813255 - RNA, 21 nt, Human
gccuucagggagugagggauu

SEQ ID NO: 1813256 - RNA, 13 nt, Human
gccuucaucuccc

SEQ ID NO: 1813257 - RNA, 12 nt, Human
gccuuccagggg

SEQ ID NO: 1813258 - RNA, 16 nt, Human
gccuuauggaacacuc

SEQ ID NO: 1813259 - RNA, 18 nt, Human
gccuuauggaacacucug

SEQ ID NO: 1813260 - RNA, 19 nt, Human
gccuuauggaacacucuga

SEQ ID NO: 1813261 - RNA, 20 nt, Human
gccuuauggaacacucugag

SEQ ID NO: 1813262 - RNA, 22 nt, Human
gccuuuggaaacagcucgacuu

SEQ ID NO: 1813263 - RNA, 23 nt, Human
gcgacaaugcaaaccaucauuga

SEQ ID NO: 1813264 - RNA, 13 nt, Human
gccuuuggcuuca

SEQ ID NO: 1813265 - RNA, 22 nt, Human
gccugggggcugggcagaggaa

SEQ ID NO: 1813266 - RNA, 21 nt, Human
gccugguggcagcugcggucc

SEQ ID NO: 1813267 - RNA, 19 nt, Human
gccugguggcagcugcggu

SEQ ID NO: 1813268 - RNA, 18 nt, Human
gccugguggcagcugcgg

SEQ ID NO: 1813269 - RNA, 14 nt, Human
gccugguggcagcu

SEQ ID NO: 1813270 - RNA, 13 nt, Human
gccugguggcagc

SEQ ID NO: 1813271 - RNA, 10 nt, Human
gccuuaugga

SEQ ID NO: 1813272 - RNA, 14 nt, Human
gccuuauggaacac

SEQ ID NO: 1813273 - RNA, 18 nt, Human
gccuuagaagucacacag

SEQ ID NO: 1813274 - RNA, 17 nt, Human
gccuuagaagucacaca

SEQ ID NO: 1813275 - RNA, 19 nt, Human
gccuuagaagucacacagu

SEQ ID NO: 1813276 - RNA, 12 nt, Human
gccuguuuaaga

SEQ ID NO: 1813277 - RNA, 13 nt, Human
gccuguuuaagag

SEQ ID NO: 1813278 - RNA, 18 nt, Human
gccuuacccucauguucu

SEQ ID NO: 1813279 - RNA, 21 nt, Human
gccuuacacaaugguuuucuu

SEQ ID NO: 1813280 - RNA, 20 nt, Human
gccuuacacaaugguuuucu

SEQ ID NO: 1813281 - RNA, 13 nt, Human
gcuaagagggagg

SEQ ID NO: 1813282 - RNA, 21 nt, Human
gcuaagagggagggagggcuc

SEQ ID NO: 1813283 - RNA, 20 nt, Human
gcuaagagggagggagggcu

SEQ ID NO: 1813284 - RNA, 20 nt, Human
gcuacacacugcauguuugu

SEQ ID NO: 1813285 - RNA, 13 nt, Human
gcuacacacugca

SEQ ID NO: 1813286 - RNA, 14 nt, Human
gcuacacaggggaa

SEQ ID NO: 1813287 - RNA, 19 nt, Human
gcuaggaaauccagggugg

SEQ ID NO: 1813288 - RNA, 15 nt, Human
gcuaggaacacuccu

SEQ ID NO: 1813289 - RNA, 22 nt, Human
gcuaggaaauccaggguggugg

SEQ ID NO: 1813290 - RNA, 16 nt, Human
gcuaggaacacuccuu

SEQ ID NO: 1813291 - RNA, 20 nt, Human
gcuaccuuuguauucucucc

SEQ ID NO: 1813292 - RNA, 16 nt, Human
gcuaccuuuguauucu

SEQ ID NO: 1813293 - RNA, 19 nt, Human
gcuagaacucccuuucaac

SEQ ID NO: 1813294 - RNA, 12 nt, Human
gcgacagugaga

SEQ ID NO: 1813295 - RNA, 22 nt, Human
gcgacagugagacucugucuca

SEQ ID NO: 1813296 - RNA, 15 nt, Human
gcgccuacaggagug

SEQ ID NO: 1813297 - RNA, 18 nt, Human
gcgccuacaggagugagc

SEQ ID NO: 1813298 - RNA, 13 nt, Human
gcggacagccacg

SEQ ID NO: 1813299 - RNA, 11 nt, Human
gcggacagcca

SEQ ID NO: 1813300 - RNA, 19 nt, Human
gcgucucauacucaccuca

SEQ ID NO: 1813301 - RNA, 19 nt, Human
gcgggucacaggagggagg

SEQ ID NO: 1813302 - RNA, 20 nt, Human
gcgggucacaggagggaggg

SEQ ID NO: 1813303 - RNA, 15 nt, Human
gcggacagccacggc

SEQ ID NO: 1813304 - RNA, 13 nt, Human
gcgggucacagga

SEQ ID NO: 1813305 - RNA, 15 nt, Human
gcgggucacaggagg

SEQ ID NO: 1813306 - RNA, 14 nt, Human
gcccuucucuccag

SEQ ID NO: 1813307 - RNA, 16 nt, Human
gcccuucucuccagcc

SEQ ID NO: 1813308 - RNA, 17 nt, Human
gcccuucucuccagccc

SEQ ID NO: 1813309 - RNA, 18 nt, Human
gcccuucucuccagcccc

SEQ ID NO: 1813310 - RNA, 16 nt, Human
gcccugcuuugggcug

SEQ ID NO: 1813311 - RNA, 18 nt, Human
gcccugcuuugggcugcc

SEQ ID NO: 1813312 - RNA, 20 nt, Human
gccgggcgugguggugagug

SEQ ID NO: 1813313 - RNA, 21 nt, Human
gccgggcgcgguggcucacgc

SEQ ID NO: 1813314 - RNA, 19 nt, Human
gccgggaccccgagccugg

SEQ ID NO: 1813315 - RNA, 23 nt, Human
gccgggaccccgagccuggcucc

SEQ ID NO: 1813316 - RNA, 18 nt, Human
gccgggaccccgagccug

SEQ ID NO: 1813317 - RNA, 21 nt, Human
gccgagaucacgccacugcac

SEQ ID NO: 1813318 - RNA, 20 nt, Human
gccgagaucacgccacugca

SEQ ID NO: 1813319 - RNA, 22 nt, Human
gccgagaucacgccacugcacu

SEQ ID NO: 1813320 - RNA, 11 nt, Human
gccgcagcccu

SEQ ID NO: 1813321 - RNA, 12 nt, Human
gccgcagcccug

SEQ ID NO: 1813322 - RNA, 13 nt, Human
gccgcagcccugc

SEQ ID NO: 1813323 - RNA, 13 nt, Human
gccucacaguccu

SEQ ID NO: 1813324 - RNA, 17 nt, Human
gccucacaguccuuacc

SEQ ID NO: 1813325 - RNA, 19 nt, Human
gccucaaccuccugggcua

SEQ ID NO: 1813326 - RNA, 18 nt, Human
gccucaaccuccugggcu

SEQ ID NO: 1813327 - RNA, 22 nt, Human
gccuaugugcaugcagcaucua

SEQ ID NO: 1813328 - RNA, 19 nt, Human
gccguggcuucccgcucag

SEQ ID NO: 1813329 - RNA, 14 nt, Human
gccgugccuucagc

SEQ ID NO: 1813330 - RNA, 15 nt, Human
gccgugccuucagcu

SEQ ID NO: 1813331 - RNA, 17 nt, Human
gccgugccuucagcucu

SEQ ID NO: 1813332 - RNA, 19 nt, Human
gccgugccuucagcucuac

SEQ ID NO: 1813333 - RNA, 21 nt, Human
gccguggcuucccgcucagcc

SEQ ID NO: 1813334 - RNA, 22 nt, Human
gccguggcuucccgcucagccc

SEQ ID NO: 1813335 - RNA, 20 nt, Human
gccguguaaccauggaccca

SEQ ID NO: 1813336 - RNA, 15 nt, Human
gccgucuaccugagg

SEQ ID NO: 1813337 - RNA, 16 nt, Human
gccgucuaccugaggg

SEQ ID NO: 1813338 - RNA, 17 nt, Human
gccgucuaccugagggg

SEQ ID NO: 1813339 - RNA, 19 nt, Human
gccucccgaguagcuggga

SEQ ID NO: 1813340 - RNA, 18 nt, Human
gccucccgaguagcuggg

SEQ ID NO: 1813341 - RNA, 20 nt, Human
gccucccgaguagcugggac

SEQ ID NO: 1813342 - RNA, 17 nt, Human
gccucccaucacccgcu

SEQ ID NO: 1813343 - RNA, 14 nt, Human
gccucccaucaccc

SEQ ID NO: 1813344 - RNA, 16 nt, Human
gccucccaucacccgc

SEQ ID NO: 1813345 - RNA, 16 nt, Human
gccucccaacucaccc

SEQ ID NO: 1813346 - RNA, 17 nt, Human
gccucccaacucacccc

SEQ ID NO: 1813347 - RNA, 18 nt, Human
gccucccaacucacccca

SEQ ID NO: 1813348 - RNA, 19 nt, Human
gccucccaacucaccccag

SEQ ID NO: 1813349 - RNA, 19 nt, Human
gccucccaaagugcuggga

SEQ ID NO: 1813350 - RNA, 13 nt, Human
gccucccaacuca

SEQ ID NO: 1813351 - RNA, 18 nt, Human
gccucccaaagugcuggg

SEQ ID NO: 1813352 - RNA, 17 nt, Human
gccucagcauccuggca

SEQ ID NO: 1813353 - RNA, 16 nt, Human
gccucagcauccuggc

SEQ ID NO: 1813354 - RNA, 15 nt, Human
gccucagcauccugg

SEQ ID NO: 1813355 - RNA, 21 nt, Human
gccucacaguccuuaccagca

SEQ ID NO: 1813356 - RNA, 18 nt, Human
gccucacaguccuuacca

SEQ ID NO: 1813357 - RNA, 13 nt, Human
gccugcaagggag

SEQ ID NO: 1813358 - RNA, 15 nt, Human
gccugcaagggagug

SEQ ID NO: 1813359 - RNA, 13 nt, Human
gccucugccucug

SEQ ID NO: 1813360 - RNA, 12 nt, Human
gccucugccucu

SEQ ID NO: 1813361 - RNA, 15 nt, Human
gccucugcacucccc

SEQ ID NO: 1813362 - RNA, 18 nt, Human
gccucugccucugacaca

SEQ ID NO: 1813363 - RNA, 21 nt, Human
gccucugacacacagcucugu

SEQ ID NO: 1813364 - RNA, 20 nt, Human
gccucugacacacagcucug

SEQ ID NO: 1813365 - RNA, 19 nt, Human
gccucugacacacagcucu

SEQ ID NO: 1813366 - RNA, 14 nt, Human
gccucugcacuccc

SEQ ID NO: 1813367 - RNA, 18 nt, Human
gccucugacacacagcuc

SEQ ID NO: 1813368 - RNA, 17 nt, Human
gccucugacacacagcu

SEQ ID NO: 1813369 - RNA, 16 nt, Human
gccucucucaggccaa

SEQ ID NO: 1813370 - RNA, 13 nt, Human
gccucucucaggc

SEQ ID NO: 1813371 - RNA, 14 nt, Human
gccucucucaggcc

SEQ ID NO: 1813372 - RNA, 17 nt, Human
gcaagaauugaagcagg

SEQ ID NO: 1813373 - RNA, 23 nt, Human
gcaagacgcugugcugcccugcc

SEQ ID NO: 1813374 - RNA, 14 nt, Human
gcaagacgcugugc

SEQ ID NO: 1813375 - RNA, 20 nt, Human
gcaagacgcugugcugcccu

SEQ ID NO: 1813376 - RNA, 21 nt, Human
gcaagacgcugugcugcccug

SEQ ID NO: 1813377 - RNA, 22 nt, Human
gcaagacgcugugcugcccugc

SEQ ID NO: 1813378 - RNA, 16 nt, Human
gcaaaguaucccuacu

SEQ ID NO: 1813379 - RNA, 15 nt, Human
gauuuuugucuugug

SEQ ID NO: 1813380 - RNA, 21 nt, Human
gcaaagcccagcuugaaaccu

SEQ ID NO: 1813381 - RNA, 13 nt, Human
gcaaagcccagcu

SEQ ID NO: 1813382 - RNA, 18 nt, Human
gcaaggagauuuacaacu

SEQ ID NO: 1813383 - RNA, 13 nt, Human
gcaaggcugucaa

SEQ ID NO: 1813384 - RNA, 11 nt, Human
gcaaggcuguc

SEQ ID NO: 1813385 - RNA, 23 nt, Human
gcaaugcuggcuguuggcugggg

SEQ ID NO: 1813386 - RNA, 22 nt, Human
gcaaugcuggcuguuggcuggg

SEQ ID NO: 1813387 - RNA, 14 nt, Human
gcaaugcuggcugu

SEQ ID NO: 1813388 - RNA, 13 nt, Human
gcaaugcuggcug

SEQ ID NO: 1813389 - RNA, 23 nt, Human
gcaaugaccuuucaauaggaaaa

SEQ ID NO: 1813390 - RNA, 14 nt, Human
gcaaggucauuuuu

SEQ ID NO: 1813391 - RNA, 15 nt, Human
gcaaucaaaucugcu

SEQ ID NO: 1813392 - RNA, 17 nt, Human
gcaaucaaaucugcuuu

SEQ ID NO: 1813393 - RNA, 15 nt, Human
gcaaugaccuuucaa

SEQ ID NO: 1813394 - RNA, 17 nt, Human
gcaaugaccuuucaaua

SEQ ID NO: 1813395 - RNA, 20 nt, Human
gcaaugaccuuucaauagga

SEQ ID NO: 1813396 - RNA, 22 nt, Human
gcaaugaccuuucaauaggaaa

SEQ ID NO: 1813397 - RNA, 19 nt, Human
gauuuguuaaugauagcua

SEQ ID NO: 1813398 - RNA, 22 nt, Human
gauuugucuuuggugaacauug

SEQ ID NO: 1813399 - RNA, 20 nt, Human
gauuugucuuuggugaacau

SEQ ID NO: 1813400 - RNA, 19 nt, Human
gauuucuguuuagauaaua

SEQ ID NO: 1813401 - RNA, 11 nt, Human
gauuucuguuu

SEQ ID NO: 1813402 - RNA, 22 nt, Human
gauuuggucaacacuaacauga

SEQ ID NO: 1813403 - RNA, 18 nt, Human
gauuuccguuaaaauacc

SEQ ID NO: 1813404 - RNA, 15 nt, Human
gauuuccguuaaaau

SEQ ID NO: 1813405 - RNA, 20 nt, Human
gauugcaacaggcugggcuu

SEQ ID NO: 1813406 - RNA, 18 nt, Human
gauucuuuccugaggcug

SEQ ID NO: 1813407 - RNA, 16 nt, Human
gauucuuuccugaggc

SEQ ID NO: 1813408 - RNA, 17 nt, Human
gauucuuuccugaggcu

SEQ ID NO: 1813409 - RNA, 21 nt, Human
gauugcaacaggcugggcuuc

SEQ ID NO: 1813410 - RNA, 16 nt, Human
gauugcaccacugcac

SEQ ID NO: 1813411 - RNA, 23 nt, Human
gauugcaccacugcacuccagcc

SEQ ID NO: 1813412 - RNA, 20 nt, Human
gauucccaagcucugcuccu

SEQ ID NO: 1813413 - RNA, 19 nt, Human
gauucccaagcucugcucc

SEQ ID NO: 1813414 - RNA, 21 nt, Human
gauucccaagcucugcuccuc

SEQ ID NO: 1813415 - RNA, 12 nt, Human
gauucuuuccug

SEQ ID NO: 1813416 - RNA, 23 nt, Human
gauggggcugcaccggcuggccu

SEQ ID NO: 1813417 - RNA, 19 nt, Human
gauucagacagcugccugg

SEQ ID NO: 1813418 - RNA, 13 nt, Human
gauucagcucugc

SEQ ID NO: 1813419 - RNA, 15 nt, Human
gauucagcucugcaa

SEQ ID NO: 1813420 - RNA, 19 nt, Human
gauuccagagaguggcucc

SEQ ID NO: 1813421 - RNA, 20 nt, Human
gauuccagagaguggcuccu

SEQ ID NO: 1813422 - RNA, 22 nt, Human
gauuccagagaguggcuccucc

SEQ ID NO: 1813423 - RNA, 17 nt, Human
gauucauauuuacuucu

SEQ ID NO: 1813424 - RNA, 18 nt, Human
gauucauauuuacuucuu

SEQ ID NO: 1813425 - RNA, 19 nt, Human
gauucauauuuacuucuua

SEQ ID NO: 1813426 - RNA, 23 nt, Human
gauagauaggucagugcaaauac

SEQ ID NO: 1813427 - RNA, 19 nt, Human
gauacaccgggccuggaga

SEQ ID NO: 1813428 - RNA, 22 nt, Human
gauaauacaccacuacauucug

SEQ ID NO: 1813429 - RNA, 21 nt, Human
gauaauacaccacuacauucu

SEQ ID NO: 1813430 - RNA, 18 nt, Human
gauaauacaccacuacau

SEQ ID NO: 1813431 - RNA, 14 nt, Human
gauaauacaccacu

SEQ ID NO: 1813432 - RNA, 19 nt, Human
gauacaggaaaagcugcug

SEQ ID NO: 1813433 - RNA, 18 nt, Human
gauacaggaaaagcugcu

SEQ ID NO: 1813434 - RNA, 21 nt, Human
gauagcacagacccugcccug

SEQ ID NO: 1813435 - RNA, 22 nt, Human
gauagcacagacccugcccugu

SEQ ID NO: 1813436 - RNA, 21 nt, Human
gauaaauaacuuuuuuuuaag

SEQ ID NO: 1813437 - RNA, 16 nt, Human
gauaaauaacuuuuuu

SEQ ID NO: 1813438 - RNA, 22 nt, Human
gauaaauaguuuaugauuccac

SEQ ID NO: 1813439 - RNA, 21 nt, Human
gauaaauauugagcagaucua

SEQ ID NO: 1813440 - RNA, 19 nt, Human
gauaaaguugguaaaccuu

SEQ ID NO: 1813441 - RNA, 13 nt, Human
gaggaaggaaacc

SEQ ID NO: 1813442 - RNA, 19 nt, Human
gaggaaggaaacccagcuc

SEQ ID NO: 1813443 - RNA, 20 nt, Human
gaggaaggaaacccagcucu

SEQ ID NO: 1813444 - RNA, 21 nt, Human
gaggaaggaaacccagcucug

SEQ ID NO: 1813445 - RNA, 18 nt, Human
gaucacgccacugcacua

SEQ ID NO: 1813446 - RNA, 16 nt, Human
gaucacgccacugcac

SEQ ID NO: 1813447 - RNA, 22 nt, Human
gaucagucugauucccaagcuc

SEQ ID NO: 1813448 - RNA, 12 nt, Human
gaucagccuggg

SEQ ID NO: 1813449 - RNA, 15 nt, Human
gaucagccugggcaa

SEQ ID NO: 1813450 - RNA, 12 nt, Human
gaucacggcuca

SEQ ID NO: 1813451 - RNA, 21 nt, Human
gaucauccacugugccaugug

SEQ ID NO: 1813452 - RNA, 19 nt, Human
gaucauccacugugccaug

SEQ ID NO: 1813453 - RNA, 17 nt, Human
gaucauccacugugcca

SEQ ID NO: 1813454 - RNA, 14 nt, Human
gaucauugugaaau

SEQ ID NO: 1813455 - RNA, 20 nt, Human
gaucauugugaaauuauuca

SEQ ID NO: 1813456 - RNA, 20 nt, Human
gauccccaagccuggcaagg

SEQ ID NO: 1813457 - RNA, 13 nt, Human
gaugcaccagccc

SEQ ID NO: 1813458 - RNA, 22 nt, Human
gaugcacagaguuguuacauuu

SEQ ID NO: 1813459 - RNA, 21 nt, Human
gaugcacagaguuguuacauu

SEQ ID NO: 1813460 - RNA, 19 nt, Human
gaugcagccucacaguccu

SEQ ID NO: 1813461 - RNA, 14 nt, Human
gaugcagccucaca

SEQ ID NO: 1813462 - RNA, 12 nt, Human
gaugcagccuca

SEQ ID NO: 1813463 - RNA, 19 nt, Human
gaugccugguggcagcugc

SEQ ID NO: 1813464 - RNA, 18 nt, Human
gaugccugguggcagcug

SEQ ID NO: 1813465 - RNA, 20 nt, Human
gaugccugguggcagcugcg

SEQ ID NO: 1813466 - RNA, 22 nt, Human
gauggauuuccagccaaagccu

SEQ ID NO: 1813467 - RNA, 20 nt, Human
gauggcugugccucugccug

SEQ ID NO: 1813468 - RNA, 13 nt, Human
gauggggcccugc

SEQ ID NO: 1813469 - RNA, 14 nt, Human
gauggggcccugcc

SEQ ID NO: 1813470 - RNA, 22 nt, Human
gauggggcccugccuccuuugu

SEQ ID NO: 1813471 - RNA, 13 nt, Human
gauggcugugccu

SEQ ID NO: 1813472 - RNA, 17 nt, Human
gauggcugugccucugc

SEQ ID NO: 1813473 - RNA, 18 nt, Human
gauggcugugccucugcc

SEQ ID NO: 1813474 - RNA, 19 nt, Human
gauggcugugccucugccu

SEQ ID NO: 1813475 - RNA, 21 nt, Human
gauggcuaguaucaaaagaaa

SEQ ID NO: 1813476 - RNA, 14 nt, Human
gauccccagcuguu

SEQ ID NO: 1813477 - RNA, 15 nt, Human
gaucccucauccuca

SEQ ID NO: 1813478 - RNA, 16 nt, Human
gaucccucauccucau

SEQ ID NO: 1813479 - RNA, 21 nt, Human
gauccugagccagauuucacu

SEQ ID NO: 1813480 - RNA, 22 nt, Human
gauccugagccagauuucacuc

SEQ ID NO: 1813481 - RNA, 18 nt, Human
gaucuuugcagacaggca

SEQ ID NO: 1813482 - RNA, 21 nt, Human
gaucuuuggacagaagcagcu

SEQ ID NO: 1813483 - RNA, 13 nt, Human
gaucuuuggacag

SEQ ID NO: 1813484 - RNA, 17 nt, Human
gcauuaucuagauacug

SEQ ID NO: 1813485 - RNA, 13 nt, Human
gcauuugcugaau

SEQ ID NO: 1813486 - RNA, 16 nt, Human
gcauuuguuugaacug

SEQ ID NO: 1813487 - RNA, 14 nt, Human
gcauuugcugaaua

SEQ ID NO: 1813488 - RNA, 17 nt, Human
gcauuugcugaauacag

SEQ ID NO: 1813489 - RNA, 12 nt, Human
gccaaaggaagc

SEQ ID NO: 1813490 - RNA, 22 nt, Human
gccaaagcuaggccuggccaga

SEQ ID NO: 1813491 - RNA, 16 nt, Human
gccaaagcuaggccug

SEQ ID NO: 1813492 - RNA, 20 nt, Human
gccaaagccaaagcuaggcc

SEQ ID NO: 1813493 - RNA, 13 nt, Human
gccaaagccaaag

SEQ ID NO: 1813494 - RNA, 16 nt, Human
gccaaagccuccucca

SEQ ID NO: 1813495 - RNA, 19 nt, Human
gccaaagccuccuccagcc

SEQ ID NO: 1813496 - RNA, 14 nt, Human
gccaaacucaccug

SEQ ID NO: 1813497 - RNA, 16 nt, Human
gccaaacucaccugcc

SEQ ID NO: 1813498 - RNA, 22 nt, Human
gcauuuguuucuuucucugagg

SEQ ID NO: 1813499 - RNA, 18 nt, Human
gcauuuguuugaacugau

SEQ ID NO: 1813500 - RNA, 22 nt, Human
gcauguucucugaggacacuaa

SEQ ID NO: 1813501 - RNA, 21 nt, Human
gcauguucucugaggacacua

SEQ ID NO: 1813502 - RNA, 15 nt, Human
gcauguucucugagg

SEQ ID NO: 1813503 - RNA, 20 nt, Human
gcauggcaaggacugcaggg

SEQ ID NO: 1813504 - RNA, 18 nt, Human
gcaugcgggcuuccuccu

SEQ ID NO: 1813505 - RNA, 18 nt, Human
gcaugaaguaauaugcac

SEQ ID NO: 1813506 - RNA, 16 nt, Human
gcaucugaaaauugau

SEQ ID NO: 1813507 - RNA, 17 nt, Human
gcaguuauuaacacuaa

SEQ ID NO: 1813508 - RNA, 13 nt, Human
gcauagaaguaaa

SEQ ID NO: 1813509 - RNA, 15 nt, Human
gcagugggagcugcc

SEQ ID NO: 1813510 - RNA, 14 nt, Human
gcagugggagcugc

SEQ ID NO: 1813511 - RNA, 13 nt, Human
gcagugggagcug

SEQ ID NO: 1813512 - RNA, 23 nt, Human
gcaguggugguuuucuguucuuu

SEQ ID NO: 1813513 - RNA, 22 nt, Human
gcaguggugguuuucuguucuu

SEQ ID NO: 1813514 - RNA, 17 nt, Human
gcauagguuuaauaauu

SEQ ID NO: 1813515 - RNA, 21 nt, Human
gcagggcucagcggggacagc

SEQ ID NO: 1813516 - RNA, 19 nt, Human
gcagggcucagcggggaca

SEQ ID NO: 1813517 - RNA, 15 nt, Human
gcaggcagccaggcc

SEQ ID NO: 1813518 - RNA, 16 nt, Human
gcaggcagccaggcca

SEQ ID NO: 1813519 - RNA, 18 nt, Human
gcagggucucacucuguc

SEQ ID NO: 1813520 - RNA, 17 nt, Human
gcagggucucacucugu

SEQ ID NO: 1813521 - RNA, 22 nt, Human
gcagggcucagcggggacagcu

SEQ ID NO: 1813522 - RNA, 20 nt, Human
gcaggucuugaacuccuggc

SEQ ID NO: 1813523 - RNA, 19 nt, Human
gcaggucuugaacuccugg

SEQ ID NO: 1813524 - RNA, 22 nt, Human
gcagguccaggguuugaguuca

SEQ ID NO: 1813525 - RNA, 15 nt, Human
gcagugcaugcuguc

SEQ ID NO: 1813526 - RNA, 16 nt, Human
gcagugcaugcugucc

SEQ ID NO: 1813527 - RNA, 19 nt, Human
gcagacaggcaagcaccuc

SEQ ID NO: 1813528 - RNA, 18 nt, Human
gcagacaggaccagggau

SEQ ID NO: 1813529 - RNA, 23 nt, Human
gcagacaggcaagcaccuccugc

SEQ ID NO: 1813530 - RNA, 12 nt, Human
gcagacaggacc

SEQ ID NO: 1813531 - RNA, 13 nt, Human
gcagacaggacca

SEQ ID NO: 1813532 - RNA, 15 nt, Human
gcagacaggaccagg

SEQ ID NO: 1813533 - RNA, 16 nt, Human
gcacugcuuccaguga

SEQ ID NO: 1813534 - RNA, 18 nt, Human
gcacugcuuccagugagg

SEQ ID NO: 1813535 - RNA, 22 nt, Human
gcacugguggcccgacagccug

SEQ ID NO: 1813536 - RNA, 23 nt, Human
gcacugguggcccgacagccugg

SEQ ID NO: 1813537 - RNA, 24 nt, Human
gcacugguggcccgacagccuggc

SEQ ID NO: 1813538 - RNA, 12 nt, Human
gcacugcugccc

SEQ ID NO: 1813539 - RNA, 22 nt, Human
gcacugcuuccagugaggcucu

SEQ ID NO: 1813540 - RNA, 20 nt, Human
gcacugcuuccagugaggcu

SEQ ID NO: 1813541 - RNA, 15 nt, Human
gcacguauuuuaaua

SEQ ID NO: 1813542 - RNA, 14 nt, Human
gcacguauuuuaau

SEQ ID NO: 1813543 - RNA, 12 nt, Human
gcacgauuucug

SEQ ID NO: 1813544 - RNA, 19 nt, Human
gcaccuuagacagucccug

SEQ ID NO: 1813545 - RNA, 18 nt, Human
gcaccuuagacagucccu

SEQ ID NO: 1813546 - RNA, 15 nt, Human
gcacccucaggcagg

SEQ ID NO: 1813547 - RNA, 21 nt, Human
gcaccuggaauauauaaccag

SEQ ID NO: 1813548 - RNA, 18 nt, Human
gcaccuggaauauauaac

SEQ ID NO: 1813549 - RNA, 22 nt, Human
gcaccuggaauauauaaccagu

SEQ ID NO: 1813550 - RNA, 14 nt, Human
gcaccuuagacagu

SEQ ID NO: 1813551 - RNA, 17 nt, Human
gcaccuuagacaguccc

SEQ ID NO: 1813552 - RNA, 14 nt, Human
gcaauggcagccuu

SEQ ID NO: 1813553 - RNA, 20 nt, Human
gcaccacugcacuccagccu

SEQ ID NO: 1813554 - RNA, 13 nt, Human
gcaauggcagccu

SEQ ID NO: 1813555 - RNA, 12 nt, Human
gcaauggcagcc

SEQ ID NO: 1813556 - RNA, 15 nt, Human
gcaccagcagccugg

SEQ ID NO: 1813557 - RNA, 21 nt, Human
gcaccacugcacuccagccug

SEQ ID NO: 1813558 - RNA, 22 nt, Human
gcaccacugcacuccagccugg

SEQ ID NO: 1813559 - RNA, 19 nt, Human
gcacccggccccugcuggu

SEQ ID NO: 1813560 - RNA, 22 nt, Human
gcacccaccaucaugucuggcu

SEQ ID NO: 1813561 - RNA, 16 nt, Human
gcaccagcagccugga

SEQ ID NO: 1813562 - RNA, 23 nt, Human
gcaggaggaucacuugaguccag

SEQ ID NO: 1813563 - RNA, 20 nt, Human
gcaggaaggcugagaggaga

SEQ ID NO: 1813564 - RNA, 12 nt, Human
gcaggcagccag

SEQ ID NO: 1813565 - RNA, 13 nt, Human
gcaggcagccagg

SEQ ID NO: 1813566 - RNA, 14 nt, Human
gcaggcagccaggc

SEQ ID NO: 1813567 - RNA, 15 nt, Human
gcagccuuggcaaac

SEQ ID NO: 1813568 - RNA, 14 nt, Human
gcagcucaccucuc

SEQ ID NO: 1813569 - RNA, 15 nt, Human
gcagcucaccucucc

SEQ ID NO: 1813570 - RNA, 13 nt, Human
gcagcccugcuuu

SEQ ID NO: 1813571 - RNA, 14 nt, Human
gcagcccugcagag

SEQ ID NO: 1813572 - RNA, 15 nt, Human
gcagcccugcagagg

SEQ ID NO: 1813573 - RNA, 16 nt, Human
gcagcccugcagaggg

SEQ ID NO: 1813574 - RNA, 17 nt, Human
gcagcccugcagagggc

SEQ ID NO: 1813575 - RNA, 24 nt, Human
gcagccccauucugccugcccagg

SEQ ID NO: 1813576 - RNA, 21 nt, Human
gcagccccauucugccugccc

SEQ ID NO: 1813577 - RNA, 19 nt, Human
gcagccccauucugccugc

SEQ ID NO: 1813578 - RNA, 18 nt, Human
gcagccccauucugccug

SEQ ID NO: 1813579 - RNA, 17 nt, Human
gcagccccauucugccu

SEQ ID NO: 1813580 - RNA, 23 nt, Human
gcagcaauaaagcagcguuucua

SEQ ID NO: 1813581 - RNA, 16 nt, Human
gcagcaauaaagcagc

SEQ ID NO: 1813582 - RNA, 13 nt, Human
gcagcccugcaga

SEQ ID NO: 1813583 - RNA, 20 nt, Human
gcagccccuguucuggcaga

SEQ ID NO: 1813584 - RNA, 21 nt, Human
gcagccccuguucuggcagag

SEQ ID NO: 1813585 - RNA, 20 nt, Human
gcagccccgugggguuccuc

SEQ ID NO: 1813586 - RNA, 22 nt, Human
gcagauacaggaaaagcugcug

SEQ ID NO: 1813587 - RNA, 17 nt, Human
gcagacaguuaagagaa

SEQ ID NO: 1813588 - RNA, 21 nt, Human
gcagaguugaagacagagcua

SEQ ID NO: 1813589 - RNA, 18 nt, Human
gcagauaaacaguaguga

SEQ ID NO: 1813590 - RNA, 20 nt, Human
gcagaguugaagacagagcu

SEQ ID NO: 1813591 - RNA, 21 nt, Human
gaccuuucaauaggaaaaacu

SEQ ID NO: 1813592 - RNA, 23 nt, Human
gaccuugaacuggguacuugugg

SEQ ID NO: 1813593 - RNA, 19 nt, Human
gaccugccucggccuccca

SEQ ID NO: 1813594 - RNA, 18 nt, Human
gacggagucccaccuugg

SEQ ID NO: 1813595 - RNA, 14 nt, Human
gacggagucccacc

SEQ ID NO: 1813596 - RNA, 21 nt, Human
gacggagucccaccuuggcug

SEQ ID NO: 1813597 - RNA, 23 nt, Human
gacggagucccaccuuggcugca

SEQ ID NO: 1813598 - RNA, 17 nt, Human
gacgggguuucaccaug

SEQ ID NO: 1813599 - RNA, 17 nt, Human
gacguguuaugacucca

SEQ ID NO: 1813600 - RNA, 20 nt, Human
gacguguuaugacuccagaa

SEQ ID NO: 1813601 - RNA, 15 nt, Human
gacucaguggggagg

SEQ ID NO: 1813602 - RNA, 15 nt, Human
gacucagguugucug

SEQ ID NO: 1813603 - RNA, 14 nt, Human
gacuccugcaggca

SEQ ID NO: 1813604 - RNA, 15 nt, Human
gacuccugcaggcag

SEQ ID NO: 1813605 - RNA, 16 nt, Human
gacuccugcaggcagc

SEQ ID NO: 1813606 - RNA, 12 nt, Human
gacuacaggcac

SEQ ID NO: 1813607 - RNA, 17 nt, Human
gacuacucccccaggug

SEQ ID NO: 1813608 - RNA, 22 nt, Human
gacguguuaugacuccagaauu

SEQ ID NO: 1813609 - RNA, 23 nt, Human
gaccugauuucugagcauuuaau

SEQ ID NO: 1813610 - RNA, 21 nt, Human
gaccugccccuccucucugcc

SEQ ID NO: 1813611 - RNA, 15 nt, Human
gaccugccucggccu

SEQ ID NO: 1813612 - RNA, 18 nt, Human
gaccugaggcccuucucu

SEQ ID NO: 1813613 - RNA, 21 nt, Human
gaccugaggcccuucucucca

SEQ ID NO: 1813614 - RNA, 11 nt, Human
gaccucaggcc

SEQ ID NO: 1813615 - RNA, 12 nt, Human
gaccucaggccu

SEQ ID NO: 1813616 - RNA, 13 nt, Human
gaccucaggccug

SEQ ID NO: 1813617 - RNA, 15 nt, Human
gaccugaggcccuuc

SEQ ID NO: 1813618 - RNA, 14 nt, Human
gaccgugaggccag

SEQ ID NO: 1813619 - RNA, 15 nt, Human
gaccgugaggccaga

SEQ ID NO: 1813620 - RNA, 14 nt, Human
gacccaugcugccc

SEQ ID NO: 1813621 - RNA, 15 nt, Human
gacccaugcugcccu

SEQ ID NO: 1813622 - RNA, 16 nt, Human
gacccaugcugcccug

SEQ ID NO: 1813623 - RNA, 17 nt, Human
gacccaugcugcccugu

SEQ ID NO: 1813624 - RNA, 12 nt, Human
gacccacugcuu

SEQ ID NO: 1813625 - RNA, 11 nt, Human
gacccacugcu

SEQ ID NO: 1813626 - RNA, 13 nt, Human
gaccccuccaugu

SEQ ID NO: 1813627 - RNA, 23 nt, Human
gaccccucauagcccucacccug

SEQ ID NO: 1813628 - RNA, 20 nt, Human
gaccccgagccuggcuccaa

SEQ ID NO: 1813629 - RNA, 22 nt, Human
gaccccucauagcccucacccu

SEQ ID NO: 1813630 - RNA, 19 nt, Human
gacccugaggcccagaggg

SEQ ID NO: 1813631 - RNA, 20 nt, Human
gacccugaggcccagagggc

SEQ ID NO: 1813632 - RNA, 21 nt, Human
gacccugaggcccagagggcc

SEQ ID NO: 1813633 - RNA, 13 nt, Human
gacccugcccugu

SEQ ID NO: 1813634 - RNA, 15 nt, Human
gacccugcccugugg

SEQ ID NO: 1813635 - RNA, 16 nt, Human
gacccugcccuguggg

SEQ ID NO: 1813636 - RNA, 23 nt, Human
gacccugucucaaaaaaagaaaa

SEQ ID NO: 1813637 - RNA, 23 nt, Human
gacauacuaaccagcagaaaugc

SEQ ID NO: 1813638 - RNA, 14 nt, Human
gacaucaacagaua

SEQ ID NO: 1813639 - RNA, 16 nt, Human
gacauacuaaccagca

SEQ ID NO: 1813640 - RNA, 15 nt, Human
gacauacuaaccagc

SEQ ID NO: 1813641 - RNA, 21 nt, Human
gacaugucuuuucuugcauga

SEQ ID NO: 1813642 - RNA, 17 nt, Human
gacaugucuuuucuugc

SEQ ID NO: 1813643 - RNA, 16 nt, Human
gacagacacaggcccg

SEQ ID NO: 1813644 - RNA, 15 nt, Human
gacagacacaggccc

SEQ ID NO: 1813645 - RNA, 19 nt, Human
gacagaucucugcuuugga

SEQ ID NO: 1813646 - RNA, 21 nt, Human
gacagaucucugcuuuggaaa

SEQ ID NO: 1813647 - RNA, 23 nt, Human
gacagaucucugcuuuggaaauc

SEQ ID NO: 1813648 - RNA, 21 nt, Human
gacacuaaccacgcuggaccu

SEQ ID NO: 1813649 - RNA, 20 nt, Human
gacacuaaccacgcuggacc

SEQ ID NO: 1813650 - RNA, 14 nt, Human
gacagacacaggcc

SEQ ID NO: 1813651 - RNA, 13 nt, Human
gacagccacggcc

SEQ ID NO: 1813652 - RNA, 22 nt, Human
gacagccaacuauggccugugg

SEQ ID NO: 1813653 - RNA, 12 nt, Human
gacagcugccug

SEQ ID NO: 1813654 - RNA, 13 nt, Human
gacagcugccugg

SEQ ID NO: 1813655 - RNA, 12 nt, Human
gacagcaugaga

SEQ ID NO: 1813656 - RNA, 19 nt, Human
gacagccaacuauggccug

SEQ ID NO: 1813657 - RNA, 14 nt, Human
gacagcugccuggg

SEQ ID NO: 1813658 - RNA, 15 nt, Human
gacagcugccuggga

SEQ ID NO: 1813659 - RNA, 19 nt, Human
gacaggcauguucucugag

SEQ ID NO: 1813660 - RNA, 18 nt, Human
gacaggcauguucucuga

SEQ ID NO: 1813661 - RNA, 17 nt, Human
gacaggcaaugcuggcu

SEQ ID NO: 1813662 - RNA, 16 nt, Human
gacaggcaaugcuggc

SEQ ID NO: 1813663 - RNA, 14 nt, Human
gacaggcaaugcug

SEQ ID NO: 1813664 - RNA, 22 nt, Human
gacaaggauugcuacuguccua

SEQ ID NO: 1813665 - RNA, 14 nt, Human
gaagucuuuguaca

SEQ ID NO: 1813666 - RNA, 16 nt, Human
gaagucuuuguacaga

SEQ ID NO: 1813667 - RNA, 16 nt, Human
gacaaugacccagugg

SEQ ID NO: 1813668 - RNA, 17 nt, Human
gacacaggcccggcucc

SEQ ID NO: 1813669 - RNA, 15 nt, Human
gacacaggcccggcu

SEQ ID NO: 1813670 - RNA, 13 nt, Human
gacacacagcucu

SEQ ID NO: 1813671 - RNA, 19 nt, Human
gacaauuuauuauggcaca

SEQ ID NO: 1813672 - RNA, 13 nt, Human
gacaauuuauuau

SEQ ID NO: 1813673 - RNA, 12 nt, Human
gacaauuuauua

SEQ ID NO: 1813674 - RNA, 16 nt, Human
gacaaugcaaaccauc

SEQ ID NO: 1813675 - RNA, 18 nt, Human
gacaaugcaaaccaucau

SEQ ID NO: 1813676 - RNA, 21 nt, Human
gacaaugacuuacuguacaug

SEQ ID NO: 1813677 - RNA, 12 nt, Human
gacaaugcaaac

SEQ ID NO: 1813678 - RNA, 20 nt, Human
gacaaugacuuacuguacau

SEQ ID NO: 1813679 - RNA, 17 nt, Human
gacaaugacuuacugua

SEQ ID NO: 1813680 - RNA, 18 nt, Human
gacacuaaccacgcugga

SEQ ID NO: 1813681 - RNA, 17 nt, Human
gacacuaaccacgcugg

SEQ ID NO: 1813682 - RNA, 16 nt, Human
gacacuaaccacgcug

SEQ ID NO: 1813683 - RNA, 15 nt, Human
gacacuaaccacgcu

SEQ ID NO: 1813684 - RNA, 19 nt, Human
gacacgaauauugcugaug

SEQ ID NO: 1813685 - RNA, 17 nt, Human
gacacgaauauugcuga

SEQ ID NO: 1813686 - RNA, 18 nt, Human
gacacgaauauugcugau

SEQ ID NO: 1813687 - RNA, 17 nt, Human
gacaccuugacagggca

SEQ ID NO: 1813688 - RNA, 15 nt, Human
gacaccuugacaggg

SEQ ID NO: 1813689 - RNA, 20 nt, Human
gacaccuugacagggcacac

SEQ ID NO: 1813690 - RNA, 18 nt, Human
gacaccuugacagggcac

SEQ ID NO: 1813691 - RNA, 15 nt, Human
gacacgaauauugcu

SEQ ID NO: 1813692 - RNA, 18 nt, Human
gacacaggcccggcucca

SEQ ID NO: 1813693 - RNA, 17 nt, Human
gacacagugaccauacu

SEQ ID NO: 1813694 - RNA, 12 nt, Human
gacacccuguga

SEQ ID NO: 1813695 - RNA, 13 nt, Human
gacacccugugau

SEQ ID NO: 1813696 - RNA, 17 nt, Human
gacaccuacugaguggc

SEQ ID NO: 1813697 - RNA, 22 nt, Human
gacacccugugauggggcccug

SEQ ID NO: 1813698 - RNA, 23 nt, Human
gacacccugugauggggcccugc

SEQ ID NO: 1813699 - RNA, 17 nt, Human
gagauacagaauuuuau

SEQ ID NO: 1813700 - RNA, 19 nt, Human
gagagugaacaaauuuaca

SEQ ID NO: 1813701 - RNA, 15 nt, Human
gagagugaacaaauu

SEQ ID NO: 1813702 - RNA, 18 nt, Human
gagaggggaacagacugg

SEQ ID NO: 1813703 - RNA, 13 nt, Human
gagaggggaacag

SEQ ID NO: 1813704 - RNA, 21 nt, Human
gagagggugggagugggccca

SEQ ID NO: 1813705 - RNA, 13 nt, Human
gagagccuuccag

SEQ ID NO: 1813706 - RNA, 14 nt, Human
gagagccuuccagg

SEQ ID NO: 1813707 - RNA, 17 nt, Human
gagagaagagaaugcac

SEQ ID NO: 1813708 - RNA, 14 nt, Human
gagacucugucuca

SEQ ID NO: 1813709 - RNA, 22 nt, Human
gagacugucucaagagggcacu

SEQ ID NO: 1813710 - RNA, 23 nt, Human
gagacugucucaagagggcacug

SEQ ID NO: 1813711 - RNA, 13 nt, Human
gagacuuguauga

SEQ ID NO: 1813712 - RNA, 12 nt, Human
gagaccaucccu

SEQ ID NO: 1813713 - RNA, 16 nt, Human
gagacucgcgacaaug

SEQ ID NO: 1813714 - RNA, 18 nt, Human
gagacucgcgacaaugca

SEQ ID NO: 1813715 - RNA, 22 nt, Human
gagacuccugcaggcagccagg

SEQ ID NO: 1813716 - RNA, 14 nt, Human
gagacagcccgggc

SEQ ID NO: 1813717 - RNA, 17 nt, Human
gagacagcccgggcucu

SEQ ID NO: 1813718 - RNA, 18 nt, Human
gagacagcccgggcucug

SEQ ID NO: 1813719 - RNA, 19 nt, Human
gagacagcccgggcucugc

SEQ ID NO: 1813720 - RNA, 20 nt, Human
gagacagcccgggcucugcc

SEQ ID NO: 1813721 - RNA, 21 nt, Human
gagacagcccgggcucugccu

SEQ ID NO: 1813722 - RNA, 22 nt, Human
gagacagcccgggcucugccuc

SEQ ID NO: 1813723 - RNA, 23 nt, Human
gagacagcccgggcucugccucc

SEQ ID NO: 1813724 - RNA, 24 nt, Human
gagacagcccgggcucugccuccc

SEQ ID NO: 1813725 - RNA, 13 nt, Human
gagacagcucugc

SEQ ID NO: 1813726 - RNA, 18 nt, Human
gagacagcucugcauacu

SEQ ID NO: 1813727 - RNA, 15 nt, Human
gagacagcucugcau

SEQ ID NO: 1813728 - RNA, 21 nt, Human
gagaaaauggacguguuauga

SEQ ID NO: 1813729 - RNA, 16 nt, Human
gacuuggaagcuccgc

SEQ ID NO: 1813730 - RNA, 15 nt, Human
gacuuggaagcuccg

SEQ ID NO: 1813731 - RNA, 14 nt, Human
gacuuggaagcucc

SEQ ID NO: 1813732 - RNA, 19 nt, Human
gacucgcgacaaugcaaac

SEQ ID NO: 1813733 - RNA, 17 nt, Human
gacuccugcaggcagcc

SEQ ID NO: 1813734 - RNA, 18 nt, Human
gacucgcgacaaugcaaa

SEQ ID NO: 1813735 - RNA, 23 nt, Human
gagaaaguacuucuccacccugc

SEQ ID NO: 1813736 - RNA, 12 nt, Human
gagaaaugaaaa

SEQ ID NO: 1813737 - RNA, 14 nt, Human
gagaaauuuauaaa

SEQ ID NO: 1813738 - RNA, 19 nt, Human
gagacagaguuuucacucu

SEQ ID NO: 1813739 - RNA, 17 nt, Human
gagacagacuagaaguu

SEQ ID NO: 1813740 - RNA, 16 nt, Human
gagacagccaacuaug

SEQ ID NO: 1813741 - RNA, 12 nt, Human
gagacagcccgg

SEQ ID NO: 1813742 - RNA, 15 nt, Human
gagacagacuagaag

SEQ ID NO: 1813743 - RNA, 15 nt, Human
gagacacaagccuuc

SEQ ID NO: 1813744 - RNA, 17 nt, Human
gagacacaagccuucgg

SEQ ID NO: 1813745 - RNA, 22 nt, Human
gagaaugcacaaacagaggccg

SEQ ID NO: 1813746 - RNA, 20 nt, Human
gagaaugcacaaacagaggc

SEQ ID NO: 1813747 - RNA, 21 nt, Human
gagaaugcacaaacagaggcc

SEQ ID NO: 1813748 - RNA, 14 nt, Human
gaggaacaaggcaa

SEQ ID NO: 1813749 - RNA, 16 nt, Human
gaggaacaaggcaagg

SEQ ID NO: 1813750 - RNA, 17 nt, Human
gaggaagagaaaaaaua

SEQ ID NO: 1813751 - RNA, 13 nt, Human
gaggaagccgcug

SEQ ID NO: 1813752 - RNA, 14 nt, Human
gaggaagccgcugg

SEQ ID NO: 1813753 - RNA, 17 nt, Human
gaggaagccgcuggggc

SEQ ID NO: 1813754 - RNA, 18 nt, Human
gaggaagccgcuggggcc

SEQ ID NO: 1813755 - RNA, 16 nt, Human
gaggaaagcaaaggag

SEQ ID NO: 1813756 - RNA, 17 nt, Human
gaggaaagcaaaggaga

SEQ ID NO: 1813757 - RNA, 20 nt, Human
gaggaaaaccaagccguggc

SEQ ID NO: 1813758 - RNA, 21 nt, Human
gaggaaaaccaagccguggcu

SEQ ID NO: 1813759 - RNA, 23 nt, Human
gaggaaaaccaagccguggcuuc

SEQ ID NO: 1813760 - RNA, 23 nt, Human
gagcuuugucuacuucaaaaguu

SEQ ID NO: 1813761 - RNA, 20 nt, Human
gagcuuugaaaauucagugg

SEQ ID NO: 1813762 - RNA, 22 nt, Human
gagcuuucugcuaucaaagagg

SEQ ID NO: 1813763 - RNA, 22 nt, Human
gagcuugaaacccguggcgcuu

SEQ ID NO: 1813764 - RNA, 15 nt, Human
gagcugaguggggga

SEQ ID NO: 1813765 - RNA, 15 nt, Human
gagcuagcagcaggg

SEQ ID NO: 1813766 - RNA, 17 nt, Human
gagcuagcagcagggag

SEQ ID NO: 1813767 - RNA, 15 nt, Human
gagccugcaguuauu

SEQ ID NO: 1813768 - RNA, 20 nt, Human
gagccgagaucacgccacug

SEQ ID NO: 1813769 - RNA, 19 nt, Human
gagccgagaucacgccacu

SEQ ID NO: 1813770 - RNA, 18 nt, Human
gagcccacuguacuugcu

SEQ ID NO: 1813771 - RNA, 21 nt, Human
gagcccacuguacuugcucuu

SEQ ID NO: 1813772 - RNA, 18 nt, Human
gagcccacgcccccacug

SEQ ID NO: 1813773 - RNA, 22 nt, Human
gagccgagaucacgccacugca

SEQ ID NO: 1813774 - RNA, 21 nt, Human
gagccgagaucacgccacugc

SEQ ID NO: 1813775 - RNA, 15 nt, Human
gagccucagcauccu

SEQ ID NO: 1813776 - RNA, 14 nt, Human
gagccucagcaucc

SEQ ID NO: 1813777 - RNA, 17 nt, Human
gagccucagcauccugg

SEQ ID NO: 1813778 - RNA, 19 nt, Human
gagccucagucucccuccc

SEQ ID NO: 1813779 - RNA, 13 nt, Human
gagccucagcauc

SEQ ID NO: 1813780 - RNA, 12 nt, Human
gagccugcaguu

SEQ ID NO: 1813781 - RNA, 13 nt, Human
gagccuccugccc

SEQ ID NO: 1813782 - RNA, 20 nt, Human
gagauagccaaggccaaagg

SEQ ID NO: 1813783 - RNA, 21 nt, Human
gagauagccaaggccaaagga

SEQ ID NO: 1813784 - RNA, 17 nt, Human
gagcagagaccaucccu

SEQ ID NO: 1813785 - RNA, 18 nt, Human
gagcagagaccaucccug

SEQ ID NO: 1813786 - RNA, 16 nt, Human
gagcagagaccauccc

SEQ ID NO: 1813787 - RNA, 22 nt, Human
gagcagccacauuccugaugcu

SEQ ID NO: 1813788 - RNA, 21 nt, Human
gagcagccacauuccugaugc

SEQ ID NO: 1813789 - RNA, 23 nt, Human
gagcagagaccaucccugaaggc

SEQ ID NO: 1813790 - RNA, 19 nt, Human
gagcagagaccaucccuga

SEQ ID NO: 1813791 - RNA, 21 nt, Human
gagcagagaccaucccugaag

SEQ ID NO: 1813792 - RNA, 20 nt, Human
gagccacugcaccgggccac

SEQ ID NO: 1813793 - RNA, 15 nt, Human
gagccagauuucacu

SEQ ID NO: 1813794 - RNA, 18 nt, Human
gagccagauuucacucuc

SEQ ID NO: 1813795 - RNA, 19 nt, Human
gagccagauuucacucucc

SEQ ID NO: 1813796 - RNA, 19 nt, Human
gagccacugcaccgggcca

SEQ ID NO: 1813797 - RNA, 18 nt, Human
gagccacugcaccgggcc

SEQ ID NO: 1813798 - RNA, 17 nt, Human
gagcccaccuuggcuca

SEQ ID NO: 1813799 - RNA, 15 nt, Human
gagcccaccuuggcu

SEQ ID NO: 1813800 - RNA, 13 nt, Human
gagcccaccuugg

SEQ ID NO: 1813801 - RNA, 11 nt, Human
gaaaggaaaga

SEQ ID NO: 1813802 - RNA, 16 nt, Human
gaaaggaaagaggcuc

SEQ ID NO: 1813803 - RNA, 21 nt, Human
gaaagcuugcccuggugccuc

SEQ ID NO: 1813804 - RNA, 14 nt, Human
gaaaguuuacagga

SEQ ID NO: 1813805 - RNA, 16 nt, Human
gaaaguuuacaggaaa

SEQ ID NO: 1813806 - RNA, 20 nt, Human
gaaacuaggugcauauuuau

SEQ ID NO: 1813807 - RNA, 16 nt, Human
gaaaaaugagccuggc

SEQ ID NO: 1813808 - RNA, 17 nt, Human
gaaagacuguacaaagu

SEQ ID NO: 1813809 - RNA, 22 nt, Human
gaaagauggcugugccucugcc

SEQ ID NO: 1813810 - RNA, 16 nt, Human
gaaagaucaaaagguu

SEQ ID NO: 1813811 - RNA, 23 nt, Human
gaaagauggcugugccucugccu

SEQ ID NO: 1813812 - RNA, 14 nt, Human
gaaagcagaacagu

SEQ ID NO: 1813813 - RNA, 13 nt, Human
gaaagcagaacag

SEQ ID NO: 1813814 - RNA, 20 nt, Human
gaacagacuggaagcacagc

SEQ ID NO: 1813815 - RNA, 17 nt, Human
gaacacuccuucacaga

SEQ ID NO: 1813816 - RNA, 15 nt, Human
gaacacuccuucaca

SEQ ID NO: 1813817 - RNA, 16 nt, Human
gaacacuccuucacag

SEQ ID NO: 1813818 - RNA, 19 nt, Human
gaaauuuccacucaggucu

SEQ ID NO: 1813819 - RNA, 20 nt, Human
gaaauuuccacucaggucug

SEQ ID NO: 1813820 - RNA, 23 nt, Human
gaaauuaguacuccccuccuuga

SEQ ID NO: 1813821 - RNA, 22 nt, Human
gaacagacuggaagcacagcuu

SEQ ID NO: 1813822 - RNA, 20 nt, Human
gaaauaucugaaaauguaug

SEQ ID NO: 1813823 - RNA, 18 nt, Human
gaaauaucugaaaaugua

SEQ ID NO: 1813824 - RNA, 19 nt, Human
gaaauaucugaaaauguau

SEQ ID NO: 1813825 - RNA, 17 nt, Human
gaaauauaggaacuuaa

SEQ ID NO: 1813826 - RNA, 16 nt, Human
gaaaugggcagagcag

SEQ ID NO: 1813827 - RNA, 15 nt, Human
gaaaugggcagagca

SEQ ID NO: 1813828 - RNA, 18 nt, Human
gaaaugaggucagagccu

SEQ ID NO: 1813829 - RNA, 11 nt, Human
gaaaugagcug

SEQ ID NO: 1813830 - RNA, 17 nt, Human
gaaauguacagcaagga

SEQ ID NO: 1813831 - RNA, 17 nt, Human
gaaaugggcagagcaga

SEQ ID NO: 1813832 - RNA, 19 nt, Human
gaaaugggcagagcagaga

SEQ ID NO: 1813833 - RNA, 13 nt, Human
gaagggggcuggg

SEQ ID NO: 1813834 - RNA, 15 nt, Human
gaagggggcugggac

SEQ ID NO: 1813835 - RNA, 20 nt, Human
gaaggcagggagggccuggg

SEQ ID NO: 1813836 - RNA, 22 nt, Human
gaaggcagggagggccugggcc

SEQ ID NO: 1813837 - RNA, 23 nt, Human
gaaggcagggagggccugggccc

SEQ ID NO: 1813838 - RNA, 18 nt, Human
gaaggcagggagggccug

SEQ ID NO: 1813839 - RNA, 13 nt, Human
gaagucacacagu

SEQ ID NO: 1813840 - RNA, 21 nt, Human
gaaguaauaugcacacauuuu

SEQ ID NO: 1813841 - RNA, 20 nt, Human
gaaguaauaugcacacauuu

SEQ ID NO: 1813842 - RNA, 19 nt, Human
gaaguaauaugcacacauu

SEQ ID NO: 1813843 - RNA, 21 nt, Human
gaaggugaggagcuugaaacc

SEQ ID NO: 1813844 - RNA, 15 nt, Human
gaagucacugcacag

SEQ ID NO: 1813845 - RNA, 21 nt, Human
gaagccgcuggggccaguugg

SEQ ID NO: 1813846 - RNA, 18 nt, Human
gaagccgcuggggccagu

SEQ ID NO: 1813847 - RNA, 20 nt, Human
gaagccgcuggggccaguug

SEQ ID NO: 1813848 - RNA, 14 nt, Human
gaagccgcuggggc

SEQ ID NO: 1813849 - RNA, 19 nt, Human
gaaggaaacccagcucugg

SEQ ID NO: 1813850 - RNA, 20 nt, Human
gaaggaaacccagcucuggu

SEQ ID NO: 1813851 - RNA, 21 nt, Human
gaaggacauugcggacagcca

SEQ ID NO: 1813852 - RNA, 20 nt, Human
gaaggacauugcggacagcc

SEQ ID NO: 1813853 - RNA, 19 nt, Human
gaaggacauugcggacagc

SEQ ID NO: 1813854 - RNA, 22 nt, Human
gaaggaauaaauugcuccuuga

SEQ ID NO: 1813855 - RNA, 22 nt, Human
gaaggacccggaggggccuggc

SEQ ID NO: 1813856 - RNA, 19 nt, Human
gaaggaagacuucaucccu

SEQ ID NO: 1813857 - RNA, 21 nt, Human
gaaggaaacccagcucugguc

SEQ ID NO: 1813858 - RNA, 22 nt, Human
gaaggaaacccagcucuggucc

SEQ ID NO: 1813859 - RNA, 15 nt, Human
gaaggaacguccccu

SEQ ID NO: 1813860 - RNA, 23 nt, Human
gaagauuuugaaauuuuuauuaa

SEQ ID NO: 1813861 - RNA, 17 nt, Human
gaagauugagauguguu

SEQ ID NO: 1813862 - RNA, 22 nt, Human
gaagauugagauguguucacaa

SEQ ID NO: 1813863 - RNA, 17 nt, Human
gaagauguagaggagaa

SEQ ID NO: 1813864 - RNA, 15 nt, Human
gaagacuucaucccu

SEQ ID NO: 1813865 - RNA, 16 nt, Human
gaagacuucaucccuc

SEQ ID NO: 1813866 - RNA, 12 nt, Human
gaagagccuugc

SEQ ID NO: 1813867 - RNA, 17 nt, Human
gaagacuucaucccucu

SEQ ID NO: 1813868 - RNA, 19 nt, Human
gaagacuucaucccucugg

SEQ ID NO: 1813869 - RNA, 22 nt, Human
gaacuuguaaaggaauuuaaaa

SEQ ID NO: 1813870 - RNA, 18 nt, Human
gaacuuggcgcugccccu

SEQ ID NO: 1813871 - RNA, 17 nt, Human
gaacuugggccacugug

SEQ ID NO: 1813872 - RNA, 17 nt, Human
gaacuuuccaggaaggc

SEQ ID NO: 1813873 - RNA, 12 nt, Human
gaacuugguucc

SEQ ID NO: 1813874 - RNA, 15 nt, Human
gaacuuguuuucugg

SEQ ID NO: 1813875 - RNA, 22 nt, Human
gaacuuugaccucugcagcaau

SEQ ID NO: 1813876 - RNA, 16 nt, Human
gaacuuugaccucugc

SEQ ID NO: 1813877 - RNA, 18 nt, Human
gaaccacaucuugcucug

SEQ ID NO: 1813878 - RNA, 20 nt, Human
gaaccacaucuugcucugcu

SEQ ID NO: 1813879 - RNA, 16 nt, Human
gaacuccuaaaucaag

SEQ ID NO: 1813880 - RNA, 13 nt, Human
gaacuccugaccu

SEQ ID NO: 1813881 - RNA, 15 nt, Human
gaacuccuaaaucaa

SEQ ID NO: 1813882 - RNA, 16 nt, Human
gaacucccuuucaaca

SEQ ID NO: 1813883 - RNA, 17 nt, Human
gaacuuaaauaauguga

SEQ ID NO: 1813884 - RNA, 14 nt, Human
gaacuuaaauaaug

SEQ ID NO: 1813885 - RNA, 17 nt, Human
gaacuuggcgcugcccc

SEQ ID NO: 1813886 - RNA, 17 nt, Human
cuugccaaauauaaaua

SEQ ID NO: 1813887 - RNA, 13 nt, Human
cuugcuugcuuuu

SEQ ID NO: 1813888 - RNA, 15 nt, Human
cuugcuuuuaaaauc

SEQ ID NO: 1813889 - RNA, 13 nt, Human
cuuggcugcaggg

SEQ ID NO: 1813890 - RNA, 12 nt, Human
cuuggcugcagg

SEQ ID NO: 1813891 - RNA, 23 nt, Human
cuuggcucaaguccucuuuucug

SEQ ID NO: 1813892 - RNA, 24 nt, Human
cuuggcucacugcaacuucugccu

SEQ ID NO: 1813893 - RNA, 13 nt, Human
cuuggauuguccc

SEQ ID NO: 1813894 - RNA, 14 nt, Human
cuuggauugucccc

SEQ ID NO: 1813895 - RNA, 18 nt, Human
cuuguaaaggaauuuaaa

SEQ ID NO: 1813896 - RNA, 18 nt, Human
cuuguaaaaauuaaaagu

SEQ ID NO: 1813897 - RNA, 17 nt, Human
cuuggggaccagagcug

SEQ ID NO: 1813898 - RNA, 18 nt, Human
cuuggggaccagagcugc

SEQ ID NO: 1813899 - RNA, 19 nt, Human
cuuggggaccagagcugcc

SEQ ID NO: 1813900 - RNA, 14 nt, Human
cuuggcugcaggga

SEQ ID NO: 1813901 - RNA, 18 nt, Human
cuuguggacacagcucuu

SEQ ID NO: 1813902 - RNA, 17 nt, Human
cuuguggacacagcucu

SEQ ID NO: 1813903 - RNA, 18 nt, Human
cuuguauuauguguguuu

SEQ ID NO: 1813904 - RNA, 21 nt, Human
cuuguaugaaagauggcugug

SEQ ID NO: 1813905 - RNA, 22 nt, Human
cuuguaacuaaaauaauuuugu

SEQ ID NO: 1813906 - RNA, 17 nt, Human
cuuguaacuaaaauaau

SEQ ID NO: 1813907 - RNA, 16 nt, Human
cuuguaacuaaaauaa

SEQ ID NO: 1813908 - RNA, 14 nt, Human
cuuguaacuaaaau

SEQ ID NO: 1813909 - RNA, 23 nt, Human
cuuguauuaaguuguuaauaaaa

SEQ ID NO: 1813910 - RNA, 22 nt, Human
cuuguauuaaguuguuaauaaa

SEQ ID NO: 1813911 - RNA, 13 nt, Human
cuuguauuaugug

SEQ ID NO: 1813912 - RNA, 17 nt, Human
cuuguauuaaguuguua

SEQ ID NO: 1813913 - RNA, 13 nt, Human
cuuguauuaaguu

SEQ ID NO: 1813914 - RNA, 18 nt, Human
cuugcagacucuacagag

SEQ ID NO: 1813915 - RNA, 20 nt, Human
cuugcagacucuacagaggc

SEQ ID NO: 1813916 - RNA, 21 nt, Human
cuugcaugaggcuaguguggu

SEQ ID NO: 1813917 - RNA, 21 nt, Human
cuugcaugguuuagaaagcuu

SEQ ID NO: 1813918 - RNA, 14 nt, Human
cuugcaauggcagc

SEQ ID NO: 1813919 - RNA, 19 nt, Human
cuugcacguauuuuaauag

SEQ ID NO: 1813920 - RNA, 22 nt, Human
cuugcaaaguaucccuacugua

SEQ ID NO: 1813921 - RNA, 13 nt, Human
cuugagcucagga

SEQ ID NO: 1813922 - RNA, 22 nt, Human
cuugagccuugaacuuugaccu

SEQ ID NO: 1813923 - RNA, 20 nt, Human
cuugagccuugaacuuugac

SEQ ID NO: 1813924 - RNA, 19 nt, Human
cuugagccuugaacuuuga

SEQ ID NO: 1813925 - RNA, 17 nt, Human
cuugaccauucuccacc

SEQ ID NO: 1813926 - RNA, 20 nt, Human
cuugaccauucuccaccugc

SEQ ID NO: 1813927 - RNA, 14 nt, Human
cuugagagggugga

SEQ ID NO: 1813928 - RNA, 21 nt, Human
cuugaccauucuccaccugcc

SEQ ID NO: 1813929 - RNA, 18 nt, Human
cuugaacuccuggccuca

SEQ ID NO: 1813930 - RNA, 17 nt, Human
cuugaacuccuggccuc

SEQ ID NO: 1813931 - RNA, 15 nt, Human
cuugaacuccuggcc

SEQ ID NO: 1813932 - RNA, 14 nt, Human
cuugaacuccuggc

SEQ ID NO: 1813933 - RNA, 20 nt, Human
cuugaacccgggaggcagag

SEQ ID NO: 1813934 - RNA, 19 nt, Human
cuugaacccgggaggcaga

SEQ ID NO: 1813935 - RNA, 14 nt, Human
cuugaacccgggag

SEQ ID NO: 1813936 - RNA, 20 nt, Human
cuugaacuggguacuugugg

SEQ ID NO: 1813937 - RNA, 18 nt, Human
cuugaacuggguacuugu

SEQ ID NO: 1813938 - RNA, 15 nt, Human
cuugaacuuugaccu

SEQ ID NO: 1813939 - RNA, 16 nt, Human
cuugaacuggguacuu

SEQ ID NO: 1813940 - RNA, 19 nt, Human
cuugaacuccuggccucaa

SEQ ID NO: 1813941 - RNA, 17 nt, Human
cuucuuuuuuugugaug

SEQ ID NO: 1813942 - RNA, 19 nt, Human
cuugaaauauaggaacuua

SEQ ID NO: 1813943 - RNA, 14 nt, Human
cuuuucccuucuuu

SEQ ID NO: 1813944 - RNA, 16 nt, Human
cuuuucacugcuggcu

SEQ ID NO: 1813945 - RNA, 20 nt, Human
cuuuucgcaggauucuuccu

SEQ ID NO: 1813946 - RNA, 21 nt, Human
cuuuucgcaggauucuuccuc

SEQ ID NO: 1813947 - RNA, 12 nt, Human
cuuuucacugcu

SEQ ID NO: 1813948 - RNA, 22 nt, Human
cuuuucauuuaggugaggaagc

SEQ ID NO: 1813949 - RNA, 13 nt, Human
cuuuuccaacccu

SEQ ID NO: 1813950 - RNA, 23 nt, Human
cuuuuccaacccucaucaccaac

SEQ ID NO: 1813951 - RNA, 18 nt, Human
cuuuuaaaacacuuccau

SEQ ID NO: 1813952 - RNA, 17 nt, Human
cuuuucuuucagccaag

SEQ ID NO: 1813953 - RNA, 13 nt, Human
cuuuucuuuucuu

SEQ ID NO: 1813954 - RNA, 22 nt, Human
cuuuuuaauauugauaugcuua

SEQ ID NO: 1813955 - RNA, 18 nt, Human
cuuuuuuauacauaaaca

SEQ ID NO: 1813956 - RNA, 19 nt, Human
cuuuuuuaucaugugaaau

SEQ ID NO: 1813957 - RNA, 11 nt, Human
gaaaaagaaaa

SEQ ID NO: 1813958 - RNA, 16 nt, Human
gaaaaagaaaaaauau

SEQ ID NO: 1813959 - RNA, 15 nt, Human
cuuuuuuauacauaa

SEQ ID NO: 1813960 - RNA, 17 nt, Human
cuuuuuuauacauaaac

SEQ ID NO: 1813961 - RNA, 16 nt, Human
cuuuuuuauacauaaa

SEQ ID NO: 1813962 - RNA, 14 nt, Human
cuuuccaggaaggc

SEQ ID NO: 1813963 - RNA, 22 nt, Human
cuuuccaaaguacacuguuuca

SEQ ID NO: 1813964 - RNA, 16 nt, Human
cuuuccaaaugcccag

SEQ ID NO: 1813965 - RNA, 16 nt, Human
cuuuccaaaguacacu

SEQ ID NO: 1813966 - RNA, 15 nt, Human
cuuuccccaugucuc

SEQ ID NO: 1813967 - RNA, 20 nt, Human
cuuuccccaugucucgacuc

SEQ ID NO: 1813968 - RNA, 21 nt, Human
cuuuccccaugucucgacuca

SEQ ID NO: 1813969 - RNA, 21 nt, Human
cuuuccgguguuuaagacauu

SEQ ID NO: 1813970 - RNA, 21 nt, Human
cuuguggacacagcucuucuc

SEQ ID NO: 1813971 - RNA, 19 nt, Human
cuuuauuuuguguuuagga

SEQ ID NO: 1813972 - RNA, 15 nt, Human
cuuugcagacaggca

SEQ ID NO: 1813973 - RNA, 14 nt, Human
cuuugcagacaggc

SEQ ID NO: 1813974 - RNA, 19 nt, Human
cuuuggaaagaguaggaag

SEQ ID NO: 1813975 - RNA, 23 nt, Human
cuuuggaaagaguaggaagacuu

SEQ ID NO: 1813976 - RNA, 17 nt, Human
cuuuccugaggcugggc

SEQ ID NO: 1813977 - RNA, 16 nt, Human
cuuuccugaggcuggg

SEQ ID NO: 1813978 - RNA, 20 nt, Human
cuuuccugaggcugggcucc

SEQ ID NO: 1813979 - RNA, 21 nt, Human
cuuuccugaggcugggcuccc

SEQ ID NO: 1813980 - RNA, 15 nt, Human
cugcaccgggccaca

SEQ ID NO: 1813981 - RNA, 14 nt, Human
cugcaccgggccac

SEQ ID NO: 1813982 - RNA, 15 nt, Human
cugcaccggcuggcc

SEQ ID NO: 1813983 - RNA, 16 nt, Human
cugcaccggcuggccu

SEQ ID NO: 1813984 - RNA, 22 nt, Human
cugaggcccuucucuccagccc

SEQ ID NO: 1813985 - RNA, 23 nt, Human
cugaggcccuucucuccagcccc

SEQ ID NO: 1813986 - RNA, 14 nt, Human
cugcaccggcuggc

SEQ ID NO: 1813987 - RNA, 20 nt, Human
cugcaccgggccacagagaa

SEQ ID NO: 1813988 - RNA, 18 nt, Human
cugcaccgggccacagag

SEQ ID NO: 1813989 - RNA, 20 nt, Human
cugcacuccagccuggguga

SEQ ID NO: 1813990 - RNA, 14 nt, Human
cugcacuccccugc

SEQ ID NO: 1813991 - RNA, 13 nt, Human
cugcacuccccug

SEQ ID NO: 1813992 - RNA, 19 nt, Human
cugcacuccccugcugggu

SEQ ID NO: 1813993 - RNA, 20 nt, Human
cugcacuccccugcugggug

SEQ ID NO: 1813994 - RNA, 10 nt, Human
cugcagaggg

SEQ ID NO: 1813995 - RNA, 16 nt, Human
cugcagcaauaaagca

SEQ ID NO: 1813996 - RNA, 15 nt, Human
cugcagcaauaaagc

SEQ ID NO: 1813997 - RNA, 13 nt, Human
cugcagagggcac

SEQ ID NO: 1813998 - RNA, 21 nt, Human
cugcacuccccugcugggugu

SEQ ID NO: 1813999 - RNA, 13 nt, Human
cugcaguugccag

SEQ ID NO: 1814000 - RNA, 16 nt, Human
cugcaguugccaguca

SEQ ID NO: 1814001 - RNA, 19 nt, Human
cugcaggucccuaauaaag

SEQ ID NO: 1814002 - RNA, 20 nt, Human
cugcaggucccuaauaaagc

SEQ ID NO: 1814003 - RNA, 21 nt, Human
cugcaggucccuaauaaagcu

SEQ ID NO: 1814004 - RNA, 22 nt, Human
cugcaggucccuaauaaagcug

SEQ ID NO: 1814005 - RNA, 23 nt, Human
cugcaggucccuaauaaagcugu

SEQ ID NO: 1814006 - RNA, 11 nt, Human
cugcagguccc

SEQ ID NO: 1814007 - RNA, 12 nt, Human
cugcaggucccu

SEQ ID NO: 1814008 - RNA, 13 nt, Human
cugcaggucccua

SEQ ID NO: 1814009 - RNA, 14 nt, Human
cugcaggucccuaa

SEQ ID NO: 1814010 - RNA, 15 nt, Human
cugcaggucccuaau

SEQ ID NO: 1814011 - RNA, 16 nt, Human
cugcaggucccuaaua

SEQ ID NO: 1814012 - RNA, 17 nt, Human
cugcaggucccuaauaa

SEQ ID NO: 1814013 - RNA, 18 nt, Human
cugcaggucccuaauaaa

SEQ ID NO: 1814014 - RNA, 17 nt, Human
cugcagcaauaaagcag

SEQ ID NO: 1814015 - RNA, 20 nt, Human
cugcaucaagaugugacaug

SEQ ID NO: 1814016 - RNA, 15 nt, Human
cugcauaugaaagga

SEQ ID NO: 1814017 - RNA, 14 nt, Human
cugccacccugggg

SEQ ID NO: 1814018 - RNA, 12 nt, Human
cugccacccugg

SEQ ID NO: 1814019 - RNA, 21 nt, Human
cugccacccuggggagaaagu

SEQ ID NO: 1814020 - RNA, 13 nt, Human
cugccaggaagcc

SEQ ID NO: 1814021 - RNA, 14 nt, Human
cugccaggaagcca

SEQ ID NO: 1814022 - RNA, 20 nt, Human
cugccaggaagccagcaggc

SEQ ID NO: 1814023 - RNA, 21 nt, Human
cugccaggaagccagcaggcu

SEQ ID NO: 1814024 - RNA, 21 nt, Human
cugccauccagguucagcuug

SEQ ID NO: 1814025 - RNA, 15 nt, Human
cugccauccucccaa

SEQ ID NO: 1814026 - RNA, 22 nt, Human
cugccaggaagccagcaggcuc

SEQ ID NO: 1814027 - RNA, 20 nt, Human
cugcccaggccccugccacc

SEQ ID NO: 1814028 - RNA, 19 nt, Human
cugcccaggccccugccac

SEQ ID NO: 1814029 - RNA, 18 nt, Human
cugcccaggccccugcca

SEQ ID NO: 1814030 - RNA, 16 nt, Human
cugcccaggccccugc

SEQ ID NO: 1814031 - RNA, 17 nt, Human
cugcccaggccugccug

SEQ ID NO: 1814032 - RNA, 15 nt, Human
cugcccaggccccug

SEQ ID NO: 1814033 - RNA, 14 nt, Human
cugcccaggccccu

SEQ ID NO: 1814034 - RNA, 12 nt, Human
cugcccaccugg

SEQ ID NO: 1814035 - RNA, 15 nt, Human
cugccauuucugaga

SEQ ID NO: 1814036 - RNA, 18 nt, Human
cugccccuggcagccccu

SEQ ID NO: 1814037 - RNA, 19 nt, Human
cugccccuggcagccccug

SEQ ID NO: 1814038 - RNA, 13 nt, Human
cugcccggcaggg

SEQ ID NO: 1814039 - RNA, 20 nt, Human
cugcccggcaggguccuaga

SEQ ID NO: 1814040 - RNA, 22 nt, Human
cugcccuaaugcgcaggcuggc

SEQ ID NO: 1814041 - RNA, 20 nt, Human
cugcccuaaugcgcaggcug

SEQ ID NO: 1814042 - RNA, 21 nt, Human
cugcccuaaugcgcaggcugg

SEQ ID NO: 1814043 - RNA, 13 nt, Human
cugcuugaggcaa

SEQ ID NO: 1814044 - RNA, 20 nt, Human
cugcuugaggcaacucaucu

SEQ ID NO: 1814045 - RNA, 21 nt, Human
cugcuugaggcaacucaucuu

SEQ ID NO: 1814046 - RNA, 12 nt, Human
cugcugcuggcu

SEQ ID NO: 1814047 - RNA, 13 nt, Human
cugcugcuggcug

SEQ ID NO: 1814048 - RNA, 14 nt, Human
cugcuggcugccuu

SEQ ID NO: 1814049 - RNA, 15 nt, Human
cugcuggcugccuua

SEQ ID NO: 1814050 - RNA, 13 nt, Human
cugcuggcugccu

SEQ ID NO: 1814051 - RNA, 14 nt, Human
cugcugcuggcugg

SEQ ID NO: 1814052 - RNA, 14 nt, Human
cugcuggguguggc

SEQ ID NO: 1814053 - RNA, 15 nt, Human
cugcuggguguggcg

SEQ ID NO: 1814054 - RNA, 17 nt, Human
cugcuggguguggcgca

SEQ ID NO: 1814055 - RNA, 15 nt, Human
cugcuuuuggucugu

SEQ ID NO: 1814056 - RNA, 17 nt, Human
cugcuuugggcugcccu

SEQ ID NO: 1814057 - RNA, 16 nt, Human
cugcuuugggcugccc

SEQ ID NO: 1814058 - RNA, 13 nt, Human
cugcuuuggaaau

SEQ ID NO: 1814059 - RNA, 17 nt, Human
cugcuuuuggucugugu

SEQ ID NO: 1814060 - RNA, 19 nt, Human
cugcuuuugucuaugggac

SEQ ID NO: 1814061 - RNA, 19 nt, Human
cugcuugggcuucauccuc

SEQ ID NO: 1814062 - RNA, 19 nt, Human
cugcuugugaaaggaaaga

SEQ ID NO: 1814063 - RNA, 13 nt, Human
cugcuugggcuuc

SEQ ID NO: 1814064 - RNA, 15 nt, Human
cugcuugggcuucau

SEQ ID NO: 1814065 - RNA, 17 nt, Human
cugcuugggcuucaucc

SEQ ID NO: 1814066 - RNA, 18 nt, Human
cugcuugggcuucauccu

SEQ ID NO: 1814067 - RNA, 22 nt, Human
cugcuugaggcaacucaucuua

SEQ ID NO: 1814068 - RNA, 20 nt, Human
cugcuugcuugcuuuuuaau

SEQ ID NO: 1814069 - RNA, 16 nt, Human
cugccugaagucacac

SEQ ID NO: 1814070 - RNA, 18 nt, Human
cugccugaagucacacag

SEQ ID NO: 1814071 - RNA, 21 nt, Human
cugcccugcccaccuggccuc

SEQ ID NO: 1814072 - RNA, 20 nt, Human
cugcccugcccaccuggccu

SEQ ID NO: 1814073 - RNA, 17 nt, Human
cugcccugcccaccugg

SEQ ID NO: 1814074 - RNA, 19 nt, Human
cugccugaagucacacagu

SEQ ID NO: 1814075 - RNA, 23 nt, Human
cugccugaagucacacagugagu

SEQ ID NO: 1814076 - RNA, 20 nt, Human
cugccugcaguacuuuaccu

SEQ ID NO: 1814077 - RNA, 21 nt, Human
cugccugcaguacuuuaccuc

SEQ ID NO: 1814078 - RNA, 23 nt, Human
cugcgguccacccaggagccccg

SEQ ID NO: 1814079 - RNA, 22 nt, Human
cugcgggucacaggagggaggg

SEQ ID NO: 1814080 - RNA, 23 nt, Human
cugcgggucacaggagggagggg

SEQ ID NO: 1814081 - RNA, 18 nt, Human
cugcggugcuaucucccc

SEQ ID NO: 1814082 - RNA, 19 nt, Human
cugcggugcuaucuccccc

SEQ ID NO: 1814083 - RNA, 15 nt, Human
cugcgggucacagga

SEQ ID NO: 1814084 - RNA, 21 nt, Human
cugcgggucacaggagggagg

SEQ ID NO: 1814085 - RNA, 22 nt, Human
cugccugcuuuuuauggccugu

SEQ ID NO: 1814086 - RNA, 19 nt, Human
cugcucuccgaccagacac

SEQ ID NO: 1814087 - RNA, 15 nt, Human
cugcucuccgaccag

SEQ ID NO: 1814088 - RNA, 20 nt, Human
cugcuccucuccccagcaag

SEQ ID NO: 1814089 - RNA, 19 nt, Human
cugcuccucuccccagcaa

SEQ ID NO: 1814090 - RNA, 23 nt, Human
cugcuccucuccccagcaaguga

SEQ ID NO: 1814091 - RNA, 20 nt, Human
cugcggugcuaucuccccca

SEQ ID NO: 1814092 - RNA, 21 nt, Human
cugcggugcuaucucccccag

SEQ ID NO: 1814093 - RNA, 22 nt, Human
cugcggugcuaucucccccagc

SEQ ID NO: 1814094 - RNA, 23 nt, Human
cugcggugcuaucucccccagcc

SEQ ID NO: 1814095 - RNA, 20 nt, Human
cugcucugaugaagaggagu

SEQ ID NO: 1814096 - RNA, 12 nt, Human
cugcucugguua

SEQ ID NO: 1814097 - RNA, 16 nt, Human
cugcucuugaacuccu

SEQ ID NO: 1814098 - RNA, 18 nt, Human
cugcucuugaacuccuga

SEQ ID NO: 1814099 - RNA, 19 nt, Human
cugcucuugaacuccugac

SEQ ID NO: 1814100 - RNA, 14 nt, Human
cugcugccugcuuu

SEQ ID NO: 1814101 - RNA, 23 nt, Human
cugcugccugcuuuuuauggccu

SEQ ID NO: 1814102 - RNA, 15 nt, Human
cugcugcaguugcca

SEQ ID NO: 1814103 - RNA, 14 nt, Human
cugcugcaguugcc

SEQ ID NO: 1814104 - RNA, 10 nt, Human
cugcugcagu

SEQ ID NO: 1814105 - RNA, 13 nt, Human
cugcugcaguugc

SEQ ID NO: 1814106 - RNA, 18 nt, Human
cuguaucccaugagccuc

SEQ ID NO: 1814107 - RNA, 19 nt, Human
cuguaucccaugagccuca

SEQ ID NO: 1814108 - RNA, 20 nt, Human
cuguaugucucgugguagga

SEQ ID NO: 1814109 - RNA, 15 nt, Human
cuguaucccaugagc

SEQ ID NO: 1814110 - RNA, 14 nt, Human
cuguaucccaugag

SEQ ID NO: 1814111 - RNA, 22 nt, Human
cuguaccucuugagccuugaac

SEQ ID NO: 1814112 - RNA, 22 nt, Human
cugucccagugccgagaaggaa

SEQ ID NO: 1814113 - RNA, 20 nt, Human
cuguccaggcacugcugccc

SEQ ID NO: 1814114 - RNA, 21 nt, Human
cuguccaggcacugcugccca

SEQ ID NO: 1814115 - RNA, 22 nt, Human
cuguccaggcacugcugcccag

SEQ ID NO: 1814116 - RNA, 18 nt, Human
cuguccaggcacugcugc

SEQ ID NO: 1814117 - RNA, 19 nt, Human
cuguccaggcacugcugcc

SEQ ID NO: 1814118 - RNA, 18 nt, Human
cugucucuacuaaaaaua

SEQ ID NO: 1814119 - RNA, 21 nt, Human
cuguccuacucugugucaggu

SEQ ID NO: 1814120 - RNA, 14 nt, Human
cuguccgagcuuug

SEQ ID NO: 1814121 - RNA, 22 nt, Human
cugucucaaaaaaagaaaaaga

SEQ ID NO: 1814122 - RNA, 18 nt, Human
cugucucaagagggcacu

SEQ ID NO: 1814123 - RNA, 19 nt, Human
cugucucaagagggcacug

SEQ ID NO: 1814124 - RNA, 20 nt, Human
cugucucaagagggcacugg

SEQ ID NO: 1814125 - RNA, 21 nt, Human
cugucucaagagggcacuggu

SEQ ID NO: 1814126 - RNA, 20 nt, Human
cuguccuacucugugucagg

SEQ ID NO: 1814127 - RNA, 18 nt, Human
cuguccuacucuguguca

SEQ ID NO: 1814128 - RNA, 17 nt, Human
cuguccuacucuguguc

SEQ ID NO: 1814129 - RNA, 16 nt, Human
cuguccuacucugugu

SEQ ID NO: 1814130 - RNA, 13 nt, Human
cugucccccugac

SEQ ID NO: 1814131 - RNA, 14 nt, Human
cugucccccugaca

SEQ ID NO: 1814132 - RNA, 13 nt, Human
cuggucccacuca

SEQ ID NO: 1814133 - RNA, 14 nt, Human
cuggucccacucag

SEQ ID NO: 1814134 - RNA, 23 nt, Human
cuggucucaaacucuugaccuca

SEQ ID NO: 1814135 - RNA, 19 nt, Human
cuggucacaggacucugcc

SEQ ID NO: 1814136 - RNA, 20 nt, Human
cuggucacaggacucugccu

SEQ ID NO: 1814137 - RNA, 21 nt, Human
cuggucacaggacucugccuc

SEQ ID NO: 1814138 - RNA, 22 nt, Human
cuggucacaggacucugccucc

SEQ ID NO: 1814139 - RNA, 23 nt, Human
cuggucacaggacucugccuccu

SEQ ID NO: 1814140 - RNA, 14 nt, Human
cuggguacuugugg

SEQ ID NO: 1814141 - RNA, 16 nt, Human
cuggguacuuguggac

SEQ ID NO: 1814142 - RNA, 18 nt, Human
cuggguacuuguggacac

SEQ ID NO: 1814143 - RNA, 19 nt, Human
cuggguacuuguggacaca

SEQ ID NO: 1814144 - RNA, 20 nt, Human
cugggcucccuucccaccuc

SEQ ID NO: 1814145 - RNA, 21 nt, Human
cugggcucccuucccaccucu

SEQ ID NO: 1814146 - RNA, 22 nt, Human
cugggcucccuucccaccucuc

SEQ ID NO: 1814147 - RNA, 15 nt, Human
cuggguuggagggug

SEQ ID NO: 1814148 - RNA, 17 nt, Human
cugggucgcccuggacu

SEQ ID NO: 1814149 - RNA, 18 nt, Human
cugggucgcccuggacug

SEQ ID NO: 1814150 - RNA, 22 nt, Human
cugggucgcccuggacugugug

SEQ ID NO: 1814151 - RNA, 23 nt, Human
cuguacaugaaaacacauuuuuc

SEQ ID NO: 1814152 - RNA, 22 nt, Human
cuguacaugaaaacacauuuuu

SEQ ID NO: 1814153 - RNA, 21 nt, Human
cuguaccucuugagccuugaa

SEQ ID NO: 1814154 - RNA, 17 nt, Human
cuguaauuugugauaca

SEQ ID NO: 1814155 - RNA, 18 nt, Human
cuguaauuugugauacaa

SEQ ID NO: 1814156 - RNA, 22 nt, Human
cuguaauuugugauacaaugcu

SEQ ID NO: 1814157 - RNA, 21 nt, Human
cuguaauuugugauacaaugc

SEQ ID NO: 1814158 - RNA, 23 nt, Human
cuguacagagcccacgcccccac

SEQ ID NO: 1814159 - RNA, 16 nt, Human
cugguggcagcucacc

SEQ ID NO: 1814160 - RNA, 13 nt, Human
cugguggcagcuc

SEQ ID NO: 1814161 - RNA, 14 nt, Human
cugguggcagcuca

SEQ ID NO: 1814162 - RNA, 12 nt, Human
cugguggcagcu

SEQ ID NO: 1814163 - RNA, 16 nt, Human
cuggucucgaacuccu

SEQ ID NO: 1814164 - RNA, 20 nt, Human
cugguucaggguuggccccu

SEQ ID NO: 1814165 - RNA, 23 nt, Human
cugguuaauauuuauaggucacu

SEQ ID NO: 1814166 - RNA, 18 nt, Human
cuguaaggcaaucauggu

SEQ ID NO: 1814167 - RNA, 17 nt, Human
cuggcuguuggcugggg

SEQ ID NO: 1814168 - RNA, 16 nt, Human
cuggcuguuggcuggg

SEQ ID NO: 1814169 - RNA, 20 nt, Human
cuggcugguuagagguuccc

SEQ ID NO: 1814170 - RNA, 18 nt, Human
cuggcuguuggcuggggg

SEQ ID NO: 1814171 - RNA, 23 nt, Human
cuggcuuuucacugcuggcugcc

SEQ ID NO: 1814172 - RNA, 17 nt, Human
cugggagagccuuccag

SEQ ID NO: 1814173 - RNA, 18 nt, Human
cugggagagccuuccagg

SEQ ID NO: 1814174 - RNA, 21 nt, Human
cugggagagccuuccaggggu

SEQ ID NO: 1814175 - RNA, 19 nt, Human
cugggagagccuuccaggg

SEQ ID NO: 1814176 - RNA, 20 nt, Human
cugggagagccuuccagggg

SEQ ID NO: 1814177 - RNA, 17 nt, Human
cugggauuacaggugug

SEQ ID NO: 1814178 - RNA, 20 nt, Human
cugggauuacaggugugaac

SEQ ID NO: 1814179 - RNA, 16 nt, Human
cugggauuacaggugu

SEQ ID NO: 1814180 - RNA, 18 nt, Human
cugggauuacagguguga

SEQ ID NO: 1814181 - RNA, 12 nt, Human
cugggagugagc

SEQ ID NO: 1814182 - RNA, 20 nt, Human
cugggaucccucauccucau

SEQ ID NO: 1814183 - RNA, 20 nt, Human
cugggaucacauguggacuu

SEQ ID NO: 1814184 - RNA, 18 nt, Human
cugggaugauuggagggg

SEQ ID NO: 1814185 - RNA, 15 nt, Human
cugggccccaguugu

SEQ ID NO: 1814186 - RNA, 19 nt, Human
cugggccccaguuguauuu

SEQ ID NO: 1814187 - RNA, 18 nt, Human
cugggaggcucuggagcc

SEQ ID NO: 1814188 - RNA, 20 nt, Human
cugggaggcucuggagccca

SEQ ID NO: 1814189 - RNA, 21 nt, Human
cugggaggcucuggagcccac

SEQ ID NO: 1814190 - RNA, 17 nt, Human
cugggaggcucuggagc

SEQ ID NO: 1814191 - RNA, 22 nt, Human
cugggaggcucuggagcccacu

SEQ ID NO: 1814192 - RNA, 19 nt, Human
cugggaggucaaggcugca

SEQ ID NO: 1814193 - RNA, 21 nt, Human
cugggaggucaaggcugcagu

SEQ ID NO: 1814194 - RNA, 23 nt, Human
cuggccucaagugauucuccugc

SEQ ID NO: 1814195 - RNA, 12 nt, Human
cuggccucugca

SEQ ID NO: 1814196 - RNA, 14 nt, Human
cuggccuggccccu

SEQ ID NO: 1814197 - RNA, 18 nt, Human
cuggccugagcugggaug

SEQ ID NO: 1814198 - RNA, 13 nt, Human
cuggccucugcac

SEQ ID NO: 1814199 - RNA, 14 nt, Human
cuggccucugcacu

SEQ ID NO: 1814200 - RNA, 16 nt, Human
cuggccucugcacucc

SEQ ID NO: 1814201 - RNA, 16 nt, Human
cuggccugagcuggga

SEQ ID NO: 1814202 - RNA, 16 nt, Human
cuggccuggccccuca

SEQ ID NO: 1814203 - RNA, 17 nt, Human
cuggccuggccccucag

SEQ ID NO: 1814204 - RNA, 19 nt, Human
cuggccuggccccucaggg

SEQ ID NO: 1814205 - RNA, 15 nt, Human
cuggccuucggccuc

SEQ ID NO: 1814206 - RNA, 21 nt, Human
cuggccuucggccuccauccu

SEQ ID NO: 1814207 - RNA, 18 nt, Human
cuggccuucggccuccau

SEQ ID NO: 1814208 - RNA, 17 nt, Human
cuggccuucggccucca

SEQ ID NO: 1814209 - RNA, 16 nt, Human
cuggccuucggccucc

SEQ ID NO: 1814210 - RNA, 22 nt, Human
cuggcacuauaauguaagcucu

SEQ ID NO: 1814211 - RNA, 15 nt, Human
cuggcacuauaaugu

SEQ ID NO: 1814212 - RNA, 16 nt, Human
cuggcacuauaaugua

SEQ ID NO: 1814213 - RNA, 16 nt, Human
cuggcaugggaaugaa

SEQ ID NO: 1814214 - RNA, 18 nt, Human
cuggcaugggaaugaaug

SEQ ID NO: 1814215 - RNA, 19 nt, Human
cuggcaugggaaugaaugu

SEQ ID NO: 1814216 - RNA, 22 nt, Human
cuggcaugggaaugaaugucag

SEQ ID NO: 1814217 - RNA, 24 nt, Human
cuggcaugggaaugaaugucagug

SEQ ID NO: 1814218 - RNA, 18 nt, Human
cuggcacccggccccugc

SEQ ID NO: 1814219 - RNA, 17 nt, Human
cuggcacccggccccug

SEQ ID NO: 1814220 - RNA, 16 nt, Human
cuggcacccggccccu

SEQ ID NO: 1814221 - RNA, 15 nt, Human
cuggcacagggcagu

SEQ ID NO: 1814222 - RNA, 16 nt, Human
cuggcacagggcagug

SEQ ID NO: 1814223 - RNA, 20 nt, Human
cuggaagugcuaauuuugaa

SEQ ID NO: 1814224 - RNA, 18 nt, Human
cuggaauauauaaccagu

SEQ ID NO: 1814225 - RNA, 14 nt, Human
cuggcaagaaugug

SEQ ID NO: 1814226 - RNA, 19 nt, Human
cucuuggguucaagcgauu

SEQ ID NO: 1814227 - RNA, 15 nt, Human
cucuugaacuccuga

SEQ ID NO: 1814228 - RNA, 21 nt, Human
cucuuggguucaagcgauucu

SEQ ID NO: 1814229 - RNA, 19 nt, Human
cucuuggguucaagugauu

SEQ ID NO: 1814230 - RNA, 22 nt, Human
cucuugaaauauaggaacuuaa

SEQ ID NO: 1814231 - RNA, 23 nt, Human
cucuuuaaugucacaggcagguc

SEQ ID NO: 1814232 - RNA, 22 nt, Human
cucuuuaaugucacaggcaggu

SEQ ID NO: 1814233 - RNA, 21 nt, Human
cucuuuaaugucacaggcagg

SEQ ID NO: 1814234 - RNA, 20 nt, Human
cucuuuaaugucacaggcag

SEQ ID NO: 1814235 - RNA, 17 nt, Human
cucuuucccucccuucc

SEQ ID NO: 1814236 - RNA, 18 nt, Human
cucuuuaaugucacaggc

SEQ ID NO: 1814237 - RNA, 13 nt, Human
cucuugguccugc

SEQ ID NO: 1814238 - RNA, 15 nt, Human
cucuugguccugcug

SEQ ID NO: 1814239 - RNA, 16 nt, Human
cucuugguccugcugc

SEQ ID NO: 1814240 - RNA, 17 nt, Human
cucuugguccugcugca

SEQ ID NO: 1814241 - RNA, 16 nt, Human
cugaacucugacaaca

SEQ ID NO: 1814242 - RNA, 17 nt, Human
cugaacucugacaacag

SEQ ID NO: 1814243 - RNA, 19 nt, Human
cugaagaauugaaaaacca

SEQ ID NO: 1814244 - RNA, 15 nt, Human
cugaaagcccugagc

SEQ ID NO: 1814245 - RNA, 17 nt, Human
cucuuucuauuguuucu

SEQ ID NO: 1814246 - RNA, 22 nt, Human
cugaaauagacccacaagaggc

SEQ ID NO: 1814247 - RNA, 23 nt, Human
cugaaagcccugagcuuucugcu

SEQ ID NO: 1814248 - RNA, 16 nt, Human
cugaaagcccugagcu

SEQ ID NO: 1814249 - RNA, 17 nt, Human
cugaaagcccugagcuu

SEQ ID NO: 1814250 - RNA, 18 nt, Human
cugaaagcccugagcuuu

SEQ ID NO: 1814251 - RNA, 19 nt, Human
cugaaagcccugagcuuuc

SEQ ID NO: 1814252 - RNA, 22 nt, Human
cucuggcuccagcuggccggga

SEQ ID NO: 1814253 - RNA, 13 nt, Human
cucuuccaggcug

SEQ ID NO: 1814254 - RNA, 14 nt, Human
cucuuccaggcugg

SEQ ID NO: 1814255 - RNA, 15 nt, Human
cucuuccaggcuggg

SEQ ID NO: 1814256 - RNA, 13 nt, Human
cucuuagaaaaac

SEQ ID NO: 1814257 - RNA, 15 nt, Human
cucuuagaaaaacca

SEQ ID NO: 1814258 - RNA, 15 nt, Human
cucugugucaggugg

SEQ ID NO: 1814259 - RNA, 19 nt, Human
cucugugucagguggggca

SEQ ID NO: 1814260 - RNA, 22 nt, Human
cucuguuacacuuuuuggaagu

SEQ ID NO: 1814261 - RNA, 12 nt, Human
cucuggcagcuc

SEQ ID NO: 1814262 - RNA, 14 nt, Human
cucuggcagcucag

SEQ ID NO: 1814263 - RNA, 22 nt, Human
cucuggacaggcauguucucug

SEQ ID NO: 1814264 - RNA, 16 nt, Human
cucuggacaggcaugu

SEQ ID NO: 1814265 - RNA, 19 nt, Human
cucuggagcccacuguacu

SEQ ID NO: 1814266 - RNA, 15 nt, Human
cucuggcuccagcug

SEQ ID NO: 1814267 - RNA, 16 nt, Human
cucuggcuccagcugg

SEQ ID NO: 1814268 - RNA, 19 nt, Human
cucuggccuucggccucca

SEQ ID NO: 1814269 - RNA, 15 nt, Human
cucuggcagcucaga

SEQ ID NO: 1814270 - RNA, 16 nt, Human
cucuggcagcucagag

SEQ ID NO: 1814271 - RNA, 12 nt, Human
cucuggccuucg

SEQ ID NO: 1814272 - RNA, 15 nt, Human
cucuggacaggcaug

SEQ ID NO: 1814273 - RNA, 22 nt, Human
cucugccugaagucacacagug

SEQ ID NO: 1814274 - RNA, 21 nt, Human
cucugccugaagucacacagu

SEQ ID NO: 1814275 - RNA, 13 nt, Human
cucucuccucccu

SEQ ID NO: 1814276 - RNA, 22 nt, Human
cugagccucagucucccucccu

SEQ ID NO: 1814277 - RNA, 20 nt, Human
cugagcgacagugagacucu

SEQ ID NO: 1814278 - RNA, 16 nt, Human
cugagcgacagugaga

SEQ ID NO: 1814279 - RNA, 16 nt, Human
cugagccucagucucc

SEQ ID NO: 1814280 - RNA, 21 nt, Human
cugagccucagucucccuccc

SEQ ID NO: 1814281 - RNA, 16 nt, Human
cugagacagcccgggc

SEQ ID NO: 1814282 - RNA, 17 nt, Human
cugagacagcccgggcu

SEQ ID NO: 1814283 - RNA, 18 nt, Human
cugagacagcccgggcuc

SEQ ID NO: 1814284 - RNA, 17 nt, Human
cugagccagauuucacu

SEQ ID NO: 1814285 - RNA, 18 nt, Human
cugagccagauuucacuc

SEQ ID NO: 1814286 - RNA, 19 nt, Human
cugagccagauuucacucu

SEQ ID NO: 1814287 - RNA, 20 nt, Human
cugagccagauuucacucuc

SEQ ID NO: 1814288 - RNA, 21 nt, Human
cugagccagauuucacucucc

SEQ ID NO: 1814289 - RNA, 19 nt, Human
cugaggaucagaguaaucc

SEQ ID NO: 1814290 - RNA, 17 nt, Human
cugaggaucagaguaau

SEQ ID NO: 1814291 - RNA, 12 nt, Human
cugaggcccaga

SEQ ID NO: 1814292 - RNA, 13 nt, Human
cugaggcccagag

SEQ ID NO: 1814293 - RNA, 14 nt, Human
cugaggcccagagg

SEQ ID NO: 1814294 - RNA, 15 nt, Human
cugaggcccagaggg

SEQ ID NO: 1814295 - RNA, 16 nt, Human
cugaggcccagagggc

SEQ ID NO: 1814296 - RNA, 17 nt, Human
cugaggcccagagggcc

SEQ ID NO: 1814297 - RNA, 18 nt, Human
cugaggcccagagggccu

SEQ ID NO: 1814298 - RNA, 19 nt, Human
cugaggcccagagggccug

SEQ ID NO: 1814299 - RNA, 21 nt, Human
cugaggcccagagggccugca

SEQ ID NO: 1814300 - RNA, 23 nt, Human
cugaggcccagagggccugcaag

SEQ ID NO: 1814301 - RNA, 14 nt, Human
cugaggcccuucuc

SEQ ID NO: 1814302 - RNA, 15 nt, Human
cugaggcccuucucu

SEQ ID NO: 1814303 - RNA, 18 nt, Human
cugaggcccuucucucca

SEQ ID NO: 1814304 - RNA, 19 nt, Human
cugaggcccuucucuccag

SEQ ID NO: 1814305 - RNA, 20 nt, Human
cugaggcccuucucuccagc

SEQ ID NO: 1814306 - RNA, 21 nt, Human
cugacaggcaaugcuggcugu

SEQ ID NO: 1814307 - RNA, 19 nt, Human
cugaagacucauucuucug

SEQ ID NO: 1814308 - RNA, 22 nt, Human
cugacauuguuggccaaagcca

SEQ ID NO: 1814309 - RNA, 18 nt, Human
cugaccaauauuguacag

SEQ ID NO: 1814310 - RNA, 15 nt, Human
cugaccaauauugua

SEQ ID NO: 1814311 - RNA, 21 nt, Human
cugaccaauauuguacaguuu

SEQ ID NO: 1814312 - RNA, 20 nt, Human
cugaccaauauuguacaguu

SEQ ID NO: 1814313 - RNA, 19 nt, Human
cugaccaauauuguacagu

SEQ ID NO: 1814314 - RNA, 14 nt, Human
cugacccacugcuu

SEQ ID NO: 1814315 - RNA, 13 nt, Human
cugacccacugcu

SEQ ID NO: 1814316 - RNA, 13 nt, Human
cugacccaugcug

SEQ ID NO: 1814317 - RNA, 16 nt, Human
cugacccaugcugccc

SEQ ID NO: 1814318 - RNA, 14 nt, Human
cugacccaugcugc

SEQ ID NO: 1814319 - RNA, 15 nt, Human
cugacccaugcugcc

SEQ ID NO: 1814320 - RNA, 16 nt, Human
cugacuguuuucucuu

SEQ ID NO: 1814321 - RNA, 18 nt, Human
cugacuguuuucucuuga

SEQ ID NO: 1814322 - RNA, 11 nt, Human
cugagaaauuu

SEQ ID NO: 1814323 - RNA, 14 nt, Human
cugagaaauuuaua

SEQ ID NO: 1814324 - RNA, 14 nt, Human
cugagacagcccgg

SEQ ID NO: 1814325 - RNA, 15 nt, Human
cugagacagcccggg

SEQ ID NO: 1814326 - RNA, 20 nt, Human
cucccggcuaugggggcacu

SEQ ID NO: 1814327 - RNA, 18 nt, Human
cucccgaguagcugggac

SEQ ID NO: 1814328 - RNA, 19 nt, Human
cucccgaauagcugggacu

SEQ ID NO: 1814329 - RNA, 17 nt, Human
cucccgaguagcuggga

SEQ ID NO: 1814330 - RNA, 16 nt, Human
cucccgaguagcuggg

SEQ ID NO: 1814331 - RNA, 18 nt, Human
cucccgaauagcugggac

SEQ ID NO: 1814332 - RNA, 15 nt, Human
cucccgaguagcugg

SEQ ID NO: 1814333 - RNA, 16 nt, Human
cucccgaauagcuggg

SEQ ID NO: 1814334 - RNA, 17 nt, Human
cucccgaauagcuggga

SEQ ID NO: 1814335 - RNA, 13 nt, Human
cuccccugcuggg

SEQ ID NO: 1814336 - RNA, 14 nt, Human
cuccccugcugggu

SEQ ID NO: 1814337 - RNA, 12 nt, Human
cuccccugcugg

SEQ ID NO: 1814338 - RNA, 21 nt, Human
cuccccagcaagugagagcug

SEQ ID NO: 1814339 - RNA, 20 nt, Human
cuccccagcaagugagagcu

SEQ ID NO: 1814340 - RNA, 12 nt, Human
cuccccagcaag

SEQ ID NO: 1814341 - RNA, 18 nt, Human
cucacuauguugcccagg

SEQ ID NO: 1814342 - RNA, 14 nt, Human
cuccaucuccacuc

SEQ ID NO: 1814343 - RNA, 20 nt, Human
cuccauccugaggcuccacu

SEQ ID NO: 1814344 - RNA, 18 nt, Human
cuccauccugaggcucca

SEQ ID NO: 1814345 - RNA, 16 nt, Human
cuccauccugaggcuc

SEQ ID NO: 1814346 - RNA, 11 nt, Human
cuccauccuga

SEQ ID NO: 1814347 - RNA, 13 nt, Human
cuccaugugggcu

SEQ ID NO: 1814348 - RNA, 17 nt, Human
cucccaaagugcuggga

SEQ ID NO: 1814349 - RNA, 13 nt, Human
cuccaugucucug

SEQ ID NO: 1814350 - RNA, 22 nt, Human
cuccaugucucugagcauuaga

SEQ ID NO: 1814351 - RNA, 16 nt, Human
cuccaucuccacucca

SEQ ID NO: 1814352 - RNA, 11 nt, Human
cucccaucugu

SEQ ID NO: 1814353 - RNA, 14 nt, Human
cucccaucugugaa

SEQ ID NO: 1814354 - RNA, 15 nt, Human
cucccaucugugaaa

SEQ ID NO: 1814355 - RNA, 18 nt, Human
cucccaucugugaaagga

SEQ ID NO: 1814356 - RNA, 23 nt, Human
cucccaucugugaaaggaaagag

SEQ ID NO: 1814357 - RNA, 18 nt, Human
cucccaaagugcugggau

SEQ ID NO: 1814358 - RNA, 22 nt, Human
cucccaaagugcugggauuaca

SEQ ID NO: 1814359 - RNA, 17 nt, Human
cucccaacucaccccag

SEQ ID NO: 1814360 - RNA, 22 nt, Human
cucccaacucaccccagcccca

SEQ ID NO: 1814361 - RNA, 15 nt, Human
cuccgaccagacacc

SEQ ID NO: 1814362 - RNA, 13 nt, Human
cucccucauucca

SEQ ID NO: 1814363 - RNA, 22 nt, Human
cuccucuccccagcaagugaga

SEQ ID NO: 1814364 - RNA, 14 nt, Human
cuccucccggugcc

SEQ ID NO: 1814365 - RNA, 15 nt, Human
cuccucccggugccc

SEQ ID NO: 1814366 - RNA, 17 nt, Human
cuccucccggugcccaa

SEQ ID NO: 1814367 - RNA, 14 nt, Human
cuccugccucagcc

SEQ ID NO: 1814368 - RNA, 13 nt, Human
cuccugccucagc

SEQ ID NO: 1814369 - RNA, 11 nt, Human
cuccugcccuu

SEQ ID NO: 1814370 - RNA, 18 nt, Human
cuccugcaggcagccagg

SEQ ID NO: 1814371 - RNA, 20 nt, Human
cuccugcaggcagccaggcc

SEQ ID NO: 1814372 - RNA, 11 nt, Human
cuccugcaggc

SEQ ID NO: 1814373 - RNA, 12 nt, Human
cuccugcaggca

SEQ ID NO: 1814374 - RNA, 16 nt, Human
cuccugcaggcagcca

SEQ ID NO: 1814375 - RNA, 17 nt, Human
cuccugcaggcagccag

SEQ ID NO: 1814376 - RNA, 19 nt, Human
cuccugugugugcgccuac

SEQ ID NO: 1814377 - RNA, 16 nt, Human
cuccugugugugcgcc

SEQ ID NO: 1814378 - RNA, 15 nt, Human
cuccugccucagccu

SEQ ID NO: 1814379 - RNA, 16 nt, Human
cuccugccucagccuc

SEQ ID NO: 1814380 - RNA, 23 nt, Human
cucuagggaaaaaccagcgugug

SEQ ID NO: 1814381 - RNA, 13 nt, Human
cucuacccuggca

SEQ ID NO: 1814382 - RNA, 20 nt, Human
cucuaccauccccuguagag

SEQ ID NO: 1814383 - RNA, 17 nt, Human
cucuacuuagcaugucc

SEQ ID NO: 1814384 - RNA, 19 nt, Human
cucuacuuagcaugucccu

SEQ ID NO: 1814385 - RNA, 20 nt, Human
cucuacuuagcaugucccua

SEQ ID NO: 1814386 - RNA, 16 nt, Human
cucuacuuagcauguc

SEQ ID NO: 1814387 - RNA, 20 nt, Human
cuccugugugugcgccuaca

SEQ ID NO: 1814388 - RNA, 16 nt, Human
cuccuucacagauggg

SEQ ID NO: 1814389 - RNA, 17 nt, Human
cuccuucacagaugggu

SEQ ID NO: 1814390 - RNA, 13 nt, Human
cuccuucaccuuu

SEQ ID NO: 1814391 - RNA, 19 nt, Human
cuccuucacagaugggugc

SEQ ID NO: 1814392 - RNA, 17 nt, Human
cucggcucacugcaucc

SEQ ID NO: 1814393 - RNA, 18 nt, Human
cucggcucacugcauccu

SEQ ID NO: 1814394 - RNA, 14 nt, Human
cucggcucacugca

SEQ ID NO: 1814395 - RNA, 16 nt, Human
cucuacagaggccaug

SEQ ID NO: 1814396 - RNA, 14 nt, Human
cucuacagaggcca

SEQ ID NO: 1814397 - RNA, 19 nt, Human
cucuacagaggccaugggc

SEQ ID NO: 1814398 - RNA, 21 nt, Human
cucuacagcuaaucagcauuc

SEQ ID NO: 1814399 - RNA, 13 nt, Human
cucuacagaggcc

SEQ ID NO: 1814400 - RNA, 13 nt, Human
cucuacaaaaagc

SEQ ID NO: 1814401 - RNA, 24 nt, Human
cucuccccagcaagugagagcugg

SEQ ID NO: 1814402 - RNA, 12 nt, Human
cucuccucugcu

SEQ ID NO: 1814403 - RNA, 22 nt, Human
cucuccccagcaagugagagcu

SEQ ID NO: 1814404 - RNA, 14 nt, Human
cucuccccagcaag

SEQ ID NO: 1814405 - RNA, 15 nt, Human
cucuccacugccuuc

SEQ ID NO: 1814406 - RNA, 19 nt, Human
cucuccagccccuggaugc

SEQ ID NO: 1814407 - RNA, 13 nt, Human
cucuccucugcug

SEQ ID NO: 1814408 - RNA, 14 nt, Human
cucuccucugcugc

SEQ ID NO: 1814409 - RNA, 15 nt, Human
cucuccucugcugcu

SEQ ID NO: 1814410 - RNA, 18 nt, Human
cucuccucugcugcuggc

SEQ ID NO: 1814411 - RNA, 14 nt, Human
cucuccucuugcca

SEQ ID NO: 1814412 - RNA, 15 nt, Human
cucuccucuugccac

SEQ ID NO: 1814413 - RNA, 16 nt, Human
cucuccucuugccacu

SEQ ID NO: 1814414 - RNA, 17 nt, Human
cucuccucuugccacug

SEQ ID NO: 1814415 - RNA, 19 nt, Human
cucuccucuugccacugcc

SEQ ID NO: 1814416 - RNA, 22 nt, Human
cucuccucuugccacugccucu

SEQ ID NO: 1814417 - RNA, 14 nt, Human
cucucucacuccuu

SEQ ID NO: 1814418 - RNA, 13 nt, Human
cucucucaggcca

SEQ ID NO: 1814419 - RNA, 12 nt, Human
cucucucacucc

SEQ ID NO: 1814420 - RNA, 21 nt, Human
cucuaguuugauuaaauucuu

SEQ ID NO: 1814421 - RNA, 20 nt, Human
cucuaguuugauuaaauucu

SEQ ID NO: 1814422 - RNA, 19 nt, Human
cucuaguuugauuaaauuc

SEQ ID NO: 1814423 - RNA, 15 nt, Human
cucuaguuugauuaa

SEQ ID NO: 1814424 - RNA, 12 nt, Human
cucucaggccaa

SEQ ID NO: 1814425 - RNA, 20 nt, Human
cucucaggccaaacucaccu

SEQ ID NO: 1814426 - RNA, 21 nt, Human
cucucaggccaaacucaccug

SEQ ID NO: 1814427 - RNA, 22 nt, Human
cucucaggccaaacucaccugc

SEQ ID NO: 1814428 - RNA, 23 nt, Human
cucucaggccaaacucaccugcc

SEQ ID NO: 1814429 - RNA, 13 nt, Human
cucucaggccagc

SEQ ID NO: 1814430 - RNA, 15 nt, Human
cucucaggccagcug

SEQ ID NO: 1814431 - RNA, 17 nt, Human
cucucaggccagcugcu

SEQ ID NO: 1814432 - RNA, 18 nt, Human
cucucaggccagcugcuu

SEQ ID NO: 1814433 - RNA, 19 nt, Human
cucucaggccagcugcuug

SEQ ID NO: 1814434 - RNA, 21 nt, Human
cucucaggccagcugcuuggg

SEQ ID NO: 1814435 - RNA, 11 nt, Human
cucuccacugc

SEQ ID NO: 1814436 - RNA, 12 nt, Human
cucuccacugcc

SEQ ID NO: 1814437 - RNA, 14 nt, Human
cucuccacugccuu

SEQ ID NO: 1814438 - RNA, 14 nt, Human
cucuccagccccug

SEQ ID NO: 1814439 - RNA, 15 nt, Human
cucuccagccccugg

SEQ ID NO: 1814440 - RNA, 16 nt, Human
cucuccagccccugga

SEQ ID NO: 1814441 - RNA, 17 nt, Human
cucuccagccccuggau

SEQ ID NO: 1814442 - RNA, 18 nt, Human
cucuccagccccuggaug

SEQ ID NO: 1814443 - RNA, 17 nt, Human
cggugagcuacaaaugc

SEQ ID NO: 1814444 - RNA, 21 nt, Human
cggugagaggggaacagacug

SEQ ID NO: 1814445 - RNA, 20 nt, Human
cggugagaggggaacagacu

SEQ ID NO: 1814446 - RNA, 20 nt, Human
cgguccacccaggagccccg

SEQ ID NO: 1814447 - RNA, 16 nt, Human
cgguccacccaggagc

SEQ ID NO: 1814448 - RNA, 15 nt, Human
cgguccacccaggag

SEQ ID NO: 1814449 - RNA, 14 nt, Human
cgguccacccagga

SEQ ID NO: 1814450 - RNA, 19 nt, Human
cgggucacaggagggaggg

SEQ ID NO: 1814451 - RNA, 11 nt, Human
cgggucacagg

SEQ ID NO: 1814452 - RNA, 22 nt, Human
cgggcacucagaagacacugau

SEQ ID NO: 1814453 - RNA, 14 nt, Human
cgggcacucagaag

SEQ ID NO: 1814454 - RNA, 22 nt, Human
cggggacagcuccuucuguccu

SEQ ID NO: 1814455 - RNA, 17 nt, Human
cgggauuaguacacacu

SEQ ID NO: 1814456 - RNA, 18 nt, Human
cgggaggucgaggcagga

SEQ ID NO: 1814457 - RNA, 20 nt, Human
cgggaggucgaggcaggagg

SEQ ID NO: 1814458 - RNA, 23 nt, Human
cggcuggccuggccccucagggu

SEQ ID NO: 1814459 - RNA, 22 nt, Human
cggcuggccuggccccucaggg

SEQ ID NO: 1814460 - RNA, 15 nt, Human
cgggggcagagaggg

SEQ ID NO: 1814461 - RNA, 16 nt, Human
cgggguggauuggauu

SEQ ID NO: 1814462 - RNA, 23 nt, Human
cggggacagcuccuucuguccua

SEQ ID NO: 1814463 - RNA, 14 nt, Human
cggccuccauccug

SEQ ID NO: 1814464 - RNA, 12 nt, Human
cggccuccaucc

SEQ ID NO: 1814465 - RNA, 11 nt, Human
cggcugcccuu

SEQ ID NO: 1814466 - RNA, 12 nt, Human
cggcugcccuuu

SEQ ID NO: 1814467 - RNA, 24 nt, Human
cggccaggccagagggagugacag

SEQ ID NO: 1814468 - RNA, 19 nt, Human
cggccccugcugguucagg

SEQ ID NO: 1814469 - RNA, 18 nt, Human
cggccccugcugguucag

SEQ ID NO: 1814470 - RNA, 13 nt, Human
cggccccugcugg

SEQ ID NO: 1814471 - RNA, 13 nt, Human
cggcauuuguuuc

SEQ ID NO: 1814472 - RNA, 11 nt, Human
cggccaccugc

SEQ ID NO: 1814473 - RNA, 15 nt, Human
cggccaccugcggug

SEQ ID NO: 1814474 - RNA, 16 nt, Human
cggccaccugcggugc

SEQ ID NO: 1814475 - RNA, 17 nt, Human
cggccaccugcggugcu

SEQ ID NO: 1814476 - RNA, 14 nt, Human
cggaauaguuggcu

SEQ ID NO: 1814477 - RNA, 13 nt, Human
cggaagagccuug

SEQ ID NO: 1814478 - RNA, 22 nt, Human
cgcuaagagggagggagggcuc

SEQ ID NO: 1814479 - RNA, 16 nt, Human
cgcuacccgggaaggg

SEQ ID NO: 1814480 - RNA, 16 nt, Human
cgcucagcccucccug

SEQ ID NO: 1814481 - RNA, 21 nt, Human
cgcucagcccucccugccccu

SEQ ID NO: 1814482 - RNA, 12 nt, Human
cgcucagcccuc

SEQ ID NO: 1814483 - RNA, 17 nt, Human
cgcuacccgggaagggg

SEQ ID NO: 1814484 - RNA, 15 nt, Human
cgcucucuggccuuc

SEQ ID NO: 1814485 - RNA, 14 nt, Human
cgcucucuggccuu

SEQ ID NO: 1814486 - RNA, 20 nt, Human
cggaaaacaugcuacacacu

SEQ ID NO: 1814487 - RNA, 15 nt, Human
cggaaaacaugcuac

SEQ ID NO: 1814488 - RNA, 18 nt, Human
cgcugugcugcccugccc

SEQ ID NO: 1814489 - RNA, 15 nt, Human
cgcugugcugcccug

SEQ ID NO: 1814490 - RNA, 16 nt, Human
cgcugugcugcccugc

SEQ ID NO: 1814491 - RNA, 17 nt, Human
cgcugugcugcccugcc

SEQ ID NO: 1814492 - RNA, 22 nt, Human
cgcugucagccauuccuguucc

SEQ ID NO: 1814493 - RNA, 18 nt, Human
cgcucucuggccuucggc

SEQ ID NO: 1814494 - RNA, 17 nt, Human
cgccaucccagccccaa

SEQ ID NO: 1814495 - RNA, 23 nt, Human
cgccaggggaaaaucagccugcu

SEQ ID NO: 1814496 - RNA, 14 nt, Human
cgccaucccagccc

SEQ ID NO: 1814497 - RNA, 16 nt, Human
cgccaucccagcccca

SEQ ID NO: 1814498 - RNA, 22 nt, Human
cgccagauucuuuccugaggcu

SEQ ID NO: 1814499 - RNA, 17 nt, Human
ccucugcccacucccug

SEQ ID NO: 1814500 - RNA, 19 nt, Human
ccucugcccacucccugca

SEQ ID NO: 1814501 - RNA, 20 nt, Human
ccucugcccacucccugcaa

SEQ ID NO: 1814502 - RNA, 22 nt, Human
cgcccaggcuuagucacugaga

SEQ ID NO: 1814503 - RNA, 12 nt, Human
cgcccagucugg

SEQ ID NO: 1814504 - RNA, 19 nt, Human
cgccccucccacagcgcug

SEQ ID NO: 1814505 - RNA, 21 nt, Human
cgccccucccacagcgcuggc

SEQ ID NO: 1814506 - RNA, 13 nt, Human
cgccccuuccccc

SEQ ID NO: 1814507 - RNA, 16 nt, Human
cgcccuggacugugug

SEQ ID NO: 1814508 - RNA, 15 nt, Human
cuaacauggaaguac

SEQ ID NO: 1814509 - RNA, 17 nt, Human
cuaacauggaaguacua

SEQ ID NO: 1814510 - RNA, 15 nt, Human
cuaacaugauuuggg

SEQ ID NO: 1814511 - RNA, 23 nt, Human
cuaaauugacacuuaaaaauggu

SEQ ID NO: 1814512 - RNA, 16 nt, Human
cuaaauguugaaagau

SEQ ID NO: 1814513 - RNA, 20 nt, Human
cuaaaucuccaaaauaaaac

SEQ ID NO: 1814514 - RNA, 15 nt, Human
cuaaauggaaccacu

SEQ ID NO: 1814515 - RNA, 17 nt, Human
cuaaauggaaccacucu

SEQ ID NO: 1814516 - RNA, 16 nt, Human
cuaaauggaaccacuc

SEQ ID NO: 1814517 - RNA, 18 nt, Human
cuaaauggaaccacucua

SEQ ID NO: 1814518 - RNA, 18 nt, Human
cuaaauauauuuuaagac

SEQ ID NO: 1814519 - RNA, 20 nt, Human
cuaaauauauuuuaagacga

SEQ ID NO: 1814520 - RNA, 20 nt, Human
cguggcuucccgcucagccc

SEQ ID NO: 1814521 - RNA, 21 nt, Human
cguggcuucccgcucagcccu

SEQ ID NO: 1814522 - RNA, 18 nt, Human
cguggcuucccgcucagc

SEQ ID NO: 1814523 - RNA, 19 nt, Human
cguggcuucccgcucagcc

SEQ ID NO: 1814524 - RNA, 20 nt, Human
cguggaacguuuuuccuguu

SEQ ID NO: 1814525 - RNA, 15 nt, Human
cguggaacguuuuuc

SEQ ID NO: 1814526 - RNA, 19 nt, Human
cgugcacacaccagagccc

SEQ ID NO: 1814527 - RNA, 18 nt, Human
cgugcacacaccagagcc

SEQ ID NO: 1814528 - RNA, 22 nt, Human
cgugcaguggugcgaucugggu

SEQ ID NO: 1814529 - RNA, 21 nt, Human
cgugcaguggugcgaucuggg

SEQ ID NO: 1814530 - RNA, 23 nt, Human
cgugcauaccacuuuuguucuug

SEQ ID NO: 1814531 - RNA, 22 nt, Human
cgucugacaggcaaugcuggcu

SEQ ID NO: 1814532 - RNA, 21 nt, Human
cgucugacaggcaaugcuggc

SEQ ID NO: 1814533 - RNA, 20 nt, Human
cgucugacaggcaaugcugg

SEQ ID NO: 1814534 - RNA, 16 nt, Human
cgugcacacaccagag

SEQ ID NO: 1814535 - RNA, 16 nt, Human
cgucgacguagaaccu

SEQ ID NO: 1814536 - RNA, 16 nt, Human
cgucucauacucaccu

SEQ ID NO: 1814537 - RNA, 16 nt, Human
cgucuaccugaggggc

SEQ ID NO: 1814538 - RNA, 18 nt, Human
cggugcuaucucccccag

SEQ ID NO: 1814539 - RNA, 20 nt, Human
cggugcuaucucccccagcc

SEQ ID NO: 1814540 - RNA, 21 nt, Human
cggugcuaucucccccagccc

SEQ ID NO: 1814541 - RNA, 22 nt, Human
cggugcuaucucccccagcccc

SEQ ID NO: 1814542 - RNA, 13 nt, Human
cucacauuuauau

SEQ ID NO: 1814543 - RNA, 19 nt, Human
cucaccagccccagugccc

SEQ ID NO: 1814544 - RNA, 20 nt, Human
cucacauagcuuacaagcca

SEQ ID NO: 1814545 - RNA, 21 nt, Human
cucaccagccccagugcccac

SEQ ID NO: 1814546 - RNA, 20 nt, Human
cucaccagccccagugccca

SEQ ID NO: 1814547 - RNA, 20 nt, Human
cucaagugauucuccugccu

SEQ ID NO: 1814548 - RNA, 19 nt, Human
cucaagugauucuccugcc

SEQ ID NO: 1814549 - RNA, 18 nt, Human
cucaagugauucuccugc

SEQ ID NO: 1814550 - RNA, 17 nt, Human
cucacuauguugcccag

SEQ ID NO: 1814551 - RNA, 16 nt, Human
cucacuauguugccca

SEQ ID NO: 1814552 - RNA, 20 nt, Human
cucacuaggcuucugguuga

SEQ ID NO: 1814553 - RNA, 20 nt, Human
cucacuaucccggcugcccu

SEQ ID NO: 1814554 - RNA, 21 nt, Human
cucacuaucccggcugcccuu

SEQ ID NO: 1814555 - RNA, 13 nt, Human
cucacuaggcuuc

SEQ ID NO: 1814556 - RNA, 16 nt, Human
cucacuaggcuucugg

SEQ ID NO: 1814557 - RNA, 17 nt, Human
cucaccccuugccauaa

SEQ ID NO: 1814558 - RNA, 14 nt, Human
cucaccccagcccc

SEQ ID NO: 1814559 - RNA, 12 nt, Human
cucaccccagcc

SEQ ID NO: 1814560 - RNA, 13 nt, Human
cucaccccagccc

SEQ ID NO: 1814561 - RNA, 19 nt, Human
cucaagagggcacuggugg

SEQ ID NO: 1814562 - RNA, 21 nt, Human
cucaagagggcacugguggcc

SEQ ID NO: 1814563 - RNA, 17 nt, Human
cucaagagggcacuggu

SEQ ID NO: 1814564 - RNA, 13 nt, Human
cucaaauuucuaa

SEQ ID NO: 1814565 - RNA, 20 nt, Human
cucaacucuccuccagaguc

SEQ ID NO: 1814566 - RNA, 21 nt, Human
cucaacucuccuccagaguca

SEQ ID NO: 1814567 - RNA, 18 nt, Human
cuauuuuaauaaacacuc

SEQ ID NO: 1814568 - RNA, 22 nt, Human
cuauuuuaauaaacacucuuga

SEQ ID NO: 1814569 - RNA, 14 nt, Human
cuaugcauuugaaa

SEQ ID NO: 1814570 - RNA, 21 nt, Human
cuaugcauuugaaaauuuuga

SEQ ID NO: 1814571 - RNA, 12 nt, Human
cuaugcauuuga

SEQ ID NO: 1814572 - RNA, 11 nt, Human
cuaugcauuug

SEQ ID NO: 1814573 - RNA, 19 nt, Human
cuagugugguguuuccugg

SEQ ID NO: 1814574 - RNA, 21 nt, Human
cuagugugguguuuccuggca

SEQ ID NO: 1814575 - RNA, 22 nt, Human
cuagugugguguuuccuggcac

SEQ ID NO: 1814576 - RNA, 23 nt, Human
cuagugugguguuuccuggcacu

SEQ ID NO: 1814577 - RNA, 16 nt, Human
cuaggcaggaccugug

SEQ ID NO: 1814578 - RNA, 15 nt, Human
cuaggcaggaccugu

SEQ ID NO: 1814579 - RNA, 21 nt, Human
cuaggcauuugcugaauacag

SEQ ID NO: 1814580 - RNA, 23 nt, Human
cuaguaucaaaagaaagaaaauc

SEQ ID NO: 1814581 - RNA, 17 nt, Human
cuaguaucaaaagaaag

SEQ ID NO: 1814582 - RNA, 15 nt, Human
cuaguaucaaaagaa

SEQ ID NO: 1814583 - RNA, 22 nt, Human
cuaggaccccuccaugugggcu

SEQ ID NO: 1814584 - RNA, 17 nt, Human
cuaggaggucucuaaga

SEQ ID NO: 1814585 - RNA, 16 nt, Human
cuaggaaauccagggu

SEQ ID NO: 1814586 - RNA, 17 nt, Human
cuaggaaauccagggug

SEQ ID NO: 1814587 - RNA, 21 nt, Human
cuaggaagacuuuggaaagag

SEQ ID NO: 1814588 - RNA, 13 nt, Human
cuaggaacacucc

SEQ ID NO: 1814589 - RNA, 15 nt, Human
cuaggaacacuccuu

SEQ ID NO: 1814590 - RNA, 12 nt, Human
cuagcagcaggg

SEQ ID NO: 1814591 - RNA, 23 nt, Human
cuauauuguuuucaguguacaug

SEQ ID NO: 1814592 - RNA, 20 nt, Human
cuauauuuuuuguuaaauga

SEQ ID NO: 1814593 - RNA, 22 nt, Human
cuauauuguuuucaguguacau

SEQ ID NO: 1814594 - RNA, 22 nt, Human
cuauauuuuuuguuaaaugauu

SEQ ID NO: 1814595 - RNA, 20 nt, Human
cuaucaaguauuauaccuuu

SEQ ID NO: 1814596 - RNA, 14 nt, Human
cuaugacacaugca

SEQ ID NO: 1814597 - RNA, 14 nt, Human
cuaguuccaccauc

SEQ ID NO: 1814598 - RNA, 15 nt, Human
cuacaagacacagug

SEQ ID NO: 1814599 - RNA, 19 nt, Human
cuaaugaaugcauaaaaug

SEQ ID NO: 1814600 - RNA, 22 nt, Human
cuaaugaaugcauaaaauguua

SEQ ID NO: 1814601 - RNA, 16 nt, Human
cuaauguacugcauau

SEQ ID NO: 1814602 - RNA, 14 nt, Human
cuaauguacugcau

SEQ ID NO: 1814603 - RNA, 16 nt, Human
cuaaggugugcucuga

SEQ ID NO: 1814604 - RNA, 12 nt, Human
cuaauaaagcug

SEQ ID NO: 1814605 - RNA, 21 nt, Human
cuaauaaaauuuaaaagucuu

SEQ ID NO: 1814606 - RNA, 13 nt, Human
cuaauaaagcugu

SEQ ID NO: 1814607 - RNA, 17 nt, Human
cuaaucagcauucucac

SEQ ID NO: 1814608 - RNA, 19 nt, Human
cuaaucagcauucucacuc

SEQ ID NO: 1814609 - RNA, 16 nt, Human
cuaauccucuuuuucu

SEQ ID NO: 1814610 - RNA, 15 nt, Human
cuacagaggccaugg

SEQ ID NO: 1814611 - RNA, 15 nt, Human
cuacacacugcaugu

SEQ ID NO: 1814612 - RNA, 13 nt, Human
cuacacacugcau

SEQ ID NO: 1814613 - RNA, 18 nt, Human
cuacacugugcugagucu

SEQ ID NO: 1814614 - RNA, 17 nt, Human
cuacacuccagugagac

SEQ ID NO: 1814615 - RNA, 21 nt, Human
cuacacacugcauguuuguga

SEQ ID NO: 1814616 - RNA, 16 nt, Human
cuacacuccagugaga

SEQ ID NO: 1814617 - RNA, 19 nt, Human
cuacccagcgagcccuggu

SEQ ID NO: 1814618 - RNA, 20 nt, Human
cuacccagcgagcccuggug

SEQ ID NO: 1814619 - RNA, 12 nt, Human
cuacccaggugc

SEQ ID NO: 1814620 - RNA, 22 nt, Human
cuacccacccuccuuucaccac

SEQ ID NO: 1814621 - RNA, 17 nt, Human
cuacccacccuccuuuc

SEQ ID NO: 1814622 - RNA, 18 nt, Human
cuaccauccccuguagag

SEQ ID NO: 1814623 - RNA, 17 nt, Human
cuacagaggccaugggc

SEQ ID NO: 1814624 - RNA, 17 nt, Human
cuaaccacgcuggaccu

SEQ ID NO: 1814625 - RNA, 16 nt, Human
cuaaccagcagaaaug

SEQ ID NO: 1814626 - RNA, 17 nt, Human
cuaaccagcagaaaugc

SEQ ID NO: 1814627 - RNA, 14 nt, Human
cuaagcaaaaugug

SEQ ID NO: 1814628 - RNA, 23 nt, Human
cuaagcacgggccauaugaauaa

SEQ ID NO: 1814629 - RNA, 20 nt, Human
cuaagcacgggccauaugaa

SEQ ID NO: 1814630 - RNA, 18 nt, Human
cuaagcaaaaugugauau

SEQ ID NO: 1814631 - RNA, 15 nt, Human
cuaagcaaaauguga

SEQ ID NO: 1814632 - RNA, 19 nt, Human
cuaagcuauucaguaauaa

SEQ ID NO: 1814633 - RNA, 21 nt, Human
cuaagcuauucaguaauaacu

SEQ ID NO: 1814634 - RNA, 15 nt, Human
cuaaggugugcucug

SEQ ID NO: 1814635 - RNA, 14 nt, Human
cuaaggcugaacuu

SEQ ID NO: 1814636 - RNA, 21 nt, Human
cuacucugugucagguggggc

SEQ ID NO: 1814637 - RNA, 16 nt, Human
cuacucugugucaggu

SEQ ID NO: 1814638 - RNA, 14 nt, Human
cuacccgggaaggg

SEQ ID NO: 1814639 - RNA, 15 nt, Human
cuacccgggaagggg

SEQ ID NO: 1814640 - RNA, 20 nt, Human
cuacccgggaagggggcugg

SEQ ID NO: 1814641 - RNA, 21 nt, Human
cuacccgggaagggggcuggg

SEQ ID NO: 1814642 - RNA, 21 nt, Human
cuacuguaaggcaaucauggu

SEQ ID NO: 1814643 - RNA, 16 nt, Human
cuacuguaauuuguga

SEQ ID NO: 1814644 - RNA, 17 nt, Human
cuacuguaauuugugau

SEQ ID NO: 1814645 - RNA, 14 nt, Human
cuacugaggugcua

SEQ ID NO: 1814646 - RNA, 20 nt, Human
cuacuuccugugacuucagc

SEQ ID NO: 1814647 - RNA, 14 nt, Human
cuacuuccccuucc

SEQ ID NO: 1814648 - RNA, 15 nt, Human
cuacuuccccuuccu

SEQ ID NO: 1814649 - RNA, 20 nt, Human
cuacuuccccuuccuaauuc

SEQ ID NO: 1814650 - RNA, 19 nt, Human
cuacuugggaggcugagau

SEQ ID NO: 1814651 - RNA, 18 nt, Human
cuacuugggaggcugaga

SEQ ID NO: 1814652 - RNA, 15 nt, Human
cuacuugggaggcug

SEQ ID NO: 1814653 - RNA, 18 nt, Human
cuagacucccaagcugga

SEQ ID NO: 1814654 - RNA, 20 nt, Human
cuagacgagcaggcuucuuc

SEQ ID NO: 1814655 - RNA, 21 nt, Human
cuagacgagcaggcuucuucc

SEQ ID NO: 1814656 - RNA, 17 nt, Human
cuagagugaacuugggc

SEQ ID NO: 1814657 - RNA, 21 nt, Human
cuagagugaacuugggccacu

SEQ ID NO: 1814658 - RNA, 15 nt, Human
cuagagguucaaaga

SEQ ID NO: 1814659 - RNA, 17 nt, Human
cuagcacuuugggaggc

SEQ ID NO: 1814660 - RNA, 21 nt, Human
cuacuguaauuugugauacaa

SEQ ID NO: 1814661 - RNA, 16 nt, Human
ccuaaaauucagugga

SEQ ID NO: 1814662 - RNA, 13 nt, Human
ccuaaacauauga

SEQ ID NO: 1814663 - RNA, 22 nt, Human
ccuaacaacauuguagccucaa

SEQ ID NO: 1814664 - RNA, 21 nt, Human
ccuaacaacauuguagccuca

SEQ ID NO: 1814665 - RNA, 22 nt, Human
ccuacaguugaaaaacagcuga

SEQ ID NO: 1814666 - RNA, 19 nt, Human
ccuacagcuugaccgugag

SEQ ID NO: 1814667 - RNA, 13 nt, Human
ccuacccacccuc

SEQ ID NO: 1814668 - RNA, 18 nt, Human
ccuacccacccuccuuuc

SEQ ID NO: 1814669 - RNA, 19 nt, Human
ccuacuguaauuugugaua

SEQ ID NO: 1814670 - RNA, 21 nt, Human
ccuagaaauuccccacccuga

SEQ ID NO: 1814671 - RNA, 16 nt, Human
ccuacuuccccuuccu

SEQ ID NO: 1814672 - RNA, 13 nt, Human
ccuacuuccccuu

SEQ ID NO: 1814673 - RNA, 13 nt, Human
ccuaggugacaga

SEQ ID NO: 1814674 - RNA, 22 nt, Human
ccuagguauaauucacauugua

SEQ ID NO: 1814675 - RNA, 12 nt, Human
ccguuauuaaaa

SEQ ID NO: 1814676 - RNA, 16 nt, Human
ccgggagccugaucac

SEQ ID NO: 1814677 - RNA, 23 nt, Human
ccgggagccugaucaccugcccu

SEQ ID NO: 1814678 - RNA, 17 nt, Human
ccgggaagggggcuggg

SEQ ID NO: 1814679 - RNA, 17 nt, Human
ccggaggggccuggcag

SEQ ID NO: 1814680 - RNA, 21 nt, Human
ccggaggggccuggcagccgu

SEQ ID NO: 1814681 - RNA, 22 nt, Human
cccuuguggucccaccccacac

SEQ ID NO: 1814682 - RNA, 22 nt, Human
cccuugguuaggcauuguggga

SEQ ID NO: 1814683 - RNA, 23 nt, Human
cccuugguuaggcauugugggaa

SEQ ID NO: 1814684 - RNA, 21 nt, Human
cccuuccuaauuccacagcug

SEQ ID NO: 1814685 - RNA, 11 nt, Human
cccuucuuuuu

SEQ ID NO: 1814686 - RNA, 19 nt, Human
cccuucuuuuucuucuuuu

SEQ ID NO: 1814687 - RNA, 17 nt, Human
cccuuggauuguccccg

SEQ ID NO: 1814688 - RNA, 13 nt, Human
cccuucccaccuc

SEQ ID NO: 1814689 - RNA, 11 nt, Human
cccuucauuug

SEQ ID NO: 1814690 - RNA, 12 nt, Human
cccuucccaccu

SEQ ID NO: 1814691 - RNA, 13 nt, Human
cccuuccuaauuc

SEQ ID NO: 1814692 - RNA, 14 nt, Human
cccuuccuaauucc

SEQ ID NO: 1814693 - RNA, 19 nt, Human
cccuuccuaauuccacagc

SEQ ID NO: 1814694 - RNA, 20 nt, Human
cccuuccuaauuccacagcu

SEQ ID NO: 1814695 - RNA, 14 nt, Human
cccuguucacucua

SEQ ID NO: 1814696 - RNA, 22 nt, Human
cccuguucacucuacuuagcau

SEQ ID NO: 1814697 - RNA, 13 nt, Human
cccuguucacucu

SEQ ID NO: 1814698 - RNA, 15 nt, Human
ccuaggugacagagu

SEQ ID NO: 1814699 - RNA, 24 nt, Human
ccucacaguccuuaccagcagagc

SEQ ID NO: 1814700 - RNA, 23 nt, Human
ccucacaguccuuaccagcagag

SEQ ID NO: 1814701 - RNA, 16 nt, Human
ccuauuagagaagaga

SEQ ID NO: 1814702 - RNA, 17 nt, Human
ccuauuagagaagagau

SEQ ID NO: 1814703 - RNA, 16 nt, Human
ccucagagccaccccu

SEQ ID NO: 1814704 - RNA, 14 nt, Human
ccucacccuggggc

SEQ ID NO: 1814705 - RNA, 16 nt, Human
ccucagaucuucugug

SEQ ID NO: 1814706 - RNA, 16 nt, Human
ccucagggucccuggu

SEQ ID NO: 1814707 - RNA, 17 nt, Human
ccucagggucccuggug

SEQ ID NO: 1814708 - RNA, 20 nt, Human
ccucagggucccugguggca

SEQ ID NO: 1814709 - RNA, 22 nt, Human
ccucagggucccugguggcagc

SEQ ID NO: 1814710 - RNA, 22 nt, Human
ccucaggugagaagcagaggaa

SEQ ID NO: 1814711 - RNA, 19 nt, Human
ccuccaugcugccuccaga

SEQ ID NO: 1814712 - RNA, 16 nt, Human
ccuccaugcugccucc

SEQ ID NO: 1814713 - RNA, 14 nt, Human
ccuccauccugagg

SEQ ID NO: 1814714 - RNA, 13 nt, Human
ccuccauccugag

SEQ ID NO: 1814715 - RNA, 12 nt, Human
ccuccauccuga

SEQ ID NO: 1814716 - RNA, 17 nt, Human
ccucccaaagugcuggg

SEQ ID NO: 1814717 - RNA, 14 nt, Human
ccucccaacucacc

SEQ ID NO: 1814718 - RNA, 15 nt, Human
ccuccaugugggcua

SEQ ID NO: 1814719 - RNA, 12 nt, Human
ccuccauguggg

SEQ ID NO: 1814720 - RNA, 17 nt, Human
ccuccaggugcacaagc

SEQ ID NO: 1814721 - RNA, 11 nt, Human
ccuccaggugc

SEQ ID NO: 1814722 - RNA, 12 nt, Human
ccuccaggugca

SEQ ID NO: 1814723 - RNA, 12 nt, Human
ccucauacccac

SEQ ID NO: 1814724 - RNA, 17 nt, Human
ccucaggugagaagcag

SEQ ID NO: 1814725 - RNA, 18 nt, Human
ccucaggugagaagcaga

SEQ ID NO: 1814726 - RNA, 20 nt, Human
ccucaggugagaagcagagg

SEQ ID NO: 1814727 - RNA, 18 nt, Human
ccucccgaauagcuggga

SEQ ID NO: 1814728 - RNA, 15 nt, Human
ccuccccuccuccug

SEQ ID NO: 1814729 - RNA, 23 nt, Human
ccucccaaagugcugggauuaca

SEQ ID NO: 1814730 - RNA, 15 nt, Human
ccucccaacucaccc

SEQ ID NO: 1814731 - RNA, 20 nt, Human
ccucccgaauagcugggacu

SEQ ID NO: 1814732 - RNA, 19 nt, Human
ccucccgaauagcugggac

SEQ ID NO: 1814733 - RNA, 21 nt, Human
ccucccgaauagcugggacua

SEQ ID NO: 1814734 - RNA, 18 nt, Human
ccucccgaguagcuggga

SEQ ID NO: 1814735 - RNA, 17 nt, Human
ccucccgaguagcuggg

SEQ ID NO: 1814736 - RNA, 19 nt, Human
ccucccgaguagcugggac

SEQ ID NO: 1814737 - RNA, 13 nt, Human
ccucccucuuucc

SEQ ID NO: 1814738 - RNA, 11 nt, Human
ccuccucagau

SEQ ID NO: 1814739 - RNA, 12 nt, Human
ccuccuccagcc

SEQ ID NO: 1814740 - RNA, 20 nt, Human
ccucugacacacagcucugu

SEQ ID NO: 1814741 - RNA, 19 nt, Human
ccucugacacacagcucug

SEQ ID NO: 1814742 - RNA, 14 nt, Human
ccucugacacacag

SEQ ID NO: 1814743 - RNA, 15 nt, Human
ccucugacacacagc

SEQ ID NO: 1814744 - RNA, 13 nt, Human
ccucugacacaca

SEQ ID NO: 1814745 - RNA, 21 nt, Human
ccucugacacacagcucuguc

SEQ ID NO: 1814746 - RNA, 19 nt, Human
ccucugcagcaauaaagca

SEQ ID NO: 1814747 - RNA, 19 nt, Human
ccucugcacuccccugcug

SEQ ID NO: 1814748 - RNA, 13 nt, Human
ccucugcccacuc

SEQ ID NO: 1814749 - RNA, 16 nt, Human
ccucugcccacucccu

SEQ ID NO: 1814750 - RNA, 18 nt, Human
ccucugcagcaauaaagc

SEQ ID NO: 1814751 - RNA, 14 nt, Human
ccucugcagcaaua

SEQ ID NO: 1814752 - RNA, 23 nt, Human
ccucugcacuccccugcugggug

SEQ ID NO: 1814753 - RNA, 18 nt, Human
ccucugcacuccccugcu

SEQ ID NO: 1814754 - RNA, 13 nt, Human
ccucugaggcuga

SEQ ID NO: 1814755 - RNA, 11 nt, Human
ccucugagccu

SEQ ID NO: 1814756 - RNA, 12 nt, Human
ccucugagccuu

SEQ ID NO: 1814757 - RNA, 16 nt, Human
ccucugcacuccccug

SEQ ID NO: 1814758 - RNA, 17 nt, Human
ccucugcacuccccugc

SEQ ID NO: 1814759 - RNA, 15 nt, Human
ccucuccccagcaag

SEQ ID NO: 1814760 - RNA, 20 nt, Human
ccucuccccagcaagugaga

SEQ ID NO: 1814761 - RNA, 13 nt, Human
ccucucccuugga

SEQ ID NO: 1814762 - RNA, 22 nt, Human
ccucucccuuggauuguccccg

SEQ ID NO: 1814763 - RNA, 21 nt, Human
ccuccuccagccgccaugcuc

SEQ ID NO: 1814764 - RNA, 16 nt, Human
ccuccucucugcccua

SEQ ID NO: 1814765 - RNA, 13 nt, Human
ccuccucucugcc

SEQ ID NO: 1814766 - RNA, 15 nt, Human
ccuccucucugcccu

SEQ ID NO: 1814767 - RNA, 19 nt, Human
cccgcucagcccucccugc

SEQ ID NO: 1814768 - RNA, 22 nt, Human
cccgcuaagagggagggagggc

SEQ ID NO: 1814769 - RNA, 23 nt, Human
cccgcucagcccucccugccccu

SEQ ID NO: 1814770 - RNA, 15 nt, Human
cccgaggccuucucu

SEQ ID NO: 1814771 - RNA, 20 nt, Human
cccgaggccuucucugaagg

SEQ ID NO: 1814772 - RNA, 23 nt, Human
ccccuggcuuuucacugcuggcu

SEQ ID NO: 1814773 - RNA, 15 nt, Human
ccccuguaggccuca

SEQ ID NO: 1814774 - RNA, 22 nt, Human
ccccuguccccgcacugggcuu

SEQ ID NO: 1814775 - RNA, 20 nt, Human
ccccuuccuaauuccacagc

SEQ ID NO: 1814776 - RNA, 21 nt, Human
ccccuuccuaauuccacagcu

SEQ ID NO: 1814777 - RNA, 22 nt, Human
ccccuuccuaauuccacagcug

SEQ ID NO: 1814778 - RNA, 12 nt, Human
ccccuucccccu

SEQ ID NO: 1814779 - RNA, 20 nt, Human
ccccuguucuggcagaguug

SEQ ID NO: 1814780 - RNA, 14 nt, Human
ccccuuaccacugc

SEQ ID NO: 1814781 - RNA, 12 nt, Human
ccccaggaggcc

SEQ ID NO: 1814782 - RNA, 15 nt, Human
ccccuggcagccccu

SEQ ID NO: 1814783 - RNA, 12 nt, Human
ccccuggcagcc

SEQ ID NO: 1814784 - RNA, 14 nt, Human
ccccuggcagcccc

SEQ ID NO: 1814785 - RNA, 22 nt, Human
ccccaggugguuauggagaggg

SEQ ID NO: 1814786 - RNA, 19 nt, Human
ccccagcccuccuuaucaa

SEQ ID NO: 1814787 - RNA, 15 nt, Human
ccccagccccauccu

SEQ ID NO: 1814788 - RNA, 16 nt, Human
ccccagccccauccca

SEQ ID NO: 1814789 - RNA, 13 nt, Human
ccccagccugcua

SEQ ID NO: 1814790 - RNA, 21 nt, Human
ccccagcuggggccaggcugg

SEQ ID NO: 1814791 - RNA, 22 nt, Human
ccccagcuggggccaggcuggg

SEQ ID NO: 1814792 - RNA, 17 nt, Human
cccuccaugugggcuag

SEQ ID NO: 1814793 - RNA, 19 nt, Human
cccuccaucuaaacugccc

SEQ ID NO: 1814794 - RNA, 14 nt, Human
cccucccuucaacc

SEQ ID NO: 1814795 - RNA, 13 nt, Human
cccucccucuuuc

SEQ ID NO: 1814796 - RNA, 19 nt, Human
cccucauagcccucacccu

SEQ ID NO: 1814797 - RNA, 22 nt, Human
cccucaucaccaacgucugugc

SEQ ID NO: 1814798 - RNA, 17 nt, Human
cccucauccucauaccc

SEQ ID NO: 1814799 - RNA, 20 nt, Human
cccucauccucauacccacc

SEQ ID NO: 1814800 - RNA, 13 nt, Human
cccucauagcccu

SEQ ID NO: 1814801 - RNA, 15 nt, Human
cccucauagcccuca

SEQ ID NO: 1814802 - RNA, 21 nt, Human
cccucagggucccugguggca

SEQ ID NO: 1814803 - RNA, 20 nt, Human
cccucagucuggcccuuccu

SEQ ID NO: 1814804 - RNA, 22 nt, Human
cccucauuccaccuucccaugc

SEQ ID NO: 1814805 - RNA, 21 nt, Human
cccuccaagaccuucuccuuc

SEQ ID NO: 1814806 - RNA, 22 nt, Human
cccucauccucauacccacccc

SEQ ID NO: 1814807 - RNA, 17 nt, Human
cccggaggggccuggca

SEQ ID NO: 1814808 - RNA, 18 nt, Human
cccggaggggccuggcag

SEQ ID NO: 1814809 - RNA, 16 nt, Human
cccggcaggguccuag

SEQ ID NO: 1814810 - RNA, 13 nt, Human
cccuaaagccuca

SEQ ID NO: 1814811 - RNA, 22 nt, Human
cccuaaaguguauuuuuuuacu

SEQ ID NO: 1814812 - RNA, 17 nt, Human
cccuaaaguguauuuuu

SEQ ID NO: 1814813 - RNA, 15 nt, Human
cccuaauaaagcugu

SEQ ID NO: 1814814 - RNA, 18 nt, Human
cccuaauaaagcugugug

SEQ ID NO: 1814815 - RNA, 12 nt, Human
cccuaauaaagc

SEQ ID NO: 1814816 - RNA, 13 nt, Human
cccuaauaaagcu

SEQ ID NO: 1814817 - RNA, 14 nt, Human
cccuaauaaagcug

SEQ ID NO: 1814818 - RNA, 15 nt, Human
cccucagggucccug

SEQ ID NO: 1814819 - RNA, 16 nt, Human
cccucagggucccugg

SEQ ID NO: 1814820 - RNA, 17 nt, Human
cccucagggucccuggu

SEQ ID NO: 1814821 - RNA, 18 nt, Human
cccucagggucccuggug

SEQ ID NO: 1814822 - RNA, 19 nt, Human
cccucagggucccuggugg

SEQ ID NO: 1814823 - RNA, 22 nt, Human
cccugcaaccugauugugucuc

SEQ ID NO: 1814824 - RNA, 16 nt, Human
cccugcaaccugauug

SEQ ID NO: 1814825 - RNA, 12 nt, Human
cccugcagaggg

SEQ ID NO: 1814826 - RNA, 20 nt, Human
cccugcagagggcacagaaa

SEQ ID NO: 1814827 - RNA, 18 nt, Human
cccugcagagggcacaga

SEQ ID NO: 1814828 - RNA, 15 nt, Human
cccugccacccuggg

SEQ ID NO: 1814829 - RNA, 14 nt, Human
cccugccacccugg

SEQ ID NO: 1814830 - RNA, 12 nt, Human
cccugccacccu

SEQ ID NO: 1814831 - RNA, 18 nt, Human
cccugccacccuggggag

SEQ ID NO: 1814832 - RNA, 17 nt, Human
cccugccacccugggga

SEQ ID NO: 1814833 - RNA, 14 nt, Human
cccugccuccuuug

SEQ ID NO: 1814834 - RNA, 11 nt, Human
cccugccucuc

SEQ ID NO: 1814835 - RNA, 18 nt, Human
cccugccucucugcaggu

SEQ ID NO: 1814836 - RNA, 16 nt, Human
cccugccuccuuugug

SEQ ID NO: 1814837 - RNA, 23 nt, Human
cccugccuccuuugugaggaagc

SEQ ID NO: 1814838 - RNA, 22 nt, Human
cccugguggcagugggagcugc

SEQ ID NO: 1814839 - RNA, 17 nt, Human
cccuggugcugccacac

SEQ ID NO: 1814840 - RNA, 21 nt, Human
cccuggugcugccacacuuca

SEQ ID NO: 1814841 - RNA, 16 nt, Human
cccugggaggcucugg

SEQ ID NO: 1814842 - RNA, 17 nt, Human
cccugggaggcucugga

SEQ ID NO: 1814843 - RNA, 18 nt, Human
cccugggaggcucuggag

SEQ ID NO: 1814844 - RNA, 21 nt, Human
cccuggacugugugcucagga

SEQ ID NO: 1814845 - RNA, 20 nt, Human
cccugcugguucaggguugg

SEQ ID NO: 1814846 - RNA, 19 nt, Human
cccugcugguucaggguug

SEQ ID NO: 1814847 - RNA, 23 nt, Human
cccugcuuugggcugcccuggug

SEQ ID NO: 1814848 - RNA, 13 nt, Human
cccugcugguuca

SEQ ID NO: 1814849 - RNA, 16 nt, Human
cccugccucucugcag

SEQ ID NO: 1814850 - RNA, 21 nt, Human
cccugccucucugcagguccc

SEQ ID NO: 1814851 - RNA, 22 nt, Human
cccugccucucugcaggucccu

SEQ ID NO: 1814852 - RNA, 14 nt, Human
cccugguggcagcu

SEQ ID NO: 1814853 - RNA, 13 nt, Human
ccaugugccaggu

SEQ ID NO: 1814854 - RNA, 23 nt, Human
ccauggcacucuauguucuaaga

SEQ ID NO: 1814855 - RNA, 14 nt, Human
ccauguuggccagg

SEQ ID NO: 1814856 - RNA, 13 nt, Human
ccauguuggccag

SEQ ID NO: 1814857 - RNA, 14 nt, Human
ccaugcugccucca

SEQ ID NO: 1814858 - RNA, 16 nt, Human
ccaugcugcccuguga

SEQ ID NO: 1814859 - RNA, 17 nt, Human
ccaugcugcccugugag

SEQ ID NO: 1814860 - RNA, 15 nt, Human
ccaugcugcccugug

SEQ ID NO: 1814861 - RNA, 15 nt, Human
ccaugcuccuggccc

SEQ ID NO: 1814862 - RNA, 18 nt, Human
ccaugcuccuggcccacu

SEQ ID NO: 1814863 - RNA, 15 nt, Human
cccacgcccccacug

SEQ ID NO: 1814864 - RNA, 13 nt, Human
cccacgcccccac

SEQ ID NO: 1814865 - RNA, 14 nt, Human
cccacgcccccacu

SEQ ID NO: 1814866 - RNA, 20 nt, Human
cccaccuuggcugcagggag

SEQ ID NO: 1814867 - RNA, 19 nt, Human
cccaccuuggcugcaggga

SEQ ID NO: 1814868 - RNA, 17 nt, Human
cccaccuuggcugcagg

SEQ ID NO: 1814869 - RNA, 12 nt, Human
cccaccuggccu

SEQ ID NO: 1814870 - RNA, 15 nt, Human
cccaccuggccucug

SEQ ID NO: 1814871 - RNA, 21 nt, Human
ccauguuggccaggcuggucu

SEQ ID NO: 1814872 - RNA, 19 nt, Human
ccauguuggccaggcuggu

SEQ ID NO: 1814873 - RNA, 15 nt, Human
ccauguuggccaggc

SEQ ID NO: 1814874 - RNA, 18 nt, Human
ccauguuggccaggcugg

SEQ ID NO: 1814875 - RNA, 12 nt, Human
cccagcucuggu

SEQ ID NO: 1814876 - RNA, 13 nt, Human
cccagcucugguc

SEQ ID NO: 1814877 - RNA, 14 nt, Human
cccagcucuggucc

SEQ ID NO: 1814878 - RNA, 15 nt, Human
cccagcucuggucca

SEQ ID NO: 1814879 - RNA, 16 nt, Human
cccagcucugguccau

SEQ ID NO: 1814880 - RNA, 18 nt, Human
cccagcucugguccauag

SEQ ID NO: 1814881 - RNA, 14 nt, Human
cccagcgagcccug

SEQ ID NO: 1814882 - RNA, 18 nt, Human
cccaggagccccgaggcc

SEQ ID NO: 1814883 - RNA, 14 nt, Human
cccaggaggccagc

SEQ ID NO: 1814884 - RNA, 14 nt, Human
cccaggagccccga

SEQ ID NO: 1814885 - RNA, 13 nt, Human
cccaggagccccg

SEQ ID NO: 1814886 - RNA, 23 nt, Human
cccagcccuccuuaucaaaggac

SEQ ID NO: 1814887 - RNA, 18 nt, Human
cccagccuccaagcucca

SEQ ID NO: 1814888 - RNA, 20 nt, Human
cccagccuccaagcuccauc

SEQ ID NO: 1814889 - RNA, 18 nt, Human
cccagccccauccucugu

SEQ ID NO: 1814890 - RNA, 19 nt, Human
cccagccccauccucugua

SEQ ID NO: 1814891 - RNA, 13 nt, Human
cccagccccaucc

SEQ ID NO: 1814892 - RNA, 14 nt, Human
cccagccccauccc

SEQ ID NO: 1814893 - RNA, 14 nt, Human
cccagccccauccu

SEQ ID NO: 1814894 - RNA, 15 nt, Human
cccagccccauccuc

SEQ ID NO: 1814895 - RNA, 13 nt, Human
cccagccccaaug

SEQ ID NO: 1814896 - RNA, 17 nt, Human
cccagccccaaugaaca

SEQ ID NO: 1814897 - RNA, 11 nt, Human
cccagccccau

SEQ ID NO: 1814898 - RNA, 12 nt, Human
cccagccccauc

SEQ ID NO: 1814899 - RNA, 16 nt, Human
cccagaggcuggguga

SEQ ID NO: 1814900 - RNA, 18 nt, Human
cccaggaggccagccuug

SEQ ID NO: 1814901 - RNA, 21 nt, Human
ccccaaauggaaaugggcaga

SEQ ID NO: 1814902 - RNA, 16 nt, Human
cccaugucucgacuca

SEQ ID NO: 1814903 - RNA, 17 nt, Human
cccaugucucgacucau

SEQ ID NO: 1814904 - RNA, 20 nt, Human
cccaugagccucagcauccu

SEQ ID NO: 1814905 - RNA, 16 nt, Human
cccaugagccucagca

SEQ ID NO: 1814906 - RNA, 15 nt, Human
cccaugagccucagc

SEQ ID NO: 1814907 - RNA, 14 nt, Human
cccaugcugcccug

SEQ ID NO: 1814908 - RNA, 12 nt, Human
cccaugcugccc

SEQ ID NO: 1814909 - RNA, 13 nt, Human
cccaugcugcccu

SEQ ID NO: 1814910 - RNA, 20 nt, Human
cccaucugugaaaggaaaga

SEQ ID NO: 1814911 - RNA, 18 nt, Human
cccaucucacacaugagc

SEQ ID NO: 1814912 - RNA, 13 nt, Human
cccaucucacaca

SEQ ID NO: 1814913 - RNA, 19 nt, Human
cccagucuggaaugcagug

SEQ ID NO: 1814914 - RNA, 18 nt, Human
cccagucuggaaugcagu

SEQ ID NO: 1814915 - RNA, 10 nt, Human
cccagucugg

SEQ ID NO: 1814916 - RNA, 21 nt, Human
cccagugcccacaggaucagu

SEQ ID NO: 1814917 - RNA, 15 nt, Human
cccagugccgagaag

SEQ ID NO: 1814918 - RNA, 20 nt, Human
cccagugguuccuaauccuc

SEQ ID NO: 1814919 - RNA, 14 nt, Human
cccaguuagcucuc

SEQ ID NO: 1814920 - RNA, 23 nt, Human
cccaggcaggucuugaacuccug

SEQ ID NO: 1814921 - RNA, 15 nt, Human
cccaggcauucccca

SEQ ID NO: 1814922 - RNA, 15 nt, Human
cccaggaggccagcc

SEQ ID NO: 1814923 - RNA, 16 nt, Human
cccaggaggccagccu

SEQ ID NO: 1814924 - RNA, 19 nt, Human
cccagggugggaagggcua

SEQ ID NO: 1814925 - RNA, 17 nt, Human
cccaggcauuccccagg

SEQ ID NO: 1814926 - RNA, 18 nt, Human
cccaggcauuccccagga

SEQ ID NO: 1814927 - RNA, 13 nt, Human
cccagguuucuau

SEQ ID NO: 1814928 - RNA, 22 nt, Human
cccaugagccucagcauccugg

SEQ ID NO: 1814929 - RNA, 16 nt, Human
ccaucaugucuggcua

SEQ ID NO: 1814930 - RNA, 14 nt, Human
ccaucaugucuggc

SEQ ID NO: 1814931 - RNA, 21 nt, Human
ccauccucuguacagagccca

SEQ ID NO: 1814932 - RNA, 15 nt, Human
ccauccugaggcucc

SEQ ID NO: 1814933 - RNA, 16 nt, Human
ccauccugaggcucca

SEQ ID NO: 1814934 - RNA, 16 nt, Human
ccaucgcugucaucuc

SEQ ID NO: 1814935 - RNA, 19 nt, Human
ccauauucuguuggccagu

SEQ ID NO: 1814936 - RNA, 18 nt, Human
ccauauucuguuggccag

SEQ ID NO: 1814937 - RNA, 15 nt, Human
ccauauucuguuggc

SEQ ID NO: 1814938 - RNA, 23 nt, Human
ccauagagagcaagacgcugugc

SEQ ID NO: 1814939 - RNA, 12 nt, Human
ccaucacccgcu

SEQ ID NO: 1814940 - RNA, 23 nt, Human
ccagggacagaggggguggccuc

SEQ ID NO: 1814941 - RNA, 12 nt, Human
ccaggccugccu

SEQ ID NO: 1814942 - RNA, 23 nt, Human
ccauguuggccaggcuggucuca

SEQ ID NO: 1814943 - RNA, 21 nt, Human
ccagcugugcucuggacaggc

SEQ ID NO: 1814944 - RNA, 20 nt, Human
ccagcugugcucuggacagg

SEQ ID NO: 1814945 - RNA, 18 nt, Human
ccagcugugcucuggaca

SEQ ID NO: 1814946 - RNA, 16 nt, Human
ccagcuggguuggaaa

SEQ ID NO: 1814947 - RNA, 17 nt, Human
ccagcuggguuggaaaa

SEQ ID NO: 1814948 - RNA, 14 nt, Human
ccagcuggccggga

SEQ ID NO: 1814949 - RNA, 20 nt, Human
ccagcuggccgggagccuga

SEQ ID NO: 1814950 - RNA, 12 nt, Human
ccagcuggccgg

SEQ ID NO: 1814951 - RNA, 16 nt, Human
ccagcugcuugggcuu

SEQ ID NO: 1814952 - RNA, 18 nt, Human
ccagcugcuugggcuuca

SEQ ID NO: 1814953 - RNA, 13 nt, Human
ccagcugcuuggg

SEQ ID NO: 1814954 - RNA, 15 nt, Human
ccagcugcuugggcu

SEQ ID NO: 1814955 - RNA, 17 nt, Human
ccaggcccucugcccac

SEQ ID NO: 1814956 - RNA, 18 nt, Human
ccaggcccucugcccacu

SEQ ID NO: 1814957 - RNA, 19 nt, Human
ccaggcccucugcccacuc

SEQ ID NO: 1814958 - RNA, 13 nt, Human
ccaggccuccuac

SEQ ID NO: 1814959 - RNA, 18 nt, Human
ccaggccuccuacagcuu

SEQ ID NO: 1814960 - RNA, 19 nt, Human
ccaggccuccuacagcuug

SEQ ID NO: 1814961 - RNA, 23 nt, Human
ccaggccccugccacccugggga

SEQ ID NO: 1814962 - RNA, 21 nt, Human
ccaggccccugccacccuggg

SEQ ID NO: 1814963 - RNA, 21 nt, Human
ccaggccagagggagugacag

SEQ ID NO: 1814964 - RNA, 14 nt, Human
ccaggccagaggga

SEQ ID NO: 1814965 - RNA, 14 nt, Human
ccaggagcagccac

SEQ ID NO: 1814966 - RNA, 23 nt, Human
ccagcugugcucuggacaggcau

SEQ ID NO: 1814967 - RNA, 22 nt, Human
ccagcugugcucuggacaggca

SEQ ID NO: 1814968 - RNA, 15 nt, Human
ccaggaagccagcag

SEQ ID NO: 1814969 - RNA, 17 nt, Human
ccaggaagccagcaggc

SEQ ID NO: 1814970 - RNA, 19 nt, Human
ccaggaagccagcaggcuc

SEQ ID NO: 1814971 - RNA, 12 nt, Human
ccaggagcagcc

SEQ ID NO: 1814972 - RNA, 13 nt, Human
ccaggagcagcca

SEQ ID NO: 1814973 - RNA, 15 nt, Human
ccaagaccuucuccu

SEQ ID NO: 1814974 - RNA, 18 nt, Human
ccaacccuggcacccagg

SEQ ID NO: 1814975 - RNA, 13 nt, Human
ccaacccucauca

SEQ ID NO: 1814976 - RNA, 15 nt, Human
ccaacccucaucacc

SEQ ID NO: 1814977 - RNA, 16 nt, Human
ccaacaucaacaucuu

SEQ ID NO: 1814978 - RNA, 14 nt, Human
ccaacauacuccca

SEQ ID NO: 1814979 - RNA, 15 nt, Human
ccaaauucuuucagu

SEQ ID NO: 1814980 - RNA, 22 nt, Human
ccaaauucuuucaguggcuacc

SEQ ID NO: 1814981 - RNA, 13 nt, Human
ccaaagaugcagc

SEQ ID NO: 1814982 - RNA, 14 nt, Human
ccaaagaugcagcc

SEQ ID NO: 1814983 - RNA, 23 nt, Human
ccaagcagagguugggaggccau

SEQ ID NO: 1814984 - RNA, 14 nt, Human
ccaagccguggcuu

SEQ ID NO: 1814985 - RNA, 14 nt, Human
ccaagcaggacaug

SEQ ID NO: 1814986 - RNA, 15 nt, Human
ccaagccguggcuuc

SEQ ID NO: 1814987 - RNA, 16 nt, Human
ccaagccguggcuucc

SEQ ID NO: 1814988 - RNA, 17 nt, Human
ccaagccguggcuuccc

SEQ ID NO: 1814989 - RNA, 21 nt, Human
ccaagccguggcuucccgcuc

SEQ ID NO: 1814990 - RNA, 23 nt, Human
ccaagccguggcuucccgcucag

SEQ ID NO: 1814991 - RNA, 12 nt, Human
ccaagcucccag

SEQ ID NO: 1814992 - RNA, 13 nt, Human
ccaagcucccagg

SEQ ID NO: 1814993 - RNA, 14 nt, Human
ccaagcuccaucuc

SEQ ID NO: 1814994 - RNA, 18 nt, Human
ccaaggcuagaaccaccu

SEQ ID NO: 1814995 - RNA, 18 nt, Human
ccacaaaggagagcuagc

SEQ ID NO: 1814996 - RNA, 13 nt, Human
ccacaacacacag

SEQ ID NO: 1814997 - RNA, 16 nt, Human
ccacaagacccuugug

SEQ ID NO: 1814998 - RNA, 13 nt, Human
ccacaagagccca

SEQ ID NO: 1814999 - RNA, 22 nt, Human
ccacaagaaaugaaagcaggga

SEQ ID NO: 1815000 - RNA, 16 nt, Human
ccacaagaaaugaaag

SEQ ID NO: 1815001 - RNA, 23 nt, Human
ccaauuuuuuaagugaaaauaua

SEQ ID NO: 1815002 - RNA, 18 nt, Human
ccaauauuguacaguuuu

SEQ ID NO: 1815003 - RNA, 16 nt, Human
ccaauauuguacaguu

SEQ ID NO: 1815004 - RNA, 15 nt, Human
ccaauauuguacagu

SEQ ID NO: 1815005 - RNA, 14 nt, Human
ccaauauuguacag

SEQ ID NO: 1815006 - RNA, 14 nt, Human
ccaaggcuggggga

SEQ ID NO: 1815007 - RNA, 16 nt, Human
ccaaggcucugagcaa

SEQ ID NO: 1815008 - RNA, 19 nt, Human
ccaaggcugauuaaaccaa

SEQ ID NO: 1815009 - RNA, 13 nt, Human
ccaaguggcuccc

SEQ ID NO: 1815010 - RNA, 16 nt, Human
ccaaguggcucccaca

SEQ ID NO: 1815011 - RNA, 20 nt, Human
ccaauauucauagcagcuua

SEQ ID NO: 1815012 - RNA, 15 nt, Human
ccacaaguuaaauaa

SEQ ID NO: 1815013 - RNA, 20 nt, Human
ccacaaguuaaauaaaucau

SEQ ID NO: 1815014 - RNA, 20 nt, Human
ccacaagagcccaggccucc

SEQ ID NO: 1815015 - RNA, 21 nt, Human
ccacaagagcccaggccuccu

SEQ ID NO: 1815016 - RNA, 16 nt, Human
ccacaagagcccaggc

SEQ ID NO: 1815017 - RNA, 17 nt, Human
ccacaagagcccaggcc

SEQ ID NO: 1815018 - RNA, 18 nt, Human
ccacaagagcccaggccu

SEQ ID NO: 1815019 - RNA, 19 nt, Human
ccacaagagcccaggccuc

SEQ ID NO: 1815020 - RNA, 21 nt, Human
cauuuacuuuguguucaccuu

SEQ ID NO: 1815021 - RNA, 17 nt, Human
cauuuacuuuguguuca

SEQ ID NO: 1815022 - RNA, 18 nt, Human
cauuucccaacacaaaga

SEQ ID NO: 1815023 - RNA, 15 nt, Human
cauugcaauagaaau

SEQ ID NO: 1815024 - RNA, 13 nt, Human
cauugcaauagaa

SEQ ID NO: 1815025 - RNA, 14 nt, Human
cauugcaauagaaa

SEQ ID NO: 1815026 - RNA, 21 nt, Human
cauuuaaaagauacaguuacu

SEQ ID NO: 1815027 - RNA, 21 nt, Human
cauuucuuccacaagagccca

SEQ ID NO: 1815028 - RNA, 13 nt, Human
cauugaccugagg

SEQ ID NO: 1815029 - RNA, 22 nt, Human
cauugaccugaggcccuucucu

SEQ ID NO: 1815030 - RNA, 19 nt, Human
cauugaaaucuuuuugcuu

SEQ ID NO: 1815031 - RNA, 22 nt, Human
cauuuugggguacccacugcuc

SEQ ID NO: 1815032 - RNA, 21 nt, Human
cauuuugggguacccacugcu

SEQ ID NO: 1815033 - RNA, 20 nt, Human
cauuuugggguacccacugc

SEQ ID NO: 1815034 - RNA, 18 nt, Human
cauuuugcuaaaugugaa

SEQ ID NO: 1815035 - RNA, 21 nt, Human
cauuuugcuaaaugugaauga

SEQ ID NO: 1815036 - RNA, 24 nt, Human
cauuuugcuaaaugugaaugauga

SEQ ID NO: 1815037 - RNA, 18 nt, Human
cauuuuuaguagagacag

SEQ ID NO: 1815038 - RNA, 19 nt, Human
cauuuuuaguagagacagg

SEQ ID NO: 1815039 - RNA, 20 nt, Human
cauuuuuaagugcugcauuu

SEQ ID NO: 1815040 - RNA, 15 nt, Human
cauuuuuaagugcug

SEQ ID NO: 1815041 - RNA, 23 nt, Human
cauuuugggguacccacugcucu

SEQ ID NO: 1815042 - RNA, 22 nt, Human
cauuugaggucuguucuuucca

SEQ ID NO: 1815043 - RNA, 21 nt, Human
cauuuuauuuuauuaugcaug

SEQ ID NO: 1815044 - RNA, 22 nt, Human
cauuuuauuuuauuaugcauga

SEQ ID NO: 1815045 - RNA, 19 nt, Human
cauuuuauuuuauuaugca

SEQ ID NO: 1815046 - RNA, 20 nt, Human
cauuuuuaguagagacaggg

SEQ ID NO: 1815047 - RNA, 21 nt, Human
ccaaaauaaaacuuuuuaaaa

SEQ ID NO: 1815048 - RNA, 18 nt, Human
ccaaaauaaaacuuuuua

SEQ ID NO: 1815049 - RNA, 14 nt, Human
cauuugagcagggc

SEQ ID NO: 1815050 - RNA, 16 nt, Human
cauuugagcagggcuc

SEQ ID NO: 1815051 - RNA, 17 nt, Human
cauuugaggucuguucu

SEQ ID NO: 1815052 - RNA, 19 nt, Human
cauuugaggucuguucuuu

SEQ ID NO: 1815053 - RNA, 18 nt, Human
cauuugaggucuguucuu

SEQ ID NO: 1815054 - RNA, 23 nt, Human
cauuucuuccacaagagcccagg

SEQ ID NO: 1815055 - RNA, 17 nt, Human
cauuagcaguuugcuuu

SEQ ID NO: 1815056 - RNA, 18 nt, Human
cauuagcaguuugcuuug

SEQ ID NO: 1815057 - RNA, 21 nt, Human
cauuaaagccugaguuugcuu

SEQ ID NO: 1815058 - RNA, 15 nt, Human
cauguuuuguuuacg

SEQ ID NO: 1815059 - RNA, 18 nt, Human
cauguuuuucuucucccu

SEQ ID NO: 1815060 - RNA, 21 nt, Human
cauguuucuuuguaaugaaaa

SEQ ID NO: 1815061 - RNA, 22 nt, Human
cauguuucuuuguaaugaaaac

SEQ ID NO: 1815062 - RNA, 23 nt, Human
cauguuugauguaucugagcagg

SEQ ID NO: 1815063 - RNA, 22 nt, Human
caugugccagguuuuuggucug

SEQ ID NO: 1815064 - RNA, 21 nt, Human
caugugccagguuuuuggucu

SEQ ID NO: 1815065 - RNA, 15 nt, Human
caugugcacaugcac

SEQ ID NO: 1815066 - RNA, 16 nt, Human
cauggucggaaaacau

SEQ ID NO: 1815067 - RNA, 15 nt, Human
caugugaaaucauuc

SEQ ID NO: 1815068 - RNA, 16 nt, Human
caugugaaaucauuca

SEQ ID NO: 1815069 - RNA, 17 nt, Human
caugugaaaucauucau

SEQ ID NO: 1815070 - RNA, 14 nt, Human
caugucuuuucuug

SEQ ID NO: 1815071 - RNA, 19 nt, Human
caugucuuuucuugcauga

SEQ ID NO: 1815072 - RNA, 21 nt, Human
caugucuuuucuugcaugagg

SEQ ID NO: 1815073 - RNA, 23 nt, Human
caugucuuuucuugcaugaggcu

SEQ ID NO: 1815074 - RNA, 18 nt, Human
caugucgccucugcauuc

SEQ ID NO: 1815075 - RNA, 20 nt, Human
caugucgccucugcauucag

SEQ ID NO: 1815076 - RNA, 14 nt, Human
caugucgccucugc

SEQ ID NO: 1815077 - RNA, 15 nt, Human
caugucgccucugca

SEQ ID NO: 1815078 - RNA, 18 nt, Human
cauguaauuaaguacuau

SEQ ID NO: 1815079 - RNA, 21 nt, Human
cauguaauuaaguacuaugua

SEQ ID NO: 1815080 - RNA, 16 nt, Human
cauggaauaacaugua

SEQ ID NO: 1815081 - RNA, 18 nt, Human
cauggacaugaucuucuu

SEQ ID NO: 1815082 - RNA, 20 nt, Human
cauggaaguacuauaauuua

SEQ ID NO: 1815083 - RNA, 22 nt, Human
cauggaaguacuauaauuuacc

SEQ ID NO: 1815084 - RNA, 23 nt, Human
caugccuggauggggcugcaccg

SEQ ID NO: 1815085 - RNA, 18 nt, Human
caugccuggauggggcug

SEQ ID NO: 1815086 - RNA, 21 nt, Human
caugccuggauggggcugcac

SEQ ID NO: 1815087 - RNA, 22 nt, Human
caugcugucccuuacgugaguc

SEQ ID NO: 1815088 - RNA, 15 nt, Human
caugggccuccugug

SEQ ID NO: 1815089 - RNA, 22 nt, Human
caugggaaugaaugucagugug

SEQ ID NO: 1815090 - RNA, 17 nt, Human
caugggacagggaggac

SEQ ID NO: 1815091 - RNA, 17 nt, Human
caugggccuccugugug

SEQ ID NO: 1815092 - RNA, 16 nt, Human
caugggccuccugugu

SEQ ID NO: 1815093 - RNA, 18 nt, Human
caugggaaugaaugucag

SEQ ID NO: 1815094 - RNA, 16 nt, Human
cauggaguauauguca

SEQ ID NO: 1815095 - RNA, 11 nt, Human
cauggacuuug

SEQ ID NO: 1815096 - RNA, 13 nt, Human
cauggacuuuguu

SEQ ID NO: 1815097 - RNA, 17 nt, Human
cauggagguuugaagau

SEQ ID NO: 1815098 - RNA, 14 nt, Human
caugccucucucag

SEQ ID NO: 1815099 - RNA, 15 nt, Human
caugccucucucagg

SEQ ID NO: 1815100 - RNA, 16 nt, Human
caugccucucucaggc

SEQ ID NO: 1815101 - RNA, 17 nt, Human
caugccucucucaggcc

SEQ ID NO: 1815102 - RNA, 18 nt, Human
caugccucucucaggcca

SEQ ID NO: 1815103 - RNA, 19 nt, Human
caugccucucucaggccaa

SEQ ID NO: 1815104 - RNA, 13 nt, Human
caugccuggaugg

SEQ ID NO: 1815105 - RNA, 19 nt, Human
caugccagcuuaucucagg

SEQ ID NO: 1815106 - RNA, 20 nt, Human
caugccagcuuaucucaggg

SEQ ID NO: 1815107 - RNA, 13 nt, Human
caugccccugaac

SEQ ID NO: 1815108 - RNA, 12 nt, Human
caguugaaaaac

SEQ ID NO: 1815109 - RNA, 18 nt, Human
caguugaaaaacagcuga

SEQ ID NO: 1815110 - RNA, 19 nt, Human
caguugaaaaacagcugag

SEQ ID NO: 1815111 - RNA, 22 nt, Human
caguucggugagcuacaaaugc

SEQ ID NO: 1815112 - RNA, 13 nt, Human
caguucucuccuu

SEQ ID NO: 1815113 - RNA, 14 nt, Human
caguucucuccuuc

SEQ ID NO: 1815114 - RNA, 15 nt, Human
caguucucuccuucu

SEQ ID NO: 1815115 - RNA, 22 nt, Human
caguucucuccuucuucccccc

SEQ ID NO: 1815116 - RNA, 22 nt, Human
caguguuguggauuuaacagaa

SEQ ID NO: 1815117 - RNA, 20 nt, Human
caguguuguggauuuaacag

SEQ ID NO: 1815118 - RNA, 19 nt, Human
caguguuguggauuuaaca

SEQ ID NO: 1815119 - RNA, 20 nt, Human
caguuaagccuuuggaaaca

SEQ ID NO: 1815120 - RNA, 14 nt, Human
caguuaagccuuug

SEQ ID NO: 1815121 - RNA, 15 nt, Human
caguuaagccuuugg

SEQ ID NO: 1815122 - RNA, 17 nt, Human
caguuaagccuuuggaa

SEQ ID NO: 1815123 - RNA, 13 nt, Human
caguuaagagaaa

SEQ ID NO: 1815124 - RNA, 14 nt, Human
caguuaagagaaau

SEQ ID NO: 1815125 - RNA, 14 nt, Human
caguuacucagaau

SEQ ID NO: 1815126 - RNA, 15 nt, Human
caguguacagucuug

SEQ ID NO: 1815127 - RNA, 12 nt, Human
caguguacaguc

SEQ ID NO: 1815128 - RNA, 18 nt, Human
caguguacagucuuguau

SEQ ID NO: 1815129 - RNA, 17 nt, Human
caguguacagucuugua

SEQ ID NO: 1815130 - RNA, 16 nt, Human
caguguacauggaaua

SEQ ID NO: 1815131 - RNA, 20 nt, Human
caguguacauggaauaacau

SEQ ID NO: 1815132 - RNA, 23 nt, Human
caguguacauggaauaacaugua

SEQ ID NO: 1815133 - RNA, 14 nt, Human
cagugucaaugcag

SEQ ID NO: 1815134 - RNA, 14 nt, Human
cagugugacaagga

SEQ ID NO: 1815135 - RNA, 12 nt, Human
cagugugacuga

SEQ ID NO: 1815136 - RNA, 11 nt, Human
cagugggaacu

SEQ ID NO: 1815137 - RNA, 22 nt, Human
cagugguuccuaauccucuagg

SEQ ID NO: 1815138 - RNA, 16 nt, Human
caguggcagcugcuuu

SEQ ID NO: 1815139 - RNA, 15 nt, Human
caguggcagcugcuu

SEQ ID NO: 1815140 - RNA, 14 nt, Human
caguggcagcugcu

SEQ ID NO: 1815141 - RNA, 13 nt, Human
caguggcagcugc

SEQ ID NO: 1815142 - RNA, 12 nt, Human
caguggcagcug

SEQ ID NO: 1815143 - RNA, 16 nt, Human
caguggaaccagccca

SEQ ID NO: 1815144 - RNA, 23 nt, Human
caguugccagucaccccggccac

SEQ ID NO: 1815145 - RNA, 16 nt, Human
caguuggguggaugcc

SEQ ID NO: 1815146 - RNA, 19 nt, Human
caguuggguggaugccugg

SEQ ID NO: 1815147 - RNA, 18 nt, Human
caguuggguggaugccug

SEQ ID NO: 1815148 - RNA, 18 nt, Human
caguuggucccccuucca

SEQ ID NO: 1815149 - RNA, 19 nt, Human
caguuggucccccuuccau

SEQ ID NO: 1815150 - RNA, 20 nt, Human
caguuggucccccuuccaug

SEQ ID NO: 1815151 - RNA, 21 nt, Human
caguuggucccccuuccaugg

SEQ ID NO: 1815152 - RNA, 22 nt, Human
caguuggucccccuuccaugga

SEQ ID NO: 1815153 - RNA, 17 nt, Human
caguuguuagugugucu

SEQ ID NO: 1815154 - RNA, 15 nt, Human
caguuuuuauugcuu

SEQ ID NO: 1815155 - RNA, 19 nt, Human
cauaccacuuuuguucuug

SEQ ID NO: 1815156 - RNA, 11 nt, Human
cauacccaccc

SEQ ID NO: 1815157 - RNA, 12 nt, Human
cauacccacccc

SEQ ID NO: 1815158 - RNA, 18 nt, Human
cauaccacuuuuguucuu

SEQ ID NO: 1815159 - RNA, 15 nt, Human
cauaccacuuuuguu

SEQ ID NO: 1815160 - RNA, 14 nt, Human
cauaccacuuuugu

SEQ ID NO: 1815161 - RNA, 13 nt, Human
cauaccacuuuug

SEQ ID NO: 1815162 - RNA, 15 nt, Human
cauaauacuugcuuu

SEQ ID NO: 1815163 - RNA, 13 nt, Human
cauaacuagaacu

SEQ ID NO: 1815164 - RNA, 14 nt, Human
cauaagauaaaugu

SEQ ID NO: 1815165 - RNA, 16 nt, Human
cauaaccuagccuuag

SEQ ID NO: 1815166 - RNA, 14 nt, Human
cauaaagcaggcag

SEQ ID NO: 1815167 - RNA, 16 nt, Human
cauaaagcaggcagaa

SEQ ID NO: 1815168 - RNA, 21 nt, Human
cauaaacaagaccacguuucu

SEQ ID NO: 1815169 - RNA, 20 nt, Human
cauaaacaagaccacguuuc

SEQ ID NO: 1815170 - RNA, 22 nt, Human
cauaaacaagaccacguuucua

SEQ ID NO: 1815171 - RNA, 21 nt, Human
cauaaaaauuagccaagugug

SEQ ID NO: 1815172 - RNA, 13 nt, Human
cauacguacacau

SEQ ID NO: 1815173 - RNA, 16 nt, Human
cauacguacacauuuu

SEQ ID NO: 1815174 - RNA, 15 nt, Human
cauacguacacauuu

SEQ ID NO: 1815175 - RNA, 21 nt, Human
cauacuaaccagcagaaaugc

SEQ ID NO: 1815176 - RNA, 14 nt, Human
cauacuaaccagca

SEQ ID NO: 1815177 - RNA, 18 nt, Human
cauacguacacauuuuau

SEQ ID NO: 1815178 - RNA, 17 nt, Human
cauacguacacauuuua

SEQ ID NO: 1815179 - RNA, 14 nt, Human
cauacccaccccca

SEQ ID NO: 1815180 - RNA, 17 nt, Human
cauacccacccccaccc

SEQ ID NO: 1815181 - RNA, 18 nt, Human
cauacccacccccaccca

SEQ ID NO: 1815182 - RNA, 21 nt, Human
cauacccacccccacccaagg

SEQ ID NO: 1815183 - RNA, 20 nt, Human
cauacuaauuauacccccug

SEQ ID NO: 1815184 - RNA, 13 nt, Human
caucucagcccac

SEQ ID NO: 1815185 - RNA, 20 nt, Human
caucucacacaugagcauca

SEQ ID NO: 1815186 - RNA, 16 nt, Human
caucucacacaugagc

SEQ ID NO: 1815187 - RNA, 17 nt, Human
caucucacacaugagca

SEQ ID NO: 1815188 - RNA, 15 nt, Human
caucuacccuccgau

SEQ ID NO: 1815189 - RNA, 12 nt, Human
caucuaggauuu

SEQ ID NO: 1815190 - RNA, 17 nt, Human
caucuagguaaauuaca

SEQ ID NO: 1815191 - RNA, 18 nt, Human
caucuagguaaauuacag

SEQ ID NO: 1815192 - RNA, 21 nt, Human
cauccucuguacagagcccac

SEQ ID NO: 1815193 - RNA, 19 nt, Human
cauccucuguacagagccc

SEQ ID NO: 1815194 - RNA, 15 nt, Human
cauccucuguacaga

SEQ ID NO: 1815195 - RNA, 18 nt, Human
cauccucuguacagagcc

SEQ ID NO: 1815196 - RNA, 13 nt, Human
cauccucccaagg

SEQ ID NO: 1815197 - RNA, 17 nt, Human
cauccucauacccaccc

SEQ ID NO: 1815198 - RNA, 18 nt, Human
cauccucauacccacccc

SEQ ID NO: 1815199 - RNA, 21 nt, Human
cauccucauacccacccccac

SEQ ID NO: 1815200 - RNA, 22 nt, Human
cauccucauacccacccccacc

SEQ ID NO: 1815201 - RNA, 20 nt, Human
cauccuccgccucccggguu

SEQ ID NO: 1815202 - RNA, 11 nt, Human
cauccuccuca

SEQ ID NO: 1815203 - RNA, 12 nt, Human
cauccuccucag

SEQ ID NO: 1815204 - RNA, 15 nt, Human
cauccuccucagauc

SEQ ID NO: 1815205 - RNA, 16 nt, Human
cauccuccucagaucu

SEQ ID NO: 1815206 - RNA, 18 nt, Human
cauccuccucagaucuuc

SEQ ID NO: 1815207 - RNA, 19 nt, Human
cauccuccucagaucuucu

SEQ ID NO: 1815208 - RNA, 16 nt, Human
cauccuacaagacaca

SEQ ID NO: 1815209 - RNA, 15 nt, Human
cauccucauacccac

SEQ ID NO: 1815210 - RNA, 16 nt, Human
cauccucauacccacc

SEQ ID NO: 1815211 - RNA, 20 nt, Human
caucuugcucugcugacaga

SEQ ID NO: 1815212 - RNA, 14 nt, Human
caucuugcucugcu

SEQ ID NO: 1815213 - RNA, 15 nt, Human
caucuugcucugcug

SEQ ID NO: 1815214 - RNA, 13 nt, Human
caucuugcucugc

SEQ ID NO: 1815215 - RNA, 22 nt, Human
caucucuucuggguuccuuccu

SEQ ID NO: 1815216 - RNA, 14 nt, Human
caucuccacuccag

SEQ ID NO: 1815217 - RNA, 16 nt, Human
caucucuuguuuaaau

SEQ ID NO: 1815218 - RNA, 22 nt, Human
caucuuccaaggguacuaagga

SEQ ID NO: 1815219 - RNA, 15 nt, Human
cauccagguucagcu

SEQ ID NO: 1815220 - RNA, 11 nt, Human
caucccugaag

SEQ ID NO: 1815221 - RNA, 13 nt, Human
caucccugaaggc

SEQ ID NO: 1815222 - RNA, 19 nt, Human
caucccucuggggcuguuc

SEQ ID NO: 1815223 - RNA, 13 nt, Human
caucauugaaauc

SEQ ID NO: 1815224 - RNA, 15 nt, Human
caucaccaacgucug

SEQ ID NO: 1815225 - RNA, 14 nt, Human
caucauugaaaucu

SEQ ID NO: 1815226 - RNA, 15 nt, Human
caucauugaaaucuu

SEQ ID NO: 1815227 - RNA, 20 nt, Human
caucauugaaaucuuuuugc

SEQ ID NO: 1815228 - RNA, 21 nt, Human
caucauugaaaucuuuuugcu

SEQ ID NO: 1815229 - RNA, 17 nt, Human
cauccuacaagacacag

SEQ ID NO: 1815230 - RNA, 22 nt, Human
caucccugaaggccccgcccag

SEQ ID NO: 1815231 - RNA, 14 nt, Human
cauccuaacuccau

SEQ ID NO: 1815232 - RNA, 21 nt, Human
cauccuaacuccaugucucug

SEQ ID NO: 1815233 - RNA, 17 nt, Human
caucccugaaggccccg

SEQ ID NO: 1815234 - RNA, 18 nt, Human
caucccugaaggccccgc

SEQ ID NO: 1815235 - RNA, 19 nt, Human
caucccugaaggccccgcc

SEQ ID NO: 1815236 - RNA, 21 nt, Human
caucccugaaggccccgccca

SEQ ID NO: 1815237 - RNA, 22 nt, Human
cauaguggcuuaaaacaacacu

SEQ ID NO: 1815238 - RNA, 20 nt, Human
cauaguaugguggcuggguu

SEQ ID NO: 1815239 - RNA, 22 nt, Human
cauagugaugguuccccuguuc

SEQ ID NO: 1815240 - RNA, 19 nt, Human
cauaguaugguggcugggu

SEQ ID NO: 1815241 - RNA, 18 nt, Human
cauaguaugguggcuggg

SEQ ID NO: 1815242 - RNA, 22 nt, Human
cauauauauguuuuaagaggca

SEQ ID NO: 1815243 - RNA, 23 nt, Human
cauauauauguuuuaagaggcag

SEQ ID NO: 1815244 - RNA, 15 nt, Human
cauaugauguacaug

SEQ ID NO: 1815245 - RNA, 17 nt, Human
cauaugauguacaugua

SEQ ID NO: 1815246 - RNA, 21 nt, Human
cauaugauguacauguacuga

SEQ ID NO: 1815247 - RNA, 11 nt, Human
cauacucugcu

SEQ ID NO: 1815248 - RNA, 16 nt, Human
cauacucccaucugug

SEQ ID NO: 1815249 - RNA, 15 nt, Human
cauacucccaucugu

SEQ ID NO: 1815250 - RNA, 18 nt, Human
cauacucccaucugugaa

SEQ ID NO: 1815251 - RNA, 20 nt, Human
cauacucccaucugugaaag

SEQ ID NO: 1815252 - RNA, 14 nt, Human
cauagaauaaaauu

SEQ ID NO: 1815253 - RNA, 20 nt, Human
cauagaauaaaauuuuuaau

SEQ ID NO: 1815254 - RNA, 19 nt, Human
cauagagagcaagacgcug

SEQ ID NO: 1815255 - RNA, 21 nt, Human
cauagagagcaagacgcugug

SEQ ID NO: 1815256 - RNA, 23 nt, Human
cauagagagcaagacgcugugcu

SEQ ID NO: 1815257 - RNA, 22 nt, Human
caucaagucuuucacauuuaaa

SEQ ID NO: 1815258 - RNA, 14 nt, Human
caucaagaugugac

SEQ ID NO: 1815259 - RNA, 18 nt, Human
caucaaugaaugaaugaa

SEQ ID NO: 1815260 - RNA, 13 nt, Human
cauaugccugggc

SEQ ID NO: 1815261 - RNA, 14 nt, Human
cauauuuacuucuu

SEQ ID NO: 1815262 - RNA, 12 nt, Human
cauauuuauaaa

SEQ ID NO: 1815263 - RNA, 20 nt, Human
cauauuuacuucuuauacau

SEQ ID NO: 1815264 - RNA, 16 nt, Human
cauauuuacuucuuau

SEQ ID NO: 1815265 - RNA, 17 nt, Human
cauauuuacuucuuaua

SEQ ID NO: 1815266 - RNA, 17 nt, Human
cauauuuauaaaaauaa

SEQ ID NO: 1815267 - RNA, 21 nt, Human
caaggggaauguuugccucug

SEQ ID NO: 1815268 - RNA, 15 nt, Human
caagggccuggccug

SEQ ID NO: 1815269 - RNA, 13 nt, Human
caagggccuggcc

SEQ ID NO: 1815270 - RNA, 14 nt, Human
caagggccuggccu

SEQ ID NO: 1815271 - RNA, 13 nt, Human
caaggucauuuuu

SEQ ID NO: 1815272 - RNA, 23 nt, Human
caaggggaauguuugccucugcc

SEQ ID NO: 1815273 - RNA, 18 nt, Human
caagugauucuccugccu

SEQ ID NO: 1815274 - RNA, 19 nt, Human
caagugauucuccugccuc

SEQ ID NO: 1815275 - RNA, 15 nt, Human
caagugagacccugu

SEQ ID NO: 1815276 - RNA, 19 nt, Human
caagugagacccugucuca

SEQ ID NO: 1815277 - RNA, 20 nt, Human
caagugauucuccugccuca

SEQ ID NO: 1815278 - RNA, 22 nt, Human
caagugaaaaaggaggaagaga

SEQ ID NO: 1815279 - RNA, 23 nt, Human
caagugaaaaaggaggaagagaa

SEQ ID NO: 1815280 - RNA, 14 nt, Human
caagugagacccug

SEQ ID NO: 1815281 - RNA, 16 nt, Human
caagggccuggccuga

SEQ ID NO: 1815282 - RNA, 13 nt, Human
caagaccuucucc

SEQ ID NO: 1815283 - RNA, 20 nt, Human
caagacgcugugcugcccug

SEQ ID NO: 1815284 - RNA, 21 nt, Human
caagacgcugugcugcccugc

SEQ ID NO: 1815285 - RNA, 22 nt, Human
caagacgcugugcugcccugcc

SEQ ID NO: 1815286 - RNA, 13 nt, Human
caagaaaugaaag

SEQ ID NO: 1815287 - RNA, 15 nt, Human
caagaaaugaaagca

SEQ ID NO: 1815288 - RNA, 23 nt, Human
caagacccuuguggucccacccc

SEQ ID NO: 1815289 - RNA, 17 nt, Human
caagagggucugaggaa

SEQ ID NO: 1815290 - RNA, 16 nt, Human
caagagggucugagga

SEQ ID NO: 1815291 - RNA, 12 nt, Human
caagagggucug

SEQ ID NO: 1815292 - RNA, 17 nt, Human
caagagggcacuggugg

SEQ ID NO: 1815293 - RNA, 18 nt, Human
caagagggcacugguggc

SEQ ID NO: 1815294 - RNA, 19 nt, Human
caagagggcacugguggcc

SEQ ID NO: 1815295 - RNA, 20 nt, Human
caagagggcacugguggccc

SEQ ID NO: 1815296 - RNA, 17 nt, Human
caaggauccugagccag

SEQ ID NO: 1815297 - RNA, 15 nt, Human
caaggauccugagcc

SEQ ID NO: 1815298 - RNA, 16 nt, Human
caaggauccugagcca

SEQ ID NO: 1815299 - RNA, 21 nt, Human
caaggcugggggaagaagcuc

SEQ ID NO: 1815300 - RNA, 13 nt, Human
caaggcugucaau

SEQ ID NO: 1815301 - RNA, 14 nt, Human
caaggcugucaauu

SEQ ID NO: 1815302 - RNA, 23 nt, Human
caagggaauuucuucaacucccu

SEQ ID NO: 1815303 - RNA, 21 nt, Human
caaggcugucaauuacaggaa

SEQ ID NO: 1815304 - RNA, 16 nt, Human
caaggacuaggguccu

SEQ ID NO: 1815305 - RNA, 18 nt, Human
caaggacuaggguccugg

SEQ ID NO: 1815306 - RNA, 19 nt, Human
caaggacuaggguccuggg

SEQ ID NO: 1815307 - RNA, 20 nt, Human
caaggacuaggguccugggg

SEQ ID NO: 1815308 - RNA, 21 nt, Human
caaggacuaggguccugggga

SEQ ID NO: 1815309 - RNA, 14 nt, Human
caaggauccugagc

SEQ ID NO: 1815310 - RNA, 14 nt, Human
caacaggcugggcu

SEQ ID NO: 1815311 - RNA, 23 nt, Human
caaauuuacagagacagaaagca

SEQ ID NO: 1815312 - RNA, 17 nt, Human
caaauuuacagagacag

SEQ ID NO: 1815313 - RNA, 16 nt, Human
caaauuuacagagaca

SEQ ID NO: 1815314 - RNA, 17 nt, Human
caacaggcugggcuuca

SEQ ID NO: 1815315 - RNA, 16 nt, Human
caacauacucccaucu

SEQ ID NO: 1815316 - RNA, 14 nt, Human
caacauacucccau

SEQ ID NO: 1815317 - RNA, 15 nt, Human
caacauacucccauc

SEQ ID NO: 1815318 - RNA, 17 nt, Human
caacugcaucaagaugu

SEQ ID NO: 1815319 - RNA, 20 nt, Human
caacugcaucaagaugugac

SEQ ID NO: 1815320 - RNA, 23 nt, Human
caacugcaucaagaugugacaug

SEQ ID NO: 1815321 - RNA, 16 nt, Human
caacugcauuggcuuu

SEQ ID NO: 1815322 - RNA, 17 nt, Human
caaccugauugugucuc

SEQ ID NO: 1815323 - RNA, 19 nt, Human
caaccugauugugucucuu

SEQ ID NO: 1815324 - RNA, 21 nt, Human
caaccugauugugucucuugg

SEQ ID NO: 1815325 - RNA, 17 nt, Human
caaauuguaagcaugca

SEQ ID NO: 1815326 - RNA, 21 nt, Human
caaauauuuagauguaauuuu

SEQ ID NO: 1815327 - RNA, 13 nt, Human
caaauauuccaga

SEQ ID NO: 1815328 - RNA, 17 nt, Human
caaauauuccagagacu

SEQ ID NO: 1815329 - RNA, 23 nt, Human
caaauauuuagauguaauuuugu

SEQ ID NO: 1815330 - RNA, 22 nt, Human
caaauauuuagauguaauuuug

SEQ ID NO: 1815331 - RNA, 22 nt, Human
caaaguucccuacuuccuguga

SEQ ID NO: 1815332 - RNA, 21 nt, Human
caaaguucccuacuuccugug

SEQ ID NO: 1815333 - RNA, 19 nt, Human
caaaguggugagaggcauc

SEQ ID NO: 1815334 - RNA, 20 nt, Human
caaaggagauuggaaggaac

SEQ ID NO: 1815335 - RNA, 18 nt, Human
caaagcccuuccaugucg

SEQ ID NO: 1815336 - RNA, 14 nt, Human
caaaggagauugga

SEQ ID NO: 1815337 - RNA, 23 nt, Human
caaaggguaucaggugcugccau

SEQ ID NO: 1815338 - RNA, 19 nt, Human
caaagugguauagaaaugc

SEQ ID NO: 1815339 - RNA, 18 nt, Human
caaagugguauagaaaug

SEQ ID NO: 1815340 - RNA, 16 nt, Human
caaaguggugagaggc

SEQ ID NO: 1815341 - RNA, 17 nt, Human
caaaguggugagaggca

SEQ ID NO: 1815342 - RNA, 21 nt, Human
caaaggguaucaggugcugcc

SEQ ID NO: 1815343 - RNA, 20 nt, Human
caaaggguaucaggugcugc

SEQ ID NO: 1815344 - RNA, 13 nt, Human
caaagaaauuaug

SEQ ID NO: 1815345 - RNA, 15 nt, Human
caaagaaauuaugug

SEQ ID NO: 1815346 - RNA, 12 nt, Human
caaagaaauuau

SEQ ID NO: 1815347 - RNA, 17 nt, Human
caaagcccaaaguggua

SEQ ID NO: 1815348 - RNA, 19 nt, Human
caaagcccaaagugguaua

SEQ ID NO: 1815349 - RNA, 13 nt, Human
caaagcccagcuu

SEQ ID NO: 1815350 - RNA, 14 nt, Human
caaagagguuuuaa

SEQ ID NO: 1815351 - RNA, 21 nt, Human
caaagagguuuuaaaaaaauc

SEQ ID NO: 1815352 - RNA, 20 nt, Human
caacaggcugggcuucagug

SEQ ID NO: 1815353 - RNA, 18 nt, Human
caaucucggcucacugca

SEQ ID NO: 1815354 - RNA, 14 nt, Human
caaugcacugacau

SEQ ID NO: 1815355 - RNA, 13 nt, Human
caaugcacuuugu

SEQ ID NO: 1815356 - RNA, 23 nt, Human
caaugcaaaccaucauugaaauc

SEQ ID NO: 1815357 - RNA, 14 nt, Human
caaugauggucacc

SEQ ID NO: 1815358 - RNA, 14 nt, Human
caaugcaaaccauc

SEQ ID NO: 1815359 - RNA, 21 nt, Human
caaugcaaaccaucauugaaa

SEQ ID NO: 1815360 - RNA, 22 nt, Human
caaugcaaaccaucauugaaau

SEQ ID NO: 1815361 - RNA, 14 nt, Human
caaugaccuuucaa

SEQ ID NO: 1815362 - RNA, 21 nt, Human
caaugaccuuucaauaggaaa

SEQ ID NO: 1815363 - RNA, 13 nt, Human
caaugauggucac

SEQ ID NO: 1815364 - RNA, 15 nt, Human
caaugaccuuucaau

SEQ ID NO: 1815365 - RNA, 16 nt, Human
caaugaccuuucaaua

SEQ ID NO: 1815366 - RNA, 14 nt, Human
caaugcacuuuguu

SEQ ID NO: 1815367 - RNA, 18 nt, Human
caaugguuuucuugugug

SEQ ID NO: 1815368 - RNA, 17 nt, Human
cacaaacgggcucagca

SEQ ID NO: 1815369 - RNA, 15 nt, Human
cacaagaaaugaaag

SEQ ID NO: 1815370 - RNA, 13 nt, Human
cacaagaaaugaa

SEQ ID NO: 1815371 - RNA, 17 nt, Human
cacaaagguagcuuuuc

SEQ ID NO: 1815372 - RNA, 19 nt, Human
cacaaucucggcucacugc

SEQ ID NO: 1815373 - RNA, 23 nt, Human
cacaagacccaaaaggcagaagc

SEQ ID NO: 1815374 - RNA, 23 nt, Human
cacaagaaaugaaagcagggacu

SEQ ID NO: 1815375 - RNA, 14 nt, Human
cacacacuuuggcu

SEQ ID NO: 1815376 - RNA, 18 nt, Human
cacacagauuugagcuca

SEQ ID NO: 1815377 - RNA, 20 nt, Human
cacacagauuugagcucagc

SEQ ID NO: 1815378 - RNA, 21 nt, Human
cacacagaggcugccucuccc

SEQ ID NO: 1815379 - RNA, 20 nt, Human
cacacaccagagcccaccuu

SEQ ID NO: 1815380 - RNA, 16 nt, Human
cacacaccagagccca

SEQ ID NO: 1815381 - RNA, 15 nt, Human
cacacaccagagccc

SEQ ID NO: 1815382 - RNA, 20 nt, Human
cacaaucucggcucacugca

SEQ ID NO: 1815383 - RNA, 22 nt, Human
cacaaucucggcucacugcauc

SEQ ID NO: 1815384 - RNA, 23 nt, Human
cacaaucucggcucacugcaucc

SEQ ID NO: 1815385 - RNA, 24 nt, Human
cacaaucucggcucacugcauccu

SEQ ID NO: 1815386 - RNA, 15 nt, Human
cacacagcucugucc

SEQ ID NO: 1815387 - RNA, 14 nt, Human
cacacagcucuguc

SEQ ID NO: 1815388 - RNA, 13 nt, Human
cacacagcucugu

SEQ ID NO: 1815389 - RNA, 22 nt, Human
cacacagauuugagcucagccc

SEQ ID NO: 1815390 - RNA, 22 nt, Human
cacaccagagcccaccuuggcu

SEQ ID NO: 1815391 - RNA, 21 nt, Human
cacaccagagcccaccuuggc

SEQ ID NO: 1815392 - RNA, 16 nt, Human
cacacagcucuguccu

SEQ ID NO: 1815393 - RNA, 20 nt, Human
cacacccagcccacuucugc

SEQ ID NO: 1815394 - RNA, 14 nt, Human
cacacccagcccac

SEQ ID NO: 1815395 - RNA, 13 nt, Human
caccaucaagcca

SEQ ID NO: 1815396 - RNA, 14 nt, Human
caccaucaagccac

SEQ ID NO: 1815397 - RNA, 15 nt, Human
caccaucaagccacc

SEQ ID NO: 1815398 - RNA, 18 nt, Human
caccauaggucaccuuua

SEQ ID NO: 1815399 - RNA, 21 nt, Human
caccauauuaccacagacaua

SEQ ID NO: 1815400 - RNA, 18 nt, Human
caccaucaugucuggcua

SEQ ID NO: 1815401 - RNA, 17 nt, Human
caccaucaugucuggcu

SEQ ID NO: 1815402 - RNA, 15 nt, Human
caccaucaugucugg

SEQ ID NO: 1815403 - RNA, 16 nt, Human
caccaucaagccacca

SEQ ID NO: 1815404 - RNA, 17 nt, Human
caccaucaagccaccaa

SEQ ID NO: 1815405 - RNA, 19 nt, Human
caccaucaagccaccaaca

SEQ ID NO: 1815406 - RNA, 24 nt, Human
caccaucaagccaccaacauacuc

SEQ ID NO: 1815407 - RNA, 19 nt, Human
caccauguuggccaggcug

SEQ ID NO: 1815408 - RNA, 20 nt, Human
caccauguuggccaggcugc

SEQ ID NO: 1815409 - RNA, 20 nt, Human
caccauguuggccaggcugg

SEQ ID NO: 1815410 - RNA, 15 nt, Human
caccagagcccaccu

SEQ ID NO: 1815411 - RNA, 22 nt, Human
caccagagcccaccuuggcuca

SEQ ID NO: 1815412 - RNA, 20 nt, Human
caccagagcccaccuuggcu

SEQ ID NO: 1815413 - RNA, 18 nt, Human
caccagagcccaccuugg

SEQ ID NO: 1815414 - RNA, 17 nt, Human
caccagagcccaccuug

SEQ ID NO: 1815415 - RNA, 19 nt, Human
caccacacccagcccacuu

SEQ ID NO: 1815416 - RNA, 15 nt, Human
caccacgcccggcua

SEQ ID NO: 1815417 - RNA, 14 nt, Human
caccacgcccggcu

SEQ ID NO: 1815418 - RNA, 18 nt, Human
caccaacuacuaccugua

SEQ ID NO: 1815419 - RNA, 23 nt, Human
cacauguccaagaagcccaggaa

SEQ ID NO: 1815420 - RNA, 17 nt, Human
caccaacgucugugcca

SEQ ID NO: 1815421 - RNA, 18 nt, Human
cacauguccaagaagccc

SEQ ID NO: 1815422 - RNA, 19 nt, Human
cacauguccaagaagccca

SEQ ID NO: 1815423 - RNA, 21 nt, Human
cacauguccaagaagcccagg

SEQ ID NO: 1815424 - RNA, 22 nt, Human
cacauguccaagaagcccagga

SEQ ID NO: 1815425 - RNA, 12 nt, Human
caccaagcccag

SEQ ID NO: 1815426 - RNA, 13 nt, Human
caccaagcccagu

SEQ ID NO: 1815427 - RNA, 21 nt, Human
cacaugccucucucaggccaa

SEQ ID NO: 1815428 - RNA, 20 nt, Human
cacaugccucucucaggcca

SEQ ID NO: 1815429 - RNA, 16 nt, Human
cacauguccaagaagc

SEQ ID NO: 1815430 - RNA, 17 nt, Human
cacauguccaagaagcc

SEQ ID NO: 1815431 - RNA, 18 nt, Human
cacaugcacgugugugca

SEQ ID NO: 1815432 - RNA, 20 nt, Human
cacaugcaaggucauuuuuu

SEQ ID NO: 1815433 - RNA, 19 nt, Human
cacaugcaaggucauuuuu

SEQ ID NO: 1815434 - RNA, 17 nt, Human
cacaugcaaggucauuu

SEQ ID NO: 1815435 - RNA, 18 nt, Human
cacaugagcaucaggcca

SEQ ID NO: 1815436 - RNA, 19 nt, Human
cacaugagcaucaggccag

SEQ ID NO: 1815437 - RNA, 20 nt, Human
cacaugagcaucaggccagg

SEQ ID NO: 1815438 - RNA, 21 nt, Human
cacaugagcaucaggccaggc

SEQ ID NO: 1815439 - RNA, 13 nt, Human
cacaugagcauca

SEQ ID NO: 1815440 - RNA, 17 nt, Human
cacaugagcaucaggcc

SEQ ID NO: 1815441 - RNA, 20 nt, Human
cacagcucuucuccaggcug

SEQ ID NO: 1815442 - RNA, 19 nt, Human
cacagcucuucuccaggcu

SEQ ID NO: 1815443 - RNA, 21 nt, Human
cacagcucuucuccaggcugu

SEQ ID NO: 1815444 - RNA, 15 nt, Human
cacaggacucugccu

SEQ ID NO: 1815445 - RNA, 16 nt, Human
cacaggacucugccuc

SEQ ID NO: 1815446 - RNA, 17 nt, Human
cacaggaucagucugau

SEQ ID NO: 1815447 - RNA, 14 nt, Human
cacaggcccggcuc

SEQ ID NO: 1815448 - RNA, 23 nt, Human
cacaguccuuaccagcagagcac

SEQ ID NO: 1815449 - RNA, 18 nt, Human
cacagcucuucuccaggc

SEQ ID NO: 1815450 - RNA, 22 nt, Human
cacacggacacucaaaagcugg

SEQ ID NO: 1815451 - RNA, 13 nt, Human
cacccaagggccu

SEQ ID NO: 1815452 - RNA, 23 nt, Human
aggcuguaucccaugagccucag

SEQ ID NO: 1815453 - RNA, 17 nt, Human
aggcugcagugagccga

SEQ ID NO: 1815454 - RNA, 19 nt, Human
aggcugcagugagccgaga

SEQ ID NO: 1815455 - RNA, 24 nt, Human
aggcuguaucccaugagccucagc

SEQ ID NO: 1815456 - RNA, 19 nt, Human
aggcugucaauuacaggaa

SEQ ID NO: 1815457 - RNA, 12 nt, Human
aggcugucaauu

SEQ ID NO: 1815458 - RNA, 13 nt, Human
aggcucuucuccu

SEQ ID NO: 1815459 - RNA, 11 nt, Human
aggcugagccu

SEQ ID NO: 1815460 - RNA, 13 nt, Human
aggcugagccuca

SEQ ID NO: 1815461 - RNA, 11 nt, Human
aggcugaggac

SEQ ID NO: 1815462 - RNA, 13 nt, Human
aggcugaggacuu

SEQ ID NO: 1815463 - RNA, 22 nt, Human
aggcucuggagcccacuguacu

SEQ ID NO: 1815464 - RNA, 21 nt, Human
aggcccucugcccacucccug

SEQ ID NO: 1815465 - RNA, 19 nt, Human
aggcccucugcccacuccc

SEQ ID NO: 1815466 - RNA, 20 nt, Human
aggcccucugcccacucccu

SEQ ID NO: 1815467 - RNA, 13 nt, Human
agggccuggcuca

SEQ ID NO: 1815468 - RNA, 14 nt, Human
agggccuggcucag

SEQ ID NO: 1815469 - RNA, 18 nt, Human
agggccuggcucaggugg

SEQ ID NO: 1815470 - RNA, 17 nt, Human
agggacugagaaauuua

SEQ ID NO: 1815471 - RNA, 15 nt, Human
agggacugagaaauu

SEQ ID NO: 1815472 - RNA, 13 nt, Human
agggacugagaaa

SEQ ID NO: 1815473 - RNA, 14 nt, Human
agggacugagaaau

SEQ ID NO: 1815474 - RNA, 19 nt, Human
aggaaguacuggagaaaau

SEQ ID NO: 1815475 - RNA, 13 nt, Human
aggaaguagagga

SEQ ID NO: 1815476 - RNA, 16 nt, Human
aggagagcccuucauu

SEQ ID NO: 1815477 - RNA, 14 nt, Human
aggaggucucuaag

SEQ ID NO: 1815478 - RNA, 12 nt, Human
aggagugagcac

SEQ ID NO: 1815479 - RNA, 15 nt, Human
aggaggucucuaaga

SEQ ID NO: 1815480 - RNA, 14 nt, Human
aggagugagcacua

SEQ ID NO: 1815481 - RNA, 18 nt, Human
aggaguuucguuuucaaa

SEQ ID NO: 1815482 - RNA, 23 nt, Human
aggccagcugcuugggcuucauc

SEQ ID NO: 1815483 - RNA, 17 nt, Human
aggccaugggccuccug

SEQ ID NO: 1815484 - RNA, 17 nt, Human
aggcccucugcccacuc

SEQ ID NO: 1815485 - RNA, 16 nt, Human
aggccaugggccuccu

SEQ ID NO: 1815486 - RNA, 14 nt, Human
aggccaugggccuc

SEQ ID NO: 1815487 - RNA, 13 nt, Human
aggccagcugcuu

SEQ ID NO: 1815488 - RNA, 14 nt, Human
aggccagcugcuug

SEQ ID NO: 1815489 - RNA, 16 nt, Human
aggccagcugcuuggg

SEQ ID NO: 1815490 - RNA, 16 nt, Human
aggccaggcccucugc

SEQ ID NO: 1815491 - RNA, 17 nt, Human
aggccaggcccucugcc

SEQ ID NO: 1815492 - RNA, 18 nt, Human
aggccaggcccucugccc

SEQ ID NO: 1815493 - RNA, 19 nt, Human
aggccaggcccucugccca

SEQ ID NO: 1815494 - RNA, 23 nt, Human
aggccaggcccucugcccacucc

SEQ ID NO: 1815495 - RNA, 22 nt, Human
aggcauguucucugaggacacu

SEQ ID NO: 1815496 - RNA, 20 nt, Human
aggcauguucucugaggaca

SEQ ID NO: 1815497 - RNA, 21 nt, Human
aggcauuccccaggaggccag

SEQ ID NO: 1815498 - RNA, 22 nt, Human
aggcauuccccaggaggccagc

SEQ ID NO: 1815499 - RNA, 23 nt, Human
aggcauuccccaggaggccagcc

SEQ ID NO: 1815500 - RNA, 12 nt, Human
aggcauguucuc

SEQ ID NO: 1815501 - RNA, 22 nt, Human
aggcaugugccacccacccaac

SEQ ID NO: 1815502 - RNA, 23 nt, Human
aggcaugugaugagaggaaauca

SEQ ID NO: 1815503 - RNA, 24 nt, Human
aggcaugugaugagaggaaaucac

SEQ ID NO: 1815504 - RNA, 17 nt, Human
aggcaucgcaauguaag

SEQ ID NO: 1815505 - RNA, 18 nt, Human
aggcagccaggccacaag

SEQ ID NO: 1815506 - RNA, 13 nt, Human
aggcagauacagg

SEQ ID NO: 1815507 - RNA, 20 nt, Human
aggcagagguugcagugagc

SEQ ID NO: 1815508 - RNA, 22 nt, Human
aggcagaacucaucuagguaaa

SEQ ID NO: 1815509 - RNA, 14 nt, Human
aggcagccaggcca

SEQ ID NO: 1815510 - RNA, 15 nt, Human
aggcagccaggccac

SEQ ID NO: 1815511 - RNA, 16 nt, Human
aggcagccaggccaca

SEQ ID NO: 1815512 - RNA, 12 nt, Human
agcuacaaaugc

SEQ ID NO: 1815513 - RNA, 15 nt, Human
agcuaaugggacacu

SEQ ID NO: 1815514 - RNA, 14 nt, Human
agcuaaugggacac

SEQ ID NO: 1815515 - RNA, 13 nt, Human
agcuaaugggaca

SEQ ID NO: 1815516 - RNA, 19 nt, Human
agcuaagguuuagauaaau

SEQ ID NO: 1815517 - RNA, 13 nt, Human
agcuacaaaugca

SEQ ID NO: 1815518 - RNA, 21 nt, Human
agcucaccagccccagugccc

SEQ ID NO: 1815519 - RNA, 15 nt, Human
agcucaccagcccca

SEQ ID NO: 1815520 - RNA, 14 nt, Human
agcucaccagcccc

SEQ ID NO: 1815521 - RNA, 13 nt, Human
agcucaccagccc

SEQ ID NO: 1815522 - RNA, 15 nt, Human
agcgauucuucugcu

SEQ ID NO: 1815523 - RNA, 17 nt, Human
agcgacagugagacucu

SEQ ID NO: 1815524 - RNA, 19 nt, Human
agcgauucuucugcuucag

SEQ ID NO: 1815525 - RNA, 17 nt, Human
agcgauucuucugcuuc

SEQ ID NO: 1815526 - RNA, 15 nt, Human
agcgacagugagacu

SEQ ID NO: 1815527 - RNA, 13 nt, Human
agcgacagugaga

SEQ ID NO: 1815528 - RNA, 19 nt, Human
agcuaacauggaaguacua

SEQ ID NO: 1815529 - RNA, 20 nt, Human
agcuaacauggaaguacuau

SEQ ID NO: 1815530 - RNA, 18 nt, Human
agccugggcaaugugaua

SEQ ID NO: 1815531 - RNA, 17 nt, Human
agccugcugccugcuuu

SEQ ID NO: 1815532 - RNA, 20 nt, Human
agccuggcacagggcagugg

SEQ ID NO: 1815533 - RNA, 17 nt, Human
agccuggcacagggcag

SEQ ID NO: 1815534 - RNA, 18 nt, Human
agccuggcacagggcagu

SEQ ID NO: 1815535 - RNA, 14 nt, Human
agccuggacccugu

SEQ ID NO: 1815536 - RNA, 22 nt, Human
agcuuuguuuguugucagcuga

SEQ ID NO: 1815537 - RNA, 21 nt, Human
agcuuuguuuguugucagcug

SEQ ID NO: 1815538 - RNA, 18 nt, Human
aggaaaaaauaacaauga

SEQ ID NO: 1815539 - RNA, 19 nt, Human
aggaaaaccaagccguggc

SEQ ID NO: 1815540 - RNA, 15 nt, Human
aggaacacuccuuca

SEQ ID NO: 1815541 - RNA, 20 nt, Human
aggaaaaccaagccguggcu

SEQ ID NO: 1815542 - RNA, 21 nt, Human
aggaaaaccaagccguggcuu

SEQ ID NO: 1815543 - RNA, 22 nt, Human
aggaaaaccaagccguggcuuc

SEQ ID NO: 1815544 - RNA, 23 nt, Human
aggaaaaccaagccguggcuucc

SEQ ID NO: 1815545 - RNA, 12 nt, Human
aggaacacuccu

SEQ ID NO: 1815546 - RNA, 11 nt, Human
aggaaguacug

SEQ ID NO: 1815547 - RNA, 15 nt, Human
aggaaguacuggaga

SEQ ID NO: 1815548 - RNA, 14 nt, Human
aggaagguagaaau

SEQ ID NO: 1815549 - RNA, 16 nt, Human
agcugucaaggcucag

SEQ ID NO: 1815550 - RNA, 15 nt, Human
agcuggucccacuca

SEQ ID NO: 1815551 - RNA, 20 nt, Human
agcuggguuggaaaacagua

SEQ ID NO: 1815552 - RNA, 16 nt, Human
agcuggguuggaaaac

SEQ ID NO: 1815553 - RNA, 14 nt, Human
agcuggguuggaaa

SEQ ID NO: 1815554 - RNA, 16 nt, Human
agcugguugagguuuc

SEQ ID NO: 1815555 - RNA, 15 nt, Human
agcugacuuuucugu

SEQ ID NO: 1815556 - RNA, 21 nt, Human
agcugacuuuucuguccgagc

SEQ ID NO: 1815557 - RNA, 23 nt, Human
agcucaccagccccagugcccac

SEQ ID NO: 1815558 - RNA, 22 nt, Human
agcucaccagccccagugccca

SEQ ID NO: 1815559 - RNA, 18 nt, Human
agacgaaacauuuguucu

SEQ ID NO: 1815560 - RNA, 17 nt, Human
agacccaaaaggcagaa

SEQ ID NO: 1815561 - RNA, 14 nt, Human
agaccacguuucua

SEQ ID NO: 1815562 - RNA, 23 nt, Human
agaccaucccugaaggccccgcc

SEQ ID NO: 1815563 - RNA, 13 nt, Human
agacagcccucca

SEQ ID NO: 1815564 - RNA, 21 nt, Human
agacagcccgggcucugccuc

SEQ ID NO: 1815565 - RNA, 14 nt, Human
agacaauuuauuau

SEQ ID NO: 1815566 - RNA, 22 nt, Human
agacagcccgggcucugccucc

SEQ ID NO: 1815567 - RNA, 23 nt, Human
agacagcccgggcucugccuccc

SEQ ID NO: 1815568 - RNA, 15 nt, Human
agacuaucuaaaugu

SEQ ID NO: 1815569 - RNA, 17 nt, Human
agacgcugugcugcccu

SEQ ID NO: 1815570 - RNA, 18 nt, Human
agacgcugugcugcccug

SEQ ID NO: 1815571 - RNA, 19 nt, Human
agacgcugugcugcccugc

SEQ ID NO: 1815572 - RNA, 20 nt, Human
agacgcugugcugcccugcc

SEQ ID NO: 1815573 - RNA, 19 nt, Human
agacaaggaaaaaauaaca

SEQ ID NO: 1815574 - RNA, 20 nt, Human
agacaaugugaaaagaaaaa

SEQ ID NO: 1815575 - RNA, 15 nt, Human
agaauuuugagcagg

SEQ ID NO: 1815576 - RNA, 18 nt, Human
agagcccacgcccccacu

SEQ ID NO: 1815577 - RNA, 11 nt, Human
agagagcaaga

SEQ ID NO: 1815578 - RNA, 19 nt, Human
agagagcaagacgcugugc

SEQ ID NO: 1815579 - RNA, 23 nt, Human
agagagcaagacgcugugcugcc

SEQ ID NO: 1815580 - RNA, 12 nt, Human
agacugaccaau

SEQ ID NO: 1815581 - RNA, 21 nt, Human
agacugaccaauauuguacag

SEQ ID NO: 1815582 - RNA, 16 nt, Human
agacucuuuggacacu

SEQ ID NO: 1815583 - RNA, 22 nt, Human
agaacagugauuaccagggacu

SEQ ID NO: 1815584 - RNA, 13 nt, Human
agaacaucccucc

SEQ ID NO: 1815585 - RNA, 17 nt, Human
agaacaucccuccuggg

SEQ ID NO: 1815586 - RNA, 17 nt, Human
agaaccaaaaagaggcu

SEQ ID NO: 1815587 - RNA, 18 nt, Human
agaaccaaaaagaggcua

SEQ ID NO: 1815588 - RNA, 18 nt, Human
agaaugcucuuuacuuca

SEQ ID NO: 1815589 - RNA, 23 nt, Human
agaaugcacaaacagaggccgcc

SEQ ID NO: 1815590 - RNA, 17 nt, Human
agaaucucaaauaacua

SEQ ID NO: 1815591 - RNA, 16 nt, Human
agaaugaaagggccca

SEQ ID NO: 1815592 - RNA, 20 nt, Human
agaaccaggcaacuugggaa

SEQ ID NO: 1815593 - RNA, 17 nt, Human
agaaccaggcaacuugg

SEQ ID NO: 1815594 - RNA, 21 nt, Human
agaaccaaaaagaggcuaugu

SEQ ID NO: 1815595 - RNA, 15 nt, Human
agaagagaaugcaca

SEQ ID NO: 1815596 - RNA, 23 nt, Human
agaagagaaugcacaaacagagg

SEQ ID NO: 1815597 - RNA, 14 nt, Human
agaagucacacagu

SEQ ID NO: 1815598 - RNA, 17 nt, Human
agaagucuuagauguau

SEQ ID NO: 1815599 - RNA, 19 nt, Human
agaagucuuagauguauau

SEQ ID NO: 1815600 - RNA, 19 nt, Human
agaagauggcacuuauaac

SEQ ID NO: 1815601 - RNA, 18 nt, Human
agaagaugaaugagcaaa

SEQ ID NO: 1815602 - RNA, 16 nt, Human
agcaucuaugugagac

SEQ ID NO: 1815603 - RNA, 22 nt, Human
agccagcaggcucucaggccag

SEQ ID NO: 1815604 - RNA, 21 nt, Human
agccagcaggcucucaggcca

SEQ ID NO: 1815605 - RNA, 23 nt, Human
agccagcaggcucucaggccagc

SEQ ID NO: 1815606 - RNA, 13 nt, Human
agcccaccuuggc

SEQ ID NO: 1815607 - RNA, 23 nt, Human
agcccaccccucaacaccucugc

SEQ ID NO: 1815608 - RNA, 17 nt, Human
agcccacgcccccacug

SEQ ID NO: 1815609 - RNA, 18 nt, Human
agcccacgcccccacugg

SEQ ID NO: 1815610 - RNA, 19 nt, Human
agcccacgcccccacuggu

SEQ ID NO: 1815611 - RNA, 20 nt, Human
agcccacgcccccacuggug

SEQ ID NO: 1815612 - RNA, 17 nt, Human
agccaacuauggccugu

SEQ ID NO: 1815613 - RNA, 14 nt, Human
agccagauuucacu

SEQ ID NO: 1815614 - RNA, 17 nt, Human
agccagauuucacucuc

SEQ ID NO: 1815615 - RNA, 20 nt, Human
agccagauuucacucuccuu

SEQ ID NO: 1815616 - RNA, 22 nt, Human
agccagauuucacucuccuugg

SEQ ID NO: 1815617 - RNA, 16 nt, Human
agcagccuggacccug

SEQ ID NO: 1815618 - RNA, 13 nt, Human
agcagugcaugcu

SEQ ID NO: 1815619 - RNA, 16 nt, Human
agcagugcaugcuguc

SEQ ID NO: 1815620 - RNA, 20 nt, Human
agcagccuggacccugugga

SEQ ID NO: 1815621 - RNA, 19 nt, Human
agcagcguuucuaugacac

SEQ ID NO: 1815622 - RNA, 17 nt, Human
agcagugcaugcugucc

SEQ ID NO: 1815623 - RNA, 18 nt, Human
agcagugcaugcuguccc

SEQ ID NO: 1815624 - RNA, 21 nt, Human
agcacagacccugcccugugg

SEQ ID NO: 1815625 - RNA, 17 nt, Human
agcaauucuccugccuc

SEQ ID NO: 1815626 - RNA, 18 nt, Human
agcaauucuccugccuca

SEQ ID NO: 1815627 - RNA, 19 nt, Human
agcaauucuccugccucag

SEQ ID NO: 1815628 - RNA, 20 nt, Human
agcaauucuccugccucagc

SEQ ID NO: 1815629 - RNA, 15 nt, Human
agcaauucuccugcc

SEQ ID NO: 1815630 - RNA, 20 nt, Human
agauagauaggucagugcaa

SEQ ID NO: 1815631 - RNA, 20 nt, Human
agauagccaaggccaaagga

SEQ ID NO: 1815632 - RNA, 15 nt, Human
agauauaaaagacug

SEQ ID NO: 1815633 - RNA, 14 nt, Human
agaguugaagacag

SEQ ID NO: 1815634 - RNA, 15 nt, Human
agaguugaagacaga

SEQ ID NO: 1815635 - RNA, 13 nt, Human
agaguugaagaca

SEQ ID NO: 1815636 - RNA, 20 nt, Human
agagggucugaggaauccag

SEQ ID NO: 1815637 - RNA, 12 nt, Human
agaguggcuccu

SEQ ID NO: 1815638 - RNA, 13 nt, Human
agaguggcuccuc

SEQ ID NO: 1815639 - RNA, 14 nt, Human
agaguggcuccucc

SEQ ID NO: 1815640 - RNA, 15 nt, Human
agaguggcuccuccc

SEQ ID NO: 1815641 - RNA, 19 nt, Human
agcaaauucuguuuuucua

SEQ ID NO: 1815642 - RNA, 19 nt, Human
agauugcaacaggcugggc

SEQ ID NO: 1815643 - RNA, 17 nt, Human
agauugcaacaggcugg

SEQ ID NO: 1815644 - RNA, 16 nt, Human
agauugcaccacugca

SEQ ID NO: 1815645 - RNA, 16 nt, Human
agauugcaacaggcug

SEQ ID NO: 1815646 - RNA, 17 nt, Human
agauugagauguguuca

SEQ ID NO: 1815647 - RNA, 18 nt, Human
agauucuuuccugaggcu

SEQ ID NO: 1815648 - RNA, 15 nt, Human
agauucuuuccugag

SEQ ID NO: 1815649 - RNA, 16 nt, Human
agauucuuuccugagg

SEQ ID NO: 1815650 - RNA, 21 nt, Human
agauggcugugccucugccug

SEQ ID NO: 1815651 - RNA, 22 nt, Human
agauggcugugccucugccugu

SEQ ID NO: 1815652 - RNA, 17 nt, Human
agauggcugugccucug

SEQ ID NO: 1815653 - RNA, 18 nt, Human
agauggcugugccucugc

SEQ ID NO: 1815654 - RNA, 19 nt, Human
agauggcugugccucugcc

SEQ ID NO: 1815655 - RNA, 20 nt, Human
agauggcugugccucugccu

SEQ ID NO: 1815656 - RNA, 18 nt, Human
agaugacaucugucuagg

SEQ ID NO: 1815657 - RNA, 14 nt, Human
agauucuuuccuga

SEQ ID NO: 1815658 - RNA, 20 nt, Human
agaugggugcuuggaggaag

SEQ ID NO: 1815659 - RNA, 22 nt, Human
agaugggugcuuggaggaagga

SEQ ID NO: 1815660 - RNA, 18 nt, Human
agaucucugcuuuggaaa

SEQ ID NO: 1815661 - RNA, 23 nt, Human
agaucucugcuuuggaaaucaca

SEQ ID NO: 1815662 - RNA, 18 nt, Human
aguuacacuaaaagguga

SEQ ID NO: 1815663 - RNA, 14 nt, Human
aguucauacccugu

SEQ ID NO: 1815664 - RNA, 19 nt, Human
aguuacacauuuuucagau

SEQ ID NO: 1815665 - RNA, 16 nt, Human
aguuacacauuuuuca

SEQ ID NO: 1815666 - RNA, 13 nt, Human
aguuacacauuuu

SEQ ID NO: 1815667 - RNA, 18 nt, Human
aguuccaccaucaagcca

SEQ ID NO: 1815668 - RNA, 21 nt, Human
aguuccaccaucaagccacca

SEQ ID NO: 1815669 - RNA, 15 nt, Human
aguuccacugagacc

SEQ ID NO: 1815670 - RNA, 13 nt, Human
aguuccacugaga

SEQ ID NO: 1815671 - RNA, 17 nt, Human
aguugaaaaacagcuga

SEQ ID NO: 1815672 - RNA, 16 nt, Human
aguugaagacagagcu

SEQ ID NO: 1815673 - RNA, 17 nt, Human
aguugaagacagagcua

SEQ ID NO: 1815674 - RNA, 18 nt, Human
aguugaaaaacagcugag

SEQ ID NO: 1815675 - RNA, 20 nt, Human
aguuguuagauuaagaaaua

SEQ ID NO: 1815676 - RNA, 17 nt, Human
aguuguuagugugucuu

SEQ ID NO: 1815677 - RNA, 22 nt, Human
aguuguuagugugucuuagugu

SEQ ID NO: 1815678 - RNA, 16 nt, Human
auaaaagacagugaaa

SEQ ID NO: 1815679 - RNA, 15 nt, Human
auaaaagacagugaa

SEQ ID NO: 1815680 - RNA, 23 nt, Human
aguuucugucguuaaaaacagau

SEQ ID NO: 1815681 - RNA, 22 nt, Human
aguuucugucguuaaaaacaga

SEQ ID NO: 1815682 - RNA, 20 nt, Human
aguuucugucguuaaaaaca

SEQ ID NO: 1815683 - RNA, 14 nt, Human
aguuugauuaaauu

SEQ ID NO: 1815684 - RNA, 11 nt, Human
aguuugcaguu

SEQ ID NO: 1815685 - RNA, 23 nt, Human
auacaaugcugugcccuaaagug

SEQ ID NO: 1815686 - RNA, 12 nt, Human
auaauguuaaca

SEQ ID NO: 1815687 - RNA, 15 nt, Human
auacaccacuacauu

SEQ ID NO: 1815688 - RNA, 21 nt, Human
auaaagaugagugagcaugcc

SEQ ID NO: 1815689 - RNA, 18 nt, Human
auacaccgggccuggaga

SEQ ID NO: 1815690 - RNA, 14 nt, Human
auacaccgggccug

SEQ ID NO: 1815691 - RNA, 17 nt, Human
auacaccacuacauucu

SEQ ID NO: 1815692 - RNA, 22 nt, Human
aguacuucuccacccugcucuc

SEQ ID NO: 1815693 - RNA, 21 nt, Human
aguacuucuccacccugcucu

SEQ ID NO: 1815694 - RNA, 19 nt, Human
aguacuucuccacccugcu

SEQ ID NO: 1815695 - RNA, 20 nt, Human
aguacuucuccacccugcuc

SEQ ID NO: 1815696 - RNA, 22 nt, Human
aguauauugauccagaaagaaa

SEQ ID NO: 1815697 - RNA, 15 nt, Human
aguacuggagaaaau

SEQ ID NO: 1815698 - RNA, 17 nt, Human
aguaacuuacuuaggug

SEQ ID NO: 1815699 - RNA, 20 nt, Human
aguaaaugggggugcauuug

SEQ ID NO: 1815700 - RNA, 19 nt, Human
aguaaaugggggugcauuu

SEQ ID NO: 1815701 - RNA, 21 nt, Human
aguaaaugggggugcauuuga

SEQ ID NO: 1815702 - RNA, 20 nt, Human
agugauucuccugccucagc

SEQ ID NO: 1815703 - RNA, 19 nt, Human
agugauucuccugccucag

SEQ ID NO: 1815704 - RNA, 18 nt, Human
agugauucuccugccuca

SEQ ID NO: 1815705 - RNA, 19 nt, Human
agugccuuauggaacacuc

SEQ ID NO: 1815706 - RNA, 20 nt, Human
agugccuuauggaacacucu

SEQ ID NO: 1815707 - RNA, 21 nt, Human
agugccuuauggaacacucug

SEQ ID NO: 1815708 - RNA, 22 nt, Human
agugccuuauggaacacucuga

SEQ ID NO: 1815709 - RNA, 13 nt, Human
agugauuaccagg

SEQ ID NO: 1815710 - RNA, 23 nt, Human
agugauccucccaccucagccuc

SEQ ID NO: 1815711 - RNA, 22 nt, Human
agugauccucccaccucagccu

SEQ ID NO: 1815712 - RNA, 20 nt, Human
agugauccucccaccucagc

SEQ ID NO: 1815713 - RNA, 19 nt, Human
agugauccucccaccucag

SEQ ID NO: 1815714 - RNA, 14 nt, Human
agugacagaggcag

SEQ ID NO: 1815715 - RNA, 19 nt, Human
agugacagaggcagcccca

SEQ ID NO: 1815716 - RNA, 16 nt, Human
agugacagaggcagcc

SEQ ID NO: 1815717 - RNA, 18 nt, Human
agucuggcccuuccuuuu

SEQ ID NO: 1815718 - RNA, 16 nt, Human
agucgaggacagggag

SEQ ID NO: 1815719 - RNA, 22 nt, Human
agucugauucccaagcucugcu

SEQ ID NO: 1815720 - RNA, 21 nt, Human
agucugauucccaagcucugc

SEQ ID NO: 1815721 - RNA, 14 nt, Human
aguccucuuuucug

SEQ ID NO: 1815722 - RNA, 16 nt, Human
aguccuuaccagcaga

SEQ ID NO: 1815723 - RNA, 18 nt, Human
aguccuuaccagcagagc

SEQ ID NO: 1815724 - RNA, 12 nt, Human
augaauacuuug

SEQ ID NO: 1815725 - RNA, 17 nt, Human
augaauaaagacaccua

SEQ ID NO: 1815726 - RNA, 21 nt, Human
augaaguaauaugcacacauu

SEQ ID NO: 1815727 - RNA, 14 nt, Human
augaaguaauaugc

SEQ ID NO: 1815728 - RNA, 23 nt, Human
augaaguaauaugcacacauuuu

SEQ ID NO: 1815729 - RNA, 13 nt, Human
augaaguacucau

SEQ ID NO: 1815730 - RNA, 23 nt, Human
augaagcauuuacuuuguguuca

SEQ ID NO: 1815731 - RNA, 12 nt, Human
augaaagacugu

SEQ ID NO: 1815732 - RNA, 21 nt, Human
augagcuuugucuacuucaaa

SEQ ID NO: 1815733 - RNA, 21 nt, Human
augagccucagcauccuggca

SEQ ID NO: 1815734 - RNA, 11 nt, Human
augagccuggc

SEQ ID NO: 1815735 - RNA, 12 nt, Human
augagccuggca

SEQ ID NO: 1815736 - RNA, 13 nt, Human
augaccuuucaau

SEQ ID NO: 1815737 - RNA, 15 nt, Human
augaccuuucaauag

SEQ ID NO: 1815738 - RNA, 18 nt, Human
augaccuuucaauaggaa

SEQ ID NO: 1815739 - RNA, 19 nt, Human
aucuaggauuuuaagggaa

SEQ ID NO: 1815740 - RNA, 11 nt, Human
aucuaggauuu

SEQ ID NO: 1815741 - RNA, 23 nt, Human
aucuaggaagacuuuggaaagag

SEQ ID NO: 1815742 - RNA, 24 nt, Human
augcauauuauuuuauguugcaua

SEQ ID NO: 1815743 - RNA, 21 nt, Human
augccugguggcagcugcggu

SEQ ID NO: 1815744 - RNA, 18 nt, Human
augccugguggcagcugc

SEQ ID NO: 1815745 - RNA, 19 nt, Human
augccugguggcagcugcg

SEQ ID NO: 1815746 - RNA, 14 nt, Human
augccugguggcag

SEQ ID NO: 1815747 - RNA, 13 nt, Human
augccugguggca

SEQ ID NO: 1815748 - RNA, 12 nt, Human
augccugguggc

SEQ ID NO: 1815749 - RNA, 11 nt, Human
augccuggugg

SEQ ID NO: 1815750 - RNA, 16 nt, Human
augcuuugaucccuuc

SEQ ID NO: 1815751 - RNA, 14 nt, Human
augcuucuucagag

SEQ ID NO: 1815752 - RNA, 17 nt, Human
augcuucuucagagacu

SEQ ID NO: 1815753 - RNA, 20 nt, Human
augcuucuucagagacuccu

SEQ ID NO: 1815754 - RNA, 22 nt, Human
augcuucuucagagacuccugc

SEQ ID NO: 1815755 - RNA, 18 nt, Human
augcucugcauguuacau

SEQ ID NO: 1815756 - RNA, 19 nt, Human
augcucugcauguuacaua

SEQ ID NO: 1815757 - RNA, 15 nt, Human
augggacagggagga

SEQ ID NO: 1815758 - RNA, 14 nt, Human
aucgaccugccucg

SEQ ID NO: 1815759 - RNA, 22 nt, Human
aucuaggaagacuuuggaaaga

SEQ ID NO: 1815760 - RNA, 21 nt, Human
auccacugugccaugugccag

SEQ ID NO: 1815761 - RNA, 23 nt, Human
auccacuuuaucuugaauaaugu

SEQ ID NO: 1815762 - RNA, 14 nt, Human
aucaaauacauuua

SEQ ID NO: 1815763 - RNA, 13 nt, Human
aucaaauacauuu

SEQ ID NO: 1815764 - RNA, 15 nt, Human
aucauccuaagcuau

SEQ ID NO: 1815765 - RNA, 20 nt, Human
aucaugacaaagacugagua

SEQ ID NO: 1815766 - RNA, 19 nt, Human
aucauggagguuugaagau

SEQ ID NO: 1815767 - RNA, 14 nt, Human
auagcacagacccu

SEQ ID NO: 1815768 - RNA, 24 nt, Human
aucaaaagguuaauaaaguaauua

SEQ ID NO: 1815769 - RNA, 20 nt, Human
aucaaaagguuaauaaagua

SEQ ID NO: 1815770 - RNA, 19 nt, Human
aucaaagagguuuuaaaaa

SEQ ID NO: 1815771 - RNA, 12 nt, Human
aucaaaggacac

SEQ ID NO: 1815772 - RNA, 18 nt, Human
auauuuuuuucuuuucuu

SEQ ID NO: 1815773 - RNA, 14 nt, Human
aucaaaagaaagaa

SEQ ID NO: 1815774 - RNA, 15 nt, Human
acaaguuaaauaaau

SEQ ID NO: 1815775 - RNA, 16 nt, Human
acaaggcaaggcuguc

SEQ ID NO: 1815776 - RNA, 17 nt, Human
acaaggcaaggcuguca

SEQ ID NO: 1815777 - RNA, 19 nt, Human
acaaggcaaggcugucaau

SEQ ID NO: 1815778 - RNA, 20 nt, Human
acaaggcaaggcugucaauu

SEQ ID NO: 1815779 - RNA, 13 nt, Human
acaccagagccca

SEQ ID NO: 1815780 - RNA, 15 nt, Human
acaccaauauucaua

SEQ ID NO: 1815781 - RNA, 23 nt, Human
acaccagagcccaccuuggcuca

SEQ ID NO: 1815782 - RNA, 18 nt, Human
acaccagagcccaccuug

SEQ ID NO: 1815783 - RNA, 18 nt, Human
acacagcucuucuccagg

SEQ ID NO: 1815784 - RNA, 16 nt, Human
acacagcucuucucca

SEQ ID NO: 1815785 - RNA, 14 nt, Human
acacagcucuucuc

SEQ ID NO: 1815786 - RNA, 11 nt, Human
aauuguaauag

SEQ ID NO: 1815787 - RNA, 21 nt, Human
aauuuccacucaggucuguuu

SEQ ID NO: 1815788 - RNA, 15 nt, Human
aauuucccaaagcag

SEQ ID NO: 1815789 - RNA, 17 nt, Human
aauuucccaaagcagug

SEQ ID NO: 1815790 - RNA, 19 nt, Human
aauuauacccccugcaaag

SEQ ID NO: 1815791 - RNA, 19 nt, Human
aauuaugaguuauuuuuau

SEQ ID NO: 1815792 - RNA, 14 nt, Human
aauucuguuuuucu

SEQ ID NO: 1815793 - RNA, 18 nt, Human
aauucuguuuuucuaggc

SEQ ID NO: 1815794 - RNA, 22 nt, Human
aauuggauacgacaacuugcac

SEQ ID NO: 1815795 - RNA, 13 nt, Human
aauucuuaaauau

SEQ ID NO: 1815796 - RNA, 22 nt, Human
aauuguaaggaaugauuaauua

SEQ ID NO: 1815797 - RNA, 21 nt, Human
aauucucauuugucacacacu

SEQ ID NO: 1815798 - RNA, 14 nt, Human
aauucuccugccuc

SEQ ID NO: 1815799 - RNA, 15 nt, Human
aauucuccugccuca

SEQ ID NO: 1815800 - RNA, 16 nt, Human
aauucuccugccucag

SEQ ID NO: 1815801 - RNA, 17 nt, Human
aauucucuaguuugauu

SEQ ID NO: 1815802 - RNA, 15 nt, Human
aauucucuaguuuga

SEQ ID NO: 1815803 - RNA, 15 nt, Human
aauucucuuauccaa

SEQ ID NO: 1815804 - RNA, 22 nt, Human
aauucuagcuuugagcuuaaga

SEQ ID NO: 1815805 - RNA, 14 nt, Human
aauucuacuuugag

SEQ ID NO: 1815806 - RNA, 15 nt, Human
aauucuaugccuguc

SEQ ID NO: 1815807 - RNA, 13 nt, Human
aauucuaugccug

SEQ ID NO: 1815808 - RNA, 19 nt, Human
aauucucagaaucucaaau

SEQ ID NO: 1815809 - RNA, 17 nt, Human
acauguguuggcagccu

SEQ ID NO: 1815810 - RNA, 17 nt, Human
acauguuaaacuuacuu

SEQ ID NO: 1815811 - RNA, 19 nt, Human
acauguuuuucuucucccu

SEQ ID NO: 1815812 - RNA, 16 nt, Human
acauacaauuccaaac

SEQ ID NO: 1815813 - RNA, 20 nt, Human
acauacaggaagguagaaau

SEQ ID NO: 1815814 - RNA, 20 nt, Human
acauaaguauuuaauucaug

SEQ ID NO: 1815815 - RNA, 15 nt, Human
acauaagauaaaugu

SEQ ID NO: 1815816 - RNA, 13 nt, Human
acaugcacgugug

SEQ ID NO: 1815817 - RNA, 14 nt, Human
accaacgucugugc

SEQ ID NO: 1815818 - RNA, 17 nt, Human
accaacgucugugccau

SEQ ID NO: 1815819 - RNA, 16 nt, Human
accacgcuggaccuug

SEQ ID NO: 1815820 - RNA, 14 nt, Human
accacgcuggaccu

SEQ ID NO: 1815821 - RNA, 18 nt, Human
accacgcuggaccuugaa

SEQ ID NO: 1815822 - RNA, 14 nt, Human
accacguuucuaaa

SEQ ID NO: 1815823 - RNA, 13 nt, Human
accacguuucuaa

SEQ ID NO: 1815824 - RNA, 15 nt, Human
accaagccguggcuu

SEQ ID NO: 1815825 - RNA, 16 nt, Human
accaagccguggcuuc

SEQ ID NO: 1815826 - RNA, 17 nt, Human
accaagccguggcuucc

SEQ ID NO: 1815827 - RNA, 18 nt, Human
accaagccguggcuuccc

SEQ ID NO: 1815828 - RNA, 14 nt, Human
accaagccguggcu

SEQ ID NO: 1815829 - RNA, 21 nt, Human
accaacgucugugccauuuug

SEQ ID NO: 1815830 - RNA, 13 nt, Human
accagagcugcca

SEQ ID NO: 1815831 - RNA, 12 nt, Human
accagagcugcc

SEQ ID NO: 1815832 - RNA, 14 nt, Human
accagagcugccac

SEQ ID NO: 1815833 - RNA, 16 nt, Human
accagagcugccaccu

SEQ ID NO: 1815834 - RNA, 23 nt, Human
acaggcacccaccaucaugucug

SEQ ID NO: 1815835 - RNA, 15 nt, Human
acagugcaucucagc

SEQ ID NO: 1815836 - RNA, 17 nt, Human
acagugcaucucagccc

SEQ ID NO: 1815837 - RNA, 18 nt, Human
acagugcaucucagccca

SEQ ID NO: 1815838 - RNA, 13 nt, Human
acagugcaucuca

SEQ ID NO: 1815839 - RNA, 19 nt, Human
acagugauuaccagggacu

SEQ ID NO: 1815840 - RNA, 18 nt, Human
acaguggaaccagcccag

SEQ ID NO: 1815841 - RNA, 17 nt, Human
acaggcaaugcuggcug

SEQ ID NO: 1815842 - RNA, 14 nt, Human
acaggcacccacca

SEQ ID NO: 1815843 - RNA, 16 nt, Human
acaggcaaugcuggcu

SEQ ID NO: 1815844 - RNA, 15 nt, Human
acaggcaaugcuggc

SEQ ID NO: 1815845 - RNA, 14 nt, Human
acaggauuauugga

SEQ ID NO: 1815846 - RNA, 20 nt, Human
acagcucuucuccaggcugu

SEQ ID NO: 1815847 - RNA, 19 nt, Human
acagcucuucuccaggcug

SEQ ID NO: 1815848 - RNA, 19 nt, Human
acggaauaguuggcuagga

SEQ ID NO: 1815849 - RNA, 17 nt, Human
acggacacucaaaagcu

SEQ ID NO: 1815850 - RNA, 19 nt, Human
acggacacucaaaagcugg

SEQ ID NO: 1815851 - RNA, 12 nt, Human
acgucugugcca

SEQ ID NO: 1815852 - RNA, 13 nt, Human
acgucugugccau

SEQ ID NO: 1815853 - RNA, 12 nt, Human
acgcagcccugc

SEQ ID NO: 1815854 - RNA, 22 nt, Human
acgcagcccugcuuugggcugc

SEQ ID NO: 1815855 - RNA, 23 nt, Human
acgcagcccugcuuugggcugcc

SEQ ID NO: 1815856 - RNA, 22 nt, Human
acgcugugcugcccugcccacc

SEQ ID NO: 1815857 - RNA, 19 nt, Human
acgcugugcugcccugccc

SEQ ID NO: 1815858 - RNA, 19 nt, Human
acgauuucuguuuagauaa

SEQ ID NO: 1815859 - RNA, 23 nt, Human
acgauuucuguuuagauaauaca

SEQ ID NO: 1815860 - RNA, 20 nt, Human
acgauuucuguuuagauaau

SEQ ID NO: 1815861 - RNA, 18 nt, Human
acuaauggggcggugaga

SEQ ID NO: 1815862 - RNA, 12 nt, Human
accuuggcucaa

SEQ ID NO: 1815863 - RNA, 23 nt, Human
accucugccugaagucacacagu

SEQ ID NO: 1815864 - RNA, 20 nt, Human
accucugccugaagucacac

SEQ ID NO: 1815865 - RNA, 12 nt, Human
accucugccuga

SEQ ID NO: 1815866 - RNA, 17 nt, Human
accuguggccaaguucu

SEQ ID NO: 1815867 - RNA, 21 nt, Human
accugccaggaagccagcagg

SEQ ID NO: 1815868 - RNA, 22 nt, Human
accugccaggaagccagcaggc

SEQ ID NO: 1815869 - RNA, 23 nt, Human
accugccaggaagccagcaggcu

SEQ ID NO: 1815870 - RNA, 12 nt, Human
accugccccuca

SEQ ID NO: 1815871 - RNA, 15 nt, Human
accugccccucaacu

SEQ ID NO: 1815872 - RNA, 20 nt, Human
accugccccucaacucuccu

SEQ ID NO: 1815873 - RNA, 16 nt, Human
acccuggggagaaagu

SEQ ID NO: 1815874 - RNA, 16 nt, Human
acccugugauggggcc

SEQ ID NO: 1815875 - RNA, 21 nt, Human
acccugucucuacuaaaaaua

SEQ ID NO: 1815876 - RNA, 23 nt, Human
acccucaucaccaacgucugugc

SEQ ID NO: 1815877 - RNA, 18 nt, Human
acccuggcacccagggug

SEQ ID NO: 1815878 - RNA, 23 nt, Human
acccuggcacuauaauguaagcu

SEQ ID NO: 1815879 - RNA, 18 nt, Human
acccucagagccaccccu

SEQ ID NO: 1815880 - RNA, 13 nt, Human
acccucaggcagg

SEQ ID NO: 1815881 - RNA, 14 nt, Human
acccucaggcaggu

SEQ ID NO: 1815882 - RNA, 13 nt, Human
acccucaucacca

SEQ ID NO: 1815883 - RNA, 15 nt, Human
acccucaggcaggug

SEQ ID NO: 1815884 - RNA, 16 nt, Human
acccucaggcaggugg

SEQ ID NO: 1815885 - RNA, 11 nt, Human
acccucagagc

SEQ ID NO: 1815886 - RNA, 14 nt, Human
acccuauugcugcu

SEQ ID NO: 1815887 - RNA, 19 nt, Human
acccuauugcugcuugagg

SEQ ID NO: 1815888 - RNA, 13 nt, Human
acccuauugcugc

SEQ ID NO: 1815889 - RNA, 21 nt, Human
accucaggugauccacccacc

SEQ ID NO: 1815890 - RNA, 20 nt, Human
accucaggugauccacccac

SEQ ID NO: 1815891 - RNA, 11 nt, Human
accucaggccu

SEQ ID NO: 1815892 - RNA, 16 nt, Human
accgggcacucagaag

SEQ ID NO: 1815893 - RNA, 14 nt, Human
accgggcacucaga

SEQ ID NO: 1815894 - RNA, 12 nt, Human
accgggcacuca

SEQ ID NO: 1815895 - RNA, 17 nt, Human
acccugugauggggccc

SEQ ID NO: 1815896 - RNA, 19 nt, Human
acccugugauggggcccug

SEQ ID NO: 1815897 - RNA, 20 nt, Human
acccugugauggggcccugc

SEQ ID NO: 1815898 - RNA, 21 nt, Human
acccugugauggggcccugcc

SEQ ID NO: 1815899 - RNA, 11 nt, Human
accucagccuc

SEQ ID NO: 1815900 - RNA, 12 nt, Human
accucagccucc

SEQ ID NO: 1815901 - RNA, 19 nt, Human
accgugccuggccacgccc

SEQ ID NO: 1815902 - RNA, 23 nt, Human
accgugaggccagagacacaagc

SEQ ID NO: 1815903 - RNA, 21 nt, Human
accgggcugggagcucugcag

SEQ ID NO: 1815904 - RNA, 23 nt, Human
accgggcugggagcucugcagag

SEQ ID NO: 1815905 - RNA, 18 nt, Human
accgugaggccagagaca

SEQ ID NO: 1815906 - RNA, 19 nt, Human
acuguuucaaacuuuacua

SEQ ID NO: 1815907 - RNA, 18 nt, Human
acuguuucaaacuuuacu

SEQ ID NO: 1815908 - RNA, 15 nt, Human
acuguuucaaacuuu

SEQ ID NO: 1815909 - RNA, 22 nt, Human
acuuaaaaaugguuuaaauggu

SEQ ID NO: 1815910 - RNA, 15 nt, Human
acuucaaaaguuugu

SEQ ID NO: 1815911 - RNA, 20 nt, Human
acuuaaaauauuccugcauu

SEQ ID NO: 1815912 - RNA, 21 nt, Human
acuucagacauagaauuaaca

SEQ ID NO: 1815913 - RNA, 12 nt, Human
acuugaaaauua

SEQ ID NO: 1815914 - RNA, 14 nt, Human
acuugaaaauuaac

SEQ ID NO: 1815915 - RNA, 16 nt, Human
acuugaaaauuaacau

SEQ ID NO: 1815916 - RNA, 23 nt, Human
acuuggggggcugaggugggagg

SEQ ID NO: 1815917 - RNA, 13 nt, Human
acuuggucuguga

SEQ ID NO: 1815918 - RNA, 17 nt, Human
acuguaaaauaauaacu

SEQ ID NO: 1815919 - RNA, 12 nt, Human
acugguggcccg

SEQ ID NO: 1815920 - RNA, 15 nt, Human
acugccuauuuuaau

SEQ ID NO: 1815921 - RNA, 12 nt, Human
acuggaacucuc

SEQ ID NO: 1815922 - RNA, 14 nt, Human
acugccaugccagc

SEQ ID NO: 1815923 - RNA, 19 nt, Human
acugcccaggccugccugu

SEQ ID NO: 1815924 - RNA, 18 nt, Human
acugugccaugugccagg

SEQ ID NO: 1815925 - RNA, 17 nt, Human
acugugccaugugccag

SEQ ID NO: 1815926 - RNA, 22 nt, Human
acugucuuuuuucuaaaguaaa

SEQ ID NO: 1815927 - RNA, 23 nt, Human
acugucuuuuuucuaaaguaaaa

SEQ ID NO: 1815928 - RNA, 16 nt, Human
acugugaagagaacca

SEQ ID NO: 1815929 - RNA, 16 nt, Human
acugucuuuuuucuaa

SEQ ID NO: 1815930 - RNA, 18 nt, Human
acugacauuguuggccaa

SEQ ID NO: 1815931 - RNA, 17 nt, Human
acugacauuguuggcca

SEQ ID NO: 1815932 - RNA, 23 nt, Human
acugaauuucuuuugccguuauu

SEQ ID NO: 1815933 - RNA, 12 nt, Human
acugaauuucuu

SEQ ID NO: 1815934 - RNA, 23 nt, Human
acugaugggcaacccccagccug

SEQ ID NO: 1815935 - RNA, 20 nt, Human
acugauguaugaggaauuuc

SEQ ID NO: 1815936 - RNA, 14 nt, Human
acugauuacugccu

SEQ ID NO: 1815937 - RNA, 17 nt, Human
acugauuuuuuuuuccu

SEQ ID NO: 1815938 - RNA, 18 nt, Human
acugauuuuuuuuuccuu

SEQ ID NO: 1815939 - RNA, 19 nt, Human
acugauuuuuuuuuccuuc

SEQ ID NO: 1815940 - RNA, 20 nt, Human
acugauuuuuuuuuccuuca

SEQ ID NO: 1815941 - RNA, 16 nt, Human
acugauuuuuuuuucc

SEQ ID NO: 1815942 - RNA, 15 nt, Human
acucuacagaggcca

SEQ ID NO: 1815943 - RNA, 14 nt, Human
acucccuuucaaca

SEQ ID NO: 1815944 - RNA, 18 nt, Human
acucccugccccccagcc

SEQ ID NO: 1815945 - RNA, 15 nt, Human
acucccaagcuggac

SEQ ID NO: 1815946 - RNA, 22 nt, Human
acucccaucugugaaaggaaag

SEQ ID NO: 1815947 - RNA, 21 nt, Human
aagacaaggaaaaaauaacaa

SEQ ID NO: 1815948 - RNA, 22 nt, Human
aagacaaugacuuacuguacau

SEQ ID NO: 1815949 - RNA, 19 nt, Human
aagacaaugugaaaagaaa

SEQ ID NO: 1815950 - RNA, 20 nt, Human
aagacaaugugaaaagaaaa

SEQ ID NO: 1815951 - RNA, 14 nt, Human
aagaacuagcauaa

SEQ ID NO: 1815952 - RNA, 12 nt, Human
aacgcagcccug

SEQ ID NO: 1815953 - RNA, 16 nt, Human
aacgcagcccugcuuu

SEQ ID NO: 1815954 - RNA, 12 nt, Human
aagacagagucu

SEQ ID NO: 1815955 - RNA, 23 nt, Human
aagacagauacuccuccaagguu

SEQ ID NO: 1815956 - RNA, 17 nt, Human
aagaccacguuucuaaa

SEQ ID NO: 1815957 - RNA, 15 nt, Human
aagaccacguuucua

SEQ ID NO: 1815958 - RNA, 21 nt, Human
aagacuuuuccaacccucauc

SEQ ID NO: 1815959 - RNA, 12 nt, Human
aagacuuuucuu

SEQ ID NO: 1815960 - RNA, 19 nt, Human
aagacuuuucuuucagcca

SEQ ID NO: 1815961 - RNA, 13 nt, Human
aagagaaaaaaua

SEQ ID NO: 1815962 - RNA, 13 nt, Human
aaggcaaggcugu

SEQ ID NO: 1815963 - RNA, 19 nt, Human
aaggcagggagggccuggg

SEQ ID NO: 1815964 - RNA, 22 nt, Human
aaggcagggagggccugggccc

SEQ ID NO: 1815965 - RNA, 16 nt, Human
aaggcaaggcugucaa

SEQ ID NO: 1815966 - RNA, 15 nt, Human
aaggcaaggcuguca

SEQ ID NO: 1815967 - RNA, 22 nt, Human
aagcuagacgagcaggcuucuu

SEQ ID NO: 1815968 - RNA, 13 nt, Human
aagcugcacccuc

SEQ ID NO: 1815969 - RNA, 19 nt, Human
aagcugcacccucaggcag

SEQ ID NO: 1815970 - RNA, 23 nt, Human
aagauacaguuacucagaauucu

SEQ ID NO: 1815971 - RNA, 17 nt, Human
aagauacaguuacucag

SEQ ID NO: 1815972 - RNA, 19 nt, Human
aagauaauauuaaggaaga

SEQ ID NO: 1815973 - RNA, 21 nt, Human
aagauaauauuaaggaagaca

SEQ ID NO: 1815974 - RNA, 23 nt, Human
aagccagguuccacagaggacac

SEQ ID NO: 1815975 - RNA, 21 nt, Human
aagccagguuccacagaggac

SEQ ID NO: 1815976 - RNA, 15 nt, Human
aagcgugagccacug

SEQ ID NO: 1815977 - RNA, 16 nt, Human
aagcgugagccacugc

SEQ ID NO: 1815978 - RNA, 13 nt, Human
aagcuagaaauga

SEQ ID NO: 1815979 - RNA, 14 nt, Human
aagcggcuggcagc

SEQ ID NO: 1815980 - RNA, 10 nt, Human
aagccuuugu

SEQ ID NO: 1815981 - RNA, 20 nt, Human
aaugaauacuuuauaaagga

SEQ ID NO: 1815982 - RNA, 20 nt, Human
aaugauguauguugaagccu

SEQ ID NO: 1815983 - RNA, 20 nt, Human
aaugaugccaugaggaacaa

SEQ ID NO: 1815984 - RNA, 14 nt, Human
aaugaagcaaugcu

SEQ ID NO: 1815985 - RNA, 21 nt, Human
aaugaaagacuguacaaagua

SEQ ID NO: 1815986 - RNA, 18 nt, Human
aaugaaagacuguacaaa

SEQ ID NO: 1815987 - RNA, 20 nt, Human
aaugaaagacuguacaaagu

SEQ ID NO: 1815988 - RNA, 23 nt, Human
aauauguggaguucaucuugaau

SEQ ID NO: 1815989 - RNA, 13 nt, Human
aauauuaagaaag

SEQ ID NO: 1815990 - RNA, 23 nt, Human
aaucaaguuggcuucuaaucaaa

SEQ ID NO: 1815991 - RNA, 15 nt, Human
aaucacguaaagcua

SEQ ID NO: 1815992 - RNA, 23 nt, Human
aaucaccgaaaacguggcugcuu

SEQ ID NO: 1815993 - RNA, 22 nt, Human
aaucaaugcuauaacuauguug

SEQ ID NO: 1815994 - RNA, 21 nt, Human
aaucaccgaaaacguggcugc

SEQ ID NO: 1815995 - RNA, 12 nt, Human
aauaaagacagg

SEQ ID NO: 1815996 - RNA, 11 nt, Human
aauaaagacag

SEQ ID NO: 1815997 - RNA, 22 nt, Human
aauaaugugaaacuggauuaaa

SEQ ID NO: 1815998 - RNA, 17 nt, Human
aauaaugugaaacugga

SEQ ID NO: 1815999 - RNA, 14 nt, Human
aauaaagcagcguu

SEQ ID NO: 1816000 - RNA, 19 nt, Human
aauaauguuaacauggaca

SEQ ID NO: 1816001 - RNA, 12 nt, Human
aagugcugggau

SEQ ID NO: 1816002 - RNA, 22 nt, Human
aagugcugggauuacaggugug

SEQ ID NO: 1816003 - RNA, 22 nt, Human
aagugcugcauuuaaaagauac

SEQ ID NO: 1816004 - RNA, 22 nt, Human
aaguuguaggcauaaagucagg

SEQ ID NO: 1816005 - RNA, 19 nt, Human
aauaaacacucuugaaaaa

SEQ ID NO: 1816006 - RNA, 11 nt, Human
aauaaacacuc

SEQ ID NO: 1816007 - RNA, 16 nt, Human
aauaaacacucuugaa

SEQ ID NO: 1816008 - RNA, 22 nt, Human
aacauggccuuugcuugaaaga

SEQ ID NO: 1816009 - RNA, 11 nt, Human
aacaggcagau

SEQ ID NO: 1816010 - RNA, 18 nt, Human
aaauucuugcaaaguauc

SEQ ID NO: 1816011 - RNA, 15 nt, Human
aaauucuugcaaagu

SEQ ID NO: 1816012 - RNA, 23 nt, Human
aaauucuucuccacuuucuagcc

SEQ ID NO: 1816013 - RNA, 19 nt, Human
aacccucagagccaccccu

SEQ ID NO: 1816014 - RNA, 12 nt, Human
aacccucagagc

SEQ ID NO: 1816015 - RNA, 23 nt, Human
aacauggccuuugcuugaaagaa

SEQ ID NO: 1816016 - RNA, 18 nt, Human
aaccuuuguuugcaucug

SEQ ID NO: 1816017 - RNA, 16 nt, Human
aaccuuuugagugccu

SEQ ID NO: 1816018 - RNA, 23 nt, Human
aaccuuuugagugccuuacacaa

SEQ ID NO: 1816019 - RNA, 14 nt, Human
aaaugaaaaaauau

SEQ ID NO: 1816020 - RNA, 22 nt, Human
aaaugcugguuuuucaguuuuc

SEQ ID NO: 1816021 - RNA, 19 nt, Human
aaaugcuguaacuuucuga

SEQ ID NO: 1816022 - RNA, 19 nt, Human
aaaucuccaaaauaaaacu

SEQ ID NO: 1816023 - RNA, 13 nt, Human
aaaucuuuuugcu

SEQ ID NO: 1816024 - RNA, 14 nt, Human
aaaucuuuuugcuu

SEQ ID NO: 1816025 - RNA, 22 nt, Human
aaauauuuagauguaauuuugu

SEQ ID NO: 1816026 - RNA, 20 nt, Human
aaaggaugcccaaagaugca

SEQ ID NO: 1816027 - RNA, 14 nt, Human
aaaggaugcacaga

SEQ ID NO: 1816028 - RNA, 13 nt, Human
aaauguucaucaa

SEQ ID NO: 1816029 - RNA, 17 nt, Human
aaauguucaucaaugaa

SEQ ID NO: 1816030 - RNA, 18 nt, Human
aaacccagcucuggucca

SEQ ID NO: 1816031 - RNA, 12 nt, Human
aaacccagcucu

SEQ ID NO: 1816032 - RNA, 16 nt, Human
aaacccagcucugguc

SEQ ID NO: 1816033 - RNA, 22 nt, Human
aaacucuguuacacuuuuugga

SEQ ID NO: 1816034 - RNA, 18 nt, Human
aaacucuguuacacuuuu

SEQ ID NO: 1816035 - RNA, 15 nt, Human
aaaccgccaaggcug

SEQ ID NO: 1816036 - RNA, 16 nt, Human
aaaccgccaaggcugg

SEQ ID NO: 1816037 - RNA, 12 nt, Human
aaacucuuaaaa

SEQ ID NO: 1816038 - RNA, 23 nt, Human
aaacucuuaaaacccaagugccu

SEQ ID NO: 1816039 - RNA, 22 nt, Human
aaacugauuuuuuuuuccuuca

SEQ ID NO: 1816040 - RNA, 23 nt, Human
aaacugauuuuuuuuuccuucag

SEQ ID NO: 1816041 - RNA, 18 nt, Human
aaaaucucaaauuucuaa

SEQ ID NO: 1816042 - RNA, 16 nt, Human
aaaaucucaaauuucu

SEQ ID NO: 1816043 - RNA, 15 nt, Human
aaaaucucaaauuuc

SEQ ID NO: 1816044 - RNA, 15 nt, Human
aaagcccaaaguggu

SEQ ID NO: 1816045 - RNA, 16 nt, Human
aaaauaaaacuuuuua

SEQ ID NO: 1816046 - RNA, 13 nt, Human
aaaaucagccugc

SEQ ID NO: 1816047 - RNA, 17 nt, Human
aaaaucagccugcucca

SEQ ID NO: 1816048 - RNA, 21 nt, Human
aaaaucagccugcuccagcug

SEQ ID NO: 1816049 - RNA, 14 nt, Human
aaaauaaaacuuuu

SEQ ID NO: 1816050 - RNA, 20 nt, Human
aaaagacaaggaaaaaauaa

SEQ ID NO: 1816051 - RNA, 16 nt, Human
aaaagaaaagucaagg

SEQ ID NO: 1816052 - RNA, 17 nt, Human
aaaagaaagaaaaucag

SEQ ID NO: 1816053 - RNA, 19 nt, Human
aaaacacuguucucugccc

SEQ ID NO: 1816054 - RNA, 17 nt, Human
aaaacacauuuuucuua

SEQ ID NO: 1816055 - RNA, 11 nt, Human
aaaagaaaaag

SEQ ID NO: 1816056 - RNA, 20 nt, Human
auguuacauaagauaaaugu

SEQ ID NO: 1816057 - RNA, 19 nt, Human
auguuacauaagauaaaug

SEQ ID NO: 1816058 - RNA, 17 nt, Human
uuuuagaguugauacua

SEQ ID NO: 1816059 - RNA, 21 nt, Human
uuuuagacccuauugcugcuu

SEQ ID NO: 1816060 - RNA, 16 nt, Human
auguugcccaggcagg

SEQ ID NO: 1816061 - RNA, 15 nt, Human
auguugcccaggcag

SEQ ID NO: 1816062 - RNA, 14 nt, Human
auguugcccaggca

SEQ ID NO: 1816063 - RNA, 13 nt, Human
auguugcccaggc

SEQ ID NO: 1816064 - RNA, 18 nt, Human
auguugaaagaucaaaag

SEQ ID NO: 1816065 - RNA, 12 nt, Human
auguugaaagau

SEQ ID NO: 1816066 - RNA, 15 nt, Human
auguguguuuuaaaa

SEQ ID NO: 1816067 - RNA, 21 nt, Human
augugccagguuuuuggucug

SEQ ID NO: 1816068 - RNA, 21 nt, Human
uuuuaaaaaacugcugacugu

SEQ ID NO: 1816069 - RNA, 18 nt, Human
uuuuaaaaaacugcugac

SEQ ID NO: 1816070 - RNA, 16 nt, Human
uuuucuauaauuuaaa

SEQ ID NO: 1816071 - RNA, 14 nt, Human
uuuucaguguacau

SEQ ID NO: 1816072 - RNA, 15 nt, Human
uuuuaguagagacag

SEQ ID NO: 1816073 - RNA, 19 nt, Human
uuuuauggcuuuugugcau

SEQ ID NO: 1816074 - RNA, 18 nt, Human
uuuuauggcuuuugugca

SEQ ID NO: 1816075 - RNA, 21 nt, Human
uuuuauggcuuuugugcauua

SEQ ID NO: 1816076 - RNA, 12 nt, Human
uuuuauuaaauu

SEQ ID NO: 1816077 - RNA, 17 nt, Human
auguuggccaggcuggu

SEQ ID NO: 1816078 - RNA, 21 nt, Human
uuuucuuaaccagaucauugu

SEQ ID NO: 1816079 - RNA, 13 nt, Human
uuuucuguucuuu

SEQ ID NO: 1816080 - RNA, 19 nt, Human
auuaaaacacaacaucuuu

SEQ ID NO: 1816081 - RNA, 23 nt, Human
auuaaaaaucucaaauuucuaaa

SEQ ID NO: 1816082 - RNA, 15 nt, Human
auguuuuuuuuuaaa

SEQ ID NO: 1816083 - RNA, 23 nt, Human
augucgucaaagcugaaauggac

SEQ ID NO: 1816084 - RNA, 14 nt, Human
augugagacugguu

SEQ ID NO: 1816085 - RNA, 13 nt, Human
augugagaccauu

SEQ ID NO: 1816086 - RNA, 16 nt, Human
auguccaagaagccca

SEQ ID NO: 1816087 - RNA, 17 nt, Human
auguccaagaagcccag

SEQ ID NO: 1816088 - RNA, 17 nt, Human
auguaucaaauacauuu

SEQ ID NO: 1816089 - RNA, 12 nt, Human
auguaucaauga

SEQ ID NO: 1816090 - RNA, 19 nt, Human
auguauauuuuauaucaau

SEQ ID NO: 1816091 - RNA, 15 nt, Human
augugaugagaggaa

SEQ ID NO: 1816092 - RNA, 18 nt, Human
augugauccuuuuggagu

SEQ ID NO: 1816093 - RNA, 16 nt, Human
uuuguaauuuuuuuau

SEQ ID NO: 1816094 - RNA, 14 nt, Human
uuuguacagacaac

SEQ ID NO: 1816095 - RNA, 14 nt, Human
uuuguuucugaaag

SEQ ID NO: 1816096 - RNA, 16 nt, Human
uuuguuucugaaaggg

SEQ ID NO: 1816097 - RNA, 13 nt, Human
uuuguuucauauu

SEQ ID NO: 1816098 - RNA, 22 nt, Human
uuugugcauuaucuagauacug

SEQ ID NO: 1816099 - RNA, 19 nt, Human
uuugugcauuaucuagaua

SEQ ID NO: 1816100 - RNA, 15 nt, Human
uuugugauacaaugc

SEQ ID NO: 1816101 - RNA, 22 nt, Human
uuugugauacaaugcugugccc

SEQ ID NO: 1816102 - RNA, 16 nt, Human
uuugugauacaaugcu

SEQ ID NO: 1816103 - RNA, 23 nt, Human
uuugucuuaaaaaguggaaaaau

SEQ ID NO: 1816104 - RNA, 13 nt, Human
uuugucuuaaaaa

SEQ ID NO: 1816105 - RNA, 14 nt, Human
uuugucuuaaaaag

SEQ ID NO: 1816106 - RNA, 22 nt, Human
uuugggguacccacugcucugg

SEQ ID NO: 1816107 - RNA, 21 nt, Human
uuugggguacccacugcucug

SEQ ID NO: 1816108 - RNA, 13 nt, Human
uuuggggaagaac

SEQ ID NO: 1816109 - RNA, 14 nt, Human
uuugggcugcccug

SEQ ID NO: 1816110 - RNA, 12 nt, Human
uuuggcugcuga

SEQ ID NO: 1816111 - RNA, 13 nt, Human
uuuggcugcugaa

SEQ ID NO: 1816112 - RNA, 18 nt, Human
uuugauucagacagcugc

SEQ ID NO: 1816113 - RNA, 22 nt, Human
uuugcuggggccgaaagaacag

SEQ ID NO: 1816114 - RNA, 19 nt, Human
uuugcuggggccgaaagaa

SEQ ID NO: 1816115 - RNA, 20 nt, Human
uuugcuggagcucugcccau

SEQ ID NO: 1816116 - RNA, 13 nt, Human
uuugcuguagaag

SEQ ID NO: 1816117 - RNA, 22 nt, Human
uuuggauuggaugaauuccaaa

SEQ ID NO: 1816118 - RNA, 18 nt, Human
uuugaccucugcagcaau

SEQ ID NO: 1816119 - RNA, 13 nt, Human
uuugagacagagu

SEQ ID NO: 1816120 - RNA, 15 nt, Human
uuugauccaagcugg

SEQ ID NO: 1816121 - RNA, 15 nt, Human
uuugauucagacagc

SEQ ID NO: 1816122 - RNA, 18 nt, Human
uuugacaaagguaaauca

SEQ ID NO: 1816123 - RNA, 14 nt, Human
uuugacaaggggca

SEQ ID NO: 1816124 - RNA, 21 nt, Human
uuugaccucugcagcaauaaa

SEQ ID NO: 1816125 - RNA, 19 nt, Human
uuugaccucugcagcaaua

SEQ ID NO: 1816126 - RNA, 23 nt, Human
uuucccucccuuccucuuuccau

SEQ ID NO: 1816127 - RNA, 20 nt, Human
auuauauggcuugaguuuaa

SEQ ID NO: 1816128 - RNA, 17 nt, Human
auuccaagugauugaaa

SEQ ID NO: 1816129 - RNA, 12 nt, Human
auuccacagcug

SEQ ID NO: 1816130 - RNA, 13 nt, Human
auuccacagcugc

SEQ ID NO: 1816131 - RNA, 17 nt, Human
auucccaagcucugcuc

SEQ ID NO: 1816132 - RNA, 18 nt, Human
auuccagagaguggcucc

SEQ ID NO: 1816133 - RNA, 19 nt, Human
auucccaagcucugcuccu

SEQ ID NO: 1816134 - RNA, 18 nt, Human
auucccaagcucugcucc

SEQ ID NO: 1816135 - RNA, 20 nt, Human
auuccccaggaggccagccu

SEQ ID NO: 1816136 - RNA, 22 nt, Human
auuccccaggaggccagccuug

SEQ ID NO: 1816137 - RNA, 14 nt, Human
auucagccuggcuu

SEQ ID NO: 1816138 - RNA, 15 nt, Human
auucagccuggcuuc

SEQ ID NO: 1816139 - RNA, 21 nt, Human
uuuugugaaguuuaauugacu

SEQ ID NO: 1816140 - RNA, 16 nt, Human
uuuuguuuuugucuua

SEQ ID NO: 1816141 - RNA, 15 nt, Human
uuuuugaagcuguau

SEQ ID NO: 1816142 - RNA, 19 nt, Human
uuuuuggaagugaaaacuu

SEQ ID NO: 1816143 - RNA, 15 nt, Human
uuuuuggaagugaaa

SEQ ID NO: 1816144 - RNA, 22 nt, Human
uuuuugggaaaagaaaagucaa

SEQ ID NO: 1816145 - RNA, 11 nt, Human
uuuuuguauuu

SEQ ID NO: 1816146 - RNA, 13 nt, Human
auuaaggaagaca

SEQ ID NO: 1816147 - RNA, 18 nt, Human
auuaaguacuauguauca

SEQ ID NO: 1816148 - RNA, 19 nt, Human
auuaaguacuauguaucaa

SEQ ID NO: 1816149 - RNA, 13 nt, Human
auuacuucugcua

SEQ ID NO: 1816150 - RNA, 12 nt, Human
auuacuucugcu

SEQ ID NO: 1816151 - RNA, 14 nt, Human
auuacuucugcuac

SEQ ID NO: 1816152 - RNA, 13 nt, Human
auuagagaagaga

SEQ ID NO: 1816153 - RNA, 13 nt, Human
auuaaguuguuaa

SEQ ID NO: 1816154 - RNA, 19 nt, Human
auugcaacaggcugggcuu

SEQ ID NO: 1816155 - RNA, 12 nt, Human
auugcaccacug

SEQ ID NO: 1816156 - RNA, 18 nt, Human
auugcaacaggcugggcu

SEQ ID NO: 1816157 - RNA, 17 nt, Human
auugcaacaggcugggc

SEQ ID NO: 1816158 - RNA, 16 nt, Human
auugcauuuccugaca

SEQ ID NO: 1816159 - RNA, 22 nt, Human
auuggcuagagguucaaagaua

SEQ ID NO: 1816160 - RNA, 20 nt, Human
auuggcuagagguucaaaga

SEQ ID NO: 1816161 - RNA, 19 nt, Human
auuggcuagagguucaaag

SEQ ID NO: 1816162 - RNA, 23 nt, Human
auuggcuagagguucaaagauau

SEQ ID NO: 1816163 - RNA, 16 nt, Human
auuuaguguucauaaa

SEQ ID NO: 1816164 - RNA, 19 nt, Human
auuuacuucuuauacauuu

SEQ ID NO: 1816165 - RNA, 20 nt, Human
auuuacuucuuauacauuug

SEQ ID NO: 1816166 - RNA, 17 nt, Human
auuuaguguucauaaau

SEQ ID NO: 1816167 - RNA, 23 nt, Human
auuuauaaaaauaaaaaacacug

SEQ ID NO: 1816168 - RNA, 15 nt, Human
auuuauaaacuuuuu

SEQ ID NO: 1816169 - RNA, 16 nt, Human
auuguaguccuguaau

SEQ ID NO: 1816170 - RNA, 17 nt, Human
auuguuuucaguguaca

SEQ ID NO: 1816171 - RNA, 17 nt, Human
auuuaaaaaaaaaccug

SEQ ID NO: 1816172 - RNA, 18 nt, Human
auuguuuucaguguacau

SEQ ID NO: 1816173 - RNA, 19 nt, Human
auuguuuucaguguacaug

SEQ ID NO: 1816174 - RNA, 14 nt, Human
auuuaaaaaaaauc

SEQ ID NO: 1816175 - RNA, 21 nt, Human
auuuccuaaauauauuuuaag

SEQ ID NO: 1816176 - RNA, 14 nt, Human
auuuccuaaauaua

SEQ ID NO: 1816177 - RNA, 17 nt, Human
auuuccguuaaaauacc

SEQ ID NO: 1816178 - RNA, 14 nt, Human
auuucccaaagcag

SEQ ID NO: 1816179 - RNA, 16 nt, Human
auuucccaaagcagug

SEQ ID NO: 1816180 - RNA, 21 nt, Human
auuuggugguuucagaaaugu

SEQ ID NO: 1816181 - RNA, 22 nt, Human
auuugaggucuguucuuuccaa

SEQ ID NO: 1816182 - RNA, 21 nt, Human
auuugaggucuguucuuucca

SEQ ID NO: 1816183 - RNA, 16 nt, Human
auuugagcagggcuca

SEQ ID NO: 1816184 - RNA, 15 nt, Human
auuugagcagggcuc

SEQ ID NO: 1816185 - RNA, 18 nt, Human
auuugaggucuguucuuu

SEQ ID NO: 1816186 - RNA, 17 nt, Human
auuugaggucuguucuu

SEQ ID NO: 1816187 - RNA, 16 nt, Human
auuucuuccacaagag

SEQ ID NO: 1816188 - RNA, 23 nt, Human
augcacuuuguucuggcucuucc

SEQ ID NO: 1816189 - RNA, 18 nt, Human
uuuaaaaaaauuccaagu

SEQ ID NO: 1816190 - RNA, 17 nt, Human
augcagagguccacaac

SEQ ID NO: 1816191 - RNA, 18 nt, Human
augcagagguccacaaca

SEQ ID NO: 1816192 - RNA, 21 nt, Human
augcacuuuguucuggcucuu

SEQ ID NO: 1816193 - RNA, 13 nt, Human
augauuucauuca

SEQ ID NO: 1816194 - RNA, 17 nt, Human
augauuuaauuugaaau

SEQ ID NO: 1816195 - RNA, 20 nt, Human
uuguucuugguuuguaaauu

SEQ ID NO: 1816196 - RNA, 19 nt, Human
uuguucuugguuuguaaau

SEQ ID NO: 1816197 - RNA, 17 nt, Human
uuguucuugguuuguaa

SEQ ID NO: 1816198 - RNA, 21 nt, Human
uuuaaauauaugcuaagucuu

SEQ ID NO: 1816199 - RNA, 21 nt, Human
uuuaaaugaaagugagacuuu

SEQ ID NO: 1816200 - RNA, 13 nt, Human
uuuaaaugaaagu

SEQ ID NO: 1816201 - RNA, 11 nt, Human
uuuaaaugcac

SEQ ID NO: 1816202 - RNA, 23 nt, Human
uuuaaaaauacagauagauauau

SEQ ID NO: 1816203 - RNA, 21 nt, Human
uuuaaaaaauuaaucugggcc

SEQ ID NO: 1816204 - RNA, 14 nt, Human
uuuaagaggcaggg

SEQ ID NO: 1816205 - RNA, 14 nt, Human
uuuaagagacagcc

SEQ ID NO: 1816206 - RNA, 12 nt, Human
uuuaagagaaau

SEQ ID NO: 1816207 - RNA, 19 nt, Human
uuuaaggaugcuuguacau

SEQ ID NO: 1816208 - RNA, 21 nt, Human
uuuaagcuguuacugucuuca

SEQ ID NO: 1816209 - RNA, 22 nt, Human
uuuaaggaugcuuguacauaau

SEQ ID NO: 1816210 - RNA, 21 nt, Human
uuuaaggaugcuuguacauaa

SEQ ID NO: 1816211 - RNA, 20 nt, Human
uuuaaggaugcuuguacaua

SEQ ID NO: 1816212 - RNA, 17 nt, Human
uuuaaggguuuguggaa

SEQ ID NO: 1816213 - RNA, 20 nt, Human
uuuaaggguuuguggaaaau

SEQ ID NO: 1816214 - RNA, 22 nt, Human
uuuaaggguuuguggaaaauga

SEQ ID NO: 1816215 - RNA, 16 nt, Human
uuuaaugaaagacugu

SEQ ID NO: 1816216 - RNA, 13 nt, Human
augaguccccugu

SEQ ID NO: 1816217 - RNA, 23 nt, Human
augaguccccuguuuguuucuga

SEQ ID NO: 1816218 - RNA, 21 nt, Human
uugucauauaagauucauauu

SEQ ID NO: 1816219 - RNA, 17 nt, Human
uugucacacacuuuggc

SEQ ID NO: 1816220 - RNA, 18 nt, Human
augaggucagagccugca

SEQ ID NO: 1816221 - RNA, 16 nt, Human
augaggucagagccug

SEQ ID NO: 1816222 - RNA, 15 nt, Human
augaggucagagccu

SEQ ID NO: 1816223 - RNA, 21 nt, Human
augagguacaaccuguucugc

SEQ ID NO: 1816224 - RNA, 20 nt, Human
augaggucagagccugcagu

SEQ ID NO: 1816225 - RNA, 19 nt, Human
augaggucagagccugcag

SEQ ID NO: 1816226 - RNA, 22 nt, Human
augaggucagagccugcaguua

SEQ ID NO: 1816227 - RNA, 15 nt, Human
augagguacugagag

SEQ ID NO: 1816228 - RNA, 18 nt, Human
augagguacugagaguga

SEQ ID NO: 1816229 - RNA, 17 nt, Human
augagguacugagagug

SEQ ID NO: 1816230 - RNA, 18 nt, Human
uugugaugucccaacuug

SEQ ID NO: 1816231 - RNA, 22 nt, Human
uugugaugucccaacuuguaaa

SEQ ID NO: 1816232 - RNA, 18 nt, Human
uuguccccaccgcagaca

SEQ ID NO: 1816233 - RNA, 20 nt, Human
uuguccccaccgcagacagg

SEQ ID NO: 1816234 - RNA, 15 nt, Human
uuguccccgacccuu

SEQ ID NO: 1816235 - RNA, 16 nt, Human
uuguccccgacccuug

SEQ ID NO: 1816236 - RNA, 20 nt, Human
uugugauacaaugcugugcc

SEQ ID NO: 1816237 - RNA, 17 nt, Human
uugugaggaagccgcug

SEQ ID NO: 1816238 - RNA, 18 nt, Human
uugugaggaagccgcugg

SEQ ID NO: 1816239 - RNA, 13 nt, Human
uugugaggaagcc

SEQ ID NO: 1816240 - RNA, 16 nt, Human
uuucccuauuagagaa

SEQ ID NO: 1816241 - RNA, 12 nt, Human
uuucagaaaugu

SEQ ID NO: 1816242 - RNA, 11 nt, Human
uuucagaaaug

SEQ ID NO: 1816243 - RNA, 15 nt, Human
uuucaaacuuuacua

SEQ ID NO: 1816244 - RNA, 12 nt, Human
uuucaaacuuua

SEQ ID NO: 1816245 - RNA, 21 nt, Human
uuucagaaagaaguggggaca

SEQ ID NO: 1816246 - RNA, 14 nt, Human
auggaaggggcuga

SEQ ID NO: 1816247 - RNA, 17 nt, Human
auggaagacagcucuua

SEQ ID NO: 1816248 - RNA, 18 nt, Human
auggaagacagcucuuau

SEQ ID NO: 1816249 - RNA, 16 nt, Human
augcuucucacugcca

SEQ ID NO: 1816250 - RNA, 20 nt, Human
augcuucucacugccaugcc

SEQ ID NO: 1816251 - RNA, 20 nt, Human
augcuggcuguuggcugggg

SEQ ID NO: 1816252 - RNA, 19 nt, Human
augcuggcuguuggcuggg

SEQ ID NO: 1816253 - RNA, 18 nt, Human
augcuggcuguuggcugg

SEQ ID NO: 1816254 - RNA, 14 nt, Human
augcuccuggccca

SEQ ID NO: 1816255 - RNA, 19 nt, Human
augcuccuggcccacugca

SEQ ID NO: 1816256 - RNA, 14 nt, Human
uuuaucagaauucu

SEQ ID NO: 1816257 - RNA, 18 nt, Human
augcuacaggauuugaaa

SEQ ID NO: 1816258 - RNA, 12 nt, Human
augcgugugugu

SEQ ID NO: 1816259 - RNA, 22 nt, Human
augcgugcauaccacuuuuguu

SEQ ID NO: 1816260 - RNA, 14 nt, Human
augcgcaggcuggc

SEQ ID NO: 1816261 - RNA, 18 nt, Human
augcgcaggcuggcccug

SEQ ID NO: 1816262 - RNA, 20 nt, Human
augcgcaggcuggcccugcc

SEQ ID NO: 1816263 - RNA, 22 nt, Human
augcgcaggcuggcccugcccu

SEQ ID NO: 1816264 - RNA, 13 nt, Human
augcgcaggcugg

SEQ ID NO: 1816265 - RNA, 17 nt, Human
augccucucucaggcca

SEQ ID NO: 1816266 - RNA, 13 nt, Human
augccucucucag

SEQ ID NO: 1816267 - RNA, 14 nt, Human
augccucucucagg

SEQ ID NO: 1816268 - RNA, 15 nt, Human
augccucucucaggc

SEQ ID NO: 1816269 - RNA, 21 nt, Human
augccaugaggaacaaggcaa

SEQ ID NO: 1816270 - RNA, 16 nt, Human
augcccagccccuucu

SEQ ID NO: 1816271 - RNA, 21 nt, Human
augccccgucccccucuggcu

SEQ ID NO: 1816272 - RNA, 18 nt, Human
augccccgucccccucug

SEQ ID NO: 1816273 - RNA, 17 nt, Human
augcccagccccuucug

SEQ ID NO: 1816274 - RNA, 21 nt, Human
uuuaaugaaagacuguacaaa

SEQ ID NO: 1816275 - RNA, 23 nt, Human
uuuaaugaaagacuguacaaagu

SEQ ID NO: 1816276 - RNA, 13 nt, Human
uuuacuucuuaua

SEQ ID NO: 1816277 - RNA, 14 nt, Human
uuuacuucuuauac

SEQ ID NO: 1816278 - RNA, 15 nt, Human
uuuacuucuuauaca

SEQ ID NO: 1816279 - RNA, 11 nt, Human
uuuacuuaaac

SEQ ID NO: 1816280 - RNA, 16 nt, Human
uuuacugcagcuuugu

SEQ ID NO: 1816281 - RNA, 16 nt, Human
augcgugugugugugu

SEQ ID NO: 1816282 - RNA, 20 nt, Human
uuuacccuucuuuucugacu

SEQ ID NO: 1816283 - RNA, 22 nt, Human
uuuaccugaagucuuuguacag

SEQ ID NO: 1816284 - RNA, 18 nt, Human
uuuaccugaagucuuugu

SEQ ID NO: 1816285 - RNA, 16 nt, Human
aucuuauaauuuaaaa

SEQ ID NO: 1816286 - RNA, 14 nt, Human
aucuugcucugcug

SEQ ID NO: 1816287 - RNA, 15 nt, Human
aucuuauaauuuaaa

SEQ ID NO: 1816288 - RNA, 16 nt, Human
aucuugcucugcugac

SEQ ID NO: 1816289 - RNA, 15 nt, Human
aucuugcucugcuga

SEQ ID NO: 1816290 - RNA, 22 nt, Human
aucugucauuugagcagggcuc

SEQ ID NO: 1816291 - RNA, 17 nt, Human
aucugucauuugagcag

SEQ ID NO: 1816292 - RNA, 12 nt, Human
aucugucauuug

SEQ ID NO: 1816293 - RNA, 12 nt, Human
uuggaaaauaaa

SEQ ID NO: 1816294 - RNA, 15 nt, Human
uuggaaaauaaauca

SEQ ID NO: 1816295 - RNA, 17 nt, Human
uuggaaaauaaauuauu

SEQ ID NO: 1816296 - RNA, 16 nt, Human
uugcuuuguaugcacu

SEQ ID NO: 1816297 - RNA, 20 nt, Human
uugcuuugugauuuuuguaa

SEQ ID NO: 1816298 - RNA, 14 nt, Human
uugcucuugaugcc

SEQ ID NO: 1816299 - RNA, 17 nt, Human
uugcucuugaugccugg

SEQ ID NO: 1816300 - RNA, 18 nt, Human
uugcucuugaugccuggc

SEQ ID NO: 1816301 - RNA, 17 nt, Human
uugcuuuggaaguuuua

SEQ ID NO: 1816302 - RNA, 13 nt, Human
uugcuuuguaugc

SEQ ID NO: 1816303 - RNA, 15 nt, Human
uugcuuugugauuuu

SEQ ID NO: 1816304 - RNA, 22 nt, Human
augaaccacaucuugcucugcu

SEQ ID NO: 1816305 - RNA, 23 nt, Human
augaaccacaucuugcucugcug

SEQ ID NO: 1816306 - RNA, 16 nt, Human
augaaagugagacuuu

SEQ ID NO: 1816307 - RNA, 14 nt, Human
augaagcaaugcuu

SEQ ID NO: 1816308 - RNA, 15 nt, Human
augaagcaaugcuuc

SEQ ID NO: 1816309 - RNA, 17 nt, Human
augaaugaaacauuuug

SEQ ID NO: 1816310 - RNA, 16 nt, Human
augaaugucaguguga

SEQ ID NO: 1816311 - RNA, 18 nt, Human
augaaugucagugugacu

SEQ ID NO: 1816312 - RNA, 19 nt, Human
uuggugguuucagaaaugu

SEQ ID NO: 1816313 - RNA, 18 nt, Human
uuggugguuucagaaaug

SEQ ID NO: 1816314 - RNA, 14 nt, Human
uugguuuguaaauu

SEQ ID NO: 1816315 - RNA, 17 nt, Human
uuggugucgggcaugac

SEQ ID NO: 1816316 - RNA, 18 nt, Human
uuggugucgggcaugaca

SEQ ID NO: 1816317 - RNA, 19 nt, Human
uuggugucgggcaugacac

SEQ ID NO: 1816318 - RNA, 14 nt, Human
uuguaaauuucucu

SEQ ID NO: 1816319 - RNA, 13 nt, Human
uuguaaauuguca

SEQ ID NO: 1816320 - RNA, 15 nt, Human
uuguaauaauaaaga

SEQ ID NO: 1816321 - RNA, 15 nt, Human
uuguaauauguaaau

SEQ ID NO: 1816322 - RNA, 14 nt, Human
uuguaauauguaaa

SEQ ID NO: 1816323 - RNA, 22 nt, Human
uuguaagcaugcacaaauucug

SEQ ID NO: 1816324 - RNA, 12 nt, Human
uuguaaugaaaa

SEQ ID NO: 1816325 - RNA, 12 nt, Human
aucugaaaaugu

SEQ ID NO: 1816326 - RNA, 22 nt, Human
aucucuuuguucuaaagaugga

SEQ ID NO: 1816327 - RNA, 16 nt, Human
aucucuuguuuaaauu

SEQ ID NO: 1816328 - RNA, 17 nt, Human
aucucaaauuucuaaau

SEQ ID NO: 1816329 - RNA, 16 nt, Human
aucucaaauuucuaaa

SEQ ID NO: 1816330 - RNA, 23 nt, Human
aucucacacaugagcaucaggcc

SEQ ID NO: 1816331 - RNA, 21 nt, Human
uugauuaaauucuugcaaagu

SEQ ID NO: 1816332 - RNA, 20 nt, Human
uugauuaaauucuugcaaag

SEQ ID NO: 1816333 - RNA, 16 nt, Human
uugauuaaauucuugc

SEQ ID NO: 1816334 - RNA, 15 nt, Human
uugauuaaauucuug

SEQ ID NO: 1816335 - RNA, 16 nt, Human
uugcaacuuuguauaa

SEQ ID NO: 1816336 - RNA, 17 nt, Human
uugcaacuuuguauaaa

SEQ ID NO: 1816337 - RNA, 18 nt, Human
uugcaacuuuguauaaaa

SEQ ID NO: 1816338 - RNA, 23 nt, Human
uugauguucuuucacccuuuucu

SEQ ID NO: 1816339 - RNA, 23 nt, Human
uugcccaggcuggcgugcagugg

SEQ ID NO: 1816340 - RNA, 14 nt, Human
uugcccaggcuggc

SEQ ID NO: 1816341 - RNA, 12 nt, Human
uugcccaggcug

SEQ ID NO: 1816342 - RNA, 11 nt, Human
uugcccaggcu

SEQ ID NO: 1816343 - RNA, 18 nt, Human
uugcccaggcaggucuug

SEQ ID NO: 1816344 - RNA, 16 nt, Human
uugcccaggcaggucu

SEQ ID NO: 1816345 - RNA, 14 nt, Human
uugcccaggcaggu

SEQ ID NO: 1816346 - RNA, 13 nt, Human
uugcccaggcagg

SEQ ID NO: 1816347 - RNA, 14 nt, Human
uugcaauggcagcc

SEQ ID NO: 1816348 - RNA, 22 nt, Human
uugcaauagaaauccaauugga

SEQ ID NO: 1816349 - RNA, 15 nt, Human
uugcaauagaaaucc

SEQ ID NO: 1816350 - RNA, 21 nt, Human
uugcaccacugcacuccagcc

SEQ ID NO: 1816351 - RNA, 14 nt, Human
uugcaugaggcuag

SEQ ID NO: 1816352 - RNA, 19 nt, Human
uugacagggcacaccgggc

SEQ ID NO: 1816353 - RNA, 16 nt, Human
uugacaucaacugcau

SEQ ID NO: 1816354 - RNA, 12 nt, Human
uugacagggcac

SEQ ID NO: 1816355 - RNA, 10 nt, Human
uugacagggc

SEQ ID NO: 1816356 - RNA, 19 nt, Human
uugacaggauuauuggaaa

SEQ ID NO: 1816357 - RNA, 11 nt, Human
uugagacagag

SEQ ID NO: 1816358 - RNA, 10 nt, Human
uugagacaga

SEQ ID NO: 1816359 - RNA, 12 nt, Human
uugagcagggcu

SEQ ID NO: 1816360 - RNA, 16 nt, Human
uugagcagggcucagc

SEQ ID NO: 1816361 - RNA, 17 nt, Human
uugaccauucuccaccu

SEQ ID NO: 1816362 - RNA, 11 nt, Human
uugagugccuu

SEQ ID NO: 1816363 - RNA, 21 nt, Human
uugagugcugucuccauguuu

SEQ ID NO: 1816364 - RNA, 18 nt, Human
uugauagcacagacccug

SEQ ID NO: 1816365 - RNA, 17 nt, Human
uugauacuacaguuugu

SEQ ID NO: 1816366 - RNA, 23 nt, Human
aucuaauauguaacaagccaccc

SEQ ID NO: 1816367 - RNA, 18 nt, Human
aucuagauacuguaucau

SEQ ID NO: 1816368 - RNA, 19 nt, Human
aucuagauacuguaucaug

SEQ ID NO: 1816369 - RNA, 17 nt, Human
aucuaggaagacuuugg

SEQ ID NO: 1816370 - RNA, 18 nt, Human
aucuaggaagacuuugga

SEQ ID NO: 1816371 - RNA, 19 nt, Human
aucuaggaagacuuuggaa

SEQ ID NO: 1816372 - RNA, 14 nt, Human
aucucaaauuucua

SEQ ID NO: 1816373 - RNA, 23 nt, Human
aucucaaauaacuaaaagguaug

SEQ ID NO: 1816374 - RNA, 14 nt, Human
aucucaaauaacua

SEQ ID NO: 1816375 - RNA, 21 nt, Human
aucucaaauaacuaaaaggua

SEQ ID NO: 1816376 - RNA, 18 nt, Human
auauauucagccuggcuu

SEQ ID NO: 1816377 - RNA, 18 nt, Human
uucaucauccuaagcuau

SEQ ID NO: 1816378 - RNA, 21 nt, Human
uucaucauccuaagcuauuca

SEQ ID NO: 1816379 - RNA, 17 nt, Human
uucauauuuuaaacaga

SEQ ID NO: 1816380 - RNA, 21 nt, Human
uucauauuuuaaacagaggau

SEQ ID NO: 1816381 - RNA, 14 nt, Human
uucaguaauaacuc

SEQ ID NO: 1816382 - RNA, 16 nt, Human
uucauauuuacuucuu

SEQ ID NO: 1816383 - RNA, 21 nt, Human
uucauauuuacuucuuauaca

SEQ ID NO: 1816384 - RNA, 22 nt, Human
auaucugaaaauguauguguaa

SEQ ID NO: 1816385 - RNA, 20 nt, Human
auaugauuuaaaucagccgu

SEQ ID NO: 1816386 - RNA, 14 nt, Human
auaugucaagccau

SEQ ID NO: 1816387 - RNA, 13 nt, Human
auaugcacacauu

SEQ ID NO: 1816388 - RNA, 17 nt, Human
uucagaucucuaacuuc

SEQ ID NO: 1816389 - RNA, 23 nt, Human
uucagcaccuacaguguacaguc

SEQ ID NO: 1816390 - RNA, 22 nt, Human
uucagcaccuacaguguacagu

SEQ ID NO: 1816391 - RNA, 19 nt, Human
uucagccaagaauucuuaa

SEQ ID NO: 1816392 - RNA, 15 nt, Human
uucagaaagaagugg

SEQ ID NO: 1816393 - RNA, 13 nt, Human
uucacugcuggcu

SEQ ID NO: 1816394 - RNA, 15 nt, Human
uucacugcuggcugc

SEQ ID NO: 1816395 - RNA, 16 nt, Human
uucacugcuggcugcc

SEQ ID NO: 1816396 - RNA, 17 nt, Human
uucacugcuggcugccu

SEQ ID NO: 1816397 - RNA, 18 nt, Human
uucacugcuggcugccuu

SEQ ID NO: 1816398 - RNA, 19 nt, Human
uucacugcuggcugccuua

SEQ ID NO: 1816399 - RNA, 22 nt, Human
auauaaauuuuuuuuguuucau

SEQ ID NO: 1816400 - RNA, 17 nt, Human
auauaaauuuuuuuugu

SEQ ID NO: 1816401 - RNA, 16 nt, Human
uucaaaauuguuacaa

SEQ ID NO: 1816402 - RNA, 15 nt, Human
uucaaggauccugag

SEQ ID NO: 1816403 - RNA, 16 nt, Human
uucaaggauccugagc

SEQ ID NO: 1816404 - RNA, 18 nt, Human
uucaaggauccugagcca

SEQ ID NO: 1816405 - RNA, 19 nt, Human
uucaaggauccugagccag

SEQ ID NO: 1816406 - RNA, 21 nt, Human
uucaaggauccugagccagau

SEQ ID NO: 1816407 - RNA, 20 nt, Human
uucaagugauucuccugccu

SEQ ID NO: 1816408 - RNA, 20 nt, Human
uucaagugauucucaugccu

SEQ ID NO: 1816409 - RNA, 22 nt, Human
uucaagugauucucaugccuca

SEQ ID NO: 1816410 - RNA, 22 nt, Human
uucaccauguuggccaggcugc

SEQ ID NO: 1816411 - RNA, 22 nt, Human
uucaccauguuggccaggcugg

SEQ ID NO: 1816412 - RNA, 22 nt, Human
auagcuuacaagccagcuggag

SEQ ID NO: 1816413 - RNA, 19 nt, Human
auaggaacuuaaauaaugu

SEQ ID NO: 1816414 - RNA, 21 nt, Human
auaggaauugacccacaagaa

SEQ ID NO: 1816415 - RNA, 22 nt, Human
auaggcaccuaccaccacgccc

SEQ ID NO: 1816416 - RNA, 17 nt, Human
auaggcacaggaaacca

SEQ ID NO: 1816417 - RNA, 22 nt, Human
auaggaauugacccacaagaaa

SEQ ID NO: 1816418 - RNA, 22 nt, Human
uucaccacaugugcacaugcac

SEQ ID NO: 1816419 - RNA, 19 nt, Human
uucacauuguauucagagu

SEQ ID NO: 1816420 - RNA, 17 nt, Human
uucacauauugauuucc

SEQ ID NO: 1816421 - RNA, 13 nt, Human
uucacaguucucu

SEQ ID NO: 1816422 - RNA, 14 nt, Human
auagcuacuaauuu

SEQ ID NO: 1816423 - RNA, 17 nt, Human
auagcuacuaauuuuaa

SEQ ID NO: 1816424 - RNA, 18 nt, Human
auagcgucauaacuagaa

SEQ ID NO: 1816425 - RNA, 20 nt, Human
auagcgucauaacuagaacu

SEQ ID NO: 1816426 - RNA, 18 nt, Human
auagccugccucuucucu

SEQ ID NO: 1816427 - RNA, 13 nt, Human
auaagauaaaugu

SEQ ID NO: 1816428 - RNA, 17 nt, Human
auaagauaaaugugcug

SEQ ID NO: 1816429 - RNA, 12 nt, Human
auagcugggacu

SEQ ID NO: 1816430 - RNA, 21 nt, Human
auagcucaggugucccugcac

SEQ ID NO: 1816431 - RNA, 20 nt, Human
auagcucaggugucccugca

SEQ ID NO: 1816432 - RNA, 22 nt, Human
auagcucaggugucccugcacu

SEQ ID NO: 1816433 - RNA, 18 nt, Human
auagcuacuaauuuuaaa

SEQ ID NO: 1816434 - RNA, 19 nt, Human
auagcucaggugucccugc

SEQ ID NO: 1816435 - RNA, 17 nt, Human
uuauuuagcaccaggga

SEQ ID NO: 1816436 - RNA, 16 nt, Human
uuauuuaguuccuuga

SEQ ID NO: 1816437 - RNA, 15 nt, Human
uuauuuaguauuuau

SEQ ID NO: 1816438 - RNA, 17 nt, Human
auagcugggacuacagg

SEQ ID NO: 1816439 - RNA, 22 nt, Human
auagcuggucuuauuuguaaag

SEQ ID NO: 1816440 - RNA, 23 nt, Human
auagcuggucuuauuuguaaagc

SEQ ID NO: 1816441 - RNA, 18 nt, Human
uuauuuaaugaaagacug

SEQ ID NO: 1816442 - RNA, 22 nt, Human
uuauuuaaugaaagacuguaca

SEQ ID NO: 1816443 - RNA, 14 nt, Human
uuauuuaaauuuua

SEQ ID NO: 1816444 - RNA, 16 nt, Human
aucccauaugccuggg

SEQ ID NO: 1816445 - RNA, 17 nt, Human
aucccauaugccugggc

SEQ ID NO: 1816446 - RNA, 16 nt, Human
auccagguucagcuug

SEQ ID NO: 1816447 - RNA, 15 nt, Human
auccagguucagcuu

SEQ ID NO: 1816448 - RNA, 17 nt, Human
auccaggguggugguga

SEQ ID NO: 1816449 - RNA, 17 nt, Human
aucccaggauguacaag

SEQ ID NO: 1816450 - RNA, 20 nt, Human
aucauugaaaucuuuuugcu

SEQ ID NO: 1816451 - RNA, 19 nt, Human
aucauugaaaucuuuuugc

SEQ ID NO: 1816452 - RNA, 15 nt, Human
uucugaaagggacgc

SEQ ID NO: 1816453 - RNA, 22 nt, Human
uucugggacacaguucaauucu

SEQ ID NO: 1816454 - RNA, 11 nt, Human
uucugggacac

SEQ ID NO: 1816455 - RNA, 10 nt, Human
uucugggaca

SEQ ID NO: 1816456 - RNA, 23 nt, Human
uucugccgcagcccugcagaggg

SEQ ID NO: 1816457 - RNA, 23 nt, Human
aucauaguggcuuaaaacaacac

SEQ ID NO: 1816458 - RNA, 14 nt, Human
aucauugaaaucuu

SEQ ID NO: 1816459 - RNA, 15 nt, Human
aucauugaaaucuuu

SEQ ID NO: 1816460 - RNA, 22 nt, Human
aucauuaaagccugaguuugcu

SEQ ID NO: 1816461 - RNA, 14 nt, Human
aucauucauuuucu

SEQ ID NO: 1816462 - RNA, 16 nt, Human
aucagcacgauuucug

SEQ ID NO: 1816463 - RNA, 15 nt, Human
aucagcacgauuucu

SEQ ID NO: 1816464 - RNA, 18 nt, Human
aucagcacgauuucuguu

SEQ ID NO: 1816465 - RNA, 17 nt, Human
aucagcacgauuucugu

SEQ ID NO: 1816466 - RNA, 13 nt, Human
uucuaggccuggg

SEQ ID NO: 1816467 - RNA, 23 nt, Human
uucucagaaucucaaauaacuaa

SEQ ID NO: 1816468 - RNA, 19 nt, Human
uucucagaaucucaaauaa

SEQ ID NO: 1816469 - RNA, 22 nt, Human
uucucagaaucucaaauaacua

SEQ ID NO: 1816470 - RNA, 17 nt, Human
auauugccauuaugcuu

SEQ ID NO: 1816471 - RNA, 17 nt, Human
auauugcugauggugca

SEQ ID NO: 1816472 - RNA, 21 nt, Human
auauugcugauggugcaauga

SEQ ID NO: 1816473 - RNA, 20 nt, Human
auauuguuuucaguguacau

SEQ ID NO: 1816474 - RNA, 14 nt, Human
auauuuuaaacaga

SEQ ID NO: 1816475 - RNA, 20 nt, Human
auauuuguauuuaaaugaaa

SEQ ID NO: 1816476 - RNA, 24 nt, Human
auauuaagaaagacuaucuaaaug

SEQ ID NO: 1816477 - RNA, 22 nt, Human
auauuaaggaagacaaugugaa

SEQ ID NO: 1816478 - RNA, 18 nt, Human
auauguuuuaagaggcag

SEQ ID NO: 1816479 - RNA, 20 nt, Human
auauguuuuaagaggcaggg

SEQ ID NO: 1816480 - RNA, 15 nt, Human
auauugauccagaaa

SEQ ID NO: 1816481 - RNA, 22 nt, Human
auauugauccagaaagaaaacu

SEQ ID NO: 1816482 - RNA, 22 nt, Human
auauugauuuccguuaaaauac

SEQ ID NO: 1816483 - RNA, 21 nt, Human
auauugauuuccguuaaaaua

SEQ ID NO: 1816484 - RNA, 13 nt, Human
auauugaugugug

SEQ ID NO: 1816485 - RNA, 19 nt, Human
auauugauuuccguuaaaa

SEQ ID NO: 1816486 - RNA, 16 nt, Human
auauucuguuggccag

SEQ ID NO: 1816487 - RNA, 18 nt, Human
aucaaguauuauaccuuu

SEQ ID NO: 1816488 - RNA, 14 nt, Human
aucaaguauuauac

SEQ ID NO: 1816489 - RNA, 13 nt, Human
aucaaguauuaua

SEQ ID NO: 1816490 - RNA, 21 nt, Human
aucaagaugugacauguuuua

SEQ ID NO: 1816491 - RNA, 22 nt, Human
aucacggcucacugcagccuca

SEQ ID NO: 1816492 - RNA, 21 nt, Human
aucacguaaagcuagaaauga

SEQ ID NO: 1816493 - RNA, 14 nt, Human
aucacguaaagcua

SEQ ID NO: 1816494 - RNA, 21 nt, Human
uuccuuuuaaaacacuuccau

SEQ ID NO: 1816495 - RNA, 22 nt, Human
uuccuuuuaaaacacuuccaua

SEQ ID NO: 1816496 - RNA, 20 nt, Human
uuccuuuuaaaacacuucca

SEQ ID NO: 1816497 - RNA, 14 nt, Human
auauuuuaagacga

SEQ ID NO: 1816498 - RNA, 13 nt, Human
uuccuaauccucu

SEQ ID NO: 1816499 - RNA, 15 nt, Human
uuccuaauccucuag

SEQ ID NO: 1816500 - RNA, 17 nt, Human
uuccuaauccucuagga

SEQ ID NO: 1816501 - RNA, 17 nt, Human
uuccuguucccaugaga

SEQ ID NO: 1816502 - RNA, 11 nt, Human
uuccucuuucc

SEQ ID NO: 1816503 - RNA, 19 nt, Human
auauuuucaacgcagcccu

SEQ ID NO: 1816504 - RNA, 20 nt, Human
auauuuucaacgcagcccug

SEQ ID NO: 1816505 - RNA, 15 nt, Human
uuccuucagugccuu

SEQ ID NO: 1816506 - RNA, 20 nt, Human
uuccuguucuuaagacguga

SEQ ID NO: 1816507 - RNA, 11 nt, Human
uuccuucagug

SEQ ID NO: 1816508 - RNA, 14 nt, Human
uuccuucagugccu

SEQ ID NO: 1816509 - RNA, 15 nt, Human
agugaaagaaaauaa

SEQ ID NO: 1816510 - RNA, 20 nt, Human
agugaacaaauuuacagaga

SEQ ID NO: 1816511 - RNA, 16 nt, Human
agugaacaaauuuaca

SEQ ID NO: 1816512 - RNA, 18 nt, Human
ugugaugagaggaaauca

SEQ ID NO: 1816513 - RNA, 19 nt, Human
ugugauggggcccugccuc

SEQ ID NO: 1816514 - RNA, 20 nt, Human
ugugauggggcccugccucc

SEQ ID NO: 1816515 - RNA, 18 nt, Human
ugugccagauuuaugcau

SEQ ID NO: 1816516 - RNA, 16 nt, Human
ugugccaugugccagg

SEQ ID NO: 1816517 - RNA, 12 nt, Human
ugugccaugugc

SEQ ID NO: 1816518 - RNA, 20 nt, Human
ugugccagguuuuuggucug

SEQ ID NO: 1816519 - RNA, 20 nt, Human
ugugccagauuuaugcauau

SEQ ID NO: 1816520 - RNA, 17 nt, Human
uguggaguucaucuuga

SEQ ID NO: 1816521 - RNA, 21 nt, Human
uguggaguucaucuugaauug

SEQ ID NO: 1816522 - RNA, 21 nt, Human
ugugcccccauguaagcaccc

SEQ ID NO: 1816523 - RNA, 15 nt, Human
agugagucgaggaca

SEQ ID NO: 1816524 - RNA, 21 nt, Human
agugaguugauagcacagacc

SEQ ID NO: 1816525 - RNA, 14 nt, Human
agugagggauuauc

SEQ ID NO: 1816526 - RNA, 21 nt, Human
agugaggcucugcccuugguu

SEQ ID NO: 1816527 - RNA, 19 nt, Human
agugaggcucugcccuugg

SEQ ID NO: 1816528 - RNA, 20 nt, Human
agugaggcucugcccuuggu

SEQ ID NO: 1816529 - RNA, 18 nt, Human
uguggccaaguucuuagu

SEQ ID NO: 1816530 - RNA, 15 nt, Human
agugaggcucugccc

SEQ ID NO: 1816531 - RNA, 14 nt, Human
agugaggcucugcc

SEQ ID NO: 1816532 - RNA, 16 nt, Human
agugaggcucugcccu

SEQ ID NO: 1816533 - RNA, 17 nt, Human
agugaggcucugcccuu

SEQ ID NO: 1816534 - RNA, 21 nt, Human
ugugaaccaccacacccagcc

SEQ ID NO: 1816535 - RNA, 20 nt, Human
ugugaaccaccacacccagc

SEQ ID NO: 1816536 - RNA, 19 nt, Human
ugugaaccaccacacccag

SEQ ID NO: 1816537 - RNA, 14 nt, Human
ugugaagagaacca

SEQ ID NO: 1816538 - RNA, 15 nt, Human
ugucuuguguuucuu

SEQ ID NO: 1816539 - RNA, 18 nt, Human
ugucuuguguuucuuuag

SEQ ID NO: 1816540 - RNA, 12 nt, Human
ugugaaauuauu

SEQ ID NO: 1816541 - RNA, 15 nt, Human
ugugaaaggaaagag

SEQ ID NO: 1816542 - RNA, 18 nt, Human
ugugaaaggaaagaggcu

SEQ ID NO: 1816543 - RNA, 21 nt, Human
ugugaaaggaaagagggaggu

SEQ ID NO: 1816544 - RNA, 15 nt, Human
agucucuucuccacu

SEQ ID NO: 1816545 - RNA, 16 nt, Human
agucucuucuccacug

SEQ ID NO: 1816546 - RNA, 18 nt, Human
agucucuucuccacugga

SEQ ID NO: 1816547 - RNA, 17 nt, Human
agucucuucuccacugg

SEQ ID NO: 1816548 - RNA, 18 nt, Human
agucuuguauuaaguugu

SEQ ID NO: 1816549 - RNA, 16 nt, Human
agucuuguauuaaguu

SEQ ID NO: 1816550 - RNA, 15 nt, Human
agucuuggcucacug

SEQ ID NO: 1816551 - RNA, 22 nt, Human
agucuuguauuaaguuguuaau

SEQ ID NO: 1816552 - RNA, 14 nt, Human
agucuuuguacaga

SEQ ID NO: 1816553 - RNA, 13 nt, Human
agucucuucucca

SEQ ID NO: 1816554 - RNA, 14 nt, Human
agucucuucuccac

SEQ ID NO: 1816555 - RNA, 15 nt, Human
ugugacugaauuucu

SEQ ID NO: 1816556 - RNA, 16 nt, Human
ugugacugaauuucuu

SEQ ID NO: 1816557 - RNA, 19 nt, Human
ugugagaugcuagaacucc

SEQ ID NO: 1816558 - RNA, 15 nt, Human
ugugagaugcuagaa

SEQ ID NO: 1816559 - RNA, 16 nt, Human
uguggucccaccccac

SEQ ID NO: 1816560 - RNA, 13 nt, Human
uguggucccaccc

SEQ ID NO: 1816561 - RNA, 15 nt, Human
uguggucccacccca

SEQ ID NO: 1816562 - RNA, 20 nt, Human
ugugguguuuccuggcacug

SEQ ID NO: 1816563 - RNA, 14 nt, Human
ugugguguuuccug

SEQ ID NO: 1816564 - RNA, 16 nt, Human
ugugguguuuccuggc

SEQ ID NO: 1816565 - RNA, 21 nt, Human
uguggguuucuaaagcugcca

SEQ ID NO: 1816566 - RNA, 23 nt, Human
uguggguuucuaaagcugccagc

SEQ ID NO: 1816567 - RNA, 20 nt, Human
uguggucacaggaaguagag

SEQ ID NO: 1816568 - RNA, 13 nt, Human
agugcugcauuua

SEQ ID NO: 1816569 - RNA, 12 nt, Human
agugcugcauuu

SEQ ID NO: 1816570 - RNA, 22 nt, Human
agugaguugauagcacagaccc

SEQ ID NO: 1816571 - RNA, 23 nt, Human
agugaguugauagcacagacccu

SEQ ID NO: 1816572 - RNA, 21 nt, Human
agugcugggauuacaggugug

SEQ ID NO: 1816573 - RNA, 20 nt, Human
agugcugggauuacaggugu

SEQ ID NO: 1816574 - RNA, 19 nt, Human
agugcugcauuuaaaagau

SEQ ID NO: 1816575 - RNA, 17 nt, Human
agugcugcauuuaaaag

SEQ ID NO: 1816576 - RNA, 16 nt, Human
agugcugcauuuaaaa

SEQ ID NO: 1816577 - RNA, 11 nt, Human
ugugugugugc

SEQ ID NO: 1816578 - RNA, 19 nt, Human
uguguguuuauugucaaag

SEQ ID NO: 1816579 - RNA, 23 nt, Human
uguguguuuauugucaaaguggu

SEQ ID NO: 1816580 - RNA, 21 nt, Human
ugugucuugcaauggcagccu

SEQ ID NO: 1816581 - RNA, 21 nt, Human
ugugucucuugguccugcugc

SEQ ID NO: 1816582 - RNA, 22 nt, Human
ugugucucuugguccugcugca

SEQ ID NO: 1816583 - RNA, 17 nt, Human
ugugucucuugguccug

SEQ ID NO: 1816584 - RNA, 20 nt, Human
ugugucucuugguccugcug

SEQ ID NO: 1816585 - RNA, 17 nt, Human
uguguaagaaauacaga

SEQ ID NO: 1816586 - RNA, 20 nt, Human
uguuccacaaguuaaauaaa

SEQ ID NO: 1816587 - RNA, 20 nt, Human
agugugucuuagugugugca

SEQ ID NO: 1816588 - RNA, 16 nt, Human
uguucugggacacagu

SEQ ID NO: 1816589 - RNA, 18 nt, Human
uguugcccaggcaggucu

SEQ ID NO: 1816590 - RNA, 17 nt, Human
uguugcccaggcagguc

SEQ ID NO: 1816591 - RNA, 16 nt, Human
uguugcccaggcaggu

SEQ ID NO: 1816592 - RNA, 15 nt, Human
uguugcccaggcagg

SEQ ID NO: 1816593 - RNA, 12 nt, Human
uguugcccaggc

SEQ ID NO: 1816594 - RNA, 13 nt, Human
uguugcccaggca

SEQ ID NO: 1816595 - RNA, 15 nt, Human
uguucugugauauaa

SEQ ID NO: 1816596 - RNA, 18 nt, Human
uguucugugauauaagug

SEQ ID NO: 1816597 - RNA, 16 nt, Human
agugugguguuuccug

SEQ ID NO: 1816598 - RNA, 20 nt, Human
agugugccugaagucccaga

SEQ ID NO: 1816599 - RNA, 17 nt, Human
agugugguguuuccugg

SEQ ID NO: 1816600 - RNA, 19 nt, Human
agugugguguuuccuggca

SEQ ID NO: 1816601 - RNA, 20 nt, Human
agugugguguuuccuggcac

SEQ ID NO: 1816602 - RNA, 21 nt, Human
agugguggugaacagaacaaa

SEQ ID NO: 1816603 - RNA, 18 nt, Human
aguggugguuuucuguuc

SEQ ID NO: 1816604 - RNA, 17 nt, Human
aguggugguuuucuguu

SEQ ID NO: 1816605 - RNA, 23 nt, Human
aguggugguuuucuguucuuucu

SEQ ID NO: 1816606 - RNA, 21 nt, Human
aguggugguuuucuguucuuu

SEQ ID NO: 1816607 - RNA, 20 nt, Human
aguggugguuuucuguucuu

SEQ ID NO: 1816608 - RNA, 19 nt, Human
aguggugguuuucuguucu

SEQ ID NO: 1816609 - RNA, 17 nt, Human
aguggugcgaucugggu

SEQ ID NO: 1816610 - RNA, 17 nt, Human
aguggaaguaguggagc

SEQ ID NO: 1816611 - RNA, 14 nt, Human
uguuacaaauugua

SEQ ID NO: 1816612 - RNA, 15 nt, Human
uuaaauuucuaccgc

SEQ ID NO: 1816613 - RNA, 20 nt, Human
uuaaauucuugcaaaguauc

SEQ ID NO: 1816614 - RNA, 13 nt, Human
uuaaauaauguga

SEQ ID NO: 1816615 - RNA, 21 nt, Human
aguuggguggaugccuggugg

SEQ ID NO: 1816616 - RNA, 13 nt, Human
aguuggcuucuaa

SEQ ID NO: 1816617 - RNA, 16 nt, Human
aguuggcuaggacccc

SEQ ID NO: 1816618 - RNA, 21 nt, Human
aguucuuaguugcuguauguc

SEQ ID NO: 1816619 - RNA, 20 nt, Human
aguucuuaguugcuguaugu

SEQ ID NO: 1816620 - RNA, 18 nt, Human
aguuggucccccuuccau

SEQ ID NO: 1816621 - RNA, 21 nt, Human
aguuguuugauucagacagcu

SEQ ID NO: 1816622 - RNA, 23 nt, Human
aguuguuugauucagacagcugc

SEQ ID NO: 1816623 - RNA, 21 nt, Human
uguuucuuucucugaggacaa

SEQ ID NO: 1816624 - RNA, 20 nt, Human
uguuucuuucucugaggaca

SEQ ID NO: 1816625 - RNA, 18 nt, Human
uguuucuuuguaaugaaa

SEQ ID NO: 1816626 - RNA, 19 nt, Human
uguuucuuuguaaugaaaa

SEQ ID NO: 1816627 - RNA, 17 nt, Human
uguuugauucagacagc

SEQ ID NO: 1816628 - RNA, 22 nt, Human
uguuugauucagacagcugccu

SEQ ID NO: 1816629 - RNA, 19 nt, Human
uguuuauugucaaaguggu

SEQ ID NO: 1816630 - RNA, 19 nt, Human
uguugcccaggcaggucuu

SEQ ID NO: 1816631 - RNA, 19 nt, Human
uguugccuugcauaauggu

SEQ ID NO: 1816632 - RNA, 21 nt, Human
uguuuuauuuuaauucaguug

SEQ ID NO: 1816633 - RNA, 13 nt, Human
uguuuggagacag

SEQ ID NO: 1816634 - RNA, 20 nt, Human
uguuuuccaugaguccccug

SEQ ID NO: 1816635 - RNA, 14 nt, Human
aguucugguuccua

SEQ ID NO: 1816636 - RNA, 16 nt, Human
aguucuuaguugcugu

SEQ ID NO: 1816637 - RNA, 16 nt, Human
aguucugcagauaaac

SEQ ID NO: 1816638 - RNA, 21 nt, Human
aguucugcagauaaacaguag

SEQ ID NO: 1816639 - RNA, 14 nt, Human
auaaauaacuuuuu

SEQ ID NO: 1816640 - RNA, 18 nt, Human
auaaacacucuugaaaaa

SEQ ID NO: 1816641 - RNA, 19 nt, Human
auaacuagaacugaauuuu

SEQ ID NO: 1816642 - RNA, 13 nt, Human
uuacagcugccug

SEQ ID NO: 1816643 - RNA, 14 nt, Human
uuacagcugccugc

SEQ ID NO: 1816644 - RNA, 14 nt, Human
uuacaggaaguacu

SEQ ID NO: 1816645 - RNA, 11 nt, Human
uuagacagagu

SEQ ID NO: 1816646 - RNA, 13 nt, Human
uuagaaccuuucu

SEQ ID NO: 1816647 - RNA, 11 nt, Human
uuagaaauaua

SEQ ID NO: 1816648 - RNA, 12 nt, Human
uuagaaauauaa

SEQ ID NO: 1816649 - RNA, 14 nt, Human
uuagaaauauaauu

SEQ ID NO: 1816650 - RNA, 20 nt, Human
uuacauaagauaaaugugcu

SEQ ID NO: 1816651 - RNA, 23 nt, Human
uuacucagaauucucuaguuuga

SEQ ID NO: 1816652 - RNA, 18 nt, Human
uuacucagaauucucuag

SEQ ID NO: 1816653 - RNA, 20 nt, Human
auaaaauuuuuaaucuuuaa

SEQ ID NO: 1816654 - RNA, 22 nt, Human
auaaacaagaccacguuucuaa

SEQ ID NO: 1816655 - RNA, 15 nt, Human
auaaacaagaccacg

SEQ ID NO: 1816656 - RNA, 23 nt, Human
auaaacaagaccacguuucuaaa

SEQ ID NO: 1816657 - RNA, 19 nt, Human
uuaauuuuuuugagacaga

SEQ ID NO: 1816658 - RNA, 16 nt, Human
auaaaauuaaagcuga

SEQ ID NO: 1816659 - RNA, 15 nt, Human
uuaauucuuagcuca

SEQ ID NO: 1816660 - RNA, 20 nt, Human
uuaaguuaguuccacugaga

SEQ ID NO: 1816661 - RNA, 13 nt, Human
uuaauaaacacuc

SEQ ID NO: 1816662 - RNA, 17 nt, Human
uuaauaaacacucuuga

SEQ ID NO: 1816663 - RNA, 14 nt, Human
uuaauaaagacagg

SEQ ID NO: 1816664 - RNA, 13 nt, Human
uuaauaaagacag

SEQ ID NO: 1816665 - RNA, 23 nt, Human
uuaaugaaagacuguacaaagua

SEQ ID NO: 1816666 - RNA, 20 nt, Human
uuaaugaaagacuguacaaa

SEQ ID NO: 1816667 - RNA, 13 nt, Human
uuaagaggcaggg

SEQ ID NO: 1816668 - RNA, 16 nt, Human
uuaagaggcagggucu

SEQ ID NO: 1816669 - RNA, 15 nt, Human
uuaagaggcaggguc

SEQ ID NO: 1816670 - RNA, 18 nt, Human
uuaaguaaggaauuuuau

SEQ ID NO: 1816671 - RNA, 22 nt, Human
uuaagugcugcauuuaaaagau

SEQ ID NO: 1816672 - RNA, 22 nt, Human
uuaaguuacacauuuuucagau

SEQ ID NO: 1816673 - RNA, 17 nt, Human
uuaaguacuauguauca

SEQ ID NO: 1816674 - RNA, 17 nt, Human
uuaagugaaaauauagc

SEQ ID NO: 1816675 - RNA, 21 nt, Human
auaaaaguacauguuaaacuu

SEQ ID NO: 1816676 - RNA, 15 nt, Human
auaaaaguacauguu

SEQ ID NO: 1816677 - RNA, 21 nt, Human
agggucucacucugucgccca

SEQ ID NO: 1816678 - RNA, 16 nt, Human
agggucucacucuguc

SEQ ID NO: 1816679 - RNA, 15 nt, Human
agggucucacucugu

SEQ ID NO: 1816680 - RNA, 14 nt, Human
agggucucacucug

SEQ ID NO: 1816681 - RNA, 15 nt, Human
aggguaaggcugugg

SEQ ID NO: 1816682 - RNA, 20 nt, Human
aggggguggccucccaacuc

SEQ ID NO: 1816683 - RNA, 18 nt, Human
aggggugggacacccugu

SEQ ID NO: 1816684 - RNA, 21 nt, Human
aggggaauguuugccucugcc

SEQ ID NO: 1816685 - RNA, 20 nt, Human
aggggaauguuugccucugc

SEQ ID NO: 1816686 - RNA, 19 nt, Human
aggggaauguuugccucug

SEQ ID NO: 1816687 - RNA, 18 nt, Human
aggggagcaugggaagug

SEQ ID NO: 1816688 - RNA, 16 nt, Human
aggguggugaccucug

SEQ ID NO: 1816689 - RNA, 16 nt, Human
ugggucgcccuggacu

SEQ ID NO: 1816690 - RNA, 18 nt, Human
ugggucgcccuggacugu

SEQ ID NO: 1816691 - RNA, 17 nt, Human
ugguagcuuuucccuuc

SEQ ID NO: 1816692 - RNA, 20 nt, Human
ugguagagugugccugaagu

SEQ ID NO: 1816693 - RNA, 17 nt, Human
uggguggcaccagcagc

SEQ ID NO: 1816694 - RNA, 20 nt, Human
uggguggcaccagcagccug

SEQ ID NO: 1816695 - RNA, 21 nt, Human
uggguggcaccagcagccugg

SEQ ID NO: 1816696 - RNA, 22 nt, Human
uggguggcaccagcagccugga

SEQ ID NO: 1816697 - RNA, 12 nt, Human
uggggcccugcc

SEQ ID NO: 1816698 - RNA, 21 nt, Human
uggggccaguuggucccccuu

SEQ ID NO: 1816699 - RNA, 15 nt, Human
uggggaggggcugug

SEQ ID NO: 1816700 - RNA, 22 nt, Human
uggggcugcaccggcuggccug

SEQ ID NO: 1816701 - RNA, 23 nt, Human
uggggcugcaccggcuggccugg

SEQ ID NO: 1816702 - RNA, 12 nt, Human
agggcuccagac

SEQ ID NO: 1816703 - RNA, 15 nt, Human
agggcuccagacaca

SEQ ID NO: 1816704 - RNA, 14 nt, Human
uggggaccucaggc

SEQ ID NO: 1816705 - RNA, 15 nt, Human
uggggaccucaggcc

SEQ ID NO: 1816706 - RNA, 16 nt, Human
uggggaccucaggccu

SEQ ID NO: 1816707 - RNA, 17 nt, Human
uggggaccucaggccug

SEQ ID NO: 1816708 - RNA, 12 nt, Human
uggggaggacaa

SEQ ID NO: 1816709 - RNA, 20 nt, Human
ugggguacccacugcucugg

SEQ ID NO: 1816710 - RNA, 19 nt, Human
ugggguacccacugcucug

SEQ ID NO: 1816711 - RNA, 13 nt, Human
uggggucacucug

SEQ ID NO: 1816712 - RNA, 14 nt, Human
uggggucacucugg

SEQ ID NO: 1816713 - RNA, 18 nt, Human
ugggguacccacugcucu

SEQ ID NO: 1816714 - RNA, 17 nt, Human
ugggguacccacugcuc

SEQ ID NO: 1816715 - RNA, 16 nt, Human
uggggucacucuggca

SEQ ID NO: 1816716 - RNA, 22 nt, Human
uggggucacucuggcagcucag

SEQ ID NO: 1816717 - RNA, 13 nt, Human
aggggaaaagagg

SEQ ID NO: 1816718 - RNA, 14 nt, Human
aggggaacagacug

SEQ ID NO: 1816719 - RNA, 18 nt, Human
aggggaaaaucagccugc

SEQ ID NO: 1816720 - RNA, 22 nt, Human
aggggaaaaucagccugcucca

SEQ ID NO: 1816721 - RNA, 13 nt, Human
aggggaauguuug

SEQ ID NO: 1816722 - RNA, 21 nt, Human
aggggaauaaacuguugaguc

SEQ ID NO: 1816723 - RNA, 16 nt, Human
agggcacugguggccc

SEQ ID NO: 1816724 - RNA, 14 nt, Human
agggcacugguggc

SEQ ID NO: 1816725 - RNA, 16 nt, Human
agggagggcuccagac

SEQ ID NO: 1816726 - RNA, 14 nt, Human
agggagggcuccag

SEQ ID NO: 1816727 - RNA, 15 nt, Human
agggagggcuccaga

SEQ ID NO: 1816728 - RNA, 23 nt, Human
agggcucagcggggacagcuccu

SEQ ID NO: 1816729 - RNA, 22 nt, Human
agggcucagcggggacagcucc

SEQ ID NO: 1816730 - RNA, 20 nt, Human
agggcucagcggggacagcu

SEQ ID NO: 1816731 - RNA, 19 nt, Human
agggcucagcggggacagc

SEQ ID NO: 1816732 - RNA, 20 nt, Human
ugggccccugccucucugca

SEQ ID NO: 1816733 - RNA, 15 nt, Human
ugggccccugccucu

SEQ ID NO: 1816734 - RNA, 19 nt, Human
ugggccccugccucucugc

SEQ ID NO: 1816735 - RNA, 15 nt, Human
agggagggagggcuc

SEQ ID NO: 1816736 - RNA, 17 nt, Human
agggagggagggcucca

SEQ ID NO: 1816737 - RNA, 18 nt, Human
ugggccccaguuguauuu

SEQ ID NO: 1816738 - RNA, 22 nt, Human
ugggccccaguuguauuuauuu

SEQ ID NO: 1816739 - RNA, 16 nt, Human
ugggcccccaaaugga

SEQ ID NO: 1816740 - RNA, 21 nt, Human
ugggcccccaaauggaaaugg

SEQ ID NO: 1816741 - RNA, 12 nt, Human
ugggcagaagga

SEQ ID NO: 1816742 - RNA, 11 nt, Human
ugggcagagca

SEQ ID NO: 1816743 - RNA, 12 nt, Human
ugggcagagcag

SEQ ID NO: 1816744 - RNA, 18 nt, Human
ugggccaggagccuccug

SEQ ID NO: 1816745 - RNA, 13 nt, Human
ugggcagagcaga

SEQ ID NO: 1816746 - RNA, 20 nt, Human
ugggaggaucucuugagccu

SEQ ID NO: 1816747 - RNA, 21 nt, Human
ugggaggaucucuugagccug

SEQ ID NO: 1816748 - RNA, 22 nt, Human
ugggaggaucucuugagccugg

SEQ ID NO: 1816749 - RNA, 19 nt, Human
ugggaggccaaggugggag

SEQ ID NO: 1816750 - RNA, 20 nt, Human
ugggaggccaaggugggagg

SEQ ID NO: 1816751 - RNA, 13 nt, Human
agggaaggggaca

SEQ ID NO: 1816752 - RNA, 22 nt, Human
agggaaggggacaaggacuagg

SEQ ID NO: 1816753 - RNA, 22 nt, Human
agggaaggauacaaaagcaugu

SEQ ID NO: 1816754 - RNA, 21 nt, Human
agggaauuucuucaacucccu

SEQ ID NO: 1816755 - RNA, 20 nt, Human
aggcccggcuccaggcuccu

SEQ ID NO: 1816756 - RNA, 18 nt, Human
aggcccggcuccaggcuc

SEQ ID NO: 1816757 - RNA, 21 nt, Human
aggcccggcuccaggcuccuu

SEQ ID NO: 1816758 - RNA, 16 nt, Human
ugggacuacaggcacc

SEQ ID NO: 1816759 - RNA, 15 nt, Human
ugggacuacaggcac

SEQ ID NO: 1816760 - RNA, 14 nt, Human
ugggacuacaggca

SEQ ID NO: 1816761 - RNA, 22 nt, Human
agggaggacgcucucuggccuu

SEQ ID NO: 1816762 - RNA, 21 nt, Human
agggaggacgcucucuggccu

SEQ ID NO: 1816763 - RNA, 23 nt, Human
agggaggacgcucucuggccuuc

SEQ ID NO: 1816764 - RNA, 20 nt, Human
ugggacucaaugcacugaca

SEQ ID NO: 1816765 - RNA, 19 nt, Human
ugggagagaagagaaugca

SEQ ID NO: 1816766 - RNA, 21 nt, Human
ugggagagaagagaaugcaca

SEQ ID NO: 1816767 - RNA, 18 nt, Human
ugggagacugcugaguca

SEQ ID NO: 1816768 - RNA, 16 nt, Human
ugggagagccuuccag

SEQ ID NO: 1816769 - RNA, 18 nt, Human
uguagagccagggucuca

SEQ ID NO: 1816770 - RNA, 16 nt, Human
uguagagccagggucu

SEQ ID NO: 1816771 - RNA, 23 nt, Human
uguagaaaagggaacugaacauu

SEQ ID NO: 1816772 - RNA, 14 nt, Human
uguagagcuucugg

SEQ ID NO: 1816773 - RNA, 16 nt, Human
uguagaggagaaacug

SEQ ID NO: 1816774 - RNA, 22 nt, Human
uguacuugcucuugaugccugg

SEQ ID NO: 1816775 - RNA, 23 nt, Human
uguacuugcucuugaugccuggc

SEQ ID NO: 1816776 - RNA, 21 nt, Human
uguagaaaagggaacugaaca

SEQ ID NO: 1816777 - RNA, 20 nt, Human
uguagaaaagggaacugaac

SEQ ID NO: 1816778 - RNA, 19 nt, Human
uguagaaaagggaacugaa

SEQ ID NO: 1816779 - RNA, 18 nt, Human
uguagaaaagggaacuga

SEQ ID NO: 1816780 - RNA, 13 nt, Human
aguaaaauccaca

SEQ ID NO: 1816781 - RNA, 15 nt, Human
aguaauaugcacaca

SEQ ID NO: 1816782 - RNA, 14 nt, Human
aguaauaugcacac

SEQ ID NO: 1816783 - RNA, 17 nt, Human
uguaggcauaaagucag

SEQ ID NO: 1816784 - RNA, 20 nt, Human
uguaggcauaaagucagggg

SEQ ID NO: 1816785 - RNA, 11 nt, Human
aguagagacag

SEQ ID NO: 1816786 - RNA, 14 nt, Human
aguacauguuaaac

SEQ ID NO: 1816787 - RNA, 23 nt, Human
aguaccauuuaauggggaggaca

SEQ ID NO: 1816788 - RNA, 12 nt, Human
aguaccauuuaa

SEQ ID NO: 1816789 - RNA, 21 nt, Human
aguagaagucuuagauguaua

SEQ ID NO: 1816790 - RNA, 19 nt, Human
aguagaagucuuagaugua

SEQ ID NO: 1816791 - RNA, 20 nt, Human
aguagaagucuuagauguau

SEQ ID NO: 1816792 - RNA, 20 nt, Human
uguauucucuccuguaccuc

SEQ ID NO: 1816793 - RNA, 19 nt, Human
uguauucucuccuguaccu

SEQ ID NO: 1816794 - RNA, 22 nt, Human
uguauuacaaauccaaugaaau

SEQ ID NO: 1816795 - RNA, 13 nt, Human
uguauuacaaauc

SEQ ID NO: 1816796 - RNA, 23 nt, Human
uguaucaaauacauuuaaaacau

SEQ ID NO: 1816797 - RNA, 21 nt, Human
uguaucaaauacauuuaaaac

SEQ ID NO: 1816798 - RNA, 14 nt, Human
uguaucaaauacau

SEQ ID NO: 1816799 - RNA, 18 nt, Human
uguaugucucgugguagg

SEQ ID NO: 1816800 - RNA, 17 nt, Human
uguaucaaugaguaaca

SEQ ID NO: 1816801 - RNA, 18 nt, Human
aguauuacuucugcuaca

SEQ ID NO: 1816802 - RNA, 17 nt, Human
aguaugguggcuggguu

SEQ ID NO: 1816803 - RNA, 15 nt, Human
aguauuacuucugcu

SEQ ID NO: 1816804 - RNA, 16 nt, Human
aguaugguggcugggu

SEQ ID NO: 1816805 - RNA, 15 nt, Human
aguaugguggcuggg

SEQ ID NO: 1816806 - RNA, 19 nt, Human
ugucaauuacaggaaguac

SEQ ID NO: 1816807 - RNA, 17 nt, Human
ugucaauuacaggaagu

SEQ ID NO: 1816808 - RNA, 14 nt, Human
ugucaauuacagga

SEQ ID NO: 1816809 - RNA, 15 nt, Human
ugucaauuacaggaa

SEQ ID NO: 1816810 - RNA, 23 nt, Human
agucacacagugagucgaggaca

SEQ ID NO: 1816811 - RNA, 15 nt, Human
agucacacagugagu

SEQ ID NO: 1816812 - RNA, 19 nt, Human
agucaccccggccaccugc

SEQ ID NO: 1816813 - RNA, 23 nt, Human
agucacacaguauuacuucugcu

SEQ ID NO: 1816814 - RNA, 17 nt, Human
uggugcgaucuggguuc

SEQ ID NO: 1816815 - RNA, 16 nt, Human
uggugcgaucuggguu

SEQ ID NO: 1816816 - RNA, 13 nt, Human
uggugcugccaca

SEQ ID NO: 1816817 - RNA, 18 nt, Human
uggugcugccacacuuca

SEQ ID NO: 1816818 - RNA, 12 nt, Human
ugguggcagugg

SEQ ID NO: 1816819 - RNA, 15 nt, Human
ugguggcagcugcgg

SEQ ID NO: 1816820 - RNA, 13 nt, Human
ugguggcagcugc

SEQ ID NO: 1816821 - RNA, 14 nt, Human
ugguggcagcugcg

SEQ ID NO: 1816822 - RNA, 21 nt, Human
ugguggagaggcccggccucu

SEQ ID NO: 1816823 - RNA, 18 nt, Human
ugguuaggcauuguggga

SEQ ID NO: 1816824 - RNA, 20 nt, Human
ugguuaggcauugugggaag

SEQ ID NO: 1816825 - RNA, 23 nt, Human
uggugugaccacugcagaagaca

SEQ ID NO: 1816826 - RNA, 18 nt, Human
aggucagagccugcaguu

SEQ ID NO: 1816827 - RNA, 17 nt, Human
aggucagagccugcagu

SEQ ID NO: 1816828 - RNA, 15 nt, Human
aggucagagccugca

SEQ ID NO: 1816829 - RNA, 14 nt, Human
aggucagagccugc

SEQ ID NO: 1816830 - RNA, 13 nt, Human
aggucagagccug

SEQ ID NO: 1816831 - RNA, 16 nt, Human
uggucagauuugaacu

SEQ ID NO: 1816832 - RNA, 15 nt, Human
uggucagauuugaac

SEQ ID NO: 1816833 - RNA, 16 nt, Human
aggucuugaacuccug

SEQ ID NO: 1816834 - RNA, 19 nt, Human
agguccacaacacacagau

SEQ ID NO: 1816835 - RNA, 15 nt, Human
aggugacagagugag

SEQ ID NO: 1816836 - RNA, 13 nt, Human
aggugacagagug

SEQ ID NO: 1816837 - RNA, 17 nt, Human
aggucuugaacuccugg

SEQ ID NO: 1816838 - RNA, 18 nt, Human
aggucuugaacuccuggc

SEQ ID NO: 1816839 - RNA, 13 nt, Human
aggugaccccagg

SEQ ID NO: 1816840 - RNA, 22 nt, Human
aggugacagagugagacucugu

SEQ ID NO: 1816841 - RNA, 21 nt, Human
aggugagaagcagaggaagga

SEQ ID NO: 1816842 - RNA, 23 nt, Human
aggugagaagcagaggaaggaga

SEQ ID NO: 1816843 - RNA, 16 nt, Human
aggugagaagcagagg

SEQ ID NO: 1816844 - RNA, 19 nt, Human
uguaaauaaagaacuagca

SEQ ID NO: 1816845 - RNA, 21 nt, Human
uguaaauacuguuuuuaacaa

SEQ ID NO: 1816846 - RNA, 16 nt, Human
uguaaauagcucaggu

SEQ ID NO: 1816847 - RNA, 15 nt, Human
uguaaauagcucagg

SEQ ID NO: 1816848 - RNA, 14 nt, Human
ugguuauggagagg

SEQ ID NO: 1816849 - RNA, 14 nt, Human
ugguuuccugcccu

SEQ ID NO: 1816850 - RNA, 15 nt, Human
ugguuuccugcccug

SEQ ID NO: 1816851 - RNA, 20 nt, Human
ugguuuccugcccugggagg

SEQ ID NO: 1816852 - RNA, 17 nt, Human
ugguuaugaauacuuug

SEQ ID NO: 1816853 - RNA, 12 nt, Human
ugguuuccugcc

SEQ ID NO: 1816854 - RNA, 13 nt, Human
ugguuuccugccc

SEQ ID NO: 1816855 - RNA, 15 nt, Human
ugguuuguaaauuaa

SEQ ID NO: 1816856 - RNA, 14 nt, Human
ugguuuucaaaaua

SEQ ID NO: 1816857 - RNA, 15 nt, Human
ugguuuucaaaauaa

SEQ ID NO: 1816858 - RNA, 17 nt, Human
ugguuuucaaaauaaaa

SEQ ID NO: 1816859 - RNA, 20 nt, Human
aggugugcucugaucaucca

SEQ ID NO: 1816860 - RNA, 15 nt, Human
aggugugcucugauc

SEQ ID NO: 1816861 - RNA, 17 nt, Human
aggugugaaccaccaca

SEQ ID NO: 1816862 - RNA, 19 nt, Human
agguggggucacucuggca

SEQ ID NO: 1816863 - RNA, 14 nt, Human
agguuuaagcuguu

SEQ ID NO: 1816864 - RNA, 20 nt, Human
aggugcauauuuauaaaaau

SEQ ID NO: 1816865 - RNA, 20 nt, Human
aggugauccacccaccucag

SEQ ID NO: 1816866 - RNA, 14 nt, Human
aggugauccaccca

SEQ ID NO: 1816867 - RNA, 23 nt, Human
agguggggcagcuugaggguugg

SEQ ID NO: 1816868 - RNA, 18 nt, Human
aggugggauccuccaggu

SEQ ID NO: 1816869 - RNA, 16 nt, Human
aggugggauccuccag

SEQ ID NO: 1816870 - RNA, 17 nt, Human
aggugggauccuccagg

SEQ ID NO: 1816871 - RNA, 15 nt, Human
aggugggauccucca

SEQ ID NO: 1816872 - RNA, 18 nt, Human
aggugccucaagagaagg

SEQ ID NO: 1816873 - RNA, 14 nt, Human
aggaaaagcugcug

SEQ ID NO: 1816874 - RNA, 22 nt, Human
agcuuuccccaugucucgacuc

SEQ ID NO: 1816875 - RNA, 19 nt, Human
agcuuacaagccagcugga

SEQ ID NO: 1816876 - RNA, 17 nt, Human
agcuuacaagccagcug

SEQ ID NO: 1816877 - RNA, 15 nt, Human
agcuuacaagccagc

SEQ ID NO: 1816878 - RNA, 20 nt, Human
agcuugaccgugaggccaga

SEQ ID NO: 1816879 - RNA, 22 nt, Human
agcuugaccgugaggccagaga

SEQ ID NO: 1816880 - RNA, 23 nt, Human
agcuugaccgugaggccagagac

SEQ ID NO: 1816881 - RNA, 20 nt, Human
agcuugcccuggugccucac

SEQ ID NO: 1816882 - RNA, 15 nt, Human
ugcgguccacccagg

SEQ ID NO: 1816883 - RNA, 14 nt, Human
ugcgguccacccag

SEQ ID NO: 1816884 - RNA, 13 nt, Human
agcuguuuaugca

SEQ ID NO: 1816885 - RNA, 13 nt, Human
agcuuaacagugu

SEQ ID NO: 1816886 - RNA, 16 nt, Human
ugcuaauuuugaaaaa

SEQ ID NO: 1816887 - RNA, 18 nt, Human
ugcuaauuuugaaaaacu

SEQ ID NO: 1816888 - RNA, 19 nt, Human
ugcuaauuuugaaaaacug

SEQ ID NO: 1816889 - RNA, 20 nt, Human
ugcuaauuuugaaaaacugc

SEQ ID NO: 1816890 - RNA, 16 nt, Human
ugcucugcugacagac

SEQ ID NO: 1816891 - RNA, 15 nt, Human
ugcucugcugacaga

SEQ ID NO: 1816892 - RNA, 14 nt, Human
ugcucugcugacag

SEQ ID NO: 1816893 - RNA, 20 nt, Human
ugcucuugaacuccugaccu

SEQ ID NO: 1816894 - RNA, 22 nt, Human
ugcucuugaacuccugaccuca

SEQ ID NO: 1816895 - RNA, 15 nt, Human
ugcucuugaacuccu

SEQ ID NO: 1816896 - RNA, 19 nt, Human
ugcucugaucauccacugu

SEQ ID NO: 1816897 - RNA, 21 nt, Human
ugcuccagcuguucagcuggu

SEQ ID NO: 1816898 - RNA, 16 nt, Human
aggaaaagcugcugac

SEQ ID NO: 1816899 - RNA, 23 nt, Human
aggaaaccaguuaggucucaaua

SEQ ID NO: 1816900 - RNA, 13 nt, Human
ugcuaucuccccc

SEQ ID NO: 1816901 - RNA, 14 nt, Human
ugcuaucuccccca

SEQ ID NO: 1816902 - RNA, 17 nt, Human
ugcuaucucccccagcc

SEQ ID NO: 1816903 - RNA, 18 nt, Human
ugcuaucucccccagccc

SEQ ID NO: 1816904 - RNA, 18 nt, Human
aggaagcagcuuucccca

SEQ ID NO: 1816905 - RNA, 13 nt, Human
aggaagccagcag

SEQ ID NO: 1816906 - RNA, 13 nt, Human
aggaagcucaggg

SEQ ID NO: 1816907 - RNA, 14 nt, Human
aggaagcucagggc

SEQ ID NO: 1816908 - RNA, 15 nt, Human
aggaaggcugagagg

SEQ ID NO: 1816909 - RNA, 15 nt, Human
aggaagcucagggcc

SEQ ID NO: 1816910 - RNA, 16 nt, Human
aggaagcucagggccu

SEQ ID NO: 1816911 - RNA, 15 nt, Human
agcuccuucuguccu

SEQ ID NO: 1816912 - RNA, 23 nt, Human
agcucccaggcauuccccaggag

SEQ ID NO: 1816913 - RNA, 16 nt, Human
agcuccaucuccacuc

SEQ ID NO: 1816914 - RNA, 13 nt, Human
agcucccaggcau

SEQ ID NO: 1816915 - RNA, 13 nt, Human
agcuccaucucca

SEQ ID NO: 1816916 - RNA, 15 nt, Human
agcuccaucuccacu

SEQ ID NO: 1816917 - RNA, 21 nt, Human
agcuccuucuguccuacucug

SEQ ID NO: 1816918 - RNA, 16 nt, Human
agcuccuucuguccua

SEQ ID NO: 1816919 - RNA, 12 nt, Human
agcucuggucca

SEQ ID NO: 1816920 - RNA, 17 nt, Human
agcucugguccauagag

SEQ ID NO: 1816921 - RNA, 19 nt, Human
ugcccuuaccugccaggaa

SEQ ID NO: 1816922 - RNA, 18 nt, Human
ugcccuuaccugccagga

SEQ ID NO: 1816923 - RNA, 13 nt, Human
ugccucagccucc

SEQ ID NO: 1816924 - RNA, 12 nt, Human
ugccucagccuc

SEQ ID NO: 1816925 - RNA, 12 nt, Human
ugccgcagcccu

SEQ ID NO: 1816926 - RNA, 14 nt, Human
ugccgcagcccugc

SEQ ID NO: 1816927 - RNA, 23 nt, Human
agcucuguccugggagugagcug

SEQ ID NO: 1816928 - RNA, 21 nt, Human
agcucuguccugggagugagc

SEQ ID NO: 1816929 - RNA, 16 nt, Human
agcucuguccugggag

SEQ ID NO: 1816930 - RNA, 20 nt, Human
agcugccagccgagauagcc

SEQ ID NO: 1816931 - RNA, 19 nt, Human
agcuguuacugucuucagu

SEQ ID NO: 1816932 - RNA, 14 nt, Human
ugccuguucccauu

SEQ ID NO: 1816933 - RNA, 21 nt, Human
ugccuuacccucauguucuua

SEQ ID NO: 1816934 - RNA, 16 nt, Human
ugccuuggggacaaga

SEQ ID NO: 1816935 - RNA, 20 nt, Human
ugccuuacccucauguucuu

SEQ ID NO: 1816936 - RNA, 16 nt, Human
ugccuguugggccagg

SEQ ID NO: 1816937 - RNA, 17 nt, Human
ugccuguugggccagga

SEQ ID NO: 1816938 - RNA, 16 nt, Human
agcugggacuacaggu

SEQ ID NO: 1816939 - RNA, 20 nt, Human
agcugggguggggaccucag

SEQ ID NO: 1816940 - RNA, 23 nt, Human
agcugggacuacaggcacccacc

SEQ ID NO: 1816941 - RNA, 20 nt, Human
agcugggacuacaggcaccc

SEQ ID NO: 1816942 - RNA, 22 nt, Human
agcugggguggggaccucaggc

SEQ ID NO: 1816943 - RNA, 23 nt, Human
agcugggguggggaccucaggcc

SEQ ID NO: 1816944 - RNA, 18 nt, Human
agcugugcucuggacagg

SEQ ID NO: 1816945 - RNA, 17 nt, Human
agcugugcucuggacag

SEQ ID NO: 1816946 - RNA, 19 nt, Human
agcugugcucuggacaggc

SEQ ID NO: 1816947 - RNA, 18 nt, Human
agcuguuacugucuucag

SEQ ID NO: 1816948 - RNA, 16 nt, Human
agcugccuguucagcu

SEQ ID NO: 1816949 - RNA, 14 nt, Human
agcugccuguucag

SEQ ID NO: 1816950 - RNA, 18 nt, Human
agcugccuguucagcucc

SEQ ID NO: 1816951 - RNA, 19 nt, Human
agcugccuguucagcucca

SEQ ID NO: 1816952 - RNA, 16 nt, Human
ugccuggauggggcug

SEQ ID NO: 1816953 - RNA, 17 nt, Human
ugccuggauggggcugc

SEQ ID NO: 1816954 - RNA, 20 nt, Human
ugccuggauggggcugcacc

SEQ ID NO: 1816955 - RNA, 21 nt, Human
ugccuggauggggcugcaccg

SEQ ID NO: 1816956 - RNA, 20 nt, Human
agcugcuugggcuucauccu

SEQ ID NO: 1816957 - RNA, 16 nt, Human
agcugcuugggcuuca

SEQ ID NO: 1816958 - RNA, 18 nt, Human
agcuggccgggagccuga

SEQ ID NO: 1816959 - RNA, 19 nt, Human
agcuggccgggagccugau

SEQ ID NO: 1816960 - RNA, 17 nt, Human
ugccucugccucugaca

SEQ ID NO: 1816961 - RNA, 20 nt, Human
ugccucugccucugacacac

SEQ ID NO: 1816962 - RNA, 18 nt, Human
ugccucugccucugacac

SEQ ID NO: 1816963 - RNA, 14 nt, Human
ugccucagccuccc

SEQ ID NO: 1816964 - RNA, 23 nt, Human
ugccugcccaggccccugccacc

SEQ ID NO: 1816965 - RNA, 22 nt, Human
ugccugcccaggccccugccac

SEQ ID NO: 1816966 - RNA, 20 nt, Human
ugccugcccaggccccugcc

SEQ ID NO: 1816967 - RNA, 12 nt, Human
ugccucugccug

SEQ ID NO: 1816968 - RNA, 24 nt, Human
ugccugcccaggccccugccaccc

SEQ ID NO: 1816969 - RNA, 22 nt, Human
ugccugcuuuuuauggccugug

SEQ ID NO: 1816970 - RNA, 20 nt, Human
ugccugcuuuuuauggccug

SEQ ID NO: 1816971 - RNA, 21 nt, Human
ugccugcuuuuuauggccugu

SEQ ID NO: 1816972 - RNA, 23 nt, Human
uggcacaucagcacgauuucugu

SEQ ID NO: 1816973 - RNA, 13 nt, Human
uggauggaagggg

SEQ ID NO: 1816974 - RNA, 23 nt, Human
uggaugccugguggcagcugcgg

SEQ ID NO: 1816975 - RNA, 21 nt, Human
uggaugccugguggcagcugc

SEQ ID NO: 1816976 - RNA, 14 nt, Human
uggaguugaaaauc

SEQ ID NO: 1816977 - RNA, 14 nt, Human
uggagugcagugag

SEQ ID NO: 1816978 - RNA, 17 nt, Human
uggagugcaaugacaca

SEQ ID NO: 1816979 - RNA, 16 nt, Human
aggcauuugcugaaua

SEQ ID NO: 1816980 - RNA, 20 nt, Human
aggcauuugcugaauacaga

SEQ ID NO: 1816981 - RNA, 13 nt, Human
aggcccggcucca

SEQ ID NO: 1816982 - RNA, 15 nt, Human
aggcccggccucuca

SEQ ID NO: 1816983 - RNA, 13 nt, Human
aggcccggccucu

SEQ ID NO: 1816984 - RNA, 14 nt, Human
aggcccggccucuc

SEQ ID NO: 1816985 - RNA, 14 nt, Human
aggccccgcccagg

SEQ ID NO: 1816986 - RNA, 13 nt, Human
aggcccagagggc

SEQ ID NO: 1816987 - RNA, 20 nt, Human
uggcacccggccccugcugg

SEQ ID NO: 1816988 - RNA, 19 nt, Human
uggcacccggccccugcug

SEQ ID NO: 1816989 - RNA, 18 nt, Human
uggcacccggccccugcu

SEQ ID NO: 1816990 - RNA, 13 nt, Human
uggcagcucagag

SEQ ID NO: 1816991 - RNA, 23 nt, Human
uggcagcucaccucucccuugga

SEQ ID NO: 1816992 - RNA, 21 nt, Human
uggcagcucaccucucccuug

SEQ ID NO: 1816993 - RNA, 22 nt, Human
uggcagcucaccucucccuugg

SEQ ID NO: 1816994 - RNA, 13 nt, Human
aggccagccuuga

SEQ ID NO: 1816995 - RNA, 12 nt, Human
aggccagcugcu

SEQ ID NO: 1816996 - RNA, 15 nt, Human
aggccagccuugacc

SEQ ID NO: 1816997 - RNA, 17 nt, Human
aggcaagcaccuccugc

SEQ ID NO: 1816998 - RNA, 17 nt, Human
uggagccaauggagacu

SEQ ID NO: 1816999 - RNA, 19 nt, Human
aggcaagcaccuccugccu

SEQ ID NO: 1817000 - RNA, 18 nt, Human
aggcaagcaccuccugcc

SEQ ID NO: 1817001 - RNA, 20 nt, Human
aggcaagcaccuccugccuc

SEQ ID NO: 1817002 - RNA, 17 nt, Human
aggcaaggcugucaauu

SEQ ID NO: 1817003 - RNA, 16 nt, Human
aggcaaggcugucaau

SEQ ID NO: 1817004 - RNA, 17 nt, Human
aggauugcuacuguccu

SEQ ID NO: 1817005 - RNA, 15 nt, Human
aggauugcuacuguc

SEQ ID NO: 1817006 - RNA, 18 nt, Human
aggauugcuacuguccua

SEQ ID NO: 1817007 - RNA, 14 nt, Human
uggagaaaauggac

SEQ ID NO: 1817008 - RNA, 22 nt, Human
aggcauaaagucagggguuccc

SEQ ID NO: 1817009 - RNA, 18 nt, Human
aggcauugugggaagggg

SEQ ID NO: 1817010 - RNA, 20 nt, Human
aggcauuuaggccaugggac

SEQ ID NO: 1817011 - RNA, 22 nt, Human
aggcaggucuugaacuccuggc

SEQ ID NO: 1817012 - RNA, 12 nt, Human
aggcagggucuc

SEQ ID NO: 1817013 - RNA, 15 nt, Human
aggcauaaagucagg

SEQ ID NO: 1817014 - RNA, 17 nt, Human
aggcaggugggauggau

SEQ ID NO: 1817015 - RNA, 19 nt, Human
aggacuuuucuuuguggcu

SEQ ID NO: 1817016 - RNA, 17 nt, Human
aggacuuuucuuugugg

SEQ ID NO: 1817017 - RNA, 22 nt, Human
aggacuuuucuuuguggcuucc

SEQ ID NO: 1817018 - RNA, 19 nt, Human
aggagaaacuggaacucuc

SEQ ID NO: 1817019 - RNA, 18 nt, Human
aggagaaacuggaacucu

SEQ ID NO: 1817020 - RNA, 12 nt, Human
aggacucugccu

SEQ ID NO: 1817021 - RNA, 13 nt, Human
aggacucugccuc

SEQ ID NO: 1817022 - RNA, 14 nt, Human
aggacucugccucc

SEQ ID NO: 1817023 - RNA, 16 nt, Human
aggacucugccuccuc

SEQ ID NO: 1817024 - RNA, 17 nt, Human
aggacucugccuccucu

SEQ ID NO: 1817025 - RNA, 18 nt, Human
aggacucugccuccucuu

SEQ ID NO: 1817026 - RNA, 12 nt, Human
aggagcagccac

SEQ ID NO: 1817027 - RNA, 13 nt, Human
aggagcagccaca

SEQ ID NO: 1817028 - RNA, 17 nt, Human
aggagccccgaggccuu

SEQ ID NO: 1817029 - RNA, 23 nt, Human
aggagcccugggaggcucuggag

SEQ ID NO: 1817030 - RNA, 16 nt, Human
aggagccuccugcccu

SEQ ID NO: 1817031 - RNA, 14 nt, Human
aggacgcucucugg

SEQ ID NO: 1817032 - RNA, 13 nt, Human
aggacgcucucug

SEQ ID NO: 1817033 - RNA, 20 nt, Human
aggacgcucucuggccuucg

SEQ ID NO: 1817034 - RNA, 19 nt, Human
aggacgcucucuggccuuc

SEQ ID NO: 1817035 - RNA, 17 nt, Human
aggacgcucucuggccu

SEQ ID NO: 1817036 - RNA, 16 nt, Human
aggacgcucucuggcc

SEQ ID NO: 1817037 - RNA, 19 nt, Human
aggacuaggguccugggga

SEQ ID NO: 1817038 - RNA, 16 nt, Human
aggacuaggguccugg

SEQ ID NO: 1817039 - RNA, 18 nt, Human
aggacuaggguccugggg

SEQ ID NO: 1817040 - RNA, 15 nt, Human
aggacuaggguccug

SEQ ID NO: 1817041 - RNA, 18 nt, Human
ugcuuuuggucuguguga

SEQ ID NO: 1817042 - RNA, 20 nt, Human
ugcuuuugucuaugggacuc

SEQ ID NO: 1817043 - RNA, 23 nt, Human
ugcuuuuuaauauugauaugcuu

SEQ ID NO: 1817044 - RNA, 16 nt, Human
ugcuuugggcugcccu

SEQ ID NO: 1817045 - RNA, 17 nt, Human
ugcuuugggcugcccug

SEQ ID NO: 1817046 - RNA, 22 nt, Human
ugcuuugugauuuuuguaauuu

SEQ ID NO: 1817047 - RNA, 17 nt, Human
ugcuuugugauuuuugu

SEQ ID NO: 1817048 - RNA, 17 nt, Human
aggagccuccugcccuu

SEQ ID NO: 1817049 - RNA, 15 nt, Human
ugcuugagcucagga

SEQ ID NO: 1817050 - RNA, 14 nt, Human
ugcuuugggcugcc

SEQ ID NO: 1817051 - RNA, 15 nt, Human
ugcuuugggcugccc

SEQ ID NO: 1817052 - RNA, 16 nt, Human
uggaagacagcucuua

SEQ ID NO: 1817053 - RNA, 21 nt, Human
uggaaauuuguuauaaugaau

SEQ ID NO: 1817054 - RNA, 23 nt, Human
uggaaauuuguuauaaugaauga

SEQ ID NO: 1817055 - RNA, 16 nt, Human
ugcuuuuuauggccug

SEQ ID NO: 1817056 - RNA, 22 nt, Human
aggaugcacagaguuguuacau

SEQ ID NO: 1817057 - RNA, 22 nt, Human
aggaugaucuaggaagacuuug

SEQ ID NO: 1817058 - RNA, 23 nt, Human
aggaugaucuaggaagacuuugg

SEQ ID NO: 1817059 - RNA, 17 nt, Human
aggauucuuccucccuc

SEQ ID NO: 1817060 - RNA, 19 nt, Human
aggauucuuccucccuccc

SEQ ID NO: 1817061 - RNA, 13 nt, Human
aggaucagucuga

SEQ ID NO: 1817062 - RNA, 21 nt, Human
aggauaucggcauuuguuucu

SEQ ID NO: 1817063 - RNA, 17 nt, Human
aggauaucggcauuugu

SEQ ID NO: 1817064 - RNA, 20 nt, Human
ugcauaccacuuuuguucuu

SEQ ID NO: 1817065 - RNA, 18 nt, Human
ugcauaccacuuuuguuc

SEQ ID NO: 1817066 - RNA, 16 nt, Human
ugcauaccacuuuugu

SEQ ID NO: 1817067 - RNA, 17 nt, Human
ugcauagaauaaaauuu

SEQ ID NO: 1817068 - RNA, 19 nt, Human
ugcauacucauuaggaugg

SEQ ID NO: 1817069 - RNA, 13 nt, Human
ugcauacucauua

SEQ ID NO: 1817070 - RNA, 13 nt, Human
ugcaucucagccc

SEQ ID NO: 1817071 - RNA, 14 nt, Human
ugcaucucagccca

SEQ ID NO: 1817072 - RNA, 15 nt, Human
ugcaucucagcccac

SEQ ID NO: 1817073 - RNA, 18 nt, Human
ugcaugcugucccuuacg

SEQ ID NO: 1817074 - RNA, 19 nt, Human
ugcaugcugucccuuacgu

SEQ ID NO: 1817075 - RNA, 21 nt, Human
ugcaugcugucccuuacguga

SEQ ID NO: 1817076 - RNA, 18 nt, Human
ugcagccucacaguccuu

SEQ ID NO: 1817077 - RNA, 17 nt, Human
ugcagccucacaguccu

SEQ ID NO: 1817078 - RNA, 21 nt, Human
ugcagccucacaguccuuacc

SEQ ID NO: 1817079 - RNA, 11 nt, Human
ugcaggucccu

SEQ ID NO: 1817080 - RNA, 22 nt, Human
ugcaggucccuaauaaagcugu

SEQ ID NO: 1817081 - RNA, 21 nt, Human
ugcagacaggcaagcaccucc

SEQ ID NO: 1817082 - RNA, 13 nt, Human
ugcagacaggcaa

SEQ ID NO: 1817083 - RNA, 12 nt, Human
ugcagacaggca

SEQ ID NO: 1817084 - RNA, 13 nt, Human
agccuccugcccu

SEQ ID NO: 1817085 - RNA, 14 nt, Human
agccuccugcccuu

SEQ ID NO: 1817086 - RNA, 18 nt, Human
agccuccugcccuuaccu

SEQ ID NO: 1817087 - RNA, 13 nt, Human
ugccauaauuacu

SEQ ID NO: 1817088 - RNA, 17 nt, Human
ugccagccgagauagcc

SEQ ID NO: 1817089 - RNA, 22 nt, Human
ugccagccgagauagccaaggc

SEQ ID NO: 1817090 - RNA, 16 nt, Human
ugcauuuaaaagauac

SEQ ID NO: 1817091 - RNA, 18 nt, Human
ugccaaugggagcucaug

SEQ ID NO: 1817092 - RNA, 13 nt, Human
ugccaauggacua

SEQ ID NO: 1817093 - RNA, 14 nt, Human
ugccaaugggagcu

SEQ ID NO: 1817094 - RNA, 20 nt, Human
agccuuagaagucacacagu

SEQ ID NO: 1817095 - RNA, 22 nt, Human
agccuuagaagucacacaguau

SEQ ID NO: 1817096 - RNA, 15 nt, Human
agccuguuuaagaga

SEQ ID NO: 1817097 - RNA, 13 nt, Human
agccuugaacuuu

SEQ ID NO: 1817098 - RNA, 16 nt, Human
agccuugggaccccug

SEQ ID NO: 1817099 - RNA, 18 nt, Human
agccuugaccauucucca

SEQ ID NO: 1817100 - RNA, 19 nt, Human
agccuugaccauucuccac

SEQ ID NO: 1817101 - RNA, 21 nt, Human
agccuugaccauucuccaccu

SEQ ID NO: 1817102 - RNA, 19 nt, Human
agccuugcggaagguucua

SEQ ID NO: 1817103 - RNA, 17 nt, Human
agccugugccucuggga

SEQ ID NO: 1817104 - RNA, 18 nt, Human
agccugugccucugggac

SEQ ID NO: 1817105 - RNA, 19 nt, Human
agccugugccucugggacu

SEQ ID NO: 1817106 - RNA, 23 nt, Human
ugcaaaguucccuacuuccugug

SEQ ID NO: 1817107 - RNA, 20 nt, Human
ugcaaaguaucccuacugua

SEQ ID NO: 1817108 - RNA, 21 nt, Human
ugcaaaggguaucaggugcug

SEQ ID NO: 1817109 - RNA, 14 nt, Human
ugcaaagcccagcu

SEQ ID NO: 1817110 - RNA, 15 nt, Human
ugcaaagcccagcuu

SEQ ID NO: 1817111 - RNA, 17 nt, Human
ugcaaagcccagcuuga

SEQ ID NO: 1817112 - RNA, 18 nt, Human
ugcaaaccaucauugaaa

SEQ ID NO: 1817113 - RNA, 20 nt, Human
ugcaaaccaucauugaaauc

SEQ ID NO: 1817114 - RNA, 18 nt, Human
ugauuuccguuaaaauac

SEQ ID NO: 1817115 - RNA, 12 nt, Human
ugauuuggaaaa

SEQ ID NO: 1817116 - RNA, 12 nt, Human
ugcaaaccauca

SEQ ID NO: 1817117 - RNA, 13 nt, Human
ugcaaaccaucau

SEQ ID NO: 1817118 - RNA, 20 nt, Human
ugauuucagcaccuacagug

SEQ ID NO: 1817119 - RNA, 13 nt, Human
ugauuucauucaa

SEQ ID NO: 1817120 - RNA, 18 nt, Human
agccacggccaggccaga

SEQ ID NO: 1817121 - RNA, 17 nt, Human
agccacggccaggccag

SEQ ID NO: 1817122 - RNA, 13 nt, Human
ugcaacaggcugg

SEQ ID NO: 1817123 - RNA, 15 nt, Human
ugcaaggucauuuuu

SEQ ID NO: 1817124 - RNA, 12 nt, Human
agcccaggccuc

SEQ ID NO: 1817125 - RNA, 22 nt, Human
ugcagaagacaguauggcagcu

SEQ ID NO: 1817126 - RNA, 16 nt, Human
ugcacuccagccuggg

SEQ ID NO: 1817127 - RNA, 15 nt, Human
ugcacuccagccugg

SEQ ID NO: 1817128 - RNA, 17 nt, Human
ugcacuccagccugagc

SEQ ID NO: 1817129 - RNA, 14 nt, Human
ugcaccggcuggcc

SEQ ID NO: 1817130 - RNA, 15 nt, Human
ugcaccggcuggccu

SEQ ID NO: 1817131 - RNA, 16 nt, Human
ugcaccggcuggccug

SEQ ID NO: 1817132 - RNA, 14 nt, Human
ugcacuccagccug

SEQ ID NO: 1817133 - RNA, 15 nt, Human
ugcacuccagccuga

SEQ ID NO: 1817134 - RNA, 13 nt, Human
ugcaccagcccuu

SEQ ID NO: 1817135 - RNA, 21 nt, Human
ugcaccacugcacuccagccu

SEQ ID NO: 1817136 - RNA, 17 nt, Human
agcccugggaggcucug

SEQ ID NO: 1817137 - RNA, 18 nt, Human
agcccugggaggcucugg

SEQ ID NO: 1817138 - RNA, 20 nt, Human
agcccugggaggcucuggag

SEQ ID NO: 1817139 - RNA, 18 nt, Human
agccccgugggguuccuc

SEQ ID NO: 1817140 - RNA, 14 nt, Human
agccccgaggccuu

SEQ ID NO: 1817141 - RNA, 14 nt, Human
agcccaggccuccu

SEQ ID NO: 1817142 - RNA, 19 nt, Human
agcccaggccuccuacagc

SEQ ID NO: 1817143 - RNA, 21 nt, Human
agcccaggccuccuacagcuu

SEQ ID NO: 1817144 - RNA, 16 nt, Human
agcccgggcucugccu

SEQ ID NO: 1817145 - RNA, 14 nt, Human
agcccugcagaggg

SEQ ID NO: 1817146 - RNA, 15 nt, Human
agcccugcagagggc

SEQ ID NO: 1817147 - RNA, 16 nt, Human
agcccugcagagggca

SEQ ID NO: 1817148 - RNA, 19 nt, Human
agcccugcagagggcacag

SEQ ID NO: 1817149 - RNA, 14 nt, Human
agccccuucugacc

SEQ ID NO: 1817150 - RNA, 15 nt, Human
agccccuucugaccc

SEQ ID NO: 1817151 - RNA, 16 nt, Human
agccccuucugaccca

SEQ ID NO: 1817152 - RNA, 19 nt, Human
agccccuucugacccaugc

SEQ ID NO: 1817153 - RNA, 13 nt, Human
agcccgggcucug

SEQ ID NO: 1817154 - RNA, 14 nt, Human
agcccgggcucugc

SEQ ID NO: 1817155 - RNA, 15 nt, Human
agcccgggcucugcc

SEQ ID NO: 1817156 - RNA, 16 nt, Human
agcauuugucaacaaa

SEQ ID NO: 1817157 - RNA, 18 nt, Human
agccaaacauccuacaag

SEQ ID NO: 1817158 - RNA, 15 nt, Human
agcauuuugcuaaau

SEQ ID NO: 1817159 - RNA, 22 nt, Human
agcauuuugcuaaaugugaaug

SEQ ID NO: 1817160 - RNA, 13 nt, Human
agcauuuuguaau

SEQ ID NO: 1817161 - RNA, 22 nt, Human
agcauucucacuccuaccuggu

SEQ ID NO: 1817162 - RNA, 18 nt, Human
agcauucucacuccuacc

SEQ ID NO: 1817163 - RNA, 20 nt, Human
agcauucucacuccuaccug

SEQ ID NO: 1817164 - RNA, 19 nt, Human
agcauggcugccaauggga

SEQ ID NO: 1817165 - RNA, 17 nt, Human
agcauuagauuucucau

SEQ ID NO: 1817166 - RNA, 14 nt, Human
ugaucacggcucac

SEQ ID NO: 1817167 - RNA, 13 nt, Human
ugaucacggcuca

SEQ ID NO: 1817168 - RNA, 15 nt, Human
ugaucacggcucacu

SEQ ID NO: 1817169 - RNA, 18 nt, Human
ugaucacggcucacugca

SEQ ID NO: 1817170 - RNA, 14 nt, Human
ugaucaccugcccu

SEQ ID NO: 1817171 - RNA, 17 nt, Human
agcauauucaggaagcu

SEQ ID NO: 1817172 - RNA, 19 nt, Human
agcauauucaggaagcuca

SEQ ID NO: 1817173 - RNA, 21 nt, Human
agcauauucaggaagcucagg

SEQ ID NO: 1817174 - RNA, 18 nt, Human
ugauacaaugcugugccc

SEQ ID NO: 1817175 - RNA, 13 nt, Human
agcauggcugcca

SEQ ID NO: 1817176 - RNA, 23 nt, Human
agcaucaggccaggcccucugcc

SEQ ID NO: 1817177 - RNA, 22 nt, Human
agcaucaggccaggcccucugc

SEQ ID NO: 1817178 - RNA, 21 nt, Human
agcaucaggccaggcccucug

SEQ ID NO: 1817179 - RNA, 12 nt, Human
agcaucaggcca

SEQ ID NO: 1817180 - RNA, 16 nt, Human
agcauauucaggaagc

SEQ ID NO: 1817181 - RNA, 23 nt, Human
ugauccagaaagaaaacuuguau

SEQ ID NO: 1817182 - RNA, 18 nt, Human
ugauccacucgccuucau

SEQ ID NO: 1817183 - RNA, 14 nt, Human
ugauccacucgccu

SEQ ID NO: 1817184 - RNA, 13 nt, Human
ugauccagaaaga

SEQ ID NO: 1817185 - RNA, 20 nt, Human
ugauccucccaccucagccu

SEQ ID NO: 1817186 - RNA, 19 nt, Human
ugauccucccaccucagcc

SEQ ID NO: 1817187 - RNA, 13 nt, Human
ugaucuaggaaga

SEQ ID NO: 1817188 - RNA, 18 nt, Human
ugauccucccaccucagc

SEQ ID NO: 1817189 - RNA, 13 nt, Human
agccaccacgccc

SEQ ID NO: 1817190 - RNA, 16 nt, Human
agccacggccaggcca

SEQ ID NO: 1817191 - RNA, 16 nt, Human
ugauuaaauucuugca

SEQ ID NO: 1817192 - RNA, 13 nt, Human
ugauuaaauucuu

SEQ ID NO: 1817193 - RNA, 17 nt, Human
ugauuaaauucuugcaa

SEQ ID NO: 1817194 - RNA, 23 nt, Human
ugauguuuuccaugaguccccug

SEQ ID NO: 1817195 - RNA, 19 nt, Human
ugauguuuuccaugagucc

SEQ ID NO: 1817196 - RNA, 21 nt, Human
ugauguuuuaaggaugcuugu

SEQ ID NO: 1817197 - RNA, 17 nt, Human
ugauguuuuccaugagu

SEQ ID NO: 1817198 - RNA, 19 nt, Human
ugauggguuaguggaugga

SEQ ID NO: 1817199 - RNA, 23 nt, Human
ugauggguuaguggauggaaggg

SEQ ID NO: 1817200 - RNA, 22 nt, Human
ugauggggcccugccuccuuug

SEQ ID NO: 1817201 - RNA, 22 nt, Human
ugaugggcaacccccagccugc

SEQ ID NO: 1817202 - RNA, 13 nt, Human
ugauggggcccug

SEQ ID NO: 1817203 - RNA, 21 nt, Human
ugaugggcaacccccagccug

SEQ ID NO: 1817204 - RNA, 17 nt, Human
ugauggcuuaugauagc

SEQ ID NO: 1817205 - RNA, 21 nt, Human
ugaugaucuuugcagacaggc

SEQ ID NO: 1817206 - RNA, 20 nt, Human
ugaugaucuuugcagacagg

SEQ ID NO: 1817207 - RNA, 19 nt, Human
ugaugaucuuugcagacag

SEQ ID NO: 1817208 - RNA, 23 nt, Human
ugaugaaaugaggucagagccug

SEQ ID NO: 1817209 - RNA, 18 nt, Human
ugaugaaauguaaauacu

SEQ ID NO: 1817210 - RNA, 22 nt, Human
ugaugaaaugaggucagagccu

SEQ ID NO: 1817211 - RNA, 14 nt, Human
ugaucuaggaagac

SEQ ID NO: 1817212 - RNA, 15 nt, Human
ugaucuaggaagacu

SEQ ID NO: 1817213 - RNA, 14 nt, Human
agcaguuugcuuug

SEQ ID NO: 1817214 - RNA, 19 nt, Human
agcauaaaaauuagccaag

SEQ ID NO: 1817215 - RNA, 19 nt, Human
ugaguacguugugcauuug

SEQ ID NO: 1817216 - RNA, 18 nt, Human
ugaguacguugugcauuu

SEQ ID NO: 1817217 - RNA, 17 nt, Human
ugaguacguugugcauu

SEQ ID NO: 1817218 - RNA, 16 nt, Human
ugaguacguugugcau

SEQ ID NO: 1817219 - RNA, 23 nt, Human
agcauaaaaauuagccaagugug

SEQ ID NO: 1817220 - RNA, 18 nt, Human
ugaguucauacccuguua

SEQ ID NO: 1817221 - RNA, 21 nt, Human
ugagugggggaucacagccuc

SEQ ID NO: 1817222 - RNA, 23 nt, Human
ugagugggggaucacagccucug

SEQ ID NO: 1817223 - RNA, 15 nt, Human
ugauacaaugcugug

SEQ ID NO: 1817224 - RNA, 14 nt, Human
ugauacaaugcugu

SEQ ID NO: 1817225 - RNA, 16 nt, Human
ugagugccuuacacaa

SEQ ID NO: 1817226 - RNA, 17 nt, Human
ugagugcagcucuggag

SEQ ID NO: 1817227 - RNA, 13 nt, Human
ugagugccuuaca

SEQ ID NO: 1817228 - RNA, 14 nt, Human
ugagugccuuacac

SEQ ID NO: 1817229 - RNA, 13 nt, Human
ugaguccagaagu

SEQ ID NO: 1817230 - RNA, 18 nt, Human
ugagucaccaagcccagu

SEQ ID NO: 1817231 - RNA, 20 nt, Human
ugaguacguugugcauuugg

SEQ ID NO: 1817232 - RNA, 14 nt, Human
ugaguacuacaguc

SEQ ID NO: 1817233 - RNA, 16 nt, Human
agcagcagggagggcu

SEQ ID NO: 1817234 - RNA, 13 nt, Human
agcaggacaugga

SEQ ID NO: 1817235 - RNA, 15 nt, Human
agcagccacauuccu

SEQ ID NO: 1817236 - RNA, 11 nt, Human
agcagccacau

SEQ ID NO: 1817237 - RNA, 20 nt, Human
ugacccaugcugcccuguga

SEQ ID NO: 1817238 - RNA, 17 nt, Human
ugacccaugcugcccug

SEQ ID NO: 1817239 - RNA, 18 nt, Human
ugacccaugcugcccugu

SEQ ID NO: 1817240 - RNA, 19 nt, Human
ugacccaugcugcccugug

SEQ ID NO: 1817241 - RNA, 15 nt, Human
agcagggcucagcgg

SEQ ID NO: 1817242 - RNA, 14 nt, Human
agcagggcucagcg

SEQ ID NO: 1817243 - RNA, 13 nt, Human
agcagggcucagc

SEQ ID NO: 1817244 - RNA, 20 nt, Human
agcagggagggcuucugcca

SEQ ID NO: 1817245 - RNA, 22 nt, Human
agcagggcucagcggggacagc

SEQ ID NO: 1817246 - RNA, 15 nt, Human
agcagggaaacagcu

SEQ ID NO: 1817247 - RNA, 14 nt, Human
agcagggaaacagc

SEQ ID NO: 1817248 - RNA, 13 nt, Human
agcagggaaacag

SEQ ID NO: 1817249 - RNA, 15 nt, Human
agcaggcugugaguu

SEQ ID NO: 1817250 - RNA, 21 nt, Human
agcaggcucucaggccagcug

SEQ ID NO: 1817251 - RNA, 22 nt, Human
agcaggcucucaggccagcugc

SEQ ID NO: 1817252 - RNA, 23 nt, Human
agcaggcucucaggccagcugcu

SEQ ID NO: 1817253 - RNA, 17 nt, Human
agcaggcucgggcuccc

SEQ ID NO: 1817254 - RNA, 13 nt, Human
agcaggcucucag

SEQ ID NO: 1817255 - RNA, 14 nt, Human
agcaggcucucagg

SEQ ID NO: 1817256 - RNA, 15 nt, Human
agcaggcucucaggc

SEQ ID NO: 1817257 - RNA, 16 nt, Human
agcaggcucucaggcc

SEQ ID NO: 1817258 - RNA, 17 nt, Human
agcaggcucucaggcca

SEQ ID NO: 1817259 - RNA, 18 nt, Human
agcaggcucucaggccag

SEQ ID NO: 1817260 - RNA, 19 nt, Human
agcaggcucucaggccagc

SEQ ID NO: 1817261 - RNA, 15 nt, Human
ugaaauuguauuaca

SEQ ID NO: 1817262 - RNA, 18 nt, Human
agagcugccaccugccug

SEQ ID NO: 1817263 - RNA, 23 nt, Human
ugaaauaagccagacaucaacag

SEQ ID NO: 1817264 - RNA, 20 nt, Human
ugaaauaagccagacaucaa

SEQ ID NO: 1817265 - RNA, 18 nt, Human
ugaaauaagccagacauc

SEQ ID NO: 1817266 - RNA, 17 nt, Human
ugaaauaagccagacau

SEQ ID NO: 1817267 - RNA, 17 nt, Human
ucuuuggacccugaggc

SEQ ID NO: 1817268 - RNA, 21 nt, Human
ucuuuggacccugaggcccag

SEQ ID NO: 1817269 - RNA, 12 nt, Human
agagcagagacc

SEQ ID NO: 1817270 - RNA, 11 nt, Human
agagccuugcg

SEQ ID NO: 1817271 - RNA, 21 nt, Human
agagccuugcggaagguucua

SEQ ID NO: 1817272 - RNA, 20 nt, Human
agagcagagaccaucccuga

SEQ ID NO: 1817273 - RNA, 17 nt, Human
agagcagagaccauccc

SEQ ID NO: 1817274 - RNA, 18 nt, Human
agagcagagaccaucccu

SEQ ID NO: 1817275 - RNA, 19 nt, Human
agaggcagccccauucugc

SEQ ID NO: 1817276 - RNA, 13 nt, Human
agaggcagcccca

SEQ ID NO: 1817277 - RNA, 13 nt, Human
agaggcagggucu

SEQ ID NO: 1817278 - RNA, 10 nt, Human
agaggcaggg

SEQ ID NO: 1817279 - RNA, 19 nt, Human
agaggccaugggccuccug

SEQ ID NO: 1817280 - RNA, 18 nt, Human
agaggcucagauuguaau

SEQ ID NO: 1817281 - RNA, 10 nt, Human
agaggcucag

SEQ ID NO: 1817282 - RNA, 17 nt, Human
agaggcuaugugagcac

SEQ ID NO: 1817283 - RNA, 13 nt, Human
agaggcugaggac

SEQ ID NO: 1817284 - RNA, 19 nt, Human
agagguccacaacacacag

SEQ ID NO: 1817285 - RNA, 15 nt, Human
agagguugcagugag

SEQ ID NO: 1817286 - RNA, 15 nt, Human
ugaacuccuggccuc

SEQ ID NO: 1817287 - RNA, 14 nt, Human
ugaacuccuggccu

SEQ ID NO: 1817288 - RNA, 12 nt, Human
ugaacuccuggc

SEQ ID NO: 1817289 - RNA, 21 nt, Human
ugaacuaggauuguaguccca

SEQ ID NO: 1817290 - RNA, 22 nt, Human
ugaaccgaugagaaauaaaguu

SEQ ID NO: 1817291 - RNA, 12 nt, Human
ugaaccugaaua

SEQ ID NO: 1817292 - RNA, 15 nt, Human
ugaaauuuuuauuaa

SEQ ID NO: 1817293 - RNA, 20 nt, Human
ugaacaaauuuacagagaca

SEQ ID NO: 1817294 - RNA, 19 nt, Human
ugaacaaauuuacagagac

SEQ ID NO: 1817295 - RNA, 22 nt, Human
agagcuucuguugcugccucau

SEQ ID NO: 1817296 - RNA, 15 nt, Human
agagcuuaacagugu

SEQ ID NO: 1817297 - RNA, 22 nt, Human
ugaacuuugaccucugcagcaa

SEQ ID NO: 1817298 - RNA, 20 nt, Human
ugaacuuugaccucugcagc

SEQ ID NO: 1817299 - RNA, 19 nt, Human
ugaacuuugaccucugcag

SEQ ID NO: 1817300 - RNA, 18 nt, Human
agaucacgccacugcacu

SEQ ID NO: 1817301 - RNA, 17 nt, Human
agaucacgccacugcac

SEQ ID NO: 1817302 - RNA, 15 nt, Human
ugaauuucuuuugcc

SEQ ID NO: 1817303 - RNA, 16 nt, Human
agaucacgccacugca

SEQ ID NO: 1817304 - RNA, 15 nt, Human
agaucacgccacugc

SEQ ID NO: 1817305 - RNA, 14 nt, Human
agaucacgccacug

SEQ ID NO: 1817306 - RNA, 17 nt, Human
agauaaagguucaugca

SEQ ID NO: 1817307 - RNA, 12 nt, Human
agauaaaugugc

SEQ ID NO: 1817308 - RNA, 22 nt, Human
agaguugauacuacaguuuguu

SEQ ID NO: 1817309 - RNA, 20 nt, Human
agaguugauacuacaguuug

SEQ ID NO: 1817310 - RNA, 17 nt, Human
agaguugauacuacagu

SEQ ID NO: 1817311 - RNA, 20 nt, Human
agaguugaugguuguacaua

SEQ ID NO: 1817312 - RNA, 12 nt, Human
agaguuguuaca

SEQ ID NO: 1817313 - RNA, 16 nt, Human
agaguuguuacauuuu

SEQ ID NO: 1817314 - RNA, 21 nt, Human
agaguuguuacauuuuuaagu

SEQ ID NO: 1817315 - RNA, 19 nt, Human
ugaaugucagugugacuga

SEQ ID NO: 1817316 - RNA, 20 nt, Human
ugaaugguuuucaaaauaaa

SEQ ID NO: 1817317 - RNA, 15 nt, Human
agaugcaccagcccu

SEQ ID NO: 1817318 - RNA, 14 nt, Human
agaugcaccagccc

SEQ ID NO: 1817319 - RNA, 15 nt, Human
agaugcuagaacucc

SEQ ID NO: 1817320 - RNA, 14 nt, Human
agaugcuagaacuc

SEQ ID NO: 1817321 - RNA, 17 nt, Human
ugacccacaagaaauga

SEQ ID NO: 1817322 - RNA, 13 nt, Human
ugacccacugcuu

SEQ ID NO: 1817323 - RNA, 12 nt, Human
ugacccacugcu

SEQ ID NO: 1817324 - RNA, 15 nt, Human
agaugcuucucacug

SEQ ID NO: 1817325 - RNA, 21 nt, Human
ugacauuguuggccaaagcca

SEQ ID NO: 1817326 - RNA, 20 nt, Human
ugacauuguuggccaaagcc

SEQ ID NO: 1817327 - RNA, 22 nt, Human
ugacauuguagagcuucuggca

SEQ ID NO: 1817328 - RNA, 18 nt, Human
ugaccaauauuguacagu

SEQ ID NO: 1817329 - RNA, 17 nt, Human
ugaccaauauuguacag

SEQ ID NO: 1817330 - RNA, 21 nt, Human
ugaccaauauuguacaguuuu

SEQ ID NO: 1817331 - RNA, 19 nt, Human
ugaccaauauuguacaguu

SEQ ID NO: 1817332 - RNA, 18 nt, Human
ugaccaaugauggucacc

SEQ ID NO: 1817333 - RNA, 13 nt, Human
agaucagccuggg

SEQ ID NO: 1817334 - RNA, 15 nt, Human
agaucagccugggca

SEQ ID NO: 1817335 - RNA, 12 nt, Human
agaucauuguga

SEQ ID NO: 1817336 - RNA, 20 nt, Human
ugacagggcacaccgggcac

SEQ ID NO: 1817337 - RNA, 21 nt, Human
ugacagggcacaccgggcacu

SEQ ID NO: 1817338 - RNA, 16 nt, Human
ugacagggcacaccgg

SEQ ID NO: 1817339 - RNA, 11 nt, Human
ugacagggcac

SEQ ID NO: 1817340 - RNA, 14 nt, Human
ugacaggccugucc

SEQ ID NO: 1817341 - RNA, 21 nt, Human
ugacacacagcucuguccugg

SEQ ID NO: 1817342 - RNA, 20 nt, Human
ugacaggcaaugcuggcugu

SEQ ID NO: 1817343 - RNA, 15 nt, Human
agacucauucuucug

SEQ ID NO: 1817344 - RNA, 17 nt, Human
ucuugagccuugaacuu

SEQ ID NO: 1817345 - RNA, 21 nt, Human
agacucaguggggaggggcug

SEQ ID NO: 1817346 - RNA, 19 nt, Human
ucuugagccuugaacuuug

SEQ ID NO: 1817347 - RNA, 18 nt, Human
ucuugagccuugaacuuu

SEQ ID NO: 1817348 - RNA, 20 nt, Human
ucuugagccuugaacuuuga

SEQ ID NO: 1817349 - RNA, 22 nt, Human
agaccugccccuccucucugcc

SEQ ID NO: 1817350 - RNA, 23 nt, Human
agaccugccccuccucucugccc

SEQ ID NO: 1817351 - RNA, 16 nt, Human
agaccugccccuccuc

SEQ ID NO: 1817352 - RNA, 13 nt, Human
agaccugccccuc

SEQ ID NO: 1817353 - RNA, 14 nt, Human
agacccggcugcgu

SEQ ID NO: 1817354 - RNA, 21 nt, Human
agaccccuggcuuuucacugc

SEQ ID NO: 1817355 - RNA, 15 nt, Human
agaccccuggcuuuu

SEQ ID NO: 1817356 - RNA, 14 nt, Human
agaccccuggcuuu

SEQ ID NO: 1817357 - RNA, 23 nt, Human
ucuucuguacgucugacaggcaa

SEQ ID NO: 1817358 - RNA, 23 nt, Human
agacauacuaaccagcagaaaug

SEQ ID NO: 1817359 - RNA, 14 nt, Human
agacauagaauuaa

SEQ ID NO: 1817360 - RNA, 22 nt, Human
ucuucugcuucagccucccgag

SEQ ID NO: 1817361 - RNA, 22 nt, Human
ucuucuguacgucugacaggca

SEQ ID NO: 1817362 - RNA, 21 nt, Human
ucuucuguacgucugacaggc

SEQ ID NO: 1817363 - RNA, 17 nt, Human
ucuuauuuaaugaaaga

SEQ ID NO: 1817364 - RNA, 14 nt, Human
agagaaaaaagcca

SEQ ID NO: 1817365 - RNA, 15 nt, Human
agagacacaagccuu

SEQ ID NO: 1817366 - RNA, 24 nt, Human
agagacagaaagcagaacagugau

SEQ ID NO: 1817367 - RNA, 18 nt, Human
agacuuguaugaaagaug

SEQ ID NO: 1817368 - RNA, 19 nt, Human
agacuuuuuuuaaauagua

SEQ ID NO: 1817369 - RNA, 22 nt, Human
agagaaaaaauauuuuccugcc

SEQ ID NO: 1817370 - RNA, 20 nt, Human
agacucgcgacaaugcaaac

SEQ ID NO: 1817371 - RNA, 15 nt, Human
agacuguacaaagua

SEQ ID NO: 1817372 - RNA, 16 nt, Human
agacuguacaaaguag

SEQ ID NO: 1817373 - RNA, 15 nt, Human
agacuuccagagccu

SEQ ID NO: 1817374 - RNA, 14 nt, Human
agacugucucaaga

SEQ ID NO: 1817375 - RNA, 17 nt, Human
ucuuucuuccucugcug

SEQ ID NO: 1817376 - RNA, 15 nt, Human
ucuuucuuccucugc

SEQ ID NO: 1817377 - RNA, 16 nt, Human
ucuuucuuccucugcu

SEQ ID NO: 1817378 - RNA, 15 nt, Human
agacucgcgacaaug

SEQ ID NO: 1817379 - RNA, 17 nt, Human
agacucgcgacaaugca

SEQ ID NO: 1817380 - RNA, 18 nt, Human
agacucgcgacaaugcaa

SEQ ID NO: 1817381 - RNA, 19 nt, Human
agacucgcgacaaugcaaa

SEQ ID NO: 1817382 - RNA, 19 nt, Human
ucuuucuggcuaugcauuu

SEQ ID NO: 1817383 - RNA, 14 nt, Human
ucuuucuuccucug

SEQ ID NO: 1817384 - RNA, 22 nt, Human
ucuuucugcagaaacagaaagg

SEQ ID NO: 1817385 - RNA, 18 nt, Human
ucuuucuggcuaugcauu

SEQ ID NO: 1817386 - RNA, 20 nt, Human
ucuuuauaauucuacuuuga

SEQ ID NO: 1817387 - RNA, 13 nt, Human
ucuuucugcuuug

SEQ ID NO: 1817388 - RNA, 14 nt, Human
ucuugguuuguaaa

SEQ ID NO: 1817389 - RNA, 20 nt, Human
ucuuuaaugucacaggcagg

SEQ ID NO: 1817390 - RNA, 16 nt, Human
ucuugguuuguaaauu

SEQ ID NO: 1817391 - RNA, 22 nt, Human
ucuuuaaugucacaggcagguc

SEQ ID NO: 1817392 - RNA, 14 nt, Human
ucuuuaauuuuaca

SEQ ID NO: 1817393 - RNA, 15 nt, Human
ucuuuaguuuuugug

SEQ ID NO: 1817394 - RNA, 13 nt, Human
agacagucccugc

SEQ ID NO: 1817395 - RNA, 14 nt, Human
agacagucccugcc

SEQ ID NO: 1817396 - RNA, 15 nt, Human
agacagcugccuggg

SEQ ID NO: 1817397 - RNA, 16 nt, Human
agacagcugccuggga

SEQ ID NO: 1817398 - RNA, 12 nt, Human
agacagucccug

SEQ ID NO: 1817399 - RNA, 19 nt, Human
ucuuacugucuuuuuucua

SEQ ID NO: 1817400 - RNA, 14 nt, Human
ucuuagauguauau

SEQ ID NO: 1817401 - RNA, 12 nt, Human
ucuuagauguau

SEQ ID NO: 1817402 - RNA, 17 nt, Human
agacacaggcccggcuc

SEQ ID NO: 1817403 - RNA, 22 nt, Human
agacacaggcccggcuccaggc

SEQ ID NO: 1817404 - RNA, 21 nt, Human
agacacaggcccggcuccagg

SEQ ID NO: 1817405 - RNA, 20 nt, Human
agacacaggcccggcuccag

SEQ ID NO: 1817406 - RNA, 19 nt, Human
agacacaggcccggcucca

SEQ ID NO: 1817407 - RNA, 14 nt, Human
agacacaagccuuc

SEQ ID NO: 1817408 - RNA, 13 nt, Human
agacacaagccuu

SEQ ID NO: 1817409 - RNA, 19 nt, Human
agaauucucuaguuugauu

SEQ ID NO: 1817410 - RNA, 18 nt, Human
agaauucucuaguuugau

SEQ ID NO: 1817411 - RNA, 17 nt, Human
agaauucucuuauccaa

SEQ ID NO: 1817412 - RNA, 22 nt, Human
agacaccuugacagggcacacc

SEQ ID NO: 1817413 - RNA, 24 nt, Human
agacacauguccaagaagcccagg

SEQ ID NO: 1817414 - RNA, 19 nt, Human
agacaccuugacagggcac

SEQ ID NO: 1817415 - RNA, 23 nt, Human
agacacaggcccggcuccaggcu

SEQ ID NO: 1817416 - RNA, 21 nt, Human
agacacauguccaagaagccc

SEQ ID NO: 1817417 - RNA, 22 nt, Human
agacacauguccaagaagccca

SEQ ID NO: 1817418 - RNA, 13 nt, Human
agacagcugccug

SEQ ID NO: 1817419 - RNA, 14 nt, Human
agacagcugccugg

SEQ ID NO: 1817420 - RNA, 12 nt, Human
agacagaaaaaa

SEQ ID NO: 1817421 - RNA, 18 nt, Human
ucuguacgucugacaggc

SEQ ID NO: 1817422 - RNA, 17 nt, Human
ucuguucugcacacagc

SEQ ID NO: 1817423 - RNA, 18 nt, Human
ucuguucugcacacagca

SEQ ID NO: 1817424 - RNA, 19 nt, Human
ucuguucugcacacagcac

SEQ ID NO: 1817425 - RNA, 19 nt, Human
ucuguuuagauaauacacc

SEQ ID NO: 1817426 - RNA, 16 nt, Human
ucuguuuagauaauac

SEQ ID NO: 1817427 - RNA, 23 nt, Human
ucuguuuagauaauacaccacua

SEQ ID NO: 1817428 - RNA, 20 nt, Human
agaauuauaauuaguuccuc

SEQ ID NO: 1817429 - RNA, 20 nt, Human
agaauucucagaaucucaaa

SEQ ID NO: 1817430 - RNA, 14 nt, Human
agaauucucuaguu

SEQ ID NO: 1817431 - RNA, 23 nt, Human
ucuggguuccuuccucugagccu

SEQ ID NO: 1817432 - RNA, 22 nt, Human
ucuggguuccuuccucugagcc

SEQ ID NO: 1817433 - RNA, 19 nt, Human
agaauuaguggcacuugcu

SEQ ID NO: 1817434 - RNA, 21 nt, Human
agaauguguuuaaacuugguu

SEQ ID NO: 1817435 - RNA, 22 nt, Human
agaaauuuccacucaggucugu

SEQ ID NO: 1817436 - RNA, 16 nt, Human
agaaauuuccacucag

SEQ ID NO: 1817437 - RNA, 23 nt, Human
agaaccccaggguccuguagccc

SEQ ID NO: 1817438 - RNA, 19 nt, Human
ucucagggccuggucguuu

SEQ ID NO: 1817439 - RNA, 14 nt, Human
ucucagggccuggu

SEQ ID NO: 1817440 - RNA, 15 nt, Human
ucucagggccugguc

SEQ ID NO: 1817441 - RNA, 12 nt, Human
ucucagggccug

SEQ ID NO: 1817442 - RNA, 13 nt, Human
ucucagggccugg

SEQ ID NO: 1817443 - RNA, 16 nt, Human
ucuccaggcuguaucc

SEQ ID NO: 1817444 - RNA, 22 nt, Human
ucuccaaaauaaaacuuuuuaa

SEQ ID NO: 1817445 - RNA, 19 nt, Human
ucuccaaaauaaaacuuuu

SEQ ID NO: 1817446 - RNA, 17 nt, Human
ucuccaaaauaaaacuu

SEQ ID NO: 1817447 - RNA, 21 nt, Human
ucuccuccuuuucacaguucu

SEQ ID NO: 1817448 - RNA, 14 nt, Human
acuuugaccucugc

SEQ ID NO: 1817449 - RNA, 17 nt, Human
acuuucuagccagagga

SEQ ID NO: 1817450 - RNA, 16 nt, Human
ucuccauguuugaugu

SEQ ID NO: 1817451 - RNA, 11 nt, Human
acuucagcuga

SEQ ID NO: 1817452 - RNA, 16 nt, Human
acuucagcugacuuuu

SEQ ID NO: 1817453 - RNA, 14 nt, Human
acuucaggcucuuc

SEQ ID NO: 1817454 - RNA, 11 nt, Human
ucucacuccuu

SEQ ID NO: 1817455 - RNA, 14 nt, Human
acuucuccacccug

SEQ ID NO: 1817456 - RNA, 12 nt, Human
ucucacucuguc

SEQ ID NO: 1817457 - RNA, 16 nt, Human
ucucacucugucgccc

SEQ ID NO: 1817458 - RNA, 16 nt, Human
ucucacuauguugccc

SEQ ID NO: 1817459 - RNA, 13 nt, Human
ucucacuccuuga

SEQ ID NO: 1817460 - RNA, 15 nt, Human
acuuccugugacuuc

SEQ ID NO: 1817461 - RNA, 18 nt, Human
acuucuccacccugcucu

SEQ ID NO: 1817462 - RNA, 16 nt, Human
acuucuccacccugcu

SEQ ID NO: 1817463 - RNA, 15 nt, Human
acuucuccacccugc

SEQ ID NO: 1817464 - RNA, 20 nt, Human
acuugaacccgggaggcaga

SEQ ID NO: 1817465 - RNA, 19 nt, Human
acuugaacccgggaggcag

SEQ ID NO: 1817466 - RNA, 21 nt, Human
acuugaacccauauuuguaca

SEQ ID NO: 1817467 - RNA, 19 nt, Human
acuugagcccagagugaac

SEQ ID NO: 1817468 - RNA, 21 nt, Human
acuugaacccgggaggcagag

SEQ ID NO: 1817469 - RNA, 18 nt, Human
acuuguggacacagcucu

SEQ ID NO: 1817470 - RNA, 17 nt, Human
acuuguggacacagcuc

SEQ ID NO: 1817471 - RNA, 16 nt, Human
acuuguggacacagcu

SEQ ID NO: 1817472 - RNA, 14 nt, Human
acuugcucuugaug

SEQ ID NO: 1817473 - RNA, 15 nt, Human
ucugaagucacugca

SEQ ID NO: 1817474 - RNA, 16 nt, Human
ucugaagucacugcac

SEQ ID NO: 1817475 - RNA, 18 nt, Human
ucugaagucacugcacag

SEQ ID NO: 1817476 - RNA, 12 nt, Human
ucugacacacag

SEQ ID NO: 1817477 - RNA, 16 nt, Human
ucugacaacagacuuc

SEQ ID NO: 1817478 - RNA, 15 nt, Human
ucugacaacagacuu

SEQ ID NO: 1817479 - RNA, 18 nt, Human
agaaaugaaaaaauauau

SEQ ID NO: 1817480 - RNA, 23 nt, Human
agaaaugaaaaaauauauaucaa

SEQ ID NO: 1817481 - RNA, 14 nt, Human
agaaaugaaagcag

SEQ ID NO: 1817482 - RNA, 14 nt, Human
agaaagaaaaucag

SEQ ID NO: 1817483 - RNA, 12 nt, Human
agaaaucuaaaa

SEQ ID NO: 1817484 - RNA, 15 nt, Human
agaaaucuaaaaaac

SEQ ID NO: 1817485 - RNA, 17 nt, Human
agaaaugaaaaaauaua

SEQ ID NO: 1817486 - RNA, 14 nt, Human
agaaauauaauuga

SEQ ID NO: 1817487 - RNA, 19 nt, Human
agaaauaucugaaaaugua

SEQ ID NO: 1817488 - RNA, 20 nt, Human
agaaauaucugaaaauguau

SEQ ID NO: 1817489 - RNA, 18 nt, Human
ucugauucccaagcucug

SEQ ID NO: 1817490 - RNA, 18 nt, Human
ucugcacuccccugcugg

SEQ ID NO: 1817491 - RNA, 19 nt, Human
ucugcacuccccugcuggg

SEQ ID NO: 1817492 - RNA, 23 nt, Human
ucugaugcaagcaagaaacacug

SEQ ID NO: 1817493 - RNA, 14 nt, Human
ucugaccuuaaaug

SEQ ID NO: 1817494 - RNA, 23 nt, Human
ucugagacucgcgacaaugcaaa

SEQ ID NO: 1817495 - RNA, 18 nt, Human
ucugcaggucccuaauaa

SEQ ID NO: 1817496 - RNA, 13 nt, Human
agaaauuaugugc

SEQ ID NO: 1817497 - RNA, 21 nt, Human
agaaauuaugugccagauuua

SEQ ID NO: 1817498 - RNA, 22 nt, Human
agaaauuaugugccagauuuau

SEQ ID NO: 1817499 - RNA, 16 nt, Human
agaaauuuauaaacuu

SEQ ID NO: 1817500 - RNA, 17 nt, Human
agaaauuuauaaacuuu

SEQ ID NO: 1817501 - RNA, 15 nt, Human
ucugcaggucccuaa

SEQ ID NO: 1817502 - RNA, 16 nt, Human
ucugcaggucccuaau

SEQ ID NO: 1817503 - RNA, 17 nt, Human
ucugcaggucccuaaua

SEQ ID NO: 1817504 - RNA, 20 nt, Human
ucugcacuccccugcugggu

SEQ ID NO: 1817505 - RNA, 18 nt, Human
ucugcagcaauaaagcag

SEQ ID NO: 1817506 - RNA, 22 nt, Human
ucugcacuccccugcugggugu

SEQ ID NO: 1817507 - RNA, 15 nt, Human
ucucuggaauuugaa

SEQ ID NO: 1817508 - RNA, 19 nt, Human
ucucuggaauuugaaacac

SEQ ID NO: 1817509 - RNA, 12 nt, Human
ucucuggccuuc

SEQ ID NO: 1817510 - RNA, 17 nt, Human
ucucuccuguaccucuu

SEQ ID NO: 1817511 - RNA, 16 nt, Human
ucucuccuguaccucu

SEQ ID NO: 1817512 - RNA, 14 nt, Human
ucucuccuguaccu

SEQ ID NO: 1817513 - RNA, 11 nt, Human
ucucugcccuc

SEQ ID NO: 1817514 - RNA, 15 nt, Human
ucucugcccuccaag

SEQ ID NO: 1817515 - RNA, 16 nt, Human
ucucugcccuccaaga

SEQ ID NO: 1817516 - RNA, 17 nt, Human
ucucugcccuccaagac

SEQ ID NO: 1817517 - RNA, 13 nt, Human
ucucucacuccuu

SEQ ID NO: 1817518 - RNA, 15 nt, Human
ucucucacuccuuga

SEQ ID NO: 1817519 - RNA, 18 nt, Human
acuuugaccucugcagca

SEQ ID NO: 1817520 - RNA, 16 nt, Human
acuuugaccucugcag

SEQ ID NO: 1817521 - RNA, 15 nt, Human
acuuugaccucugca

SEQ ID NO: 1817522 - RNA, 17 nt, Human
ucucuccagccccugga

SEQ ID NO: 1817523 - RNA, 16 nt, Human
ucucuccagccccugg

SEQ ID NO: 1817524 - RNA, 18 nt, Human
ucucuccagccccuggau

SEQ ID NO: 1817525 - RNA, 19 nt, Human
ucucuccagccccuggaug

SEQ ID NO: 1817526 - RNA, 21 nt, Human
ucucuuuaaugucacaggcag

SEQ ID NO: 1817527 - RNA, 20 nt, Human
ucucuuuaaugucacaggca

SEQ ID NO: 1817528 - RNA, 13 nt, Human
agaaaaagaaaaa

SEQ ID NO: 1817529 - RNA, 14 nt, Human
ucucuugauucaua

SEQ ID NO: 1817530 - RNA, 16 nt, Human
ucucuugauucauaau

SEQ ID NO: 1817531 - RNA, 18 nt, Human
ucucuugagccugggagg

SEQ ID NO: 1817532 - RNA, 23 nt, Human
ucucuggccuucggccuccaucc

SEQ ID NO: 1817533 - RNA, 22 nt, Human
ucucuggccuucggccuccauc

SEQ ID NO: 1817534 - RNA, 21 nt, Human
ucucuggccuucggccuccau

SEQ ID NO: 1817535 - RNA, 17 nt, Human
agaaaaaggaugcacag

SEQ ID NO: 1817536 - RNA, 21 nt, Human
agaaaacuuguauuaugugug

SEQ ID NO: 1817537 - RNA, 18 nt, Human
agaaaaaggaugcacaga

SEQ ID NO: 1817538 - RNA, 19 nt, Human
agaaaacuuguauuaugug

SEQ ID NO: 1817539 - RNA, 23 nt, Human
uccuuuagcgcccaguugggugg

SEQ ID NO: 1817540 - RNA, 22 nt, Human
uccuuuagcgcccaguugggug

SEQ ID NO: 1817541 - RNA, 13 nt, Human
ucgaggacaggga

SEQ ID NO: 1817542 - RNA, 16 nt, Human
ucgcgacaaugcaaac

SEQ ID NO: 1817543 - RNA, 19 nt, Human
ucgcgacaaugcaaaccau

SEQ ID NO: 1817544 - RNA, 16 nt, Human
ucgagcaugccuggau

SEQ ID NO: 1817545 - RNA, 18 nt, Human
ucgagcaugccuggaugg

SEQ ID NO: 1817546 - RNA, 18 nt, Human
ucgcuauugucaccaggg

SEQ ID NO: 1817547 - RNA, 23 nt, Human
ucgcuagcauuucccaacacaaa

SEQ ID NO: 1817548 - RNA, 19 nt, Human
uccuuuagcgcccaguugg

SEQ ID NO: 1817549 - RNA, 15 nt, Human
uccuuuagcgcccag

SEQ ID NO: 1817550 - RNA, 21 nt, Human
uccuuuaauuuuuuacuauuu

SEQ ID NO: 1817551 - RNA, 23 nt, Human
uccuuguguuacuaaguuuuuau

SEQ ID NO: 1817552 - RNA, 14 nt, Human
uccuuguguuacua

SEQ ID NO: 1817553 - RNA, 16 nt, Human
uccuucagugccuuau

SEQ ID NO: 1817554 - RNA, 17 nt, Human
uccuucagugccuuaug

SEQ ID NO: 1817555 - RNA, 14 nt, Human
acuggccucugcug

SEQ ID NO: 1817556 - RNA, 16 nt, Human
acuggccucugcugau

SEQ ID NO: 1817557 - RNA, 14 nt, Human
uccuucagugccuu

SEQ ID NO: 1817558 - RNA, 15 nt, Human
uccuucagugccuua

SEQ ID NO: 1817559 - RNA, 14 nt, Human
acugccucuuccuc

SEQ ID NO: 1817560 - RNA, 15 nt, Human
acugccucuuccucc

SEQ ID NO: 1817561 - RNA, 16 nt, Human
acugccuauuuuaaua

SEQ ID NO: 1817562 - RNA, 21 nt, Human
acugccuauuuuaauaaacac

SEQ ID NO: 1817563 - RNA, 21 nt, Human
uccuagaaauuccccacccug

SEQ ID NO: 1817564 - RNA, 22 nt, Human
uccuagaaauuccccacccuga

SEQ ID NO: 1817565 - RNA, 16 nt, Human
acugcauaugaaagga

SEQ ID NO: 1817566 - RNA, 17 nt, Human
acugcauccuccgccuc

SEQ ID NO: 1817567 - RNA, 20 nt, Human
acugcauccuccgccucccg

SEQ ID NO: 1817568 - RNA, 20 nt, Human
acugcaucaagaugugacau

SEQ ID NO: 1817569 - RNA, 22 nt, Human
acugcaucaagaugugacaugu

SEQ ID NO: 1817570 - RNA, 23 nt, Human
acugcauccuccgccucccgggu

SEQ ID NO: 1817571 - RNA, 16 nt, Human
acugcauguuugugau

SEQ ID NO: 1817572 - RNA, 15 nt, Human
acugcauguuuguga

SEQ ID NO: 1817573 - RNA, 14 nt, Human
acugcuuuuggucu

SEQ ID NO: 1817574 - RNA, 17 nt, Human
acugcuuccagugaggc

SEQ ID NO: 1817575 - RNA, 20 nt, Human
acugcuuaacuucacauauu

SEQ ID NO: 1817576 - RNA, 15 nt, Human
acuggauuaaacuua

SEQ ID NO: 1817577 - RNA, 18 nt, Human
acugcuuaacuucacaua

SEQ ID NO: 1817578 - RNA, 14 nt, Human
acugcuggcugccu

SEQ ID NO: 1817579 - RNA, 15 nt, Human
acugcuggcugccuu

SEQ ID NO: 1817580 - RNA, 11 nt, Human
ucgggcaugac

SEQ ID NO: 1817581 - RNA, 12 nt, Human
ucgggcaugaca

SEQ ID NO: 1817582 - RNA, 17 nt, Human
ucgggaggucgaggcag

SEQ ID NO: 1817583 - RNA, 19 nt, Human
ucgggaggucgaggcagga

SEQ ID NO: 1817584 - RNA, 21 nt, Human
ucgggaggucgaggcaggagg

SEQ ID NO: 1817585 - RNA, 18 nt, Human
ucggcucacugcauccuc

SEQ ID NO: 1817586 - RNA, 13 nt, Human
ucguaaaauuaag

SEQ ID NO: 1817587 - RNA, 17 nt, Human
ucguuugaaucacagua

SEQ ID NO: 1817588 - RNA, 22 nt, Human
ucguuuucaaaauuguuacaaa

SEQ ID NO: 1817589 - RNA, 16 nt, Human
ucguaaaauuaagaaa

SEQ ID NO: 1817590 - RNA, 17 nt, Human
acuguccuacccacccu

SEQ ID NO: 1817591 - RNA, 23 nt, Human
acuguccuacccacccuccuuuc

SEQ ID NO: 1817592 - RNA, 18 nt, Human
acuguccuacccacccuc

SEQ ID NO: 1817593 - RNA, 16 nt, Human
acugggagaaaugaaa

SEQ ID NO: 1817594 - RNA, 15 nt, Human
acugugugcucagga

SEQ ID NO: 1817595 - RNA, 19 nt, Human
acugugugcucaggagccc

SEQ ID NO: 1817596 - RNA, 20 nt, Human
acugugugcucaggagcccu

SEQ ID NO: 1817597 - RNA, 21 nt, Human
acugugugcucaggagcccug

SEQ ID NO: 1817598 - RNA, 12 nt, Human
acugugugcuca

SEQ ID NO: 1817599 - RNA, 14 nt, Human
acuucagcucuguu

SEQ ID NO: 1817600 - RNA, 16 nt, Human
acuuagaaauugcauu

SEQ ID NO: 1817601 - RNA, 16 nt, Human
acuuaaucuaaaugga

SEQ ID NO: 1817602 - RNA, 15 nt, Human
acuuaaucuaaaugg

SEQ ID NO: 1817603 - RNA, 13 nt, Human
acuuaaucuaaau

SEQ ID NO: 1817604 - RNA, 18 nt, Human
acuguugcccaggcuggc

SEQ ID NO: 1817605 - RNA, 17 nt, Human
acuguugcccaggcugg

SEQ ID NO: 1817606 - RNA, 14 nt, Human
acuguugcccaggc

SEQ ID NO: 1817607 - RNA, 13 nt, Human
acuguugcccagg

SEQ ID NO: 1817608 - RNA, 12 nt, Human
acuguugcccag

SEQ ID NO: 1817609 - RNA, 15 nt, Human
acuuaaauaauguga

SEQ ID NO: 1817610 - RNA, 16 nt, Human
acuuaaauaaugugaa

SEQ ID NO: 1817611 - RNA, 18 nt, Human
acuuaaauaaugugaaac

SEQ ID NO: 1817612 - RNA, 17 nt, Human
acuuaaauaaugugaaa

SEQ ID NO: 1817613 - RNA, 20 nt, Human
ucuaaagccauuguaguccu

SEQ ID NO: 1817614 - RNA, 13 nt, Human
ucuaaagcugcca

SEQ ID NO: 1817615 - RNA, 14 nt, Human
ucuaaagcugccag

SEQ ID NO: 1817616 - RNA, 16 nt, Human
ucuaaagcugccagcc

SEQ ID NO: 1817617 - RNA, 15 nt, Human
ucuaaagcugccagc

SEQ ID NO: 1817618 - RNA, 21 nt, Human
acuguucucugcccuccaaga

SEQ ID NO: 1817619 - RNA, 15 nt, Human
acuguucucugcccu

SEQ ID NO: 1817620 - RNA, 20 nt, Human
acuguucucugcccuccaag

SEQ ID NO: 1817621 - RNA, 14 nt, Human
acuguucucugccc

SEQ ID NO: 1817622 - RNA, 12 nt, Human
acucaccccagc

SEQ ID NO: 1817623 - RNA, 21 nt, Human
acuacuagggaaaugccuuug

SEQ ID NO: 1817624 - RNA, 17 nt, Human
acuacucccccaggugg

SEQ ID NO: 1817625 - RNA, 17 nt, Human
ucccgaguagcugggac

SEQ ID NO: 1817626 - RNA, 16 nt, Human
ucccgaguagcuggga

SEQ ID NO: 1817627 - RNA, 18 nt, Human
ucccgaguagcugggacu

SEQ ID NO: 1817628 - RNA, 20 nt, Human
ucccgaguagcugagauuau

SEQ ID NO: 1817629 - RNA, 15 nt, Human
ucccgaguagcuggg

SEQ ID NO: 1817630 - RNA, 20 nt, Human
ucccgaauagcugggacuac

SEQ ID NO: 1817631 - RNA, 17 nt, Human
ucccugaaggccccgcc

SEQ ID NO: 1817632 - RNA, 16 nt, Human
ucccugaaggccccgc

SEQ ID NO: 1817633 - RNA, 13 nt, Human
ucccggcugcccu

SEQ ID NO: 1817634 - RNA, 14 nt, Human
ucccggcugcccuu

SEQ ID NO: 1817635 - RNA, 15 nt, Human
ucccggcugcccuuu

SEQ ID NO: 1817636 - RNA, 18 nt, Human
ucccggcugcccuuucug

SEQ ID NO: 1817637 - RNA, 22 nt, Human
ucccggcugcccuuucugggca

SEQ ID NO: 1817638 - RNA, 11 nt, Human
ucccugaaggc

SEQ ID NO: 1817639 - RNA, 15 nt, Human
ucccugaaggccccg

SEQ ID NO: 1817640 - RNA, 21 nt, Human
ucccucuuucccucccuuccu

SEQ ID NO: 1817641 - RNA, 18 nt, Human
ucccucuuucccucccuu

SEQ ID NO: 1817642 - RNA, 20 nt, Human
ucccucuuucccucccuucc

SEQ ID NO: 1817643 - RNA, 14 nt, Human
ucccucuuucccuc

SEQ ID NO: 1817644 - RNA, 14 nt, Human
ucccuuuuccauga

SEQ ID NO: 1817645 - RNA, 12 nt, Human
ucccuuuuccuu

SEQ ID NO: 1817646 - RNA, 17 nt, Human
uccggucccugucccag

SEQ ID NO: 1817647 - RNA, 19 nt, Human
uccuaaauauauuuuaaga

SEQ ID NO: 1817648 - RNA, 14 nt, Human
uccuacuuccccuu

SEQ ID NO: 1817649 - RNA, 16 nt, Human
uccuagaaauucccca

SEQ ID NO: 1817650 - RNA, 15 nt, Human
ucccugguggcagcu

SEQ ID NO: 1817651 - RNA, 12 nt, Human
ucccugucccag

SEQ ID NO: 1817652 - RNA, 21 nt, Human
acuccugcaggcagccaggcc

SEQ ID NO: 1817653 - RNA, 17 nt, Human
ucccuuacgugaguccu

SEQ ID NO: 1817654 - RNA, 15 nt, Human
acucauucuucugua

SEQ ID NO: 1817655 - RNA, 14 nt, Human
acucauugaccuga

SEQ ID NO: 1817656 - RNA, 15 nt, Human
acucauugaccugag

SEQ ID NO: 1817657 - RNA, 15 nt, Human
acuccagaauuuccc

SEQ ID NO: 1817658 - RNA, 17 nt, Human
acuccagaauuucccaa

SEQ ID NO: 1817659 - RNA, 14 nt, Human
acuccucuguccag

SEQ ID NO: 1817660 - RNA, 13 nt, Human
acuccucugucca

SEQ ID NO: 1817661 - RNA, 18 nt, Human
acuccugcaggcagccag

SEQ ID NO: 1817662 - RNA, 19 nt, Human
acuccugcaggcagccagg

SEQ ID NO: 1817663 - RNA, 15 nt, Human
acuccugaccucaag

SEQ ID NO: 1817664 - RNA, 17 nt, Human
acuccugcaggcagcca

SEQ ID NO: 1817665 - RNA, 23 nt, Human
acuccagaauuucccaaagcagu

SEQ ID NO: 1817666 - RNA, 12 nt, Human
acuccagccugg

SEQ ID NO: 1817667 - RNA, 13 nt, Human
acuccagccuggg

SEQ ID NO: 1817668 - RNA, 16 nt, Human
ucccaaagcagugcau

SEQ ID NO: 1817669 - RNA, 18 nt, Human
ucccaaacccuucagugc

SEQ ID NO: 1817670 - RNA, 14 nt, Human
ucccaaagugcugg

SEQ ID NO: 1817671 - RNA, 13 nt, Human
ucccaaagugcug

SEQ ID NO: 1817672 - RNA, 21 nt, Human
ucccaaagcagugcaugcugu

SEQ ID NO: 1817673 - RNA, 17 nt, Human
ucccaaagcagugcaug

SEQ ID NO: 1817674 - RNA, 18 nt, Human
ucccaaagcagugcaugc

SEQ ID NO: 1817675 - RNA, 18 nt, Human
uccaucuaaacugccccc

SEQ ID NO: 1817676 - RNA, 16 nt, Human
uccaucuaaacugccc

SEQ ID NO: 1817677 - RNA, 22 nt, Human
acgccagauucuuuccugaggc

SEQ ID NO: 1817678 - RNA, 23 nt, Human
acgccagauucuuuccugaggcu

SEQ ID NO: 1817679 - RNA, 21 nt, Human
uccauccugaggcuccacuug

SEQ ID NO: 1817680 - RNA, 20 nt, Human
uccauccugaggcuccacuu

SEQ ID NO: 1817681 - RNA, 21 nt, Human
uccaugaagauguagaggaga

SEQ ID NO: 1817682 - RNA, 13 nt, Human
uccaugaagaugu

SEQ ID NO: 1817683 - RNA, 22 nt, Human
acguauaaaagccuguuuaaga

SEQ ID NO: 1817684 - RNA, 15 nt, Human
acgguuuuacugcag

SEQ ID NO: 1817685 - RNA, 17 nt, Human
acgguuuuacugcagcu

SEQ ID NO: 1817686 - RNA, 23 nt, Human
acguggcugcuucaaggauccug

SEQ ID NO: 1817687 - RNA, 16 nt, Human
ucccacaaaggagagc

SEQ ID NO: 1817688 - RNA, 15 nt, Human
ucccaccccacacac

SEQ ID NO: 1817689 - RNA, 20 nt, Human
ucccaccccacacacgccag

SEQ ID NO: 1817690 - RNA, 13 nt, Human
ucccacagcgcug

SEQ ID NO: 1817691 - RNA, 20 nt, Human
acgggaggguaaggcugugg

SEQ ID NO: 1817692 - RNA, 15 nt, Human
ucccaucacccgcua

SEQ ID NO: 1817693 - RNA, 22 nt, Human
ucccauaugccugggcagaagg

SEQ ID NO: 1817694 - RNA, 15 nt, Human
acuacauucuguuaa

SEQ ID NO: 1817695 - RNA, 17 nt, Human
uccccaugucucgacuc

SEQ ID NO: 1817696 - RNA, 22 nt, Human
uccccaccgcagacaggaccag

SEQ ID NO: 1817697 - RNA, 17 nt, Human
uccccaccgcagacagg

SEQ ID NO: 1817698 - RNA, 18 nt, Human
uccccaccgcagacagga

SEQ ID NO: 1817699 - RNA, 21 nt, Human
uccccaccgcagacaggacca

SEQ ID NO: 1817700 - RNA, 17 nt, Human
ucccagcugugcucugg

SEQ ID NO: 1817701 - RNA, 12 nt, Human
ucccagccccaa

SEQ ID NO: 1817702 - RNA, 14 nt, Human
acuacauucuguua

SEQ ID NO: 1817703 - RNA, 13 nt, Human
acuacauucuguu

SEQ ID NO: 1817704 - RNA, 12 nt, Human
acuacauucugu

SEQ ID NO: 1817705 - RNA, 11 nt, Human
acuacauucug

SEQ ID NO: 1817706 - RNA, 15 nt, Human
acuacaguuuguuag

SEQ ID NO: 1817707 - RNA, 12 nt, Human
acuaaccacgcu

SEQ ID NO: 1817708 - RNA, 11 nt, Human
acuacaggcac

SEQ ID NO: 1817709 - RNA, 15 nt, Human
acuacaggcacccac

SEQ ID NO: 1817710 - RNA, 14 nt, Human
acuacaguuuguua

SEQ ID NO: 1817711 - RNA, 13 nt, Human
acuacaguuuguu

SEQ ID NO: 1817712 - RNA, 16 nt, Human
acgagcaggcuucuuc

SEQ ID NO: 1817713 - RNA, 19 nt, Human
acgccagauucuuuccuga

SEQ ID NO: 1817714 - RNA, 17 nt, Human
acgccagauucuuuccu

SEQ ID NO: 1817715 - RNA, 14 nt, Human
acgagaaaacaaua

SEQ ID NO: 1817716 - RNA, 22 nt, Human
accuuuuuuauacauaaacaag

SEQ ID NO: 1817717 - RNA, 21 nt, Human
accuuuuuuauacauaaacaa

SEQ ID NO: 1817718 - RNA, 21 nt, Human
uccaggcuguaucccaugagc

SEQ ID NO: 1817719 - RNA, 20 nt, Human
accuuuuuuauacauaaaca

SEQ ID NO: 1817720 - RNA, 19 nt, Human
accuuuuuuauacauaaac

SEQ ID NO: 1817721 - RNA, 14 nt, Human
uccagccccuggau

SEQ ID NO: 1817722 - RNA, 13 nt, Human
uccagccccugga

SEQ ID NO: 1817723 - RNA, 16 nt, Human
uccagagaguggcucc

SEQ ID NO: 1817724 - RNA, 17 nt, Human
uccagagaguggcuccu

SEQ ID NO: 1817725 - RNA, 15 nt, Human
uccagagaguggcuc

SEQ ID NO: 1817726 - RNA, 12 nt, Human
uccagccccugg

SEQ ID NO: 1817727 - RNA, 14 nt, Human
uccaggcuguaucc

SEQ ID NO: 1817728 - RNA, 14 nt, Human
accuuuugagugcc

SEQ ID NO: 1817729 - RNA, 17 nt, Human
accuuuugagugccuua

SEQ ID NO: 1817730 - RNA, 20 nt, Human
accuuuugagugccuuacac

SEQ ID NO: 1817731 - RNA, 19 nt, Human
uccaccuucccaugcccug

SEQ ID NO: 1817732 - RNA, 16 nt, Human
uccaccuucccaugcc

SEQ ID NO: 1817733 - RNA, 18 nt, Human
uccaccuucccaugcccu

SEQ ID NO: 1817734 - RNA, 17 nt, Human
uccacucaggucuguuu

SEQ ID NO: 1817735 - RNA, 18 nt, Human
uccagacccggcugcgug

SEQ ID NO: 1817736 - RNA, 15 nt, Human
uccagacccggcugc

SEQ ID NO: 1817737 - RNA, 19 nt, Human
uccagacccggcugcgugg

SEQ ID NO: 1817738 - RNA, 14 nt, Human
uccagagacuggga

SEQ ID NO: 1817739 - RNA, 16 nt, Human
uccagaauuucccaaa

SEQ ID NO: 1817740 - RNA, 13 nt, Human
uccacugccuucg

SEQ ID NO: 1817741 - RNA, 15 nt, Human
uccacugccuucgau

SEQ ID NO: 1817742 - RNA, 22 nt, Human
uccacugccuucgauacaccgg

SEQ ID NO: 1817743 - RNA, 20 nt, Human
uccagaauuucccaaagcag

SEQ ID NO: 1817744 - RNA, 22 nt, Human
uccagaauuucccaaagcagug

SEQ ID NO: 1817745 - RNA, 13 nt, Human
uccagacacaugu

SEQ ID NO: 1817746 - RNA, 15 nt, Human
uccacccaggagccc

SEQ ID NO: 1817747 - RNA, 14 nt, Human
uccacccaggagcc

SEQ ID NO: 1817748 - RNA, 12 nt, Human
uccacccaggag

SEQ ID NO: 1817749 - RNA, 19 nt, Human
uccacccaccucagccucc

SEQ ID NO: 1817750 - RNA, 18 nt, Human
uccacccaccucagccuc

SEQ ID NO: 1817751 - RNA, 17 nt, Human
uccacccaccucagccu

SEQ ID NO: 1817752 - RNA, 14 nt, Human
accuggccucugca

SEQ ID NO: 1817753 - RNA, 16 nt, Human
accuggccucugcacu

SEQ ID NO: 1817754 - RNA, 17 nt, Human
accuggccucugcacuc

SEQ ID NO: 1817755 - RNA, 23 nt, Human
accuggccucugcacuccccugc

SEQ ID NO: 1817756 - RNA, 18 nt, Human
accuggccucugcacucc

SEQ ID NO: 1817757 - RNA, 20 nt, Human
accuggccucugcacucccc

SEQ ID NO: 1817758 - RNA, 21 nt, Human
accuggucacaggacucugcc

SEQ ID NO: 1817759 - RNA, 19 nt, Human
accuguuucugcagccacu

SEQ ID NO: 1817760 - RNA, 18 nt, Human
accuuagacagucccugc

SEQ ID NO: 1817761 - RNA, 19 nt, Human
accuuagacagucccugcc

SEQ ID NO: 1817762 - RNA, 20 nt, Human
accuuagacagucccugcca

SEQ ID NO: 1817763 - RNA, 21 nt, Human
uccaagcuggucccacucagu

SEQ ID NO: 1817764 - RNA, 19 nt, Human
uccaaguccacaguggaac

SEQ ID NO: 1817765 - RNA, 18 nt, Human
uccaaucccaccaacccu

SEQ ID NO: 1817766 - RNA, 20 nt, Human
uccaagcuggucccacucag

SEQ ID NO: 1817767 - RNA, 16 nt, Human
uccaagcuggucccac

SEQ ID NO: 1817768 - RNA, 12 nt, Human
uccaagaagccc

SEQ ID NO: 1817769 - RNA, 12 nt, Human
accugccaggaa

SEQ ID NO: 1817770 - RNA, 14 nt, Human
accugccaggaagc

SEQ ID NO: 1817771 - RNA, 15 nt, Human
accugccaggaagcc

SEQ ID NO: 1817772 - RNA, 23 nt, Human
uccaacccucaucaccaacgucu

SEQ ID NO: 1817773 - RNA, 16 nt, Human
uccaacccucaucacc

SEQ ID NO: 1817774 - RNA, 17 nt, Human
uccaacccucaucacca

SEQ ID NO: 1817775 - RNA, 14 nt, Human
uccaacccucauca

SEQ ID NO: 1817776 - RNA, 20 nt, Human
accuacaguguacagucuug

SEQ ID NO: 1817777 - RNA, 18 nt, Human
accuacaguguacagucu

SEQ ID NO: 1817778 - RNA, 17 nt, Human
accuacaguguacaguc

SEQ ID NO: 1817779 - RNA, 16 nt, Human
accuacaguguacagu

SEQ ID NO: 1817780 - RNA, 15 nt, Human
accuacaguguacag

SEQ ID NO: 1817781 - RNA, 16 nt, Human
accuaccaccacgccc

SEQ ID NO: 1817782 - RNA, 20 nt, Human
accuaccaccacgcccggcu

SEQ ID NO: 1817783 - RNA, 12 nt, Human
ucaggaagcuca

SEQ ID NO: 1817784 - RNA, 13 nt, Human
ucaggaagcucag

SEQ ID NO: 1817785 - RNA, 14 nt, Human
ucaggaagcucagg

SEQ ID NO: 1817786 - RNA, 15 nt, Human
ucaggaagcucaggg

SEQ ID NO: 1817787 - RNA, 20 nt, Human
accuaacaacauuguagccu

SEQ ID NO: 1817788 - RNA, 12 nt, Human
accuccugccuc

SEQ ID NO: 1817789 - RNA, 13 nt, Human
accuccugccucg

SEQ ID NO: 1817790 - RNA, 23 nt, Human
accuccugccucgaacuggcugc

SEQ ID NO: 1817791 - RNA, 15 nt, Human
ucauccuaagcuauu

SEQ ID NO: 1817792 - RNA, 14 nt, Human
ucauccuucuggaa

SEQ ID NO: 1817793 - RNA, 18 nt, Human
ucauccucauacccaccc

SEQ ID NO: 1817794 - RNA, 13 nt, Human
ucauccuccucag

SEQ ID NO: 1817795 - RNA, 19 nt, Human
ucauccuccucagaucuuc

SEQ ID NO: 1817796 - RNA, 18 nt, Human
ucaucuagguaaauuaca

SEQ ID NO: 1817797 - RNA, 14 nt, Human
ucaucuaggauuuu

SEQ ID NO: 1817798 - RNA, 22 nt, Human
ucauccuucuggaauaaggaga

SEQ ID NO: 1817799 - RNA, 12 nt, Human
ucauucuucugu

SEQ ID NO: 1817800 - RNA, 12 nt, Human
ucauugaaaucu

SEQ ID NO: 1817801 - RNA, 13 nt, Human
ucauugaaaucuu

SEQ ID NO: 1817802 - RNA, 13 nt, Human
accuccugggcua

SEQ ID NO: 1817803 - RNA, 19 nt, Human
accucggugccuuccucuu

SEQ ID NO: 1817804 - RNA, 19 nt, Human
ucauugaccugaggcccuu

SEQ ID NO: 1817805 - RNA, 22 nt, Human
ucauugaaaucuuuuugcuuug

SEQ ID NO: 1817806 - RNA, 12 nt, Human
ucauugaccuga

SEQ ID NO: 1817807 - RNA, 14 nt, Human
ucauugaccugagg

SEQ ID NO: 1817808 - RNA, 15 nt, Human
ucauugaccugaggc

SEQ ID NO: 1817809 - RNA, 15 nt, Human
accugauugugucuc

SEQ ID NO: 1817810 - RNA, 17 nt, Human
accugauugugucucuu

SEQ ID NO: 1817811 - RNA, 18 nt, Human
accugauugugucucuug

SEQ ID NO: 1817812 - RNA, 22 nt, Human
accugaggcccuucucuccagc

SEQ ID NO: 1817813 - RNA, 15 nt, Human
accugaggcccuucu

SEQ ID NO: 1817814 - RNA, 16 nt, Human
accugaggcccuucuc

SEQ ID NO: 1817815 - RNA, 20 nt, Human
accugaggcccuucucucca

SEQ ID NO: 1817816 - RNA, 21 nt, Human
accugaggcccuucucuccag

SEQ ID NO: 1817817 - RNA, 14 nt, Human
accugaggcccuuc

SEQ ID NO: 1817818 - RNA, 23 nt, Human
uauuuccuauauuguuuucagug

SEQ ID NO: 1817819 - RNA, 22 nt, Human
uauuucccucaccuuucccauc

SEQ ID NO: 1817820 - RNA, 20 nt, Human
acaguugaaaaacagcugag

SEQ ID NO: 1817821 - RNA, 15 nt, Human
acaguugaaaaacag

SEQ ID NO: 1817822 - RNA, 16 nt, Human
acaguugaaaaacagc

SEQ ID NO: 1817823 - RNA, 13 nt, Human
acauacuaaccag

SEQ ID NO: 1817824 - RNA, 13 nt, Human
acauacucccauc

SEQ ID NO: 1817825 - RNA, 22 nt, Human
acauacuaaccagcagaaaugc

SEQ ID NO: 1817826 - RNA, 21 nt, Human
acauacuaaccagcagaaaug

SEQ ID NO: 1817827 - RNA, 17 nt, Human
acauacucccaucugug

SEQ ID NO: 1817828 - RNA, 14 nt, Human
acauacucugcuua

SEQ ID NO: 1817829 - RNA, 20 nt, Human
acaguuuguuaguaugaggc

SEQ ID NO: 1817830 - RNA, 16 nt, Human
acaguuuguuaguaug

SEQ ID NO: 1817831 - RNA, 15 nt, Human
acaguuuuuauugcu

SEQ ID NO: 1817832 - RNA, 16 nt, Human
acauagugaugguucc

SEQ ID NO: 1817833 - RNA, 21 nt, Human
acauagugaugguuccccugu

SEQ ID NO: 1817834 - RNA, 21 nt, Human
acauagcuuacaagccagcug

SEQ ID NO: 1817835 - RNA, 18 nt, Human
acauagaauuaacacaug

SEQ ID NO: 1817836 - RNA, 14 nt, Human
acauagaauuaaca

SEQ ID NO: 1817837 - RNA, 16 nt, Human
acauauugauuuccgu

SEQ ID NO: 1817838 - RNA, 14 nt, Human
acauauugauuucc

SEQ ID NO: 1817839 - RNA, 23 nt, Human
acauauugauuuccguuaaaaua

SEQ ID NO: 1817840 - RNA, 22 nt, Human
acauauugauuuccguuaaaau

SEQ ID NO: 1817841 - RNA, 18 nt, Human
acauauugauuuccguua

SEQ ID NO: 1817842 - RNA, 23 nt, Human
acaucucccuuuuccaugacugu

SEQ ID NO: 1817843 - RNA, 16 nt, Human
acaucaacaucuuggu

SEQ ID NO: 1817844 - RNA, 18 nt, Human
acaucaacaucuugguca

SEQ ID NO: 1817845 - RNA, 13 nt, Human
acaucaacagaua

SEQ ID NO: 1817846 - RNA, 14 nt, Human
acaucuugcucugc

SEQ ID NO: 1817847 - RNA, 13 nt, Human
acaucuugcucug

SEQ ID NO: 1817848 - RNA, 19 nt, Human
acaucuugcucugcugaca

SEQ ID NO: 1817849 - RNA, 18 nt, Human
acaucuugcucugcugac

SEQ ID NO: 1817850 - RNA, 21 nt, Human
acaucuugcucugcugacaga

SEQ ID NO: 1817851 - RNA, 17 nt, Human
acaugaaaacacauuuu

SEQ ID NO: 1817852 - RNA, 19 nt, Human
acaugaaaacacauuuuuc

SEQ ID NO: 1817853 - RNA, 18 nt, Human
acaugaaaacacauuuuu

SEQ ID NO: 1817854 - RNA, 11 nt, Human
ucaaguauuau

SEQ ID NO: 1817855 - RNA, 15 nt, Human
ucaaguauuauaccu

SEQ ID NO: 1817856 - RNA, 21 nt, Human
ucaaguauuauaccuuuuuua

SEQ ID NO: 1817857 - RNA, 16 nt, Human
ucaaguauuauaccuu

SEQ ID NO: 1817858 - RNA, 23 nt, Human
ucaaguauuauaccuuuuuuaga

SEQ ID NO: 1817859 - RNA, 19 nt, Human
ucaagaauagcauuguaaa

SEQ ID NO: 1817860 - RNA, 15 nt, Human
ucaagacuuccagag

SEQ ID NO: 1817861 - RNA, 16 nt, Human
ucaacagguuuuccug

SEQ ID NO: 1817862 - RNA, 17 nt, Human
ucaaauuucuaaaucuc

SEQ ID NO: 1817863 - RNA, 12 nt, Human
acauucuguuaa

SEQ ID NO: 1817864 - RNA, 16 nt, Human
ucaaauuucuaaaucu

SEQ ID NO: 1817865 - RNA, 15 nt, Human
ucaaauuucuaaauc

SEQ ID NO: 1817866 - RNA, 15 nt, Human
acauucuguuaauca

SEQ ID NO: 1817867 - RNA, 21 nt, Human
acauguccaagaagcccagga

SEQ ID NO: 1817868 - RNA, 18 nt, Human
acauuagcaguuugcuuu

SEQ ID NO: 1817869 - RNA, 22 nt, Human
acauuagcaguuugcuuuguau

SEQ ID NO: 1817870 - RNA, 22 nt, Human
ucaaauacauuuaaaacauuaa

SEQ ID NO: 1817871 - RNA, 21 nt, Human
ucaaauacauuuaaaacauua

SEQ ID NO: 1817872 - RNA, 18 nt, Human
ucaaauaacuaaaaggua

SEQ ID NO: 1817873 - RNA, 20 nt, Human
acaugagcaucaggccaggc

SEQ ID NO: 1817874 - RNA, 22 nt, Human
acaugcuacacacugcauguuu

SEQ ID NO: 1817875 - RNA, 15 nt, Human
acaugaucuucuuua

SEQ ID NO: 1817876 - RNA, 17 nt, Human
acaugaucuucuuuaua

SEQ ID NO: 1817877 - RNA, 17 nt, Human
acaugagcaucaggcca

SEQ ID NO: 1817878 - RNA, 18 nt, Human
acaugagcaucaggccag

SEQ ID NO: 1817879 - RNA, 19 nt, Human
acaugagcaucaggccagg

SEQ ID NO: 1817880 - RNA, 19 nt, Human
acaugauccugcaauucca

SEQ ID NO: 1817881 - RNA, 14 nt, Human
ucaaagcugaaaug

SEQ ID NO: 1817882 - RNA, 16 nt, Human
ucaaaauuguuacaaa

SEQ ID NO: 1817883 - RNA, 19 nt, Human
ucaaaauuguuacaaauug

SEQ ID NO: 1817884 - RNA, 14 nt, Human
ucaaaaguuuguuu

SEQ ID NO: 1817885 - RNA, 13 nt, Human
ucaaaaguuuguu

SEQ ID NO: 1817886 - RNA, 18 nt, Human
ucaaaagaaagaaaauca

SEQ ID NO: 1817887 - RNA, 23 nt, Human
accauuucuugagguaaaagcau

SEQ ID NO: 1817888 - RNA, 11 nt, Human
acccacugcuc

SEQ ID NO: 1817889 - RNA, 10 nt, Human
acccacugcu

SEQ ID NO: 1817890 - RNA, 11 nt, Human
acccacugcuu

SEQ ID NO: 1817891 - RNA, 15 nt, Human
acccacugcucuggu

SEQ ID NO: 1817892 - RNA, 14 nt, Human
acccacugcucugg

SEQ ID NO: 1817893 - RNA, 13 nt, Human
acccacugcucug

SEQ ID NO: 1817894 - RNA, 22 nt, Human
accauggucggaaaacaugcua

SEQ ID NO: 1817895 - RNA, 23 nt, Human
ucacucuuauugcccacgcugga

SEQ ID NO: 1817896 - RNA, 21 nt, Human
ucacucuuauugcccacgcug

SEQ ID NO: 1817897 - RNA, 15 nt, Human
ucacuccuaccuggu

SEQ ID NO: 1817898 - RNA, 19 nt, Human
ucagaaguuucucagcucc

SEQ ID NO: 1817899 - RNA, 19 nt, Human
ucagaaguuucugccgcag

SEQ ID NO: 1817900 - RNA, 22 nt, Human
ucagaaguuucugccgcagccc

SEQ ID NO: 1817901 - RNA, 14 nt, Human
ucagaagacacuga

SEQ ID NO: 1817902 - RNA, 18 nt, Human
ucagagccugcaguuauu

SEQ ID NO: 1817903 - RNA, 15 nt, Human
ucagagccugcaguu

SEQ ID NO: 1817904 - RNA, 14 nt, Human
ucagagccugcagu

SEQ ID NO: 1817905 - RNA, 13 nt, Human
ucagagccugcag

SEQ ID NO: 1817906 - RNA, 12 nt, Human
ucagagccugca

SEQ ID NO: 1817907 - RNA, 23 nt, Human
ucagagagggugggagugggccc

SEQ ID NO: 1817908 - RNA, 16 nt, Human
ucagagagggugggag

SEQ ID NO: 1817909 - RNA, 21 nt, Human
ucagagagggugggagugggc

SEQ ID NO: 1817910 - RNA, 17 nt, Human
ucagaaucucucuucuu

SEQ ID NO: 1817911 - RNA, 18 nt, Human
ucagaaucucaaauaacu

SEQ ID NO: 1817912 - RNA, 19 nt, Human
ucagaaucucaaauaacua

SEQ ID NO: 1817913 - RNA, 21 nt, Human
ucagagacuccugcaggcagc

SEQ ID NO: 1817914 - RNA, 17 nt, Human
ucagagacuccugcagg

SEQ ID NO: 1817915 - RNA, 20 nt, Human
ucagagacuccugcaggcag

SEQ ID NO: 1817916 - RNA, 23 nt, Human
accccagcuggggccaggcuggg

SEQ ID NO: 1817917 - RNA, 24 nt, Human
acccagcgagcccugguggcagug

SEQ ID NO: 1817918 - RNA, 22 nt, Human
ucagccaagaauucuuaaauau

SEQ ID NO: 1817919 - RNA, 23 nt, Human
acccagcgagcccugguggcagu

SEQ ID NO: 1817920 - RNA, 19 nt, Human
acccagcgagcccuggugg

SEQ ID NO: 1817921 - RNA, 23 nt, Human
ucagccguguaaccauggaccca

SEQ ID NO: 1817922 - RNA, 14 nt, Human
ucagcggggacagc

SEQ ID NO: 1817923 - RNA, 13 nt, Human
ucagcucacugca

SEQ ID NO: 1817924 - RNA, 16 nt, Human
ucagcucacugcaacc

SEQ ID NO: 1817925 - RNA, 20 nt, Human
ucagcuuguaaauagcucag

SEQ ID NO: 1817926 - RNA, 12 nt, Human
ucagcucaugga

SEQ ID NO: 1817927 - RNA, 15 nt, Human
accccuucgcuccug

SEQ ID NO: 1817928 - RNA, 14 nt, Human
accccuucgcuccu

SEQ ID NO: 1817929 - RNA, 16 nt, Human
accccuucgcuccugu

SEQ ID NO: 1817930 - RNA, 17 nt, Human
accccuguaggccucag

SEQ ID NO: 1817931 - RNA, 16 nt, Human
accccuguaggccuca

SEQ ID NO: 1817932 - RNA, 15 nt, Human
accccuguaggccuc

SEQ ID NO: 1817933 - RNA, 12 nt, Human
acccccacccaa

SEQ ID NO: 1817934 - RNA, 20 nt, Human
ucacuauguugcccaggcag

SEQ ID NO: 1817935 - RNA, 19 nt, Human
ucacuauguugcccaggca

SEQ ID NO: 1817936 - RNA, 18 nt, Human
ucacuauguugcccaggc

SEQ ID NO: 1817937 - RNA, 17 nt, Human
accagagcccaccuugg

SEQ ID NO: 1817938 - RNA, 14 nt, Human
accagccuccaugc

SEQ ID NO: 1817939 - RNA, 19 nt, Human
accagccuccaugcugccu

SEQ ID NO: 1817940 - RNA, 20 nt, Human
accagccuccaugcugccuc

SEQ ID NO: 1817941 - RNA, 21 nt, Human
accagccuccaugcugccucc

SEQ ID NO: 1817942 - RNA, 14 nt, Human
accagggacugagg

SEQ ID NO: 1817943 - RNA, 16 nt, Human
ucaccugaagacucau

SEQ ID NO: 1817944 - RNA, 15 nt, Human
ucaccucucccuugg

SEQ ID NO: 1817945 - RNA, 15 nt, Human
ucaccugccccucaa

SEQ ID NO: 1817946 - RNA, 13 nt, Human
ucaccugccccuc

SEQ ID NO: 1817947 - RNA, 14 nt, Human
accagacaccuuga

SEQ ID NO: 1817948 - RNA, 16 nt, Human
accagagcccaccuug

SEQ ID NO: 1817949 - RNA, 14 nt, Human
accagagcccaccu

SEQ ID NO: 1817950 - RNA, 12 nt, Human
accagagcccac

SEQ ID NO: 1817951 - RNA, 22 nt, Human
accacuuuuguucuugguuugu

SEQ ID NO: 1817952 - RNA, 17 nt, Human
ucaccccggccaccugc

SEQ ID NO: 1817953 - RNA, 18 nt, Human
ucaccccggccaccugcg

SEQ ID NO: 1817954 - RNA, 17 nt, Human
accacugcacuccagcc

SEQ ID NO: 1817955 - RNA, 20 nt, Human
accacugcacuccagccugg

SEQ ID NO: 1817956 - RNA, 15 nt, Human
accacugcucugaug

SEQ ID NO: 1817957 - RNA, 17 nt, Human
accacugcucugaugaa

SEQ ID NO: 1817958 - RNA, 23 nt, Human
accacugcucugaugaagaggag

SEQ ID NO: 1817959 - RNA, 21 nt, Human
accacugcacuccagccuggg

SEQ ID NO: 1817960 - RNA, 22 nt, Human
ucaccccggccaccugcggugc

SEQ ID NO: 1817961 - RNA, 21 nt, Human
accacuuuuguucuugguuug

SEQ ID NO: 1817962 - RNA, 16 nt, Human
accacuuuuguucuug

SEQ ID NO: 1817963 - RNA, 15 nt, Human
accacuuuuguucuu

SEQ ID NO: 1817964 - RNA, 15 nt, Human
ucaauucuugccaaa

SEQ ID NO: 1817965 - RNA, 14 nt, Human
accacacuccagcu

SEQ ID NO: 1817966 - RNA, 15 nt, Human
ucaagugaaaaagga

SEQ ID NO: 1817967 - RNA, 17 nt, Human
ucaagugauucucaugc

SEQ ID NO: 1817968 - RNA, 23 nt, Human
ucaagugaaaaaggaggaagaga

SEQ ID NO: 1817969 - RNA, 20 nt, Human
ucaagugauucucaugccuc

SEQ ID NO: 1817970 - RNA, 19 nt, Human
accaacauacucccaucug

SEQ ID NO: 1817971 - RNA, 21 nt, Human
accaacauacucccaucugug

SEQ ID NO: 1817972 - RNA, 22 nt, Human
accaacauacucccaucuguga

SEQ ID NO: 1817973 - RNA, 17 nt, Human
accaauauuguacaguu

SEQ ID NO: 1817974 - RNA, 16 nt, Human
accaauauuguacagu

SEQ ID NO: 1817975 - RNA, 15 nt, Human
accaauauuguacag

SEQ ID NO: 1817976 - RNA, 19 nt, Human
accaauauuguacaguuuu

SEQ ID NO: 1817977 - RNA, 18 nt, Human
accaauauuguacaguuu

SEQ ID NO: 1817978 - RNA, 15 nt, Human
accaauguucucucu

SEQ ID NO: 1817979 - RNA, 15 nt, Human
ucacaguucucuccu

SEQ ID NO: 1817980 - RNA, 15 nt, Human
ucacauaucugucau

SEQ ID NO: 1817981 - RNA, 12 nt, Human
ucacauaucugu

SEQ ID NO: 1817982 - RNA, 22 nt, Human
ucacacgucuggcuucacagau

SEQ ID NO: 1817983 - RNA, 16 nt, Human
ucacaacaaccugguc

SEQ ID NO: 1817984 - RNA, 15 nt, Human
ucaccccggccaccu

SEQ ID NO: 1817985 - RNA, 13 nt, Human
ucaccccagcccc

SEQ ID NO: 1817986 - RNA, 14 nt, Human
ucaccccagcccca

SEQ ID NO: 1817987 - RNA, 20 nt, Human
ucaccccagccccaaaacuc

SEQ ID NO: 1817988 - RNA, 18 nt, Human
uaguucagguaacaggca

SEQ ID NO: 1817989 - RNA, 10 nt, Human
uaguuuuugu

SEQ ID NO: 1817990 - RNA, 20 nt, Human
uauaaaaauaaaaaacacug

SEQ ID NO: 1817991 - RNA, 21 nt, Human
uauaaaaauaaaaaacacugg

SEQ ID NO: 1817992 - RNA, 14 nt, Human
uauaaaagacugac

SEQ ID NO: 1817993 - RNA, 13 nt, Human
acacccagcccac

SEQ ID NO: 1817994 - RNA, 12 nt, Human
acacccagccca

SEQ ID NO: 1817995 - RNA, 13 nt, Human
acacauuuuauuu

SEQ ID NO: 1817996 - RNA, 21 nt, Human
acacauguccaagaagcccag

SEQ ID NO: 1817997 - RNA, 22 nt, Human
acacauguccaagaagcccagg

SEQ ID NO: 1817998 - RNA, 13 nt, Human
acacauguccaag

SEQ ID NO: 1817999 - RNA, 18 nt, Human
acacauguccaagaagcc

SEQ ID NO: 1818000 - RNA, 19 nt, Human
acacauguccaagaagccc

SEQ ID NO: 1818001 - RNA, 18 nt, Human
acaccucugcacaagcug

SEQ ID NO: 1818002 - RNA, 16 nt, Human
acaccuugacagggca

SEQ ID NO: 1818003 - RNA, 15 nt, Human
acaccuugacagggc

SEQ ID NO: 1818004 - RNA, 14 nt, Human
acaccuugacaggg

SEQ ID NO: 1818005 - RNA, 19 nt, Human
acaccucugcacaagcugc

SEQ ID NO: 1818006 - RNA, 19 nt, Human
acacuaaccacgcuggacc

SEQ ID NO: 1818007 - RNA, 17 nt, Human
acacuaaccacgcugga

SEQ ID NO: 1818008 - RNA, 16 nt, Human
acacuaaccacgcugg

SEQ ID NO: 1818009 - RNA, 19 nt, Human
uauaacuauguugauaaaa

SEQ ID NO: 1818010 - RNA, 22 nt, Human
uauaaccaguguuguggauuua

SEQ ID NO: 1818011 - RNA, 15 nt, Human
acaaugguuuucuug

SEQ ID NO: 1818012 - RNA, 21 nt, Human
acaaugguuuucuuguguguu

SEQ ID NO: 1818013 - RNA, 14 nt, Human
acacacacauacac

SEQ ID NO: 1818014 - RNA, 12 nt, Human
acacacagcucu

SEQ ID NO: 1818015 - RNA, 11 nt, Human
acacacagcuc

SEQ ID NO: 1818016 - RNA, 13 nt, Human
acacagugagucg

SEQ ID NO: 1818017 - RNA, 17 nt, Human
acacagugaccauacua

SEQ ID NO: 1818018 - RNA, 21 nt, Human
uagguuggcaaaaaggcagga

SEQ ID NO: 1818019 - RNA, 11 nt, Human
acacagugagu

SEQ ID NO: 1818020 - RNA, 19 nt, Human
acacagucuuggcucacug

SEQ ID NO: 1818021 - RNA, 13 nt, Human
uaguagagacagg

SEQ ID NO: 1818022 - RNA, 20 nt, Human
acagauguaaaagacuuuuu

SEQ ID NO: 1818023 - RNA, 23 nt, Human
acagaugggugcuuggaggaagg

SEQ ID NO: 1818024 - RNA, 20 nt, Human
acagauacuccuccaagguu

SEQ ID NO: 1818025 - RNA, 20 nt, Human
acagauagauauaugcucug

SEQ ID NO: 1818026 - RNA, 22 nt, Human
acagaguuguuacauuuuuaag

SEQ ID NO: 1818027 - RNA, 21 nt, Human
acagaguuguuacauuuuuaa

SEQ ID NO: 1818028 - RNA, 20 nt, Human
uaugaaagauggcugugccu

SEQ ID NO: 1818029 - RNA, 22 nt, Human
uaugaaagauggcugugccucu

SEQ ID NO: 1818030 - RNA, 23 nt, Human
uaugaaagauggcugugccucug

SEQ ID NO: 1818031 - RNA, 16 nt, Human
acagcaaggagauuua

SEQ ID NO: 1818032 - RNA, 21 nt, Human
acagcccgggcucugccuccc

SEQ ID NO: 1818033 - RNA, 22 nt, Human
acagcccgggcucugccuccca

SEQ ID NO: 1818034 - RNA, 23 nt, Human
acagcccgggcucugccucccau

SEQ ID NO: 1818035 - RNA, 16 nt, Human
acagaguuguuacauu

SEQ ID NO: 1818036 - RNA, 20 nt, Human
acagaguuguuacauuuuua

SEQ ID NO: 1818037 - RNA, 19 nt, Human
acagaguuguuacauuuuu

SEQ ID NO: 1818038 - RNA, 18 nt, Human
acagaguuguuacauuuu

SEQ ID NO: 1818039 - RNA, 17 nt, Human
acagaguuguuacauuu

SEQ ID NO: 1818040 - RNA, 21 nt, Human
acagagcaagugagacccugu

SEQ ID NO: 1818041 - RNA, 14 nt, Human
acagagcccacgcc

SEQ ID NO: 1818042 - RNA, 14 nt, Human
uauccuacuucccc

SEQ ID NO: 1818043 - RNA, 17 nt, Human
uauccuacuuccccuuc

SEQ ID NO: 1818044 - RNA, 13 nt, Human
uaucucagggccu

SEQ ID NO: 1818045 - RNA, 15 nt, Human
uaucucagggccugg

SEQ ID NO: 1818046 - RNA, 16 nt, Human
uaucccggcugcccuu

SEQ ID NO: 1818047 - RNA, 20 nt, Human
uaucccuacuguaauuugug

SEQ ID NO: 1818048 - RNA, 19 nt, Human
uaucccuacuguaauuugu

SEQ ID NO: 1818049 - RNA, 12 nt, Human
uauauuuacaaa

SEQ ID NO: 1818050 - RNA, 17 nt, Human
acagacacaggcccggc

SEQ ID NO: 1818051 - RNA, 19 nt, Human
acagaaagcagaacaguga

SEQ ID NO: 1818052 - RNA, 22 nt, Human
acagacacaggcccggcuccag

SEQ ID NO: 1818053 - RNA, 18 nt, Human
acagacacaggcccggcu

SEQ ID NO: 1818054 - RNA, 22 nt, Human
acagacuggaagcacagcuuca

SEQ ID NO: 1818055 - RNA, 21 nt, Human
acagacuggaagcacagcuuc

SEQ ID NO: 1818056 - RNA, 19 nt, Human
acagacuggaagcacagcu

SEQ ID NO: 1818057 - RNA, 17 nt, Human
acagacuggaagcacag

SEQ ID NO: 1818058 - RNA, 23 nt, Human
acacuguuucaaacuuuacuaug

SEQ ID NO: 1818059 - RNA, 15 nt, Human
acacuguuucaaacu

SEQ ID NO: 1818060 - RNA, 16 nt, Human
acacuguuucaaacuu

SEQ ID NO: 1818061 - RNA, 15 nt, Human
acacuuaaaaauggu

SEQ ID NO: 1818062 - RNA, 13 nt, Human
acacuuaaaaaug

SEQ ID NO: 1818063 - RNA, 20 nt, Human
acacuuguugauuaauggaa

SEQ ID NO: 1818064 - RNA, 23 nt, Human
acacuuguugauuaauggaaaug

SEQ ID NO: 1818065 - RNA, 11 nt, Human
acacucugaga

SEQ ID NO: 1818066 - RNA, 13 nt, Human
acacucugagacu

SEQ ID NO: 1818067 - RNA, 14 nt, Human
acacuccagugaga

SEQ ID NO: 1818068 - RNA, 22 nt, Human
acacuguucucugcccuccaag

SEQ ID NO: 1818069 - RNA, 23 nt, Human
acacuguucucugcccuccaaga

SEQ ID NO: 1818070 - RNA, 16 nt, Human
acacuguucucugccc

SEQ ID NO: 1818071 - RNA, 17 nt, Human
acacuguucucugcccu

SEQ ID NO: 1818072 - RNA, 18 nt, Human
acacuguucucugcccuc

SEQ ID NO: 1818073 - RNA, 20 nt, Human
acacuguucucugcccucca

SEQ ID NO: 1818074 - RNA, 14 nt, Human
acacuguucucugc

SEQ ID NO: 1818075 - RNA, 15 nt, Human
acacuguucucugcc

SEQ ID NO: 1818076 - RNA, 22 nt, Human
aauuuauaaacuuuuuucuuac

SEQ ID NO: 1818077 - RNA, 17 nt, Human
aauuuauuauggcacau

SEQ ID NO: 1818078 - RNA, 14 nt, Human
aauuuauuauggca

SEQ ID NO: 1818079 - RNA, 13 nt, Human
aauuuauuauggc

SEQ ID NO: 1818080 - RNA, 15 nt, Human
aauuuacauacucug

SEQ ID NO: 1818081 - RNA, 17 nt, Human
aauuuaccugaagucuu

SEQ ID NO: 1818082 - RNA, 18 nt, Human
aauuuacagagacagaaa

SEQ ID NO: 1818083 - RNA, 17 nt, Human
aauuuacagagacagaa

SEQ ID NO: 1818084 - RNA, 15 nt, Human
aauuugaaacacuuu

SEQ ID NO: 1818085 - RNA, 18 nt, Human
uacuucuccacccugcuc

SEQ ID NO: 1818086 - RNA, 13 nt, Human
uacuucuccaccc

SEQ ID NO: 1818087 - RNA, 23 nt, Human
uacuuccugugacuucagcucug

SEQ ID NO: 1818088 - RNA, 14 nt, Human
uacuuccccuuccu

SEQ ID NO: 1818089 - RNA, 15 nt, Human
uacuuccccuuccua

SEQ ID NO: 1818090 - RNA, 18 nt, Human
uacuuccccuuccuaauu

SEQ ID NO: 1818091 - RNA, 20 nt, Human
uacuuccccuuccuaauucc

SEQ ID NO: 1818092 - RNA, 15 nt, Human
uacuucugcuacaua

SEQ ID NO: 1818093 - RNA, 20 nt, Human
uacuucuccacccugcucuc

SEQ ID NO: 1818094 - RNA, 16 nt, Human
uacuucuuauacauuu

SEQ ID NO: 1818095 - RNA, 14 nt, Human
uacuucuuauacau

SEQ ID NO: 1818096 - RNA, 15 nt, Human
uacuucuuauacauu

SEQ ID NO: 1818097 - RNA, 23 nt, Human
uacuuugauauuuucaacgcagc

SEQ ID NO: 1818098 - RNA, 15 nt, Human
uacuugaaaauuaac

SEQ ID NO: 1818099 - RNA, 16 nt, Human
uacgucugacaggcaa

SEQ ID NO: 1818100 - RNA, 13 nt, Human
uacgugaguccug

SEQ ID NO: 1818101 - RNA, 14 nt, Human
uacuaaaaauacaa

SEQ ID NO: 1818102 - RNA, 18 nt, Human
uacuaaaaauacaaaaaa

SEQ ID NO: 1818103 - RNA, 18 nt, Human
uacuagggaaaugccuuu

SEQ ID NO: 1818104 - RNA, 22 nt, Human
uacucuacccucuuagaaaaac

SEQ ID NO: 1818105 - RNA, 15 nt, Human
uacgucugacaggca

SEQ ID NO: 1818106 - RNA, 24 nt, Human
uacgcuccaucgcugucaucucag

SEQ ID NO: 1818107 - RNA, 19 nt, Human
uacuguacagacagaaaaa

SEQ ID NO: 1818108 - RNA, 23 nt, Human
uacuguacagacagaaaaaacug

SEQ ID NO: 1818109 - RNA, 18 nt, Human
uacuguacaugaaaacac

SEQ ID NO: 1818110 - RNA, 21 nt, Human
aauugacuuauuuauauaaau

SEQ ID NO: 1818111 - RNA, 15 nt, Human
uacuguaauuuguga

SEQ ID NO: 1818112 - RNA, 17 nt, Human
uacuguaauuugugaua

SEQ ID NO: 1818113 - RNA, 16 nt, Human
uacuguaauuugugau

SEQ ID NO: 1818114 - RNA, 19 nt, Human
uacugagagugaacaaauu

SEQ ID NO: 1818115 - RNA, 17 nt, Human
uacugagagugaacaaa

SEQ ID NO: 1818116 - RNA, 14 nt, Human
acaaaacuuuucua

SEQ ID NO: 1818117 - RNA, 18 nt, Human
acaaagcccuuccauguc

SEQ ID NO: 1818118 - RNA, 21 nt, Human
acaaagcgugguggacaugca

SEQ ID NO: 1818119 - RNA, 22 nt, Human
uagauaggucagugcaaauacu

SEQ ID NO: 1818120 - RNA, 22 nt, Human
aauuuuuaaucuuuaauuuuac

SEQ ID NO: 1818121 - RNA, 22 nt, Human
aauuuuuuuaucgucacugcuu

SEQ ID NO: 1818122 - RNA, 16 nt, Human
aauuuguuauaaugaa

SEQ ID NO: 1818123 - RNA, 13 nt, Human
uacuuuuuccugg

SEQ ID NO: 1818124 - RNA, 18 nt, Human
acaaucucggcucacugc

SEQ ID NO: 1818125 - RNA, 20 nt, Human
acaaucucggcucacugcau

SEQ ID NO: 1818126 - RNA, 18 nt, Human
acaagcgugagccacugc

SEQ ID NO: 1818127 - RNA, 22 nt, Human
acaagcuccaagcucccaggca

SEQ ID NO: 1818128 - RNA, 15 nt, Human
acaagcuccaagcuc

SEQ ID NO: 1818129 - RNA, 16 nt, Human
acaagcuccaagcucc

SEQ ID NO: 1818130 - RNA, 17 nt, Human
acaagcuccaagcuccc

SEQ ID NO: 1818131 - RNA, 19 nt, Human
acaagcuccaagcucccag

SEQ ID NO: 1818132 - RNA, 16 nt, Human
uagcuacuaauuuuaa

SEQ ID NO: 1818133 - RNA, 16 nt, Human
uagcucaggugucccu

SEQ ID NO: 1818134 - RNA, 17 nt, Human
acaagcgugagccacug

SEQ ID NO: 1818135 - RNA, 13 nt, Human
acaagcuccaagc

SEQ ID NO: 1818136 - RNA, 18 nt, Human
acaagaccacguuucuaa

SEQ ID NO: 1818137 - RNA, 17 nt, Human
acaagaccacguuucua

SEQ ID NO: 1818138 - RNA, 14 nt, Human
acaagacacaguga

SEQ ID NO: 1818139 - RNA, 16 nt, Human
acaagaccacguuucu

SEQ ID NO: 1818140 - RNA, 18 nt, Human
acaagagcuuaacagugu

SEQ ID NO: 1818141 - RNA, 19 nt, Human
acaagagcuuaacagugug

SEQ ID NO: 1818142 - RNA, 22 nt, Human
acaagagcccaggccuccuaca

SEQ ID NO: 1818143 - RNA, 21 nt, Human
acaaauucugucucuggauua

SEQ ID NO: 1818144 - RNA, 17 nt, Human
acaaauuuacagagaca

SEQ ID NO: 1818145 - RNA, 13 nt, Human
acaagacacagug

SEQ ID NO: 1818146 - RNA, 17 nt, Human
acaacaucuuuuucuac

SEQ ID NO: 1818147 - RNA, 15 nt, Human
aauaacgauaaaaga

SEQ ID NO: 1818148 - RNA, 21 nt, Human
aauaacaaugaaaguugauaa

SEQ ID NO: 1818149 - RNA, 16 nt, Human
aauaaauugcuccuug

SEQ ID NO: 1818150 - RNA, 20 nt, Human
aauaaauugcuccuugacau

SEQ ID NO: 1818151 - RNA, 18 nt, Human
aauaaaacuuuuuaaaau

SEQ ID NO: 1818152 - RNA, 15 nt, Human
aauaaaacuuuuuaa

SEQ ID NO: 1818153 - RNA, 14 nt, Human
aauaaaacuuuuua

SEQ ID NO: 1818154 - RNA, 12 nt, Human
aauaaaacuuuu

SEQ ID NO: 1818155 - RNA, 16 nt, Human
aauaaaucauaaaacu

SEQ ID NO: 1818156 - RNA, 15 nt, Human
aaguuuuguaaauuu

SEQ ID NO: 1818157 - RNA, 20 nt, Human
aaguuuuuauggcuuuugug

SEQ ID NO: 1818158 - RNA, 22 nt, Human
uaaagguucaugcaaacuuuau

SEQ ID NO: 1818159 - RNA, 19 nt, Human
uaaaguaaaaacaaagaaa

SEQ ID NO: 1818160 - RNA, 21 nt, Human
uaaaguaaaaacaaagaaauu

SEQ ID NO: 1818161 - RNA, 22 nt, Human
uaaaguaaaaacaaagaaauua

SEQ ID NO: 1818162 - RNA, 18 nt, Human
uaaaucuccaaaauaaaa

SEQ ID NO: 1818163 - RNA, 15 nt, Human
uaaaucuccaaaaua

SEQ ID NO: 1818164 - RNA, 14 nt, Human
uaaaucuccaaaau

SEQ ID NO: 1818165 - RNA, 19 nt, Human
uaaaugcaaccauuugaaa

SEQ ID NO: 1818166 - RNA, 23 nt, Human
uaaaugcaccuggaauauauaac

SEQ ID NO: 1818167 - RNA, 15 nt, Human
uaaauguugaaagau

SEQ ID NO: 1818168 - RNA, 20 nt, Human
uaaauguugaaagaucaaaa

SEQ ID NO: 1818169 - RNA, 24 nt, Human
uaaauguuuuuuuuuaaagacuuu

SEQ ID NO: 1818170 - RNA, 14 nt, Human
uaaauuaacuuuua

SEQ ID NO: 1818171 - RNA, 12 nt, Human
uaaauuaacuuu

SEQ ID NO: 1818172 - RNA, 16 nt, Human
uaaauuaacuuuuaua

SEQ ID NO: 1818173 - RNA, 15 nt, Human
uaaauuaacuuuuau

SEQ ID NO: 1818174 - RNA, 17 nt, Human
uaaauuaacuuuuauaa

SEQ ID NO: 1818175 - RNA, 18 nt, Human
uaaauuaacuuuuauaaa

SEQ ID NO: 1818176 - RNA, 12 nt, Human
uaaauaaaguuu

SEQ ID NO: 1818177 - RNA, 21 nt, Human
uaaauaaaguuuguugaaaca

SEQ ID NO: 1818178 - RNA, 19 nt, Human
uaaauaaugugaaacugga

SEQ ID NO: 1818179 - RNA, 15 nt, Human
aauaauuuuguaaug

SEQ ID NO: 1818180 - RNA, 14 nt, Human
aauaauuuuguaau

SEQ ID NO: 1818181 - RNA, 13 nt, Human
aauaauuuuguaa

SEQ ID NO: 1818182 - RNA, 12 nt, Human
aauaacuuuuuu

SEQ ID NO: 1818183 - RNA, 14 nt, Human
aauauuguacaguu

SEQ ID NO: 1818184 - RNA, 13 nt, Human
aauauuguacagu

SEQ ID NO: 1818185 - RNA, 11 nt, Human
aauauugcuga

SEQ ID NO: 1818186 - RNA, 12 nt, Human
aauauugcugau

SEQ ID NO: 1818187 - RNA, 13 nt, Human
aauauugcugaug

SEQ ID NO: 1818188 - RNA, 15 nt, Human
aauauugcugauggu

SEQ ID NO: 1818189 - RNA, 18 nt, Human
aauauugcugauggugca

SEQ ID NO: 1818190 - RNA, 21 nt, Human
aauauugcugauggugcaaug

SEQ ID NO: 1818191 - RNA, 22 nt, Human
aauauugcugauggugcaauga

SEQ ID NO: 1818192 - RNA, 18 nt, Human
aauauugauaugcuuaua

SEQ ID NO: 1818193 - RNA, 15 nt, Human
aauaugcacacauuu

SEQ ID NO: 1818194 - RNA, 16 nt, Human
aauaucugaaaaugua

SEQ ID NO: 1818195 - RNA, 17 nt, Human
aauaucugaaaauguau

SEQ ID NO: 1818196 - RNA, 18 nt, Human
aauaucugaaaauguaug

SEQ ID NO: 1818197 - RNA, 19 nt, Human
aauaucugaaaauguaugu

SEQ ID NO: 1818198 - RNA, 20 nt, Human
aauaucugaaaauguaugug

SEQ ID NO: 1818199 - RNA, 19 nt, Human
aauaucuuuuuuuuaauaa

SEQ ID NO: 1818200 - RNA, 17 nt, Human
uaagacauuuuuggaag

SEQ ID NO: 1818201 - RNA, 19 nt, Human
uaacuuuuauaaacuuuac

SEQ ID NO: 1818202 - RNA, 18 nt, Human
uaacuuuuauaaacuuua

SEQ ID NO: 1818203 - RNA, 17 nt, Human
uaacuuuuauaaacuuu

SEQ ID NO: 1818204 - RNA, 15 nt, Human
uaacuuuuauaaacu

SEQ ID NO: 1818205 - RNA, 20 nt, Human
uaacuaaaauaauuuuguaa

SEQ ID NO: 1818206 - RNA, 21 nt, Human
uaacuaaaauaauuuuguaau

SEQ ID NO: 1818207 - RNA, 18 nt, Human
aauaggcguaacuaauuu

SEQ ID NO: 1818208 - RNA, 19 nt, Human
aauaggaaaaacugauuuu

SEQ ID NO: 1818209 - RNA, 17 nt, Human
aauaggaaaaacugauu

SEQ ID NO: 1818210 - RNA, 18 nt, Human
aauaggaaaaacugauuu

SEQ ID NO: 1818211 - RNA, 16 nt, Human
aauagcuuuaaugaua

SEQ ID NO: 1818212 - RNA, 15 nt, Human
aauagcuuuaaugau

SEQ ID NO: 1818213 - RNA, 15 nt, Human
aauaggaaaaacuga

SEQ ID NO: 1818214 - RNA, 16 nt, Human
aauaggaaaaacugau

SEQ ID NO: 1818215 - RNA, 18 nt, Human
aauagacccacaagaggc

SEQ ID NO: 1818216 - RNA, 16 nt, Human
aauagacagcaugaga

SEQ ID NO: 1818217 - RNA, 23 nt, Human
aauagacaauuuauuauggcaca

SEQ ID NO: 1818218 - RNA, 18 nt, Human
aauagacaauuuauuaug

SEQ ID NO: 1818219 - RNA, 14 nt, Human
aauagcugggacua

SEQ ID NO: 1818220 - RNA, 13 nt, Human
aauagcugggacu

SEQ ID NO: 1818221 - RNA, 20 nt, Human
aauagccugccucuucucua

SEQ ID NO: 1818222 - RNA, 16 nt, Human
aauagaugcugacugu

SEQ ID NO: 1818223 - RNA, 14 nt, Human
uaacuaaaagguau

SEQ ID NO: 1818224 - RNA, 19 nt, Human
uaacuaaaauaauuuugua

SEQ ID NO: 1818225 - RNA, 18 nt, Human
uaacuaaaauaauuuugu

SEQ ID NO: 1818226 - RNA, 12 nt, Human
uaacuaaaauaa

SEQ ID NO: 1818227 - RNA, 15 nt, Human
uaacuaaaagguaug

SEQ ID NO: 1818228 - RNA, 16 nt, Human
uaacauggaaguacua

SEQ ID NO: 1818229 - RNA, 15 nt, Human
uaacauggaaguacu

SEQ ID NO: 1818230 - RNA, 14 nt, Human
uaacauggaaguac

SEQ ID NO: 1818231 - RNA, 14 nt, Human
uaacaugauuuggg

SEQ ID NO: 1818232 - RNA, 15 nt, Human
aaucuaaauggaacc

SEQ ID NO: 1818233 - RNA, 13 nt, Human
aaucuaaauggaa

SEQ ID NO: 1818234 - RNA, 18 nt, Human
aaucuaaauggaaccacu

SEQ ID NO: 1818235 - RNA, 12 nt, Human
aaucuaaaugga

SEQ ID NO: 1818236 - RNA, 14 nt, Human
aaucuuauaauuua

SEQ ID NO: 1818237 - RNA, 16 nt, Human
aaucuuauaauuuaaa

SEQ ID NO: 1818238 - RNA, 14 nt, Human
aaucucaaauuucu

SEQ ID NO: 1818239 - RNA, 12 nt, Human
aaucucaaauuu

SEQ ID NO: 1818240 - RNA, 15 nt, Human
aaucucaaauaacua

SEQ ID NO: 1818241 - RNA, 15 nt, Human
aaucaucaagucuuu

SEQ ID NO: 1818242 - RNA, 17 nt, Human
uaauaaaaguacauguu

SEQ ID NO: 1818243 - RNA, 17 nt, Human
aaucauggugcucagag

SEQ ID NO: 1818244 - RNA, 14 nt, Human
aaucagacuaugaa

SEQ ID NO: 1818245 - RNA, 17 nt, Human
aaucagacuaugaaguu

SEQ ID NO: 1818246 - RNA, 12 nt, Human
aaucagcauucu

SEQ ID NO: 1818247 - RNA, 20 nt, Human
uaaguuuuuauggcuuuugu

SEQ ID NO: 1818248 - RNA, 20 nt, Human
uaaugacaggccuguccaac

SEQ ID NO: 1818249 - RNA, 15 nt, Human
uaaugacaggccugu

SEQ ID NO: 1818250 - RNA, 22 nt, Human
uaaugaaagacuguacaaagua

SEQ ID NO: 1818251 - RNA, 23 nt, Human
uaaugaaagacuguacaaaguag

SEQ ID NO: 1818252 - RNA, 15 nt, Human
uaaugacuuaagcac

SEQ ID NO: 1818253 - RNA, 21 nt, Human
uaaugacuuaagcacacuuga

SEQ ID NO: 1818254 - RNA, 14 nt, Human
uaaugaaagacugu

SEQ ID NO: 1818255 - RNA, 17 nt, Human
uaaugaaagacuguaca

SEQ ID NO: 1818256 - RNA, 18 nt, Human
uaaugaaagacuguacaa

SEQ ID NO: 1818257 - RNA, 19 nt, Human
uaaugaaagacuguacaaa

SEQ ID NO: 1818258 - RNA, 21 nt, Human
uaauagcgucauaacuagaac

SEQ ID NO: 1818259 - RNA, 13 nt, Human
aaucuucugaacu

SEQ ID NO: 1818260 - RNA, 20 nt, Human
aaucuucugaacuuggcgcu

SEQ ID NO: 1818261 - RNA, 13 nt, Human
uaaugaggaaacu

SEQ ID NO: 1818262 - RNA, 15 nt, Human
aaugaaaaccacauu

SEQ ID NO: 1818263 - RNA, 15 nt, Human
aaugacaggccuguc

SEQ ID NO: 1818264 - RNA, 17 nt, Human
aaugacuuacuguacau

SEQ ID NO: 1818265 - RNA, 14 nt, Human
aaugacuuacugua

SEQ ID NO: 1818266 - RNA, 18 nt, Human
aaugacuuacuguacaug

SEQ ID NO: 1818267 - RNA, 15 nt, Human
aaugagccuggcaag

SEQ ID NO: 1818268 - RNA, 19 nt, Human
aauggacuuuuguacauag

SEQ ID NO: 1818269 - RNA, 21 nt, Human
aauggacguguuaugacucca

SEQ ID NO: 1818270 - RNA, 19 nt, Human
uacacauuuuucagauaua

SEQ ID NO: 1818271 - RNA, 21 nt, Human
uacacauuuuucagauauaaa

SEQ ID NO: 1818272 - RNA, 17 nt, Human
uacacauuuuucagaua

SEQ ID NO: 1818273 - RNA, 15 nt, Human
uacacauuuuucaga

SEQ ID NO: 1818274 - RNA, 18 nt, Human
uacaccacuacauucugu

SEQ ID NO: 1818275 - RNA, 17 nt, Human
uacaccacuacauucug

SEQ ID NO: 1818276 - RNA, 16 nt, Human
uacaccacuacauucu

SEQ ID NO: 1818277 - RNA, 15 nt, Human
uacaccacuacauuc

SEQ ID NO: 1818278 - RNA, 20 nt, Human
uacaccacuacauucuguua

SEQ ID NO: 1818279 - RNA, 19 nt, Human
uacaccacuacauucuguu

SEQ ID NO: 1818280 - RNA, 17 nt, Human
uacaggcuccugccacc

SEQ ID NO: 1818281 - RNA, 14 nt, Human
uacaggcuccugcc

SEQ ID NO: 1818282 - RNA, 15 nt, Human
uacaggcuccugcca

SEQ ID NO: 1818283 - RNA, 22 nt, Human
uacaggcgugagccaccgugcc

SEQ ID NO: 1818284 - RNA, 18 nt, Human
uacagaggccaugggccu

SEQ ID NO: 1818285 - RNA, 15 nt, Human
uacaggcauagaguu

SEQ ID NO: 1818286 - RNA, 14 nt, Human
uacacuccagugag

SEQ ID NO: 1818287 - RNA, 11 nt, Human
aaugugauaug

SEQ ID NO: 1818288 - RNA, 14 nt, Human
aauguggcuccugg

SEQ ID NO: 1818289 - RNA, 14 nt, Human
aaugugacucaaga

SEQ ID NO: 1818290 - RNA, 14 nt, Human
aauguacugcauau

SEQ ID NO: 1818291 - RNA, 18 nt, Human
aauguacugcauaugaaa

SEQ ID NO: 1818292 - RNA, 12 nt, Human
aauguaugugua

SEQ ID NO: 1818293 - RNA, 14 nt, Human
aauguauguguaag

SEQ ID NO: 1818294 - RNA, 17 nt, Human
uacauaaugcgugcaua

SEQ ID NO: 1818295 - RNA, 15 nt, Human
uacaguaucucaggg

SEQ ID NO: 1818296 - RNA, 20 nt, Human
uacauaaugcgugcauacca

SEQ ID NO: 1818297 - RNA, 19 nt, Human
uacauaaugcgugcauacc

SEQ ID NO: 1818298 - RNA, 21 nt, Human
uacauaaugcgugcauaccac

SEQ ID NO: 1818299 - RNA, 12 nt, Human
aauguacugcau

SEQ ID NO: 1818300 - RNA, 19 nt, Human
uacauauaagugauugcug

SEQ ID NO: 1818301 - RNA, 14 nt, Human
aaugcccagccccu

SEQ ID NO: 1818302 - RNA, 15 nt, Human
aaugcccagccccuu

SEQ ID NO: 1818303 - RNA, 16 nt, Human
aaugcauaaaauguua

SEQ ID NO: 1818304 - RNA, 13 nt, Human
aaugcauaaaaug

SEQ ID NO: 1818305 - RNA, 14 nt, Human
uacaaggacagccc

SEQ ID NO: 1818306 - RNA, 13 nt, Human
aaugcugugcccu

SEQ ID NO: 1818307 - RNA, 21 nt, Human
aaugcugugcccuaaagugua

SEQ ID NO: 1818308 - RNA, 20 nt, Human
aaugcugugcccuaaagugu

SEQ ID NO: 1818309 - RNA, 20 nt, Human
aaugcccagccccuucugac

SEQ ID NO: 1818310 - RNA, 22 nt, Human
aaugcccagccccuucugaccc

SEQ ID NO: 1818311 - RNA, 23 nt, Human
aaugcccagccccuucugaccca

SEQ ID NO: 1818312 - RNA, 24 nt, Human
aaugcccagccccuucugacccau

SEQ ID NO: 1818313 - RNA, 16 nt, Human
aauggacguguuauga

SEQ ID NO: 1818314 - RNA, 14 nt, Human
uaauuccacagcug

SEQ ID NO: 1818315 - RNA, 17 nt, Human
uaauuccacagcugcuc

SEQ ID NO: 1818316 - RNA, 13 nt, Human
uaauuccacagcu

SEQ ID NO: 1818317 - RNA, 15 nt, Human
uacaaaagcauguga

SEQ ID NO: 1818318 - RNA, 20 nt, Human
uacaaaaagcauaaaaauua

SEQ ID NO: 1818319 - RNA, 15 nt, Human
gugccucaagagaag

SEQ ID NO: 1818320 - RNA, 21 nt, Human
gugaaccaccacacccagccc

SEQ ID NO: 1818321 - RNA, 13 nt, Human
gugccucugccug

SEQ ID NO: 1818322 - RNA, 12 nt, Human
gugccucuggga

SEQ ID NO: 1818323 - RNA, 13 nt, Human
gugccucugggac

SEQ ID NO: 1818324 - RNA, 15 nt, Human
gugccucugccuguc

SEQ ID NO: 1818325 - RNA, 14 nt, Human
gugccucugggacu

SEQ ID NO: 1818326 - RNA, 14 nt, Human
gugccuuauggaac

SEQ ID NO: 1818327 - RNA, 21 nt, Human
gugccuuauggaacacucuga

SEQ ID NO: 1818328 - RNA, 23 nt, Human
gugccuuauggaacacucugaga

SEQ ID NO: 1818329 - RNA, 13 nt, Human
aacuuuaccuuuu

SEQ ID NO: 1818330 - RNA, 12 nt, Human
aacuugggaacu

SEQ ID NO: 1818331 - RNA, 11 nt, Human
gugccuuaugg

SEQ ID NO: 1818332 - RNA, 15 nt, Human
aacuuguauuaugug

SEQ ID NO: 1818333 - RNA, 16 nt, Human
aacuuguauuaugugu

SEQ ID NO: 1818334 - RNA, 22 nt, Human
aacuugucuuuggacccugagg

SEQ ID NO: 1818335 - RNA, 18 nt, Human
aacuugucuuuggacccu

SEQ ID NO: 1818336 - RNA, 23 nt, Human
aagaauagcauuguaaaagcauu

SEQ ID NO: 1818337 - RNA, 18 nt, Human
aagaauagcauuguaaaa

SEQ ID NO: 1818338 - RNA, 17 nt, Human
aagaauagcauuguaaa

SEQ ID NO: 1818339 - RNA, 17 nt, Human
aagaauagcuuuaauga

SEQ ID NO: 1818340 - RNA, 18 nt, Human
gugcuaggaacacuccuu

SEQ ID NO: 1818341 - RNA, 22 nt, Human
gugcuaggaacacuccuucaca

SEQ ID NO: 1818342 - RNA, 21 nt, Human
gugcuaucucccccagcccca

SEQ ID NO: 1818343 - RNA, 22 nt, Human
aagaagugaaaaucuacacucc

SEQ ID NO: 1818344 - RNA, 16 nt, Human
aagaagugaaaaucua

SEQ ID NO: 1818345 - RNA, 13 nt, Human
aagaaauauaccu

SEQ ID NO: 1818346 - RNA, 20 nt, Human
aagaaagacuaucuaaaugu

SEQ ID NO: 1818347 - RNA, 22 nt, Human
aagaaagacuaucuaaauguug

SEQ ID NO: 1818348 - RNA, 13 nt, Human
aagaaagaaaauc

SEQ ID NO: 1818349 - RNA, 18 nt, Human
aagaaaaaggaugcacag

SEQ ID NO: 1818350 - RNA, 17 nt, Human
aagaaaaaggaugcaca

SEQ ID NO: 1818351 - RNA, 15 nt, Human
aagaaaaaggaugca

SEQ ID NO: 1818352 - RNA, 21 nt, Human
guggaugccugguggcagcug

SEQ ID NO: 1818353 - RNA, 21 nt, Human
guggauggaaggggcugacag

SEQ ID NO: 1818354 - RNA, 22 nt, Human
guggacacagcucuucuccagg

SEQ ID NO: 1818355 - RNA, 18 nt, Human
guggacacagcucuucuc

SEQ ID NO: 1818356 - RNA, 23 nt, Human
guggacacagcucuucuccaggc

SEQ ID NO: 1818357 - RNA, 20 nt, Human
gugcugggauuacaggugug

SEQ ID NO: 1818358 - RNA, 19 nt, Human
guggaaguaguggagcccc

SEQ ID NO: 1818359 - RNA, 20 nt, Human
gugcugggauuacaggcgug

SEQ ID NO: 1818360 - RNA, 22 nt, Human
gugcugggauuacaagcgugag

SEQ ID NO: 1818361 - RNA, 21 nt, Human
gugcugggauuacaagcguga

SEQ ID NO: 1818362 - RNA, 15 nt, Human
gugcucaggagcccu

SEQ ID NO: 1818363 - RNA, 12 nt, Human
gugcuauguucu

SEQ ID NO: 1818364 - RNA, 22 nt, Human
gugcuaucucccccagccccau

SEQ ID NO: 1818365 - RNA, 19 nt, Human
guggauuuaacagaaaugu

SEQ ID NO: 1818366 - RNA, 18 nt, Human
guggauuuaacagaaaug

SEQ ID NO: 1818367 - RNA, 20 nt, Human
guggauuuaacagaaaugua

SEQ ID NO: 1818368 - RNA, 19 nt, Human
guggcaccagcagccugga

SEQ ID NO: 1818369 - RNA, 20 nt, Human
guggcagcucaccucucccu

SEQ ID NO: 1818370 - RNA, 14 nt, Human
guggcagcucaccu

SEQ ID NO: 1818371 - RNA, 16 nt, Human
guggcagcucaccucu

SEQ ID NO: 1818372 - RNA, 16 nt, Human
aagaauugaagcagga

SEQ ID NO: 1818373 - RNA, 18 nt, Human
guguguaugcgugugugu

SEQ ID NO: 1818374 - RNA, 23 nt, Human
guguuuccuggcacugcuuccag

SEQ ID NO: 1818375 - RNA, 18 nt, Human
gugucuuuuuucacuaca

SEQ ID NO: 1818376 - RNA, 17 nt, Human
gugugaaaaugugugug

SEQ ID NO: 1818377 - RNA, 17 nt, Human
gugugacuacuccccca

SEQ ID NO: 1818378 - RNA, 18 nt, Human
gugucuugcaauggcagc

SEQ ID NO: 1818379 - RNA, 17 nt, Human
gugucuugcaauggcag

SEQ ID NO: 1818380 - RNA, 18 nt, Human
aagagguuuuaaaaaaau

SEQ ID NO: 1818381 - RNA, 17 nt, Human
gugguuuucuguucuuu

SEQ ID NO: 1818382 - RNA, 20 nt, Human
guggugguuuucuguucuuu

SEQ ID NO: 1818383 - RNA, 12 nt, Human
aagaugcagccg

SEQ ID NO: 1818384 - RNA, 12 nt, Human
aagcaaaggaga

SEQ ID NO: 1818385 - RNA, 13 nt, Human
aagcaaaggagau

SEQ ID NO: 1818386 - RNA, 15 nt, Human
aagcaagauuucaga

SEQ ID NO: 1818387 - RNA, 22 nt, Human
aagcaaagacuuuccucuuagu

SEQ ID NO: 1818388 - RNA, 14 nt, Human
aagaugugacaugu

SEQ ID NO: 1818389 - RNA, 18 nt, Human
aagaugugacauguuuua

SEQ ID NO: 1818390 - RNA, 14 nt, Human
guggguacgggagg

SEQ ID NO: 1818391 - RNA, 20 nt, Human
gugggggaucacagccucug

SEQ ID NO: 1818392 - RNA, 14 nt, Human
guggugguuuucug

SEQ ID NO: 1818393 - RNA, 16 nt, Human
gugguuucagaaaugu

SEQ ID NO: 1818394 - RNA, 13 nt, Human
gugggagugggcc

SEQ ID NO: 1818395 - RNA, 14 nt, Human
gugggagugggccc

SEQ ID NO: 1818396 - RNA, 13 nt, Human
gugggauccucca

SEQ ID NO: 1818397 - RNA, 23 nt, Human
guggcgcagcauauucaggaagc

SEQ ID NO: 1818398 - RNA, 22 nt, Human
gugggacacccugugauggggc

SEQ ID NO: 1818399 - RNA, 16 nt, Human
aagacuaucuaaaugu

SEQ ID NO: 1818400 - RNA, 17 nt, Human
aagacuaucuaaauguu

SEQ ID NO: 1818401 - RNA, 22 nt, Human
aagacccuuguggucccacccc

SEQ ID NO: 1818402 - RNA, 18 nt, Human
aagacccuugugguccca

SEQ ID NO: 1818403 - RNA, 21 nt, Human
aagacccuuguggucccaccc

SEQ ID NO: 1818404 - RNA, 22 nt, Human
aagacugaguacguugugcauu

SEQ ID NO: 1818405 - RNA, 21 nt, Human
aagacugaguacguugugcau

SEQ ID NO: 1818406 - RNA, 17 nt, Human
aagacuguacaaaguag

SEQ ID NO: 1818407 - RNA, 17 nt, Human
aagacugaguacguugu

SEQ ID NO: 1818408 - RNA, 18 nt, Human
aagacuaucuaaauguug

SEQ ID NO: 1818409 - RNA, 18 nt, Human
guggcccgacagccuggc

SEQ ID NO: 1818410 - RNA, 19 nt, Human
guggcccgacagccuggca

SEQ ID NO: 1818411 - RNA, 16 nt, Human
aagagcuuaacagugu

SEQ ID NO: 1818412 - RNA, 16 nt, Human
aaggguaucaggugcu

SEQ ID NO: 1818413 - RNA, 17 nt, Human
aaggguaucaggugcug

SEQ ID NO: 1818414 - RNA, 13 nt, Human
aaguaaaaacaaa

SEQ ID NO: 1818415 - RNA, 20 nt, Human
aaguaaaaacaaagaaauua

SEQ ID NO: 1818416 - RNA, 22 nt, Human
aaguaaaaacaaagaaauuaug

SEQ ID NO: 1818417 - RNA, 12 nt, Human
aaguaauaugca

SEQ ID NO: 1818418 - RNA, 19 nt, Human
guuucuaaaggcuaccuuu

SEQ ID NO: 1818419 - RNA, 16 nt, Human
aaguaauaugcacaca

SEQ ID NO: 1818420 - RNA, 15 nt, Human
aaguaauaugcacac

SEQ ID NO: 1818421 - RNA, 13 nt, Human
aagggccuggccu

SEQ ID NO: 1818422 - RNA, 23 nt, Human
aaggggaauguuugccucugccu

SEQ ID NO: 1818423 - RNA, 22 nt, Human
aaggggaauguuugccucugcc

SEQ ID NO: 1818424 - RNA, 19 nt, Human
aagggccuggccugagcug

SEQ ID NO: 1818425 - RNA, 14 nt, Human
aagggccuggccug

SEQ ID NO: 1818426 - RNA, 17 nt, Human
aagggccuggccugagc

SEQ ID NO: 1818427 - RNA, 16 nt, Human
guuugccucugccucu

SEQ ID NO: 1818428 - RNA, 13 nt, Human
guuugccucugcc

SEQ ID NO: 1818429 - RNA, 22 nt, Human
guuucugucguuaaaaacagau

SEQ ID NO: 1818430 - RNA, 22 nt, Human
guuugauucagacagcugccug

SEQ ID NO: 1818431 - RNA, 23 nt, Human
guuucuaaaggcuaccuuuguau

SEQ ID NO: 1818432 - RNA, 22 nt, Human
guuucuaaaggcuaccuuugua

SEQ ID NO: 1818433 - RNA, 17 nt, Human
guuucugucguuaaaaa

SEQ ID NO: 1818434 - RNA, 18 nt, Human
guuuggggaugagaaagg

SEQ ID NO: 1818435 - RNA, 20 nt, Human
guuugggccccagaggcugg

SEQ ID NO: 1818436 - RNA, 23 nt, Human
guuuuacaauaaaaucuugaaaa

SEQ ID NO: 1818437 - RNA, 15 nt, Human
guuuuacugcagcuu

SEQ ID NO: 1818438 - RNA, 20 nt, Human
guuuucuuaaccagaucauu

SEQ ID NO: 1818439 - RNA, 12 nt, Human
guuuucuguucu

SEQ ID NO: 1818440 - RNA, 11 nt, Human
guuuucuguuc

SEQ ID NO: 1818441 - RNA, 13 nt, Human
guuggguggaugc

SEQ ID NO: 1818442 - RNA, 18 nt, Human
guuggucccccuuccaug

SEQ ID NO: 1818443 - RNA, 12 nt, Human
guuguauucauu

SEQ ID NO: 1818444 - RNA, 18 nt, Human
guuguaccgcaaugugac

SEQ ID NO: 1818445 - RNA, 20 nt, Human
guuuaagacauuuuuggaag

SEQ ID NO: 1818446 - RNA, 21 nt, Human
guugcccaggcuggcgugcag

SEQ ID NO: 1818447 - RNA, 19 nt, Human
guugcccaggcaggucuug

SEQ ID NO: 1818448 - RNA, 18 nt, Human
guugcccaggcaggucuu

SEQ ID NO: 1818449 - RNA, 17 nt, Human
guugcccaggcaggucu

SEQ ID NO: 1818450 - RNA, 14 nt, Human
aaggcuccaggagc

SEQ ID NO: 1818451 - RNA, 18 nt, Human
aaggccaaaggaagcaca

SEQ ID NO: 1818452 - RNA, 19 nt, Human
aaggcuaccuuuguauucu

SEQ ID NO: 1818453 - RNA, 23 nt, Human
guugaugaucuuugcagacaggc

SEQ ID NO: 1818454 - RNA, 21 nt, Human
guugaugccugugaacugaac

SEQ ID NO: 1818455 - RNA, 14 nt, Human
aaggauccugagcc

SEQ ID NO: 1818456 - RNA, 15 nt, Human
aaggauccugagcca

SEQ ID NO: 1818457 - RNA, 17 nt, Human
aaggauccugagccaga

SEQ ID NO: 1818458 - RNA, 18 nt, Human
aaggaugaucuaggaaga

SEQ ID NO: 1818459 - RNA, 23 nt, Human
aaggaugaucuaggaagacuuug

SEQ ID NO: 1818460 - RNA, 19 nt, Human
aaggaugccccgucccccu

SEQ ID NO: 1818461 - RNA, 19 nt, Human
aaggaugcuuguacauaau

SEQ ID NO: 1818462 - RNA, 17 nt, Human
aaggaugcuuguacaua

SEQ ID NO: 1818463 - RNA, 16 nt, Human
aaggaugcuuguacau

SEQ ID NO: 1818464 - RNA, 15 nt, Human
aaggaugcuuguaca

SEQ ID NO: 1818465 - RNA, 18 nt, Human
aaggaugcacagaguugu

SEQ ID NO: 1818466 - RNA, 22 nt, Human
aaggaugcacagaguuguuaca

SEQ ID NO: 1818467 - RNA, 20 nt, Human
guuaguaugaggcauuuguu

SEQ ID NO: 1818468 - RNA, 17 nt, Human
guuaguaugaggcauuu

SEQ ID NO: 1818469 - RNA, 16 nt, Human
guuagauuaagaaaua

SEQ ID NO: 1818470 - RNA, 13 nt, Human
guuagauuaagaa

SEQ ID NO: 1818471 - RNA, 22 nt, Human
guuaaguugauggugaugaaau

SEQ ID NO: 1818472 - RNA, 18 nt, Human
guuaaugauagcuacugu

SEQ ID NO: 1818473 - RNA, 12 nt, Human
guuaauaaaagu

SEQ ID NO: 1818474 - RNA, 18 nt, Human
guguuuuaaaaugagaaa

SEQ ID NO: 1818475 - RNA, 12 nt, Human
guuaagccuuug

SEQ ID NO: 1818476 - RNA, 13 nt, Human
guuaagccuuugg

SEQ ID NO: 1818477 - RNA, 16 nt, Human
guuaagccuuuggaaa

SEQ ID NO: 1818478 - RNA, 17 nt, Human
guucagcuccagcucac

SEQ ID NO: 1818479 - RNA, 16 nt, Human
guucagcuccagcuca

SEQ ID NO: 1818480 - RNA, 18 nt, Human
guucagcuccagcucacc

SEQ ID NO: 1818481 - RNA, 19 nt, Human
guucaggguuggccccugc

SEQ ID NO: 1818482 - RNA, 18 nt, Human
guucaggguuggccccug

SEQ ID NO: 1818483 - RNA, 17 nt, Human
guucaggguuggccccu

SEQ ID NO: 1818484 - RNA, 22 nt, Human
aagcuaggccuggccagaugca

SEQ ID NO: 1818485 - RNA, 18 nt, Human
aagcuaggccuggccaga

SEQ ID NO: 1818486 - RNA, 17 nt, Human
aagcuaggccuggccag

SEQ ID NO: 1818487 - RNA, 19 nt, Human
aagccuccuccagccgcca

SEQ ID NO: 1818488 - RNA, 13 nt, Human
guucucuccuucu

SEQ ID NO: 1818489 - RNA, 20 nt, Human
guucccuuugacgccauccc

SEQ ID NO: 1818490 - RNA, 21 nt, Human
guucccuuugacgccauccca

SEQ ID NO: 1818491 - RNA, 22 nt, Human
guucccuuugacgccaucccag

SEQ ID NO: 1818492 - RNA, 16 nt, Human
guucuacccaggugcu

SEQ ID NO: 1818493 - RNA, 22 nt, Human
guugaugaucuuugcagacagg

SEQ ID NO: 1818494 - RNA, 17 nt, Human
guucuuaguuugcaguu

SEQ ID NO: 1818495 - RNA, 19 nt, Human
guucuuaguugcuguaugu

SEQ ID NO: 1818496 - RNA, 21 nt, Human
guucuugguuuguaaauuaac

SEQ ID NO: 1818497 - RNA, 14 nt, Human
guucuucaucuaag

SEQ ID NO: 1818498 - RNA, 20 nt, Human
guuccauggccucuucagau

SEQ ID NO: 1818499 - RNA, 20 nt, Human
guucccauuugcuccuuucu

SEQ ID NO: 1818500 - RNA, 16 nt, Human
guucccauuugcuccu

SEQ ID NO: 1818501 - RNA, 20 nt, Human
guucccuacuuccugugacu

SEQ ID NO: 1818502 - RNA, 17 nt, Human
aagcuaucguaaaauua

SEQ ID NO: 1818503 - RNA, 22 nt, Human
aagcuauucaguaauaacucua

SEQ ID NO: 1818504 - RNA, 21 nt, Human
aagcucuacugaggugcuaug

SEQ ID NO: 1818505 - RNA, 17 nt, Human
aacauugcaauagaaau

SEQ ID NO: 1818506 - RNA, 16 nt, Human
aacauuguagccucaa

SEQ ID NO: 1818507 - RNA, 20 nt, Human
aacauuuguucuauagcuuu

SEQ ID NO: 1818508 - RNA, 16 nt, Human
aacauugcaauagaaa

SEQ ID NO: 1818509 - RNA, 15 nt, Human
aacauugcaauagaa

SEQ ID NO: 1818510 - RNA, 14 nt, Human
aacauugcaauaga

SEQ ID NO: 1818511 - RNA, 14 nt, Human
aacauacucccauc

SEQ ID NO: 1818512 - RNA, 15 nt, Human
aacauacucccaucu

SEQ ID NO: 1818513 - RNA, 22 nt, Human
aacaguagugauaguuguaccg

SEQ ID NO: 1818514 - RNA, 23 nt, Human
aacaggcugggcuucaguggcag

SEQ ID NO: 1818515 - RNA, 13 nt, Human
aacaggcugggcu

SEQ ID NO: 1818516 - RNA, 22 nt, Human
aacaggcugggcuucaguggca

SEQ ID NO: 1818517 - RNA, 19 nt, Human
aacagacuggaagcacagc

SEQ ID NO: 1818518 - RNA, 21 nt, Human
guccggucccugucccagugc

SEQ ID NO: 1818519 - RNA, 15 nt, Human
gucccaacuuguaaa

SEQ ID NO: 1818520 - RNA, 13 nt, Human
guccgagcuuuga

SEQ ID NO: 1818521 - RNA, 21 nt, Human
aacagaaauguacagcaagga

SEQ ID NO: 1818522 - RNA, 11 nt, Human
aacagaaaugu

SEQ ID NO: 1818523 - RNA, 10 nt, Human
aacagaaaug

SEQ ID NO: 1818524 - RNA, 23 nt, Human
aacaaggcaaggcugucaauuac

SEQ ID NO: 1818525 - RNA, 21 nt, Human
aacaagccuccuuuuaaagua

SEQ ID NO: 1818526 - RNA, 15 nt, Human
aacaaggcaaggcug

SEQ ID NO: 1818527 - RNA, 20 nt, Human
aacaagaccacguuucuaaa

SEQ ID NO: 1818528 - RNA, 19 nt, Human
aacaagaccacguuucuaa

SEQ ID NO: 1818529 - RNA, 17 nt, Human
aacaagaccacguuucu

SEQ ID NO: 1818530 - RNA, 16 nt, Human
aacaagaccacguuuc

SEQ ID NO: 1818531 - RNA, 15 nt, Human
gucacaggcaggucc

SEQ ID NO: 1818532 - RNA, 13 nt, Human
gucacaggcaggu

SEQ ID NO: 1818533 - RNA, 16 nt, Human
gucacaggcaggucca

SEQ ID NO: 1818534 - RNA, 23 nt, Human
aaauuuuuaaucuuuaauuuuac

SEQ ID NO: 1818535 - RNA, 15 nt, Human
aacacuguucucugc

SEQ ID NO: 1818536 - RNA, 20 nt, Human
aacacuguucucugcccucc

SEQ ID NO: 1818537 - RNA, 14 nt, Human
aacacucugagacu

SEQ ID NO: 1818538 - RNA, 12 nt, Human
aacacucugaga

SEQ ID NO: 1818539 - RNA, 13 nt, Human
aacacucugagac

SEQ ID NO: 1818540 - RNA, 12 nt, Human
aacacuccuuca

SEQ ID NO: 1818541 - RNA, 11 nt, Human
aacacucugag

SEQ ID NO: 1818542 - RNA, 21 nt, Human
aacacucauugaccugaggcc

SEQ ID NO: 1818543 - RNA, 15 nt, Human
guccacaacacacag

SEQ ID NO: 1818544 - RNA, 22 nt, Human
gucauuugagcagggcucagcg

SEQ ID NO: 1818545 - RNA, 21 nt, Human
gucauuugagcagggcucagc

SEQ ID NO: 1818546 - RNA, 11 nt, Human
aacacuuccau

SEQ ID NO: 1818547 - RNA, 21 nt, Human
aacacuguucucugcccucca

SEQ ID NO: 1818548 - RNA, 19 nt, Human
gucuuauauauuguagaua

SEQ ID NO: 1818549 - RNA, 15 nt, Human
gucuuagauguauau

SEQ ID NO: 1818550 - RNA, 24 nt, Human
gucuuuucuugcaugaggcuagug

SEQ ID NO: 1818551 - RNA, 14 nt, Human
gucuuuucuugcau

SEQ ID NO: 1818552 - RNA, 19 nt, Human
gucuuuucuugcaugaggc

SEQ ID NO: 1818553 - RNA, 18 nt, Human
gucuuuggacccugaggc

SEQ ID NO: 1818554 - RNA, 17 nt, Human
gucuuuggacccugagg

SEQ ID NO: 1818555 - RNA, 14 nt, Human
gucuuuggacccug

SEQ ID NO: 1818556 - RNA, 15 nt, Human
gucuuuggacccuga

SEQ ID NO: 1818557 - RNA, 15 nt, Human
gucuggcuucacaga

SEQ ID NO: 1818558 - RNA, 11 nt, Human
aaccugcucuc

SEQ ID NO: 1818559 - RNA, 15 nt, Human
aaccugcucuccucu

SEQ ID NO: 1818560 - RNA, 20 nt, Human
aaccugcucuccucuugcca

SEQ ID NO: 1818561 - RNA, 15 nt, Human
aacguggcugcuuca

SEQ ID NO: 1818562 - RNA, 22 nt, Human
aacguggcugcuucaaggaucc

SEQ ID NO: 1818563 - RNA, 16 nt, Human
aacguggcugcuucaa

SEQ ID NO: 1818564 - RNA, 19 nt, Human
aacguggcugcuucaagga

SEQ ID NO: 1818565 - RNA, 13 nt, Human
aacucccugcccc

SEQ ID NO: 1818566 - RNA, 19 nt, Human
aacucccugccccccagcc

SEQ ID NO: 1818567 - RNA, 19 nt, Human
gugaaccaccacacccagc

SEQ ID NO: 1818568 - RNA, 14 nt, Human
aacucccuuucaac

SEQ ID NO: 1818569 - RNA, 13 nt, Human
aacucccuuucaa

SEQ ID NO: 1818570 - RNA, 13 nt, Human
aacccaaauguuc

SEQ ID NO: 1818571 - RNA, 13 nt, Human
aacccagcucugg

SEQ ID NO: 1818572 - RNA, 14 nt, Human
aacccagcucuggu

SEQ ID NO: 1818573 - RNA, 11 nt, Human
aacccagcucu

SEQ ID NO: 1818574 - RNA, 18 nt, Human
aacccaaauguucaucaa

SEQ ID NO: 1818575 - RNA, 20 nt, Human
aacccauauuuguacaccaa

SEQ ID NO: 1818576 - RNA, 17 nt, Human
aacccagcucuggucca

SEQ ID NO: 1818577 - RNA, 15 nt, Human
aacccccagccugcu

SEQ ID NO: 1818578 - RNA, 14 nt, Human
aacccccagccugc

SEQ ID NO: 1818579 - RNA, 13 nt, Human
aacccccagccug

SEQ ID NO: 1818580 - RNA, 14 nt, Human
aaccuccugggcua

SEQ ID NO: 1818581 - RNA, 17 nt, Human
aaccuccgccucuuggg

SEQ ID NO: 1818582 - RNA, 18 nt, Human
aaccacaucuugcucugc

SEQ ID NO: 1818583 - RNA, 22 nt, Human
aaccacaucuugcucugcugac

SEQ ID NO: 1818584 - RNA, 20 nt, Human
aaccacaucuugcucugcug

SEQ ID NO: 1818585 - RNA, 19 nt, Human
aaccaucauugaaaucuuu

SEQ ID NO: 1818586 - RNA, 20 nt, Human
aaccaucauugaaaucuuuu

SEQ ID NO: 1818587 - RNA, 23 nt, Human
aaccaucauugaaaucuuuuugc

SEQ ID NO: 1818588 - RNA, 21 nt, Human
aaccaucauugaaaucuuuuu

SEQ ID NO: 1818589 - RNA, 16 nt, Human
gucucccucccuuggg

SEQ ID NO: 1818590 - RNA, 14 nt, Human
aaaugcauuucuaa

SEQ ID NO: 1818591 - RNA, 13 nt, Human
aaaugcccagccc

SEQ ID NO: 1818592 - RNA, 14 nt, Human
aaaugcccagcccc

SEQ ID NO: 1818593 - RNA, 15 nt, Human
aaaugcccagccccu

SEQ ID NO: 1818594 - RNA, 18 nt, Human
aaaugcccagccccuucu

SEQ ID NO: 1818595 - RNA, 13 nt, Human
aaaugcccagcuu

SEQ ID NO: 1818596 - RNA, 15 nt, Human
aaaugggcagagcag

SEQ ID NO: 1818597 - RNA, 18 nt, Human
aaaugggcagagcagaga

SEQ ID NO: 1818598 - RNA, 20 nt, Human
aaaugggcagagcagagacc

SEQ ID NO: 1818599 - RNA, 23 nt, Human
aaaugccuuacccucauguucuu

SEQ ID NO: 1818600 - RNA, 14 nt, Human
aaaugcaccuggaa

SEQ ID NO: 1818601 - RNA, 22 nt, Human
aaaugcaccuggaauauauaac

SEQ ID NO: 1818602 - RNA, 18 nt, Human
aaaugcaccuggaauaua

SEQ ID NO: 1818603 - RNA, 13 nt, Human
aaaugcauguugc

SEQ ID NO: 1818604 - RNA, 14 nt, Human
aaaugaaagugaga

SEQ ID NO: 1818605 - RNA, 22 nt, Human
aaaugaaagcagggacuugaac

SEQ ID NO: 1818606 - RNA, 21 nt, Human
aaaugaaagcagggacuugaa

SEQ ID NO: 1818607 - RNA, 11 nt, Human
aaaugagaaau

SEQ ID NO: 1818608 - RNA, 19 nt, Human
aaaugaggucagagccugc

SEQ ID NO: 1818609 - RNA, 17 nt, Human
aaaugaggucagagccu

SEQ ID NO: 1818610 - RNA, 16 nt, Human
aaaugagguacucucc

SEQ ID NO: 1818611 - RNA, 23 nt, Human
aaaugagguacucuccuggaaau

SEQ ID NO: 1818612 - RNA, 23 nt, Human
aaaugauccccagcuguuuaugc

SEQ ID NO: 1818613 - RNA, 13 nt, Human
aaaugagaaaucu

SEQ ID NO: 1818614 - RNA, 14 nt, Human
aaaugagaaaucua

SEQ ID NO: 1818615 - RNA, 16 nt, Human
aaaugagaaaucuaaa

SEQ ID NO: 1818616 - RNA, 13 nt, Human
aaaugagccuggc

SEQ ID NO: 1818617 - RNA, 19 nt, Human
aaaugagccuggcaagaau

SEQ ID NO: 1818618 - RNA, 18 nt, Human
guaggaagguuaauguuc

SEQ ID NO: 1818619 - RNA, 15 nt, Human
guaggacuguagaaa

SEQ ID NO: 1818620 - RNA, 15 nt, Human
guaggaagacuuugg

SEQ ID NO: 1818621 - RNA, 21 nt, Human
guagcugggacuacaggcacc

SEQ ID NO: 1818622 - RNA, 18 nt, Human
guagcugggauuacaggc

SEQ ID NO: 1818623 - RNA, 19 nt, Human
guagcugggacuacaggca

SEQ ID NO: 1818624 - RNA, 18 nt, Human
guagcugggacuacaggc

SEQ ID NO: 1818625 - RNA, 12 nt, Human
guagcugggacu

SEQ ID NO: 1818626 - RNA, 17 nt, Human
guagcuggauuacaggc

SEQ ID NO: 1818627 - RNA, 17 nt, Human
aaaggagagcuagcagc

SEQ ID NO: 1818628 - RNA, 13 nt, Human
aaaucgaugcagu

SEQ ID NO: 1818629 - RNA, 15 nt, Human
aaaucccauuuaaaa

SEQ ID NO: 1818630 - RNA, 18 nt, Human
aaaucccuuaccucggug

SEQ ID NO: 1818631 - RNA, 17 nt, Human
aaaugaaaaucgugaca

SEQ ID NO: 1818632 - RNA, 11 nt, Human
aaaugaaaauu

SEQ ID NO: 1818633 - RNA, 19 nt, Human
aaaucucaaauuucuaaau

SEQ ID NO: 1818634 - RNA, 17 nt, Human
aaaucucaaauuucuaa

SEQ ID NO: 1818635 - RNA, 16 nt, Human
aaaucucaaauuucua

SEQ ID NO: 1818636 - RNA, 15 nt, Human
aaaucucaaauuucu

SEQ ID NO: 1818637 - RNA, 19 nt, Human
aaaucuacacuccagugag

SEQ ID NO: 1818638 - RNA, 17 nt, Human
guauaaaagccuguuua

SEQ ID NO: 1818639 - RNA, 16 nt, Human
aaaugggggugcauuu

SEQ ID NO: 1818640 - RNA, 15 nt, Human
aaaugggggugcauu

SEQ ID NO: 1818641 - RNA, 18 nt, Human
aaaugggggugcauuuga

SEQ ID NO: 1818642 - RNA, 17 nt, Human
aaaugggggugcauuug

SEQ ID NO: 1818643 - RNA, 19 nt, Human
aaaugggggugcauuugag

SEQ ID NO: 1818644 - RNA, 22 nt, Human
guauauugauccagaaagaaaa

SEQ ID NO: 1818645 - RNA, 19 nt, Human
guaucaaauacauuuaaaa

SEQ ID NO: 1818646 - RNA, 18 nt, Human
guauaaaagggacugaga

SEQ ID NO: 1818647 - RNA, 18 nt, Human
guauaaaagccuguuuaa

SEQ ID NO: 1818648 - RNA, 21 nt, Human
guauaaaagccuguuuaagag

SEQ ID NO: 1818649 - RNA, 15 nt, Human
guauucuuauuuaau

SEQ ID NO: 1818650 - RNA, 13 nt, Human
guaugguggcugg

SEQ ID NO: 1818651 - RNA, 16 nt, Human
guaugggacuggccuc

SEQ ID NO: 1818652 - RNA, 15 nt, Human
guaugggagagaaga

SEQ ID NO: 1818653 - RNA, 15 nt, Human
guaucccuacuguaa

SEQ ID NO: 1818654 - RNA, 22 nt, Human
guaugaucacggcucacugcag

SEQ ID NO: 1818655 - RNA, 14 nt, Human
guaugggagagaag

SEQ ID NO: 1818656 - RNA, 17 nt, Human
aaauuucagcagcugca

SEQ ID NO: 1818657 - RNA, 18 nt, Human
aaauuucagcagcugcag

SEQ ID NO: 1818658 - RNA, 14 nt, Human
aaauuuccacucag

SEQ ID NO: 1818659 - RNA, 22 nt, Human
aaauuuccacucaggucuguuu

SEQ ID NO: 1818660 - RNA, 15 nt, Human
guauuuuuuuacuaa

SEQ ID NO: 1818661 - RNA, 14 nt, Human
guauuuuuuuacua

SEQ ID NO: 1818662 - RNA, 20 nt, Human
gucacacaguauuacuucug

SEQ ID NO: 1818663 - RNA, 16 nt, Human
gucacacacuuuggcu

SEQ ID NO: 1818664 - RNA, 21 nt, Human
guauuuuuuuacuaauagaca

SEQ ID NO: 1818665 - RNA, 17 nt, Human
guauuuuuuuacuaaua

SEQ ID NO: 1818666 - RNA, 19 nt, Human
gucaaaguggugagaggca

SEQ ID NO: 1818667 - RNA, 18 nt, Human
gucaaaguggugagaggc

SEQ ID NO: 1818668 - RNA, 22 nt, Human
guauuggcuagagguucaaaga

SEQ ID NO: 1818669 - RNA, 16 nt, Human
guauuuaauucauguu

SEQ ID NO: 1818670 - RNA, 23 nt, Human
aaauuaacuuuuauaaacuuuac

SEQ ID NO: 1818671 - RNA, 22 nt, Human
aaauuaacuuuuauaaacuuua

SEQ ID NO: 1818672 - RNA, 20 nt, Human
aaauguuaaguugaugguga

SEQ ID NO: 1818673 - RNA, 21 nt, Human
aaauuaacuuuuauaaacuuu

SEQ ID NO: 1818674 - RNA, 14 nt, Human
aaauucaugcugcu

SEQ ID NO: 1818675 - RNA, 22 nt, Human
cugcaaaggguaucaggugcug

SEQ ID NO: 1818676 - RNA, 21 nt, Human
cugcaaaggguaucaggugcu

SEQ ID NO: 1818677 - RNA, 18 nt, Human
cugcaaagcccagcuuga

SEQ ID NO: 1818678 - RNA, 23 nt, Human
cugaugggcaacccccagccugc

SEQ ID NO: 1818679 - RNA, 22 nt, Human
cugaugggcaacccccagccug

SEQ ID NO: 1818680 - RNA, 24 nt, Human
cugaugggcaacccccagccugcu

SEQ ID NO: 1818681 - RNA, 21 nt, Human
cugaugggcaacccccagccu

SEQ ID NO: 1818682 - RNA, 18 nt, Human
cugaugggcaacccccag

SEQ ID NO: 1818683 - RNA, 18 nt, Human
cugaugcuucuucagaga

SEQ ID NO: 1818684 - RNA, 19 nt, Human
cugaugcuucuucagagac

SEQ ID NO: 1818685 - RNA, 20 nt, Human
cugaugcuucuucagagacu

SEQ ID NO: 1818686 - RNA, 14 nt, Human
cucuuaugggcugg

SEQ ID NO: 1818687 - RNA, 15 nt, Human
cucuuaugggcuggg

SEQ ID NO: 1818688 - RNA, 16 nt, Human
cugaugcuucuucaga

SEQ ID NO: 1818689 - RNA, 17 nt, Human
cugaugcuucuucagag

SEQ ID NO: 1818690 - RNA, 23 nt, Human
cugcaccgggccacagagaaagu

SEQ ID NO: 1818691 - RNA, 12 nt, Human
cugcaagggagu

SEQ ID NO: 1818692 - RNA, 20 nt, Human
cugcaagaauugaagcagga

SEQ ID NO: 1818693 - RNA, 22 nt, Human
cugcaaccuccgccucuugggu

SEQ ID NO: 1818694 - RNA, 14 nt, Human
cugcaaccugauug

SEQ ID NO: 1818695 - RNA, 19 nt, Human
cugcaaccugauugugucu

SEQ ID NO: 1818696 - RNA, 21 nt, Human
cugcaaccugauugugucucu

SEQ ID NO: 1818697 - RNA, 20 nt, Human
cugcaaccuccgccucuugg

SEQ ID NO: 1818698 - RNA, 17 nt, Human
cugcaaccuucgccacc

SEQ ID NO: 1818699 - RNA, 19 nt, Human
cugcaaccuucgccaccug

SEQ ID NO: 1818700 - RNA, 20 nt, Human
cugcaaccuucgccaccugg

SEQ ID NO: 1818701 - RNA, 22 nt, Human
cugcaaccuucgccaccugggu

SEQ ID NO: 1818702 - RNA, 22 nt, Human
cugcaaccugauugugucucuu

SEQ ID NO: 1818703 - RNA, 14 nt, Human
cugcaacuucugcc

SEQ ID NO: 1818704 - RNA, 15 nt, Human
cugcaacuucugccu

SEQ ID NO: 1818705 - RNA, 18 nt, Human
cugcaacuuguaaaugug

SEQ ID NO: 1818706 - RNA, 19 nt, Human
cugcaacuuguaaaugugg

SEQ ID NO: 1818707 - RNA, 18 nt, Human
cugcaagaauugaagcag

SEQ ID NO: 1818708 - RNA, 23 nt, Human
cugcacuauagccuaggugacag

SEQ ID NO: 1818709 - RNA, 22 nt, Human
cugcacuauagccuaggugaca

SEQ ID NO: 1818710 - RNA, 13 nt, Human
cugcacuccagcc

SEQ ID NO: 1818711 - RNA, 15 nt, Human
cugcacuccagccug

SEQ ID NO: 1818712 - RNA, 16 nt, Human
cugcacuccagccuga

SEQ ID NO: 1818713 - RNA, 20 nt, Human
cugcacuccagccugagcga

SEQ ID NO: 1818714 - RNA, 17 nt, Human
cugcacuccagccugag

SEQ ID NO: 1818715 - RNA, 20 nt, Human
cugcacuauagccuagguga

SEQ ID NO: 1818716 - RNA, 18 nt, Human
cugcacuauagccuaggu

SEQ ID NO: 1818717 - RNA, 17 nt, Human
cugcacuauagccuagg

SEQ ID NO: 1818718 - RNA, 16 nt, Human
cugcacuauagccuag

SEQ ID NO: 1818719 - RNA, 23 nt, Human
cugcagccucaaccuccugggcu

SEQ ID NO: 1818720 - RNA, 19 nt, Human
cugcacuccagccugggug

SEQ ID NO: 1818721 - RNA, 24 nt, Human
cugcagccucaaccuccugggcua

SEQ ID NO: 1818722 - RNA, 18 nt, Human
cugcacuccagccugggu

SEQ ID NO: 1818723 - RNA, 16 nt, Human
cugcacuccagccugg

SEQ ID NO: 1818724 - RNA, 17 nt, Human
cugcacuccagccuggg

SEQ ID NO: 1818725 - RNA, 12 nt, Human
cugcagcuuugu

SEQ ID NO: 1818726 - RNA, 13 nt, Human
cugcaggcagcca

SEQ ID NO: 1818727 - RNA, 14 nt, Human
cugcaggcagccag

SEQ ID NO: 1818728 - RNA, 15 nt, Human
cugcaggcagccagg

SEQ ID NO: 1818729 - RNA, 16 nt, Human
cugcaggcagccaggc

SEQ ID NO: 1818730 - RNA, 17 nt, Human
cugcaggcagccaggcc

SEQ ID NO: 1818731 - RNA, 18 nt, Human
cugcaggcagccaggcca

SEQ ID NO: 1818732 - RNA, 19 nt, Human
cugcaggcagccaggccac

SEQ ID NO: 1818733 - RNA, 20 nt, Human
cugcaggcagccaggccaca

SEQ ID NO: 1818734 - RNA, 14 nt, Human
cugcauuuaaaaga

SEQ ID NO: 1818735 - RNA, 13 nt, Human
cugcauuggcuuu

SEQ ID NO: 1818736 - RNA, 23 nt, Human
cugccagggacagaggggguggc

SEQ ID NO: 1818737 - RNA, 18 nt, Human
cugcauuuaaaagauaca

SEQ ID NO: 1818738 - RNA, 17 nt, Human
cugcauuuaaaagauac

SEQ ID NO: 1818739 - RNA, 20 nt, Human
cugccagggacagagggggu

SEQ ID NO: 1818740 - RNA, 22 nt, Human
cugccagggacagagggggugg

SEQ ID NO: 1818741 - RNA, 22 nt, Human
cugccagucccccugccccagg

SEQ ID NO: 1818742 - RNA, 20 nt, Human
cugccagucccccugcccca

SEQ ID NO: 1818743 - RNA, 21 nt, Human
cugccagucccccugccccag

SEQ ID NO: 1818744 - RNA, 17 nt, Human
cugccagucccccugcc

SEQ ID NO: 1818745 - RNA, 13 nt, Human
cugccccccagcc

SEQ ID NO: 1818746 - RNA, 19 nt, Human
cugccauccagguucagcu

SEQ ID NO: 1818747 - RNA, 18 nt, Human
cugccauccagguucagc

SEQ ID NO: 1818748 - RNA, 16 nt, Human
cugccauccagguuca

SEQ ID NO: 1818749 - RNA, 16 nt, Human
cugccauauucuguug

SEQ ID NO: 1818750 - RNA, 19 nt, Human
cugccccuccucucugccc

SEQ ID NO: 1818751 - RNA, 12 nt, Human
cugcccuuaccu

SEQ ID NO: 1818752 - RNA, 16 nt, Human
cugcccuuaccugcca

SEQ ID NO: 1818753 - RNA, 17 nt, Human
cugcccuuaccugccag

SEQ ID NO: 1818754 - RNA, 13 nt, Human
cugccccucccuu

SEQ ID NO: 1818755 - RNA, 14 nt, Human
cugccccucccuuc

SEQ ID NO: 1818756 - RNA, 17 nt, Human
cugccccucccuucaac

SEQ ID NO: 1818757 - RNA, 17 nt, Human
cugccccuccucucugc

SEQ ID NO: 1818758 - RNA, 18 nt, Human
cugccccuccucucugcc

SEQ ID NO: 1818759 - RNA, 19 nt, Human
cugcccugugggcccccaa

SEQ ID NO: 1818760 - RNA, 12 nt, Human
cugcugacagug

SEQ ID NO: 1818761 - RNA, 15 nt, Human
cugcugaaggcucga

SEQ ID NO: 1818762 - RNA, 13 nt, Human
cugcugaaggcuc

SEQ ID NO: 1818763 - RNA, 14 nt, Human
cugcugaaggcucg

SEQ ID NO: 1818764 - RNA, 15 nt, Human
cugcugacaguguug

SEQ ID NO: 1818765 - RNA, 13 nt, Human
cugcugacagugu

SEQ ID NO: 1818766 - RNA, 19 nt, Human
cugcugagucccaggcuga

SEQ ID NO: 1818767 - RNA, 23 nt, Human
cugcugagucccaggcugagccu

SEQ ID NO: 1818768 - RNA, 19 nt, Human
cugcucacauaucugucau

SEQ ID NO: 1818769 - RNA, 16 nt, Human
cugcucacauaucugu

SEQ ID NO: 1818770 - RNA, 12 nt, Human
cugcugaaggcu

SEQ ID NO: 1818771 - RNA, 14 nt, Human
cugcucacauaucu

SEQ ID NO: 1818772 - RNA, 20 nt, Human
cugcuuaacuucacauauug

SEQ ID NO: 1818773 - RNA, 15 nt, Human
cuggaugcagccuca

SEQ ID NO: 1818774 - RNA, 22 nt, Human
cuggaugcagccucacaguccu

SEQ ID NO: 1818775 - RNA, 19 nt, Human
cuggacugugugcucagga

SEQ ID NO: 1818776 - RNA, 22 nt, Human
cuggacugugugcucaggagcc

SEQ ID NO: 1818777 - RNA, 23 nt, Human
cuggacugugugcucaggagccc

SEQ ID NO: 1818778 - RNA, 16 nt, Human
cuggaguucugguucc

SEQ ID NO: 1818779 - RNA, 17 nt, Human
cuggaguucugguuccu

SEQ ID NO: 1818780 - RNA, 15 nt, Human
cuggaguucugguuc

SEQ ID NO: 1818781 - RNA, 16 nt, Human
cugggacuacaggcac

SEQ ID NO: 1818782 - RNA, 15 nt, Human
cugggacuacaggca

SEQ ID NO: 1818783 - RNA, 13 nt, Human
cugggacuacagg

SEQ ID NO: 1818784 - RNA, 16 nt, Human
cugggagaaaugaaaa

SEQ ID NO: 1818785 - RNA, 17 nt, Human
cugggagaaaugaaaaa

SEQ ID NO: 1818786 - RNA, 22 nt, Human
cugggagaaccaaaaagaggcu

SEQ ID NO: 1818787 - RNA, 14 nt, Human
cugggacaugggaa

SEQ ID NO: 1818788 - RNA, 18 nt, Human
cugggacaugggaaaggg

SEQ ID NO: 1818789 - RNA, 22 nt, Human
cugggacaugggaaaggggaag

SEQ ID NO: 1818790 - RNA, 12 nt, Human
cuggcccuuccu

SEQ ID NO: 1818791 - RNA, 14 nt, Human
cuggcuaugcauuu

SEQ ID NO: 1818792 - RNA, 13 nt, Human
cuggcuaugcauu

SEQ ID NO: 1818793 - RNA, 16 nt, Human
cuggcuaugcauuuga

SEQ ID NO: 1818794 - RNA, 15 nt, Human
cuggcuaugcauuug

SEQ ID NO: 1818795 - RNA, 22 nt, Human
cuggcuaugcauuugaaaauuu

SEQ ID NO: 1818796 - RNA, 14 nt, Human
cuggggagaaagua

SEQ ID NO: 1818797 - RNA, 13 nt, Human
cuggggagaaagu

SEQ ID NO: 1818798 - RNA, 18 nt, Human
cuggguggcaccagcagc

SEQ ID NO: 1818799 - RNA, 20 nt, Human
cuggguggcaccagcagccu

SEQ ID NO: 1818800 - RNA, 20 nt, Human
cugggcagguuggugggggc

SEQ ID NO: 1818801 - RNA, 12 nt, Human
cugggcagagga

SEQ ID NO: 1818802 - RNA, 13 nt, Human
cugggcagaggaa

SEQ ID NO: 1818803 - RNA, 16 nt, Human
cugggcagaggaaagc

SEQ ID NO: 1818804 - RNA, 20 nt, Human
cugggcagaggaaagcaaag

SEQ ID NO: 1818805 - RNA, 21 nt, Human
cuggugccucaccccuugcca

SEQ ID NO: 1818806 - RNA, 15 nt, Human
cuggguguggcgcag

SEQ ID NO: 1818807 - RNA, 14 nt, Human
cuggguguggcgca

SEQ ID NO: 1818808 - RNA, 21 nt, Human
cuggguggcaccagcagccug

SEQ ID NO: 1818809 - RNA, 12 nt, Human
cuugacagggca

SEQ ID NO: 1818810 - RNA, 20 nt, Human
cuugccgucuaccugagggg

SEQ ID NO: 1818811 - RNA, 23 nt, Human
cuugccgucuaccugaggggccu

SEQ ID NO: 1818812 - RNA, 23 nt, Human
cuugaaugaugccaugaggaaca

SEQ ID NO: 1818813 - RNA, 12 nt, Human
cuugcucugcug

SEQ ID NO: 1818814 - RNA, 13 nt, Human
cuugcucugcuga

SEQ ID NO: 1818815 - RNA, 20 nt, Human
cuugaaugaugccaugagga

SEQ ID NO: 1818816 - RNA, 20 nt, Human
cuucuucagagacuccugca

SEQ ID NO: 1818817 - RNA, 21 nt, Human
cuucuucagagacuccugcag

SEQ ID NO: 1818818 - RNA, 22 nt, Human
cuucuucagagacuccugcagg

SEQ ID NO: 1818819 - RNA, 16 nt, Human
cuuugagcuuaagaau

SEQ ID NO: 1818820 - RNA, 19 nt, Human
cuuugacgccaucccagcc

SEQ ID NO: 1818821 - RNA, 21 nt, Human
cuuugacgccaucccagcccc

SEQ ID NO: 1818822 - RNA, 22 nt, Human
cuuugacgccaucccagcccca

SEQ ID NO: 1818823 - RNA, 22 nt, Human
cuuucggggagaggcugaggac

SEQ ID NO: 1818824 - RNA, 17 nt, Human
cuuucuaaugugugaau

SEQ ID NO: 1818825 - RNA, 15 nt, Human
cuuuucaaaacauuu

SEQ ID NO: 1818826 - RNA, 15 nt, Human
cuuuggugaacauug

SEQ ID NO: 1818827 - RNA, 20 nt, Human
cuuuggucuacacugugcug

SEQ ID NO: 1818828 - RNA, 16 nt, Human
cuuuggucuacacugu

SEQ ID NO: 1818829 - RNA, 16 nt, Human
cuuuuaggccaaaaaa

SEQ ID NO: 1818830 - RNA, 18 nt, Human
cuuuuaggccaaaaaaau

SEQ ID NO: 1818831 - RNA, 15 nt, Human
cuuuuauaaacuuua

SEQ ID NO: 1818832 - RNA, 18 nt, Human
cuuuuauaaacuuuaccu

SEQ ID NO: 1818833 - RNA, 16 nt, Human
cuuuuauaaacuuuac

SEQ ID NO: 1818834 - RNA, 19 nt, Human
cuuuuauaaacuuuaccuu

SEQ ID NO: 1818835 - RNA, 19 nt, Human
cuuuuauuuagcaccaggg

SEQ ID NO: 1818836 - RNA, 20 nt, Human
cuuucaauaggaaaaacuga

SEQ ID NO: 1818837 - RNA, 21 nt, Human
cuuucaauaggaaaaacugau

SEQ ID NO: 1818838 - RNA, 22 nt, Human
cuuucaauaggaaaaacugauu

SEQ ID NO: 1818839 - RNA, 13 nt, Human
cuuguggacacag

SEQ ID NO: 1818840 - RNA, 15 nt, Human
cuuguggacacagcu

SEQ ID NO: 1818841 - RNA, 14 nt, Human
cuuguggacacagc

SEQ ID NO: 1818842 - RNA, 16 nt, Human
cuuguggacacagcuc

SEQ ID NO: 1818843 - RNA, 14 nt, Human
cugugucuugcaau

SEQ ID NO: 1818844 - RNA, 14 nt, Human
cugugucucccuuc

SEQ ID NO: 1818845 - RNA, 19 nt, Human
cugugucucccuucauccu

SEQ ID NO: 1818846 - RNA, 19 nt, Human
cugugucagguggggcagc

SEQ ID NO: 1818847 - RNA, 20 nt, Human
cugugucagcauagaaguaa

SEQ ID NO: 1818848 - RNA, 21 nt, Human
cugugucagguggggcagcuu

SEQ ID NO: 1818849 - RNA, 11 nt, Human
cugugcugccc

SEQ ID NO: 1818850 - RNA, 20 nt, Human
cugugcugagucugaaggcu

SEQ ID NO: 1818851 - RNA, 22 nt, Human
cugugcugagucugaaggcugg

SEQ ID NO: 1818852 - RNA, 22 nt, Human
cugugacuucagcucuguuuua

SEQ ID NO: 1818853 - RNA, 17 nt, Human
cugugacuucagcucug

SEQ ID NO: 1818854 - RNA, 19 nt, Human
cugugucuugcaauggcag

SEQ ID NO: 1818855 - RNA, 16 nt, Human
cugugucuugcaaugg

SEQ ID NO: 1818856 - RNA, 20 nt, Human
cugugucuugcaauggcagc

SEQ ID NO: 1818857 - RNA, 15 nt, Human
cuguucacucuacuu

SEQ ID NO: 1818858 - RNA, 14 nt, Human
cuguucagcuccag

SEQ ID NO: 1818859 - RNA, 13 nt, Human
cuguucagcucca

SEQ ID NO: 1818860 - RNA, 19 nt, Human
cuuaccucggugccuuccu

SEQ ID NO: 1818861 - RNA, 21 nt, Human
cuuaccucggugccuuccucu

SEQ ID NO: 1818862 - RNA, 13 nt, Human
cuuaccugccagg

SEQ ID NO: 1818863 - RNA, 13 nt, Human
cuuaccucggugc

SEQ ID NO: 1818864 - RNA, 19 nt, Human
cuuacccucauguucuuaa

SEQ ID NO: 1818865 - RNA, 18 nt, Human
cuuacccucauguucuua

SEQ ID NO: 1818866 - RNA, 17 nt, Human
cuuacccucauguucuu

SEQ ID NO: 1818867 - RNA, 13 nt, Human
cuuacacaauggu

SEQ ID NO: 1818868 - RNA, 18 nt, Human
cuuaaaauauuccugcau

SEQ ID NO: 1818869 - RNA, 20 nt, Human
cuuaaaauauuccugcauuu

SEQ ID NO: 1818870 - RNA, 16 nt, Human
cuguugggccaggagc

SEQ ID NO: 1818871 - RNA, 17 nt, Human
cuguugggccaggagcc

SEQ ID NO: 1818872 - RNA, 20 nt, Human
cuguugggccaggagccucc

SEQ ID NO: 1818873 - RNA, 14 nt, Human
cuguugcugccuca

SEQ ID NO: 1818874 - RNA, 15 nt, Human
cuguugcugccucau

SEQ ID NO: 1818875 - RNA, 16 nt, Human
cuguugcugccucaug

SEQ ID NO: 1818876 - RNA, 17 nt, Human
cuguugcugccucaugc

SEQ ID NO: 1818877 - RNA, 21 nt, Human
cuuagcagggaaacagcuaau

SEQ ID NO: 1818878 - RNA, 18 nt, Human
cuuagcagggaaacagcu

SEQ ID NO: 1818879 - RNA, 13 nt, Human
cuuauugcccacg

SEQ ID NO: 1818880 - RNA, 12 nt, Human
cuuauugcccac

SEQ ID NO: 1818881 - RNA, 22 nt, Human
cuuaugggcuggguucuaccca

SEQ ID NO: 1818882 - RNA, 23 nt, Human
cuuaugggcuggguucuacccag

SEQ ID NO: 1818883 - RNA, 14 nt, Human
cuuaugggcugggu

SEQ ID NO: 1818884 - RNA, 21 nt, Human
cuuaugggcuggguucuaccc

SEQ ID NO: 1818885 - RNA, 17 nt, Human
cuucaccuuugucccca

SEQ ID NO: 1818886 - RNA, 20 nt, Human
cuucaccuuuguccccaccg

SEQ ID NO: 1818887 - RNA, 18 nt, Human
cuuauugcccacgcugga

SEQ ID NO: 1818888 - RNA, 14 nt, Human
cuucaccuuugucc

SEQ ID NO: 1818889 - RNA, 16 nt, Human
cuucagagacuccugc

SEQ ID NO: 1818890 - RNA, 21 nt, Human
cuucagagacuccugcaggca

SEQ ID NO: 1818891 - RNA, 22 nt, Human
cuucagagacuccugcaggcag

SEQ ID NO: 1818892 - RNA, 11 nt, Human
cuucagacaua

SEQ ID NO: 1818893 - RNA, 22 nt, Human
cuucaucucccaaagugcuggg

SEQ ID NO: 1818894 - RNA, 16 nt, Human
cuucauccuccucaga

SEQ ID NO: 1818895 - RNA, 18 nt, Human
cuucaguggcagcugcuu

SEQ ID NO: 1818896 - RNA, 17 nt, Human
cuucaguuaagccuuug

SEQ ID NO: 1818897 - RNA, 23 nt, Human
cuucagagacuccugcaggcagc

SEQ ID NO: 1818898 - RNA, 24 nt, Human
cuucagagacuccugcaggcagcc

SEQ ID NO: 1818899 - RNA, 18 nt, Human
cuucaguuaagccuuugg

SEQ ID NO: 1818900 - RNA, 13 nt, Human
cuucaucccucug

SEQ ID NO: 1818901 - RNA, 15 nt, Human
cuucauccuccucag

SEQ ID NO: 1818902 - RNA, 15 nt, Human
cuuccaugucgccuc

SEQ ID NO: 1818903 - RNA, 16 nt, Human
cuuccaugucgccucu

SEQ ID NO: 1818904 - RNA, 16 nt, Human
cuuccauggacuuugu

SEQ ID NO: 1818905 - RNA, 17 nt, Human
cuuccauggacuuuguu

SEQ ID NO: 1818906 - RNA, 18 nt, Human
cuuccagugaggcucugc

SEQ ID NO: 1818907 - RNA, 17 nt, Human
cuuccagugaggcucug

SEQ ID NO: 1818908 - RNA, 19 nt, Human
cuuccagugaggcucugcc

SEQ ID NO: 1818909 - RNA, 20 nt, Human
cuuccagugaggcucugccc

SEQ ID NO: 1818910 - RNA, 17 nt, Human
cuuccaugucgccucug

SEQ ID NO: 1818911 - RNA, 18 nt, Human
cuuccaugucgccucugc

SEQ ID NO: 1818912 - RNA, 19 nt, Human
cuuccaugucgccucugca

SEQ ID NO: 1818913 - RNA, 20 nt, Human
cuuccaugucgccucugcau

SEQ ID NO: 1818914 - RNA, 20 nt, Human
gaccaucccugaaggccccg

SEQ ID NO: 1818915 - RNA, 14 nt, Human
gaccucugcagcaa

SEQ ID NO: 1818916 - RNA, 11 nt, Human
gaccugaggcc

SEQ ID NO: 1818917 - RNA, 13 nt, Human
gaccugaggcccu

SEQ ID NO: 1818918 - RNA, 14 nt, Human
gaccugaggcccuu

SEQ ID NO: 1818919 - RNA, 16 nt, Human
gacgccaucccagccc

SEQ ID NO: 1818920 - RNA, 19 nt, Human
gacgccaucccagccccaa

SEQ ID NO: 1818921 - RNA, 17 nt, Human
gacgccaucccagcccc

SEQ ID NO: 1818922 - RNA, 18 nt, Human
gacgccaucccagcccca

SEQ ID NO: 1818923 - RNA, 16 nt, Human
gacgcuacccgggaag

SEQ ID NO: 1818924 - RNA, 18 nt, Human
gacgcuacccgggaaggg

SEQ ID NO: 1818925 - RNA, 19 nt, Human
gacgcuacccgggaagggg

SEQ ID NO: 1818926 - RNA, 15 nt, Human
gacgcucucuggccu

SEQ ID NO: 1818927 - RNA, 17 nt, Human
gacgcucucuggccuuc

SEQ ID NO: 1818928 - RNA, 16 nt, Human
gacgcucucuggccuu

SEQ ID NO: 1818929 - RNA, 22 nt, Human
gacugugugcucaggagcccug

SEQ ID NO: 1818930 - RNA, 11 nt, Human
gacuguagaaa

SEQ ID NO: 1818931 - RNA, 18 nt, Human
gacuguacuccucccagg

SEQ ID NO: 1818932 - RNA, 23 nt, Human
gacuguacuccucccaggcgccc

SEQ ID NO: 1818933 - RNA, 16 nt, Human
gacugaauuucuuuug

SEQ ID NO: 1818934 - RNA, 14 nt, Human
gacugaauuucuuu

SEQ ID NO: 1818935 - RNA, 19 nt, Human
gacucugucucaaaaaaac

SEQ ID NO: 1818936 - RNA, 12 nt, Human
gacucugccucc

SEQ ID NO: 1818937 - RNA, 16 nt, Human
gacucugccuccucuu

SEQ ID NO: 1818938 - RNA, 15 nt, Human
gacucaccuccccca

SEQ ID NO: 1818939 - RNA, 22 nt, Human
gacucaccucccccaucucuuc

SEQ ID NO: 1818940 - RNA, 12 nt, Human
gacacaggcccg

SEQ ID NO: 1818941 - RNA, 23 nt, Human
gacacagcucuucuccaggcugu

SEQ ID NO: 1818942 - RNA, 22 nt, Human
gacacagcucuucuccaggcug

SEQ ID NO: 1818943 - RNA, 17 nt, Human
gacacagcucuucucca

SEQ ID NO: 1818944 - RNA, 13 nt, Human
gacacagcucuuc

SEQ ID NO: 1818945 - RNA, 16 nt, Human
gacacagcucuucucc

SEQ ID NO: 1818946 - RNA, 14 nt, Human
gacacagcucuucu

SEQ ID NO: 1818947 - RNA, 15 nt, Human
gacagaagcagcucu

SEQ ID NO: 1818948 - RNA, 17 nt, Human
gacagcccgggcucugc

SEQ ID NO: 1818949 - RNA, 21 nt, Human
gacagaaagcagaacagugau

SEQ ID NO: 1818950 - RNA, 15 nt, Human
gacauugcggacagc

SEQ ID NO: 1818951 - RNA, 14 nt, Human
gacauugcggacag

SEQ ID NO: 1818952 - RNA, 21 nt, Human
gacagugagacucugucucag

SEQ ID NO: 1818953 - RNA, 16 nt, Human
gacagaagcagcucuu

SEQ ID NO: 1818954 - RNA, 20 nt, Human
gacagcccgggcucugccuc

SEQ ID NO: 1818955 - RNA, 18 nt, Human
gacagcccgggcucugcc

SEQ ID NO: 1818956 - RNA, 19 nt, Human
gacagcccgggcucugccu

SEQ ID NO: 1818957 - RNA, 19 nt, Human
gacauuguuggccaaagcc

SEQ ID NO: 1818958 - RNA, 18 nt, Human
gaccagggauuuccauga

SEQ ID NO: 1818959 - RNA, 13 nt, Human
gaccauacuaauu

SEQ ID NO: 1818960 - RNA, 20 nt, Human
gaccagggauuuccaugaug

SEQ ID NO: 1818961 - RNA, 12 nt, Human
gaccaucccuga

SEQ ID NO: 1818962 - RNA, 13 nt, Human
gaccaucccugaa

SEQ ID NO: 1818963 - RNA, 18 nt, Human
gaccaucccugaaggccc

SEQ ID NO: 1818964 - RNA, 19 nt, Human
gaccaucccugaaggcccc

SEQ ID NO: 1818965 - RNA, 22 nt, Human
gaaggggagauaaggguaucug

SEQ ID NO: 1818966 - RNA, 18 nt, Human
gaaguuuaauugacuuau

SEQ ID NO: 1818967 - RNA, 14 nt, Human
gaauauugcugaug

SEQ ID NO: 1818968 - RNA, 15 nt, Human
gaauauugcugaugg

SEQ ID NO: 1818969 - RNA, 20 nt, Human
gaauauuagugaccucagcu

SEQ ID NO: 1818970 - RNA, 19 nt, Human
gaauauugcugauggugca

SEQ ID NO: 1818971 - RNA, 20 nt, Human
gaauauugcugauggugcaa

SEQ ID NO: 1818972 - RNA, 15 nt, Human
gaaggcuggguucug

SEQ ID NO: 1818973 - RNA, 19 nt, Human
gaaggcuggguucugaucc

SEQ ID NO: 1818974 - RNA, 21 nt, Human
gaaggcucgagcaugccugga

SEQ ID NO: 1818975 - RNA, 18 nt, Human
gaaggccccgcccaggcu

SEQ ID NO: 1818976 - RNA, 19 nt, Human
gaaggccccgcccaggcuu

SEQ ID NO: 1818977 - RNA, 20 nt, Human
gaaggcuggguucugauccu

SEQ ID NO: 1818978 - RNA, 22 nt, Human
gaaggcuggguucugauccuag

SEQ ID NO: 1818979 - RNA, 21 nt, Human
gaagggcuuggacucaagcaa

SEQ ID NO: 1818980 - RNA, 22 nt, Human
gaagcuccgcuuucuacccagc

SEQ ID NO: 1818981 - RNA, 17 nt, Human
gaaggccccgcccaggc

SEQ ID NO: 1818982 - RNA, 19 nt, Human
gaagcuccgcuuucuaccc

SEQ ID NO: 1818983 - RNA, 20 nt, Human
gaagcuaucguaaaauuaag

SEQ ID NO: 1818984 - RNA, 12 nt, Human
gaacuggcugca

SEQ ID NO: 1818985 - RNA, 11 nt, Human
gaacuggcugc

SEQ ID NO: 1818986 - RNA, 20 nt, Human
gaacucugacaacagacuuc

SEQ ID NO: 1818987 - RNA, 21 nt, Human
gaagcacaugccucucucagg

SEQ ID NO: 1818988 - RNA, 15 nt, Human
gaagcagaggaagga

SEQ ID NO: 1818989 - RNA, 15 nt, Human
gaagcacaugccucu

SEQ ID NO: 1818990 - RNA, 17 nt, Human
gaagcacaugccucucu

SEQ ID NO: 1818991 - RNA, 20 nt, Human
gaagcacaugccucucucag

SEQ ID NO: 1818992 - RNA, 20 nt, Human
gaagcaaugcuucaucccuu

SEQ ID NO: 1818993 - RNA, 23 nt, Human
gaagcaacccaaauguucaucaa

SEQ ID NO: 1818994 - RNA, 22 nt, Human
gaagacaaugacuuacuguaca

SEQ ID NO: 1818995 - RNA, 23 nt, Human
gaagacaaugugaaaagaaaaau

SEQ ID NO: 1818996 - RNA, 16 nt, Human
gaagacaaugacuuac

SEQ ID NO: 1818997 - RNA, 12 nt, Human
gaggggccucuu

SEQ ID NO: 1818998 - RNA, 15 nt, Human
gaggcagggucucac

SEQ ID NO: 1818999 - RNA, 17 nt, Human
gaggccaaggugggagg

SEQ ID NO: 1819000 - RNA, 22 nt, Human
gaggccaaggugggaggauugc

SEQ ID NO: 1819001 - RNA, 14 nt, Human
gaggcagggucuca

SEQ ID NO: 1819002 - RNA, 15 nt, Human
gaggacgcucucugg

SEQ ID NO: 1819003 - RNA, 17 nt, Human
gaggcaucgcaauguaa

SEQ ID NO: 1819004 - RNA, 13 nt, Human
gaggccagagaca

SEQ ID NO: 1819005 - RNA, 14 nt, Human
gaggccagagacac

SEQ ID NO: 1819006 - RNA, 19 nt, Human
gaggccagagacacaagcc

SEQ ID NO: 1819007 - RNA, 22 nt, Human
gaggcuagugugguguuuccug

SEQ ID NO: 1819008 - RNA, 23 nt, Human
gaggcuccacuuggucugugaga

SEQ ID NO: 1819009 - RNA, 12 nt, Human
gaggcuccacuu

SEQ ID NO: 1819010 - RNA, 18 nt, Human
gaggcuacuguaaggcaa

SEQ ID NO: 1819011 - RNA, 14 nt, Human
gaggcucagauugu

SEQ ID NO: 1819012 - RNA, 19 nt, Human
gaggcuccacuuggucugu

SEQ ID NO: 1819013 - RNA, 20 nt, Human
gagccuuccaggggugggac

SEQ ID NO: 1819014 - RNA, 21 nt, Human
gagcgcccacuagacccacug

SEQ ID NO: 1819015 - RNA, 13 nt, Human
gagccuugaacuu

SEQ ID NO: 1819016 - RNA, 23 nt, Human
gagccuuccaggggugggacacc

SEQ ID NO: 1819017 - RNA, 19 nt, Human
gagccuugaacuuugaccu

SEQ ID NO: 1819018 - RNA, 20 nt, Human
gagugacagaggcagcccca

SEQ ID NO: 1819019 - RNA, 19 nt, Human
gagugcaaugacacagucu

SEQ ID NO: 1819020 - RNA, 15 nt, Human
gaguugauucagcuc

SEQ ID NO: 1819021 - RNA, 16 nt, Human
gaguugauucagcucu

SEQ ID NO: 1819022 - RNA, 17 nt, Human
gaguugauucagcucug

SEQ ID NO: 1819023 - RNA, 18 nt, Human
gagugacagaggcagccc

SEQ ID NO: 1819024 - RNA, 13 nt, Human
gagucccaccuug

SEQ ID NO: 1819025 - RNA, 12 nt, Human
gagucccaccuu

SEQ ID NO: 1819026 - RNA, 22 nt, Human
gagucagaaguuucugccgcag

SEQ ID NO: 1819027 - RNA, 16 nt, Human
gagucaccaagcccag

SEQ ID NO: 1819028 - RNA, 17 nt, Human
gagucaccaagcccagu

SEQ ID NO: 1819029 - RNA, 23 nt, Human
gaggugaccccagguuucuaugu

SEQ ID NO: 1819030 - RNA, 15 nt, Human
gaggucgaggcagga

SEQ ID NO: 1819031 - RNA, 16 nt, Human
gaguuuaaauuguaau

SEQ ID NO: 1819032 - RNA, 18 nt, Human
gaguugauucagcucugc

SEQ ID NO: 1819033 - RNA, 22 nt, Human
gaguuguuacauuuuuaagugc

SEQ ID NO: 1819034 - RNA, 18 nt, Human
gauguaaaagacuuuuuu

SEQ ID NO: 1819035 - RNA, 12 nt, Human
gauguaaagaug

SEQ ID NO: 1819036 - RNA, 18 nt, Human
gauguagaggagaaacug

SEQ ID NO: 1819037 - RNA, 17 nt, Human
gauguagaggagaaacu

SEQ ID NO: 1819038 - RNA, 16 nt, Human
gaugagugagcaugcc

SEQ ID NO: 1819039 - RNA, 15 nt, Human
gaugaucuaggaaga

SEQ ID NO: 1819040 - RNA, 21 nt, Human
gaugaucuaggaagacuuugg

SEQ ID NO: 1819041 - RNA, 12 nt, Human
gauuauuggaaa

SEQ ID NO: 1819042 - RNA, 21 nt, Human
gauguauguugaagccuuugu

SEQ ID NO: 1819043 - RNA, 20 nt, Human
gauguauguugaagccuuug

SEQ ID NO: 1819044 - RNA, 14 nt, Human
gauuauauuaugaa

SEQ ID NO: 1819045 - RNA, 20 nt, Human
gauuauaggcaccuaccacc

SEQ ID NO: 1819046 - RNA, 12 nt, Human
gauucuucugcu

SEQ ID NO: 1819047 - RNA, 17 nt, Human
gauucuuccucccuccc

SEQ ID NO: 1819048 - RNA, 18 nt, Human
gauucuuccucccucccu

SEQ ID NO: 1819049 - RNA, 20 nt, Human
gauuuuuuacagcugccugc

SEQ ID NO: 1819050 - RNA, 17 nt, Human
gauucuccugccucagc

SEQ ID NO: 1819051 - RNA, 15 nt, Human
gauucuccugccuca

SEQ ID NO: 1819052 - RNA, 18 nt, Human
gauucuccugccucagcc

SEQ ID NO: 1819053 - RNA, 17 nt, Human
gcacucagaagacacug

SEQ ID NO: 1819054 - RNA, 17 nt, Human
gcacuccccugcugggu

SEQ ID NO: 1819055 - RNA, 16 nt, Human
gcacucagaagacacu

SEQ ID NO: 1819056 - RNA, 13 nt, Human
gcacucagaagac

SEQ ID NO: 1819057 - RNA, 22 nt, Human
gcacuccccugcuggguguggc

SEQ ID NO: 1819058 - RNA, 14 nt, Human
gcaccgggccacag

SEQ ID NO: 1819059 - RNA, 23 nt, Human
gcacaucagcacgauuucuguuu

SEQ ID NO: 1819060 - RNA, 22 nt, Human
gcacaucagcacgauuucuguu

SEQ ID NO: 1819061 - RNA, 23 nt, Human
gcaccgggccacagagaaaguac

SEQ ID NO: 1819062 - RNA, 22 nt, Human
gcaccuaccaccacgcccggcu

SEQ ID NO: 1819063 - RNA, 21 nt, Human
gcaccuaccaccacgcccggc

SEQ ID NO: 1819064 - RNA, 14 nt, Human
gcacaccgggcacu

SEQ ID NO: 1819065 - RNA, 14 nt, Human
gcacacauuuuuua

SEQ ID NO: 1819066 - RNA, 22 nt, Human
gcacaagcugcacccucaggca

SEQ ID NO: 1819067 - RNA, 20 nt, Human
gcacaccgggcacucagaag

SEQ ID NO: 1819068 - RNA, 19 nt, Human
gcacagugcaucucagccc

SEQ ID NO: 1819069 - RNA, 20 nt, Human
gcacagugcaucucagccca

SEQ ID NO: 1819070 - RNA, 21 nt, Human
gcacagugcaucucagcccac

SEQ ID NO: 1819071 - RNA, 18 nt, Human
gcaagucagaauagaaau

SEQ ID NO: 1819072 - RNA, 16 nt, Human
gccgccaugcuccugg

SEQ ID NO: 1819073 - RNA, 16 nt, Human
gcccuuaccugccagg

SEQ ID NO: 1819074 - RNA, 20 nt, Human
gcccuuaccugccaggaagc

SEQ ID NO: 1819075 - RNA, 15 nt, Human
gccgccaugcuccug

SEQ ID NO: 1819076 - RNA, 23 nt, Human
gcccugcugagucccaggcugag

SEQ ID NO: 1819077 - RNA, 21 nt, Human
gcccugcugagucccaggcug

SEQ ID NO: 1819078 - RNA, 22 nt, Human
gcccugcugagucccaggcuga

SEQ ID NO: 1819079 - RNA, 16 nt, Human
gcccugcugaguccca

SEQ ID NO: 1819080 - RNA, 16 nt, Human
gcccugccuccuuugu

SEQ ID NO: 1819081 - RNA, 22 nt, Human
gcccugccuccuuugugaggaa

SEQ ID NO: 1819082 - RNA, 19 nt, Human
gcccacucccugcaaccug

SEQ ID NO: 1819083 - RNA, 14 nt, Human
gcccacucccugca

SEQ ID NO: 1819084 - RNA, 15 nt, Human
gcccacucccugcaa

SEQ ID NO: 1819085 - RNA, 17 nt, Human
gcccacuagacccacug

SEQ ID NO: 1819086 - RNA, 23 nt, Human
gcccacuagacccacuggacuca

SEQ ID NO: 1819087 - RNA, 13 nt, Human
gcccacucccugc

SEQ ID NO: 1819088 - RNA, 18 nt, Human
gccccaaaacucuccucu

SEQ ID NO: 1819089 - RNA, 19 nt, Human
gccccaaaacucuccucug

SEQ ID NO: 1819090 - RNA, 14 nt, Human
gccccugcccggcu

SEQ ID NO: 1819091 - RNA, 13 nt, Human
gccccugcccggc

SEQ ID NO: 1819092 - RNA, 14 nt, Human
gcccccucugcccu

SEQ ID NO: 1819093 - RNA, 15 nt, Human
gccccugcccggcug

SEQ ID NO: 1819094 - RNA, 16 nt, Human
gccccuggaugcagcc

SEQ ID NO: 1819095 - RNA, 18 nt, Human
gccccuggaugcagccuc

SEQ ID NO: 1819096 - RNA, 22 nt, Human
gccccuggaugcagccucacag

SEQ ID NO: 1819097 - RNA, 22 nt, Human
gcccuaaaguguauuuuuuuac

SEQ ID NO: 1819098 - RNA, 20 nt, Human
gccugcccaggccccugcca

SEQ ID NO: 1819099 - RNA, 19 nt, Human
gccugcccaggccccugcc

SEQ ID NO: 1819100 - RNA, 18 nt, Human
gccugcccaggccccugc

SEQ ID NO: 1819101 - RNA, 17 nt, Human
gccugcccaggccccug

SEQ ID NO: 1819102 - RNA, 12 nt, Human
gccucuucucua

SEQ ID NO: 1819103 - RNA, 23 nt, Human
gccucuucucuacucuagggaaa

SEQ ID NO: 1819104 - RNA, 22 nt, Human
gccucuuccucccucauuccac

SEQ ID NO: 1819105 - RNA, 12 nt, Human
gccucuuccucc

SEQ ID NO: 1819106 - RNA, 13 nt, Human
gccuccugugugu

SEQ ID NO: 1819107 - RNA, 14 nt, Human
gccucugggacugg

SEQ ID NO: 1819108 - RNA, 12 nt, Human
gccucugggacu

SEQ ID NO: 1819109 - RNA, 13 nt, Human
gccuccuccagcc

SEQ ID NO: 1819110 - RNA, 17 nt, Human
gccugccuguucccauu

SEQ ID NO: 1819111 - RNA, 16 nt, Human
gccugccucuucucua

SEQ ID NO: 1819112 - RNA, 21 nt, Human
gccugggaggucaaggcugca

SEQ ID NO: 1819113 - RNA, 22 nt, Human
gccugggaggucaaggcugcag

SEQ ID NO: 1819114 - RNA, 14 nt, Human
gccugggaucccuc

SEQ ID NO: 1819115 - RNA, 21 nt, Human
gccugggaucccucauccuca

SEQ ID NO: 1819116 - RNA, 18 nt, Human
gccugggaucccucaucc

SEQ ID NO: 1819117 - RNA, 20 nt, Human
gccuggccccucaggguccc

SEQ ID NO: 1819118 - RNA, 22 nt, Human
gccuggccccucagggucccug

SEQ ID NO: 1819119 - RNA, 10 nt, Human
gccuggccug

SEQ ID NO: 1819120 - RNA, 15 nt, Human
gccuggccccucagg

SEQ ID NO: 1819121 - RNA, 16 nt, Human
gccuggccccucaggg

SEQ ID NO: 1819122 - RNA, 17 nt, Human
gccuggccccucagggu

SEQ ID NO: 1819123 - RNA, 21 nt, Human
gccacuugaugacccccaacc

SEQ ID NO: 1819124 - RNA, 12 nt, Human
gccacugccucu

SEQ ID NO: 1819125 - RNA, 13 nt, Human
gccacugccucuu

SEQ ID NO: 1819126 - RNA, 16 nt, Human
gccacugccucuuccu

SEQ ID NO: 1819127 - RNA, 17 nt, Human
gccacugccucuuccuc

SEQ ID NO: 1819128 - RNA, 18 nt, Human
gccacugugaagagaacc

SEQ ID NO: 1819129 - RNA, 19 nt, Human
gccacugugaagagaacca

SEQ ID NO: 1819130 - RNA, 23 nt, Human
gccacugcaccgggccacagaga

SEQ ID NO: 1819131 - RNA, 19 nt, Human
gccacccuggggagaaagu

SEQ ID NO: 1819132 - RNA, 13 nt, Human
gccacccugggga

SEQ ID NO: 1819133 - RNA, 21 nt, Human
gccacugcacuauagccuagg

SEQ ID NO: 1819134 - RNA, 22 nt, Human
gccaccaacauacucccaucug

SEQ ID NO: 1819135 - RNA, 13 nt, Human
gccaccacgcccg

SEQ ID NO: 1819136 - RNA, 14 nt, Human
gccaccacgcccgg

SEQ ID NO: 1819137 - RNA, 19 nt, Human
gccaccaacauacucccau

SEQ ID NO: 1819138 - RNA, 20 nt, Human
gccaccaacauacucccauc

SEQ ID NO: 1819139 - RNA, 21 nt, Human
gccaccaacauacucccaucu

SEQ ID NO: 1819140 - RNA, 16 nt, Human
gccacauuccugaugc

SEQ ID NO: 1819141 - RNA, 20 nt, Human
gccacauuccugaugcuucu

SEQ ID NO: 1819142 - RNA, 18 nt, Human
gcacuuggagacuuguau

SEQ ID NO: 1819143 - RNA, 24 nt, Human
gccauguuggccaggcuggucuca

SEQ ID NO: 1819144 - RNA, 22 nt, Human
gccauguuggccaggcuggucu

SEQ ID NO: 1819145 - RNA, 20 nt, Human
gccauguuggccaggcuggu

SEQ ID NO: 1819146 - RNA, 19 nt, Human
gccauguuggccaggcugg

SEQ ID NO: 1819147 - RNA, 17 nt, Human
gccauuccccgucucug

SEQ ID NO: 1819148 - RNA, 18 nt, Human
gccauuccccgucucugg

SEQ ID NO: 1819149 - RNA, 17 nt, Human
gcccacgcuggagugca

SEQ ID NO: 1819150 - RNA, 16 nt, Human
gcccacgcuggagugc

SEQ ID NO: 1819151 - RNA, 15 nt, Human
gcccacgcuggagug

SEQ ID NO: 1819152 - RNA, 18 nt, Human
gcccaccuuggcucaagu

SEQ ID NO: 1819153 - RNA, 13 nt, Human
gcccacgccccca

SEQ ID NO: 1819154 - RNA, 14 nt, Human
gcccacgcccccac

SEQ ID NO: 1819155 - RNA, 14 nt, Human
gccauguuggccag

SEQ ID NO: 1819156 - RNA, 18 nt, Human
gccauguuggccaggcug

SEQ ID NO: 1819157 - RNA, 17 nt, Human
gccauguuggccaggcu

SEQ ID NO: 1819158 - RNA, 16 nt, Human
gccauguuggccaggc

SEQ ID NO: 1819159 - RNA, 15 nt, Human
gccauguuggccagg

SEQ ID NO: 1819160 - RNA, 20 nt, Human
gccauauucuguuggccagu

SEQ ID NO: 1819161 - RNA, 19 nt, Human
gccauauucuguuggccag

SEQ ID NO: 1819162 - RNA, 13 nt, Human
gccaggccagagg

SEQ ID NO: 1819163 - RNA, 16 nt, Human
gccaggcccucugccc

SEQ ID NO: 1819164 - RNA, 17 nt, Human
gccaggcccucugccca

SEQ ID NO: 1819165 - RNA, 21 nt, Human
gccaggcccucugcccacucc

SEQ ID NO: 1819166 - RNA, 19 nt, Human
gccaggcccucugcccacu

SEQ ID NO: 1819167 - RNA, 20 nt, Human
gccaggcccucugcccacuc

SEQ ID NO: 1819168 - RNA, 12 nt, Human
gccaggccagag

SEQ ID NO: 1819169 - RNA, 23 nt, Human
gccaggccacaagacccuugugg

SEQ ID NO: 1819170 - RNA, 13 nt, Human
gccagcaggcucu

SEQ ID NO: 1819171 - RNA, 16 nt, Human
gccagcaggcucucag

SEQ ID NO: 1819172 - RNA, 17 nt, Human
gccagcaggcucucagg

SEQ ID NO: 1819173 - RNA, 18 nt, Human
gccagcaggcucucaggc

SEQ ID NO: 1819174 - RNA, 19 nt, Human
gccagcaggcucucaggcc

SEQ ID NO: 1819175 - RNA, 20 nt, Human
gccagcaggcucucaggcca

SEQ ID NO: 1819176 - RNA, 21 nt, Human
gccagcaggcucucaggccag

SEQ ID NO: 1819177 - RNA, 23 nt, Human
gccagcaggcucucaggccagcu

SEQ ID NO: 1819178 - RNA, 15 nt, Human
gccagaauuucaaac

SEQ ID NO: 1819179 - RNA, 22 nt, Human
gccagacaucaacagauaaaua

SEQ ID NO: 1819180 - RNA, 17 nt, Human
gcucagggccuggcuca

SEQ ID NO: 1819181 - RNA, 13 nt, Human
gcucagggccugg

SEQ ID NO: 1819182 - RNA, 16 nt, Human
gcucagggccuggcuc

SEQ ID NO: 1819183 - RNA, 21 nt, Human
gcucaggagcccugggaggcu

SEQ ID NO: 1819184 - RNA, 12 nt, Human
gcucagggccug

SEQ ID NO: 1819185 - RNA, 15 nt, Human
gcucaggagcccugg

SEQ ID NO: 1819186 - RNA, 18 nt, Human
gcucaggagcccugggag

SEQ ID NO: 1819187 - RNA, 14 nt, Human
gcucaggagcccug

SEQ ID NO: 1819188 - RNA, 22 nt, Human
gcucagagagggugggaguggg

SEQ ID NO: 1819189 - RNA, 18 nt, Human
gcucagagagggugggag

SEQ ID NO: 1819190 - RNA, 20 nt, Human
gcucagagagggugggagug

SEQ ID NO: 1819191 - RNA, 15 nt, Human
gcucagagagggugg

SEQ ID NO: 1819192 - RNA, 21 nt, Human
gcucagguggggucacucugg

SEQ ID NO: 1819193 - RNA, 22 nt, Human
gcucagguggggucacucuggc

SEQ ID NO: 1819194 - RNA, 19 nt, Human
gccuguucagcuccagcuc

SEQ ID NO: 1819195 - RNA, 20 nt, Human
gccuguucagcuccagcuca

SEQ ID NO: 1819196 - RNA, 14 nt, Human
gccuguucagcucc

SEQ ID NO: 1819197 - RNA, 15 nt, Human
gcuaggccuggccag

SEQ ID NO: 1819198 - RNA, 14 nt, Human
gcuaggccuggcca

SEQ ID NO: 1819199 - RNA, 16 nt, Human
gcuaguaucaaaagaa

SEQ ID NO: 1819200 - RNA, 16 nt, Human
gcuauugucaccaggg

SEQ ID NO: 1819201 - RNA, 20 nt, Human
gcuauugucaccagggcugg

SEQ ID NO: 1819202 - RNA, 21 nt, Human
gcuauugucaccagggcugga

SEQ ID NO: 1819203 - RNA, 18 nt, Human
gcuaggaacacuccuuca

SEQ ID NO: 1819204 - RNA, 19 nt, Human
gcuaggaacacuccuucac

SEQ ID NO: 1819205 - RNA, 21 nt, Human
gcuaggaacacuccuucacag

SEQ ID NO: 1819206 - RNA, 12 nt, Human
gcucuuccaggc

SEQ ID NO: 1819207 - RNA, 15 nt, Human
gcucuuccaggcugg

SEQ ID NO: 1819208 - RNA, 16 nt, Human
gcucuuccaggcuggg

SEQ ID NO: 1819209 - RNA, 15 nt, Human
gcucuguccugggag

SEQ ID NO: 1819210 - RNA, 17 nt, Human
gcucuggccuccaaguc

SEQ ID NO: 1819211 - RNA, 15 nt, Human
gcucuggccuccaag

SEQ ID NO: 1819212 - RNA, 16 nt, Human
gcucuguccugggagu

SEQ ID NO: 1819213 - RNA, 19 nt, Human
gcucugucgcccaggcugg

SEQ ID NO: 1819214 - RNA, 15 nt, Human
gcugacagacacagg

SEQ ID NO: 1819215 - RNA, 14 nt, Human
gcugacagacacag

SEQ ID NO: 1819216 - RNA, 16 nt, Human
gcugacagacacaggc

SEQ ID NO: 1819217 - RNA, 12 nt, Human
gcugaaggcucg

SEQ ID NO: 1819218 - RNA, 20 nt, Human
gcugaaggcucgagcaugcc

SEQ ID NO: 1819219 - RNA, 17 nt, Human
gcugaaugguuuucaaa

SEQ ID NO: 1819220 - RNA, 22 nt, Human
gcugaauacagaggcaacugca

SEQ ID NO: 1819221 - RNA, 20 nt, Human
gcucugagcaaauguggcuc

SEQ ID NO: 1819222 - RNA, 21 nt, Human
gcucugagcaaauguggcucc

SEQ ID NO: 1819223 - RNA, 23 nt, Human
gcucuggagcccacuguacuugc

SEQ ID NO: 1819224 - RNA, 22 nt, Human
gcuccugccaccacgcccggcu

SEQ ID NO: 1819225 - RNA, 20 nt, Human
gcucccaggcauuccccagg

SEQ ID NO: 1819226 - RNA, 21 nt, Human
gcucccaggcauuccccagga

SEQ ID NO: 1819227 - RNA, 23 nt, Human
gcucccaggcauuccccaggagg

SEQ ID NO: 1819228 - RNA, 22 nt, Human
gcucccaggcauuccccaggag

SEQ ID NO: 1819229 - RNA, 19 nt, Human
gcuccccuaaagccucaaa

SEQ ID NO: 1819230 - RNA, 14 nt, Human
gcuccccagcccca

SEQ ID NO: 1819231 - RNA, 20 nt, Human
gcucuacagcuaaucagcau

SEQ ID NO: 1819232 - RNA, 22 nt, Human
gcucuacagcuaaucagcauuc

SEQ ID NO: 1819233 - RNA, 13 nt, Human
gcucucaggccag

SEQ ID NO: 1819234 - RNA, 14 nt, Human
gcucucaggccagc

SEQ ID NO: 1819235 - RNA, 15 nt, Human
gcucucaggccagcu

SEQ ID NO: 1819236 - RNA, 16 nt, Human
gcucucaggccagcug

SEQ ID NO: 1819237 - RNA, 23 nt, Human
gcugccauccagguucagcuugu

SEQ ID NO: 1819238 - RNA, 21 nt, Human
gcugccauccagguucagcuu

SEQ ID NO: 1819239 - RNA, 19 nt, Human
gcugccagccgagauagcc

SEQ ID NO: 1819240 - RNA, 21 nt, Human
gcugccagccgagauagccaa

SEQ ID NO: 1819241 - RNA, 16 nt, Human
gcugcaccggcuggcc

SEQ ID NO: 1819242 - RNA, 17 nt, Human
gcugcaccggcuggccu

SEQ ID NO: 1819243 - RNA, 18 nt, Human
gcugcaccggcuggccug

SEQ ID NO: 1819244 - RNA, 19 nt, Human
gcugcaccggcuggccugg

SEQ ID NO: 1819245 - RNA, 22 nt, Human
gcugcaccggcuggccuggccc

SEQ ID NO: 1819246 - RNA, 18 nt, Human
gcugagggugagugggug

SEQ ID NO: 1819247 - RNA, 13 nt, Human
gcugccugggauc

SEQ ID NO: 1819248 - RNA, 19 nt, Human
gcugccugggaucccucau

SEQ ID NO: 1819249 - RNA, 16 nt, Human
gcugccugggaucccu

SEQ ID NO: 1819250 - RNA, 18 nt, Human
gcugccugggaucccuca

SEQ ID NO: 1819251 - RNA, 19 nt, Human
gcugggauuacagguguga

SEQ ID NO: 1819252 - RNA, 18 nt, Human
gcugggauuacaggugug

SEQ ID NO: 1819253 - RNA, 17 nt, Human
gcugggauuacagggau

SEQ ID NO: 1819254 - RNA, 17 nt, Human
gcugggauuacaggugu

SEQ ID NO: 1819255 - RNA, 13 nt, Human
gcugggcagagga

SEQ ID NO: 1819256 - RNA, 14 nt, Human
gcugggcagaggaa

SEQ ID NO: 1819257 - RNA, 15 nt, Human
gcugggcagaggaaa

SEQ ID NO: 1819258 - RNA, 16 nt, Human
gcugggauuacaggug

SEQ ID NO: 1819259 - RNA, 22 nt, Human
gcugggauuacaggcuccugcc

SEQ ID NO: 1819260 - RNA, 23 nt, Human
gcugggauuacaggcuccugcca

SEQ ID NO: 1819261 - RNA, 18 nt, Human
gcuggccuggccccucag

SEQ ID NO: 1819262 - RNA, 19 nt, Human
gcuggccuggccccucagg

SEQ ID NO: 1819263 - RNA, 15 nt, Human
gcuggagugcaguga

SEQ ID NO: 1819264 - RNA, 14 nt, Human
gcuggagugcagug

SEQ ID NO: 1819265 - RNA, 16 nt, Human
gcuggccuggccccuc

SEQ ID NO: 1819266 - RNA, 17 nt, Human
gcuggccuggccccuca

SEQ ID NO: 1819267 - RNA, 19 nt, Human
gcugggucgcccuggacug

SEQ ID NO: 1819268 - RNA, 15 nt, Human
gcuggguguggcgca

SEQ ID NO: 1819269 - RNA, 17 nt, Human
gcugggucgcccuggac

SEQ ID NO: 1819270 - RNA, 18 nt, Human
gcugggucgcccuggacu

SEQ ID NO: 1819271 - RNA, 16 nt, Human
gcugggucgcccugga

SEQ ID NO: 1819272 - RNA, 14 nt, Human
gcugggcagguugg

SEQ ID NO: 1819273 - RNA, 16 nt, Human
gcugggcagaggaaag

SEQ ID NO: 1819274 - RNA, 17 nt, Human
gcugggcagaggaaagc

SEQ ID NO: 1819275 - RNA, 19 nt, Human
gcugggcagaggaaagcaa

SEQ ID NO: 1819276 - RNA, 12 nt, Human
gcugggcucccu

SEQ ID NO: 1819277 - RNA, 16 nt, Human
gcugggcucccuuccc

SEQ ID NO: 1819278 - RNA, 17 nt, Human
gcugggcucccuuccca

SEQ ID NO: 1819279 - RNA, 20 nt, Human
gcugggcucccuucccaccu

SEQ ID NO: 1819280 - RNA, 14 nt, Human
gcuggagcucugcc

SEQ ID NO: 1819281 - RNA, 12 nt, Human
gcuggagugcag

SEQ ID NO: 1819282 - RNA, 17 nt, Human
gcuggagcucugcccau

SEQ ID NO: 1819283 - RNA, 23 nt, Human
gcuucccgcucagcccucccugc

SEQ ID NO: 1819284 - RNA, 15 nt, Human
gcuucccgcucagcc

SEQ ID NO: 1819285 - RNA, 16 nt, Human
gcuucccgcucagccc

SEQ ID NO: 1819286 - RNA, 17 nt, Human
gcuucccgcucagcccu

SEQ ID NO: 1819287 - RNA, 18 nt, Human
gcuucccgcucagcccuc

SEQ ID NO: 1819288 - RNA, 19 nt, Human
gcuugaaacccguggcgcu

SEQ ID NO: 1819289 - RNA, 15 nt, Human
gcuugggaauuuuau

SEQ ID NO: 1819290 - RNA, 19 nt, Human
gcuugggcuucauccuccu

SEQ ID NO: 1819291 - RNA, 16 nt, Human
gcuuguacauaaugcg

SEQ ID NO: 1819292 - RNA, 14 nt, Human
gcuuguacauaaug

SEQ ID NO: 1819293 - RNA, 21 nt, Human
gcuggguuggaggguguccca

SEQ ID NO: 1819294 - RNA, 14 nt, Human
gcuggguuggaggg

SEQ ID NO: 1819295 - RNA, 15 nt, Human
gcuggguucuaccca

SEQ ID NO: 1819296 - RNA, 15 nt, Human
gcuggguucugaucc

SEQ ID NO: 1819297 - RNA, 23 nt, Human
gcuguaucccaugagccucagca

SEQ ID NO: 1819298 - RNA, 20 nt, Human
gcuguaucccaugagccuca

SEQ ID NO: 1819299 - RNA, 15 nt, Human
gcugguuuuucaguu

SEQ ID NO: 1819300 - RNA, 14 nt, Human
gcugguuuuucagu

SEQ ID NO: 1819301 - RNA, 21 nt, Human
gcugugcucuggacaggcaug

SEQ ID NO: 1819302 - RNA, 12 nt, Human
gcugugcugccc

SEQ ID NO: 1819303 - RNA, 13 nt, Human
gcugugcugcccu

SEQ ID NO: 1819304 - RNA, 19 nt, Human
gcugugcugcccugcccac

SEQ ID NO: 1819305 - RNA, 22 nt, Human
gcugugcugcccugcccaccug

SEQ ID NO: 1819306 - RNA, 22 nt, Human
gcuguuggcugggggccucagu

SEQ ID NO: 1819307 - RNA, 21 nt, Human
gcuguuggcugggggccucag

SEQ ID NO: 1819308 - RNA, 22 nt, Human
gcuucaaggauccugagccaga

SEQ ID NO: 1819309 - RNA, 14 nt, Human
gcuuaacuucacau

SEQ ID NO: 1819310 - RNA, 20 nt, Human
gcuucacggaagagccuugc

SEQ ID NO: 1819311 - RNA, 19 nt, Human
ggacccugaggcccagagg

SEQ ID NO: 1819312 - RNA, 20 nt, Human
ggacccggaggggccuggca

SEQ ID NO: 1819313 - RNA, 21 nt, Human
ggacccggaggggccuggcag

SEQ ID NO: 1819314 - RNA, 14 nt, Human
ggacccugaggccc

SEQ ID NO: 1819315 - RNA, 15 nt, Human
ggacccugaggccca

SEQ ID NO: 1819316 - RNA, 18 nt, Human
ggacccugaggcccagag

SEQ ID NO: 1819317 - RNA, 21 nt, Human
ggaccccgagccuggcuccaa

SEQ ID NO: 1819318 - RNA, 19 nt, Human
gcuuguacauaaugcgugc

SEQ ID NO: 1819319 - RNA, 17 nt, Human
ggacuuggaagcuccgc

SEQ ID NO: 1819320 - RNA, 15 nt, Human
ggacuuggaagcucc

SEQ ID NO: 1819321 - RNA, 19 nt, Human
ggagaaaauggacguguua

SEQ ID NO: 1819322 - RNA, 18 nt, Human
ggacuuuuauuuccagug

SEQ ID NO: 1819323 - RNA, 18 nt, Human
ggagaaaugaaaaaauau

SEQ ID NO: 1819324 - RNA, 22 nt, Human
ggagaaccaaaaagaggcuaug

SEQ ID NO: 1819325 - RNA, 13 nt, Human
ggagaacuagaga

SEQ ID NO: 1819326 - RNA, 16 nt, Human
ggagacugucucaaga

SEQ ID NO: 1819327 - RNA, 22 nt, Human
ggacucaaugcacugacauugu

SEQ ID NO: 1819328 - RNA, 16 nt, Human
ggacuaggguccuggg

SEQ ID NO: 1819329 - RNA, 20 nt, Human
ggacuacaggugugagucac

SEQ ID NO: 1819330 - RNA, 12 nt, Human
ggaccucaggcc

SEQ ID NO: 1819331 - RNA, 17 nt, Human
ggacuuagcugggagaa

SEQ ID NO: 1819332 - RNA, 22 nt, Human
ggacugugugcucaggagcccu

SEQ ID NO: 1819333 - RNA, 23 nt, Human
ggacugugugcucaggagcccug

SEQ ID NO: 1819334 - RNA, 14 nt, Human
ggagagagacucca

SEQ ID NO: 1819335 - RNA, 13 nt, Human
ggagagccuucca

SEQ ID NO: 1819336 - RNA, 16 nt, Human
ggagagccuuccaggg

SEQ ID NO: 1819337 - RNA, 22 nt, Human
ggagagccuuccagggguggga

SEQ ID NO: 1819338 - RNA, 17 nt, Human
ggagagccuuccagggg

SEQ ID NO: 1819339 - RNA, 18 nt, Human
ggagagccuuccaggggu

SEQ ID NO: 1819340 - RNA, 15 nt, Human
ggagagcuagcagca

SEQ ID NO: 1819341 - RNA, 13 nt, Human
ggagcagccacau

SEQ ID NO: 1819342 - RNA, 21 nt, Human
ggagcagccacauuccugaug

SEQ ID NO: 1819343 - RNA, 15 nt, Human
ggagcccacuguacu

SEQ ID NO: 1819344 - RNA, 12 nt, Human
ggaggaagagaa

SEQ ID NO: 1819345 - RNA, 21 nt, Human
ggaggaaaaccaagccguggc

SEQ ID NO: 1819346 - RNA, 22 nt, Human
ggaggaaaaccaagccguggcu

SEQ ID NO: 1819347 - RNA, 20 nt, Human
ggaggaaaaccaagccgugg

SEQ ID NO: 1819348 - RNA, 21 nt, Human
ggaggcaugugaugagaggaa

SEQ ID NO: 1819349 - RNA, 13 nt, Human
ggaggccagccuu

SEQ ID NO: 1819350 - RNA, 18 nt, Human
ggaggccaaggugggagg

SEQ ID NO: 1819351 - RNA, 20 nt, Human
ggaggccaaggugggaggau

SEQ ID NO: 1819352 - RNA, 17 nt, Human
ggaggcucuggagccca

SEQ ID NO: 1819353 - RNA, 20 nt, Human
ggaggcucuggagcccacug

SEQ ID NO: 1819354 - RNA, 22 nt, Human
ggagcugccuguucagcuccag

SEQ ID NO: 1819355 - RNA, 16 nt, Human
ggagcugaguggggga

SEQ ID NO: 1819356 - RNA, 18 nt, Human
ggagcccacuguacuugc

SEQ ID NO: 1819357 - RNA, 22 nt, Human
ggagcccacuguacuugcucuu

SEQ ID NO: 1819358 - RNA, 18 nt, Human
ggaggucgaggcaggagg

SEQ ID NO: 1819359 - RNA, 15 nt, Human
ggaggucgaggcagg

SEQ ID NO: 1819360 - RNA, 16 nt, Human
ggaggucgaggcagga

SEQ ID NO: 1819361 - RNA, 21 nt, Human
ggaggcucuggagcccacugu

SEQ ID NO: 1819362 - RNA, 19 nt, Human
ggaggcugagaugggagaa

SEQ ID NO: 1819363 - RNA, 15 nt, Human
ggaggcugagauggg

SEQ ID NO: 1819364 - RNA, 20 nt, Human
ggccagaugcaccagcccuu

SEQ ID NO: 1819365 - RNA, 19 nt, Human
ggccagaugcaccagcccu

SEQ ID NO: 1819366 - RNA, 23 nt, Human
ggccagagggagugacagaggca

SEQ ID NO: 1819367 - RNA, 21 nt, Human
ggccaaggaugccccgucccc

SEQ ID NO: 1819368 - RNA, 13 nt, Human
ggccaagguggga

SEQ ID NO: 1819369 - RNA, 15 nt, Human
ggccaaagccaaagc

SEQ ID NO: 1819370 - RNA, 12 nt, Human
ggccaaaggaag

SEQ ID NO: 1819371 - RNA, 13 nt, Human
ggccaaaggaagc

SEQ ID NO: 1819372 - RNA, 21 nt, Human
ggccaaaggaagcacaugccu

SEQ ID NO: 1819373 - RNA, 12 nt, Human
ggcauuguggga

SEQ ID NO: 1819374 - RNA, 19 nt, Human
ggccagguggccacuccag

SEQ ID NO: 1819375 - RNA, 16 nt, Human
ggcccgacagccuggc

SEQ ID NO: 1819376 - RNA, 17 nt, Human
ggcccgacagccuggca

SEQ ID NO: 1819377 - RNA, 23 nt, Human
ggcccuuccucuccacugccuuc

SEQ ID NO: 1819378 - RNA, 19 nt, Human
ggcccuuccucuccacugc

SEQ ID NO: 1819379 - RNA, 22 nt, Human
ggcccuuccucuccacugccuu

SEQ ID NO: 1819380 - RNA, 13 nt, Human
ggccucccaaagu

SEQ ID NO: 1819381 - RNA, 14 nt, Human
ggcccuuccuuuuc

SEQ ID NO: 1819382 - RNA, 13 nt, Human
ggccucccaacuc

SEQ ID NO: 1819383 - RNA, 14 nt, Human
ggccucccaacuca

SEQ ID NO: 1819384 - RNA, 22 nt, Human
ggcagccgugccuucagcucua

SEQ ID NO: 1819385 - RNA, 19 nt, Human
ggcagccgugccuucagcu

SEQ ID NO: 1819386 - RNA, 21 nt, Human
ggcagccgugccuucagcucu

SEQ ID NO: 1819387 - RNA, 18 nt, Human
ggcagccgugccuucagc

SEQ ID NO: 1819388 - RNA, 10 nt, Human
ggcagagcag

SEQ ID NO: 1819389 - RNA, 12 nt, Human
ggcagagcagag

SEQ ID NO: 1819390 - RNA, 15 nt, Human
ggcagccaggccaca

SEQ ID NO: 1819391 - RNA, 17 nt, Human
ggcagccaggccacaag

SEQ ID NO: 1819392 - RNA, 12 nt, Human
ggcagaaggaag

SEQ ID NO: 1819393 - RNA, 23 nt, Human
ggauuaaacuuaaucuaaaugga

SEQ ID NO: 1819394 - RNA, 21 nt, Human
ggauuuugauccaagcugguc

SEQ ID NO: 1819395 - RNA, 13 nt, Human
ggauguucuggga

SEQ ID NO: 1819396 - RNA, 22 nt, Human
ggaugagaaagguugaagcacc

SEQ ID NO: 1819397 - RNA, 12 nt, Human
ggaugagaaagg

SEQ ID NO: 1819398 - RNA, 21 nt, Human
ggaugaauuccaaauucugcu

SEQ ID NO: 1819399 - RNA, 13 nt, Human
aaaggaauuuaaa

SEQ ID NO: 1819400 - RNA, 11 nt, Human
aaaggaaagag

SEQ ID NO: 1819401 - RNA, 17 nt, Human
aaagcagugcaugcugu

SEQ ID NO: 1819402 - RNA, 18 nt, Human
aaagcuaggccuggccag

SEQ ID NO: 1819403 - RNA, 13 nt, Human
aaagcuagaaaug

SEQ ID NO: 1819404 - RNA, 21 nt, Human
aaagcagugcaugcugucccu

SEQ ID NO: 1819405 - RNA, 22 nt, Human
aaagcagugcaugcugucccuu

SEQ ID NO: 1819406 - RNA, 22 nt, Human
ggucuugaacuccuggccucaa

SEQ ID NO: 1819407 - RNA, 21 nt, Human
ggucuugaacuccuggccuca

SEQ ID NO: 1819408 - RNA, 19 nt, Human
ggucuguucuuuccaaagu

SEQ ID NO: 1819409 - RNA, 17 nt, Human
ggucuguucuuuccaaa

SEQ ID NO: 1819410 - RNA, 12 nt, Human
ggucuguucuuu

SEQ ID NO: 1819411 - RNA, 24 nt, Human
ggucugugagaugcuagaacuccc

SEQ ID NO: 1819412 - RNA, 14 nt, Human
ggucugugagaugc

SEQ ID NO: 1819413 - RNA, 16 nt, Human
ggugcacaagcuccaa

SEQ ID NO: 1819414 - RNA, 22 nt, Human
ggugcacaagcuccaagcuccc

SEQ ID NO: 1819415 - RNA, 21 nt, Human
ggugauccacucgccuucauc

SEQ ID NO: 1819416 - RNA, 17 nt, Human
aaagaauggaaggugga

SEQ ID NO: 1819417 - RNA, 15 nt, Human
aaagacuguacaaag

SEQ ID NO: 1819418 - RNA, 19 nt, Human
aaagacuuuuccaacccuc

SEQ ID NO: 1819419 - RNA, 15 nt, Human
aaagaugagugagca

SEQ ID NO: 1819420 - RNA, 13 nt, Human
aaagaggcuaugu

SEQ ID NO: 1819421 - RNA, 18 nt, Human
aaagaggcuaugugagca

SEQ ID NO: 1819422 - RNA, 16 nt, Human
aaagauguucuggaua

SEQ ID NO: 1819423 - RNA, 20 nt, Human
aaagaugagcuuugucuacu

SEQ ID NO: 1819424 - RNA, 22 nt, Human
gguccacccaggagccccgagg

SEQ ID NO: 1819425 - RNA, 20 nt, Human
gguccacccaggagccccga

SEQ ID NO: 1819426 - RNA, 12 nt, Human
ggucccacccca

SEQ ID NO: 1819427 - RNA, 14 nt, Human
aaacuuuaccuuuu

SEQ ID NO: 1819428 - RNA, 23 nt, Human
gguauuggcuagagguucaaaga

SEQ ID NO: 1819429 - RNA, 19 nt, Human
gguccacccaggagccccg

SEQ ID NO: 1819430 - RNA, 18 nt, Human
gguauaaguggugugugu

SEQ ID NO: 1819431 - RNA, 21 nt, Human
aaaauguaggguuauaauaau

SEQ ID NO: 1819432 - RNA, 21 nt, Human
aaaauggacguguuaugacuc

SEQ ID NO: 1819433 - RNA, 16 nt, Human
aaaauuuuuaaucuuu

SEQ ID NO: 1819434 - RNA, 19 nt, Human
aaaauuuuuaaucuuuaau

SEQ ID NO: 1819435 - RNA, 18 nt, Human
aaacaagaccacguuucu

SEQ ID NO: 1819436 - RNA, 13 nt, Human
aaacaaagaaauu

SEQ ID NO: 1819437 - RNA, 22 nt, Human
aaacaugcuacacacugcaugu

SEQ ID NO: 1819438 - RNA, 16 nt, Human
aaacaugcuacacacu

SEQ ID NO: 1819439 - RNA, 13 nt, Human
ggggaccucaggc

SEQ ID NO: 1819440 - RNA, 15 nt, Human
ggggaccucaggccu

SEQ ID NO: 1819441 - RNA, 16 nt, Human
ggggaccucaggccug

SEQ ID NO: 1819442 - RNA, 17 nt, Human
ggggaccucaggccugg

SEQ ID NO: 1819443 - RNA, 13 nt, Human
ggggccaggcugg

SEQ ID NO: 1819444 - RNA, 14 nt, Human
ggggccaggcuggg

SEQ ID NO: 1819445 - RNA, 16 nt, Human
ggggccaggcuggguc

SEQ ID NO: 1819446 - RNA, 17 nt, Human
ggggccaguuggucccc

SEQ ID NO: 1819447 - RNA, 19 nt, Human
ggggccaguuggucccccu

SEQ ID NO: 1819448 - RNA, 16 nt, Human
ggggcccugccuccuu

SEQ ID NO: 1819449 - RNA, 19 nt, Human
ggggcccugccuccuuugu

SEQ ID NO: 1819450 - RNA, 23 nt, Human
ggggcccugccuccuuugugagg

SEQ ID NO: 1819451 - RNA, 23 nt, Human
aaacggccucacuaggcuucugg

SEQ ID NO: 1819452 - RNA, 21 nt, Human
aaaccacauuggagauguuua

SEQ ID NO: 1819453 - RNA, 12 nt, Human
aaacgugaaaau

SEQ ID NO: 1819454 - RNA, 16 nt, Human
aaacguggcugcuuca

SEQ ID NO: 1819455 - RNA, 17 nt, Human
aaacguggcugcuucaa

SEQ ID NO: 1819456 - RNA, 20 nt, Human
aaacguggcugcuucaagga

SEQ ID NO: 1819457 - RNA, 11 nt, Human
aaacuccugac

SEQ ID NO: 1819458 - RNA, 12 nt, Human
aaacugcccccu

SEQ ID NO: 1819459 - RNA, 11 nt, Human
aaacugccccc

SEQ ID NO: 1819460 - RNA, 22 nt, Human
aaacuccagaugccacaaugga

SEQ ID NO: 1819461 - RNA, 15 nt, Human
aaacuccagaugcca

SEQ ID NO: 1819462 - RNA, 13 nt, Human
aaacugcccccuc

SEQ ID NO: 1819463 - RNA, 17 nt, Human
aaacugcccccucugcc

SEQ ID NO: 1819464 - RNA, 19 nt, Human
aaacugcccccucugcccu

SEQ ID NO: 1819465 - RNA, 20 nt, Human
aaacugcccccucugcccug

SEQ ID NO: 1819466 - RNA, 21 nt, Human
aaacugcccccucugcccugc

SEQ ID NO: 1819467 - RNA, 16 nt, Human
aaacuggauuaaacuu

SEQ ID NO: 1819468 - RNA, 23 nt, Human
gggucucacuauguugcccaggc

SEQ ID NO: 1819469 - RNA, 12 nt, Human
gggucucacucu

SEQ ID NO: 1819470 - RNA, 22 nt, Human
gggucucacuauguugcccagg

SEQ ID NO: 1819471 - RNA, 19 nt, Human
aaacauguuucuuuguaau

SEQ ID NO: 1819472 - RNA, 22 nt, Human
aaacauguuucuuuguaaugaa

SEQ ID NO: 1819473 - RNA, 23 nt, Human
aaacauguuucuuuguaaugaaa

SEQ ID NO: 1819474 - RNA, 14 nt, Human
aaaccaagccgugg

SEQ ID NO: 1819475 - RNA, 16 nt, Human
aaaccaagccguggcu

SEQ ID NO: 1819476 - RNA, 14 nt, Human
aaacauuaaaauau

SEQ ID NO: 1819477 - RNA, 20 nt, Human
ggguaucaggugcugccauc

SEQ ID NO: 1819478 - RNA, 22 nt, Human
gggaacagacuggaagcacagc

SEQ ID NO: 1819479 - RNA, 20 nt, Human
aaaaaucucaaauuucuaaa

SEQ ID NO: 1819480 - RNA, 19 nt, Human
aaaaaucucaaauuucuaa

SEQ ID NO: 1819481 - RNA, 14 nt, Human
gggaacagacugga

SEQ ID NO: 1819482 - RNA, 19 nt, Human
aaaacugcucauaugaugu

SEQ ID NO: 1819483 - RNA, 20 nt, Human
aaaacugcugacuguuuucu

SEQ ID NO: 1819484 - RNA, 18 nt, Human
aaaacugauuuuuuuuuc

SEQ ID NO: 1819485 - RNA, 22 nt, Human
aaaacugauuuuuuuuuccuuc

SEQ ID NO: 1819486 - RNA, 19 nt, Human
aaaaccaagccguggcuuc

SEQ ID NO: 1819487 - RNA, 21 nt, Human
aaaacguggcugcuucaagga

SEQ ID NO: 1819488 - RNA, 14 nt, Human
aaaacguggcugcu

SEQ ID NO: 1819489 - RNA, 16 nt, Human
aaaacguggcugcuuc

SEQ ID NO: 1819490 - RNA, 17 nt, Human
aaaacguggcugcuuca

SEQ ID NO: 1819491 - RNA, 18 nt, Human
aaaacguggcugcuucaa

SEQ ID NO: 1819492 - RNA, 15 nt, Human
aaaaccaauguucuc

SEQ ID NO: 1819493 - RNA, 22 nt, Human
aaaagcuccauuuuuagugaaa

SEQ ID NO: 1819494 - RNA, 14 nt, Human
aaaagcugggcagg

SEQ ID NO: 1819495 - RNA, 16 nt, Human
aaaagccuguuuaaga

SEQ ID NO: 1819496 - RNA, 18 nt, Human
aaaagccuguuuaagaga

SEQ ID NO: 1819497 - RNA, 21 nt, Human
aaaacuuuaugcuaagugaaa

SEQ ID NO: 1819498 - RNA, 11 nt, Human
gggaggcagag

SEQ ID NO: 1819499 - RNA, 13 nt, Human
gggagggccuggg

SEQ ID NO: 1819500 - RNA, 11 nt, Human
gggagggcucc

SEQ ID NO: 1819501 - RNA, 13 nt, Human
gggagggcuccag

SEQ ID NO: 1819502 - RNA, 19 nt, Human
gggaggccaaggugggagg

SEQ ID NO: 1819503 - RNA, 20 nt, Human
gggaggcagagguugcagug

SEQ ID NO: 1819504 - RNA, 15 nt, Human
gggauuuccaugaug

SEQ ID NO: 1819505 - RNA, 18 nt, Human
aaaagggaacugaacauu

SEQ ID NO: 1819506 - RNA, 16 nt, Human
aaaagggacugagaaa

SEQ ID NO: 1819507 - RNA, 15 nt, Human
aaaauaccagccagu

SEQ ID NO: 1819508 - RNA, 14 nt, Human
aaaauaccaaggaa

SEQ ID NO: 1819509 - RNA, 14 nt, Human
aaaauaccagccag

SEQ ID NO: 1819510 - RNA, 12 nt, Human
aaaauaaauuau

SEQ ID NO: 1819511 - RNA, 13 nt, Human
aaaauauagcuaa

SEQ ID NO: 1819512 - RNA, 18 nt, Human
aaaauauauaucaaauau

SEQ ID NO: 1819513 - RNA, 18 nt, Human
aaaauaguggugugauuu

SEQ ID NO: 1819514 - RNA, 12 nt, Human
aaaauagccugc

SEQ ID NO: 1819515 - RNA, 23 nt, Human
gggaaaaucagccugcuccagcu

SEQ ID NO: 1819516 - RNA, 13 nt, Human
gggaaaaucagcc

SEQ ID NO: 1819517 - RNA, 16 nt, Human
ggcuucaguggcagcu

SEQ ID NO: 1819518 - RNA, 23 nt, Human
ggcuguaucccaugagccucagc

SEQ ID NO: 1819519 - RNA, 15 nt, Human
ggcugucaauuacag

SEQ ID NO: 1819520 - RNA, 22 nt, Human
ggcuguaucccaugagccucag

SEQ ID NO: 1819521 - RNA, 20 nt, Human
ggcuguaucccaugagccuc

SEQ ID NO: 1819522 - RNA, 15 nt, Human
ggcuucaguggcagc

SEQ ID NO: 1819523 - RNA, 16 nt, Human
ggcuggugucaccuga

SEQ ID NO: 1819524 - RNA, 19 nt, Human
ggcuguaucccaugagccu

SEQ ID NO: 1819525 - RNA, 13 nt, Human
aaaaaaacacaaa

SEQ ID NO: 1819526 - RNA, 20 nt, Human
aaaaagcuccaaaugcagcu

SEQ ID NO: 1819527 - RNA, 20 nt, Human
ggcuggcgugcaguggugcg

SEQ ID NO: 1819528 - RNA, 16 nt, Human
ggcuggcgugcagugg

SEQ ID NO: 1819529 - RNA, 14 nt, Human
ggcuggcgugcagu

SEQ ID NO: 1819530 - RNA, 16 nt, Human
ggcuggcccugcccug

SEQ ID NO: 1819531 - RNA, 13 nt, Human
ggcuggcccugcc

SEQ ID NO: 1819532 - RNA, 14 nt, Human
ggcuggcccugccc

SEQ ID NO: 1819533 - RNA, 15 nt, Human
ggcuggcccugcccu

SEQ ID NO: 1819534 - RNA, 17 nt, Human
ggcuggccuggccccuc

SEQ ID NO: 1819535 - RNA, 22 nt, Human
ggcuggccuggccccucagggu

SEQ ID NO: 1819536 - RNA, 13 nt, Human
ggcugggagagcc

SEQ ID NO: 1819537 - RNA, 17 nt, Human
ggcugcagggaguccga

SEQ ID NO: 1819538 - RNA, 22 nt, Human
ggcugcaugcgggcuuccuccu

SEQ ID NO: 1819539 - RNA, 20 nt, Human
ggcugcaugcgggcuuccuc

SEQ ID NO: 1819540 - RNA, 18 nt, Human
ggcucgagcaugccugga

SEQ ID NO: 1819541 - RNA, 23 nt, Human
ggcucuuccaggcugggagagcc

SEQ ID NO: 1819542 - RNA, 24 nt, Human
ggcucuuccaggcugggagagccu

SEQ ID NO: 1819543 - RNA, 20 nt, Human
ggcucuuccaggcugggaga

SEQ ID NO: 1819544 - RNA, 12 nt, Human
ggcuccugccac

SEQ ID NO: 1819545 - RNA, 13 nt, Human
ggcuccugccacc

SEQ ID NO: 1819546 - RNA, 17 nt, Human
ggcuccucccggugccc

SEQ ID NO: 1819547 - RNA, 20 nt, Human
ggcucccuucccaccucucu

SEQ ID NO: 1819548 - RNA, 22 nt, Human
ggcucccuucccaccucucuca

SEQ ID NO: 1819549 - RNA, 17 nt, Human
ggcucccuucccaccuc

SEQ ID NO: 1819550 - RNA, 18 nt, Human
ggcucccuucccaccucu

SEQ ID NO: 1819551 - RNA, 16 nt, Human
ggcucccuucccaccu

SEQ ID NO: 1819552 - RNA, 21 nt, Human
cauuuggugguuucagaaaug

SEQ ID NO: 1819553 - RNA, 23 nt, Human
cauuuguuucuuucucugaggac

SEQ ID NO: 1819554 - RNA, 23 nt, Human
cauuuuuuuuaagaaaaaggaug

SEQ ID NO: 1819555 - RNA, 22 nt, Human
cauuuguuucuuucucugagga

SEQ ID NO: 1819556 - RNA, 21 nt, Human
cauuuguuucuuucucugagg

SEQ ID NO: 1819557 - RNA, 14 nt, Human
ccaaaaggcagaag

SEQ ID NO: 1819558 - RNA, 18 nt, Human
cauuuaggugaggaagca

SEQ ID NO: 1819559 - RNA, 16 nt, Human
cauuuaggugaggaag

SEQ ID NO: 1819560 - RNA, 16 nt, Human
cauuggagauguuuag

SEQ ID NO: 1819561 - RNA, 21 nt, Human
ccaacucaccccagccccaaa

SEQ ID NO: 1819562 - RNA, 15 nt, Human
ccaagcucugcuccu

SEQ ID NO: 1819563 - RNA, 14 nt, Human
ccaagcucugcucc

SEQ ID NO: 1819564 - RNA, 16 nt, Human
ccaagcucugcuccuc

SEQ ID NO: 1819565 - RNA, 16 nt, Human
ccaaaucauaguggcu

SEQ ID NO: 1819566 - RNA, 23 nt, Human
ccaaaucagcugcuacuacuccu

SEQ ID NO: 1819567 - RNA, 15 nt, Human
ccaaaucagcugcua

SEQ ID NO: 1819568 - RNA, 14 nt, Human
ccaacuauggccug

SEQ ID NO: 1819569 - RNA, 15 nt, Human
ccaacuauggccugu

SEQ ID NO: 1819570 - RNA, 16 nt, Human
ccaacuauggccugug

SEQ ID NO: 1819571 - RNA, 13 nt, Human
ccaacucacccca

SEQ ID NO: 1819572 - RNA, 21 nt, Human
ccaauggagacugucucaaga

SEQ ID NO: 1819573 - RNA, 23 nt, Human
ccaauggacuaacuugucuuugg

SEQ ID NO: 1819574 - RNA, 14 nt, Human
ccaaugggagcuca

SEQ ID NO: 1819575 - RNA, 14 nt, Human
ccaaagugcuggga

SEQ ID NO: 1819576 - RNA, 22 nt, Human
ccaaaguacacuguuucaaacu

SEQ ID NO: 1819577 - RNA, 20 nt, Human
cauucuccuuguguuacuaa

SEQ ID NO: 1819578 - RNA, 17 nt, Human
cauucuccaccugccag

SEQ ID NO: 1819579 - RNA, 18 nt, Human
cauucuccaccugccagg

SEQ ID NO: 1819580 - RNA, 19 nt, Human
cauucuccaccugccaggg

SEQ ID NO: 1819581 - RNA, 21 nt, Human
cauucuccaccugccagggac

SEQ ID NO: 1819582 - RNA, 19 nt, Human
cauguuggccaggcugguc

SEQ ID NO: 1819583 - RNA, 20 nt, Human
cauguuggccaggcugcucu

SEQ ID NO: 1819584 - RNA, 17 nt, Human
cauguuggccaggcugg

SEQ ID NO: 1819585 - RNA, 18 nt, Human
cauguuggccaggcuggu

SEQ ID NO: 1819586 - RNA, 18 nt, Human
cauguucuuaauucuuag

SEQ ID NO: 1819587 - RNA, 21 nt, Human
cauguuacauaagauaaaugu

SEQ ID NO: 1819588 - RNA, 16 nt, Human
cauguucuuaauucuu

SEQ ID NO: 1819589 - RNA, 13 nt, Human
cauguucuuaauu

SEQ ID NO: 1819590 - RNA, 15 nt, Human
cauguccaagaagcc

SEQ ID NO: 1819591 - RNA, 16 nt, Human
cauguccaagaagccc

SEQ ID NO: 1819592 - RNA, 16 nt, Human
cauguuacauaagaua

SEQ ID NO: 1819593 - RNA, 17 nt, Human
cauguuacauaagauaa

SEQ ID NO: 1819594 - RNA, 15 nt, Human
cauggccagguggcc

SEQ ID NO: 1819595 - RNA, 20 nt, Human
caugcuccuggcccacugca

SEQ ID NO: 1819596 - RNA, 17 nt, Human
caugcuccuggcccacu

SEQ ID NO: 1819597 - RNA, 14 nt, Human
caugcuccuggccc

SEQ ID NO: 1819598 - RNA, 16 nt, Human
caugcuccuggcccac

SEQ ID NO: 1819599 - RNA, 22 nt, Human
cauggccucuucagaucucuaa

SEQ ID NO: 1819600 - RNA, 14 nt, Human
cauggccgugaacu

SEQ ID NO: 1819601 - RNA, 21 nt, Human
cauggccucuucagaucucua

SEQ ID NO: 1819602 - RNA, 20 nt, Human
caugggaaaugucaacaagu

SEQ ID NO: 1819603 - RNA, 18 nt, Human
caugggaaaggggaaguu

SEQ ID NO: 1819604 - RNA, 21 nt, Human
caugaauauuuaguguucaua

SEQ ID NO: 1819605 - RNA, 16 nt, Human
caugaauuugugaagg

SEQ ID NO: 1819606 - RNA, 13 nt, Human
caugacaaagacu

SEQ ID NO: 1819607 - RNA, 15 nt, Human
caugcaaggucauuu

SEQ ID NO: 1819608 - RNA, 12 nt, Human
caugcaagguca

SEQ ID NO: 1819609 - RNA, 17 nt, Human
caguuauuauauuuaca

SEQ ID NO: 1819610 - RNA, 21 nt, Human
caguuauuauauuuacaaaug

SEQ ID NO: 1819611 - RNA, 20 nt, Human
caguggugcgaucuggguuc

SEQ ID NO: 1819612 - RNA, 19 nt, Human
caguggugcgaucuggguu

SEQ ID NO: 1819613 - RNA, 21 nt, Human
cagugguaugaucacggcuca

SEQ ID NO: 1819614 - RNA, 20 nt, Human
caguuacucagaauucucua

SEQ ID NO: 1819615 - RNA, 23 nt, Human
cagucugauucccaagcucugcu

SEQ ID NO: 1819616 - RNA, 22 nt, Human
cagugauuaccagggacugagg

SEQ ID NO: 1819617 - RNA, 22 nt, Human
cagugcccacaggaucagucug

SEQ ID NO: 1819618 - RNA, 21 nt, Human
cagugcccacaggaucagucu

SEQ ID NO: 1819619 - RNA, 18 nt, Human
cagugggagcugccuguu

SEQ ID NO: 1819620 - RNA, 17 nt, Human
cagugggagcugccugu

SEQ ID NO: 1819621 - RNA, 16 nt, Human
cagugggagcugccug

SEQ ID NO: 1819622 - RNA, 20 nt, Human
cagugguaugaucacggcuc

SEQ ID NO: 1819623 - RNA, 22 nt, Human
cagucugauucccaagcucugc

SEQ ID NO: 1819624 - RNA, 21 nt, Human
cagucugauucccaagcucug

SEQ ID NO: 1819625 - RNA, 22 nt, Human
caguuauuauauuuacaaaugg

SEQ ID NO: 1819626 - RNA, 19 nt, Human
caucccaaacccuucagug

SEQ ID NO: 1819627 - RNA, 21 nt, Human
caucagcacgauuucuguuua

SEQ ID NO: 1819628 - RNA, 20 nt, Human
caucccaaacccuucagugc

SEQ ID NO: 1819629 - RNA, 11 nt, Human
caucccagccc

SEQ ID NO: 1819630 - RNA, 12 nt, Human
caucccagcccc

SEQ ID NO: 1819631 - RNA, 22 nt, Human
cauccucuguacagagcccacg

SEQ ID NO: 1819632 - RNA, 15 nt, Human
caucuaaacugcccc

SEQ ID NO: 1819633 - RNA, 21 nt, Human
caucuaaacugcccccucugc

SEQ ID NO: 1819634 - RNA, 19 nt, Human
cauccugaggcuccacuug

SEQ ID NO: 1819635 - RNA, 18 nt, Human
cauccugaggcuccacuu

SEQ ID NO: 1819636 - RNA, 16 nt, Human
cauagguuuaauaauu

SEQ ID NO: 1819637 - RNA, 23 nt, Human
cauagcagagaaugaaagggccc

SEQ ID NO: 1819638 - RNA, 19 nt, Human
cauagcagcuuauucacaa

SEQ ID NO: 1819639 - RNA, 20 nt, Human
cauagcagcuuauucacaag

SEQ ID NO: 1819640 - RNA, 21 nt, Human
cauauuauuuuauguugcaua

SEQ ID NO: 1819641 - RNA, 18 nt, Human
cauaauuauuauuuggcc

SEQ ID NO: 1819642 - RNA, 23 nt, Human
cauacaggaagguagaaauaucu

SEQ ID NO: 1819643 - RNA, 16 nt, Human
cauacaguuugcacuu

SEQ ID NO: 1819644 - RNA, 11 nt, Human
caguuuuccuu

SEQ ID NO: 1819645 - RNA, 23 nt, Human
cauaaugcgugcauaccacuuuu

SEQ ID NO: 1819646 - RNA, 23 nt, Human
caguuuguuaguaugaggcauuu

SEQ ID NO: 1819647 - RNA, 21 nt, Human
caguuuguuaguaugaggcau

SEQ ID NO: 1819648 - RNA, 18 nt, Human
caguuguuagugugucuu

SEQ ID NO: 1819649 - RNA, 22 nt, Human
caguuguuagugugucuuagug

SEQ ID NO: 1819650 - RNA, 14 nt, Human
cagauccccaagcc

SEQ ID NO: 1819651 - RNA, 22 nt, Human
cagauauaaaagacugaccaau

SEQ ID NO: 1819652 - RNA, 19 nt, Human
cagauagauauaugcucug

SEQ ID NO: 1819653 - RNA, 14 nt, Human
cagaggggguggcc

SEQ ID NO: 1819654 - RNA, 16 nt, Human
cagaggggguggccuc

SEQ ID NO: 1819655 - RNA, 19 nt, Human
cagauacuuggggggcuga

SEQ ID NO: 1819656 - RNA, 20 nt, Human
cagaggaaagcaaaggagau

SEQ ID NO: 1819657 - RNA, 13 nt, Human
cagaggggguggc

SEQ ID NO: 1819658 - RNA, 17 nt, Human
cagaggaaagcaaagga

SEQ ID NO: 1819659 - RNA, 19 nt, Human
cagaggaaagcaaaggaga

SEQ ID NO: 1819660 - RNA, 23 nt, Human
cagagaggguggugaccucugcc

SEQ ID NO: 1819661 - RNA, 23 nt, Human
cagagagggugggagugggccca

SEQ ID NO: 1819662 - RNA, 20 nt, Human
cagagagguuaaggugggua

SEQ ID NO: 1819663 - RNA, 13 nt, Human
cagagcugccacc

SEQ ID NO: 1819664 - RNA, 22 nt, Human
cagagaggguggugaccucugc

SEQ ID NO: 1819665 - RNA, 20 nt, Human
cagagaggguggugaccucu

SEQ ID NO: 1819666 - RNA, 17 nt, Human
cagagaggguggugacc

SEQ ID NO: 1819667 - RNA, 13 nt, Human
cagagaggguggg

SEQ ID NO: 1819668 - RNA, 12 nt, Human
cagagagggugg

SEQ ID NO: 1819669 - RNA, 18 nt, Human
cagcacgggggccaagga

SEQ ID NO: 1819670 - RNA, 15 nt, Human
cagcacgauuucugu

SEQ ID NO: 1819671 - RNA, 14 nt, Human
cagcacgauuucug

SEQ ID NO: 1819672 - RNA, 18 nt, Human
cagauugcaacaggcugg

SEQ ID NO: 1819673 - RNA, 20 nt, Human
cagauugcaacaggcugggc

SEQ ID NO: 1819674 - RNA, 19 nt, Human
cagauugcaacaggcuggg

SEQ ID NO: 1819675 - RNA, 13 nt, Human
cagauuuaugcau

SEQ ID NO: 1819676 - RNA, 13 nt, Human
cagauuucacucu

SEQ ID NO: 1819677 - RNA, 20 nt, Human
cagauuucacucuccuuggu

SEQ ID NO: 1819678 - RNA, 19 nt, Human
cagauuugaacucuucaau

SEQ ID NO: 1819679 - RNA, 17 nt, Human
cagcaccaucucuccuc

SEQ ID NO: 1819680 - RNA, 19 nt, Human
cagauuucacucuccuugg

SEQ ID NO: 1819681 - RNA, 19 nt, Human
cagcaccaucucuccuccu

SEQ ID NO: 1819682 - RNA, 21 nt, Human
cagacuggaagcacagcuuca

SEQ ID NO: 1819683 - RNA, 20 nt, Human
cagacuggaagcacagcuuc

SEQ ID NO: 1819684 - RNA, 18 nt, Human
cagacuggaagcacagcu

SEQ ID NO: 1819685 - RNA, 17 nt, Human
cagacuggaagcacagc

SEQ ID NO: 1819686 - RNA, 16 nt, Human
cagacuggaagcacag

SEQ ID NO: 1819687 - RNA, 14 nt, Human
cagacuggaagcac

SEQ ID NO: 1819688 - RNA, 13 nt, Human
cagacuggaagca

SEQ ID NO: 1819689 - RNA, 23 nt, Human
cagacaggcaagcaccuccugcc

SEQ ID NO: 1819690 - RNA, 22 nt, Human
cagacaggcaagcaccuccugc

SEQ ID NO: 1819691 - RNA, 17 nt, Human
cagacucuacagaggcc

SEQ ID NO: 1819692 - RNA, 21 nt, Human
cagacucuacagaggccaugg

SEQ ID NO: 1819693 - RNA, 20 nt, Human
cagacucuacagaggccaug

SEQ ID NO: 1819694 - RNA, 19 nt, Human
cagacucuacagaggccau

SEQ ID NO: 1819695 - RNA, 18 nt, Human
cagacucuacagaggcca

SEQ ID NO: 1819696 - RNA, 23 nt, Human
cagacucuacagaggccaugggc

SEQ ID NO: 1819697 - RNA, 21 nt, Human
cagacaggcaagcaccuccug

SEQ ID NO: 1819698 - RNA, 20 nt, Human
cagacaggcaagcaccuccu

SEQ ID NO: 1819699 - RNA, 18 nt, Human
cagacaggcaagcaccuc

SEQ ID NO: 1819700 - RNA, 13 nt, Human
cagacaggcaagc

SEQ ID NO: 1819701 - RNA, 11 nt, Human
cagacaggcaa

SEQ ID NO: 1819702 - RNA, 17 nt, Human
cagacaggaccagggau

SEQ ID NO: 1819703 - RNA, 24 nt, Human
cagacaggaccagggauuuccaug

SEQ ID NO: 1819704 - RNA, 13 nt, Human
cagacaggaccag

SEQ ID NO: 1819705 - RNA, 15 nt, Human
cagacaggaccaggg

SEQ ID NO: 1819706 - RNA, 16 nt, Human
cagacaggaccaggga

SEQ ID NO: 1819707 - RNA, 15 nt, Human
cagacagcugccugg

SEQ ID NO: 1819708 - RNA, 16 nt, Human
cagacagcugccuggg

SEQ ID NO: 1819709 - RNA, 17 nt, Human
cagacagcugccuggga

SEQ ID NO: 1819710 - RNA, 18 nt, Human
cagacagcugccugggau

SEQ ID NO: 1819711 - RNA, 14 nt, Human
cagacagcccucca

SEQ ID NO: 1819712 - RNA, 13 nt, Human
cagacagcugccu

SEQ ID NO: 1819713 - RNA, 14 nt, Human
cagacagcugccug

SEQ ID NO: 1819714 - RNA, 16 nt, Human
cagcugucaaggcuca

SEQ ID NO: 1819715 - RNA, 19 nt, Human
caggaaaggcuccaggagc

SEQ ID NO: 1819716 - RNA, 20 nt, Human
caggaaaggcuccaggagca

SEQ ID NO: 1819717 - RNA, 16 nt, Human
caggaaaggcuccagg

SEQ ID NO: 1819718 - RNA, 17 nt, Human
caggaaaggcuccagga

SEQ ID NO: 1819719 - RNA, 14 nt, Human
cagcugagaggcug

SEQ ID NO: 1819720 - RNA, 21 nt, Human
cagcugacuuuucuguccgag

SEQ ID NO: 1819721 - RNA, 17 nt, Human
cagccugcuccagcugu

SEQ ID NO: 1819722 - RNA, 19 nt, Human
cagccugcuccagcuguuc

SEQ ID NO: 1819723 - RNA, 16 nt, Human
cagccugcuccagcug

SEQ ID NO: 1819724 - RNA, 15 nt, Human
cagcuaacauggaag

SEQ ID NO: 1819725 - RNA, 20 nt, Human
cagcgcuggccgggaccccg

SEQ ID NO: 1819726 - RNA, 22 nt, Human
caggcugggagagccuuccagg

SEQ ID NO: 1819727 - RNA, 23 nt, Human
caggcugggagagccuuccaggg

SEQ ID NO: 1819728 - RNA, 17 nt, Human
caggggaaaaucagccu

SEQ ID NO: 1819729 - RNA, 14 nt, Human
caggggaaaagagg

SEQ ID NO: 1819730 - RNA, 16 nt, Human
caggggaaaagaggag

SEQ ID NO: 1819731 - RNA, 12 nt, Human
caggccuccuac

SEQ ID NO: 1819732 - RNA, 15 nt, Human
caggccuguccaaca

SEQ ID NO: 1819733 - RNA, 14 nt, Human
caggccuccuacag

SEQ ID NO: 1819734 - RNA, 21 nt, Human
caggcgugagccaccgugccu

SEQ ID NO: 1819735 - RNA, 21 nt, Human
caggcugggagagccuuccag

SEQ ID NO: 1819736 - RNA, 22 nt, Human
caggaggccagccuugaccauu

SEQ ID NO: 1819737 - RNA, 18 nt, Human
caggaggccagccuugac

SEQ ID NO: 1819738 - RNA, 19 nt, Human
caggaggccagccuugacc

SEQ ID NO: 1819739 - RNA, 19 nt, Human
caggaggaucacuugaguc

SEQ ID NO: 1819740 - RNA, 17 nt, Human
caggcaaugcuggcugu

SEQ ID NO: 1819741 - RNA, 16 nt, Human
caggcaaugcuggcug

SEQ ID NO: 1819742 - RNA, 15 nt, Human
caggcaaugcuggcu

SEQ ID NO: 1819743 - RNA, 14 nt, Human
caggcaaugcuggc

SEQ ID NO: 1819744 - RNA, 16 nt, Human
caggaccucaggugag

SEQ ID NO: 1819745 - RNA, 23 nt, Human
caggaccucaggugagaagcaga

SEQ ID NO: 1819746 - RNA, 11 nt, Human
caggccaggcc

SEQ ID NO: 1819747 - RNA, 12 nt, Human
caggccaggccc

SEQ ID NO: 1819748 - RNA, 14 nt, Human
auucauauuuacuu

SEQ ID NO: 1819749 - RNA, 13 nt, Human
auuaugugccaga

SEQ ID NO: 1819750 - RNA, 21 nt, Human
auuaugugccagauuuaugca

SEQ ID NO: 1819751 - RNA, 23 nt, Human
auuaugugccagauuuaugcaua

SEQ ID NO: 1819752 - RNA, 20 nt, Human
auucucuaguuugauuaaau

SEQ ID NO: 1819753 - RNA, 23 nt, Human
auucucuaguuugauuaaauucu

SEQ ID NO: 1819754 - RNA, 12 nt, Human
auucucuuaucc

SEQ ID NO: 1819755 - RNA, 14 nt, Human
auucucuuauccaa

SEQ ID NO: 1819756 - RNA, 21 nt, Human
auucgcuacuaugauuuaauu

SEQ ID NO: 1819757 - RNA, 16 nt, Human
auucucuccuguaccu

SEQ ID NO: 1819758 - RNA, 15 nt, Human
auucucuuauccaac

SEQ ID NO: 1819759 - RNA, 15 nt, Human
auuaauggaaauguu

SEQ ID NO: 1819760 - RNA, 17 nt, Human
auuacaggcuccugcca

SEQ ID NO: 1819761 - RNA, 19 nt, Human
auuacaggcuccugccacc

SEQ ID NO: 1819762 - RNA, 13 nt, Human
auuacagguguga

SEQ ID NO: 1819763 - RNA, 15 nt, Human
auuacaggcuccugc

SEQ ID NO: 1819764 - RNA, 16 nt, Human
auuacaggcuccugcc

SEQ ID NO: 1819765 - RNA, 21 nt, Human
auuaacaugaauauuuagugu

SEQ ID NO: 1819766 - RNA, 19 nt, Human
auuuguucuauagcuuuuc

SEQ ID NO: 1819767 - RNA, 14 nt, Human
auuuguuauaauga

SEQ ID NO: 1819768 - RNA, 17 nt, Human
auuuucuauaauuuaaa

SEQ ID NO: 1819769 - RNA, 18 nt, Human
auuuucuauaauuuaaau

SEQ ID NO: 1819770 - RNA, 19 nt, Human
auuuucuauaauuuaaaua

SEQ ID NO: 1819771 - RNA, 13 nt, Human
auuuugaaaaacu

SEQ ID NO: 1819772 - RNA, 15 nt, Human
auuuugaaaaacugc

SEQ ID NO: 1819773 - RNA, 20 nt, Human
caaaagguuaauaaaguaau

SEQ ID NO: 1819774 - RNA, 13 nt, Human
caaaagcauguga

SEQ ID NO: 1819775 - RNA, 19 nt, Human
caaaagcaucuaugugaga

SEQ ID NO: 1819776 - RNA, 21 nt, Human
caaaagguauuuuaaucacca

SEQ ID NO: 1819777 - RNA, 15 nt, Human
auuuuuuuuguuuca

SEQ ID NO: 1819778 - RNA, 16 nt, Human
auuuuuauuaaauuau

SEQ ID NO: 1819779 - RNA, 15 nt, Human
auuuuuuucugaauu

SEQ ID NO: 1819780 - RNA, 13 nt, Human
auuuuuaaagaaa

SEQ ID NO: 1819781 - RNA, 22 nt, Human
auuuuguuuuugucuuaaaaag

SEQ ID NO: 1819782 - RNA, 17 nt, Human
caaaccaucauugaaau

SEQ ID NO: 1819783 - RNA, 14 nt, Human
caaaccaucauuga

SEQ ID NO: 1819784 - RNA, 16 nt, Human
caaaccaucauugaaa

SEQ ID NO: 1819785 - RNA, 15 nt, Human
auuuauauaaauuuu

SEQ ID NO: 1819786 - RNA, 18 nt, Human
auuuaauuugaaauaugg

SEQ ID NO: 1819787 - RNA, 12 nt, Human
auuucacucucc

SEQ ID NO: 1819788 - RNA, 14 nt, Human
auuucacucuccuu

SEQ ID NO: 1819789 - RNA, 21 nt, Human
auuucuguuuagauaauacac

SEQ ID NO: 1819790 - RNA, 19 nt, Human
auuucuguuuagauaauac

SEQ ID NO: 1819791 - RNA, 20 nt, Human
auuucuguuuagauaauaca

SEQ ID NO: 1819792 - RNA, 16 nt, Human
caagaccacguuucua

SEQ ID NO: 1819793 - RNA, 14 nt, Human
caagaccacguuuc

SEQ ID NO: 1819794 - RNA, 18 nt, Human
caagcaagaaacacuggg

SEQ ID NO: 1819795 - RNA, 13 nt, Human
caagcaagaaaca

SEQ ID NO: 1819796 - RNA, 15 nt, Human
caagcaaaugugaau

SEQ ID NO: 1819797 - RNA, 17 nt, Human
caagcaaaugugaauca

SEQ ID NO: 1819798 - RNA, 19 nt, Human
caagcaaaugugaaucauu

SEQ ID NO: 1819799 - RNA, 13 nt, Human
caagcaccuccug

SEQ ID NO: 1819800 - RNA, 14 nt, Human
caagcaccuccugc

SEQ ID NO: 1819801 - RNA, 18 nt, Human
caagcaccuagccucgcu

SEQ ID NO: 1819802 - RNA, 16 nt, Human
caaccccuucgcuccu

SEQ ID NO: 1819803 - RNA, 14 nt, Human
caaccccuucgcuc

SEQ ID NO: 1819804 - RNA, 17 nt, Human
caaccccuucgcuccug

SEQ ID NO: 1819805 - RNA, 13 nt, Human
caacuauggccug

SEQ ID NO: 1819806 - RNA, 14 nt, Human
caacccccagccug

SEQ ID NO: 1819807 - RNA, 14 nt, Human
caacuauggccugu

SEQ ID NO: 1819808 - RNA, 21 nt, Human
caacucccugccccccagccc

SEQ ID NO: 1819809 - RNA, 15 nt, Human
caagaagcccaggaa

SEQ ID NO: 1819810 - RNA, 19 nt, Human
caacucccugccccccagc

SEQ ID NO: 1819811 - RNA, 20 nt, Human
caacucccugccccccagcc

SEQ ID NO: 1819812 - RNA, 19 nt, Human
caagaauagcauuguaaaa

SEQ ID NO: 1819813 - RNA, 18 nt, Human
caagaauagaugcugacu

SEQ ID NO: 1819814 - RNA, 18 nt, Human
caagaagcccaggaaagg

SEQ ID NO: 1819815 - RNA, 17 nt, Human
caagaaggaugauucaa

SEQ ID NO: 1819816 - RNA, 14 nt, Human
caaucaaaucugcu

SEQ ID NO: 1819817 - RNA, 15 nt, Human
caauggcagccuugg

SEQ ID NO: 1819818 - RNA, 14 nt, Human
caauggcagccuug

SEQ ID NO: 1819819 - RNA, 13 nt, Human
caauggcagccuu

SEQ ID NO: 1819820 - RNA, 16 nt, Human
caauggcagccuuggc

SEQ ID NO: 1819821 - RNA, 12 nt, Human
caaugcuggcug

SEQ ID NO: 1819822 - RNA, 20 nt, Human
caauuggauacgacaacuug

SEQ ID NO: 1819823 - RNA, 16 nt, Human
caauauuguacaguuu

SEQ ID NO: 1819824 - RNA, 18 nt, Human
caauauuguacaguuuuu

SEQ ID NO: 1819825 - RNA, 17 nt, Human
caauauuguacaguuuu

SEQ ID NO: 1819826 - RNA, 20 nt, Human
caauuuauuauggcacauca

SEQ ID NO: 1819827 - RNA, 16 nt, Human
caagcucugcuccucu

SEQ ID NO: 1819828 - RNA, 15 nt, Human
caagcucugcuccuc

SEQ ID NO: 1819829 - RNA, 12 nt, Human
caagcucccagg

SEQ ID NO: 1819830 - RNA, 14 nt, Human
caagcucccaggca

SEQ ID NO: 1819831 - RNA, 15 nt, Human
caagcucccaggcau

SEQ ID NO: 1819832 - RNA, 17 nt, Human
caagcucccaggcauuc

SEQ ID NO: 1819833 - RNA, 21 nt, Human
caagcuccaucuccacuccag

SEQ ID NO: 1819834 - RNA, 17 nt, Human
caagcuccaucuccacu

SEQ ID NO: 1819835 - RNA, 19 nt, Human
caagcuccaagcucccagg

SEQ ID NO: 1819836 - RNA, 21 nt, Human
caagcuccaagcucccaggca

SEQ ID NO: 1819837 - RNA, 17 nt, Human
caagcuccaagcuccca

SEQ ID NO: 1819838 - RNA, 18 nt, Human
caagcuccaagcucccag

SEQ ID NO: 1819839 - RNA, 20 nt, Human
caaggauugcuacuguccua

SEQ ID NO: 1819840 - RNA, 14 nt, Human
caaggcaaggcugu

SEQ ID NO: 1819841 - RNA, 22 nt, Human
caaguauuauaccuuuuuuaga

SEQ ID NO: 1819842 - RNA, 17 nt, Human
caaguauuauaccuuuu

SEQ ID NO: 1819843 - RNA, 12 nt, Human
cacccugcucuc

SEQ ID NO: 1819844 - RNA, 12 nt, Human
cacccuccuuuc

SEQ ID NO: 1819845 - RNA, 13 nt, Human
caccugccaggga

SEQ ID NO: 1819846 - RNA, 18 nt, Human
caccugccccucaacucu

SEQ ID NO: 1819847 - RNA, 21 nt, Human
caccugccccucaacucuccu

SEQ ID NO: 1819848 - RNA, 11 nt, Human
caccugccagg

SEQ ID NO: 1819849 - RNA, 12 nt, Human
caccugccaggg

SEQ ID NO: 1819850 - RNA, 16 nt, Human
caccugcggugcuauc

SEQ ID NO: 1819851 - RNA, 17 nt, Human
caccugcggugcuaucu

SEQ ID NO: 1819852 - RNA, 19 nt, Human
caccugcggugcuaucucc

SEQ ID NO: 1819853 - RNA, 20 nt, Human
caccugcggugcuaucuccc

SEQ ID NO: 1819854 - RNA, 14 nt, Human
cacuacauucuguu

SEQ ID NO: 1819855 - RNA, 13 nt, Human
cacuacauucugu

SEQ ID NO: 1819856 - RNA, 16 nt, Human
cacggaagagccuugc

SEQ ID NO: 1819857 - RNA, 22 nt, Human
cacggaagagccuugcggaagg

SEQ ID NO: 1819858 - RNA, 16 nt, Human
cacuagacccacugga

SEQ ID NO: 1819859 - RNA, 15 nt, Human
cacuacauucuguua

SEQ ID NO: 1819860 - RNA, 14 nt, Human
cacuccagaccccu

SEQ ID NO: 1819861 - RNA, 16 nt, Human
cacuccagaccccugg

SEQ ID NO: 1819862 - RNA, 15 nt, Human
cacgcuggagugcag

SEQ ID NO: 1819863 - RNA, 20 nt, Human
cacgcuggagugcagugagc

SEQ ID NO: 1819864 - RNA, 18 nt, Human
cacgcuggagugcaguga

SEQ ID NO: 1819865 - RNA, 17 nt, Human
cacgcuggagugcagug

SEQ ID NO: 1819866 - RNA, 16 nt, Human
cacgcuggagugcagu

SEQ ID NO: 1819867 - RNA, 21 nt, Human
cacgcuggagugcagugagcc

SEQ ID NO: 1819868 - RNA, 17 nt, Human
cacuccagaccccuggc

SEQ ID NO: 1819869 - RNA, 21 nt, Human
cacuccagugagacagcucug

SEQ ID NO: 1819870 - RNA, 16 nt, Human
cacuccagugagacag

SEQ ID NO: 1819871 - RNA, 22 nt, Human
cacaucuugcucugcugacaga

SEQ ID NO: 1819872 - RNA, 21 nt, Human
cacaucuugcucugcugacag

SEQ ID NO: 1819873 - RNA, 20 nt, Human
cacaucuugcucugcugaca

SEQ ID NO: 1819874 - RNA, 15 nt, Human
cacaucuugcucugc

SEQ ID NO: 1819875 - RNA, 14 nt, Human
cacaucuugcucug

SEQ ID NO: 1819876 - RNA, 13 nt, Human
cacaucuugcucu

SEQ ID NO: 1819877 - RNA, 12 nt, Human
cacccagcccac

SEQ ID NO: 1819878 - RNA, 22 nt, Human
caccagccccagugcccacagg

SEQ ID NO: 1819879 - RNA, 21 nt, Human
caccagccccagugcccacag

SEQ ID NO: 1819880 - RNA, 18 nt, Human
caccagccccagugccca

SEQ ID NO: 1819881 - RNA, 19 nt, Human
caccagcccuuagcaggga

SEQ ID NO: 1819882 - RNA, 17 nt, Human
caccagccccagugccc

SEQ ID NO: 1819883 - RNA, 18 nt, Human
cacauuuauucugcucac

SEQ ID NO: 1819884 - RNA, 17 nt, Human
cacauuuauucugcuca

SEQ ID NO: 1819885 - RNA, 23 nt, Human
cacaucuugcucugcugacagac

SEQ ID NO: 1819886 - RNA, 22 nt, Human
ccauuguggucacaggaaguag

SEQ ID NO: 1819887 - RNA, 23 nt, Human
cccaaccugcucuccucuugcca

SEQ ID NO: 1819888 - RNA, 13 nt, Human
cccaaccugcucu

SEQ ID NO: 1819889 - RNA, 14 nt, Human
cccaaccugcucuc

SEQ ID NO: 1819890 - RNA, 21 nt, Human
cccaaccugcucuccucuugc

SEQ ID NO: 1819891 - RNA, 17 nt, Human
cccaagcucugcuccuc

SEQ ID NO: 1819892 - RNA, 20 nt, Human
cccaagaauagaugcugacu

SEQ ID NO: 1819893 - RNA, 21 nt, Human
cccaagaauagaugcugacug

SEQ ID NO: 1819894 - RNA, 16 nt, Human
cccaagccuggcaagg

SEQ ID NO: 1819895 - RNA, 23 nt, Human
cccaagccuacuuuugccauuga

SEQ ID NO: 1819896 - RNA, 18 nt, Human
cccacccaagggccuggc

SEQ ID NO: 1819897 - RNA, 15 nt, Human
cccacccaagggccu

SEQ ID NO: 1819898 - RNA, 18 nt, Human
cccacuguacuugcucuu

SEQ ID NO: 1819899 - RNA, 19 nt, Human
cccacuguacuugcucuug

SEQ ID NO: 1819900 - RNA, 23 nt, Human
cccacuguacuugcucuugaugc

SEQ ID NO: 1819901 - RNA, 15 nt, Human
cccaccgcagacagg

SEQ ID NO: 1819902 - RNA, 18 nt, Human
cccaccgcagacaggacc

SEQ ID NO: 1819903 - RNA, 13 nt, Human
ccaugagccucag

SEQ ID NO: 1819904 - RNA, 16 nt, Human
ccaugaggaacaaggc

SEQ ID NO: 1819905 - RNA, 17 nt, Human
ccaugaggaacaaggca

SEQ ID NO: 1819906 - RNA, 18 nt, Human
ccaugaggaacaaggcaa

SEQ ID NO: 1819907 - RNA, 20 nt, Human
ccaugucucugagcauuaga

SEQ ID NO: 1819908 - RNA, 14 nt, Human
ccaugucucgacuc

SEQ ID NO: 1819909 - RNA, 15 nt, Human
ccaugucucgacuca

SEQ ID NO: 1819910 - RNA, 21 nt, Human
ccccaaaacucuccucugcug

SEQ ID NO: 1819911 - RNA, 20 nt, Human
ccccaaaacucuccucugcu

SEQ ID NO: 1819912 - RNA, 18 nt, Human
ccccaaaacucuccucug

SEQ ID NO: 1819913 - RNA, 21 nt, Human
ccccauucugccugcccaggc

SEQ ID NO: 1819914 - RNA, 14 nt, Human
ccccagccccaucc

SEQ ID NO: 1819915 - RNA, 14 nt, Human
ccccagccccaaaa

SEQ ID NO: 1819916 - RNA, 10 nt, Human
ccccagcccc

SEQ ID NO: 1819917 - RNA, 12 nt, Human
ccccagccccaa

SEQ ID NO: 1819918 - RNA, 14 nt, Human
ccccggccaccugc

SEQ ID NO: 1819919 - RNA, 18 nt, Human
ccccggccaccugcggug

SEQ ID NO: 1819920 - RNA, 13 nt, Human
ccccggccaccug

SEQ ID NO: 1819921 - RNA, 14 nt, Human
ccccgcccaggcuu

SEQ ID NO: 1819922 - RNA, 12 nt, Human
ccccgcccaggc

SEQ ID NO: 1819923 - RNA, 14 nt, Human
cccccuuccaugga

SEQ ID NO: 1819924 - RNA, 15 nt, Human
ccccauuguggucac

SEQ ID NO: 1819925 - RNA, 19 nt, Human
cccagcccacuucugccau

SEQ ID NO: 1819926 - RNA, 21 nt, Human
cccagccccaaaacucuccuc

SEQ ID NO: 1819927 - RNA, 23 nt, Human
cccagccccaaaacucuccucug

SEQ ID NO: 1819928 - RNA, 20 nt, Human
cccagcuggggccaggcugg

SEQ ID NO: 1819929 - RNA, 14 nt, Human
cccauccucuguac

SEQ ID NO: 1819930 - RNA, 20 nt, Human
cccaggcuggcgugcagugg

SEQ ID NO: 1819931 - RNA, 19 nt, Human
cccaggcuggcgugcagug

SEQ ID NO: 1819932 - RNA, 18 nt, Human
cccaggcuggcgugcagu

SEQ ID NO: 1819933 - RNA, 22 nt, Human
cccagcuggggccaggcugggu

SEQ ID NO: 1819934 - RNA, 23 nt, Human
cccagcuggggccaggcuggguc

SEQ ID NO: 1819935 - RNA, 20 nt, Human
cccauccucuguacagagcc

SEQ ID NO: 1819936 - RNA, 15 nt, Human
cccauccucuguaca

SEQ ID NO: 1819937 - RNA, 19 nt, Human
cccauccucuguacagagc

SEQ ID NO: 1819938 - RNA, 19 nt, Human
ccacugcaccgggccacag

SEQ ID NO: 1819939 - RNA, 17 nt, Human
ccacugcaccgggccac

SEQ ID NO: 1819940 - RNA, 14 nt, Human
ccacugcaccgggc

SEQ ID NO: 1819941 - RNA, 13 nt, Human
ccacugcaccggg

SEQ ID NO: 1819942 - RNA, 20 nt, Human
ccacugcacuauagccuagg

SEQ ID NO: 1819943 - RNA, 19 nt, Human
ccacugcacuauagccuag

SEQ ID NO: 1819944 - RNA, 18 nt, Human
ccacugcacuccagccug

SEQ ID NO: 1819945 - RNA, 12 nt, Human
ccacuuggucug

SEQ ID NO: 1819946 - RNA, 17 nt, Human
ccagacccggcugcgug

SEQ ID NO: 1819947 - RNA, 22 nt, Human
ccacuuuuguucuugguuugua

SEQ ID NO: 1819948 - RNA, 21 nt, Human
ccacuuuuguucuugguuugu

SEQ ID NO: 1819949 - RNA, 15 nt, Human
ccacuuuuguucuug

SEQ ID NO: 1819950 - RNA, 14 nt, Human
ccacuuuuguucuu

SEQ ID NO: 1819951 - RNA, 19 nt, Human
ccacuuggucugugagaug

SEQ ID NO: 1819952 - RNA, 17 nt, Human
ccacuuggucugugaga

SEQ ID NO: 1819953 - RNA, 16 nt, Human
ccacuuggucugugag

SEQ ID NO: 1819954 - RNA, 15 nt, Human
ccacuuggucuguga

SEQ ID NO: 1819955 - RNA, 22 nt, Human
ccacuuggucugugagaugcua

SEQ ID NO: 1819956 - RNA, 20 nt, Human
ccacuuggucugugagaugc

SEQ ID NO: 1819957 - RNA, 20 nt, Human
ccacuuucuagccagaggag

SEQ ID NO: 1819958 - RNA, 18 nt, Human
ccacuuucuagccagagg

SEQ ID NO: 1819959 - RNA, 19 nt, Human
ccacuuucuagccagagga

SEQ ID NO: 1819960 - RNA, 13 nt, Human
ccacuuucuagcc

SEQ ID NO: 1819961 - RNA, 14 nt, Human
ccagaugcaccagc

SEQ ID NO: 1819962 - RNA, 13 nt, Human
ccagaugcaccag

SEQ ID NO: 1819963 - RNA, 13 nt, Human
ccagagagggugg

SEQ ID NO: 1819964 - RNA, 16 nt, Human
ccagagacacaagccu

SEQ ID NO: 1819965 - RNA, 18 nt, Human
ccagagacacaagccuuc

SEQ ID NO: 1819966 - RNA, 19 nt, Human
ccagucaccccggccaccu

SEQ ID NO: 1819967 - RNA, 17 nt, Human
ccagucaccccggccac

SEQ ID NO: 1819968 - RNA, 18 nt, Human
ccagucaccccggccacc

SEQ ID NO: 1819969 - RNA, 17 nt, Human
ccaggcugagccucagu

SEQ ID NO: 1819970 - RNA, 19 nt, Human
ccaggcugagccucagucu

SEQ ID NO: 1819971 - RNA, 22 nt, Human
ccaggcugagccucagucuccc

SEQ ID NO: 1819972 - RNA, 14 nt, Human
ccaggcugagccuc

SEQ ID NO: 1819973 - RNA, 16 nt, Human
ccaggcugagccucag

SEQ ID NO: 1819974 - RNA, 13 nt, Human
ccaggcugagccu

SEQ ID NO: 1819975 - RNA, 20 nt, Human
ccaggggugggacacccugu

SEQ ID NO: 1819976 - RNA, 21 nt, Human
ccaggggugggacacccugug

SEQ ID NO: 1819977 - RNA, 22 nt, Human
ccaggggugggacacccuguga

SEQ ID NO: 1819978 - RNA, 23 nt, Human
ccaggggugggacacccugugau

SEQ ID NO: 1819979 - RNA, 19 nt, Human
ccaguaucuugaagacuuu

SEQ ID NO: 1819980 - RNA, 22 nt, Human
ccaguaucuugaagacuuuucu

SEQ ID NO: 1819981 - RNA, 16 nt, Human
ccagucaccccggcca

SEQ ID NO: 1819982 - RNA, 20 nt, Human
ccaggaaaggcuccaggagc

SEQ ID NO: 1819983 - RNA, 17 nt, Human
ccaggaaaggcuccagg

SEQ ID NO: 1819984 - RNA, 18 nt, Human
ccaggaaaggcuccagga

SEQ ID NO: 1819985 - RNA, 19 nt, Human
ccaggaaaggcuccaggag

SEQ ID NO: 1819986 - RNA, 21 nt, Human
ccagcgagcccugguggcagu

SEQ ID NO: 1819987 - RNA, 18 nt, Human
ccagccccuucugaccca

SEQ ID NO: 1819988 - RNA, 18 nt, Human
ccagccccuggaugcagc

SEQ ID NO: 1819989 - RNA, 15 nt, Human
ccagccccuucugac

SEQ ID NO: 1819990 - RNA, 16 nt, Human
ccagccccuucugacc

SEQ ID NO: 1819991 - RNA, 17 nt, Human
ccagccccuucugaccc

SEQ ID NO: 1819992 - RNA, 13 nt, Human
ccagcagccugga

SEQ ID NO: 1819993 - RNA, 23 nt, Human
ccagccccauccucuguacagag

SEQ ID NO: 1819994 - RNA, 13 nt, Human
ccagccccuggau

SEQ ID NO: 1819995 - RNA, 14 nt, Human
ccagccccuggaug

SEQ ID NO: 1819996 - RNA, 15 nt, Human
ccagccccuggaugc

SEQ ID NO: 1819997 - RNA, 22 nt, Human
ccagcagaaaugccuuacccuc

SEQ ID NO: 1819998 - RNA, 17 nt, Human
ccagcagaaaugccuua

SEQ ID NO: 1819999 - RNA, 16 nt, Human
ccagcagaaaugccuu

SEQ ID NO: 1820000 - RNA, 11 nt, Human
ccagcagccug

SEQ ID NO: 1820001 - RNA, 12 nt, Human
ccagcagccugg

SEQ ID NO: 1820002 - RNA, 14 nt, Human
ccuaaucuucugaa

SEQ ID NO: 1820003 - RNA, 20 nt, Human
ccuagccugugccucuggga

SEQ ID NO: 1820004 - RNA, 21 nt, Human
ccuagcauacguacacauuuu

SEQ ID NO: 1820005 - RNA, 17 nt, Human
ccuagcacuuugggagg

SEQ ID NO: 1820006 - RNA, 20 nt, Human
ccuaaugcgcaggcuggccc

SEQ ID NO: 1820007 - RNA, 19 nt, Human
ccuagcauacguacacauu

SEQ ID NO: 1820008 - RNA, 14 nt, Human
ccggcuccaggcuc

SEQ ID NO: 1820009 - RNA, 13 nt, Human
ccggcuccaggcu

SEQ ID NO: 1820010 - RNA, 12 nt, Human
ccggcuccaggc

SEQ ID NO: 1820011 - RNA, 15 nt, Human
ccggcuccaggcucc

SEQ ID NO: 1820012 - RNA, 14 nt, Human
ccgucuaccugagg

SEQ ID NO: 1820013 - RNA, 15 nt, Human
ccgucuaccugaggg

SEQ ID NO: 1820014 - RNA, 17 nt, Human
ccgucuaccugaggggc

SEQ ID NO: 1820015 - RNA, 12 nt, Human
ccgugaggccag

SEQ ID NO: 1820016 - RNA, 13 nt, Human
ccgugaggccaga

SEQ ID NO: 1820017 - RNA, 14 nt, Human
ccgugaggccagag

SEQ ID NO: 1820018 - RNA, 16 nt, Human
ccgugaggccagagac

SEQ ID NO: 1820019 - RNA, 20 nt, Human
ccuaacgaaguauccuucag

SEQ ID NO: 1820020 - RNA, 15 nt, Human
ccggccccugcuggu

SEQ ID NO: 1820021 - RNA, 16 nt, Human
ccggccaccugcggug

SEQ ID NO: 1820022 - RNA, 18 nt, Human
ccggcaggguccuagaaa

SEQ ID NO: 1820023 - RNA, 13 nt, Human
cccugucuaauga

SEQ ID NO: 1820024 - RNA, 23 nt, Human
cccugugauggggcccugccucc

SEQ ID NO: 1820025 - RNA, 21 nt, Human
cccuuccucuccacugccuuc

SEQ ID NO: 1820026 - RNA, 21 nt, Human
cccugugauggggcccugccu

SEQ ID NO: 1820027 - RNA, 22 nt, Human
cccugugauggggcccugccuc

SEQ ID NO: 1820028 - RNA, 12 nt, Human
ccgcccaggcuu

SEQ ID NO: 1820029 - RNA, 16 nt, Human
ccgcagacaggaccag

SEQ ID NO: 1820030 - RNA, 17 nt, Human
ccgcagacaggaccagg

SEQ ID NO: 1820031 - RNA, 15 nt, Human
cccuuccucuuucca

SEQ ID NO: 1820032 - RNA, 19 nt, Human
ccgaaagggacuuggaagc

SEQ ID NO: 1820033 - RNA, 16 nt, Human
ccgaaaacguggcugc

SEQ ID NO: 1820034 - RNA, 17 nt, Human
ccgaaaacguggcugcu

SEQ ID NO: 1820035 - RNA, 17 nt, Human
ccgaccagacaccuuga

SEQ ID NO: 1820036 - RNA, 13 nt, Human
ccgaccagacacc

SEQ ID NO: 1820037 - RNA, 18 nt, Human
ccgaccagacaccuugac

SEQ ID NO: 1820038 - RNA, 15 nt, Human
ccgaccaccugccca

SEQ ID NO: 1820039 - RNA, 17 nt, Human
ccgaauagcugggacua

SEQ ID NO: 1820040 - RNA, 16 nt, Human
ccgaauagcugggacu

SEQ ID NO: 1820041 - RNA, 23 nt, Human
ccgaaggugaggagcuugaaacc

SEQ ID NO: 1820042 - RNA, 20 nt, Human
cccugcccaccuggccucug

SEQ ID NO: 1820043 - RNA, 16 nt, Human
cccugagcuuucugcu

SEQ ID NO: 1820044 - RNA, 17 nt, Human
cccugcccggcugcgga

SEQ ID NO: 1820045 - RNA, 14 nt, Human
cccugcccggcugc

SEQ ID NO: 1820046 - RNA, 18 nt, Human
cccugccccucccuucaa

SEQ ID NO: 1820047 - RNA, 19 nt, Human
cccugccccucccuucaac

SEQ ID NO: 1820048 - RNA, 23 nt, Human
cccugccccucccuucaaccauu

SEQ ID NO: 1820049 - RNA, 17 nt, Human
cccugccccucccuuca

SEQ ID NO: 1820050 - RNA, 22 nt, Human
cccugcccaccuggccucugca

SEQ ID NO: 1820051 - RNA, 20 nt, Human
cccugccccccagcccuccu

SEQ ID NO: 1820052 - RNA, 15 nt, Human
cccugccccccagcc

SEQ ID NO: 1820053 - RNA, 14 nt, Human
cccugccccccagc

SEQ ID NO: 1820054 - RNA, 20 nt, Human
cccuggcucccacaggcccu

SEQ ID NO: 1820055 - RNA, 11 nt, Human
cccugcccugg

SEQ ID NO: 1820056 - RNA, 12 nt, Human
cccugcccuggu

SEQ ID NO: 1820057 - RNA, 22 nt, Human
cccugcccugguuuccugcccu

SEQ ID NO: 1820058 - RNA, 23 nt, Human
cccugcccugguuuccugcccug

SEQ ID NO: 1820059 - RNA, 13 nt, Human
cccuggaugcagc

SEQ ID NO: 1820060 - RNA, 17 nt, Human
cccuggaugcagccuca

SEQ ID NO: 1820061 - RNA, 21 nt, Human
cccuggaugcagccucacagu

SEQ ID NO: 1820062 - RNA, 19 nt, Human
cccuggauccaucaggcca

SEQ ID NO: 1820063 - RNA, 18 nt, Human
cccugaaagcccugagcu

SEQ ID NO: 1820064 - RNA, 11 nt, Human
cccuccuccug

SEQ ID NO: 1820065 - RNA, 16 nt, Human
cccuccuccuggacuc

SEQ ID NO: 1820066 - RNA, 18 nt, Human
cccuccuccuggacuccu

SEQ ID NO: 1820067 - RNA, 22 nt, Human
cccucgaggcggaucuuuggac

SEQ ID NO: 1820068 - RNA, 23 nt, Human
cccucgaggcggaucuuuggaca

SEQ ID NO: 1820069 - RNA, 14 nt, Human
cccuccucucugcc

SEQ ID NO: 1820070 - RNA, 12 nt, Human
cccugaaggccc

SEQ ID NO: 1820071 - RNA, 13 nt, Human
cccugaaggcccc

SEQ ID NO: 1820072 - RNA, 14 nt, Human
cccugaaggccccg

SEQ ID NO: 1820073 - RNA, 16 nt, Human
cccugaaggccccgcc

SEQ ID NO: 1820074 - RNA, 19 nt, Human
cccugaaggccccgcccag

SEQ ID NO: 1820075 - RNA, 14 nt, Human
cccugacaacacuc

SEQ ID NO: 1820076 - RNA, 20 nt, Human
cccugaaggccccgcccagg

SEQ ID NO: 1820077 - RNA, 22 nt, Human
cccugaaggccccgcccaggcu

SEQ ID NO: 1820078 - RNA, 16 nt, Human
cccugacaacacucau

SEQ ID NO: 1820079 - RNA, 22 nt, Human
cccugacaacacucauugaccu

SEQ ID NO: 1820080 - RNA, 20 nt, Human
ccucugccugaagucacaca

SEQ ID NO: 1820081 - RNA, 11 nt, Human
ccucugccuga

SEQ ID NO: 1820082 - RNA, 23 nt, Human
ccucugccucugacacacagcuc

SEQ ID NO: 1820083 - RNA, 21 nt, Human
ccucugccucugacacacagc

SEQ ID NO: 1820084 - RNA, 20 nt, Human
ccucugccucugacacacag

SEQ ID NO: 1820085 - RNA, 11 nt, Human
ccucugcccug

SEQ ID NO: 1820086 - RNA, 12 nt, Human
ccucugcccugc

SEQ ID NO: 1820087 - RNA, 13 nt, Human
ccucugcccugcg

SEQ ID NO: 1820088 - RNA, 14 nt, Human
ccucugcccugcgg

SEQ ID NO: 1820089 - RNA, 16 nt, Human
ccucucugcagguccc

SEQ ID NO: 1820090 - RNA, 17 nt, Human
ccucucugcaggucccu

SEQ ID NO: 1820091 - RNA, 18 nt, Human
ccucucugcaggucccua

SEQ ID NO: 1820092 - RNA, 19 nt, Human
ccucucugcaggucccuaa

SEQ ID NO: 1820093 - RNA, 12 nt, Human
ccucucucacuc

SEQ ID NO: 1820094 - RNA, 13 nt, Human
ccuccgccucccg

SEQ ID NO: 1820095 - RNA, 16 nt, Human
ccuccgccucccgggu

SEQ ID NO: 1820096 - RNA, 15 nt, Human
ccucgaacuggcugc

SEQ ID NO: 1820097 - RNA, 16 nt, Human
ccucgaacuggcugca

SEQ ID NO: 1820098 - RNA, 16 nt, Human
ccucgagguuucucaa

SEQ ID NO: 1820099 - RNA, 18 nt, Human
ccuccuuugugaggaagc

SEQ ID NO: 1820100 - RNA, 19 nt, Human
ccuccuuugugaggaagcc

SEQ ID NO: 1820101 - RNA, 20 nt, Human
ccuccuuugugaggaagccg

SEQ ID NO: 1820102 - RNA, 15 nt, Human
ccucagccuccugag

SEQ ID NO: 1820103 - RNA, 18 nt, Human
ccucagccuccugaguag

SEQ ID NO: 1820104 - RNA, 11 nt, Human
ccucaggcagg

SEQ ID NO: 1820105 - RNA, 17 nt, Human
ccucccaacucacccca

SEQ ID NO: 1820106 - RNA, 20 nt, Human
ccucccaacucaccccagcc

SEQ ID NO: 1820107 - RNA, 21 nt, Human
ccucccaacucaccccagccc

SEQ ID NO: 1820108 - RNA, 23 nt, Human
ccucccaacucaccccagcccca

SEQ ID NO: 1820109 - RNA, 17 nt, Human
ccugaggcugggcuccc

SEQ ID NO: 1820110 - RNA, 19 nt, Human
ccugaggcugggcucccuu

SEQ ID NO: 1820111 - RNA, 21 nt, Human
ccugaggcugggcucccuucc

SEQ ID NO: 1820112 - RNA, 12 nt, Human
ccugaggggccu

SEQ ID NO: 1820113 - RNA, 16 nt, Human
ccugaggggccucuua

SEQ ID NO: 1820114 - RNA, 15 nt, Human
ccugcaggcagccag

SEQ ID NO: 1820115 - RNA, 12 nt, Human
ccugcagagggc

SEQ ID NO: 1820116 - RNA, 16 nt, Human
ccugcaggcagccagg

SEQ ID NO: 1820117 - RNA, 17 nt, Human
ccugcaggcagccaggc

SEQ ID NO: 1820118 - RNA, 14 nt, Human
ccugcagagggcac

SEQ ID NO: 1820119 - RNA, 23 nt, Human
ccugcaggcagccaggccacaag

SEQ ID NO: 1820120 - RNA, 18 nt, Human
ccugcaggcagccaggcc

SEQ ID NO: 1820121 - RNA, 19 nt, Human
ccugcaggcagccaggcca

SEQ ID NO: 1820122 - RNA, 20 nt, Human
ccugcaggcagccaggccac

SEQ ID NO: 1820123 - RNA, 21 nt, Human
ccugcaggcagccaggccaca

SEQ ID NO: 1820124 - RNA, 21 nt, Human
ccucugccugaagucacacag

SEQ ID NO: 1820125 - RNA, 15 nt, Human
ccucugccugucucc

SEQ ID NO: 1820126 - RNA, 19 nt, Human
ccucugccugucuccccca

SEQ ID NO: 1820127 - RNA, 16 nt, Human
ccucuuugagugaagc

SEQ ID NO: 1820128 - RNA, 19 nt, Human
ccucuuuggucuacacugu

SEQ ID NO: 1820129 - RNA, 22 nt, Human
ccugcugcaguugccagucacc

SEQ ID NO: 1820130 - RNA, 11 nt, Human
ccugcugcagu

SEQ ID NO: 1820131 - RNA, 12 nt, Human
ccugcugcaguu

SEQ ID NO: 1820132 - RNA, 16 nt, Human
ccugcugcaguugcca

SEQ ID NO: 1820133 - RNA, 20 nt, Human
ccugccucucugcagguccc

SEQ ID NO: 1820134 - RNA, 21 nt, Human
ccugccucucugcaggucccu

SEQ ID NO: 1820135 - RNA, 15 nt, Human
ccugccucuucucua

SEQ ID NO: 1820136 - RNA, 17 nt, Human
ccugccucucugcaggu

SEQ ID NO: 1820137 - RNA, 23 nt, Human
ccugccuccuuugugaggaagcc

SEQ ID NO: 1820138 - RNA, 21 nt, Human
ccugccuccuuugugaggaag

SEQ ID NO: 1820139 - RNA, 22 nt, Human
ccugccuccuuugugaggaagc

SEQ ID NO: 1820140 - RNA, 13 nt, Human
ccugccuccuuug

SEQ ID NO: 1820141 - RNA, 15 nt, Human
ccugccuccuuugug

SEQ ID NO: 1820142 - RNA, 19 nt, Human
ccugccuccuuugugagga

SEQ ID NO: 1820143 - RNA, 20 nt, Human
ccugccuccuuugugaggaa

SEQ ID NO: 1820144 - RNA, 20 nt, Human
ccuuaggugauccacucgcc

SEQ ID NO: 1820145 - RNA, 13 nt, Human
ccuuaucaaagga

SEQ ID NO: 1820146 - RNA, 12 nt, Human
ccuuauggaaca

SEQ ID NO: 1820147 - RNA, 14 nt, Human
ccuuaucaaaggac

SEQ ID NO: 1820148 - RNA, 18 nt, Human
ccuuaucaaaggacacca

SEQ ID NO: 1820149 - RNA, 22 nt, Human
ccuuauggaacacucugagacu

SEQ ID NO: 1820150 - RNA, 19 nt, Human
ccuuauggaacacucugag

SEQ ID NO: 1820151 - RNA, 20 nt, Human
ccuuauggaacacucugaga

SEQ ID NO: 1820152 - RNA, 14 nt, Human
ccuuauggaacacu

SEQ ID NO: 1820153 - RNA, 16 nt, Human
ccuuauggaacacucu

SEQ ID NO: 1820154 - RNA, 17 nt, Human
ccuuauggaacacucug

SEQ ID NO: 1820155 - RNA, 18 nt, Human
ccuuauggaacacucuga

SEQ ID NO: 1820156 - RNA, 15 nt, Human
ccuucccaugcccug

SEQ ID NO: 1820157 - RNA, 12 nt, Human
ccuucccaccuc

SEQ ID NO: 1820158 - RNA, 14 nt, Human
ccuucccaccucuc

SEQ ID NO: 1820159 - RNA, 19 nt, Human
ccuucccaccucucucacu

SEQ ID NO: 1820160 - RNA, 19 nt, Human
ccuguucagcuccagcuca

SEQ ID NO: 1820161 - RNA, 16 nt, Human
ccuguucagcuccagc

SEQ ID NO: 1820162 - RNA, 15 nt, Human
ccuguucagcuccag

SEQ ID NO: 1820163 - RNA, 14 nt, Human
ccuguucagcucca

SEQ ID NO: 1820164 - RNA, 21 nt, Human
ccuguucagcuccagcucacc

SEQ ID NO: 1820165 - RNA, 20 nt, Human
ccuguucagcuccagcucac

SEQ ID NO: 1820166 - RNA, 23 nt, Human
ccuguucagcuccagcucaccag

SEQ ID NO: 1820167 - RNA, 16 nt, Human
ccuguucugcuuuccu

SEQ ID NO: 1820168 - RNA, 12 nt, Human
ccuguucuggca

SEQ ID NO: 1820169 - RNA, 17 nt, Human
ccuguucuggcagaguu

SEQ ID NO: 1820170 - RNA, 12 nt, Human
ccuguucccauu

SEQ ID NO: 1820171 - RNA, 18 nt, Human
ccuguucccaugagauga

SEQ ID NO: 1820172 - RNA, 16 nt, Human
ccuguugggccaggag

SEQ ID NO: 1820173 - RNA, 17 nt, Human
ccuguugggccaggagc

SEQ ID NO: 1820174 - RNA, 18 nt, Human
ccuguugggccaggagcc

SEQ ID NO: 1820175 - RNA, 19 nt, Human
ccuguugggccaggagccu

SEQ ID NO: 1820176 - RNA, 20 nt, Human
ccuguugggccaggagccuc

SEQ ID NO: 1820177 - RNA, 20 nt, Human
ccuuagcagggaaacagcua

SEQ ID NO: 1820178 - RNA, 19 nt, Human
ccuuagcagggaaacagcu

SEQ ID NO: 1820179 - RNA, 16 nt, Human
ccuuagcaaauucugu

SEQ ID NO: 1820180 - RNA, 13 nt, Human
ccuguucagcucc

SEQ ID NO: 1820181 - RNA, 21 nt, Human
ccuguucacucuacuuagcau

SEQ ID NO: 1820182 - RNA, 21 nt, Human
ccuucuguccuacucuguguc

SEQ ID NO: 1820183 - RNA, 20 nt, Human
ccuucuguccuacucugugu

SEQ ID NO: 1820184 - RNA, 17 nt, Human
ccuucucuucacaguca

SEQ ID NO: 1820185 - RNA, 22 nt, Human
ccuucuguccuacucuguguca

SEQ ID NO: 1820186 - RNA, 16 nt, Human
ccuucucugaaggaca

SEQ ID NO: 1820187 - RNA, 14 nt, Human
ccuucucugaagga

SEQ ID NO: 1820188 - RNA, 20 nt, Human
ccuuccucuccacugccuuc

SEQ ID NO: 1820189 - RNA, 21 nt, Human
ccuucucuccagccccuggau

SEQ ID NO: 1820190 - RNA, 23 nt, Human
ccuucucuccagccccuggaugc

SEQ ID NO: 1820191 - RNA, 14 nt, Human
ccuuccucuccacu

SEQ ID NO: 1820192 - RNA, 15 nt, Human
ccuuccucuccacug

SEQ ID NO: 1820193 - RNA, 16 nt, Human
ccuuccucuccacugc

SEQ ID NO: 1820194 - RNA, 17 nt, Human
ccuuccucuccacugcc

SEQ ID NO: 1820195 - RNA, 20 nt, Human
ccuucucuccagccccugga

SEQ ID NO: 1820196 - RNA, 21 nt, Human
ccuuccuaauuccacagcugc

SEQ ID NO: 1820197 - RNA, 19 nt, Human
ccuuccuaauuccacagcu

SEQ ID NO: 1820198 - RNA, 20 nt, Human
ccuuccuaauuccacagcug

SEQ ID NO: 1820199 - RNA, 18 nt, Human
ccuuccuaauuccacagc

SEQ ID NO: 1820200 - RNA, 19 nt, Human
ccuucccccuccaauccca

SEQ ID NO: 1820201 - RNA, 15 nt, Human
ccuuucaauaggaaa

SEQ ID NO: 1820202 - RNA, 14 nt, Human
ccuuuauucuggca

SEQ ID NO: 1820203 - RNA, 18 nt, Human
ccuuucaauaggaaaaac

SEQ ID NO: 1820204 - RNA, 17 nt, Human
ccuuucaauaggaaaaa

SEQ ID NO: 1820205 - RNA, 14 nt, Human
ccuugcauaauggu

SEQ ID NO: 1820206 - RNA, 19 nt, Human
cuacaaaaagcauaaaaau

SEQ ID NO: 1820207 - RNA, 20 nt, Human
cuaauaaaauuuaaaagucu

SEQ ID NO: 1820208 - RNA, 14 nt, Human
cuaaguuuuuaugg

SEQ ID NO: 1820209 - RNA, 11 nt, Human
cuaaagcugcc

SEQ ID NO: 1820210 - RNA, 16 nt, Human
cgugaggccagagaca

SEQ ID NO: 1820211 - RNA, 19 nt, Human
cgugaguccuggcauggga

SEQ ID NO: 1820212 - RNA, 18 nt, Human
cgugaguccuggcauggg

SEQ ID NO: 1820213 - RNA, 15 nt, Human
cguguuaugacucca

SEQ ID NO: 1820214 - RNA, 19 nt, Human
cguguuaugacuccagaau

SEQ ID NO: 1820215 - RNA, 16 nt, Human
cuaaagccucaaaaca

SEQ ID NO: 1820216 - RNA, 23 nt, Human
cuaaaguaaaaacaaagaaauua

SEQ ID NO: 1820217 - RNA, 19 nt, Human
cuaaaguguauuuuuuuac

SEQ ID NO: 1820218 - RNA, 20 nt, Human
cuaacgaaguauccuucagc

SEQ ID NO: 1820219 - RNA, 22 nt, Human
cuaagaaagcccuuaggaagaa

SEQ ID NO: 1820220 - RNA, 16 nt, Human
cuaacuuuccuucauu

SEQ ID NO: 1820221 - RNA, 14 nt, Human
cuaacuugucuuug

SEQ ID NO: 1820222 - RNA, 22 nt, Human
cuaacuugucuuuggacccuga

SEQ ID NO: 1820223 - RNA, 15 nt, Human
cgugacaacacuugu

SEQ ID NO: 1820224 - RNA, 14 nt, Human
cgugacaacacuug

SEQ ID NO: 1820225 - RNA, 20 nt, Human
cgugagccacugcaccgggc

SEQ ID NO: 1820226 - RNA, 15 nt, Human
cgugagccacugcac

SEQ ID NO: 1820227 - RNA, 14 nt, Human
cgugagccacugca

SEQ ID NO: 1820228 - RNA, 14 nt, Human
cgugaggccagaga

SEQ ID NO: 1820229 - RNA, 22 nt, Human
cgugagccacugcaccgggcca

SEQ ID NO: 1820230 - RNA, 19 nt, Human
cgcugccccuggcagcccc

SEQ ID NO: 1820231 - RNA, 20 nt, Human
cgcugccccuggcagccccu

SEQ ID NO: 1820232 - RNA, 19 nt, Human
cgcucuguugcccaggcug

SEQ ID NO: 1820233 - RNA, 20 nt, Human
cgcucugucgcccaggcugg

SEQ ID NO: 1820234 - RNA, 22 nt, Human
cgcucuguugcccaggcuggag

SEQ ID NO: 1820235 - RNA, 21 nt, Human
cgcucuuggcagguacucagc

SEQ ID NO: 1820236 - RNA, 18 nt, Human
cgcuggagugcagugagc

SEQ ID NO: 1820237 - RNA, 17 nt, Human
cgcuggagugcagugag

SEQ ID NO: 1820238 - RNA, 20 nt, Human
ccuuuucgcaggauucuucc

SEQ ID NO: 1820239 - RNA, 20 nt, Human
cgagucucuucuccacugga

SEQ ID NO: 1820240 - RNA, 21 nt, Human
cgagucucuucuccacuggau

SEQ ID NO: 1820241 - RNA, 21 nt, Human
cgcaggcuggcccugcccugg

SEQ ID NO: 1820242 - RNA, 22 nt, Human
cgcaggcuggcccugcccuggu

SEQ ID NO: 1820243 - RNA, 17 nt, Human
cgagucucuucuccacu

SEQ ID NO: 1820244 - RNA, 18 nt, Human
cgagucucuucuccacug

SEQ ID NO: 1820245 - RNA, 16 nt, Human
cgagucucuucuccac

SEQ ID NO: 1820246 - RNA, 18 nt, Human
cggcuaauuuuuguauuu

SEQ ID NO: 1820247 - RNA, 23 nt, Human
cggagucccaccuuggcugcagg

SEQ ID NO: 1820248 - RNA, 15 nt, Human
cggaggggccuggca

SEQ ID NO: 1820249 - RNA, 22 nt, Human
cggagucccaccuuggcugcag

SEQ ID NO: 1820250 - RNA, 21 nt, Human
cggagucccaccuuggcugca

SEQ ID NO: 1820251 - RNA, 17 nt, Human
cggagacggagucccac

SEQ ID NO: 1820252 - RNA, 20 nt, Human
cggagacggagucccaccuu

SEQ ID NO: 1820253 - RNA, 16 nt, Human
cgggccuggagaacua

SEQ ID NO: 1820254 - RNA, 20 nt, Human
cgggccuggagaacuagaga

SEQ ID NO: 1820255 - RNA, 19 nt, Human
cgggcucagcaaaagaugc

SEQ ID NO: 1820256 - RNA, 16 nt, Human
cgggcugggagcucug

SEQ ID NO: 1820257 - RNA, 20 nt, Human
cgggcugggagcucugcaga

SEQ ID NO: 1820258 - RNA, 12 nt, Human
cgggcucugccu

SEQ ID NO: 1820259 - RNA, 13 nt, Human
cgggcucugccuc

SEQ ID NO: 1820260 - RNA, 22 nt, Human
cguacacauuuuauuuuauuau

SEQ ID NO: 1820261 - RNA, 20 nt, Human
cgguggcucacgccuguaau

SEQ ID NO: 1820262 - RNA, 17 nt, Human
cguaaagcuagaaauga

SEQ ID NO: 1820263 - RNA, 23 nt, Human
cucagaagacacugaugggcaac

SEQ ID NO: 1820264 - RNA, 22 nt, Human
cucagccucccgaauagcuggg

SEQ ID NO: 1820265 - RNA, 21 nt, Human
cucagccucccgaauagcugg

SEQ ID NO: 1820266 - RNA, 19 nt, Human
cucagccucccgaauagcu

SEQ ID NO: 1820267 - RNA, 22 nt, Human
cucagaagacacugaugggcaa

SEQ ID NO: 1820268 - RNA, 20 nt, Human
cucagaagacacugaugggc

SEQ ID NO: 1820269 - RNA, 17 nt, Human
cucagaagacacugaug

SEQ ID NO: 1820270 - RNA, 15 nt, Human
cucagaagacacuga

SEQ ID NO: 1820271 - RNA, 13 nt, Human
cucagaagacacu

SEQ ID NO: 1820272 - RNA, 17 nt, Human
cucaccuuucccaucuu

SEQ ID NO: 1820273 - RNA, 13 nt, Human
cucaggccugggg

SEQ ID NO: 1820274 - RNA, 22 nt, Human
cucaggccugggggcugggcag

SEQ ID NO: 1820275 - RNA, 11 nt, Human
cucaggccugg

SEQ ID NO: 1820276 - RNA, 16 nt, Human
cucaggccagcugcuu

SEQ ID NO: 1820277 - RNA, 17 nt, Human
cucaggccagcugcuug

SEQ ID NO: 1820278 - RNA, 18 nt, Human
cucaggccagcugcuugg

SEQ ID NO: 1820279 - RNA, 20 nt, Human
cucaggccagcugcuugggc

SEQ ID NO: 1820280 - RNA, 21 nt, Human
cucaggccaaacucaccugcc

SEQ ID NO: 1820281 - RNA, 19 nt, Human
cucaggccaaacucaccug

SEQ ID NO: 1820282 - RNA, 20 nt, Human
cucaggccaaacucaccugc

SEQ ID NO: 1820283 - RNA, 17 nt, Human
cucaguccauagcagag

SEQ ID NO: 1820284 - RNA, 15 nt, Human
cucaguccauagcag

SEQ ID NO: 1820285 - RNA, 14 nt, Human
cucagguugucuga

SEQ ID NO: 1820286 - RNA, 16 nt, Human
cucaguccaugaagau

SEQ ID NO: 1820287 - RNA, 20 nt, Human
cucagucuggcccuuccuuu

SEQ ID NO: 1820288 - RNA, 22 nt, Human
cucagucuggcccuuccuuuuc

SEQ ID NO: 1820289 - RNA, 23 nt, Human
cucaggugucccugcacuugcag

SEQ ID NO: 1820290 - RNA, 22 nt, Human
cucagguugucugaagucacug

SEQ ID NO: 1820291 - RNA, 14 nt, Human
cuauguugcccagg

SEQ ID NO: 1820292 - RNA, 18 nt, Human
cuauguucuaagaaguga

SEQ ID NO: 1820293 - RNA, 17 nt, Human
cuaugugagcacaaagg

SEQ ID NO: 1820294 - RNA, 22 nt, Human
cuauguugcccaggcaggucuu

SEQ ID NO: 1820295 - RNA, 21 nt, Human
cuauguugcccaggcaggucu

SEQ ID NO: 1820296 - RNA, 19 nt, Human
cuauguugcccaggcaggu

SEQ ID NO: 1820297 - RNA, 18 nt, Human
cuauguugcccaggcagg

SEQ ID NO: 1820298 - RNA, 14 nt, Human
cuaugugagaccau

SEQ ID NO: 1820299 - RNA, 13 nt, Human
cuaucucccccag

SEQ ID NO: 1820300 - RNA, 14 nt, Human
cuaucucccccagc

SEQ ID NO: 1820301 - RNA, 17 nt, Human
cuauccuacuuccccuu

SEQ ID NO: 1820302 - RNA, 21 nt, Human
cucaagugauucuccugccuc

SEQ ID NO: 1820303 - RNA, 23 nt, Human
cucaauuauuuugcauuuuuucu

SEQ ID NO: 1820304 - RNA, 23 nt, Human
cuccccuaaagccucaaaacaaa

SEQ ID NO: 1820305 - RNA, 16 nt, Human
cuccccuaaagccuca

SEQ ID NO: 1820306 - RNA, 20 nt, Human
cucccugaaguaagcaaaga

SEQ ID NO: 1820307 - RNA, 20 nt, Human
cucccucuuucccucccuuc

SEQ ID NO: 1820308 - RNA, 22 nt, Human
cuccaggcuguaucccaugagc

SEQ ID NO: 1820309 - RNA, 20 nt, Human
cuccaggcuguaucccauga

SEQ ID NO: 1820310 - RNA, 23 nt, Human
cuccaggcuccuuuagcgcccag

SEQ ID NO: 1820311 - RNA, 15 nt, Human
cuccaggcuccuuua

SEQ ID NO: 1820312 - RNA, 23 nt, Human
cuccaggugcacaagcuccaagc

SEQ ID NO: 1820313 - RNA, 15 nt, Human
cucccacaggcccuu

SEQ ID NO: 1820314 - RNA, 14 nt, Human
cucccacaggcccu

SEQ ID NO: 1820315 - RNA, 16 nt, Human
cucccacaggcccuuc

SEQ ID NO: 1820316 - RNA, 20 nt, Human
cucccacaggcccuuccucu

SEQ ID NO: 1820317 - RNA, 21 nt, Human
cucccacaggcccuuccucuc

SEQ ID NO: 1820318 - RNA, 18 nt, Human
cuccugggcuaagugauc

SEQ ID NO: 1820319 - RNA, 19 nt, Human
cuccuggccucaagugauu

SEQ ID NO: 1820320 - RNA, 18 nt, Human
cuccucuugccacugccu

SEQ ID NO: 1820321 - RNA, 19 nt, Human
cuccuggcccacugcaucg

SEQ ID NO: 1820322 - RNA, 12 nt, Human
cuccucuugcca

SEQ ID NO: 1820323 - RNA, 15 nt, Human
cuccucuugccacug

SEQ ID NO: 1820324 - RNA, 16 nt, Human
cuccucuugccacugc

SEQ ID NO: 1820325 - RNA, 12 nt, Human
cuccucugucca

SEQ ID NO: 1820326 - RNA, 15 nt, Human
cuccucuguccaggc

SEQ ID NO: 1820327 - RNA, 15 nt, Human
cuccucugcugcugg

SEQ ID NO: 1820328 - RNA, 13 nt, Human
cuccucugcugcu

SEQ ID NO: 1820329 - RNA, 14 nt, Human
cuccucugcugcug

SEQ ID NO: 1820330 - RNA, 16 nt, Human
cuccuguaccucuuga

SEQ ID NO: 1820331 - RNA, 14 nt, Human
cuccuggggguucu

SEQ ID NO: 1820332 - RNA, 15 nt, Human
cuccuuucaccacau

SEQ ID NO: 1820333 - RNA, 16 nt, Human
cuccuuucacaaccuu

SEQ ID NO: 1820334 - RNA, 17 nt, Human
cuccuuucacaaccuuc

SEQ ID NO: 1820335 - RNA, 13 nt, Human
cuccuuucacaac

SEQ ID NO: 1820336 - RNA, 14 nt, Human
cuccuuguguuacu

SEQ ID NO: 1820337 - RNA, 13 nt, Human
cuccuaccuggua

SEQ ID NO: 1820338 - RNA, 13 nt, Human
cucuguccuggga

SEQ ID NO: 1820339 - RNA, 16 nt, Human
cucuguacagagccca

SEQ ID NO: 1820340 - RNA, 16 nt, Human
cucugcugcuggcugg

SEQ ID NO: 1820341 - RNA, 14 nt, Human
cucugcugcuggcu

SEQ ID NO: 1820342 - RNA, 15 nt, Human
cucugcugcuggcug

SEQ ID NO: 1820343 - RNA, 14 nt, Human
cucuguacagagcc

SEQ ID NO: 1820344 - RNA, 15 nt, Human
cucuguacagagccc

SEQ ID NO: 1820345 - RNA, 13 nt, Human
cucuguacagagc

SEQ ID NO: 1820346 - RNA, 23 nt, Human
cucugcugacagacacaggcccg

SEQ ID NO: 1820347 - RNA, 13 nt, Human
cucugcugcuggc

SEQ ID NO: 1820348 - RNA, 20 nt, Human
cucugcugacagacacaggc

SEQ ID NO: 1820349 - RNA, 22 nt, Human
cucugcugacagacacaggccc

SEQ ID NO: 1820350 - RNA, 21 nt, Human
cucugcugacagacacaggcc

SEQ ID NO: 1820351 - RNA, 21 nt, Human
cucugcuccucuccccagcaa

SEQ ID NO: 1820352 - RNA, 13 nt, Human
cucugcagguccc

SEQ ID NO: 1820353 - RNA, 17 nt, Human
cucugcacuccccugcu

SEQ ID NO: 1820354 - RNA, 18 nt, Human
cucugcacuccccugcug

SEQ ID NO: 1820355 - RNA, 20 nt, Human
cucugcacaagcugcacccu

SEQ ID NO: 1820356 - RNA, 21 nt, Human
cucugcacaagcugcacccuc

SEQ ID NO: 1820357 - RNA, 15 nt, Human
cucugcacuccccug

SEQ ID NO: 1820358 - RNA, 16 nt, Human
cucugcacuccccugc

SEQ ID NO: 1820359 - RNA, 20 nt, Human
cuccuuucacaaccuucugu

SEQ ID NO: 1820360 - RNA, 17 nt, Human
cuccuuugugaggaagc

SEQ ID NO: 1820361 - RNA, 18 nt, Human
cuccuuugugaggaagcc

SEQ ID NO: 1820362 - RNA, 23 nt, Human
cuccuuugugaggaagccgcugg

SEQ ID NO: 1820363 - RNA, 16 nt, Human
cucgguguggagaagc

SEQ ID NO: 1820364 - RNA, 17 nt, Human
cucgguguggagaagcg

SEQ ID NO: 1820365 - RNA, 23 nt, Human
cucgguguggagaagcggcuggc

SEQ ID NO: 1820366 - RNA, 19 nt, Human
cucuauguucuaagaagug

SEQ ID NO: 1820367 - RNA, 13 nt, Human
cucuccuccagag

SEQ ID NO: 1820368 - RNA, 15 nt, Human
cucuccuccagaguc

SEQ ID NO: 1820369 - RNA, 12 nt, Human
cucuccuccaga

SEQ ID NO: 1820370 - RNA, 16 nt, Human
cucuccuccagaguca

SEQ ID NO: 1820371 - RNA, 13 nt, Human
cucucuggccuuc

SEQ ID NO: 1820372 - RNA, 16 nt, Human
cucucuggccuucggc

SEQ ID NO: 1820373 - RNA, 14 nt, Human
cucucuggccuucg

SEQ ID NO: 1820374 - RNA, 13 nt, Human
uuuugaaaaacug

SEQ ID NO: 1820375 - RNA, 20 nt, Human
uuuuuuauacaggaugauga

SEQ ID NO: 1820376 - RNA, 12 nt, Human
uuuuuuacuaau

SEQ ID NO: 1820377 - RNA, 17 nt, Human
uuuuuuccuucagugcc

SEQ ID NO: 1820378 - RNA, 18 nt, Human
uuugccauguuggccagg

SEQ ID NO: 1820379 - RNA, 15 nt, Human
uuugccagugggaac

SEQ ID NO: 1820380 - RNA, 16 nt, Human
uuugccagugggaacu

SEQ ID NO: 1820381 - RNA, 14 nt, Human
uuugcagacaggca

SEQ ID NO: 1820382 - RNA, 19 nt, Human
uuugcauaacguauaaaag

SEQ ID NO: 1820383 - RNA, 23 nt, Human
uuugcauaacguauaaaagccug

SEQ ID NO: 1820384 - RNA, 15 nt, Human
uuugagcagggcuca

SEQ ID NO: 1820385 - RNA, 22 nt, Human
uuucuuacugucuuuuuucuaa

SEQ ID NO: 1820386 - RNA, 14 nt, Human
uuugagcucagccc

SEQ ID NO: 1820387 - RNA, 22 nt, Human
uuugaggucuguucuuuccaaa

SEQ ID NO: 1820388 - RNA, 17 nt, Human
uuugaggucuguucuuu

SEQ ID NO: 1820389 - RNA, 13 nt, Human
uuugagugccuua

SEQ ID NO: 1820390 - RNA, 13 nt, Human
uuuguccccaccg

SEQ ID NO: 1820391 - RNA, 21 nt, Human
uuuguccccaccgcagacagg

SEQ ID NO: 1820392 - RNA, 22 nt, Human
uuuguaaauuaacuuuuauaaa

SEQ ID NO: 1820393 - RNA, 19 nt, Human
uuuggugguuucagaaaug

SEQ ID NO: 1820394 - RNA, 17 nt, Human
uuuguaaauuaacuuuu

SEQ ID NO: 1820395 - RNA, 16 nt, Human
uuuguaaauuaacuuu

SEQ ID NO: 1820396 - RNA, 15 nt, Human
uuuguaaauuaacuu

SEQ ID NO: 1820397 - RNA, 20 nt, Human
uuugguuaugaauacuuugc

SEQ ID NO: 1820398 - RNA, 15 nt, Human
uuuuaaaaugagaaa

SEQ ID NO: 1820399 - RNA, 22 nt, Human
uuuuaaaaugagaaaucuaaaa

SEQ ID NO: 1820400 - RNA, 16 nt, Human
uuuuacagcugccugc

SEQ ID NO: 1820401 - RNA, 16 nt, Human
uuuuaugauacuugaa

SEQ ID NO: 1820402 - RNA, 20 nt, Human
uuuuaugauacuugaaaauu

SEQ ID NO: 1820403 - RNA, 18 nt, Human
uuuuaucgucacugcuua

SEQ ID NO: 1820404 - RNA, 19 nt, Human
uuuuaucgucacugcuuaa

SEQ ID NO: 1820405 - RNA, 14 nt, Human
uuuuacuguacaga

SEQ ID NO: 1820406 - RNA, 20 nt, Human
uuuuauaucaauuuaaaaaa

SEQ ID NO: 1820407 - RNA, 14 nt, Human
uuuucuucucccuc

SEQ ID NO: 1820408 - RNA, 17 nt, Human
uuuucuugcaugaggcu

SEQ ID NO: 1820409 - RNA, 15 nt, Human
uuuuccuucagugcc

SEQ ID NO: 1820410 - RNA, 18 nt, Human
uuuuccaugaguccccug

SEQ ID NO: 1820411 - RNA, 19 nt, Human
uuuuccaugaguccccugu

SEQ ID NO: 1820412 - RNA, 17 nt, Human
uuuucaacgcagcccug

SEQ ID NO: 1820413 - RNA, 21 nt, Human
uuuucaacgcagcccugcuuu

SEQ ID NO: 1820414 - RNA, 22 nt, Human
uuuucaacgcagcccugcuuug

SEQ ID NO: 1820415 - RNA, 15 nt, Human
uuuucacaguucucu

SEQ ID NO: 1820416 - RNA, 19 nt, Human
uuuucacugcuggcugccu

SEQ ID NO: 1820417 - RNA, 20 nt, Human
uuuucacugcuggcugccuu

SEQ ID NO: 1820418 - RNA, 22 nt, Human
uuuccucaaaacuucagacaua

SEQ ID NO: 1820419 - RNA, 23 nt, Human
uuuccugacagaaggacucaggu

SEQ ID NO: 1820420 - RNA, 21 nt, Human
uuuccucuuuggucuacacug

SEQ ID NO: 1820421 - RNA, 18 nt, Human
uuucuaaaggcuaccuuu

SEQ ID NO: 1820422 - RNA, 14 nt, Human
uuucuaaaggcuac

SEQ ID NO: 1820423 - RNA, 14 nt, Human
uuucuaaagcugcc

SEQ ID NO: 1820424 - RNA, 17 nt, Human
uuucuaaagcugccagc

SEQ ID NO: 1820425 - RNA, 15 nt, Human
uuucuaaugugugaa

SEQ ID NO: 1820426 - RNA, 15 nt, Human
uuucuagccagagga

SEQ ID NO: 1820427 - RNA, 20 nt, Human
uuucaauaggaaaaacugau

SEQ ID NO: 1820428 - RNA, 22 nt, Human
uuucaauaggaaaaacugauuu

SEQ ID NO: 1820429 - RNA, 13 nt, Human
uuuauuuccagug

SEQ ID NO: 1820430 - RNA, 15 nt, Human
uuucagcagcugcag

SEQ ID NO: 1820431 - RNA, 15 nt, Human
uuuccaaaguacacu

SEQ ID NO: 1820432 - RNA, 12 nt, Human
uuuccaaaguac

SEQ ID NO: 1820433 - RNA, 13 nt, Human
uuuccaggaaggc

SEQ ID NO: 1820434 - RNA, 15 nt, Human
uuucagccaagaauu

SEQ ID NO: 1820435 - RNA, 16 nt, Human
uuucagccaagaauuc

SEQ ID NO: 1820436 - RNA, 22 nt, Human
uuucauugcugggcuugucugu

SEQ ID NO: 1820437 - RNA, 15 nt, Human
uuguauuuauuuagu

SEQ ID NO: 1820438 - RNA, 20 nt, Human
uuguauuuuacuaauaaaau

SEQ ID NO: 1820439 - RNA, 23 nt, Human
uuguauuuaaaugaaagugagac

SEQ ID NO: 1820440 - RNA, 15 nt, Human
uuuacuuuguguuca

SEQ ID NO: 1820441 - RNA, 13 nt, Human
uuuauugcuuguu

SEQ ID NO: 1820442 - RNA, 14 nt, Human
uuuaugcauauuau

SEQ ID NO: 1820443 - RNA, 14 nt, Human
uuuauugucaaagu

SEQ ID NO: 1820444 - RNA, 16 nt, Human
uuuauugucaaagugg

SEQ ID NO: 1820445 - RNA, 14 nt, Human
uuuauaaacuuuac

SEQ ID NO: 1820446 - RNA, 21 nt, Human
uuuaucgucacugcuuaacuu

SEQ ID NO: 1820447 - RNA, 16 nt, Human
uuuauaaacuuuaccu

SEQ ID NO: 1820448 - RNA, 16 nt, Human
uuuaucgucacugcuu

SEQ ID NO: 1820449 - RNA, 18 nt, Human
uucaauucucauuuguca

SEQ ID NO: 1820450 - RNA, 17 nt, Human
uucaaccauuccccaug

SEQ ID NO: 1820451 - RNA, 20 nt, Human
uucaaccauuccccauggga

SEQ ID NO: 1820452 - RNA, 13 nt, Human
uucaacgcagccc

SEQ ID NO: 1820453 - RNA, 21 nt, Human
uucaacagguuuuccugaaga

SEQ ID NO: 1820454 - RNA, 14 nt, Human
uucaacgcagcccu

SEQ ID NO: 1820455 - RNA, 15 nt, Human
uucaacgcagcccug

SEQ ID NO: 1820456 - RNA, 16 nt, Human
uucaaucccaggaugu

SEQ ID NO: 1820457 - RNA, 23 nt, Human
uucaaauuguaagcaugcacaaa

SEQ ID NO: 1820458 - RNA, 16 nt, Human
uuauuuugauguaaag

SEQ ID NO: 1820459 - RNA, 13 nt, Human
uuauuuugaugua

SEQ ID NO: 1820460 - RNA, 15 nt, Human
uucaaagcaaauguc

SEQ ID NO: 1820461 - RNA, 13 nt, Human
uucaaagauauuu

SEQ ID NO: 1820462 - RNA, 13 nt, Human
uuacgugaguccu

SEQ ID NO: 1820463 - RNA, 14 nt, Human
uuacgugaguccug

SEQ ID NO: 1820464 - RNA, 12 nt, Human
uucagaggcuca

SEQ ID NO: 1820465 - RNA, 22 nt, Human
uucagaggcucagauuguaaua

SEQ ID NO: 1820466 - RNA, 13 nt, Human
uucagaggcucag

SEQ ID NO: 1820467 - RNA, 15 nt, Human
uucagagacuccugc

SEQ ID NO: 1820468 - RNA, 14 nt, Human
uucacucuccuugg

SEQ ID NO: 1820469 - RNA, 23 nt, Human
uucagcuccagcucaccagcccc

SEQ ID NO: 1820470 - RNA, 17 nt, Human
uucagcucugcaagaau

SEQ ID NO: 1820471 - RNA, 24 nt, Human
uucagcucugcaagaauugaagca

SEQ ID NO: 1820472 - RNA, 21 nt, Human
uucagcugguugagguuucaa

SEQ ID NO: 1820473 - RNA, 16 nt, Human
uucaggaagcucaggg

SEQ ID NO: 1820474 - RNA, 18 nt, Human
uucagcugcauacaguuu

SEQ ID NO: 1820475 - RNA, 17 nt, Human
uucagcugacuuuucug

SEQ ID NO: 1820476 - RNA, 15 nt, Human
uucaggcucuucucc

SEQ ID NO: 1820477 - RNA, 20 nt, Human
uucaggaagcucagggccug

SEQ ID NO: 1820478 - RNA, 15 nt, Human
uucaggaagcucagg

SEQ ID NO: 1820479 - RNA, 17 nt, Human
uucaggaagcucagggc

SEQ ID NO: 1820480 - RNA, 19 nt, Human
uucaggaagcucagggccu

SEQ ID NO: 1820481 - RNA, 13 nt, Human
uuccacugagacc

SEQ ID NO: 1820482 - RNA, 21 nt, Human
uuccacuuagaaauugcauuu

SEQ ID NO: 1820483 - RNA, 19 nt, Human
uuccacuuauaggaauuga

SEQ ID NO: 1820484 - RNA, 20 nt, Human
uuccaugucgccucugcauu

SEQ ID NO: 1820485 - RNA, 21 nt, Human
uuccaugucgccucugcauuc

SEQ ID NO: 1820486 - RNA, 14 nt, Human
uuccccaagacauu

SEQ ID NO: 1820487 - RNA, 17 nt, Human
uuccaugucgccucugc

SEQ ID NO: 1820488 - RNA, 18 nt, Human
uuccaugucgccucugca

SEQ ID NO: 1820489 - RNA, 19 nt, Human
uuccaugucgccucugcau

SEQ ID NO: 1820490 - RNA, 17 nt, Human
uuccaugaguccccugu

SEQ ID NO: 1820491 - RNA, 17 nt, Human
uucaucuugaauuguaa

SEQ ID NO: 1820492 - RNA, 12 nt, Human
uucaucuugaau

SEQ ID NO: 1820493 - RNA, 20 nt, Human
uucaucuuccaacucaaacu

SEQ ID NO: 1820494 - RNA, 11 nt, Human
uucaucuugaa

SEQ ID NO: 1820495 - RNA, 19 nt, Human
uucauuuaggugaggaagc

SEQ ID NO: 1820496 - RNA, 13 nt, Human
uucaguggcagcu

SEQ ID NO: 1820497 - RNA, 16 nt, Human
uucaggcucuucuccu

SEQ ID NO: 1820498 - RNA, 19 nt, Human
uucagugccuuauggaaca

SEQ ID NO: 1820499 - RNA, 21 nt, Human
uucagugccuuauggaacacu

SEQ ID NO: 1820500 - RNA, 12 nt, Human
uucaguuuucag

SEQ ID NO: 1820501 - RNA, 15 nt, Human
uucaucuaggauuuu

SEQ ID NO: 1820502 - RNA, 13 nt, Human
uucauaaugacuu

SEQ ID NO: 1820503 - RNA, 23 nt, Human
uucauaaugacuuaagcacacuu

SEQ ID NO: 1820504 - RNA, 23 nt, Human
uuccucauaguaugguggcuggg

SEQ ID NO: 1820505 - RNA, 20 nt, Human
uuccuagguauaauucacau

SEQ ID NO: 1820506 - RNA, 22 nt, Human
uuccucccucccucuuucccuc

SEQ ID NO: 1820507 - RNA, 12 nt, Human
uuccucccuccc

SEQ ID NO: 1820508 - RNA, 19 nt, Human
uuccucccucccucuuucc

SEQ ID NO: 1820509 - RNA, 21 nt, Human
uuccucccucccucuuucccu

SEQ ID NO: 1820510 - RNA, 19 nt, Human
uucccuuugacgccauccc

SEQ ID NO: 1820511 - RNA, 22 nt, Human
uuccccacuugagaauuacccu

SEQ ID NO: 1820512 - RNA, 13 nt, Human
uuccuuccucuga

SEQ ID NO: 1820513 - RNA, 17 nt, Human
uuccuuccucugagccu

SEQ ID NO: 1820514 - RNA, 13 nt, Human
uuccugcccuggg

SEQ ID NO: 1820515 - RNA, 16 nt, Human
uuccugcccugggagg

SEQ ID NO: 1820516 - RNA, 22 nt, Human
uuccugcccugggaggcaguga

SEQ ID NO: 1820517 - RNA, 11 nt, Human
uuccugcccug

SEQ ID NO: 1820518 - RNA, 16 nt, Human
uuccuucagugccuua

SEQ ID NO: 1820519 - RNA, 19 nt, Human
uuccuucagugccuuaugg

SEQ ID NO: 1820520 - RNA, 23 nt, Human
uuccuucagugccuuauggaaca

SEQ ID NO: 1820521 - RNA, 19 nt, Human
uuccuucauucaacccacc

SEQ ID NO: 1820522 - RNA, 13 nt, Human
uucuaaagaugga

SEQ ID NO: 1820523 - RNA, 16 nt, Human
uucuaaaggcuaccuu

SEQ ID NO: 1820524 - RNA, 18 nt, Human
uucuaaaggcuaccuuug

SEQ ID NO: 1820525 - RNA, 17 nt, Human
uucuaaaggcuaccuuu

SEQ ID NO: 1820526 - RNA, 19 nt, Human
uucggccuccauccugagg

SEQ ID NO: 1820527 - RNA, 18 nt, Human
uucggccuccauccugag

SEQ ID NO: 1820528 - RNA, 22 nt, Human
uucggccuccauccugaggcuc

SEQ ID NO: 1820529 - RNA, 17 nt, Human
uucuaugacacaugcaa

SEQ ID NO: 1820530 - RNA, 16 nt, Human
uucuaugacacaugca

SEQ ID NO: 1820531 - RNA, 14 nt, Human
uucuauuguuucuu

SEQ ID NO: 1820532 - RNA, 14 nt, Human
uucucaugccucag

SEQ ID NO: 1820533 - RNA, 21 nt, Human
uucucaugccucagccuccug

SEQ ID NO: 1820534 - RNA, 11 nt, Human
uucucaugccu

SEQ ID NO: 1820535 - RNA, 12 nt, Human
uucucaugccuc

SEQ ID NO: 1820536 - RNA, 20 nt, Human
uucucaaagaaauuuccacu

SEQ ID NO: 1820537 - RNA, 19 nt, Human
uucucaaagaaauuuccac

SEQ ID NO: 1820538 - RNA, 15 nt, Human
uucucaaagaaauuu

SEQ ID NO: 1820539 - RNA, 13 nt, Human
uucucaaagaaau

SEQ ID NO: 1820540 - RNA, 18 nt, Human
uucucuccagccccugga

SEQ ID NO: 1820541 - RNA, 13 nt, Human
uucuccacccugc

SEQ ID NO: 1820542 - RNA, 16 nt, Human
uucuccaagcaggaca

SEQ ID NO: 1820543 - RNA, 11 nt, Human
uucuccaggcu

SEQ ID NO: 1820544 - RNA, 18 nt, Human
uucugacccaugcugccc

SEQ ID NO: 1820545 - RNA, 20 nt, Human
uucugacccaugcugcccug

SEQ ID NO: 1820546 - RNA, 21 nt, Human
uucugacccaugcugcccugu

SEQ ID NO: 1820547 - RNA, 15 nt, Human
uuggaaguuuuaauc

SEQ ID NO: 1820548 - RNA, 20 nt, Human
uuggaagugaaaacuuugua

SEQ ID NO: 1820549 - RNA, 11 nt, Human
uuggaaggaac

SEQ ID NO: 1820550 - RNA, 19 nt, Human
uuggaaggaacguccccug

SEQ ID NO: 1820551 - RNA, 18 nt, Human
uuggauuuuugucuugug

SEQ ID NO: 1820552 - RNA, 14 nt, Human
uuggauuguccccg

SEQ ID NO: 1820553 - RNA, 17 nt, Human
uuggcaaaaaggcagga

SEQ ID NO: 1820554 - RNA, 20 nt, Human
uugcuguagaagauggcacu

SEQ ID NO: 1820555 - RNA, 20 nt, Human
uugcuggggccgaaagaaca

SEQ ID NO: 1820556 - RNA, 11 nt, Human
uugcccaggca

SEQ ID NO: 1820557 - RNA, 23 nt, Human
uugcccacgcuggagugcaguga

SEQ ID NO: 1820558 - RNA, 18 nt, Human
uugccacugccucuuccu

SEQ ID NO: 1820559 - RNA, 18 nt, Human
uugccagucaccccggcc

SEQ ID NO: 1820560 - RNA, 14 nt, Human
uugccucugccucu

SEQ ID NO: 1820561 - RNA, 11 nt, Human
uugccucugcc

SEQ ID NO: 1820562 - RNA, 18 nt, Human
uugccucugccucugaca

SEQ ID NO: 1820563 - RNA, 16 nt, Human
uugccucugccucuga

SEQ ID NO: 1820564 - RNA, 11 nt, Human
uugcugccuca

SEQ ID NO: 1820565 - RNA, 12 nt, Human
uugcugccucau

SEQ ID NO: 1820566 - RNA, 15 nt, Human
uugcugccucaugcu

SEQ ID NO: 1820567 - RNA, 20 nt, Human
uugcugauggugcaaugacc

SEQ ID NO: 1820568 - RNA, 22 nt, Human
uugcugauggugcaaugaccuu

SEQ ID NO: 1820569 - RNA, 14 nt, Human
uuguauuacaaauc

SEQ ID NO: 1820570 - RNA, 14 nt, Human
uuguauucagaguu

SEQ ID NO: 1820571 - RNA, 21 nt, Human
uuguauucucuccuguaccuc

SEQ ID NO: 1820572 - RNA, 15 nt, Human
uuguagagccagggu

SEQ ID NO: 1820573 - RNA, 14 nt, Human
uuguagagccaggg

SEQ ID NO: 1820574 - RNA, 13 nt, Human
uuguacaguuuuu

SEQ ID NO: 1820575 - RNA, 12 nt, Human
uuguacaguuuu

SEQ ID NO: 1820576 - RNA, 16 nt, Human
uuguacaguuuuuauu

SEQ ID NO: 1820577 - RNA, 14 nt, Human
uuguacauaaugcg

SEQ ID NO: 1820578 - RNA, 16 nt, Human
uuguaaaggaauuuaa

SEQ ID NO: 1820579 - RNA, 22 nt, Human
uuggucccccuuccauggacuu

SEQ ID NO: 1820580 - RNA, 16 nt, Human
uuggucccccuuccau

SEQ ID NO: 1820581 - RNA, 12 nt, Human
uugguccugcug

SEQ ID NO: 1820582 - RNA, 13 nt, Human
uugguccugcugc

SEQ ID NO: 1820583 - RNA, 12 nt, Human
uuguacagacaa

SEQ ID NO: 1820584 - RNA, 13 nt, Human
uuguacagacaac

SEQ ID NO: 1820585 - RNA, 16 nt, Human
uuggguggaugccugg

SEQ ID NO: 1820586 - RNA, 12 nt, Human
uugguaaaccuu

SEQ ID NO: 1820587 - RNA, 14 nt, Human
uugguaaaccuuuu

SEQ ID NO: 1820588 - RNA, 16 nt, Human
uugggaggccauuugu

SEQ ID NO: 1820589 - RNA, 12 nt, Human
uugggaggcuga

SEQ ID NO: 1820590 - RNA, 22 nt, Human
uuggcuuuggguugcaggaccu

SEQ ID NO: 1820591 - RNA, 22 nt, Human
uuggcugggggccucagugcca

SEQ ID NO: 1820592 - RNA, 21 nt, Human
uuggcugggggccucagugcc

SEQ ID NO: 1820593 - RNA, 18 nt, Human
uuggcugggggccucagu

SEQ ID NO: 1820594 - RNA, 24 nt, Human
uuggccaaagccaaagcuaggccu

SEQ ID NO: 1820595 - RNA, 14 nt, Human
uuggccaggcuggu

SEQ ID NO: 1820596 - RNA, 13 nt, Human
uuggcauucccca

SEQ ID NO: 1820597 - RNA, 22 nt, Human
uugcagacaggcaagcaccucc

SEQ ID NO: 1820598 - RNA, 16 nt, Human
uugcagacaggcaagc

SEQ ID NO: 1820599 - RNA, 14 nt, Human
uugccacugccucu

SEQ ID NO: 1820600 - RNA, 15 nt, Human
uugccacugccucuu

SEQ ID NO: 1820601 - RNA, 14 nt, Human
uugcauagaauaaa

SEQ ID NO: 1820602 - RNA, 17 nt, Human
uugcaacaggcugggcu

SEQ ID NO: 1820603 - RNA, 14 nt, Human
uugcaacaggcugg

SEQ ID NO: 1820604 - RNA, 18 nt, Human
uugauuuccguuaaaaua

SEQ ID NO: 1820605 - RNA, 21 nt, Human
uugauagcacagacccugccc

SEQ ID NO: 1820606 - RNA, 23 nt, Human
uugauagcacagacccugcccug

SEQ ID NO: 1820607 - RNA, 15 nt, Human
uugacgccaucccag

SEQ ID NO: 1820608 - RNA, 22 nt, Human
uugacgccaucccagccccaau

SEQ ID NO: 1820609 - RNA, 14 nt, Human
uugacgccauccca

SEQ ID NO: 1820610 - RNA, 12 nt, Human
uugaccugaggc

SEQ ID NO: 1820611 - RNA, 19 nt, Human
uugaccugaggcccuucuc

SEQ ID NO: 1820612 - RNA, 22 nt, Human
uugaccugaggcccuucucucc

SEQ ID NO: 1820613 - RNA, 15 nt, Human
uugaccucaggugau

SEQ ID NO: 1820614 - RNA, 20 nt, Human
uugaccgugaggccagagac

SEQ ID NO: 1820615 - RNA, 21 nt, Human
uugaccgugaggccagagaca

SEQ ID NO: 1820616 - RNA, 19 nt, Human
uugauagcacagacccugc

SEQ ID NO: 1820617 - RNA, 20 nt, Human
uugauagcacagacccugcc

SEQ ID NO: 1820618 - RNA, 16 nt, Human
uucuugguuuguaaau

SEQ ID NO: 1820619 - RNA, 13 nt, Human
uucuugguuugua

SEQ ID NO: 1820620 - RNA, 23 nt, Human
uucuugguuuguaaauuaacuuu

SEQ ID NO: 1820621 - RNA, 18 nt, Human
uucuugguuuguaaauua

SEQ ID NO: 1820622 - RNA, 17 nt, Human
uucuugguuuguaaauu

SEQ ID NO: 1820623 - RNA, 11 nt, Human
uucuguucuuu

SEQ ID NO: 1820624 - RNA, 19 nt, Human
uucuuauuuaaugaaagac

SEQ ID NO: 1820625 - RNA, 23 nt, Human
uucuuauuuaaugaaagacugua

SEQ ID NO: 1820626 - RNA, 14 nt, Human
uucuucaacucccu

SEQ ID NO: 1820627 - RNA, 14 nt, Human
uucugagcauuuaa

SEQ ID NO: 1820628 - RNA, 17 nt, Human
uucuguccgagcuuuga

SEQ ID NO: 1820629 - RNA, 21 nt, Human
uucuguccgagcuuugaaaau

SEQ ID NO: 1820630 - RNA, 17 nt, Human
uucuguccuacucugug

SEQ ID NO: 1820631 - RNA, 19 nt, Human
uucuguccuacucuguguc

SEQ ID NO: 1820632 - RNA, 12 nt, Human
uucuguggcuca

SEQ ID NO: 1820633 - RNA, 16 nt, Human
uucuguggcucacaga

SEQ ID NO: 1820634 - RNA, 23 nt, Human
uucuguggguuucuaaagcugcc

SEQ ID NO: 1820635 - RNA, 19 nt, Human
uugaagacuuuucuuucag

SEQ ID NO: 1820636 - RNA, 17 nt, Human
uugaagacagagcuaca

SEQ ID NO: 1820637 - RNA, 19 nt, Human
uugaacucuucaaucucuu

SEQ ID NO: 1820638 - RNA, 16 nt, Human
uugaacugauaaagau

SEQ ID NO: 1820639 - RNA, 22 nt, Human
uugaacuuugaccucugcagca

SEQ ID NO: 1820640 - RNA, 15 nt, Human
uugaaaaaugcaugu

SEQ ID NO: 1820641 - RNA, 19 nt, Human
uugaaaacacuguucucug

SEQ ID NO: 1820642 - RNA, 21 nt, Human
uugaaaacacuguucucugcc

SEQ ID NO: 1820643 - RNA, 18 nt, Human
uucuuuauaauucuacuu

SEQ ID NO: 1820644 - RNA, 22 nt, Human
uugaaaacacuguucucugccc

SEQ ID NO: 1820645 - RNA, 22 nt, Human
ugugcuuauguaugagguacaa

SEQ ID NO: 1820646 - RNA, 15 nt, Human
ugugccucugccugu

SEQ ID NO: 1820647 - RNA, 17 nt, Human
ugugccucugggacugg

SEQ ID NO: 1820648 - RNA, 20 nt, Human
ugugcgugcauguguguuca

SEQ ID NO: 1820649 - RNA, 22 nt, Human
ugugcacaugcacgugugugca

SEQ ID NO: 1820650 - RNA, 16 nt, Human
ugugcacaugcacgug

SEQ ID NO: 1820651 - RNA, 14 nt, Human
ugugccucugccug

SEQ ID NO: 1820652 - RNA, 13 nt, Human
ugugccucuggga

SEQ ID NO: 1820653 - RNA, 15 nt, Human
ugugccucugggacu

SEQ ID NO: 1820654 - RNA, 16 nt, Human
ugugccucugggacug

SEQ ID NO: 1820655 - RNA, 12 nt, Human
ugugggaagggg

SEQ ID NO: 1820656 - RNA, 13 nt, Human
uguggacacagcu

SEQ ID NO: 1820657 - RNA, 14 nt, Human
uguggacacagcuc

SEQ ID NO: 1820658 - RNA, 17 nt, Human
uguggaaaaugaaaauu

SEQ ID NO: 1820659 - RNA, 16 nt, Human
uguggacacagcucuu

SEQ ID NO: 1820660 - RNA, 15 nt, Human
uguggacacagcucu

SEQ ID NO: 1820661 - RNA, 21 nt, Human
uguggcuccuggggguucuuu

SEQ ID NO: 1820662 - RNA, 12 nt, Human
uguggagaagcg

SEQ ID NO: 1820663 - RNA, 21 nt, Human
uguggagaagcggcuggcagc

SEQ ID NO: 1820664 - RNA, 21 nt, Human
ugugacaaggauugcuacugu

SEQ ID NO: 1820665 - RNA, 16 nt, Human
ugugaaucauuuuacc

SEQ ID NO: 1820666 - RNA, 15 nt, Human
ugugacauguuuuau

SEQ ID NO: 1820667 - RNA, 22 nt, Human
ugugaccacugcagaagacagu

SEQ ID NO: 1820668 - RNA, 21 nt, Human
ugugauacaaugcugugcccu

SEQ ID NO: 1820669 - RNA, 13 nt, Human
ugugauauaagug

SEQ ID NO: 1820670 - RNA, 18 nt, Human
ugugaguacuacaguccu

SEQ ID NO: 1820671 - RNA, 19 nt, Human
ugugaguacuacaguccuc

SEQ ID NO: 1820672 - RNA, 20 nt, Human
ugugaguacuacaguccucc

SEQ ID NO: 1820673 - RNA, 23 nt, Human
ugugaguacuacaguccucccau

SEQ ID NO: 1820674 - RNA, 22 nt, Human
ugucucaguccaugaagaugua

SEQ ID NO: 1820675 - RNA, 21 nt, Human
ugucucaguccaugaagaugu

SEQ ID NO: 1820676 - RNA, 13 nt, Human
uguccccaccgca

SEQ ID NO: 1820677 - RNA, 23 nt, Human
ugucucaagagggcacugguggc

SEQ ID NO: 1820678 - RNA, 20 nt, Human
ugucucaagagggcacuggu

SEQ ID NO: 1820679 - RNA, 21 nt, Human
ugucucaagagggcacuggug

SEQ ID NO: 1820680 - RNA, 16 nt, Human
ugucucaggucccugc

SEQ ID NO: 1820681 - RNA, 17 nt, Human
ugucucaggucccugca

SEQ ID NO: 1820682 - RNA, 16 nt, Human
ugucuuuuuucacuac

SEQ ID NO: 1820683 - RNA, 14 nt, Human
ugucuuuuuucuaa

SEQ ID NO: 1820684 - RNA, 19 nt, Human
ugucuuuggacccugaggc

SEQ ID NO: 1820685 - RNA, 22 nt, Human
ugucuuuggacccugaggccca

SEQ ID NO: 1820686 - RNA, 17 nt, Human
ugucuuuggacccugag

SEQ ID NO: 1820687 - RNA, 18 nt, Human
ugucuuuggacccugagg

SEQ ID NO: 1820688 - RNA, 13 nt, Human
ugugaaacauguu

SEQ ID NO: 1820689 - RNA, 13 nt, Human
ugugaaaggaaag

SEQ ID NO: 1820690 - RNA, 14 nt, Human
ugugaaaggaaaga

SEQ ID NO: 1820691 - RNA, 15 nt, Human
uguaacuaaaauaau

SEQ ID NO: 1820692 - RNA, 14 nt, Human
uguaacuaaaauaa

SEQ ID NO: 1820693 - RNA, 23 nt, Human
uguaacuaaaauaauuuuguaau

SEQ ID NO: 1820694 - RNA, 15 nt, Human
uguaaucacagcuac

SEQ ID NO: 1820695 - RNA, 18 nt, Human
ugguaggacuguagaaaa

SEQ ID NO: 1820696 - RNA, 17 nt, Human
ugguaggacuguagaaa

SEQ ID NO: 1820697 - RNA, 17 nt, Human
uguaaauuaacuuuuau

SEQ ID NO: 1820698 - RNA, 16 nt, Human
uguaaauuaacuuuua

SEQ ID NO: 1820699 - RNA, 15 nt, Human
uguaaauuaacuuuu

SEQ ID NO: 1820700 - RNA, 14 nt, Human
uguaaauuaacuuu

SEQ ID NO: 1820701 - RNA, 13 nt, Human
uguaaauuaacuu

SEQ ID NO: 1820702 - RNA, 12 nt, Human
uguaaugacagg

SEQ ID NO: 1820703 - RNA, 23 nt, Human
uguaauguaucaaauacauuuaa

SEQ ID NO: 1820704 - RNA, 17 nt, Human
uguacagucuuguauua

SEQ ID NO: 1820705 - RNA, 15 nt, Human
uguacagucuuguau

SEQ ID NO: 1820706 - RNA, 14 nt, Human
uguacagucuugua

SEQ ID NO: 1820707 - RNA, 12 nt, Human
uguacagucuug

SEQ ID NO: 1820708 - RNA, 23 nt, Human
uguaccucuugagccuugaacuu

SEQ ID NO: 1820709 - RNA, 14 nt, Human
uguaccucuugagc

SEQ ID NO: 1820710 - RNA, 22 nt, Human
uguaccucuugagccuugaacu

SEQ ID NO: 1820711 - RNA, 15 nt, Human
uguaccgcaauguga

SEQ ID NO: 1820712 - RNA, 17 nt, Human
uguagauaauacaguuc

SEQ ID NO: 1820713 - RNA, 16 nt, Human
uguacgucugacaggc

SEQ ID NO: 1820714 - RNA, 17 nt, Human
uguacgucugacaggca

SEQ ID NO: 1820715 - RNA, 12 nt, Human
uguacuccuccc

SEQ ID NO: 1820716 - RNA, 13 nt, Human
uguacuccuccca

SEQ ID NO: 1820717 - RNA, 23 nt, Human
uguaucccaugagccucagcauc

SEQ ID NO: 1820718 - RNA, 19 nt, Human
uguaucccaugagccucag

SEQ ID NO: 1820719 - RNA, 14 nt, Human
uguaugcacuuugu

SEQ ID NO: 1820720 - RNA, 12 nt, Human
ugucagugugac

SEQ ID NO: 1820721 - RNA, 20 nt, Human
ugucagugugacugaucucu

SEQ ID NO: 1820722 - RNA, 23 nt, Human
ugucccaaaaagaaaggagggga

SEQ ID NO: 1820723 - RNA, 23 nt, Human
ugucauucgcuacuaugauuuaa

SEQ ID NO: 1820724 - RNA, 22 nt, Human
uguguuuaggaacuacugagga

SEQ ID NO: 1820725 - RNA, 13 nt, Human
uguguuuauuguc

SEQ ID NO: 1820726 - RNA, 14 nt, Human
uguucagcuccagc

SEQ ID NO: 1820727 - RNA, 18 nt, Human
uguucagcuccagcucac

SEQ ID NO: 1820728 - RNA, 11 nt, Human
uguucagcugg

SEQ ID NO: 1820729 - RNA, 16 nt, Human
uguucagcuccagcuc

SEQ ID NO: 1820730 - RNA, 15 nt, Human
uguucagcuccagcu

SEQ ID NO: 1820731 - RNA, 20 nt, Human
uguuagauuaagaaauagac

SEQ ID NO: 1820732 - RNA, 17 nt, Human
uguuagauuaagaaaua

SEQ ID NO: 1820733 - RNA, 13 nt, Human
uguuacauuuuua

SEQ ID NO: 1820734 - RNA, 22 nt, Human
uguuacauuuuuaagugcugca

SEQ ID NO: 1820735 - RNA, 15 nt, Human
uguuacugucuucag

SEQ ID NO: 1820736 - RNA, 16 nt, Human
uguuacugucuucagu

SEQ ID NO: 1820737 - RNA, 14 nt, Human
uguuggccaggcug

SEQ ID NO: 1820738 - RNA, 13 nt, Human
uguuggccaggcu

SEQ ID NO: 1820739 - RNA, 18 nt, Human
uguuggccaggcugcucu

SEQ ID NO: 1820740 - RNA, 17 nt, Human
uguuuacagauccccaa

SEQ ID NO: 1820741 - RNA, 14 nt, Human
uguugcugccucau

SEQ ID NO: 1820742 - RNA, 11 nt, Human
uguuggccagg

SEQ ID NO: 1820743 - RNA, 20 nt, Human
uguuggauuuuugucuugug

SEQ ID NO: 1820744 - RNA, 17 nt, Human
uguuggauuuuugucuu

SEQ ID NO: 1820745 - RNA, 13 nt, Human
uguugcugccuca

SEQ ID NO: 1820746 - RNA, 19 nt, Human
uguucucugcccuccaaga

SEQ ID NO: 1820747 - RNA, 15 nt, Human
uguucugacccugcu

SEQ ID NO: 1820748 - RNA, 18 nt, Human
uguucugacccugcuuca

SEQ ID NO: 1820749 - RNA, 17 nt, Human
uguucugcacacagcac

SEQ ID NO: 1820750 - RNA, 14 nt, Human
uguucuuucuggcu

SEQ ID NO: 1820751 - RNA, 22 nt, Human
uguucuuucuggcuaugcauuu

SEQ ID NO: 1820752 - RNA, 20 nt, Human
uguucuuucuggcuaugcau

SEQ ID NO: 1820753 - RNA, 11 nt, Human
uguugaaagau

SEQ ID NO: 1820754 - RNA, 18 nt, Human
uguucucugaggacacua

SEQ ID NO: 1820755 - RNA, 12 nt, Human
uguucucugccc

SEQ ID NO: 1820756 - RNA, 16 nt, Human
uguucucugaggacac

SEQ ID NO: 1820757 - RNA, 12 nt, Human
uguucuauagcu

SEQ ID NO: 1820758 - RNA, 13 nt, Human
uguucauaaauaa

SEQ ID NO: 1820759 - RNA, 14 nt, Human
uuacauuuccuaaa

SEQ ID NO: 1820760 - RNA, 23 nt, Human
uuacaauaaaaucuugaaaaugc

SEQ ID NO: 1820761 - RNA, 20 nt, Human
uuacagagacagaaagcaga

SEQ ID NO: 1820762 - RNA, 20 nt, Human
uuacgguuuuccagguuuaa

SEQ ID NO: 1820763 - RNA, 22 nt, Human
uuaccuuuuuuauacauaaaca

SEQ ID NO: 1820764 - RNA, 20 nt, Human
uuaccuuuuuuauacauaaa

SEQ ID NO: 1820765 - RNA, 19 nt, Human
uuaccuuuuuuauacauaa

SEQ ID NO: 1820766 - RNA, 23 nt, Human
uuacauuuuuaagugcugcauuu

SEQ ID NO: 1820767 - RNA, 22 nt, Human
uuacauuuuuaagugcugcauu

SEQ ID NO: 1820768 - RNA, 21 nt, Human
uuacauuuuuaagugcugcau

SEQ ID NO: 1820769 - RNA, 20 nt, Human
uuacauuuuuaagugcugca

SEQ ID NO: 1820770 - RNA, 14 nt, Human
uuaccagcagagca

SEQ ID NO: 1820771 - RNA, 22 nt, Human
uuaaugucaauucuugccaaau

SEQ ID NO: 1820772 - RNA, 17 nt, Human
uuaaugucacaggcagg

SEQ ID NO: 1820773 - RNA, 14 nt, Human
uuaauggaaauguu

SEQ ID NO: 1820774 - RNA, 18 nt, Human
uuaaugucacaggcaggu

SEQ ID NO: 1820775 - RNA, 22 nt, Human
uuaaggaugcuuguacauaaug

SEQ ID NO: 1820776 - RNA, 21 nt, Human
uuaaggaagacaaugugaaaa

SEQ ID NO: 1820777 - RNA, 20 nt, Human
uuaaggaugcuuguacauaa

SEQ ID NO: 1820778 - RNA, 19 nt, Human
uuaaggaugcuuguacaua

SEQ ID NO: 1820779 - RNA, 18 nt, Human
uuaaggaugcuuguacau

SEQ ID NO: 1820780 - RNA, 17 nt, Human
uuaaggaugcuuguaca

SEQ ID NO: 1820781 - RNA, 13 nt, Human
uguuuuugucuua

SEQ ID NO: 1820782 - RNA, 23 nt, Human
uguuuuaaaaugagaaaucuaaa

SEQ ID NO: 1820783 - RNA, 23 nt, Human
uguuuccuggcacugcuuccagu

SEQ ID NO: 1820784 - RNA, 20 nt, Human
uguuuccuggcacugcuucc

SEQ ID NO: 1820785 - RNA, 21 nt, Human
uguuuccuggcacugcuucca

SEQ ID NO: 1820786 - RNA, 22 nt, Human
uguuuccuggcacugcuuccag

SEQ ID NO: 1820787 - RNA, 17 nt, Human
uguuuguugucagcuga

SEQ ID NO: 1820788 - RNA, 16 nt, Human
uguuuguugucagcug

SEQ ID NO: 1820789 - RNA, 18 nt, Human
uguuuuaaaaugagaaau

SEQ ID NO: 1820790 - RNA, 13 nt, Human
uuaaaugcccagc

SEQ ID NO: 1820791 - RNA, 18 nt, Human
uuaaaugcccagccccuu

SEQ ID NO: 1820792 - RNA, 18 nt, Human
uuaaauaguaaaaauaaa

SEQ ID NO: 1820793 - RNA, 18 nt, Human
uuaaaugcaccuggaaua

SEQ ID NO: 1820794 - RNA, 17 nt, Human
uuaaaugcaccuggaau

SEQ ID NO: 1820795 - RNA, 16 nt, Human
uuaaaugcaccuggaa

SEQ ID NO: 1820796 - RNA, 14 nt, Human
uuaaagacuuuuau

SEQ ID NO: 1820797 - RNA, 22 nt, Human
uuaaacuuaaucuaaauggaac

SEQ ID NO: 1820798 - RNA, 20 nt, Human
uuaaacuuaaucuaaaugga

SEQ ID NO: 1820799 - RNA, 18 nt, Human
uuaaacuuaaucuaaaug

SEQ ID NO: 1820800 - RNA, 16 nt, Human
uuaaacuuaaucuaaa

SEQ ID NO: 1820801 - RNA, 15 nt, Human
uuaaaacauuaaaau

SEQ ID NO: 1820802 - RNA, 12 nt, Human
uggcugggggcc

SEQ ID NO: 1820803 - RNA, 16 nt, Human
uggcucuuccaggcug

SEQ ID NO: 1820804 - RNA, 13 nt, Human
uggcucuuccagg

SEQ ID NO: 1820805 - RNA, 15 nt, Human
uggcucuuccaggcu

SEQ ID NO: 1820806 - RNA, 16 nt, Human
uggcuccaaacccucg

SEQ ID NO: 1820807 - RNA, 18 nt, Human
uggcuccaaacccucgag

SEQ ID NO: 1820808 - RNA, 20 nt, Human
uggcuccaaacccucgaggc

SEQ ID NO: 1820809 - RNA, 22 nt, Human
uggcucagguggggucacucug

SEQ ID NO: 1820810 - RNA, 20 nt, Human
uggcucagguggggucacuc

SEQ ID NO: 1820811 - RNA, 15 nt, Human
uggccagaugcacca

SEQ ID NO: 1820812 - RNA, 18 nt, Human
uggccuucggccuccauc

SEQ ID NO: 1820813 - RNA, 17 nt, Human
uggccuucggccuccau

SEQ ID NO: 1820814 - RNA, 20 nt, Human
uggccuucggccuccauccu

SEQ ID NO: 1820815 - RNA, 22 nt, Human
uggcgugcaguggugcgaucug

SEQ ID NO: 1820816 - RNA, 15 nt, Human
uggcgcugccccugg

SEQ ID NO: 1820817 - RNA, 14 nt, Human
uggcgcugccccug

SEQ ID NO: 1820818 - RNA, 15 nt, Human
uggcugggggccuca

SEQ ID NO: 1820819 - RNA, 14 nt, Human
uggcugggggccuc

SEQ ID NO: 1820820 - RNA, 22 nt, Human
uggcugguuagagguucccuuu

SEQ ID NO: 1820821 - RNA, 14 nt, Human
uggcuuuucacugc

SEQ ID NO: 1820822 - RNA, 15 nt, Human
uggcuuuucacugcu

SEQ ID NO: 1820823 - RNA, 22 nt, Human
ugggaaugaaugucagugugac

SEQ ID NO: 1820824 - RNA, 16 nt, Human
ugggacagggcauggc

SEQ ID NO: 1820825 - RNA, 16 nt, Human
ugggacaugggaaagg

SEQ ID NO: 1820826 - RNA, 23 nt, Human
ugggagcugccuguucagcucca

SEQ ID NO: 1820827 - RNA, 21 nt, Human
ugggguggggggggugcuggg

SEQ ID NO: 1820828 - RNA, 22 nt, Human
ugggguggggggggugcugggc

SEQ ID NO: 1820829 - RNA, 19 nt, Human
ugggguggggggggugcug

SEQ ID NO: 1820830 - RNA, 17 nt, Human
ugggguggggaccucag

SEQ ID NO: 1820831 - RNA, 21 nt, Human
uggguuccagcaauucuccug

SEQ ID NO: 1820832 - RNA, 21 nt, Human
uggguuccuuccucugagccu

SEQ ID NO: 1820833 - RNA, 22 nt, Human
uggguuccuuccucugagccuu

SEQ ID NO: 1820834 - RNA, 17 nt, Human
uggguuggaaaacagua

SEQ ID NO: 1820835 - RNA, 16 nt, Human
uggguucacugcaacc

SEQ ID NO: 1820836 - RNA, 23 nt, Human
uggguucaagcgauucuucugcu

SEQ ID NO: 1820837 - RNA, 14 nt, Human
uggguguggcgcag

SEQ ID NO: 1820838 - RNA, 23 nt, Human
ugggugucaagagggucugagga

SEQ ID NO: 1820839 - RNA, 21 nt, Human
ugggugucaagagggucugag

SEQ ID NO: 1820840 - RNA, 16 nt, Human
uggggcagcuugaggg

SEQ ID NO: 1820841 - RNA, 21 nt, Human
ugggcuuggggaccagagcug

SEQ ID NO: 1820842 - RNA, 22 nt, Human
ugggcuuggggaccagagcugc

SEQ ID NO: 1820843 - RNA, 20 nt, Human
ugggcuucaguggcagcugc

SEQ ID NO: 1820844 - RNA, 19 nt, Human
ugggcuuggggaccagagc

SEQ ID NO: 1820845 - RNA, 19 nt, Human
ugggcuucaguggcagcug

SEQ ID NO: 1820846 - RNA, 18 nt, Human
ugggcuucaguggcagcu

SEQ ID NO: 1820847 - RNA, 17 nt, Human
ugggcgugagaccugcc

SEQ ID NO: 1820848 - RNA, 18 nt, Human
ugggcgugagaccugccc

SEQ ID NO: 1820849 - RNA, 19 nt, Human
ugggcgugagaccugcccc

SEQ ID NO: 1820850 - RNA, 24 nt, Human
ugggagcugccuguucagcuccag

SEQ ID NO: 1820851 - RNA, 22 nt, Human
ugggccuccugugugugcgccu

SEQ ID NO: 1820852 - RNA, 16 nt, Human
ugggccuccugugugu

SEQ ID NO: 1820853 - RNA, 18 nt, Human
ugggccuucagggaguga

SEQ ID NO: 1820854 - RNA, 14 nt, Human
ugggccuccugugu

SEQ ID NO: 1820855 - RNA, 20 nt, Human
uggcagugggagcugccugu

SEQ ID NO: 1820856 - RNA, 22 nt, Human
uggccacuccagaccccuggcu

SEQ ID NO: 1820857 - RNA, 19 nt, Human
uggcagugggagcugccug

SEQ ID NO: 1820858 - RNA, 16 nt, Human
uggcagugggagcugc

SEQ ID NO: 1820859 - RNA, 15 nt, Human
uggcagugggagcug

SEQ ID NO: 1820860 - RNA, 14 nt, Human
uggcagugggagcu

SEQ ID NO: 1820861 - RNA, 15 nt, Human
uggaugccugguggc

SEQ ID NO: 1820862 - RNA, 14 nt, Human
uggaugccuggugg

SEQ ID NO: 1820863 - RNA, 14 nt, Human
uggcacugcuucca

SEQ ID NO: 1820864 - RNA, 16 nt, Human
uggcacugcuuccagu

SEQ ID NO: 1820865 - RNA, 18 nt, Human
uggcacugcuuccaguga

SEQ ID NO: 1820866 - RNA, 22 nt, Human
uggcagcugcgguccacccagg

SEQ ID NO: 1820867 - RNA, 21 nt, Human
uggcagcugcgguccacccag

SEQ ID NO: 1820868 - RNA, 23 nt, Human
uggcagcugcgguccacccagga

SEQ ID NO: 1820869 - RNA, 22 nt, Human
uggaggcaugugaugagaggaa

SEQ ID NO: 1820870 - RNA, 15 nt, Human
uggauaccauuauau

SEQ ID NO: 1820871 - RNA, 13 nt, Human
uggauaccauuau

SEQ ID NO: 1820872 - RNA, 19 nt, Human
uggauacgacaacuugcac

SEQ ID NO: 1820873 - RNA, 17 nt, Human
uggacaggcauguucuc

SEQ ID NO: 1820874 - RNA, 17 nt, Human
uggagacugucucaaga

SEQ ID NO: 1820875 - RNA, 16 nt, Human
uggacaggcauguucu

SEQ ID NO: 1820876 - RNA, 12 nt, Human
uggacaggcaug

SEQ ID NO: 1820877 - RNA, 20 nt, Human
uggagaggcccggccucuca

SEQ ID NO: 1820878 - RNA, 13 nt, Human
uggagauguuuag

SEQ ID NO: 1820879 - RNA, 18 nt, Human
ugcuuguuaacugagugc

SEQ ID NO: 1820880 - RNA, 14 nt, Human
ugcuuguuggauuu

SEQ ID NO: 1820881 - RNA, 16 nt, Human
ugcuucuucagagacu

SEQ ID NO: 1820882 - RNA, 12 nt, Human
ugcuucucacug

SEQ ID NO: 1820883 - RNA, 21 nt, Human
ugcuuccagugaggcucugcc

SEQ ID NO: 1820884 - RNA, 19 nt, Human
ugcuuccagugaggcucug

SEQ ID NO: 1820885 - RNA, 20 nt, Human
ugcuuccagugaggcucugc

SEQ ID NO: 1820886 - RNA, 13 nt, Human
ugcugccucaugc

SEQ ID NO: 1820887 - RNA, 14 nt, Human
ugcugccuccagaa

SEQ ID NO: 1820888 - RNA, 18 nt, Human
ugcuuccagugaggcucu

SEQ ID NO: 1820889 - RNA, 14 nt, Human
uggaacucucgagc

SEQ ID NO: 1820890 - RNA, 11 nt, Human
uggaagacagc

SEQ ID NO: 1820891 - RNA, 12 nt, Human
uggaagacagcu

SEQ ID NO: 1820892 - RNA, 15 nt, Human
uggaaaauaaauuau

SEQ ID NO: 1820893 - RNA, 16 nt, Human
uggaaaauaaauuauu

SEQ ID NO: 1820894 - RNA, 20 nt, Human
uggaaaaaccacccccaaau

SEQ ID NO: 1820895 - RNA, 11 nt, Human
uggaaaauaaa

SEQ ID NO: 1820896 - RNA, 15 nt, Human
uggaaaauaaaucaa

SEQ ID NO: 1820897 - RNA, 21 nt, Human
uggaagugugugaucuguggg

SEQ ID NO: 1820898 - RNA, 14 nt, Human
uggaagacagcucu

SEQ ID NO: 1820899 - RNA, 15 nt, Human
uggaagacagcucuu

SEQ ID NO: 1820900 - RNA, 18 nt, Human
ugcacagugcaucucagc

SEQ ID NO: 1820901 - RNA, 19 nt, Human
ugcacagugcaucucagcc

SEQ ID NO: 1820902 - RNA, 20 nt, Human
ugcacagugcaucucagccc

SEQ ID NO: 1820903 - RNA, 18 nt, Human
ugcacagcuaacauggaa

SEQ ID NO: 1820904 - RNA, 20 nt, Human
ugcacagcuaacauggaagu

SEQ ID NO: 1820905 - RNA, 23 nt, Human
ugcacagcuaacauggaaguacu

SEQ ID NO: 1820906 - RNA, 16 nt, Human
ugaaggcuggguucug

SEQ ID NO: 1820907 - RNA, 17 nt, Human
ugaagucuuuguacaga

SEQ ID NO: 1820908 - RNA, 20 nt, Human
ugaagucuuuguacagacaa

SEQ ID NO: 1820909 - RNA, 22 nt, Human
ugaagucuuuguacagacaaca

SEQ ID NO: 1820910 - RNA, 22 nt, Human
ugcacagaguuguuacauuuuu

SEQ ID NO: 1820911 - RNA, 21 nt, Human
ugcacagaguuguuacauuuu

SEQ ID NO: 1820912 - RNA, 23 nt, Human
ugcacagaguuguuacauuuuua

SEQ ID NO: 1820913 - RNA, 17 nt, Human
ugcacagcuaacaugga

SEQ ID NO: 1820914 - RNA, 16 nt, Human
ugcacguacacacaca

SEQ ID NO: 1820915 - RNA, 19 nt, Human
ugcacguacacacacauac

SEQ ID NO: 1820916 - RNA, 16 nt, Human
ugcacuugcagacucu

SEQ ID NO: 1820917 - RNA, 21 nt, Human
ugcacuugcagacucuacaga

SEQ ID NO: 1820918 - RNA, 15 nt, Human
ugcacuuuguucugg

SEQ ID NO: 1820919 - RNA, 18 nt, Human
ugcacuuuguucuggcuc

SEQ ID NO: 1820920 - RNA, 19 nt, Human
ugcacuuuguucuggcucu

SEQ ID NO: 1820921 - RNA, 20 nt, Human
ugcacuuuguucuggcucuu

SEQ ID NO: 1820922 - RNA, 17 nt, Human
ugcagauaaacaguagu

SEQ ID NO: 1820923 - RNA, 16 nt, Human
ugcagauaaacaguag

SEQ ID NO: 1820924 - RNA, 18 nt, Human
ugcaggaccucaggugag

SEQ ID NO: 1820925 - RNA, 15 nt, Human
ugcaggaccucaggu

SEQ ID NO: 1820926 - RNA, 16 nt, Human
ugcaggaccucaggug

SEQ ID NO: 1820927 - RNA, 22 nt, Human
ugcagcuuuaaaaaauuaaucu

SEQ ID NO: 1820928 - RNA, 14 nt, Human
ugcaggaccucagg

SEQ ID NO: 1820929 - RNA, 13 nt, Human
ugcagcuuuaaaa

SEQ ID NO: 1820930 - RNA, 16 nt, Human
ugcagcaauaaagcag

SEQ ID NO: 1820931 - RNA, 15 nt, Human
ugcagcaauaaagca

SEQ ID NO: 1820932 - RNA, 14 nt, Human
ugcagcaauaaagc

SEQ ID NO: 1820933 - RNA, 19 nt, Human
ugcauguuacauaagauaa

SEQ ID NO: 1820934 - RNA, 16 nt, Human
ugcaggcagccaggcc

SEQ ID NO: 1820935 - RNA, 17 nt, Human
ugcaggcagccaggcca

SEQ ID NO: 1820936 - RNA, 18 nt, Human
ugcaggcagccaggccac

SEQ ID NO: 1820937 - RNA, 19 nt, Human
ugcaggcagccaggccaca

SEQ ID NO: 1820938 - RNA, 17 nt, Human
ugcaucguuucaucuuc

SEQ ID NO: 1820939 - RNA, 15 nt, Human
ugcaucguuucaucu

SEQ ID NO: 1820940 - RNA, 18 nt, Human
ugcauccuccgccucccg

SEQ ID NO: 1820941 - RNA, 21 nt, Human
ugcauccuccgccucccgggu

SEQ ID NO: 1820942 - RNA, 24 nt, Human
ugccagguuuuuggucugacccac

SEQ ID NO: 1820943 - RNA, 14 nt, Human
ugccagucaccccg

SEQ ID NO: 1820944 - RNA, 11 nt, Human
ugccagggaca

SEQ ID NO: 1820945 - RNA, 22 nt, Human
ugccagggacagaggggguggc

SEQ ID NO: 1820946 - RNA, 15 nt, Human
ugcccaccuggccuc

SEQ ID NO: 1820947 - RNA, 17 nt, Human
ugcccaccuggccucug

SEQ ID NO: 1820948 - RNA, 18 nt, Human
ugcccaccuggccucugc

SEQ ID NO: 1820949 - RNA, 19 nt, Human
ugcccaccuggccucugca

SEQ ID NO: 1820950 - RNA, 10 nt, Human
ugcccagccc

SEQ ID NO: 1820951 - RNA, 16 nt, Human
ugccuccuuugugagg

SEQ ID NO: 1820952 - RNA, 17 nt, Human
ugccuccuuugugagga

SEQ ID NO: 1820953 - RNA, 18 nt, Human
ugccuccuuugugaggaa

SEQ ID NO: 1820954 - RNA, 14 nt, Human
ugccucugggacug

SEQ ID NO: 1820955 - RNA, 17 nt, Human
ugccugaagucacacag

SEQ ID NO: 1820956 - RNA, 18 nt, Human
ugccugaagucacacagu

SEQ ID NO: 1820957 - RNA, 22 nt, Human
ugccugaagucacacagugagu

SEQ ID NO: 1820958 - RNA, 23 nt, Human
ugcccaggcuggcgugcaguggu

SEQ ID NO: 1820959 - RNA, 11 nt, Human
ugcccagcccc

SEQ ID NO: 1820960 - RNA, 19 nt, Human
ugccuaaggcugaacuugu

SEQ ID NO: 1820961 - RNA, 13 nt, Human
ugcgccuacagga

SEQ ID NO: 1820962 - RNA, 23 nt, Human
ugcggugcuaucucccccagccc

SEQ ID NO: 1820963 - RNA, 13 nt, Human
ugcgcaggcuggc

SEQ ID NO: 1820964 - RNA, 16 nt, Human
ugcgcaggcuggcccu

SEQ ID NO: 1820965 - RNA, 17 nt, Human
ugcgcaggcuggcccug

SEQ ID NO: 1820966 - RNA, 19 nt, Human
ugcgcaggcuggcccugcc

SEQ ID NO: 1820967 - RNA, 13 nt, Human
ugccuucagcucu

SEQ ID NO: 1820968 - RNA, 17 nt, Human
ugccuucagcucuacag

SEQ ID NO: 1820969 - RNA, 18 nt, Human
ugccuucagcucuacagc

SEQ ID NO: 1820970 - RNA, 15 nt, Human
ugccuggcggggugg

SEQ ID NO: 1820971 - RNA, 18 nt, Human
ugccuuauggaacacucu

SEQ ID NO: 1820972 - RNA, 20 nt, Human
ugccuuauggaacacucuga

SEQ ID NO: 1820973 - RNA, 21 nt, Human
ugccuuauggaacacucugag

SEQ ID NO: 1820974 - RNA, 22 nt, Human
ugccuuauggaacacucugaga

SEQ ID NO: 1820975 - RNA, 19 nt, Human
ugcugacagacacaggccc

SEQ ID NO: 1820976 - RNA, 16 nt, Human
ugcugacagacacagg

SEQ ID NO: 1820977 - RNA, 15 nt, Human
ugcugacagacacag

SEQ ID NO: 1820978 - RNA, 15 nt, Human
ugcugcaguugccag

SEQ ID NO: 1820979 - RNA, 16 nt, Human
ugcugcaguugccagu

SEQ ID NO: 1820980 - RNA, 20 nt, Human
ugcugauggugcaaugaccu

SEQ ID NO: 1820981 - RNA, 23 nt, Human
ugcugauggugcaaugaccuuuc

SEQ ID NO: 1820982 - RNA, 17 nt, Human
ugcugaaugguuuucaa

SEQ ID NO: 1820983 - RNA, 18 nt, Human
ugcugaaugguuuucaaa

SEQ ID NO: 1820984 - RNA, 22 nt, Human
ugcugaaugguuuucaaaauaa

SEQ ID NO: 1820985 - RNA, 18 nt, Human
ugcugaauacagaggcaa

SEQ ID NO: 1820986 - RNA, 23 nt, Human
ugcugaauacagaggcaacugca

SEQ ID NO: 1820987 - RNA, 19 nt, Human
ugcuccuggcccacugcau

SEQ ID NO: 1820988 - RNA, 15 nt, Human
ugcgugcauaccacu

SEQ ID NO: 1820989 - RNA, 18 nt, Human
ugcuagaacucccuuuca

SEQ ID NO: 1820990 - RNA, 19 nt, Human
ugcuagaacucccuuucaa

SEQ ID NO: 1820991 - RNA, 16 nt, Human
ugcuaggaacacuccu

SEQ ID NO: 1820992 - RNA, 17 nt, Human
ugcuaggaacacuccuu

SEQ ID NO: 1820993 - RNA, 19 nt, Human
ugcuaggaacacuccuuca

SEQ ID NO: 1820994 - RNA, 21 nt, Human
ugcuagaacucccuuucaaca

SEQ ID NO: 1820995 - RNA, 20 nt, Human
ugcuagaacucccuuucaac

SEQ ID NO: 1820996 - RNA, 19 nt, Human
ugcuccucuccccagcaag

SEQ ID NO: 1820997 - RNA, 14 nt, Human
ugcucaggagcccu

SEQ ID NO: 1820998 - RNA, 20 nt, Human
ugcucagcugucaaggcuca

SEQ ID NO: 1820999 - RNA, 16 nt, Human
ugcucagcugucaagg

SEQ ID NO: 1821000 - RNA, 21 nt, Human
ucuuccacaagagcccaggcc

SEQ ID NO: 1821001 - RNA, 16 nt, Human
ucuucaguaagccgug

SEQ ID NO: 1821002 - RNA, 14 nt, Human
ucuuccaggcuggg

SEQ ID NO: 1821003 - RNA, 19 nt, Human
ucuucuccacuuucuagcc

SEQ ID NO: 1821004 - RNA, 21 nt, Human
ucuucuccacuuucuagccag

SEQ ID NO: 1821005 - RNA, 13 nt, Human
ucuucuccacugg

SEQ ID NO: 1821006 - RNA, 14 nt, Human
ucuuagugugugca

SEQ ID NO: 1821007 - RNA, 16 nt, Human
ucuuaguggauguucu

SEQ ID NO: 1821008 - RNA, 15 nt, Human
ucuuauacauuugau

SEQ ID NO: 1821009 - RNA, 14 nt, Human
ucuuauacauuuga

SEQ ID NO: 1821010 - RNA, 13 nt, Human
ucuuaugggcugg

SEQ ID NO: 1821011 - RNA, 15 nt, Human
ucuucaguaagccgu

SEQ ID NO: 1821012 - RNA, 12 nt, Human
ucuucuccaggc

SEQ ID NO: 1821013 - RNA, 16 nt, Human
ucuucuccacuggaug

SEQ ID NO: 1821014 - RNA, 14 nt, Human
ucuucuccaggcug

SEQ ID NO: 1821015 - RNA, 13 nt, Human
ucuucuccaggcu

SEQ ID NO: 1821016 - RNA, 18 nt, Human
ucuugaacuccuggccuc

SEQ ID NO: 1821017 - RNA, 17 nt, Human
ucuugaacuccuggccu

SEQ ID NO: 1821018 - RNA, 16 nt, Human
ucuugaacuccuggcc

SEQ ID NO: 1821019 - RNA, 15 nt, Human
ucuucuccaggcugu

SEQ ID NO: 1821020 - RNA, 21 nt, Human
ucuugaauuguaaggaaugau

SEQ ID NO: 1821021 - RNA, 11 nt, Human
ucuugcucugc

SEQ ID NO: 1821022 - RNA, 13 nt, Human
ucuugcucugcug

SEQ ID NO: 1821023 - RNA, 12 nt, Human
ucuugcucugcu

SEQ ID NO: 1821024 - RNA, 22 nt, Human
ucuuguauuaaguuguuaauaa

SEQ ID NO: 1821025 - RNA, 18 nt, Human
ucuuguauuaaguuguua

SEQ ID NO: 1821026 - RNA, 16 nt, Human
ucuuguauuaaguugu

SEQ ID NO: 1821027 - RNA, 18 nt, Human
ucuuguuuuuuuuuucca

SEQ ID NO: 1821028 - RNA, 21 nt, Human
ucuuguuuuuuuuuuccacuu

SEQ ID NO: 1821029 - RNA, 22 nt, Human
ucuguggguuucuaaagcugcc

SEQ ID NO: 1821030 - RNA, 19 nt, Human
ucuguccgagcuuugaaaa

SEQ ID NO: 1821031 - RNA, 17 nt, Human
ucuguacgucugacagg

SEQ ID NO: 1821032 - RNA, 23 nt, Human
ucuguggguuucuaaagcugcca

SEQ ID NO: 1821033 - RNA, 18 nt, Human
ucuuaaaaaguggaaaaa

SEQ ID NO: 1821034 - RNA, 19 nt, Human
ucuguuacacuuuuuggaa

SEQ ID NO: 1821035 - RNA, 18 nt, Human
ucuggagguacgaaaaga

SEQ ID NO: 1821036 - RNA, 17 nt, Human
ucuggcuaugcauuuga

SEQ ID NO: 1821037 - RNA, 14 nt, Human
ucuggcuaugcauu

SEQ ID NO: 1821038 - RNA, 23 nt, Human
ucuggagcccacuguacuugcuc

SEQ ID NO: 1821039 - RNA, 23 nt, Human
ucuguacagagcccacgccccca

SEQ ID NO: 1821040 - RNA, 12 nt, Human
ucugggacacag

SEQ ID NO: 1821041 - RNA, 13 nt, Human
ucugggacacagu

SEQ ID NO: 1821042 - RNA, 17 nt, Human
ucuggcucuuccaggcu

SEQ ID NO: 1821043 - RNA, 15 nt, Human
ucuggcucuuccagg

SEQ ID NO: 1821044 - RNA, 16 nt, Human
ucuggcucuuccaggc

SEQ ID NO: 1821045 - RNA, 12 nt, Human
ugaaaggaaaga

SEQ ID NO: 1821046 - RNA, 17 nt, Human
ugaaaggaaagaggcuc

SEQ ID NO: 1821047 - RNA, 23 nt, Human
ugaaagcagggacuugaacccau

SEQ ID NO: 1821048 - RNA, 19 nt, Human
ugaaagcagggacuugaac

SEQ ID NO: 1821049 - RNA, 18 nt, Human
ugaaagcagggacuugaa

SEQ ID NO: 1821050 - RNA, 18 nt, Human
ugaaacccugucucuacu

SEQ ID NO: 1821051 - RNA, 22 nt, Human
ugaaagauggcugugccucugc

SEQ ID NO: 1821052 - RNA, 23 nt, Human
ugaaagauggcugugccucugcc

SEQ ID NO: 1821053 - RNA, 21 nt, Human
ugaaagauggcugugccucug

SEQ ID NO: 1821054 - RNA, 18 nt, Human
ugaaagggcccagagagg

SEQ ID NO: 1821055 - RNA, 17 nt, Human
ugaaagggcccagagag

SEQ ID NO: 1821056 - RNA, 16 nt, Human
ugaaagggcccagaga

SEQ ID NO: 1821057 - RNA, 15 nt, Human
ugaaagggcccagag

SEQ ID NO: 1821058 - RNA, 15 nt, Human
ugaaaucauucauuu

SEQ ID NO: 1821059 - RNA, 17 nt, Human
ugaaaucuuuuugcuuu

SEQ ID NO: 1821060 - RNA, 20 nt, Human
ugaaaugaggucagagccug

SEQ ID NO: 1821061 - RNA, 19 nt, Human
ugaaaugaggucagagccu

SEQ ID NO: 1821062 - RNA, 22 nt, Human
ugaaaugaggucagagccugca

SEQ ID NO: 1821063 - RNA, 21 nt, Human
ugaaaugaggucagagccugc

SEQ ID NO: 1821064 - RNA, 23 nt, Human
ugaaaugaggucagagccugcag

SEQ ID NO: 1821065 - RNA, 17 nt, Human
ucuuucacauuuaaaua

SEQ ID NO: 1821066 - RNA, 20 nt, Human
ucuuuugguuaugaauacuu

SEQ ID NO: 1821067 - RNA, 19 nt, Human
ucuuuugccguuauuaaaa

SEQ ID NO: 1821068 - RNA, 17 nt, Human
ucuuuugccguuauuaa

SEQ ID NO: 1821069 - RNA, 16 nt, Human
ucuuuuugcuuugcuu

SEQ ID NO: 1821070 - RNA, 16 nt, Human
ugaaaacuuuguagua

SEQ ID NO: 1821071 - RNA, 13 nt, Human
ugaaaacuuugua

SEQ ID NO: 1821072 - RNA, 15 nt, Human
ugaaaagaaaaauga

SEQ ID NO: 1821073 - RNA, 19 nt, Human
ugaaaacuuuaugcuaagu

SEQ ID NO: 1821074 - RNA, 23 nt, Human
ugaacuggguacuuguggacaca

SEQ ID NO: 1821075 - RNA, 14 nt, Human
ugaagacuuuucuu

SEQ ID NO: 1821076 - RNA, 17 nt, Human
ugaagacuuuucuuuca

SEQ ID NO: 1821077 - RNA, 22 nt, Human
ugaagacuuuucuuucagccaa

SEQ ID NO: 1821078 - RNA, 22 nt, Human
ugaacuuguaaaggaauuuaaa

SEQ ID NO: 1821079 - RNA, 14 nt, Human
ugaagacagagcua

SEQ ID NO: 1821080 - RNA, 16 nt, Human
ugaagacagagcuaca

SEQ ID NO: 1821081 - RNA, 19 nt, Human
ugaacuggguacuugugga

SEQ ID NO: 1821082 - RNA, 14 nt, Human
ugaacuuggcgcug

SEQ ID NO: 1821083 - RNA, 12 nt, Human
ugaacuugguuc

SEQ ID NO: 1821084 - RNA, 21 nt, Human
ugaaggcucgagcaugccugg

SEQ ID NO: 1821085 - RNA, 20 nt, Human
ugaaggcucgagcaugccug

SEQ ID NO: 1821086 - RNA, 19 nt, Human
ugaaauggacuuuuguaca

SEQ ID NO: 1821087 - RNA, 18 nt, Human
ugaacauugcaauagaaa

SEQ ID NO: 1821088 - RNA, 17 nt, Human
ugaacauugcaauagaa

SEQ ID NO: 1821089 - RNA, 15 nt, Human
ugaacauugcaauag

SEQ ID NO: 1821090 - RNA, 14 nt, Human
ugaacauuccagag

SEQ ID NO: 1821091 - RNA, 13 nt, Human
ugaacauuccaga

SEQ ID NO: 1821092 - RNA, 22 nt, Human
ugaaccacaucuugcucugcug

SEQ ID NO: 1821093 - RNA, 15 nt, Human
ugaacucuucaaucu

SEQ ID NO: 1821094 - RNA, 21 nt, Human
ugaaccacaucuugcucugcu

SEQ ID NO: 1821095 - RNA, 20 nt, Human
ugaaccacaucuugcucugc

SEQ ID NO: 1821096 - RNA, 14 nt, Human
ugaacugaacucug

SEQ ID NO: 1821097 - RNA, 18 nt, Human
ugaacucuucaaucucuu

SEQ ID NO: 1821098 - RNA, 15 nt, Human
ugaacugauaaagau

SEQ ID NO: 1821099 - RNA, 17 nt, Human
ugaacugaacucugaca

SEQ ID NO: 1821100 - RNA, 19 nt, Human
ugaacugaacucugacaac

SEQ ID NO: 1821101 - RNA, 13 nt, Human
ugaacugauaaag

SEQ ID NO: 1821102 - RNA, 19 nt, Human
uccuucuguccuacucugu

SEQ ID NO: 1821103 - RNA, 12 nt, Human
uccuucuguccu

SEQ ID NO: 1821104 - RNA, 16 nt, Human
uccuucaaagcaaaug

SEQ ID NO: 1821105 - RNA, 14 nt, Human
uccuuaccagcaga

SEQ ID NO: 1821106 - RNA, 10 nt, Human
ucccucccuu

SEQ ID NO: 1821107 - RNA, 22 nt, Human
uccuggcaugggaaugaauguc

SEQ ID NO: 1821108 - RNA, 17 nt, Human
uccuggcccacugcauc

SEQ ID NO: 1821109 - RNA, 15 nt, Human
uccugguguggaaga

SEQ ID NO: 1821110 - RNA, 23 nt, Human
ucgagugagacagacuagaaguu

SEQ ID NO: 1821111 - RNA, 14 nt, Human
ucgagugagacaga

SEQ ID NO: 1821112 - RNA, 15 nt, Human
ucgaguuacagacaa

SEQ ID NO: 1821113 - RNA, 17 nt, Human
ucgaguuacagacaaag

SEQ ID NO: 1821114 - RNA, 14 nt, Human
uccuuuuggaguca

SEQ ID NO: 1821115 - RNA, 23 nt, Human
uccuuuuggagucagacagaugu

SEQ ID NO: 1821116 - RNA, 17 nt, Human
ucgcaauguaagacucg

SEQ ID NO: 1821117 - RNA, 19 nt, Human
ucgcccaggcuggagugca

SEQ ID NO: 1821118 - RNA, 12 nt, Human
ucgcccaggcug

SEQ ID NO: 1821119 - RNA, 14 nt, Human
ucgcccaggcugga

SEQ ID NO: 1821120 - RNA, 14 nt, Human
ucucaaacuccuga

SEQ ID NO: 1821121 - RNA, 21 nt, Human
ucucaaacucuugaccucagg

SEQ ID NO: 1821122 - RNA, 13 nt, Human
ucucaaacucuug

SEQ ID NO: 1821123 - RNA, 22 nt, Human
ucucaaacucuugaccucaggu

SEQ ID NO: 1821124 - RNA, 17 nt, Human
ucucaaagaaauuucca

SEQ ID NO: 1821125 - RNA, 19 nt, Human
ucucaaagaaauuuccacu

SEQ ID NO: 1821126 - RNA, 17 nt, Human
ucucacucugucgccca

SEQ ID NO: 1821127 - RNA, 22 nt, Human
ucucacucugucgcccagucug

SEQ ID NO: 1821128 - RNA, 18 nt, Human
ucucacucugucgcccag

SEQ ID NO: 1821129 - RNA, 21 nt, Human
ucucacuguugcccaggcugg

SEQ ID NO: 1821130 - RNA, 20 nt, Human
ucucacuguugcccaggcug

SEQ ID NO: 1821131 - RNA, 19 nt, Human
ucucacuguugcccaggcu

SEQ ID NO: 1821132 - RNA, 18 nt, Human
ucucacuguugcccaggc

SEQ ID NO: 1821133 - RNA, 17 nt, Human
ucucagaaucucaaaua

SEQ ID NO: 1821134 - RNA, 21 nt, Human
ucucagaaucucaaauaacua

SEQ ID NO: 1821135 - RNA, 16 nt, Human
ucuaacuucaccauau

SEQ ID NO: 1821136 - RNA, 15 nt, Human
ucuaacuucaccaua

SEQ ID NO: 1821137 - RNA, 22 nt, Human
ucuaacuucaccauauuaccac

SEQ ID NO: 1821138 - RNA, 22 nt, Human
ucuacugaggugcuauguucuu

SEQ ID NO: 1821139 - RNA, 22 nt, Human
ucuagggaaaaaccagcgugug

SEQ ID NO: 1821140 - RNA, 21 nt, Human
ucuacacugugcugagucuga

SEQ ID NO: 1821141 - RNA, 15 nt, Human
ucuacacugugcuga

SEQ ID NO: 1821142 - RNA, 18 nt, Human
ucuacugaggugcuaugu

SEQ ID NO: 1821143 - RNA, 19 nt, Human
ucuacugaggugcuauguu

SEQ ID NO: 1821144 - RNA, 12 nt, Human
ucuacacugugc

SEQ ID NO: 1821145 - RNA, 14 nt, Human
ucuacacugugcug

SEQ ID NO: 1821146 - RNA, 17 nt, Human
ucuacacuccagugaga

SEQ ID NO: 1821147 - RNA, 13 nt, Human
ucucuucuccacu

SEQ ID NO: 1821148 - RNA, 14 nt, Human
ucucuucuccacug

SEQ ID NO: 1821149 - RNA, 15 nt, Human
ucucuucuccacugg

SEQ ID NO: 1821150 - RNA, 16 nt, Human
ucucuucuccacugga

SEQ ID NO: 1821151 - RNA, 11 nt, Human
ucucuucucca

SEQ ID NO: 1821152 - RNA, 18 nt, Human
ucucuucacagucacauu

SEQ ID NO: 1821153 - RNA, 11 nt, Human
ucucugcaggu

SEQ ID NO: 1821154 - RNA, 16 nt, Human
ucugaaaauguaugug

SEQ ID NO: 1821155 - RNA, 16 nt, Human
ucucuuuucaaaacau

SEQ ID NO: 1821156 - RNA, 15 nt, Human
ucucuuuucaaaaca

SEQ ID NO: 1821157 - RNA, 17 nt, Human
ucucuuuguucuaaaga

SEQ ID NO: 1821158 - RNA, 23 nt, Human
ucugaaaauguauguguaaguau

SEQ ID NO: 1821159 - RNA, 13 nt, Human
ucugaaagggacg

SEQ ID NO: 1821160 - RNA, 23 nt, Human
ucugaggacacuaaccacgcugg

SEQ ID NO: 1821161 - RNA, 20 nt, Human
ucugaggacacuaaccacgc

SEQ ID NO: 1821162 - RNA, 17 nt, Human
ucugaggacaagagaaa

SEQ ID NO: 1821163 - RNA, 14 nt, Human
ucugaggacaagag

SEQ ID NO: 1821164 - RNA, 17 nt, Human
ucugaggaauccagacc

SEQ ID NO: 1821165 - RNA, 16 nt, Human
ucugaggaauccagac

SEQ ID NO: 1821166 - RNA, 22 nt, Human
ucugagcauuagauuucucauu

SEQ ID NO: 1821167 - RNA, 23 nt, Human
ucugauucccaagcucugcuccu

SEQ ID NO: 1821168 - RNA, 18 nt, Human
ucugaggacaagagaaaa

SEQ ID NO: 1821169 - RNA, 19 nt, Human
ucugcacaagcugcacccu

SEQ ID NO: 1821170 - RNA, 14 nt, Human
ucugcacaagcugc

SEQ ID NO: 1821171 - RNA, 20 nt, Human
ucugagcauuagauuucuca

SEQ ID NO: 1821172 - RNA, 15 nt, Human
ucugacccaugcugc

SEQ ID NO: 1821173 - RNA, 16 nt, Human
ucugacccaugcugcc

SEQ ID NO: 1821174 - RNA, 17 nt, Human
ucugacccaugcugccc

SEQ ID NO: 1821175 - RNA, 18 nt, Human
ucugacccaugcugcccu

SEQ ID NO: 1821176 - RNA, 14 nt, Human
ucugacccaugcug

SEQ ID NO: 1821177 - RNA, 21 nt, Human
ucugaacuuggcgcugccccu

SEQ ID NO: 1821178 - RNA, 20 nt, Human
ucugaacuuggcgcugcccc

SEQ ID NO: 1821179 - RNA, 22 nt, Human
ucuccugccucagccucccaaa

SEQ ID NO: 1821180 - RNA, 22 nt, Human
ucucccccagccccauccucug

SEQ ID NO: 1821181 - RNA, 18 nt, Human
ucucccccagccccaucc

SEQ ID NO: 1821182 - RNA, 20 nt, Human
ucucccccagccccauccuc

SEQ ID NO: 1821183 - RNA, 14 nt, Human
ucucccccagcccc

SEQ ID NO: 1821184 - RNA, 15 nt, Human
ucucccccagcccca

SEQ ID NO: 1821185 - RNA, 17 nt, Human
ucucccccagccccauc

SEQ ID NO: 1821186 - RNA, 15 nt, Human
ucucaggucccugca

SEQ ID NO: 1821187 - RNA, 21 nt, Human
ucucagugucaaugcagcccc

SEQ ID NO: 1821188 - RNA, 19 nt, Human
ucucuaguuugauuaaauu

SEQ ID NO: 1821189 - RNA, 18 nt, Human
ucucuaguuugauuaaau

SEQ ID NO: 1821190 - RNA, 21 nt, Human
ucucuacugucucaguuuaca

SEQ ID NO: 1821191 - RNA, 13 nt, Human
ucuccuguaccuc

SEQ ID NO: 1821192 - RNA, 15 nt, Human
ucucuacaaaaagca

SEQ ID NO: 1821193 - RNA, 13 nt, Human
ucucugaggacac

SEQ ID NO: 1821194 - RNA, 14 nt, Human
ucucugaggacacu

SEQ ID NO: 1821195 - RNA, 15 nt, Human
ucucucgugaguaua

SEQ ID NO: 1821196 - RNA, 18 nt, Human
uccccuguuuguuucuga

SEQ ID NO: 1821197 - RNA, 21 nt, Human
uccccuuccuaauuccacagc

SEQ ID NO: 1821198 - RNA, 22 nt, Human
uccccuuccuaauuccacagcu

SEQ ID NO: 1821199 - RNA, 11 nt, Human
ucccuaauaaa

SEQ ID NO: 1821200 - RNA, 12 nt, Human
ucccuaauaaag

SEQ ID NO: 1821201 - RNA, 13 nt, Human
ucccuaauaaagc

SEQ ID NO: 1821202 - RNA, 15 nt, Human
ucccuacuguaauuu

SEQ ID NO: 1821203 - RNA, 17 nt, Human
ucccucccucuuucccu

SEQ ID NO: 1821204 - RNA, 15 nt, Human
ucccuacuuccugug

SEQ ID NO: 1821205 - RNA, 16 nt, Human
ucccuacuuccuguga

SEQ ID NO: 1821206 - RNA, 15 nt, Human
ucccucccucuuucc

SEQ ID NO: 1821207 - RNA, 24 nt, Human
uccccugcuggguguggcgcagca

SEQ ID NO: 1821208 - RNA, 19 nt, Human
uccccuguagagugggagc

SEQ ID NO: 1821209 - RNA, 15 nt, Human
uccccuguucacucu

SEQ ID NO: 1821210 - RNA, 22 nt, Human
uccccuguagagugggagcuga

SEQ ID NO: 1821211 - RNA, 23 nt, Human
uccccuguccccgcacugggcuu

SEQ ID NO: 1821212 - RNA, 14 nt, Human
uccccugcugggug

SEQ ID NO: 1821213 - RNA, 15 nt, Human
uccccugcugggugu

SEQ ID NO: 1821214 - RNA, 20 nt, Human
uccccugcuggguguggcgc

SEQ ID NO: 1821215 - RNA, 21 nt, Human
uccccugcuggguguggcgca

SEQ ID NO: 1821216 - RNA, 20 nt, Human
uccccgcacugggcuugggg

SEQ ID NO: 1821217 - RNA, 21 nt, Human
ucccccuuccauggacuuugu

SEQ ID NO: 1821218 - RNA, 14 nt, Human
uccccagcuguuua

SEQ ID NO: 1821219 - RNA, 15 nt, Human
uccccagcuguuuau

SEQ ID NO: 1821220 - RNA, 13 nt, Human
uccccaggaggcc

SEQ ID NO: 1821221 - RNA, 13 nt, Human
ucccccucuggcu

SEQ ID NO: 1821222 - RNA, 13 nt, Human
ucccccugcccca

SEQ ID NO: 1821223 - RNA, 17 nt, Human
ucccccaucucuucugg

SEQ ID NO: 1821224 - RNA, 23 nt, Human
ucccaucucacacaugagcauca

SEQ ID NO: 1821225 - RNA, 16 nt, Human
ucccaggcugagccuc

SEQ ID NO: 1821226 - RNA, 18 nt, Human
ucccaggcugagccucag

SEQ ID NO: 1821227 - RNA, 20 nt, Human
ucccaucucacacaugagca

SEQ ID NO: 1821228 - RNA, 12 nt, Human
ucccaugcccug

SEQ ID NO: 1821229 - RNA, 21 nt, Human
ucccaucugugaaaggaaaga

SEQ ID NO: 1821230 - RNA, 15 nt, Human
ucccaccucagccuc

SEQ ID NO: 1821231 - RNA, 14 nt, Human
ucccaccucagccu

SEQ ID NO: 1821232 - RNA, 13 nt, Human
ucccaccucagcc

SEQ ID NO: 1821233 - RNA, 22 nt, Human
ucccaaggcucugagcaaaugu

SEQ ID NO: 1821234 - RNA, 20 nt, Human
ucccaggcauuccccaggag

SEQ ID NO: 1821235 - RNA, 21 nt, Human
ucccaggcauuccccaggagg

SEQ ID NO: 1821236 - RNA, 20 nt, Human
ucccaggcgccccuuccccc

SEQ ID NO: 1821237 - RNA, 18 nt, Human
ucccaggcgccccuuccc

SEQ ID NO: 1821238 - RNA, 21 nt, Human
ucccaggcgccccuucccccu

SEQ ID NO: 1821239 - RNA, 15 nt, Human
ucccaggcugagccu

SEQ ID NO: 1821240 - RNA, 23 nt, Human
ucccaggcauuccccaggaggcc

SEQ ID NO: 1821241 - RNA, 22 nt, Human
ucccaggcauuccccaggaggc

SEQ ID NO: 1821242 - RNA, 15 nt, Human
ucccaagcucugcuc

SEQ ID NO: 1821243 - RNA, 14 nt, Human
ucccaagcucugcu

SEQ ID NO: 1821244 - RNA, 13 nt, Human
ucccaagcucugc

SEQ ID NO: 1821245 - RNA, 12 nt, Human
ucccaagcucug

SEQ ID NO: 1821246 - RNA, 17 nt, Human
ucccaagcucugcuccu

SEQ ID NO: 1821247 - RNA, 18 nt, Human
ucccaaggcucugagcaa

SEQ ID NO: 1821248 - RNA, 16 nt, Human
ucccaacucaccccag

SEQ ID NO: 1821249 - RNA, 14 nt, Human
ucccaacucacccc

SEQ ID NO: 1821250 - RNA, 15 nt, Human
ucccaacucacccca

SEQ ID NO: 1821251 - RNA, 13 nt, Human
ucccaacucaccc

SEQ ID NO: 1821252 - RNA, 23 nt, Human
uccagcucaccagccccagugcc

SEQ ID NO: 1821253 - RNA, 16 nt, Human
uccauccaggccauuc

SEQ ID NO: 1821254 - RNA, 14 nt, Human
uccauggacuuugu

SEQ ID NO: 1821255 - RNA, 15 nt, Human
uccauggacuuuguu

SEQ ID NO: 1821256 - RNA, 19 nt, Human
uccaaacuaccuuccaguu

SEQ ID NO: 1821257 - RNA, 17 nt, Human
uccaaaauaaaacuuuu

SEQ ID NO: 1821258 - RNA, 16 nt, Human
uccaaaauaaaacuuu

SEQ ID NO: 1821259 - RNA, 19 nt, Human
uccaagaccuucuccuuca

SEQ ID NO: 1821260 - RNA, 13 nt, Human
uccaagcaaaugu

SEQ ID NO: 1821261 - RNA, 22 nt, Human
uccaagaagcccaggaaaggcu

SEQ ID NO: 1821262 - RNA, 20 nt, Human
uccaagaagcccaggaaagg

SEQ ID NO: 1821263 - RNA, 23 nt, Human
uccagccaaagccuccuccagcc

SEQ ID NO: 1821264 - RNA, 14 nt, Human
uccacuuggucugu

SEQ ID NO: 1821265 - RNA, 13 nt, Human
uccaccugccagg

SEQ ID NO: 1821266 - RNA, 13 nt, Human
uccacuuggucug

SEQ ID NO: 1821267 - RNA, 12 nt, Human
uccacuuggucu

SEQ ID NO: 1821268 - RNA, 14 nt, Human
uccacaacacacag

SEQ ID NO: 1821269 - RNA, 15 nt, Human
uccacaagagcccag

SEQ ID NO: 1821270 - RNA, 14 nt, Human
uccacaagagccca

SEQ ID NO: 1821271 - RNA, 12 nt, Human
uccaccugccag

SEQ ID NO: 1821272 - RNA, 14 nt, Human
uccaccuacaugag

SEQ ID NO: 1821273 - RNA, 22 nt, Human
ucauuaggugugacugaauuuc

SEQ ID NO: 1821274 - RNA, 21 nt, Human
ucauuaggugugacugaauuu

SEQ ID NO: 1821275 - RNA, 18 nt, Human
ucauuaggugugacugaa

SEQ ID NO: 1821276 - RNA, 16 nt, Human
ucauuaggugugacug

SEQ ID NO: 1821277 - RNA, 21 nt, Human
ucauacccacccccacccaag

SEQ ID NO: 1821278 - RNA, 20 nt, Human
ucauacccacccccacccaa

SEQ ID NO: 1821279 - RNA, 14 nt, Human
ucauacccaccccc

SEQ ID NO: 1821280 - RNA, 15 nt, Human
ucauacccaccccca

SEQ ID NO: 1821281 - RNA, 13 nt, Human
ucauacccacccc

SEQ ID NO: 1821282 - RNA, 15 nt, Human
ucauaauuauuauuu

SEQ ID NO: 1821283 - RNA, 17 nt, Human
ucaguuguuaguguguc

SEQ ID NO: 1821284 - RNA, 13 nt, Human
ucauaaugacuua

SEQ ID NO: 1821285 - RNA, 15 nt, Human
ucaguuacucuucag

SEQ ID NO: 1821286 - RNA, 23 nt, Human
ucagugguuggcaauuguuucaa

SEQ ID NO: 1821287 - RNA, 11 nt, Human
ucaguguacau

SEQ ID NO: 1821288 - RNA, 13 nt, Human
ucagugugacuga

SEQ ID NO: 1821289 - RNA, 17 nt, Human
ucagugugacugaucuc

SEQ ID NO: 1821290 - RNA, 24 nt, Human
ucagucugauucccaagcucugcu

SEQ ID NO: 1821291 - RNA, 20 nt, Human
ucaguggggcccauggaugu

SEQ ID NO: 1821292 - RNA, 15 nt, Human
ucagucuggcccuuc

SEQ ID NO: 1821293 - RNA, 12 nt, Human
ucacuuuuauuu

SEQ ID NO: 1821294 - RNA, 22 nt, Human
ucacuuuuauuuagcaccaggg

SEQ ID NO: 1821295 - RNA, 16 nt, Human
ucacucugucgcccag

SEQ ID NO: 1821296 - RNA, 12 nt, Human
ucacucugucgc

SEQ ID NO: 1821297 - RNA, 19 nt, Human
ucacucugucgcccagucu

SEQ ID NO: 1821298 - RNA, 22 nt, Human
ucacucugucgcccagucugga

SEQ ID NO: 1821299 - RNA, 20 nt, Human
ucacugcuuaacuucacaua

SEQ ID NO: 1821300 - RNA, 18 nt, Human
ucacugcuuaacuucaca

SEQ ID NO: 1821301 - RNA, 17 nt, Human
ucacugcuuaacuucac

SEQ ID NO: 1821302 - RNA, 15 nt, Human
ucacugcuuaacuuc

SEQ ID NO: 1821303 - RNA, 21 nt, Human
ucagaggggaauaaacuguug

SEQ ID NO: 1821304 - RNA, 22 nt, Human
ucagaguugaugguuguacaua

SEQ ID NO: 1821305 - RNA, 19 nt, Human
ucagcacgauuucuguuua

SEQ ID NO: 1821306 - RNA, 18 nt, Human
ucagcacgauuucuguuu

SEQ ID NO: 1821307 - RNA, 15 nt, Human
ucagacagcugccug

SEQ ID NO: 1821308 - RNA, 16 nt, Human
ucagacagcugccugg

SEQ ID NO: 1821309 - RNA, 17 nt, Human
ucagacagcugccuggg

SEQ ID NO: 1821310 - RNA, 18 nt, Human
ucagacagcugccuggga

SEQ ID NO: 1821311 - RNA, 19 nt, Human
ucagacagcugccugggau

SEQ ID NO: 1821312 - RNA, 20 nt, Human
ucagacagcugccugggauc

SEQ ID NO: 1821313 - RNA, 19 nt, Human
ucagacauagaauuaacac

SEQ ID NO: 1821314 - RNA, 22 nt, Human
ucagacauagaauuaacacaug

SEQ ID NO: 1821315 - RNA, 18 nt, Human
ucacuccuaccugguaau

SEQ ID NO: 1821316 - RNA, 13 nt, Human
ucacuccuugaaa

SEQ ID NO: 1821317 - RNA, 20 nt, Human
ucacggcucacugcagccuc

SEQ ID NO: 1821318 - RNA, 15 nt, Human
ucacggcucacugca

SEQ ID NO: 1821319 - RNA, 13 nt, Human
ucacggcucacug

SEQ ID NO: 1821320 - RNA, 14 nt, Human
ucacggaagagccu

SEQ ID NO: 1821321 - RNA, 16 nt, Human
ucacggaagagccuug

SEQ ID NO: 1821322 - RNA, 17 nt, Human
ucacggaagagccuugc

SEQ ID NO: 1821323 - RNA, 14 nt, Human
ucacucuggcagcu

SEQ ID NO: 1821324 - RNA, 15 nt, Human
ucacucuggcagcuc

SEQ ID NO: 1821325 - RNA, 16 nt, Human
ucacucuggcagcuca

SEQ ID NO: 1821326 - RNA, 17 nt, Human
ucacucuggcagcucag

SEQ ID NO: 1821327 - RNA, 18 nt, Human
ucacucuggcagcucaga

SEQ ID NO: 1821328 - RNA, 19 nt, Human
ucacucuggcagcucagag

SEQ ID NO: 1821329 - RNA, 20 nt, Human
ucacucuggcagcucagaga

SEQ ID NO: 1821330 - RNA, 22 nt, Human
ucacucuggcagcucagagagg

SEQ ID NO: 1821331 - RNA, 23 nt, Human
ucacucuccuuggugucgggcau

SEQ ID NO: 1821332 - RNA, 12 nt, Human
ucacucuggcag

SEQ ID NO: 1821333 - RNA, 13 nt, Human
ucacucuggcagc

SEQ ID NO: 1821334 - RNA, 12 nt, Human
ucacucuccuug

SEQ ID NO: 1821335 - RNA, 14 nt, Human
ucacucuccuuggu

SEQ ID NO: 1821336 - RNA, 19 nt, Human
ucacucuacuuagcauguc

SEQ ID NO: 1821337 - RNA, 20 nt, Human
ucacucuacuuagcaugucc

SEQ ID NO: 1821338 - RNA, 13 nt, Human
ucaccuuuauucu

SEQ ID NO: 1821339 - RNA, 14 nt, Human
ucaccuuucccauc

SEQ ID NO: 1821340 - RNA, 12 nt, Human
ucaccuuugucc

SEQ ID NO: 1821341 - RNA, 15 nt, Human
ucacaggcaggucca

SEQ ID NO: 1821342 - RNA, 12 nt, Human
ucacaggcaggu

SEQ ID NO: 1821343 - RNA, 22 nt, Human
ucaccuuuguccccaccgcaga

SEQ ID NO: 1821344 - RNA, 14 nt, Human
ucaccuuugucccc

SEQ ID NO: 1821345 - RNA, 15 nt, Human
ucaccuuugucccca

SEQ ID NO: 1821346 - RNA, 17 nt, Human
ucaccuuuguccccacc

SEQ ID NO: 1821347 - RNA, 18 nt, Human
ucaccuuuguccccaccg

SEQ ID NO: 1821348 - RNA, 14 nt, Human
ucacgccacugcac

SEQ ID NO: 1821349 - RNA, 13 nt, Human
ucacgccacugca

SEQ ID NO: 1821350 - RNA, 16 nt, Human
ucacgccacugcacua

SEQ ID NO: 1821351 - RNA, 19 nt, Human
ucacgccuguaauccuagc

SEQ ID NO: 1821352 - RNA, 20 nt, Human
ucacgccuguaauccuagca

SEQ ID NO: 1821353 - RNA, 14 nt, Human
uaucugaaaaugua

SEQ ID NO: 1821354 - RNA, 15 nt, Human
uaucugaaaauguau

SEQ ID NO: 1821355 - RNA, 20 nt, Human
uaucugaaaauguaugugua

SEQ ID NO: 1821356 - RNA, 23 nt, Human
uauuuauuaaaugcccagccccu

SEQ ID NO: 1821357 - RNA, 21 nt, Human
uauuuucaacgcagcccugcu

SEQ ID NO: 1821358 - RNA, 15 nt, Human
uauuuuauguugcau

SEQ ID NO: 1821359 - RNA, 16 nt, Human
uauuuuauguugcaua

SEQ ID NO: 1821360 - RNA, 22 nt, Human
ucaaaacgguuuuacugcagcu

SEQ ID NO: 1821361 - RNA, 23 nt, Human
ucaaacggccucacuaggcuucu

SEQ ID NO: 1821362 - RNA, 15 nt, Human
ucaaacgugaaaaug

SEQ ID NO: 1821363 - RNA, 16 nt, Human
ucaaacgugaaaaugc

SEQ ID NO: 1821364 - RNA, 14 nt, Human
ucaaacucuuaaaa

SEQ ID NO: 1821365 - RNA, 15 nt, Human
ucaaaaacauucuua

SEQ ID NO: 1821366 - RNA, 22 nt, Human
uauuuuuuucugaauuauuuuc

SEQ ID NO: 1821367 - RNA, 15 nt, Human
uauuuuuuuacuaau

SEQ ID NO: 1821368 - RNA, 14 nt, Human
ucaaccuccugggc

SEQ ID NO: 1821369 - RNA, 13 nt, Human
ucaaccuccuggg

SEQ ID NO: 1821370 - RNA, 22 nt, Human
ucaaacucuugaccucagguga

SEQ ID NO: 1821371 - RNA, 13 nt, Human
ucaaacuuuacua

SEQ ID NO: 1821372 - RNA, 15 nt, Human
ucaaacuuuacuaug

SEQ ID NO: 1821373 - RNA, 16 nt, Human
ucaaacuuuacuaugg

SEQ ID NO: 1821374 - RNA, 22 nt, Human
ucaagugauucuccugccucag

SEQ ID NO: 1821375 - RNA, 23 nt, Human
ucaaggauccugagccagauuuc

SEQ ID NO: 1821376 - RNA, 20 nt, Human
ucaaggauccugagccagau

SEQ ID NO: 1821377 - RNA, 18 nt, Human
ucaaggauccugagccag

SEQ ID NO: 1821378 - RNA, 19 nt, Human
ucaaggauccugagccaga

SEQ ID NO: 1821379 - RNA, 17 nt, Human
ucaagcgauucuucugc

SEQ ID NO: 1821380 - RNA, 16 nt, Human
ucaagcgauucuucug

SEQ ID NO: 1821381 - RNA, 11 nt, Human
ucacaggcagg

SEQ ID NO: 1821382 - RNA, 19 nt, Human
ucacaggaaguagaggagg

SEQ ID NO: 1821383 - RNA, 14 nt, Human
ucacaggaaguaga

SEQ ID NO: 1821384 - RNA, 23 nt, Human
ucacacagugagucgaggacagg

SEQ ID NO: 1821385 - RNA, 22 nt, Human
ucacacagugagucgaggacag

SEQ ID NO: 1821386 - RNA, 21 nt, Human
ucacacaugagcaucaggcca

SEQ ID NO: 1821387 - RNA, 13 nt, Human
ucacacagugagu

SEQ ID NO: 1821388 - RNA, 22 nt, Human
ucacacaguauuacuucugcua

SEQ ID NO: 1821389 - RNA, 21 nt, Human
ucacacaguauuacuucugcu

SEQ ID NO: 1821390 - RNA, 19 nt, Human
ucaauuacaggaaguacug

SEQ ID NO: 1821391 - RNA, 20 nt, Human
ucaauuacaggaaguacugg

SEQ ID NO: 1821392 - RNA, 18 nt, Human
ucaaugcacugacauugu

SEQ ID NO: 1821393 - RNA, 17 nt, Human
ucaaugcuauaacuaug

SEQ ID NO: 1821394 - RNA, 13 nt, Human
ucaauuacaggaa

SEQ ID NO: 1821395 - RNA, 18 nt, Human
ucaauuacaggaaguacu

SEQ ID NO: 1821396 - RNA, 14 nt, Human
ucaaugcacugaca

SEQ ID NO: 1821397 - RNA, 17 nt, Human
ucaauaggaaaaacuga

SEQ ID NO: 1821398 - RNA, 14 nt, Human
ucaauaggaaaaac

SEQ ID NO: 1821399 - RNA, 13 nt, Human
ucaauaggaaaaa

SEQ ID NO: 1821400 - RNA, 12 nt, Human
uaaaaaacacug

SEQ ID NO: 1821401 - RNA, 20 nt, Human
uaaaaaacugcugacuguuu

SEQ ID NO: 1821402 - RNA, 23 nt, Human
uaaaaaacugcugacuguuuucu

SEQ ID NO: 1821403 - RNA, 11 nt, Human
uaaaaaacacu

SEQ ID NO: 1821404 - RNA, 14 nt, Human
guuuuucaguuuuc

SEQ ID NO: 1821405 - RNA, 12 nt, Human
guuuuucaguuu

SEQ ID NO: 1821406 - RNA, 12 nt, Human
guuuucucuuga

SEQ ID NO: 1821407 - RNA, 19 nt, Human
guuuucucuugagagggug

SEQ ID NO: 1821408 - RNA, 23 nt, Human
guuuuuauggcuuuugugcauua

SEQ ID NO: 1821409 - RNA, 22 nt, Human
guuuuuauggcuuuugugcauu

SEQ ID NO: 1821410 - RNA, 19 nt, Human
guuuuuauggcuuuugugc

SEQ ID NO: 1821411 - RNA, 17 nt, Human
guuuucaguguacaugg

SEQ ID NO: 1821412 - RNA, 16 nt, Human
guuuucaguguacaug

SEQ ID NO: 1821413 - RNA, 16 nt, Human
guuuguugugaggauu

SEQ ID NO: 1821414 - RNA, 21 nt, Human
gguuggccccugcccggcugc

SEQ ID NO: 1821415 - RNA, 17 nt, Human
guuuagaaagcuugccc

SEQ ID NO: 1821416 - RNA, 13 nt, Human
guuuagaaagcuu

SEQ ID NO: 1821417 - RNA, 16 nt, Human
guuuaguaaucauauu

SEQ ID NO: 1821418 - RNA, 18 nt, Human
guuucagaaauguguuau

SEQ ID NO: 1821419 - RNA, 14 nt, Human
guuucagaaaugug

SEQ ID NO: 1821420 - RNA, 22 nt, Human
guuuccugcccugggaggcagu

SEQ ID NO: 1821421 - RNA, 16 nt, Human
guuuccuuauauuaug

SEQ ID NO: 1821422 - RNA, 21 nt, Human
guuuccuggcacugcuuccag

SEQ ID NO: 1821423 - RNA, 22 nt, Human
guuuccuggcacugcuuccagu

SEQ ID NO: 1821424 - RNA, 13 nt, Human
guuuccugcccug

SEQ ID NO: 1821425 - RNA, 17 nt, Human
guuuccugcccugggag

SEQ ID NO: 1821426 - RNA, 16 nt, Human
guuuccuggcacugcu

SEQ ID NO: 1821427 - RNA, 20 nt, Human
guuuccuggcacugcuucca

SEQ ID NO: 1821428 - RNA, 20 nt, Human
guuucuaaagcugccagccg

SEQ ID NO: 1821429 - RNA, 16 nt, Human
guuucuaaagcugcca

SEQ ID NO: 1821430 - RNA, 14 nt, Human
guuucuaaagcugc

SEQ ID NO: 1821431 - RNA, 15 nt, Human
guuucuaaagcugcc

SEQ ID NO: 1821432 - RNA, 16 nt, Human
guuugaaccaagaacu

SEQ ID NO: 1821433 - RNA, 17 nt, Human
guuucuuuguaaugaaa

SEQ ID NO: 1821434 - RNA, 20 nt, Human
guuucuuucucugaggacaa

SEQ ID NO: 1821435 - RNA, 19 nt, Human
guuucuuucucugaggaca

SEQ ID NO: 1821436 - RNA, 14 nt, Human
guuucuuuguaaug

SEQ ID NO: 1821437 - RNA, 22 nt, Human
guuugauuaaauucuugcaaag

SEQ ID NO: 1821438 - RNA, 19 nt, Human
guuugauuaaauucuugca

SEQ ID NO: 1821439 - RNA, 17 nt, Human
guuugauuaaauucuug

SEQ ID NO: 1821440 - RNA, 20 nt, Human
guuuguaaauuaacuuuuau

SEQ ID NO: 1821441 - RNA, 19 nt, Human
guuuguaaauuaacuuuua

SEQ ID NO: 1821442 - RNA, 17 nt, Human
guuuguaaauuaacuuu

SEQ ID NO: 1821443 - RNA, 18 nt, Human
guuuguuccccaagacau

SEQ ID NO: 1821444 - RNA, 19 nt, Human
guuuguggaaaaugaaaau

SEQ ID NO: 1821445 - RNA, 13 nt, Human
uaaaaugagaaau

SEQ ID NO: 1821446 - RNA, 15 nt, Human
uaaaaugagaaaucu

SEQ ID NO: 1821447 - RNA, 16 nt, Human
uaaaaugagaaaucua

SEQ ID NO: 1821448 - RNA, 15 nt, Human
uaaaaaugguuuaaa

SEQ ID NO: 1821449 - RNA, 18 nt, Human
uaaaagcauuuuguaaua

SEQ ID NO: 1821450 - RNA, 17 nt, Human
uaaaagcauuuuguaau

SEQ ID NO: 1821451 - RNA, 16 nt, Human
uaaaagcauuuuguaa

SEQ ID NO: 1821452 - RNA, 15 nt, Human
uaaaagcauuuugua

SEQ ID NO: 1821453 - RNA, 14 nt, Human
uaaaagcauuuugu

SEQ ID NO: 1821454 - RNA, 17 nt, Human
uaaaagggacugagaaa

SEQ ID NO: 1821455 - RNA, 19 nt, Human
uaaaagggacugagaaauu

SEQ ID NO: 1821456 - RNA, 20 nt, Human
uaaaagggacugagaaauuu

SEQ ID NO: 1821457 - RNA, 21 nt, Human
uaaaagggacugagaaauuua

SEQ ID NO: 1821458 - RNA, 19 nt, Human
uaaacuuaaucuaaaugga

SEQ ID NO: 1821459 - RNA, 18 nt, Human
uaaacuuaaucuaaaugg

SEQ ID NO: 1821460 - RNA, 13 nt, Human
uaaacuuaaucua

SEQ ID NO: 1821461 - RNA, 14 nt, Human
uaaacuuaaucuaa

SEQ ID NO: 1821462 - RNA, 16 nt, Human
uaaacuuuaccuuuuu

SEQ ID NO: 1821463 - RNA, 22 nt, Human
uaaacuuuaccuuuuuuauaca

SEQ ID NO: 1821464 - RNA, 22 nt, Human
uaaacugcccccucugcccugc

SEQ ID NO: 1821465 - RNA, 23 nt, Human
uaaacugcccccucugcccugcg

SEQ ID NO: 1821466 - RNA, 20 nt, Human
uaaacugcccccucugcccu

SEQ ID NO: 1821467 - RNA, 21 nt, Human
uaaacugcccccucugcccug

SEQ ID NO: 1821468 - RNA, 18 nt, Human
uaaacaagaccacguuuc

SEQ ID NO: 1821469 - RNA, 19 nt, Human
uaaacaagaccacguuucu

SEQ ID NO: 1821470 - RNA, 23 nt, Human
uaaacaagaccacguuucuaaag

SEQ ID NO: 1821471 - RNA, 21 nt, Human
uaaacacucuugaaaaaugca

SEQ ID NO: 1821472 - RNA, 14 nt, Human
uaaaggaauuuaaa

SEQ ID NO: 1821473 - RNA, 14 nt, Human
uaaagcuagaaaug

SEQ ID NO: 1821474 - RNA, 15 nt, Human
uaaagcuagaaauga

SEQ ID NO: 1821475 - RNA, 20 nt, Human
uaaacuuuuuucuuacuguc

SEQ ID NO: 1821476 - RNA, 17 nt, Human
uaaauaaaaauaauccu

SEQ ID NO: 1821477 - RNA, 14 nt, Human
uaaaguuuguugaa

SEQ ID NO: 1821478 - RNA, 13 nt, Human
uaaaguuucuguu

SEQ ID NO: 1821479 - RNA, 21 nt, Human
uaaaguguauuuuuuuacuaa

SEQ ID NO: 1821480 - RNA, 23 nt, Human
uaaaguguauuuuuuuacuaaua

SEQ ID NO: 1821481 - RNA, 22 nt, Human
uaaaguguauuuuuuuacuaau

SEQ ID NO: 1821482 - RNA, 18 nt, Human
uaaauauaugcuaagucu

SEQ ID NO: 1821483 - RNA, 16 nt, Human
uaaauauauuuuaaga

SEQ ID NO: 1821484 - RNA, 22 nt, Human
uaaauauauuuuaagacgaaac

SEQ ID NO: 1821485 - RNA, 19 nt, Human
uaaaucaaguuggcuucua

SEQ ID NO: 1821486 - RNA, 20 nt, Human
uaaaucagacuaugaaguuu

SEQ ID NO: 1821487 - RNA, 19 nt, Human
uaaaucagccguguaacca

SEQ ID NO: 1821488 - RNA, 15 nt, Human
uaaauugcuccuuga

SEQ ID NO: 1821489 - RNA, 13 nt, Human
uaacagaaaugua

SEQ ID NO: 1821490 - RNA, 15 nt, Human
uaacagaaauguaca

SEQ ID NO: 1821491 - RNA, 14 nt, Human
uaacagaaauguac

SEQ ID NO: 1821492 - RNA, 19 nt, Human
uaacaggcagauacaggaa

SEQ ID NO: 1821493 - RNA, 19 nt, Human
uaaccagcagaaaugccuu

SEQ ID NO: 1821494 - RNA, 16 nt, Human
uaaccagcagaaaugc

SEQ ID NO: 1821495 - RNA, 14 nt, Human
uaaccagcagaaau

SEQ ID NO: 1821496 - RNA, 16 nt, Human
uaacugagugccuuuu

SEQ ID NO: 1821497 - RNA, 17 nt, Human
uaacugagugccuuuug

SEQ ID NO: 1821498 - RNA, 20 nt, Human
uaacuuuuauaaacuuuacc

SEQ ID NO: 1821499 - RNA, 15 nt, Human
uaagcaugcacaaau

SEQ ID NO: 1821500 - RNA, 13 nt, Human
uaagccagacauc

SEQ ID NO: 1821501 - RNA, 21 nt, Human
uaagccagacaucaacagaua

SEQ ID NO: 1821502 - RNA, 20 nt, Human
uaagccagacaucaacagau

SEQ ID NO: 1821503 - RNA, 14 nt, Human
uaagccuuuggaaa

SEQ ID NO: 1821504 - RNA, 17 nt, Human
uaagccuuuggaaacag

SEQ ID NO: 1821505 - RNA, 21 nt, Human
uaagccuuuggaaacagcucg

SEQ ID NO: 1821506 - RNA, 19 nt, Human
uaaggaugcuuguacauaa

SEQ ID NO: 1821507 - RNA, 15 nt, Human
uaaggcaaucauggu

SEQ ID NO: 1821508 - RNA, 18 nt, Human
uaaggaugcuuguacaua

SEQ ID NO: 1821509 - RNA, 23 nt, Human
uaaggaugcuuguacauaaugcg

SEQ ID NO: 1821510 - RNA, 22 nt, Human
uaaggaugcuuguacauaaugc

SEQ ID NO: 1821511 - RNA, 21 nt, Human
uaaggaugcuuguacauaaug

SEQ ID NO: 1821512 - RNA, 20 nt, Human
uaaggaugcuuguacauaau

SEQ ID NO: 1821513 - RNA, 22 nt, Human
uaagaggcagggucucacucug

SEQ ID NO: 1821514 - RNA, 15 nt, Human
uaagaaauacagacu

SEQ ID NO: 1821515 - RNA, 22 nt, Human
uaagaaccuuuugagugccuua

SEQ ID NO: 1821516 - RNA, 22 nt, Human
uaacuuuuauaaacuuuaccuu

SEQ ID NO: 1821517 - RNA, 21 nt, Human
uaacuuuuauaaacuuuaccu

SEQ ID NO: 1821518 - RNA, 14 nt, Human
uaagauaaaugugc

SEQ ID NO: 1821519 - RNA, 12 nt, Human
uaagagggaggg

SEQ ID NO: 1821520 - RNA, 22 nt, Human
uaagagggagggagggcuccag

SEQ ID NO: 1821521 - RNA, 23 nt, Human
uaagagggagggagggcuccaga

SEQ ID NO: 1821522 - RNA, 18 nt, Human
uaagaucguucucugccu

SEQ ID NO: 1821523 - RNA, 16 nt, Human
uaagauaaaugugcug

SEQ ID NO: 1821524 - RNA, 17 nt, Human
uaagauaaaugugcuga

SEQ ID NO: 1821525 - RNA, 13 nt, Human
uaaucgaccugcc

SEQ ID NO: 1821526 - RNA, 14 nt, Human
uaaucgaccugccu

SEQ ID NO: 1821527 - RNA, 16 nt, Human
uaaucgaccugccucg

SEQ ID NO: 1821528 - RNA, 16 nt, Human
uaaucguguccccuau

SEQ ID NO: 1821529 - RNA, 19 nt, Human
uaaugccacuaaauugaca

SEQ ID NO: 1821530 - RNA, 17 nt, Human
uaaugaugucguuugaa

SEQ ID NO: 1821531 - RNA, 23 nt, Human
uaaugaugucguuugaaucacag

SEQ ID NO: 1821532 - RNA, 15 nt, Human
uaaugauaugcuugu

SEQ ID NO: 1821533 - RNA, 16 nt, Human
uaaugauaugcuugua

SEQ ID NO: 1821534 - RNA, 11 nt, Human
uaaucuaaaug

SEQ ID NO: 1821535 - RNA, 20 nt, Human
uaagugguacuaacuuuccu

SEQ ID NO: 1821536 - RNA, 13 nt, Human
uaauaaagacagg

SEQ ID NO: 1821537 - RNA, 11 nt, Human
uaauaaagcug

SEQ ID NO: 1821538 - RNA, 16 nt, Human
uaauaauaaagaauag

SEQ ID NO: 1821539 - RNA, 21 nt, Human
uaauaguucagguaacaggca

SEQ ID NO: 1821540 - RNA, 14 nt, Human
uaauacaccacuac

SEQ ID NO: 1821541 - RNA, 18 nt, Human
uaauuugugauacaaugc

SEQ ID NO: 1821542 - RNA, 15 nt, Human
uaauuugugauacaa

SEQ ID NO: 1821543 - RNA, 14 nt, Human
uaauuugugauaca

SEQ ID NO: 1821544 - RNA, 22 nt, Human
uaauuugugauacaaugcugug

SEQ ID NO: 1821545 - RNA, 19 nt, Human
uaauuugugauacaaugcu

SEQ ID NO: 1821546 - RNA, 18 nt, Human
uaauucuuagcucauucu

SEQ ID NO: 1821547 - RNA, 22 nt, Human
uaauugacaggauuauuggaaa

SEQ ID NO: 1821548 - RNA, 20 nt, Human
uaauugacaggauuauugga

SEQ ID NO: 1821549 - RNA, 19 nt, Human
uaaugcgcaggcuggcccu

SEQ ID NO: 1821550 - RNA, 22 nt, Human
uaaugcgcaggcuggcccugcc

SEQ ID NO: 1821551 - RNA, 14 nt, Human
uaaugcgugcauac

SEQ ID NO: 1821552 - RNA, 23 nt, Human
uaaugcgcaggcuggcccugccc

SEQ ID NO: 1821553 - RNA, 17 nt, Human
uaauuaaaacacaacau

SEQ ID NO: 1821554 - RNA, 21 nt, Human
uacuguaucaugacaaagacu

SEQ ID NO: 1821555 - RNA, 17 nt, Human
uacugcauaugaaagga

SEQ ID NO: 1821556 - RNA, 21 nt, Human
uacuugcucuugaugccuggc

SEQ ID NO: 1821557 - RNA, 18 nt, Human
uacuuguggacacagcuc

SEQ ID NO: 1821558 - RNA, 15 nt, Human
uacuuguggacacag

SEQ ID NO: 1821559 - RNA, 19 nt, Human
uacuuguggacacagcucu

SEQ ID NO: 1821560 - RNA, 15 nt, Human
uagaaauauaauuga

SEQ ID NO: 1821561 - RNA, 20 nt, Human
uagaaauaucugaaaaugua

SEQ ID NO: 1821562 - RNA, 21 nt, Human
uagaaauaucugaaaauguau

SEQ ID NO: 1821563 - RNA, 23 nt, Human
uagaaauaucugaaaauguaugu

SEQ ID NO: 1821564 - RNA, 15 nt, Human
uagaaagaagaugaa

SEQ ID NO: 1821565 - RNA, 12 nt, Human
uacucccaucug

SEQ ID NO: 1821566 - RNA, 14 nt, Human
uacucccaucugug

SEQ ID NO: 1821567 - RNA, 16 nt, Human
uacucccaucugugaa

SEQ ID NO: 1821568 - RNA, 17 nt, Human
uacucccaucugugaaa

SEQ ID NO: 1821569 - RNA, 15 nt, Human
uacugaggugcuaug

SEQ ID NO: 1821570 - RNA, 22 nt, Human
uacucagaauucucuaguuuga

SEQ ID NO: 1821571 - RNA, 16 nt, Human
uacucagaauucucua

SEQ ID NO: 1821572 - RNA, 14 nt, Human
uacucaccucaccc

SEQ ID NO: 1821573 - RNA, 12 nt, Human
uacucaccucac

SEQ ID NO: 1821574 - RNA, 14 nt, Human
uacuaccuguaaug

SEQ ID NO: 1821575 - RNA, 20 nt, Human
uacuacaguccucccaucuc

SEQ ID NO: 1821576 - RNA, 20 nt, Human
uacuacaguuuguuaguaug

SEQ ID NO: 1821577 - RNA, 22 nt, Human
uacccaucccauaugccugggc

SEQ ID NO: 1821578 - RNA, 19 nt, Human
uaccuuugacaaagguaaa

SEQ ID NO: 1821579 - RNA, 20 nt, Human
uaccuuuguauucucuccug

SEQ ID NO: 1821580 - RNA, 20 nt, Human
uaccuuuuuuauacauaaac

SEQ ID NO: 1821581 - RNA, 19 nt, Human
uaccuuuuuuauacauaaa

SEQ ID NO: 1821582 - RNA, 18 nt, Human
uaccuuuuuuauacauaa

SEQ ID NO: 1821583 - RNA, 15 nt, Human
uacgacaacuugcac

SEQ ID NO: 1821584 - RNA, 14 nt, Human
uacgacaacuugca

SEQ ID NO: 1821585 - RNA, 22 nt, Human
uaccuuuuuuauacauaaacaa

SEQ ID NO: 1821586 - RNA, 18 nt, Human
uacuaaccagcagaaaug

SEQ ID NO: 1821587 - RNA, 17 nt, Human
uacuaaccagcagaaau

SEQ ID NO: 1821588 - RNA, 19 nt, Human
uacuaaccagcagaaaugc

SEQ ID NO: 1821589 - RNA, 17 nt, Human
uacuaauagacaauuua

SEQ ID NO: 1821590 - RNA, 15 nt, Human
uacuaauagacaauu

SEQ ID NO: 1821591 - RNA, 22 nt, Human
uacuaauaaaauuuaaaagucu

SEQ ID NO: 1821592 - RNA, 13 nt, Human
uacuaacuuuccu

SEQ ID NO: 1821593 - RNA, 12 nt, Human
uacuacaguccu

SEQ ID NO: 1821594 - RNA, 17 nt, Human
uacuacaguccucccau

SEQ ID NO: 1821595 - RNA, 21 nt, Human
uacauuuuguauauuuguauu

SEQ ID NO: 1821596 - RNA, 22 nt, Human
uacaugagguacugagagugaa

SEQ ID NO: 1821597 - RNA, 21 nt, Human
uacaugagguacugagaguga

SEQ ID NO: 1821598 - RNA, 22 nt, Human
uacauaagauaaaugugcugaa

SEQ ID NO: 1821599 - RNA, 23 nt, Human
uacaguuacucagaauucucuag

SEQ ID NO: 1821600 - RNA, 19 nt, Human
uacaguuacucagaauucu

SEQ ID NO: 1821601 - RNA, 18 nt, Human
uacaguuccuagguauaa

SEQ ID NO: 1821602 - RNA, 18 nt, Human
uacauaagauaaaugugc

SEQ ID NO: 1821603 - RNA, 19 nt, Human
uacauaagauaaaugugcu

SEQ ID NO: 1821604 - RNA, 23 nt, Human
uaccauuuugggguacccacugc

SEQ ID NO: 1821605 - RNA, 15 nt, Human
uaccaccacgcccgg

SEQ ID NO: 1821606 - RNA, 13 nt, Human
uaccacagacaua

SEQ ID NO: 1821607 - RNA, 18 nt, Human
uacccagcgagcccuggu

SEQ ID NO: 1821608 - RNA, 22 nt, Human
uacccaggugcuaggaacacuc

SEQ ID NO: 1821609 - RNA, 14 nt, Human
uacccacugcucug

SEQ ID NO: 1821610 - RNA, 13 nt, Human
uacccacugcucu

SEQ ID NO: 1821611 - RNA, 12 nt, Human
uacccacugcuc

SEQ ID NO: 1821612 - RNA, 11 nt, Human
uacccacugcu

SEQ ID NO: 1821613 - RNA, 12 nt, Human
uacccaccccca

SEQ ID NO: 1821614 - RNA, 15 nt, Human
uacccacccccaccc

SEQ ID NO: 1821615 - RNA, 23 nt, Human
uacccacccccacccaagggccu

SEQ ID NO: 1821616 - RNA, 17 nt, Human
uacccacccccacccaa

SEQ ID NO: 1821617 - RNA, 19 nt, Human
uacccacccccacccaagg

SEQ ID NO: 1821618 - RNA, 13 nt, Human
uacagaauuuuau

SEQ ID NO: 1821619 - RNA, 24 nt, Human
uacagcaaggagauuuacaacugg

SEQ ID NO: 1821620 - RNA, 13 nt, Human
uacacuuuaugca

SEQ ID NO: 1821621 - RNA, 19 nt, Human
uacacuguuucaaacuuua

SEQ ID NO: 1821622 - RNA, 18 nt, Human
uacacuguuucaaacuuu

SEQ ID NO: 1821623 - RNA, 17 nt, Human
uacacuguuucaaacuu

SEQ ID NO: 1821624 - RNA, 14 nt, Human
uacaggauuugaaa

SEQ ID NO: 1821625 - RNA, 16 nt, Human
uacaggcacccaccau

SEQ ID NO: 1821626 - RNA, 19 nt, Human
uacaggaaaagcugcugac

SEQ ID NO: 1821627 - RNA, 16 nt, Human
uacaguguacagucuu

SEQ ID NO: 1821628 - RNA, 15 nt, Human
uacaguguacagucu

SEQ ID NO: 1821629 - RNA, 22 nt, Human
uacaguguacagucuuguauua

SEQ ID NO: 1821630 - RNA, 13 nt, Human
uacaguguacagu

SEQ ID NO: 1821631 - RNA, 18 nt, Human
uacaggaaaagcugcuga

SEQ ID NO: 1821632 - RNA, 17 nt, Human
uacaggaaaagcugcug

SEQ ID NO: 1821633 - RNA, 23 nt, Human
uacagcuugaccgugaggccaga

SEQ ID NO: 1821634 - RNA, 22 nt, Human
uacagcuugaccgugaggccag

SEQ ID NO: 1821635 - RNA, 15 nt, Human
uacaagacacaguga

SEQ ID NO: 1821636 - RNA, 19 nt, Human
uacaagagcuuaacagugu

SEQ ID NO: 1821637 - RNA, 13 nt, Human
uaauuuugaaaaa

SEQ ID NO: 1821638 - RNA, 17 nt, Human
uaauuuugaaaaacugc

SEQ ID NO: 1821639 - RNA, 19 nt, Human
uaauuuuguaauguaucaa

SEQ ID NO: 1821640 - RNA, 12 nt, Human
uaauuuuguaau

SEQ ID NO: 1821641 - RNA, 22 nt, Human
uacacacugcauguuugugauu

SEQ ID NO: 1821642 - RNA, 14 nt, Human
uacacuguuucaaa

SEQ ID NO: 1821643 - RNA, 16 nt, Human
uacacugugcugaguc

SEQ ID NO: 1821644 - RNA, 15 nt, Human
uacacacacauacac

SEQ ID NO: 1821645 - RNA, 21 nt, Human
uacacacacacgcgugcacac

SEQ ID NO: 1821646 - RNA, 17 nt, Human
uacacacugcauguuug

SEQ ID NO: 1821647 - RNA, 17 nt, Human
uacacaaugguuuucuu

SEQ ID NO: 1821648 - RNA, 21 nt, Human
uacacaaugguuuucuugugu

SEQ ID NO: 1821649 - RNA, 23 nt, Human
uacacaaugguuuucuugugugu

SEQ ID NO: 1821650 - RNA, 20 nt, Human
uagcugggacuacaggcacc

SEQ ID NO: 1821651 - RNA, 12 nt, Human
uagcugggacua

SEQ ID NO: 1821652 - RNA, 18 nt, Human
uagcugggacuacaggug

SEQ ID NO: 1821653 - RNA, 22 nt, Human
uagcugggagaaagagagagcu

SEQ ID NO: 1821654 - RNA, 11 nt, Human
uagcugggacu

SEQ ID NO: 1821655 - RNA, 22 nt, Human
uagcucauucuccuuguguuac

SEQ ID NO: 1821656 - RNA, 17 nt, Human
uagccugccucuucucu

SEQ ID NO: 1821657 - RNA, 21 nt, Human
uagcucuaggagggcuggcaa

SEQ ID NO: 1821658 - RNA, 14 nt, Human
uagcccaaaaccaa

SEQ ID NO: 1821659 - RNA, 18 nt, Human
uagcccucacccuggggc

SEQ ID NO: 1821660 - RNA, 13 nt, Human
uagccccauaauu

SEQ ID NO: 1821661 - RNA, 15 nt, Human
uaggaagguuaaugu

SEQ ID NO: 1821662 - RNA, 14 nt, Human
uaggaauuguguuu

SEQ ID NO: 1821663 - RNA, 20 nt, Human
uaggaauugacccacaagaa

SEQ ID NO: 1821664 - RNA, 23 nt, Human
uaggaauugacccacaagaaaug

SEQ ID NO: 1821665 - RNA, 13 nt, Human
uaggccuggccag

SEQ ID NO: 1821666 - RNA, 14 nt, Human
uaggccuggccaga

SEQ ID NO: 1821667 - RNA, 19 nt, Human
uaggccucaggugaaacuc

SEQ ID NO: 1821668 - RNA, 17 nt, Human
uaggccguuccuucaaa

SEQ ID NO: 1821669 - RNA, 13 nt, Human
uaggccaugggac

SEQ ID NO: 1821670 - RNA, 17 nt, Human
uaggaacacuccuucac

SEQ ID NO: 1821671 - RNA, 21 nt, Human
uaggaacuuaaauaaugugaa

SEQ ID NO: 1821672 - RNA, 13 nt, Human
uaggaacacuccu

SEQ ID NO: 1821673 - RNA, 14 nt, Human
uaggaacacuccuu

SEQ ID NO: 1821674 - RNA, 13 nt, Human
uaggaagacuuug

SEQ ID NO: 1821675 - RNA, 14 nt, Human
uaggaagacuuugg

SEQ ID NO: 1821676 - RNA, 15 nt, Human
uaggaagacuuugga

SEQ ID NO: 1821677 - RNA, 16 nt, Human
uaggaagacuuuggaa

SEQ ID NO: 1821678 - RNA, 17 nt, Human
uaggaagacuuuggaaa

SEQ ID NO: 1821679 - RNA, 21 nt, Human
uagaaccucgagguuucucaa

SEQ ID NO: 1821680 - RNA, 12 nt, Human
uagaaccaggca

SEQ ID NO: 1821681 - RNA, 23 nt, Human
uagaaccaggcaacuugggaacu

SEQ ID NO: 1821682 - RNA, 16 nt, Human
uagagagagaccacuu

SEQ ID NO: 1821683 - RNA, 21 nt, Human
uagagguucaaagauauuuug

SEQ ID NO: 1821684 - RNA, 16 nt, Human
uagagguucaaagaua

SEQ ID NO: 1821685 - RNA, 19 nt, Human
uagagguucaaagauauuu

SEQ ID NO: 1821686 - RNA, 18 nt, Human
uagauaauacaccacuac

SEQ ID NO: 1821687 - RNA, 16 nt, Human
uagauguaauuuugug

SEQ ID NO: 1821688 - RNA, 12 nt, Human
uagauguauaua

SEQ ID NO: 1821689 - RNA, 23 nt, Human
uagcagagaaugaaagggcccag

SEQ ID NO: 1821690 - RNA, 19 nt, Human
uagcagagaaugaaagggc

SEQ ID NO: 1821691 - RNA, 16 nt, Human
uagcacuuugggaggc

SEQ ID NO: 1821692 - RNA, 20 nt, Human
uauaugcucugcauguuaca

SEQ ID NO: 1821693 - RNA, 13 nt, Human
uauauuuuaagac

SEQ ID NO: 1821694 - RNA, 14 nt, Human
uauauuuuaagacg

SEQ ID NO: 1821695 - RNA, 19 nt, Human
uaucgucacugcuuaacuu

SEQ ID NO: 1821696 - RNA, 15 nt, Human
uaucuaaauguugaa

SEQ ID NO: 1821697 - RNA, 21 nt, Human
uaucaugucaaacgugaaaau

SEQ ID NO: 1821698 - RNA, 17 nt, Human
uaucaugugaaaucauu

SEQ ID NO: 1821699 - RNA, 22 nt, Human
uaucaugugaaaucauucauuu

SEQ ID NO: 1821700 - RNA, 22 nt, Human
uauccugcuucugauaugcagu

SEQ ID NO: 1821701 - RNA, 16 nt, Human
uaucaugacaaagacu

SEQ ID NO: 1821702 - RNA, 16 nt, Human
uaucaugucaaacgug

SEQ ID NO: 1821703 - RNA, 17 nt, Human
uaucaugacaaagacug

SEQ ID NO: 1821704 - RNA, 17 nt, Human
uaucaggugcugccauc

SEQ ID NO: 1821705 - RNA, 19 nt, Human
uauauuuuuuguuaaauga

SEQ ID NO: 1821706 - RNA, 18 nt, Human
uaguggauggaaggggcu

SEQ ID NO: 1821707 - RNA, 15 nt, Human
uaguggauggaaggg

SEQ ID NO: 1821708 - RNA, 15 nt, Human
uaguggauguucuga

SEQ ID NO: 1821709 - RNA, 13 nt, Human
uaguuucuccaag

SEQ ID NO: 1821710 - RNA, 23 nt, Human
uaguuugauuaaauucuugcaaa

SEQ ID NO: 1821711 - RNA, 12 nt, Human
uaguuugcaguu

SEQ ID NO: 1821712 - RNA, 21 nt, Human
uaguuguaccgcaaugugacu

SEQ ID NO: 1821713 - RNA, 13 nt, Human
uagugaugguucc

SEQ ID NO: 1821714 - RNA, 14 nt, Human
uagugaugguuccc

SEQ ID NO: 1821715 - RNA, 18 nt, Human
uagugaugguuccccugu

SEQ ID NO: 1821716 - RNA, 20 nt, Human
uauacucuuauagacaacau

SEQ ID NO: 1821717 - RNA, 17 nt, Human
uauacccccugcaaagc

SEQ ID NO: 1821718 - RNA, 14 nt, Human
uauaauguaagcuc

SEQ ID NO: 1821719 - RNA, 19 nt, Human
uauaauguaagcucuacug

SEQ ID NO: 1821720 - RNA, 20 nt, Human
uauaauguaagcucuacuga

SEQ ID NO: 1821721 - RNA, 20 nt, Human
uauaauucacauuguauuca

SEQ ID NO: 1821722 - RNA, 17 nt, Human
uauaauucuacuuugag

SEQ ID NO: 1821723 - RNA, 20 nt, Human
uauaaugaaugaaacauuuu

SEQ ID NO: 1821724 - RNA, 18 nt, Human
uauaaugaaugaaacauu

SEQ ID NO: 1821725 - RNA, 21 nt, Human
uauaaauuuuuuuuguuucau

SEQ ID NO: 1821726 - RNA, 17 nt, Human
uauaaauuuuuuuuguu

SEQ ID NO: 1821727 - RNA, 19 nt, Human
ggcaacccccagccugcua

SEQ ID NO: 1821728 - RNA, 21 nt, Human
ggaucagucugauucccaagc

SEQ ID NO: 1821729 - RNA, 18 nt, Human
ggcaacugcauuggcuuu

SEQ ID NO: 1821730 - RNA, 18 nt, Human
ggcaacuugggaacuaga

SEQ ID NO: 1821731 - RNA, 23 nt, Human
ggcaacuugggaacuagacuccc

SEQ ID NO: 1821732 - RNA, 15 nt, Human
ggcaaggcugucaau

SEQ ID NO: 1821733 - RNA, 19 nt, Human
ggcaacugcauuggcuuug

SEQ ID NO: 1821734 - RNA, 20 nt, Human
ggcagagcagagaccauccc

SEQ ID NO: 1821735 - RNA, 15 nt, Human
ggcagagcagagacc

SEQ ID NO: 1821736 - RNA, 16 nt, Human
ggcagagcagagacca

SEQ ID NO: 1821737 - RNA, 16 nt, Human
ggcacccggccccugc

SEQ ID NO: 1821738 - RNA, 15 nt, Human
ggcacccggccccug

SEQ ID NO: 1821739 - RNA, 17 nt, Human
ggcacccggccccugcu

SEQ ID NO: 1821740 - RNA, 16 nt, Human
ggcaaggcugucaauu

SEQ ID NO: 1821741 - RNA, 23 nt, Human
ggcagauacaggaaaagcugcug

SEQ ID NO: 1821742 - RNA, 23 nt, Human
ggcagaguugaagacagagcuac

SEQ ID NO: 1821743 - RNA, 17 nt, Human
ggcagaggaaagcaaag

SEQ ID NO: 1821744 - RNA, 13 nt, Human
ggcagguccaggg

SEQ ID NO: 1821745 - RNA, 14 nt, Human
ggcaggaaggcuga

SEQ ID NO: 1821746 - RNA, 23 nt, Human
ggcaggucuugaacuccuggccu

SEQ ID NO: 1821747 - RNA, 19 nt, Human
ggcagcugcgguccaccca

SEQ ID NO: 1821748 - RNA, 21 nt, Human
ggcagcuugaggguugggcug

SEQ ID NO: 1821749 - RNA, 22 nt, Human
ggcagcucaccucucccuugga

SEQ ID NO: 1821750 - RNA, 18 nt, Human
ggcagcucaccucucccu

SEQ ID NO: 1821751 - RNA, 21 nt, Human
ggcagcucaccucucccuugg

SEQ ID NO: 1821752 - RNA, 23 nt, Human
ggcauguucucugaggacacuaa

SEQ ID NO: 1821753 - RNA, 15 nt, Human
ggcagguuggugggg

SEQ ID NO: 1821754 - RNA, 16 nt, Human
ggccaccugcggugcu

SEQ ID NO: 1821755 - RNA, 22 nt, Human
ggccaccugcggugcuaucucc

SEQ ID NO: 1821756 - RNA, 12 nt, Human
ggccaaguucuu

SEQ ID NO: 1821757 - RNA, 15 nt, Human
ggcauuccccaggag

SEQ ID NO: 1821758 - RNA, 16 nt, Human
ggccacaagacccuug

SEQ ID NO: 1821759 - RNA, 17 nt, Human
ggccacaagacccuugu

SEQ ID NO: 1821760 - RNA, 11 nt, Human
ggccaggcugg

SEQ ID NO: 1821761 - RNA, 18 nt, Human
ggccaggcugggucgccc

SEQ ID NO: 1821762 - RNA, 22 nt, Human
ggccaggcugggucgcccugga

SEQ ID NO: 1821763 - RNA, 16 nt, Human
ggccaggccagaggga

SEQ ID NO: 1821764 - RNA, 14 nt, Human
ggccaggccagagg

SEQ ID NO: 1821765 - RNA, 16 nt, Human
ggccaggagccuccug

SEQ ID NO: 1821766 - RNA, 16 nt, Human
ggccacugugaagaga

SEQ ID NO: 1821767 - RNA, 14 nt, Human
ggccaggagccucc

SEQ ID NO: 1821768 - RNA, 11 nt, Human
ggccacuguga

SEQ ID NO: 1821769 - RNA, 13 nt, Human
ggccaugggccuc

SEQ ID NO: 1821770 - RNA, 22 nt, Human
ggccaugggacagggaggacgc

SEQ ID NO: 1821771 - RNA, 12 nt, Human
ggccaggcuggu

SEQ ID NO: 1821772 - RNA, 12 nt, Human
ggccccugccac

SEQ ID NO: 1821773 - RNA, 16 nt, Human
ggccccugccacccug

SEQ ID NO: 1821774 - RNA, 13 nt, Human
ggccccugccacc

SEQ ID NO: 1821775 - RNA, 13 nt, Human
ggccccugcccgg

SEQ ID NO: 1821776 - RNA, 18 nt, Human
ggccccugccacccuggg

SEQ ID NO: 1821777 - RNA, 17 nt, Human
ggccccugccacccugg

SEQ ID NO: 1821778 - RNA, 16 nt, Human
ggccccucaggguccc

SEQ ID NO: 1821779 - RNA, 19 nt, Human
ggccccucagggucccugg

SEQ ID NO: 1821780 - RNA, 20 nt, Human
ggccccucagggucccuggu

SEQ ID NO: 1821781 - RNA, 21 nt, Human
ggccccucagggucccuggug

SEQ ID NO: 1821782 - RNA, 15 nt, Human
ggaggauguucuggg

SEQ ID NO: 1821783 - RNA, 23 nt, Human
ggaggaucacuugaguccagaag

SEQ ID NO: 1821784 - RNA, 17 nt, Human
ggaggaucucuugagcc

SEQ ID NO: 1821785 - RNA, 21 nt, Human
ggaggaucucuugagccuggg

SEQ ID NO: 1821786 - RNA, 12 nt, Human
ggagggcuccag

SEQ ID NO: 1821787 - RNA, 13 nt, Human
ggagggcuccaga

SEQ ID NO: 1821788 - RNA, 12 nt, Human
ggagggagggcu

SEQ ID NO: 1821789 - RNA, 19 nt, Human
ggaggacgcucucuggccu

SEQ ID NO: 1821790 - RNA, 21 nt, Human
ggaggacgcucucuggccuuc

SEQ ID NO: 1821791 - RNA, 20 nt, Human
ggaggacgcucucuggccuu

SEQ ID NO: 1821792 - RNA, 14 nt, Human
ggagugagcugguu

SEQ ID NO: 1821793 - RNA, 21 nt, Human
ggagugaguugauagcacaga

SEQ ID NO: 1821794 - RNA, 12 nt, Human
ggagugagcugg

SEQ ID NO: 1821795 - RNA, 21 nt, Human
ggagugacagaggcagcccca

SEQ ID NO: 1821796 - RNA, 19 nt, Human
ggagugacagaggcagccc

SEQ ID NO: 1821797 - RNA, 18 nt, Human
ggagugacagaggcagcc

SEQ ID NO: 1821798 - RNA, 17 nt, Human
ggagugacagaggcagc

SEQ ID NO: 1821799 - RNA, 16 nt, Human
ggaucacagccucuga

SEQ ID NO: 1821800 - RNA, 23 nt, Human
ggagugaguugauagcacagacc

SEQ ID NO: 1821801 - RNA, 17 nt, Human
ggagggcuccagacaca

SEQ ID NO: 1821802 - RNA, 14 nt, Human
ggagggcuccagac

SEQ ID NO: 1821803 - RNA, 15 nt, Human
ggagggcuccagaca

SEQ ID NO: 1821804 - RNA, 21 nt, Human
ggagucccaccuuggcugcag

SEQ ID NO: 1821805 - RNA, 20 nt, Human
ggagucccaccuuggcugca

SEQ ID NO: 1821806 - RNA, 16 nt, Human
ggagugacagaggcag

SEQ ID NO: 1821807 - RNA, 11 nt, Human
ggagugacaga

SEQ ID NO: 1821808 - RNA, 20 nt, Human
ggaagccagcaggcucucag

SEQ ID NO: 1821809 - RNA, 15 nt, Human
ggacuccucugucca

SEQ ID NO: 1821810 - RNA, 14 nt, Human
ggacuccucugucc

SEQ ID NO: 1821811 - RNA, 12 nt, Human
ggacuccucugu

SEQ ID NO: 1821812 - RNA, 13 nt, Human
ggacucuaaaguc

SEQ ID NO: 1821813 - RNA, 11 nt, Human
ggacucugccu

SEQ ID NO: 1821814 - RNA, 17 nt, Human
ggagagcuagcagcagg

SEQ ID NO: 1821815 - RNA, 21 nt, Human
ggagagcuagcagcagggagg

SEQ ID NO: 1821816 - RNA, 21 nt, Human
ggagaccccuuggggagcagg

SEQ ID NO: 1821817 - RNA, 21 nt, Human
ggacugccagucccccugccc

SEQ ID NO: 1821818 - RNA, 15 nt, Human
ggagaggggcacagg

SEQ ID NO: 1821819 - RNA, 20 nt, Human
ggagauuuacaacuggggga

SEQ ID NO: 1821820 - RNA, 13 nt, Human
ggagcccugggag

SEQ ID NO: 1821821 - RNA, 12 nt, Human
ggagcccuggga

SEQ ID NO: 1821822 - RNA, 20 nt, Human
ggagcaaaaucgaugcagug

SEQ ID NO: 1821823 - RNA, 23 nt, Human
ggaacuagacucccaagcuggac

SEQ ID NO: 1821824 - RNA, 20 nt, Human
ggaacagacuggaagcacag

SEQ ID NO: 1821825 - RNA, 19 nt, Human
ggaacagacuggaagcaca

SEQ ID NO: 1821826 - RNA, 15 nt, Human
ggaaaaucagccugc

SEQ ID NO: 1821827 - RNA, 14 nt, Human
ggaaaauaaauuau

SEQ ID NO: 1821828 - RNA, 17 nt, Human
ggaacagacuggaagca

SEQ ID NO: 1821829 - RNA, 17 nt, Human
ggaagcacagcuucauu

SEQ ID NO: 1821830 - RNA, 13 nt, Human
ggaagcacaugcc

SEQ ID NO: 1821831 - RNA, 14 nt, Human
ggaagcacaugccu

SEQ ID NO: 1821832 - RNA, 15 nt, Human
ggaagcacaugccuc

SEQ ID NO: 1821833 - RNA, 17 nt, Human
ggaagcacaugccucuc

SEQ ID NO: 1821834 - RNA, 13 nt, Human
ggaagagccuugc

SEQ ID NO: 1821835 - RNA, 13 nt, Human
ggaagcagcuuuc

SEQ ID NO: 1821836 - RNA, 23 nt, Human
ggaagcacaugccucucucaggc

SEQ ID NO: 1821837 - RNA, 21 nt, Human
ggaagcacaugccucucucag

SEQ ID NO: 1821838 - RNA, 22 nt, Human
ggaagcacaugccucucucagg

SEQ ID NO: 1821839 - RNA, 15 nt, Human
ggaagccagcaggcu

SEQ ID NO: 1821840 - RNA, 16 nt, Human
ggaagccagcaggcuc

SEQ ID NO: 1821841 - RNA, 17 nt, Human
ggaagccagcaggcucu

SEQ ID NO: 1821842 - RNA, 18 nt, Human
ggaagccagcaggcucuc

SEQ ID NO: 1821843 - RNA, 13 nt, Human
ggaagccagcagg

SEQ ID NO: 1821844 - RNA, 14 nt, Human
ggaagccagcaggc

SEQ ID NO: 1821845 - RNA, 20 nt, Human
ggaaaaaauaacaaugaaag

SEQ ID NO: 1821846 - RNA, 14 nt, Human
gcuuuuacuuaaac

SEQ ID NO: 1821847 - RNA, 15 nt, Human
gcuuugggcugcccu

SEQ ID NO: 1821848 - RNA, 16 nt, Human
gcuuugggcugcccug

SEQ ID NO: 1821849 - RNA, 22 nt, Human
ggaaaaccaagccguggcuucc

SEQ ID NO: 1821850 - RNA, 15 nt, Human
ggaaaaauagccugc

SEQ ID NO: 1821851 - RNA, 13 nt, Human
ggaaaaauagccu

SEQ ID NO: 1821852 - RNA, 19 nt, Human
ggaaaaaccacccccaaau

SEQ ID NO: 1821853 - RNA, 14 nt, Human
ggaaaaacugauuu

SEQ ID NO: 1821854 - RNA, 14 nt, Human
gcuuugggcugccc

SEQ ID NO: 1821855 - RNA, 22 nt, Human
gcuugcagagaugaggccgcca

SEQ ID NO: 1821856 - RNA, 16 nt, Human
gcuucuguugcugccu

SEQ ID NO: 1821857 - RNA, 14 nt, Human
gcuuggaggaagga

SEQ ID NO: 1821858 - RNA, 15 nt, Human
gcuuggaggaaggaa

SEQ ID NO: 1821859 - RNA, 13 nt, Human
gcuuggaggaagg

SEQ ID NO: 1821860 - RNA, 19 nt, Human
gcuugcccuggugccucac

SEQ ID NO: 1821861 - RNA, 17 nt, Human
gcuugcccuggugccuc

SEQ ID NO: 1821862 - RNA, 17 nt, Human
gcuucucacugccaugc

SEQ ID NO: 1821863 - RNA, 21 nt, Human
gcuuccagugaggcucugccc

SEQ ID NO: 1821864 - RNA, 19 nt, Human
gcuuccagugaggcucugc

SEQ ID NO: 1821865 - RNA, 20 nt, Human
gcuuccagugaggcucugcc

SEQ ID NO: 1821866 - RNA, 13 nt, Human
gcuguucagcugg

SEQ ID NO: 1821867 - RNA, 20 nt, Human
gcuggucccacucaguccau

SEQ ID NO: 1821868 - RNA, 18 nt, Human
gcuggugucaccugaaga

SEQ ID NO: 1821869 - RNA, 16 nt, Human
gcuggugucaccugaa

SEQ ID NO: 1821870 - RNA, 22 nt, Human
gcugguucaggguuggccccug

SEQ ID NO: 1821871 - RNA, 14 nt, Human
gcugucaaggcuca

SEQ ID NO: 1821872 - RNA, 16 nt, Human
gcugucaauuacagga

SEQ ID NO: 1821873 - RNA, 15 nt, Human
gcugguucaggguug

SEQ ID NO: 1821874 - RNA, 21 nt, Human
gcugguuagagguucccuuug

SEQ ID NO: 1821875 - RNA, 23 nt, Human
gcugucuguuguauucauugugg

SEQ ID NO: 1821876 - RNA, 17 nt, Human
gcugucuccauguuuga

SEQ ID NO: 1821877 - RNA, 19 nt, Human
gcugucccuuacgugaguc

SEQ ID NO: 1821878 - RNA, 22 nt, Human
gcugucccuuacgugaguccug

SEQ ID NO: 1821879 - RNA, 21 nt, Human
gcugucccuuacgugaguccu

SEQ ID NO: 1821880 - RNA, 17 nt, Human
gcugucaauuacaggaa

SEQ ID NO: 1821881 - RNA, 19 nt, Human
gcugucaauuacaggaagu

SEQ ID NO: 1821882 - RNA, 22 nt, Human
gcugucaauuacaggaaguacu

SEQ ID NO: 1821883 - RNA, 23 nt, Human
gcugucaauuacaggaaguacug

SEQ ID NO: 1821884 - RNA, 17 nt, Human
gcugggcuucaguggca

SEQ ID NO: 1821885 - RNA, 21 nt, Human
gcugggauuacaggcuccugc

SEQ ID NO: 1821886 - RNA, 17 nt, Human
gcugggauuacaggcgu

SEQ ID NO: 1821887 - RNA, 18 nt, Human
gcugggauuacaggcgug

SEQ ID NO: 1821888 - RNA, 19 nt, Human
gcugggauuacaggcuccu

SEQ ID NO: 1821889 - RNA, 20 nt, Human
gcugggauuacaggcuccug

SEQ ID NO: 1821890 - RNA, 16 nt, Human
gcugggagcucugcag

SEQ ID NO: 1821891 - RNA, 15 nt, Human
gcugggagcucugca

SEQ ID NO: 1821892 - RNA, 21 nt, Human
gcugggaugauuggagggggg

SEQ ID NO: 1821893 - RNA, 19 nt, Human
gcugggagagccuuccagg

SEQ ID NO: 1821894 - RNA, 22 nt, Human
gcugggagagccuuccaggggu

SEQ ID NO: 1821895 - RNA, 12 nt, Human
gcugggagagcc

SEQ ID NO: 1821896 - RNA, 13 nt, Human
gcugggagagccu

SEQ ID NO: 1821897 - RNA, 17 nt, Human
gcugggagagccuucca

SEQ ID NO: 1821898 - RNA, 18 nt, Human
gcugggagagccuuccag

SEQ ID NO: 1821899 - RNA, 20 nt, Human
gcugggggccucagugccac

SEQ ID NO: 1821900 - RNA, 19 nt, Human
gcugggggccucagugcca

SEQ ID NO: 1821901 - RNA, 19 nt, Human
gcuggucccacucagucca

SEQ ID NO: 1821902 - RNA, 15 nt, Human
gcuggucccacucag

SEQ ID NO: 1821903 - RNA, 13 nt, Human
gcugggggccuca

SEQ ID NO: 1821904 - RNA, 19 nt, Human
gcugggcuucaguggcagc

SEQ ID NO: 1821905 - RNA, 18 nt, Human
gcugggcuucaguggcag

SEQ ID NO: 1821906 - RNA, 16 nt, Human
gcuggggccaggcugg

SEQ ID NO: 1821907 - RNA, 19 nt, Human
gcuggggccaggcuggguc

SEQ ID NO: 1821908 - RNA, 12 nt, Human
gcuggggccagu

SEQ ID NO: 1821909 - RNA, 23 nt, Human
gcugggggaagaagcucucuccu

SEQ ID NO: 1821910 - RNA, 17 nt, Human
gcugcccuuucugggca

SEQ ID NO: 1821911 - RNA, 23 nt, Human
gcugcccuggugcugccacacuu

SEQ ID NO: 1821912 - RNA, 12 nt, Human
gcugcccuguga

SEQ ID NO: 1821913 - RNA, 14 nt, Human
gcugcccugugagu

SEQ ID NO: 1821914 - RNA, 20 nt, Human
gcugcccuggugcugccaca

SEQ ID NO: 1821915 - RNA, 22 nt, Human
gcugcccuggugcugccacacu

SEQ ID NO: 1821916 - RNA, 11 nt, Human
gcugcccugug

SEQ ID NO: 1821917 - RNA, 18 nt, Human
gcugcccuggugcugcca

SEQ ID NO: 1821918 - RNA, 19 nt, Human
gcugcccuggugcugccac

SEQ ID NO: 1821919 - RNA, 22 nt, Human
gcuagcagcagggagggcuucu

SEQ ID NO: 1821920 - RNA, 18 nt, Human
gcugcgguccacccagga

SEQ ID NO: 1821921 - RNA, 17 nt, Human
gcugcgguccacccagg

SEQ ID NO: 1821922 - RNA, 19 nt, Human
gcugcgguccacccaggag

SEQ ID NO: 1821923 - RNA, 13 nt, Human
gcugcuucaagga

SEQ ID NO: 1821924 - RNA, 23 nt, Human
gcugcuucaaggauccugagcca

SEQ ID NO: 1821925 - RNA, 21 nt, Human
gcugcuucaaggauccugagc

SEQ ID NO: 1821926 - RNA, 22 nt, Human
gcugcuucaaggauccugagcc

SEQ ID NO: 1821927 - RNA, 16 nt, Human
gcugcuugggcuucau

SEQ ID NO: 1821928 - RNA, 22 nt, Human
gcuggaccuugaacuggguacu

SEQ ID NO: 1821929 - RNA, 21 nt, Human
gcuggaccuugaacuggguac

SEQ ID NO: 1821930 - RNA, 18 nt, Human
gcuggaccuugaacuggg

SEQ ID NO: 1821931 - RNA, 17 nt, Human
gcugcuugggcuucauc

SEQ ID NO: 1821932 - RNA, 22 nt, Human
gcugcuugggcuucauccuccu

SEQ ID NO: 1821933 - RNA, 16 nt, Human
gcuggauuacaggcau

SEQ ID NO: 1821934 - RNA, 20 nt, Human
gcugggacuacaggcaccca

SEQ ID NO: 1821935 - RNA, 19 nt, Human
gcugggacuacaggcaccc

SEQ ID NO: 1821936 - RNA, 18 nt, Human
gcugggacuacaggcacc

SEQ ID NO: 1821937 - RNA, 13 nt, Human
gcugggacuacag

SEQ ID NO: 1821938 - RNA, 19 nt, Human
gcugggacuacagguguga

SEQ ID NO: 1821939 - RNA, 12 nt, Human
gcuggcccugcc

SEQ ID NO: 1821940 - RNA, 13 nt, Human
gcuggccgggacc

SEQ ID NO: 1821941 - RNA, 13 nt, Human
gcuggcccugccc

SEQ ID NO: 1821942 - RNA, 17 nt, Human
gcuggccgggagccuga

SEQ ID NO: 1821943 - RNA, 20 nt, Human
gcugggacaugggaaagggg

SEQ ID NO: 1821944 - RNA, 16 nt, Human
gggacucaaugcacug

SEQ ID NO: 1821945 - RNA, 17 nt, Human
gggacuacaggcaccca

SEQ ID NO: 1821946 - RNA, 12 nt, Human
gggaccucaggc

SEQ ID NO: 1821947 - RNA, 13 nt, Human
gggaccucaggcc

SEQ ID NO: 1821948 - RNA, 15 nt, Human
gggaccucaggccug

SEQ ID NO: 1821949 - RNA, 23 nt, Human
gggacaaggacuaggguccuggg

SEQ ID NO: 1821950 - RNA, 17 nt, Human
gggaauuucuucaacuc

SEQ ID NO: 1821951 - RNA, 18 nt, Human
gggaccccgagccuggcu

SEQ ID NO: 1821952 - RNA, 20 nt, Human
gggaccccgagccuggcucc

SEQ ID NO: 1821953 - RNA, 14 nt, Human
gggaccccugagcu

SEQ ID NO: 1821954 - RNA, 22 nt, Human
gggaaggcagggagggccuggg

SEQ ID NO: 1821955 - RNA, 23 nt, Human
gggaaggauacaaaagcauguga

SEQ ID NO: 1821956 - RNA, 21 nt, Human
gggaaggauacaaaagcaugu

SEQ ID NO: 1821957 - RNA, 14 nt, Human
ggcuuuugugcauu

SEQ ID NO: 1821958 - RNA, 17 nt, Human
gggaagggggcugggac

SEQ ID NO: 1821959 - RNA, 14 nt, Human
gggaagggggcugg

SEQ ID NO: 1821960 - RNA, 16 nt, Human
gggaagggggcuggga

SEQ ID NO: 1821961 - RNA, 22 nt, Human
ggcuugaguuuaaauuguaaua

SEQ ID NO: 1821962 - RNA, 21 nt, Human
ggcuuggggaccagagcugcc

SEQ ID NO: 1821963 - RNA, 19 nt, Human
ggcuuuucacugcuggcug

SEQ ID NO: 1821964 - RNA, 22 nt, Human
ggcuuuucacugcuggcugccu

SEQ ID NO: 1821965 - RNA, 10 nt, Human
ggcuuuugug

SEQ ID NO: 1821966 - RNA, 14 nt, Human
ggcuuuucacugcu

SEQ ID NO: 1821967 - RNA, 15 nt, Human
ggcuuuucacugcug

SEQ ID NO: 1821968 - RNA, 17 nt, Human
ggcuuuucacugcuggc

SEQ ID NO: 1821969 - RNA, 12 nt, Human
ggcugggcuuca

SEQ ID NO: 1821970 - RNA, 18 nt, Human
ggcugggcucccuuccca

SEQ ID NO: 1821971 - RNA, 17 nt, Human
ggcugggcucccuuccc

SEQ ID NO: 1821972 - RNA, 17 nt, Human
ggcugggcuucaguggc

SEQ ID NO: 1821973 - RNA, 13 nt, Human
ggcugggcuucag

SEQ ID NO: 1821974 - RNA, 18 nt, Human
ggcugggcuucaguggca

SEQ ID NO: 1821975 - RNA, 21 nt, Human
ggcuuagucacugagacagcc

SEQ ID NO: 1821976 - RNA, 18 nt, Human
ggcugcaaaggguaucag

SEQ ID NO: 1821977 - RNA, 23 nt, Human
ggcugcaaaggguaucaggugcu

SEQ ID NO: 1821978 - RNA, 22 nt, Human
ggcugcaaaggguaucaggugc

SEQ ID NO: 1821979 - RNA, 24 nt, Human
ggcugcaaaggguaucaggugcug

SEQ ID NO: 1821980 - RNA, 17 nt, Human
ggcugcaccggcuggcc

SEQ ID NO: 1821981 - RNA, 18 nt, Human
ggcugcaccggcuggccu

SEQ ID NO: 1821982 - RNA, 19 nt, Human
ggcugcaccggcuggccug

SEQ ID NO: 1821983 - RNA, 13 nt, Human
ggcugagguggga

SEQ ID NO: 1821984 - RNA, 15 nt, Human
ggcugaggugggagg

SEQ ID NO: 1821985 - RNA, 17 nt, Human
ggccccugcccggcugc

SEQ ID NO: 1821986 - RNA, 16 nt, Human
ggccccugcccggcug

SEQ ID NO: 1821987 - RNA, 20 nt, Human
ggccccugcccggcugcgga

SEQ ID NO: 1821988 - RNA, 17 nt, Human
ggcucugccucccauca

SEQ ID NO: 1821989 - RNA, 13 nt, Human
ggcucuggagccc

SEQ ID NO: 1821990 - RNA, 14 nt, Human
ggcucuggagccca

SEQ ID NO: 1821991 - RNA, 13 nt, Human
ggcugcagggagu

SEQ ID NO: 1821992 - RNA, 14 nt, Human
ggcugcugaaggcu

SEQ ID NO: 1821993 - RNA, 12 nt, Human
ggcugcagggag

SEQ ID NO: 1821994 - RNA, 18 nt, Human
ggcugcugaaggcucgag

SEQ ID NO: 1821995 - RNA, 15 nt, Human
ggcugcugaaggcuc

SEQ ID NO: 1821996 - RNA, 17 nt, Human
ggcugcugaaggcucga

SEQ ID NO: 1821997 - RNA, 11 nt, Human
ggcugcuucaa

SEQ ID NO: 1821998 - RNA, 12 nt, Human
ggcugcuucaag

SEQ ID NO: 1821999 - RNA, 14 nt, Human
ggcugcuucaagga

SEQ ID NO: 1822000 - RNA, 22 nt, Human
ggcugcuucaaggauccugagc

SEQ ID NO: 1822001 - RNA, 15 nt, Human
ggcugggcagaggaa

SEQ ID NO: 1822002 - RNA, 19 nt, Human
ggcugggcagaggaaagca

SEQ ID NO: 1822003 - RNA, 13 nt, Human
ggcugggcagagg

SEQ ID NO: 1822004 - RNA, 14 nt, Human
ggcugggcagagga

SEQ ID NO: 1822005 - RNA, 20 nt, Human
ggcugggagagccuuccagg

SEQ ID NO: 1822006 - RNA, 23 nt, Human
ggcugggagagccuuccaggggu

SEQ ID NO: 1822007 - RNA, 19 nt, Human
ggcugggagagccuuccag

SEQ ID NO: 1822008 - RNA, 23 nt, Human
ggcugcuucaaggauccugagcc

SEQ ID NO: 1822009 - RNA, 23 nt, Human
gggcacaccgggcacucagaaga

SEQ ID NO: 1822010 - RNA, 18 nt, Human
gggcacagaaaauggaag

SEQ ID NO: 1822011 - RNA, 20 nt, Human
gggcacagaaaauggaagac

SEQ ID NO: 1822012 - RNA, 21 nt, Human
gggcacagaaaauggaagaca

SEQ ID NO: 1822013 - RNA, 19 nt, Human
gggcacucagaagacacug

SEQ ID NO: 1822014 - RNA, 16 nt, Human
gggcacucagaagaca

SEQ ID NO: 1822015 - RNA, 14 nt, Human
gggcaccggggccu

SEQ ID NO: 1822016 - RNA, 13 nt, Human
gggcacagggucu

SEQ ID NO: 1822017 - RNA, 16 nt, Human
gggcacagggucucua

SEQ ID NO: 1822018 - RNA, 20 nt, Human
gggcacucagaagacacuga

SEQ ID NO: 1822019 - RNA, 13 nt, Human
gggcacugguggc

SEQ ID NO: 1822020 - RNA, 16 nt, Human
gggcacugguggcccg

SEQ ID NO: 1822021 - RNA, 14 nt, Human
gggcagaaggaaga

SEQ ID NO: 1822022 - RNA, 18 nt, Human
gggcagaaggaagacuuc

SEQ ID NO: 1822023 - RNA, 11 nt, Human
gggcagagcag

SEQ ID NO: 1822024 - RNA, 12 nt, Human
gggcagagcaga

SEQ ID NO: 1822025 - RNA, 17 nt, Human
gggcagguugguggggg

SEQ ID NO: 1822026 - RNA, 14 nt, Human
gggagugagcuggu

SEQ ID NO: 1822027 - RNA, 11 nt, Human
gggagugagcu

SEQ ID NO: 1822028 - RNA, 18 nt, Human
gggagugacagaggcagc

SEQ ID NO: 1822029 - RNA, 16 nt, Human
gggaggugaccccagg

SEQ ID NO: 1822030 - RNA, 17 nt, Human
gggaggugggauccucc

SEQ ID NO: 1822031 - RNA, 13 nt, Human
gggacugagaaau

SEQ ID NO: 1822032 - RNA, 13 nt, Human
gggauagagagag

SEQ ID NO: 1822033 - RNA, 21 nt, Human
gggauaugauuuaaaucagcc

SEQ ID NO: 1822034 - RNA, 15 nt, Human
gggauccuccaggug

SEQ ID NO: 1822035 - RNA, 16 nt, Human
gggauccuccaggugc

SEQ ID NO: 1822036 - RNA, 23 nt, Human
gggauccuggaguucugguuccu

SEQ ID NO: 1822037 - RNA, 18 nt, Human
gggcaacccuggugacca

SEQ ID NO: 1822038 - RNA, 20 nt, Human
gggcaacccccagccugcua

SEQ ID NO: 1822039 - RNA, 17 nt, Human
gggcccagagagggugg

SEQ ID NO: 1822040 - RNA, 16 nt, Human
gggccacagagaaagu

SEQ ID NO: 1822041 - RNA, 23 nt, Human
gggccacagagaaaguacuucuc

SEQ ID NO: 1822042 - RNA, 12 nt, Human
gggcaugacacg

SEQ ID NO: 1822043 - RNA, 15 nt, Human
gggcauggccaggug

SEQ ID NO: 1822044 - RNA, 17 nt, Human
gggcauggccagguggc

SEQ ID NO: 1822045 - RNA, 20 nt, Human
gggcauggccagguggccac

SEQ ID NO: 1822046 - RNA, 19 nt, Human
gggccuggccugagcuggg

SEQ ID NO: 1822047 - RNA, 14 nt, Human
gggccuggccugag

SEQ ID NO: 1822048 - RNA, 18 nt, Human
gggccuggccugagcugg

SEQ ID NO: 1822049 - RNA, 17 nt, Human
gggccuggcucaggugg

SEQ ID NO: 1822050 - RNA, 13 nt, Human
gggccuggcuccc

SEQ ID NO: 1822051 - RNA, 22 nt, Human
gggccccugccucucugcaggu

SEQ ID NO: 1822052 - RNA, 13 nt, Human
gggcccugccucc

SEQ ID NO: 1822053 - RNA, 13 nt, Human
gggccuggccuga

SEQ ID NO: 1822054 - RNA, 14 nt, Human
gggccccagaggcu

SEQ ID NO: 1822055 - RNA, 13 nt, Human
gggccccugccuc

SEQ ID NO: 1822056 - RNA, 15 nt, Human
gggccccugccucuc

SEQ ID NO: 1822057 - RNA, 17 nt, Human
gggccccugccucucug

SEQ ID NO: 1822058 - RNA, 18 nt, Human
gggccccugccucucugc

SEQ ID NO: 1822059 - RNA, 19 nt, Human
gggccccugccucucugca

SEQ ID NO: 1822060 - RNA, 21 nt, Human
gggccccugccucucugcagg

SEQ ID NO: 1822061 - RNA, 14 nt, Human
gggucucacucugu

SEQ ID NO: 1822062 - RNA, 17 nt, Human
ggguaagugagagaggg

SEQ ID NO: 1822063 - RNA, 21 nt, Human
gggucugaggaauccagaccc

SEQ ID NO: 1822064 - RNA, 12 nt, Human
gggucugaggaa

SEQ ID NO: 1822065 - RNA, 12 nt, Human
gggguggccucc

SEQ ID NO: 1822066 - RNA, 18 nt, Human
ggggugcugggccccugc

SEQ ID NO: 1822067 - RNA, 20 nt, Human
gggguggggggggugcuggg

SEQ ID NO: 1822068 - RNA, 17 nt, Human
gggguggggaccucagg

SEQ ID NO: 1822069 - RNA, 22 nt, Human
gggggaggugggauccuccagg

SEQ ID NO: 1822070 - RNA, 23 nt, Human
ggggcugcaccggcuggccuggc

SEQ ID NO: 1822071 - RNA, 19 nt, Human
ggggcugaggugggaggau

SEQ ID NO: 1822072 - RNA, 12 nt, Human
ggggcugcaccg

SEQ ID NO: 1822073 - RNA, 21 nt, Human
ggggcugcaccggcuggccug

SEQ ID NO: 1822074 - RNA, 22 nt, Human
ggggcugcaccggcuggccugg

SEQ ID NO: 1822075 - RNA, 18 nt, Human
ggggaggggcugugggcg

SEQ ID NO: 1822076 - RNA, 21 nt, Human
ggggaaaaucagccugcucca

SEQ ID NO: 1822077 - RNA, 24 nt, Human
ggggaaaaucagccugcuccagcu

SEQ ID NO: 1822078 - RNA, 11 nt, Human
gggccugggcc

SEQ ID NO: 1822079 - RNA, 16 nt, Human
ggggaaaaucagccug

SEQ ID NO: 1822080 - RNA, 17 nt, Human
ggggaaaaucagccugc

SEQ ID NO: 1822081 - RNA, 19 nt, Human
ggggaaaaucagccugcuc

SEQ ID NO: 1822082 - RNA, 17 nt, Human
ggggcugaggugggagg

SEQ ID NO: 1822083 - RNA, 16 nt, Human
ggggcaacccugguga

SEQ ID NO: 1822084 - RNA, 19 nt, Human
ggguucuuucuuccucugc

SEQ ID NO: 1822085 - RNA, 17 nt, Human
ggguucuuucuuccucu

SEQ ID NO: 1822086 - RNA, 16 nt, Human
ggguucuuucuuccuc

SEQ ID NO: 1822087 - RNA, 20 nt, Human
ggguuccuuccucugagccu

SEQ ID NO: 1822088 - RNA, 21 nt, Human
ggguuccuuccucugagccuu

SEQ ID NO: 1822089 - RNA, 12 nt, Human
ggguucuaccca

SEQ ID NO: 1822090 - RNA, 19 nt, Human
ggguuccuuccucugagcc

SEQ ID NO: 1822091 - RNA, 23 nt, Human
ggguucaagcgauucuucugcuu

SEQ ID NO: 1822092 - RNA, 22 nt, Human
ggguucaagcgauucuucugcu

SEQ ID NO: 1822093 - RNA, 18 nt, Human
gggugcugggccccugcc

SEQ ID NO: 1822094 - RNA, 17 nt, Human
gggugcugggccccugc

SEQ ID NO: 1822095 - RNA, 17 nt, Human
gggugaagugaagacaa

SEQ ID NO: 1822096 - RNA, 19 nt, Human
gggugacagagcaagugag

SEQ ID NO: 1822097 - RNA, 11 nt, Human
ggucagagccu

SEQ ID NO: 1822098 - RNA, 15 nt, Human
ggucccaccccacac

SEQ ID NO: 1822099 - RNA, 16 nt, Human
ggucccaccccacaca

SEQ ID NO: 1822100 - RNA, 16 nt, Human
ggucacaggacucugc

SEQ ID NO: 1822101 - RNA, 18 nt, Human
ggucacaggacucugccu

SEQ ID NO: 1822102 - RNA, 12 nt, Human
ggucacucuggc

SEQ ID NO: 1822103 - RNA, 17 nt, Human
gguacuuguggacacag

SEQ ID NO: 1822104 - RNA, 16 nt, Human
gguacuuguggacaca

SEQ ID NO: 1822105 - RNA, 20 nt, Human
gguacuuguggacacagcuc

SEQ ID NO: 1822106 - RNA, 22 nt, Human
gguagaaauaucugaaaaugua

SEQ ID NO: 1822107 - RNA, 13 nt, Human
gguacccacugcu

SEQ ID NO: 1822108 - RNA, 16 nt, Human
gguacccacugcucug

SEQ ID NO: 1822109 - RNA, 11 nt, Human
gguacccacug

SEQ ID NO: 1822110 - RNA, 23 nt, Human
gguagaaauaucugaaaauguau

SEQ ID NO: 1822111 - RNA, 22 nt, Human
gguagaagcccuucuaccuucc

SEQ ID NO: 1822112 - RNA, 18 nt, Human
gguucuuucauuugcuuu

SEQ ID NO: 1822113 - RNA, 13 nt, Human
gguugagguuuca

SEQ ID NO: 1822114 - RNA, 14 nt, Human
gguucuuucuuccu

SEQ ID NO: 1822115 - RNA, 16 nt, Human
gguucuuucuuccucu

SEQ ID NO: 1822116 - RNA, 21 nt, Human
gguucaaagauauuuugcuuu

SEQ ID NO: 1822117 - RNA, 23 nt, Human
gguuauuuugauguaaagauguu

SEQ ID NO: 1822118 - RNA, 13 nt, Human
gguucaaagauau

SEQ ID NO: 1822119 - RNA, 21 nt, Human
gguuacccaguuagcucucaa

SEQ ID NO: 1822120 - RNA, 17 nt, Human
gguuaggcauuguggga

SEQ ID NO: 1822121 - RNA, 21 nt, Human
gguuaguggauggaaggggcu

SEQ ID NO: 1822122 - RNA, 22 nt, Human
gguuaguggauggaaggggcug

SEQ ID NO: 1822123 - RNA, 13 nt, Human
gguuauggagagg

SEQ ID NO: 1822124 - RNA, 17 nt, Human
ggugucaagagggucug

SEQ ID NO: 1822125 - RNA, 19 nt, Human
ggugucaagagggucugag

SEQ ID NO: 1822126 - RNA, 19 nt, Human
ggugucaccugaagacuca

SEQ ID NO: 1822127 - RNA, 18 nt, Human
ggugguuucagaaaugug

SEQ ID NO: 1822128 - RNA, 17 nt, Human
ggugguuucagaaaugu

SEQ ID NO: 1822129 - RNA, 21 nt, Human
ggugguuauggagaggguguc

SEQ ID NO: 1822130 - RNA, 18 nt, Human
ggugguuuucuguucuuu

SEQ ID NO: 1822131 - RNA, 15 nt, Human
ggugguuuucuguuc

SEQ ID NO: 1822132 - RNA, 15 nt, Human
gguggugaccucugc

SEQ ID NO: 1822133 - RNA, 14 nt, Human
gguggugaccucug

SEQ ID NO: 1822134 - RNA, 16 nt, Human
gguggugaccucugcc

SEQ ID NO: 1822135 - RNA, 16 nt, Human
ggugagaggggaacag

SEQ ID NO: 1822136 - RNA, 15 nt, Human
ggugagaagcagagg

SEQ ID NO: 1822137 - RNA, 15 nt, Human
ggugcgaucuggguu

SEQ ID NO: 1822138 - RNA, 16 nt, Human
ggugcuaucuccccca

SEQ ID NO: 1822139 - RNA, 17 nt, Human
ggugcuaucucccccag

SEQ ID NO: 1822140 - RNA, 19 nt, Human
ggugcuaucucccccagcc

SEQ ID NO: 1822141 - RNA, 20 nt, Human
ggugcuaucucccccagccc

SEQ ID NO: 1822142 - RNA, 22 nt, Human
gguggcagugggagcugccugu

SEQ ID NO: 1822143 - RNA, 19 nt, Human
gguggcagugggagcugcc

SEQ ID NO: 1822144 - RNA, 21 nt, Human
ggugcugccauccagguucag

SEQ ID NO: 1822145 - RNA, 15 nt, Human
ggugcugccauccag

SEQ ID NO: 1822146 - RNA, 21 nt, Human
ggugcuaucucccccagcccc

SEQ ID NO: 1822147 - RNA, 23 nt, Human
gguggccucccaacucaccccag

SEQ ID NO: 1822148 - RNA, 20 nt, Human
gguggccacuccagaccccu

SEQ ID NO: 1822149 - RNA, 21 nt, Human
gguggccacuccagaccccug

SEQ ID NO: 1822150 - RNA, 22 nt, Human
gguggccacuccagaccccugg

SEQ ID NO: 1822151 - RNA, 23 nt, Human
gguggccacuccagaccccuggc

SEQ ID NO: 1822152 - RNA, 22 nt, Human
gguggccucccaacucacccca

SEQ ID NO: 1822153 - RNA, 22 nt, Human
ggugaccagcaccaucucuccu

SEQ ID NO: 1822154 - RNA, 14 nt, Human
ggucugacccacug

SEQ ID NO: 1822155 - RNA, 23 nt, Human
ggucucacucugucgcccagucu

SEQ ID NO: 1822156 - RNA, 22 nt, Human
ggucucacucugucgcccaguc

SEQ ID NO: 1822157 - RNA, 21 nt, Human
ggucucacuauguugcccagg

SEQ ID NO: 1822158 - RNA, 17 nt, Human
ggucucaaacuccugac

SEQ ID NO: 1822159 - RNA, 17 nt, Human
ggucccaccccacacac

SEQ ID NO: 1822160 - RNA, 14 nt, Human
ggucccaccccaca

SEQ ID NO: 1822161 - RNA, 19 nt, Human
gccuucggccuccauccug

SEQ ID NO: 1822162 - RNA, 13 nt, Human
gccuucagcucua

SEQ ID NO: 1822163 - RNA, 16 nt, Human
gccuucagcucuacag

SEQ ID NO: 1822164 - RNA, 18 nt, Human
gccuucggccuccauccu

SEQ ID NO: 1822165 - RNA, 17 nt, Human
gccugguggcagcugcg

SEQ ID NO: 1822166 - RNA, 16 nt, Human
gccugguggcagcugc

SEQ ID NO: 1822167 - RNA, 18 nt, Human
gccuguaaucacagcuac

SEQ ID NO: 1822168 - RNA, 15 nt, Human
gccugguggcagcug

SEQ ID NO: 1822169 - RNA, 21 nt, Human
gccuuauggaacacucugaga

SEQ ID NO: 1822170 - RNA, 22 nt, Human
gccuuauggaacacucugagac

SEQ ID NO: 1822171 - RNA, 23 nt, Human
gccuuauggaacacucugagacu

SEQ ID NO: 1822172 - RNA, 20 nt, Human
gccuuagaagucacacagua

SEQ ID NO: 1822173 - RNA, 17 nt, Human
gccuuagaaccuuucuu

SEQ ID NO: 1822174 - RNA, 16 nt, Human
gccuuagaaccuuucu

SEQ ID NO: 1822175 - RNA, 19 nt, Human
gccuuacccucauguucuu

SEQ ID NO: 1822176 - RNA, 21 nt, Human
gcuagacgagcaggcuucuuc

SEQ ID NO: 1822177 - RNA, 22 nt, Human
gcuagacgagcaggcuucuucc

SEQ ID NO: 1822178 - RNA, 15 nt, Human
gcgugagccacugca

SEQ ID NO: 1822179 - RNA, 16 nt, Human
gcgugagccacugcac

SEQ ID NO: 1822180 - RNA, 16 nt, Human
gcgugagaccugcccc

SEQ ID NO: 1822181 - RNA, 14 nt, Human
gcgugagccacugc

SEQ ID NO: 1822182 - RNA, 17 nt, Human
gcuaacauggaaguacu

SEQ ID NO: 1822183 - RNA, 18 nt, Human
gcuaacauggaaguacua

SEQ ID NO: 1822184 - RNA, 14 nt, Human
gcuaacauggaagu

SEQ ID NO: 1822185 - RNA, 22 nt, Human
gcuacacaggggaaaagaggag

SEQ ID NO: 1822186 - RNA, 23 nt, Human
gcgguccacccaggagccccgag

SEQ ID NO: 1822187 - RNA, 23 nt, Human
gcggggacagcuccuucuguccu

SEQ ID NO: 1822188 - RNA, 19 nt, Human
gcggggacagcuccuucug

SEQ ID NO: 1822189 - RNA, 23 nt, Human
gcggacagccacggccaggccag

SEQ ID NO: 1822190 - RNA, 19 nt, Human
gcggacagccacggccagg

SEQ ID NO: 1822191 - RNA, 16 nt, Human
gcggacagccacggcc

SEQ ID NO: 1822192 - RNA, 19 nt, Human
gcggaaugaaccacaucuu

SEQ ID NO: 1822193 - RNA, 17 nt, Human
gcgcugccccuggcagc

SEQ ID NO: 1822194 - RNA, 19 nt, Human
gcgcuggccgggaccccga

SEQ ID NO: 1822195 - RNA, 14 nt, Human
gcgcugccccuggc

SEQ ID NO: 1822196 - RNA, 21 nt, Human
gcgccuacaggagugagcacu

SEQ ID NO: 1822197 - RNA, 20 nt, Human
gcgccuacaggagugagcac

SEQ ID NO: 1822198 - RNA, 15 nt, Human
gccucugacacacag

SEQ ID NO: 1822199 - RNA, 16 nt, Human
gccucugacacacagc

SEQ ID NO: 1822200 - RNA, 16 nt, Human
gccucugcacuccccu

SEQ ID NO: 1822201 - RNA, 17 nt, Human
gccucugcacuccccug

SEQ ID NO: 1822202 - RNA, 18 nt, Human
gccucugcacuccccugc

SEQ ID NO: 1822203 - RNA, 19 nt, Human
gccucugcacuccccugcu

SEQ ID NO: 1822204 - RNA, 20 nt, Human
gccucugcacuccccugcug

SEQ ID NO: 1822205 - RNA, 15 nt, Human
gccugaagucacaca

SEQ ID NO: 1822206 - RNA, 15 nt, Human
gccucugcauucagg

SEQ ID NO: 1822207 - RNA, 12 nt, Human
gccucugcauuc

SEQ ID NO: 1822208 - RNA, 21 nt, Human
gccucugcacuccccugcugg

SEQ ID NO: 1822209 - RNA, 12 nt, Human
gccugcccaggc

SEQ ID NO: 1822210 - RNA, 11 nt, Human
gccugcccagg

SEQ ID NO: 1822211 - RNA, 14 nt, Human
gccuggacccugug

SEQ ID NO: 1822212 - RNA, 20 nt, Human
gccucccgaauagcugggac

SEQ ID NO: 1822213 - RNA, 23 nt, Human
gccucccgaguagcugggacuac

SEQ ID NO: 1822214 - RNA, 21 nt, Human
gccucccgaguagcugggacu

SEQ ID NO: 1822215 - RNA, 19 nt, Human
gccucccgaauagcuggga

SEQ ID NO: 1822216 - RNA, 18 nt, Human
gccucccgaauagcuggg

SEQ ID NO: 1822217 - RNA, 22 nt, Human
gccucagccucccaaagugcug

SEQ ID NO: 1822218 - RNA, 14 nt, Human
gccucagccuccca

SEQ ID NO: 1822219 - RNA, 12 nt, Human
gccucagccucc

SEQ ID NO: 1822220 - RNA, 10 nt, Human
gccucucugc

SEQ ID NO: 1822221 - RNA, 14 nt, Human
gccucucugcaggu

SEQ ID NO: 1822222 - RNA, 16 nt, Human
gccucucugcaggucc

SEQ ID NO: 1822223 - RNA, 17 nt, Human
gccucucugcagguccc

SEQ ID NO: 1822224 - RNA, 15 nt, Human
gccucucccaucacu

SEQ ID NO: 1822225 - RNA, 11 nt, Human
gccguggcuuc

SEQ ID NO: 1822226 - RNA, 12 nt, Human
gccguggcuucc

SEQ ID NO: 1822227 - RNA, 13 nt, Human
gccguggcuuccc

SEQ ID NO: 1822228 - RNA, 15 nt, Human
gccguggcuucccgc

SEQ ID NO: 1822229 - RNA, 18 nt, Human
gccgucuaccugaggggc

SEQ ID NO: 1822230 - RNA, 20 nt, Human
gccgucuaccugaggggccu

SEQ ID NO: 1822231 - RNA, 22 nt, Human
gccgucuaccugaggggccucu

SEQ ID NO: 1822232 - RNA, 23 nt, Human
gccgucuaccugaggggccucuu

SEQ ID NO: 1822233 - RNA, 17 nt, Human
gccuauuuuaauaaaca

SEQ ID NO: 1822234 - RNA, 14 nt, Human
gccuaaggcugaac

SEQ ID NO: 1822235 - RNA, 21 nt, Human
gccucagcauccuggcacccg

SEQ ID NO: 1822236 - RNA, 18 nt, Human
gccucagcauccuggcac

SEQ ID NO: 1822237 - RNA, 24 nt, Human
gccucaagugauucuccugccuca

SEQ ID NO: 1822238 - RNA, 22 nt, Human
gccucaagugauucuccugccu

SEQ ID NO: 1822239 - RNA, 12 nt, Human
gccgggguggau

SEQ ID NO: 1822240 - RNA, 19 nt, Human
gccgcagcccugcagaggg

SEQ ID NO: 1822241 - RNA, 15 nt, Human
gccgcagcccugcag

SEQ ID NO: 1822242 - RNA, 16 nt, Human
gccgcagcccugcaga

SEQ ID NO: 1822243 - RNA, 17 nt, Human
gccgcagcccugcagag

SEQ ID NO: 1822244 - RNA, 17 nt, Human
gccgagauagccaaggc

SEQ ID NO: 1822245 - RNA, 19 nt, Human
gccgagauagccaaggcca

SEQ ID NO: 1822246 - RNA, 16 nt, Human
gccgagauagccaagg

SEQ ID NO: 1822247 - RNA, 22 nt, Human
gcccuuccucuccacugccuuc

SEQ ID NO: 1822248 - RNA, 13 nt, Human
gcccuucucucca

SEQ ID NO: 1822249 - RNA, 17 nt, Human
gccccgucccccucugg

SEQ ID NO: 1822250 - RNA, 21 nt, Human
gccccgucccccucuggcucc

SEQ ID NO: 1822251 - RNA, 17 nt, Human
gccccgugggguuccuc

SEQ ID NO: 1822252 - RNA, 23 nt, Human
gccccgaggccuucucugaagga

SEQ ID NO: 1822253 - RNA, 23 nt, Human
gccccauucugccugcccaggcc

SEQ ID NO: 1822254 - RNA, 22 nt, Human
gccccauucugccugcccaggc

SEQ ID NO: 1822255 - RNA, 14 nt, Human
gccccgcccaggcu

SEQ ID NO: 1822256 - RNA, 19 nt, Human
gccccucagggucccuggu

SEQ ID NO: 1822257 - RNA, 21 nt, Human
gccccucagggucccuggugg

SEQ ID NO: 1822258 - RNA, 23 nt, Human
gccccucaacucuccuccagagu

SEQ ID NO: 1822259 - RNA, 17 nt, Human
gccccuucccccuccaa

SEQ ID NO: 1822260 - RNA, 18 nt, Human
gccccucccacagcgcug

SEQ ID NO: 1822261 - RNA, 13 nt, Human
gccccugcacaaa

SEQ ID NO: 1822262 - RNA, 23 nt, Human
gccccuggcagccccuguucugg

SEQ ID NO: 1822263 - RNA, 19 nt, Human
gccccugcacuccagccug

SEQ ID NO: 1822264 - RNA, 15 nt, Human
gcccucccugccccu

SEQ ID NO: 1822265 - RNA, 21 nt, Human
gcccgggcucugccucccauc

SEQ ID NO: 1822266 - RNA, 19 nt, Human
gcccgggcucugccuccca

SEQ ID NO: 1822267 - RNA, 20 nt, Human
gcccgggcucugccucccau

SEQ ID NO: 1822268 - RNA, 22 nt, Human
gcccucugcccacucccugcaa

SEQ ID NO: 1822269 - RNA, 15 nt, Human
gcccggcuccaggcu

SEQ ID NO: 1822270 - RNA, 12 nt, Human
gcccgggcucug

SEQ ID NO: 1822271 - RNA, 14 nt, Human
gcccggcuccaggc

SEQ ID NO: 1822272 - RNA, 13 nt, Human
gcccggcuccagg

SEQ ID NO: 1822273 - RNA, 13 nt, Human
gcccgggcucugc

SEQ ID NO: 1822274 - RNA, 14 nt, Human
gcccgggcucugcc

SEQ ID NO: 1822275 - RNA, 15 nt, Human
gcccgggcucugccu

SEQ ID NO: 1822276 - RNA, 18 nt, Human
gcccgggcucugccuccc

SEQ ID NO: 1822277 - RNA, 20 nt, Human
gccccuucugacccaugcug

SEQ ID NO: 1822278 - RNA, 19 nt, Human
gccccuucugacccaugcu

SEQ ID NO: 1822279 - RNA, 12 nt, Human
gcccggcuccag

SEQ ID NO: 1822280 - RNA, 11 nt, Human
gcccaggcugg

SEQ ID NO: 1822281 - RNA, 17 nt, Human
gcccaggccugccuguu

SEQ ID NO: 1822282 - RNA, 12 nt, Human
gcccaggaaagg

SEQ ID NO: 1822283 - RNA, 15 nt, Human
gcccaggaaaggcuc

SEQ ID NO: 1822284 - RNA, 16 nt, Human
gcccaggaaaggcucc

SEQ ID NO: 1822285 - RNA, 18 nt, Human
gcccaggccuccuacagc

SEQ ID NO: 1822286 - RNA, 15 nt, Human
gcccaggcuggcgug

SEQ ID NO: 1822287 - RNA, 14 nt, Human
gcccaggcuggcgu

SEQ ID NO: 1822288 - RNA, 16 nt, Human
gcccaggcuggcgugc

SEQ ID NO: 1822289 - RNA, 22 nt, Human
gcccagucuggaaugcaguggu

SEQ ID NO: 1822290 - RNA, 21 nt, Human
gccccauucugccugcccagg

SEQ ID NO: 1822291 - RNA, 20 nt, Human
gccccauucugccugcccag

SEQ ID NO: 1822292 - RNA, 18 nt, Human
gccccauucugccugccc

SEQ ID NO: 1822293 - RNA, 17 nt, Human
gccccauucugccugcc

SEQ ID NO: 1822294 - RNA, 23 nt, Human
gccccauccucuguacagagccc

SEQ ID NO: 1822295 - RNA, 21 nt, Human
gccccagugcccacaggauca

SEQ ID NO: 1822296 - RNA, 17 nt, Human
gccccagugcccacagg

SEQ ID NO: 1822297 - RNA, 16 nt, Human
gccccagugcccacag

SEQ ID NO: 1822298 - RNA, 22 nt, Human
gcccaucugggggccucuucug

SEQ ID NO: 1822299 - RNA, 19 nt, Human
gcccaaagugguauagaaa

SEQ ID NO: 1822300 - RNA, 16 nt, Human
gccauuuguguuuaua

SEQ ID NO: 1822301 - RNA, 15 nt, Human
gcccaaagaugcagc

SEQ ID NO: 1822302 - RNA, 16 nt, Human
gcccaaagaugcagcc

SEQ ID NO: 1822303 - RNA, 18 nt, Human
gcccacaggaucagucug

SEQ ID NO: 1822304 - RNA, 13 nt, Human
gcccacaggauca

SEQ ID NO: 1822305 - RNA, 19 nt, Human
gcccacaggaucagucuga

SEQ ID NO: 1822306 - RNA, 15 nt, Human
gcccaccccucaaca

SEQ ID NO: 1822307 - RNA, 17 nt, Human
gccauuucuuccacaag

SEQ ID NO: 1822308 - RNA, 20 nt, Human
gccauuucuuccacaagagc

SEQ ID NO: 1822309 - RNA, 22 nt, Human
gccauuucuuccacaagagccc

SEQ ID NO: 1822310 - RNA, 19 nt, Human
gccaugggacagggaggac

SEQ ID NO: 1822311 - RNA, 14 nt, Human
gccaugggacaggg

SEQ ID NO: 1822312 - RNA, 20 nt, Human
gccauccagguucagcuugu

SEQ ID NO: 1822313 - RNA, 19 nt, Human
gccauccagguucagcuug

SEQ ID NO: 1822314 - RNA, 18 nt, Human
gccagguggccacuccag

SEQ ID NO: 1822315 - RNA, 13 nt, Human
gccaucccagccc

SEQ ID NO: 1822316 - RNA, 14 nt, Human
gccaucccagcccc

SEQ ID NO: 1822317 - RNA, 15 nt, Human
gccaucccagcccca

SEQ ID NO: 1822318 - RNA, 16 nt, Human
gccaucccagccccaa

SEQ ID NO: 1822319 - RNA, 17 nt, Human
gccaucccagccccaau

SEQ ID NO: 1822320 - RNA, 17 nt, Human
gccaggggaaaaucagc

SEQ ID NO: 1822321 - RNA, 21 nt, Human
gccaggggaaaaucagccugc

SEQ ID NO: 1822322 - RNA, 22 nt, Human
gccaggggaaaaucagccugcu

SEQ ID NO: 1822323 - RNA, 23 nt, Human
gccaggggaaaaucagccugcuc

SEQ ID NO: 1822324 - RNA, 20 nt, Human
gccaggaagccagcaggcuc

SEQ ID NO: 1822325 - RNA, 19 nt, Human
gccaggaagccagcaggcu

SEQ ID NO: 1822326 - RNA, 11 nt, Human
gccaggaagcc

SEQ ID NO: 1822327 - RNA, 17 nt, Human
gccaggaagccagcagg

SEQ ID NO: 1822328 - RNA, 18 nt, Human
gccaggaagccagcaggc

SEQ ID NO: 1822329 - RNA, 22 nt, Human
gccacguucuuacuaguuuccc

SEQ ID NO: 1822330 - RNA, 16 nt, Human
gccacggccaggccag

SEQ ID NO: 1822331 - RNA, 21 nt, Human
gccacuauuguuagucucuug

SEQ ID NO: 1822332 - RNA, 15 nt, Human
gccacggccaggcca

SEQ ID NO: 1822333 - RNA, 14 nt, Human
gccacggccaggcc

SEQ ID NO: 1822334 - RNA, 18 nt, Human
gccacugcaccgggccac

SEQ ID NO: 1822335 - RNA, 17 nt, Human
gccacugcaccgggcca

SEQ ID NO: 1822336 - RNA, 19 nt, Human
gccacugcaccgggccaca

SEQ ID NO: 1822337 - RNA, 16 nt, Human
gccacuccagaccccu

SEQ ID NO: 1822338 - RNA, 18 nt, Human
gccacuccagaccccugg

SEQ ID NO: 1822339 - RNA, 19 nt, Human
gccacuccagaccccuggc

SEQ ID NO: 1822340 - RNA, 18 nt, Human
gccagagggagugacaga

SEQ ID NO: 1822341 - RNA, 12 nt, Human
gccagagacaca

SEQ ID NO: 1822342 - RNA, 15 nt, Human
gccagagacacaagc

SEQ ID NO: 1822343 - RNA, 14 nt, Human
gccagcugcuuggg

SEQ ID NO: 1822344 - RNA, 16 nt, Human
gccagcugcuugggcu

SEQ ID NO: 1822345 - RNA, 15 nt, Human
gccagcugcuugggc

SEQ ID NO: 1822346 - RNA, 14 nt, Human
gccagccuugacca

SEQ ID NO: 1822347 - RNA, 20 nt, Human
gccagccuugaccauucucc

SEQ ID NO: 1822348 - RNA, 21 nt, Human
gccagccuugaccauucucca

SEQ ID NO: 1822349 - RNA, 22 nt, Human
gccagccuugaccauucuccac

SEQ ID NO: 1822350 - RNA, 20 nt, Human
gccagagggagugacagagg

SEQ ID NO: 1822351 - RNA, 19 nt, Human
gccagagggagugacagag

SEQ ID NO: 1822352 - RNA, 16 nt, Human
gccagauucuuuccug

SEQ ID NO: 1822353 - RNA, 17 nt, Human
gccagauucuuuccuga

SEQ ID NO: 1822354 - RNA, 19 nt, Human
gccagauucuuuccugagg

SEQ ID NO: 1822355 - RNA, 21 nt, Human
gccagccgagauagccaaggc

SEQ ID NO: 1822356 - RNA, 20 nt, Human
gccagccgagauagccaagg

SEQ ID NO: 1822357 - RNA, 12 nt, Human
gccagccuugac

SEQ ID NO: 1822358 - RNA, 12 nt, Human
gcauuuuguaau

SEQ ID NO: 1822359 - RNA, 22 nt, Human
gcauuuugcuaaaugugaauga

SEQ ID NO: 1822360 - RNA, 21 nt, Human
gccaaacucaccugccccuca

SEQ ID NO: 1822361 - RNA, 19 nt, Human
gccaaacucaccugccccu

SEQ ID NO: 1822362 - RNA, 14 nt, Human
gccaaaggaagcac

SEQ ID NO: 1822363 - RNA, 16 nt, Human
gccaaaggaagcacau

SEQ ID NO: 1822364 - RNA, 20 nt, Human
gccaaaggaagcacaugccu

SEQ ID NO: 1822365 - RNA, 18 nt, Human
gcauucucacuccuaccu

SEQ ID NO: 1822366 - RNA, 13 nt, Human
gcauucucacucc

SEQ ID NO: 1822367 - RNA, 15 nt, Human
gcauucucacuccua

SEQ ID NO: 1822368 - RNA, 12 nt, Human
gcauuccccagg

SEQ ID NO: 1822369 - RNA, 12 nt, Human
gcauuccccacu

SEQ ID NO: 1822370 - RNA, 23 nt, Human
gcauuugcugaauacagaggcaa

SEQ ID NO: 1822371 - RNA, 21 nt, Human
gcauuuggugguuucagaaau

SEQ ID NO: 1822372 - RNA, 16 nt, Human
gcauuuuacuguacag

SEQ ID NO: 1822373 - RNA, 17 nt, Human
gcauuuuacuguacaga

SEQ ID NO: 1822374 - RNA, 13 nt, Human
gcaucaggccagg

SEQ ID NO: 1822375 - RNA, 15 nt, Human
gcaucaggccaggcc

SEQ ID NO: 1822376 - RNA, 16 nt, Human
gcaucaggccaggccc

SEQ ID NO: 1822377 - RNA, 17 nt, Human
gcaucaggccaggcccu

SEQ ID NO: 1822378 - RNA, 15 nt, Human
gcaugaauuugugaa

SEQ ID NO: 1822379 - RNA, 20 nt, Human
gcaugacacgaauauugcug

SEQ ID NO: 1822380 - RNA, 17 nt, Human
gcaugaauuugugaagg

SEQ ID NO: 1822381 - RNA, 17 nt, Human
gcaugccuggauggggc

SEQ ID NO: 1822382 - RNA, 22 nt, Human
gcaugccuggauggggcugcac

SEQ ID NO: 1822383 - RNA, 17 nt, Human
gcauguuugugauugac

SEQ ID NO: 1822384 - RNA, 15 nt, Human
gcaugcugucccuua

SEQ ID NO: 1822385 - RNA, 20 nt, Human
gcauuagauuucucauuugc

SEQ ID NO: 1822386 - RNA, 18 nt, Human
gcagugggagcugccugu

SEQ ID NO: 1822387 - RNA, 17 nt, Human
gcagugggagcugccug

SEQ ID NO: 1822388 - RNA, 19 nt, Human
gcauauuuauaaaaauaaa

SEQ ID NO: 1822389 - RNA, 21 nt, Human
gcaucaagaugugacauguuu

SEQ ID NO: 1822390 - RNA, 17 nt, Human
gcauauucaggaagcuc

SEQ ID NO: 1822391 - RNA, 18 nt, Human
gcauauucaggaagcuca

SEQ ID NO: 1822392 - RNA, 20 nt, Human
gcauauucaggaagcucagg

SEQ ID NO: 1822393 - RNA, 18 nt, Human
gcauauuauuuuauguug

SEQ ID NO: 1822394 - RNA, 23 nt, Human
gcauauuauuuuauguugcauag

SEQ ID NO: 1822395 - RNA, 15 nt, Human
gcauauucaggaagc

SEQ ID NO: 1822396 - RNA, 12 nt, Human
gcagggcucagc

SEQ ID NO: 1822397 - RNA, 14 nt, Human
gcagggcucagcgg

SEQ ID NO: 1822398 - RNA, 18 nt, Human
gcagggagggccugggcc

SEQ ID NO: 1822399 - RNA, 22 nt, Human
gcagggagggccugggccccag

SEQ ID NO: 1822400 - RNA, 16 nt, Human
gcagggagggcuucug

SEQ ID NO: 1822401 - RNA, 20 nt, Human
gcaggauucuuccucccucc

SEQ ID NO: 1822402 - RNA, 14 nt, Human
gcagggagggccug

SEQ ID NO: 1822403 - RNA, 17 nt, Human
gcagggagggccugggc

SEQ ID NO: 1822404 - RNA, 16 nt, Human
gcagugggagcugccu

SEQ ID NO: 1822405 - RNA, 23 nt, Human
gcagugcuuccaaggauggacca

SEQ ID NO: 1822406 - RNA, 12 nt, Human
gcaggucccuaa

SEQ ID NO: 1822407 - RNA, 13 nt, Human
gcaggucccuaau

SEQ ID NO: 1822408 - RNA, 10 nt, Human
gcaggucccu

SEQ ID NO: 1822409 - RNA, 11 nt, Human
gcaggucccua

SEQ ID NO: 1822410 - RNA, 18 nt, Human
gcacccggccccugcugg

SEQ ID NO: 1822411 - RNA, 17 nt, Human
gcacuaaggugugcucu

SEQ ID NO: 1822412 - RNA, 18 nt, Human
gcacuaaggugugcucug

SEQ ID NO: 1822413 - RNA, 19 nt, Human
gcacuaaggugugcucuga

SEQ ID NO: 1822414 - RNA, 17 nt, Human
gcacugaggaccagcca

SEQ ID NO: 1822415 - RNA, 22 nt, Human
gcacugggcuuggggaccagag

SEQ ID NO: 1822416 - RNA, 23 nt, Human
gcacugggcuuggggaccagagc

SEQ ID NO: 1822417 - RNA, 12 nt, Human
gcagaaggaaga

SEQ ID NO: 1822418 - RNA, 13 nt, Human
gcagaaggaagac

SEQ ID NO: 1822419 - RNA, 14 nt, Human
gcagaaggaagacu

SEQ ID NO: 1822420 - RNA, 14 nt, Human
gcagaagacaguau

SEQ ID NO: 1822421 - RNA, 16 nt, Human
gcacagcuucauuucc

SEQ ID NO: 1822422 - RNA, 19 nt, Human
gcacagcuaacauggaagu

SEQ ID NO: 1822423 - RNA, 13 nt, Human
gcaaugaccuuuc

SEQ ID NO: 1822424 - RNA, 14 nt, Human
gcaaugaccuuuca

SEQ ID NO: 1822425 - RNA, 19 nt, Human
gcaccacugcacuccagcc

SEQ ID NO: 1822426 - RNA, 15 nt, Human
gcaccuccugccucg

SEQ ID NO: 1822427 - RNA, 14 nt, Human
gcaccuccugccuc

SEQ ID NO: 1822428 - RNA, 17 nt, Human
gcacccggccccugcug

SEQ ID NO: 1822429 - RNA, 15 nt, Human
gcacccggccccugc

SEQ ID NO: 1822430 - RNA, 14 nt, Human
gcacccggccccug

SEQ ID NO: 1822431 - RNA, 15 nt, Human
gcagcacagcugaga

SEQ ID NO: 1822432 - RNA, 12 nt, Human
gcagcaauaaag

SEQ ID NO: 1822433 - RNA, 19 nt, Human
gcagaguugaagacagagc

SEQ ID NO: 1822434 - RNA, 16 nt, Human
gcagaguugaagacag

SEQ ID NO: 1822435 - RNA, 17 nt, Human
gcagaguugaagacaga

SEQ ID NO: 1822436 - RNA, 15 nt, Human
gcagaguugaagaca

SEQ ID NO: 1822437 - RNA, 14 nt, Human
gcagagaccauccc

SEQ ID NO: 1822438 - RNA, 15 nt, Human
gcagagaccaucccu

SEQ ID NO: 1822439 - RNA, 17 nt, Human
gcagagaccaucccuga

SEQ ID NO: 1822440 - RNA, 19 nt, Human
gcagagaccaucccugaag

SEQ ID NO: 1822441 - RNA, 23 nt, Human
gcagagaaugaaagggcccagag

SEQ ID NO: 1822442 - RNA, 22 nt, Human
gcagagaaugaaagggcccaga

SEQ ID NO: 1822443 - RNA, 21 nt, Human
gcagagaauucucuuauccaa

SEQ ID NO: 1822444 - RNA, 21 nt, Human
gcagagaaugaaagggcccag

SEQ ID NO: 1822445 - RNA, 20 nt, Human
gcagagaaugaaagggccca

SEQ ID NO: 1822446 - RNA, 19 nt, Human
gcagagaaugaaagggccc

SEQ ID NO: 1822447 - RNA, 18 nt, Human
gcagaaggaagacuucau

SEQ ID NO: 1822448 - RNA, 20 nt, Human
gcaggaggaucacuugaguc

SEQ ID NO: 1822449 - RNA, 20 nt, Human
gcaggaguuucguuuucaaa

SEQ ID NO: 1822450 - RNA, 21 nt, Human
gcaggaguuucguuuucaaaa

SEQ ID NO: 1822451 - RNA, 22 nt, Human
gcagccucaaccuccugggcua

SEQ ID NO: 1822452 - RNA, 21 nt, Human
gcagccucaaccuccugggcu

SEQ ID NO: 1822453 - RNA, 18 nt, Human
gcagccgugccuucagcu

SEQ ID NO: 1822454 - RNA, 14 nt, Human
gcagccuggacccu

SEQ ID NO: 1822455 - RNA, 20 nt, Human
gcagccucaaccuccugggc

SEQ ID NO: 1822456 - RNA, 19 nt, Human
gcagccucaaccuccuggg

SEQ ID NO: 1822457 - RNA, 15 nt, Human
gcagccgugccuuca

SEQ ID NO: 1822458 - RNA, 17 nt, Human
gcagccgugccuucagc

SEQ ID NO: 1822459 - RNA, 14 nt, Human
gcagccgugccuuc

SEQ ID NO: 1822460 - RNA, 21 nt, Human
gauuucuguuuagauaauaca

SEQ ID NO: 1822461 - RNA, 22 nt, Human
gauuucuguuuagauaauacac

SEQ ID NO: 1822462 - RNA, 16 nt, Human
gauugggaauccgccc

SEQ ID NO: 1822463 - RNA, 16 nt, Human
gauugcaacaggcugg

SEQ ID NO: 1822464 - RNA, 20 nt, Human
gauucuuuccugaggcuggg

SEQ ID NO: 1822465 - RNA, 22 nt, Human
gauucuuuccugaggcugggcu

SEQ ID NO: 1822466 - RNA, 18 nt, Human
gauucccaagcucugcuc

SEQ ID NO: 1822467 - RNA, 19 nt, Human
gauucuuuccugaggcugg

SEQ ID NO: 1822468 - RNA, 17 nt, Human
gauucccaagcucugcu

SEQ ID NO: 1822469 - RNA, 16 nt, Human
gauucccaagcucugc

SEQ ID NO: 1822470 - RNA, 18 nt, Human
gauugcuugagcucagga

SEQ ID NO: 1822471 - RNA, 18 nt, Human
gauugcaacaggcugggc

SEQ ID NO: 1822472 - RNA, 17 nt, Human
gauugcaacaggcuggg

SEQ ID NO: 1822473 - RNA, 20 nt, Human
gaugccugugaacugaacuc

SEQ ID NO: 1822474 - RNA, 17 nt, Human
gaugccugguggcagcu

SEQ ID NO: 1822475 - RNA, 16 nt, Human
gaugcuagaacucccu

SEQ ID NO: 1822476 - RNA, 18 nt, Human
gauguucuagcauggcug

SEQ ID NO: 1822477 - RNA, 14 nt, Human
gauguucugggaca

SEQ ID NO: 1822478 - RNA, 18 nt, Human
gauguucuggauaccauu

SEQ ID NO: 1822479 - RNA, 21 nt, Human
gauguuuuaaggaugcuugua

SEQ ID NO: 1822480 - RNA, 21 nt, Human
gauuacaagcgugagccacug

SEQ ID NO: 1822481 - RNA, 13 nt, Human
gauuacaagcgug

SEQ ID NO: 1822482 - RNA, 13 nt, Human
gauucagacagcu

SEQ ID NO: 1822483 - RNA, 14 nt, Human
gauucagacagcug

SEQ ID NO: 1822484 - RNA, 17 nt, Human
gauucagacagcugccu

SEQ ID NO: 1822485 - RNA, 18 nt, Human
gauucagacagcugccug

SEQ ID NO: 1822486 - RNA, 15 nt, Human
gauucccaagcucug

SEQ ID NO: 1822487 - RNA, 17 nt, Human
gcaauccugcaagaaca

SEQ ID NO: 1822488 - RNA, 21 nt, Human
gcaagggaauuucuucaacuc

SEQ ID NO: 1822489 - RNA, 14 nt, Human
gcaaggcugucaau

SEQ ID NO: 1822490 - RNA, 18 nt, Human
gcaaggcugucaauuaca

SEQ ID NO: 1822491 - RNA, 20 nt, Human
gcaagcaccuccugccucga

SEQ ID NO: 1822492 - RNA, 18 nt, Human
gcaagcaccuccugccuc

SEQ ID NO: 1822493 - RNA, 16 nt, Human
gcaagcaccuccugcc

SEQ ID NO: 1822494 - RNA, 15 nt, Human
gcaagcaccuccugc

SEQ ID NO: 1822495 - RNA, 18 nt, Human
gcaagcaagaaacacugg

SEQ ID NO: 1822496 - RNA, 22 nt, Human
gcaacuuuguauaaaagggacu

SEQ ID NO: 1822497 - RNA, 23 nt, Human
gcaaaguucccuacuuccuguga

SEQ ID NO: 1822498 - RNA, 20 nt, Human
gcaaacuuuauuuuguguuu

SEQ ID NO: 1822499 - RNA, 18 nt, Human
gcaacugcauuggcuuug

SEQ ID NO: 1822500 - RNA, 12 nt, Human
gcaaaugugaau

SEQ ID NO: 1822501 - RNA, 14 nt, Human
gcaaauggccucau

SEQ ID NO: 1822502 - RNA, 18 nt, Human
gcaaacuuuauuuugugu

SEQ ID NO: 1822503 - RNA, 16 nt, Human
gcaaaccaucauugaa

SEQ ID NO: 1822504 - RNA, 17 nt, Human
gcaaaccaucauugaaa

SEQ ID NO: 1822505 - RNA, 19 nt, Human
gcaaaccaucauugaaauc

SEQ ID NO: 1822506 - RNA, 20 nt, Human
gcaaaccaucauugaaaucu

SEQ ID NO: 1822507 - RNA, 21 nt, Human
gcaaaccaucauugaaaucuu

SEQ ID NO: 1822508 - RNA, 16 nt, Human
gaugaaauguaaauac

SEQ ID NO: 1822509 - RNA, 21 nt, Human
gaugaaaugaggucagagccu

SEQ ID NO: 1822510 - RNA, 15 nt, Human
gaugaaaugagguca

SEQ ID NO: 1822511 - RNA, 19 nt, Human
gaucuucuuuauaauucua

SEQ ID NO: 1822512 - RNA, 22 nt, Human
gaucuucuguggguuucuaaag

SEQ ID NO: 1822513 - RNA, 23 nt, Human
gaugcaccagcccuuagcaggga

SEQ ID NO: 1822514 - RNA, 15 nt, Human
gaugcaccagcccuu

SEQ ID NO: 1822515 - RNA, 14 nt, Human
gaugcaccagcccu

SEQ ID NO: 1822516 - RNA, 14 nt, Human
gaugagaggaaauc

SEQ ID NO: 1822517 - RNA, 18 nt, Human
gaugaccuugaaugaugc

SEQ ID NO: 1822518 - RNA, 23 nt, Human
gaugagaaauaaaguuucuguug

SEQ ID NO: 1822519 - RNA, 20 nt, Human
gaugaccuugaaugaugcca

SEQ ID NO: 1822520 - RNA, 16 nt, Human
gaugccugguggcagc

SEQ ID NO: 1822521 - RNA, 15 nt, Human
gaugccugguggcag

SEQ ID NO: 1822522 - RNA, 14 nt, Human
gaugccugguggca

SEQ ID NO: 1822523 - RNA, 14 nt, Human
gaugcagugcuucc

SEQ ID NO: 1822524 - RNA, 16 nt, Human
gaugagaggaaaucac

SEQ ID NO: 1822525 - RNA, 16 nt, Human
gauccucccaggcuuc

SEQ ID NO: 1822526 - RNA, 12 nt, Human
gauccugagcca

SEQ ID NO: 1822527 - RNA, 13 nt, Human
gaucuaggaagac

SEQ ID NO: 1822528 - RNA, 14 nt, Human
gaucuaggaagacu

SEQ ID NO: 1822529 - RNA, 18 nt, Human
gaucuaggaagacuuugg

SEQ ID NO: 1822530 - RNA, 20 nt, Human
gaucuaggaagacuuuggaa

SEQ ID NO: 1822531 - RNA, 16 nt, Human
gaucauccacugugcc

SEQ ID NO: 1822532 - RNA, 13 nt, Human
gaucauccacugu

SEQ ID NO: 1822533 - RNA, 18 nt, Human
gauccucccaccucagcc

SEQ ID NO: 1822534 - RNA, 17 nt, Human
gauccucccaccucagc

SEQ ID NO: 1822535 - RNA, 16 nt, Human
gauccucccaccucag

SEQ ID NO: 1822536 - RNA, 14 nt, Human
gauccuccaggugc

SEQ ID NO: 1822537 - RNA, 23 nt, Human
gauccuaaugaaugcauaaaaug

SEQ ID NO: 1822538 - RNA, 18 nt, Human
gauccuaggcauuugcug

SEQ ID NO: 1822539 - RNA, 17 nt, Human
gauaggucagugcaaau

SEQ ID NO: 1822540 - RNA, 16 nt, Human
gauacaaaagcaugug

SEQ ID NO: 1822541 - RNA, 17 nt, Human
gauacaaaagcauguga

SEQ ID NO: 1822542 - RNA, 18 nt, Human
gauaauucuagcuuugag

SEQ ID NO: 1822543 - RNA, 18 nt, Human
gauauaugcucugcaugu

SEQ ID NO: 1822544 - RNA, 18 nt, Human
gauauaaaagacugacca

SEQ ID NO: 1822545 - RNA, 20 nt, Human
gauagugucccacggugccu

SEQ ID NO: 1822546 - RNA, 20 nt, Human
gaucacggcucacugcagcc

SEQ ID NO: 1822547 - RNA, 23 nt, Human
gaucacggcucacugcagccuca

SEQ ID NO: 1822548 - RNA, 16 nt, Human
gaucacauguggacuu

SEQ ID NO: 1822549 - RNA, 13 nt, Human
gauaaacaguagu

SEQ ID NO: 1822550 - RNA, 13 nt, Human
gaguucugguucc

SEQ ID NO: 1822551 - RNA, 24 nt, Human
gauaauacaccacuacauucuguu

SEQ ID NO: 1822552 - RNA, 23 nt, Human
gauaauacaccacuacauucugu

SEQ ID NO: 1822553 - RNA, 12 nt, Human
gauaauacacca

SEQ ID NO: 1822554 - RNA, 23 nt, Human
gaaugaaccacaucuugcucugc

SEQ ID NO: 1822555 - RNA, 18 nt, Human
gaaugaaccacaucuugc

SEQ ID NO: 1822556 - RNA, 22 nt, Human
gaaugaaccacaucuugcucug

SEQ ID NO: 1822557 - RNA, 11 nt, Human
gaaugcagugg

SEQ ID NO: 1822558 - RNA, 14 nt, Human
gaaugcauaaaaug

SEQ ID NO: 1822559 - RNA, 13 nt, Human
gaaugcuuuagga

SEQ ID NO: 1822560 - RNA, 14 nt, Human
gaaugucaguguga

SEQ ID NO: 1822561 - RNA, 22 nt, Human
gaaugguuuucaaaauaaaaau

SEQ ID NO: 1822562 - RNA, 17 nt, Human
gaauucucuaguuugau

SEQ ID NO: 1822563 - RNA, 17 nt, Human
gaauucucagaaucuca

SEQ ID NO: 1822564 - RNA, 20 nt, Human
gaaugucagugugacugauc

SEQ ID NO: 1822565 - RNA, 21 nt, Human
gaaugucagugugacugaucu

SEQ ID NO: 1822566 - RNA, 19 nt, Human
gaauucucuaguuugauua

SEQ ID NO: 1822567 - RNA, 14 nt, Human
gaauugaaaaacca

SEQ ID NO: 1822568 - RNA, 14 nt, Human
gaauugaagcagga

SEQ ID NO: 1822569 - RNA, 15 nt, Human
gaauuucccaaagca

SEQ ID NO: 1822570 - RNA, 22 nt, Human
gaauuguaaggaaugauuaauu

SEQ ID NO: 1822571 - RNA, 15 nt, Human
gaauuguguuuauaa

SEQ ID NO: 1822572 - RNA, 23 nt, Human
gaauuguguuuauaauuuuaaau

SEQ ID NO: 1822573 - RNA, 22 nt, Human
gaauagcugggacuacaggugu

SEQ ID NO: 1822574 - RNA, 23 nt, Human
gaauagcugggacuacaggugug

SEQ ID NO: 1822575 - RNA, 22 nt, Human
gaauagcuuuaaugauaugcuu

SEQ ID NO: 1822576 - RNA, 13 nt, Human
gaauaccuguccc

SEQ ID NO: 1822577 - RNA, 15 nt, Human
gaauaccuguccccc

SEQ ID NO: 1822578 - RNA, 21 nt, Human
gaauacagaggcaacugcauu

SEQ ID NO: 1822579 - RNA, 17 nt, Human
gaauaauacaguaucuc

SEQ ID NO: 1822580 - RNA, 20 nt, Human
gaaguuugagaucagccugg

SEQ ID NO: 1822581 - RNA, 18 nt, Human
gaauaacauguaauuaag

SEQ ID NO: 1822582 - RNA, 19 nt, Human
gaauaacauguaauuaagu

SEQ ID NO: 1822583 - RNA, 23 nt, Human
gaaguaguggagccccugcucug

SEQ ID NO: 1822584 - RNA, 14 nt, Human
gaaguauccuucag

SEQ ID NO: 1822585 - RNA, 16 nt, Human
gaaguauccuucagcc

SEQ ID NO: 1822586 - RNA, 18 nt, Human
gaagucuuagauguauau

SEQ ID NO: 1822587 - RNA, 21 nt, Human
gaaguuucugccgcagcccug

SEQ ID NO: 1822588 - RNA, 15 nt, Human
gaagucuuagaugua

SEQ ID NO: 1822589 - RNA, 20 nt, Human
gaaguuucugccgcagcccu

SEQ ID NO: 1822590 - RNA, 15 nt, Human
gaaguacuggagaaa

SEQ ID NO: 1822591 - RNA, 18 nt, Human
gaaguacuauaauuuacc

SEQ ID NO: 1822592 - RNA, 22 nt, Human
gaaguaauaugcacacauuuuu

SEQ ID NO: 1822593 - RNA, 16 nt, Human
gaagggggcugggaca

SEQ ID NO: 1822594 - RNA, 19 nt, Human
gaagggggcugggacaugg

SEQ ID NO: 1822595 - RNA, 18 nt, Human
gaagauguagaggagaaa

SEQ ID NO: 1822596 - RNA, 20 nt, Human
gaagauaauauuaaggaaga

SEQ ID NO: 1822597 - RNA, 18 nt, Human
gaagcauuuacuuugugu

SEQ ID NO: 1822598 - RNA, 17 nt, Human
gaagcauuuacuuugug

SEQ ID NO: 1822599 - RNA, 20 nt, Human
gaagccagcaggcucucagg

SEQ ID NO: 1822600 - RNA, 21 nt, Human
gaagccagcaggcucucaggc

SEQ ID NO: 1822601 - RNA, 22 nt, Human
gaagccagcaggcucucaggcc

SEQ ID NO: 1822602 - RNA, 13 nt, Human
gaagcccaggaaa

SEQ ID NO: 1822603 - RNA, 15 nt, Human
gaagcccaggaaagg

SEQ ID NO: 1822604 - RNA, 16 nt, Human
gaagcccaggaaaggc

SEQ ID NO: 1822605 - RNA, 19 nt, Human
gaagcccaggaaaggcucc

SEQ ID NO: 1822606 - RNA, 23 nt, Human
gaagcccuucuaccuuccugcaa

SEQ ID NO: 1822607 - RNA, 14 nt, Human
gaagacuuuggaaa

SEQ ID NO: 1822608 - RNA, 17 nt, Human
gaagacuuuggaaagag

SEQ ID NO: 1822609 - RNA, 20 nt, Human
gaagacuuuucuuucagcca

SEQ ID NO: 1822610 - RNA, 19 nt, Human
gaagagaaugcacaaacag

SEQ ID NO: 1822611 - RNA, 22 nt, Human
gaacucaucuagguaaauuaca

SEQ ID NO: 1822612 - RNA, 20 nt, Human
gaacucaucuagguaaauua

SEQ ID NO: 1822613 - RNA, 21 nt, Human
gaacucaucuagguaaauuac

SEQ ID NO: 1822614 - RNA, 23 nt, Human
gaacuuugaccucugcagcaaua

SEQ ID NO: 1822615 - RNA, 11 nt, Human
gaagacuuugg

SEQ ID NO: 1822616 - RNA, 13 nt, Human
gaagacuuuggaa

SEQ ID NO: 1822617 - RNA, 22 nt, Human
gaaccuuuugagugccuuacac

SEQ ID NO: 1822618 - RNA, 15 nt, Human
gaacguuuuuccugu

SEQ ID NO: 1822619 - RNA, 12 nt, Human
gaacguuuuucc

SEQ ID NO: 1822620 - RNA, 14 nt, Human
gaacuacugaggau

SEQ ID NO: 1822621 - RNA, 18 nt, Human
gaaccuuuugagugccuu

SEQ ID NO: 1822622 - RNA, 19 nt, Human
gaaccuuuugagugccuua

SEQ ID NO: 1822623 - RNA, 21 nt, Human
gaaccuuuugagugccuuaca

SEQ ID NO: 1822624 - RNA, 15 nt, Human
gaacauugguucuuu

SEQ ID NO: 1822625 - RNA, 17 nt, Human
gaacauugcaauagaaa

SEQ ID NO: 1822626 - RNA, 15 nt, Human
gaacauugcaauaga

SEQ ID NO: 1822627 - RNA, 13 nt, Human
gaacauugcaaua

SEQ ID NO: 1822628 - RNA, 14 nt, Human
gaacaucccuccug

SEQ ID NO: 1822629 - RNA, 16 nt, Human
gaaauuguauuacaaa

SEQ ID NO: 1822630 - RNA, 23 nt, Human
gaaaauaaaucaaugcuauaacu

SEQ ID NO: 1822631 - RNA, 18 nt, Human
gaaauuguauuacaaauc

SEQ ID NO: 1822632 - RNA, 16 nt, Human
gaaauuuauaaacuuu

SEQ ID NO: 1822633 - RNA, 17 nt, Human
gaaauuuauaaacuuuu

SEQ ID NO: 1822634 - RNA, 13 nt, Human
gaacacucugaga

SEQ ID NO: 1822635 - RNA, 14 nt, Human
gaacacucugagac

SEQ ID NO: 1822636 - RNA, 15 nt, Human
gaacacucugagacu

SEQ ID NO: 1822637 - RNA, 20 nt, Human
gaacagugauuaccagggac

SEQ ID NO: 1822638 - RNA, 16 nt, Human
gaacagugauuaccag

SEQ ID NO: 1822639 - RNA, 11 nt, Human
gacguguuaug

SEQ ID NO: 1822640 - RNA, 14 nt, Human
gacguguuaugacu

SEQ ID NO: 1822641 - RNA, 15 nt, Human
gacguguuaugacuc

SEQ ID NO: 1822642 - RNA, 16 nt, Human
gacuaacuugucuuug

SEQ ID NO: 1822643 - RNA, 23 nt, Human
gacuaacuugucuuuggacccug

SEQ ID NO: 1822644 - RNA, 13 nt, Human
gacggagucccac

SEQ ID NO: 1822645 - RNA, 21 nt, Human
gacgcugugcugcccugccca

SEQ ID NO: 1822646 - RNA, 22 nt, Human
gacgcugugcugcccugcccac

SEQ ID NO: 1822647 - RNA, 22 nt, Human
gaccuuuaagagaaaugagcug

SEQ ID NO: 1822648 - RNA, 11 nt, Human
gaccuuucaau

SEQ ID NO: 1822649 - RNA, 19 nt, Human
gaccuuucaauaggaaaaa

SEQ ID NO: 1822650 - RNA, 20 nt, Human
gaccuuucaauaggaaaaac

SEQ ID NO: 1822651 - RNA, 17 nt, Human
gacgugauuuugcugua

SEQ ID NO: 1822652 - RNA, 16 nt, Human
gacgugauuuugcugu

SEQ ID NO: 1822653 - RNA, 14 nt, Human
gaccuugaacuggg

SEQ ID NO: 1822654 - RNA, 20 nt, Human
gaccuucuccuucaccuuug

SEQ ID NO: 1822655 - RNA, 21 nt, Human
gaccuucuccuucaccuuugu

SEQ ID NO: 1822656 - RNA, 14 nt, Human
gaccuucuccuuca

SEQ ID NO: 1822657 - RNA, 15 nt, Human
gaccuucuccuucac

SEQ ID NO: 1822658 - RNA, 16 nt, Human
gaccuucuccuucacc

SEQ ID NO: 1822659 - RNA, 14 nt, Human
gaccuuaaaugcaa

SEQ ID NO: 1822660 - RNA, 19 nt, Human
gaccuguggccaaguucuu

SEQ ID NO: 1822661 - RNA, 19 nt, Human
gacccuugccgucuaccug

SEQ ID NO: 1822662 - RNA, 20 nt, Human
gacccuugccgucuaccuga

SEQ ID NO: 1822663 - RNA, 23 nt, Human
gacccuugccgucuaccugaggg

SEQ ID NO: 1822664 - RNA, 15 nt, Human
gacccuugugguccc

SEQ ID NO: 1822665 - RNA, 17 nt, Human
gacuggauguaccacca

SEQ ID NO: 1822666 - RNA, 23 nt, Human
gacuggccaagguuuggggaaga

SEQ ID NO: 1822667 - RNA, 14 nt, Human
gacuucagcucugu

SEQ ID NO: 1822668 - RNA, 12 nt, Human
gacuucaucccu

SEQ ID NO: 1822669 - RNA, 20 nt, Human
gacuucaucccucuggggcu

SEQ ID NO: 1822670 - RNA, 16 nt, Human
gacuuauuuauauaaa

SEQ ID NO: 1822671 - RNA, 15 nt, Human
gacuuagcugggaga

SEQ ID NO: 1822672 - RNA, 23 nt, Human
gacuuacuguacaugaaaacaca

SEQ ID NO: 1822673 - RNA, 18 nt, Human
gacuuacuguacaugaaa

SEQ ID NO: 1822674 - RNA, 12 nt, Human
gacuuacuguac

SEQ ID NO: 1822675 - RNA, 16 nt, Human
gacuuacuguacauga

SEQ ID NO: 1822676 - RNA, 15 nt, Human
gacuuacuguacaug

SEQ ID NO: 1822677 - RNA, 20 nt, Human
gacugccagucccccugccc

SEQ ID NO: 1822678 - RNA, 13 nt, Human
gacugagaaauuu

SEQ ID NO: 1822679 - RNA, 18 nt, Human
gacugaguacguugugca

SEQ ID NO: 1822680 - RNA, 16 nt, Human
gacugaggggagggga

SEQ ID NO: 1822681 - RNA, 15 nt, Human
gacuacaggcaccca

SEQ ID NO: 1822682 - RNA, 13 nt, Human
gacuacaggcacc

SEQ ID NO: 1822683 - RNA, 18 nt, Human
gacuacaggcacccacca

SEQ ID NO: 1822684 - RNA, 18 nt, Human
gacuccugcaggcagcca

SEQ ID NO: 1822685 - RNA, 19 nt, Human
gacuccugcaggcagccag

SEQ ID NO: 1822686 - RNA, 20 nt, Human
gacuccugcaggcagccagg

SEQ ID NO: 1822687 - RNA, 21 nt, Human
gacuccugcaggcagccaggc

SEQ ID NO: 1822688 - RNA, 15 nt, Human
gacucuacagaggcc

SEQ ID NO: 1822689 - RNA, 15 nt, Human
gacucuaaagucugu

SEQ ID NO: 1822690 - RNA, 21 nt, Human
gacucuacagaggccaugggc

SEQ ID NO: 1822691 - RNA, 11 nt, Human
gacugagaaau

SEQ ID NO: 1822692 - RNA, 22 nt, Human
gacugaccaauauuguacaguu

SEQ ID NO: 1822693 - RNA, 21 nt, Human
gacugaccaauauuguacagu

SEQ ID NO: 1822694 - RNA, 19 nt, Human
gacccaaaaggcagaagca

SEQ ID NO: 1822695 - RNA, 18 nt, Human
gacccaaaaggcagaagc

SEQ ID NO: 1822696 - RNA, 19 nt, Human
gacccacuggacucaccuc

SEQ ID NO: 1822697 - RNA, 20 nt, Human
gacccaaaaggcagaagcaa

SEQ ID NO: 1822698 - RNA, 13 nt, Human
gacccaugcugcc

SEQ ID NO: 1822699 - RNA, 18 nt, Human
gacccaugcugcccugug

SEQ ID NO: 1822700 - RNA, 19 nt, Human
gacccaugcugcccuguga

SEQ ID NO: 1822701 - RNA, 20 nt, Human
gacccaugcugcccugugag

SEQ ID NO: 1822702 - RNA, 11 nt, Human
gacccugaggc

SEQ ID NO: 1822703 - RNA, 12 nt, Human
gacccugaggcc

SEQ ID NO: 1822704 - RNA, 16 nt, Human
gacccugaggcccaga

SEQ ID NO: 1822705 - RNA, 18 nt, Human
gacccugaggcccagagg

SEQ ID NO: 1822706 - RNA, 17 nt, Human
gacccugcccugugggc

SEQ ID NO: 1822707 - RNA, 20 nt, Human
gacccugcccugugggcccc

SEQ ID NO: 1822708 - RNA, 22 nt, Human
gacccugcccugugggccccca

SEQ ID NO: 1822709 - RNA, 22 nt, Human
gaccagacaccuugacagggca

SEQ ID NO: 1822710 - RNA, 18 nt, Human
gaccacugcagaagacag

SEQ ID NO: 1822711 - RNA, 16 nt, Human
gaccacugcagaagac

SEQ ID NO: 1822712 - RNA, 24 nt, Human
gaccagacaccuugacagggcaca

SEQ ID NO: 1822713 - RNA, 23 nt, Human
gaccagacaccuugacagggcac

SEQ ID NO: 1822714 - RNA, 21 nt, Human
gaccagagcugccaccugccu

SEQ ID NO: 1822715 - RNA, 20 nt, Human
gaccagcaccaucucuccuc

SEQ ID NO: 1822716 - RNA, 21 nt, Human
gaccagcaccaucucuccucc

SEQ ID NO: 1822717 - RNA, 14 nt, Human
gaccacacuccagc

SEQ ID NO: 1822718 - RNA, 16 nt, Human
gaccacacuccagcug

SEQ ID NO: 1822719 - RNA, 22 nt, Human
gaccacacuccagcugggauca

SEQ ID NO: 1822720 - RNA, 21 nt, Human
gaccaauauuguacaguuuuu

SEQ ID NO: 1822721 - RNA, 19 nt, Human
gaccaauauuguacaguuu

SEQ ID NO: 1822722 - RNA, 18 nt, Human
gaccaauauuguacaguu

SEQ ID NO: 1822723 - RNA, 17 nt, Human
gaccaauauuguacagu

SEQ ID NO: 1822724 - RNA, 18 nt, Human
gaccacaaaacuuuucua

SEQ ID NO: 1822725 - RNA, 18 nt, Human
gacaggcaagcaccuccu

SEQ ID NO: 1822726 - RNA, 17 nt, Human
gacaggcaagcaccucc

SEQ ID NO: 1822727 - RNA, 13 nt, Human
gacaggcaagcac

SEQ ID NO: 1822728 - RNA, 19 nt, Human
gacaggcaaugcuggcugu

SEQ ID NO: 1822729 - RNA, 18 nt, Human
gacaggcaaugcuggcug

SEQ ID NO: 1822730 - RNA, 21 nt, Human
gacaggcaagcaccuccugcc

SEQ ID NO: 1822731 - RNA, 20 nt, Human
gacaggcaagcaccuccugc

SEQ ID NO: 1822732 - RNA, 21 nt, Human
gacaggcauguucucugagga

SEQ ID NO: 1822733 - RNA, 20 nt, Human
gacaggcauguucucugagg

SEQ ID NO: 1822734 - RNA, 23 nt, Human
gacaggcaaugcuggcuguuggc

SEQ ID NO: 1822735 - RNA, 24 nt, Human
gacaggcaaugcuggcuguuggcu

SEQ ID NO: 1822736 - RNA, 22 nt, Human
gacaggcauguucucugaggac

SEQ ID NO: 1822737 - RNA, 14 nt, Human
gacagggcauggcc

SEQ ID NO: 1822738 - RNA, 15 nt, Human
gacagggcauggcca

SEQ ID NO: 1822739 - RNA, 20 nt, Human
gacagggcauggccaggugg

SEQ ID NO: 1822740 - RNA, 22 nt, Human
gacagggcauggccagguggcc

SEQ ID NO: 1822741 - RNA, 23 nt, Human
gacaucaacugcaucaagaugug

SEQ ID NO: 1822742 - RNA, 16 nt, Human
gacaucaacugcauca

SEQ ID NO: 1822743 - RNA, 16 nt, Human
gacagagugagacucu

SEQ ID NO: 1822744 - RNA, 21 nt, Human
gacagagucucacuguugccc

SEQ ID NO: 1822745 - RNA, 19 nt, Human
gacagagugagacucuguc

SEQ ID NO: 1822746 - RNA, 23 nt, Human
gacagaggcagccccauucugcc

SEQ ID NO: 1822747 - RNA, 13 nt, Human
gacagagggggug

SEQ ID NO: 1822748 - RNA, 12 nt, Human
gacagaggcagc

SEQ ID NO: 1822749 - RNA, 20 nt, Human
gacagagcuacacaggggaa

SEQ ID NO: 1822750 - RNA, 16 nt, Human
gacagacagcccucca

SEQ ID NO: 1822751 - RNA, 22 nt, Human
gacagacacaggcccggcucca

SEQ ID NO: 1822752 - RNA, 20 nt, Human
gacagacacaggcccggcuc

SEQ ID NO: 1822753 - RNA, 17 nt, Human
gacagacacaggcccgg

SEQ ID NO: 1822754 - RNA, 16 nt, Human
gacacuagaagauuuu

SEQ ID NO: 1822755 - RNA, 22 nt, Human
gacacgaauauugcugauggug

SEQ ID NO: 1822756 - RNA, 22 nt, Human
gaauuucccaaagcagugcaug

SEQ ID NO: 1822757 - RNA, 16 nt, Human
gaauuucccaaagcag

SEQ ID NO: 1822758 - RNA, 18 nt, Human
gaauuucccaaagcagug

SEQ ID NO: 1822759 - RNA, 20 nt, Human
cuugcuugauuguauggugg

SEQ ID NO: 1822760 - RNA, 14 nt, Human
cuuggaagcuccgc

SEQ ID NO: 1822761 - RNA, 20 nt, Human
cuuggaagcuccgcuuucua

SEQ ID NO: 1822762 - RNA, 22 nt, Human
cuugcucugcugacagacacag

SEQ ID NO: 1822763 - RNA, 19 nt, Human
cuugcucuugaugccuggc

SEQ ID NO: 1822764 - RNA, 17 nt, Human
cuugcucuugaugccug

SEQ ID NO: 1822765 - RNA, 18 nt, Human
cuugcucuugaugccugg

SEQ ID NO: 1822766 - RNA, 17 nt, Human
cuugcaugaggcuagug

SEQ ID NO: 1822767 - RNA, 13 nt, Human
cuugcaugaggcu

SEQ ID NO: 1822768 - RNA, 14 nt, Human
cuugcaugaggcua

SEQ ID NO: 1822769 - RNA, 13 nt, Human
cuugccacugccu

SEQ ID NO: 1822770 - RNA, 18 nt, Human
cuugcccuggugccucac

SEQ ID NO: 1822771 - RNA, 17 nt, Human
cuugaggguugggcugg

SEQ ID NO: 1822772 - RNA, 15 nt, Human
cuugaggguugggcu

SEQ ID NO: 1822773 - RNA, 12 nt, Human
cuugagccuggg

SEQ ID NO: 1822774 - RNA, 15 nt, Human
cuugagccugggagg

SEQ ID NO: 1822775 - RNA, 17 nt, Human
cuucuggcacuuggaga

SEQ ID NO: 1822776 - RNA, 21 nt, Human
cuugcagacucuacagaggcc

SEQ ID NO: 1822777 - RNA, 18 nt, Human
cuugcaauggcagccuug

SEQ ID NO: 1822778 - RNA, 17 nt, Human
cuugcaauggcagccuu

SEQ ID NO: 1822779 - RNA, 16 nt, Human
cuugcaauggcagccu

SEQ ID NO: 1822780 - RNA, 15 nt, Human
cuugcaauggcagcc

SEQ ID NO: 1822781 - RNA, 21 nt, Human
cuugaguugauucagcucugc

SEQ ID NO: 1822782 - RNA, 20 nt, Human
cuugaguugauucagcucug

SEQ ID NO: 1822783 - RNA, 18 nt, Human
cuugaguugauucagcuc

SEQ ID NO: 1822784 - RNA, 19 nt, Human
cuugaguugauucagcucu

SEQ ID NO: 1822785 - RNA, 22 nt, Human
cuuuaaaaaauuaaucugggcc

SEQ ID NO: 1822786 - RNA, 21 nt, Human
cuuuaaaaagcuccaaaugca

SEQ ID NO: 1822787 - RNA, 17 nt, Human
cuuuaccuuuuuuauac

SEQ ID NO: 1822788 - RNA, 20 nt, Human
cuuuaccuuuuuuauacaua

SEQ ID NO: 1822789 - RNA, 19 nt, Human
cuuuaccuuuuuuauacau

SEQ ID NO: 1822790 - RNA, 16 nt, Human
cuuguuaagauaguua

SEQ ID NO: 1822791 - RNA, 16 nt, Human
cuuguggucccacccc

SEQ ID NO: 1822792 - RNA, 19 nt, Human
cuuguggucccaccccaca

SEQ ID NO: 1822793 - RNA, 15 nt, Human
cuuguggucccaccc

SEQ ID NO: 1822794 - RNA, 15 nt, Human
cuuggggccuaugca

SEQ ID NO: 1822795 - RNA, 15 nt, Human
cuugguuuguaaauu

SEQ ID NO: 1822796 - RNA, 14 nt, Human
cuugguuuguaaau

SEQ ID NO: 1822797 - RNA, 20 nt, Human
cuugguuuguaaauuaacuu

SEQ ID NO: 1822798 - RNA, 22 nt, Human
cuuggagccaauggagacuguc

SEQ ID NO: 1822799 - RNA, 20 nt, Human
cuugggccacugugaagaga

SEQ ID NO: 1822800 - RNA, 19 nt, Human
gaaaauaacaauaaaagac

SEQ ID NO: 1822801 - RNA, 22 nt, Human
gaaaagucaaggguaggguggg

SEQ ID NO: 1822802 - RNA, 19 nt, Human
gaaaacaugcuacacacug

SEQ ID NO: 1822803 - RNA, 14 nt, Human
gaaaacguggcugc

SEQ ID NO: 1822804 - RNA, 19 nt, Human
gaaaacacuguucucugcc

SEQ ID NO: 1822805 - RNA, 18 nt, Human
gaaaacaugcuacacacu

SEQ ID NO: 1822806 - RNA, 16 nt, Human
gaaaacaugcuacaca

SEQ ID NO: 1822807 - RNA, 20 nt, Human
gaaaacacuguucucugccc

SEQ ID NO: 1822808 - RNA, 21 nt, Human
gaaaacacuguucucugcccu

SEQ ID NO: 1822809 - RNA, 16 nt, Human
cuuuuuuagaguugau

SEQ ID NO: 1822810 - RNA, 17 nt, Human
cuuuguuuuacugucuu

SEQ ID NO: 1822811 - RNA, 21 nt, Human
cuuuguuuguugucagcugaa

SEQ ID NO: 1822812 - RNA, 15 nt, Human
cuuuucuguuugcua

SEQ ID NO: 1822813 - RNA, 22 nt, Human
cuuuuguucuugguuuguaaau

SEQ ID NO: 1822814 - RNA, 12 nt, Human
cuuuggaaagac

SEQ ID NO: 1822815 - RNA, 23 nt, Human
cuuuggaaagacuuuuccaaccc

SEQ ID NO: 1822816 - RNA, 14 nt, Human
cuuugcuugaaaga

SEQ ID NO: 1822817 - RNA, 19 nt, Human
cuuugacaaagguaaauca

SEQ ID NO: 1822818 - RNA, 13 nt, Human
cuuuguggcuucc

SEQ ID NO: 1822819 - RNA, 12 nt, Human
cuuugugauuuu

SEQ ID NO: 1822820 - RNA, 19 nt, Human
cuuugugaggaagccgcug

SEQ ID NO: 1822821 - RNA, 16 nt, Human
cuuuguucuggcucuu

SEQ ID NO: 1822822 - RNA, 21 nt, Human
cuuuguucuggcucuuccagg

SEQ ID NO: 1822823 - RNA, 23 nt, Human
cuuugggaggccaaggugggagg

SEQ ID NO: 1822824 - RNA, 17 nt, Human
cuuugggccuggcuccc

SEQ ID NO: 1822825 - RNA, 23 nt, Human
cuuugugaggaagccgcuggggc

SEQ ID NO: 1822826 - RNA, 19 nt, Human
cuuuccucaaaacuucaga

SEQ ID NO: 1822827 - RNA, 13 nt, Human
cuuucugaaauaa

SEQ ID NO: 1822828 - RNA, 16 nt, Human
cuuuccucuuuggucu

SEQ ID NO: 1822829 - RNA, 15 nt, Human
cuuucugcagaaaca

SEQ ID NO: 1822830 - RNA, 16 nt, Human
cuuucuuccucugcug

SEQ ID NO: 1822831 - RNA, 19 nt, Human
cuuucuuuuuuuuuuuuga

SEQ ID NO: 1822832 - RNA, 17 nt, Human
cuuugacaaagguaaau

SEQ ID NO: 1822833 - RNA, 13 nt, Human
cuucgcuccugug

SEQ ID NO: 1822834 - RNA, 15 nt, Human
cuucgcuccuguguc

SEQ ID NO: 1822835 - RNA, 14 nt, Human
cuucgcuccugugu

SEQ ID NO: 1822836 - RNA, 16 nt, Human
cuucgcuccugugucu

SEQ ID NO: 1822837 - RNA, 17 nt, Human
cuucggccuccauccug

SEQ ID NO: 1822838 - RNA, 19 nt, Human
cuucggccuccauccugag

SEQ ID NO: 1822839 - RNA, 18 nt, Human
cuucggccuccauccuga

SEQ ID NO: 1822840 - RNA, 20 nt, Human
cuucgggaggucgaggcagg

SEQ ID NO: 1822841 - RNA, 21 nt, Human
cuucgggaggucgaggcagga

SEQ ID NO: 1822842 - RNA, 17 nt, Human
cuucugccauauucugu

SEQ ID NO: 1822843 - RNA, 15 nt, Human
cuucugccauauucu

SEQ ID NO: 1822844 - RNA, 21 nt, Human
cuucugccauauucuguuggc

SEQ ID NO: 1822845 - RNA, 20 nt, Human
cuucugccauuucugagauc

SEQ ID NO: 1822846 - RNA, 17 nt, Human
cuucugcuucagccucc

SEQ ID NO: 1822847 - RNA, 16 nt, Human
cuucugcuucagccuc

SEQ ID NO: 1822848 - RNA, 18 nt, Human
cuucugcuucagccuccc

SEQ ID NO: 1822849 - RNA, 22 nt, Human
cuucuccuucaccuuugucccc

SEQ ID NO: 1822850 - RNA, 20 nt, Human
cuucuccuuucacaaccuuc

SEQ ID NO: 1822851 - RNA, 22 nt, Human
cuucuccuuucacaaccuucug

SEQ ID NO: 1822852 - RNA, 14 nt, Human
cuucuccuuucaca

SEQ ID NO: 1822853 - RNA, 17 nt, Human
cuucuccuuucacaacc

SEQ ID NO: 1822854 - RNA, 15 nt, Human
cuucuccacccugcu

SEQ ID NO: 1822855 - RNA, 14 nt, Human
cuucuccacccugc

SEQ ID NO: 1822856 - RNA, 16 nt, Human
cuucuccacccugcuc

SEQ ID NO: 1822857 - RNA, 17 nt, Human
cuucuccaggcuguauc

SEQ ID NO: 1822858 - RNA, 18 nt, Human
cuucauuuccugugucuu

SEQ ID NO: 1822859 - RNA, 13 nt, Human
cuucagugccuua

SEQ ID NO: 1822860 - RNA, 14 nt, Human
cuucagugccuuau

SEQ ID NO: 1822861 - RNA, 11 nt, Human
cuucagugccu

SEQ ID NO: 1822862 - RNA, 12 nt, Human
cuucagugccuu

SEQ ID NO: 1822863 - RNA, 13 nt, Human
cuucauuuggaga

SEQ ID NO: 1822864 - RNA, 14 nt, Human
cuucauuuggagau

SEQ ID NO: 1822865 - RNA, 23 nt, Human
cuuccacaagagcccaggccucc

SEQ ID NO: 1822866 - RNA, 22 nt, Human
cuuccacaagagcccaggccuc

SEQ ID NO: 1822867 - RNA, 15 nt, Human
cuucaggcucuucuc

SEQ ID NO: 1822868 - RNA, 16 nt, Human
cuucaggcucuucucc

SEQ ID NO: 1822869 - RNA, 17 nt, Human
cuucaggcucuucuccu

SEQ ID NO: 1822870 - RNA, 18 nt, Human
cuucaggcucuucuccuu

SEQ ID NO: 1822871 - RNA, 14 nt, Human
cuucaggcucuucu

SEQ ID NO: 1822872 - RNA, 11 nt, Human
cuucagcugac

SEQ ID NO: 1822873 - RNA, 22 nt, Human
cuuccaggggugggacacccug

SEQ ID NO: 1822874 - RNA, 24 nt, Human
cuuccaggggugggacacccugug

SEQ ID NO: 1822875 - RNA, 14 nt, Human
cuuccagugaggcu

SEQ ID NO: 1822876 - RNA, 15 nt, Human
cuuccagugaggcuc

SEQ ID NO: 1822877 - RNA, 15 nt, Human
cuucccgcucagccc

SEQ ID NO: 1822878 - RNA, 16 nt, Human
cuucccgcucagcccu

SEQ ID NO: 1822879 - RNA, 17 nt, Human
cuucccgcucagcccuc

SEQ ID NO: 1822880 - RNA, 18 nt, Human
cuucccgcucagcccucc

SEQ ID NO: 1822881 - RNA, 16 nt, Human
cuuaucaaaggacacc

SEQ ID NO: 1822882 - RNA, 14 nt, Human
cuuaucaaaggaca

SEQ ID NO: 1822883 - RNA, 23 nt, Human
cuuaugauagcaaauggccucau

SEQ ID NO: 1822884 - RNA, 15 nt, Human
cuuauuuaaugaaag

SEQ ID NO: 1822885 - RNA, 13 nt, Human
cuuauaauuuaaa

SEQ ID NO: 1822886 - RNA, 20 nt, Human
cuuaggugauccacucgccu

SEQ ID NO: 1822887 - RNA, 17 nt, Human
cuuagguuggcaaaaag

SEQ ID NO: 1822888 - RNA, 14 nt, Human
cuuauaauuuaaaa

SEQ ID NO: 1822889 - RNA, 15 nt, Human
cuuauacauuugaua

SEQ ID NO: 1822890 - RNA, 19 nt, Human
cuuauaggaauugacccac

SEQ ID NO: 1822891 - RNA, 15 nt, Human
cuuacgugaguccug

SEQ ID NO: 1822892 - RNA, 19 nt, Human
cuuacuaguuucccuugca

SEQ ID NO: 1822893 - RNA, 16 nt, Human
cuuacuguacaugaaa

SEQ ID NO: 1822894 - RNA, 14 nt, Human
cuuacuuaguguua

SEQ ID NO: 1822895 - RNA, 15 nt, Human
cuuagaagucacaca

SEQ ID NO: 1822896 - RNA, 14 nt, Human
cuuagacagucccu

SEQ ID NO: 1822897 - RNA, 15 nt, Human
cuuagacagucccug

SEQ ID NO: 1822898 - RNA, 16 nt, Human
cuuagacagucccugc

SEQ ID NO: 1822899 - RNA, 17 nt, Human
cuuagaaauugcauuuc

SEQ ID NO: 1822900 - RNA, 15 nt, Human
cuuagaaccuuucuu

SEQ ID NO: 1822901 - RNA, 19 nt, Human
cuuagacagucccugccaa

SEQ ID NO: 1822902 - RNA, 17 nt, Human
cuuagacagucccugcc

SEQ ID NO: 1822903 - RNA, 18 nt, Human
cuuagacagucccugcca

SEQ ID NO: 1822904 - RNA, 12 nt, Human
cuguuuagauaa

SEQ ID NO: 1822905 - RNA, 17 nt, Human
cugguugaugccuguga

SEQ ID NO: 1822906 - RNA, 18 nt, Human
cuguuuguuucugaaagg

SEQ ID NO: 1822907 - RNA, 17 nt, Human
cuguuuucucuugagag

SEQ ID NO: 1822908 - RNA, 14 nt, Human
cuguuuucucuuga

SEQ ID NO: 1822909 - RNA, 21 nt, Human
cuguuuuauuuuaauucaguu

SEQ ID NO: 1822910 - RNA, 21 nt, Human
cuguuuguuucugaaagggac

SEQ ID NO: 1822911 - RNA, 23 nt, Human
cuguuuguuucugaaagggacgc

SEQ ID NO: 1822912 - RNA, 21 nt, Human
cuuaaguuaguuccacugaga

SEQ ID NO: 1822913 - RNA, 19 nt, Human
cuuaaguuaguuccacuga

SEQ ID NO: 1822914 - RNA, 16 nt, Human
cuuaaguuuauacucu

SEQ ID NO: 1822915 - RNA, 16 nt, Human
cuuaaucuaaauggaa

SEQ ID NO: 1822916 - RNA, 14 nt, Human
cuuaaucuaaaugg

SEQ ID NO: 1822917 - RNA, 18 nt, Human
cuuaaugccacuaaauug

SEQ ID NO: 1822918 - RNA, 22 nt, Human
cuuaaaugcaaccauuugaaac

SEQ ID NO: 1822919 - RNA, 22 nt, Human
cuuaacuucacauauugauuuc

SEQ ID NO: 1822920 - RNA, 17 nt, Human
cuuaacuucacauauug

SEQ ID NO: 1822921 - RNA, 16 nt, Human
cuuaacuucacauauu

SEQ ID NO: 1822922 - RNA, 15 nt, Human
cuuaacuucacauau

SEQ ID NO: 1822923 - RNA, 14 nt, Human
cuuaacuucacaua

SEQ ID NO: 1822924 - RNA, 12 nt, Human
cuuaacuucaca

SEQ ID NO: 1822925 - RNA, 21 nt, Human
cugacauuguuggccaaagcc

SEQ ID NO: 1822926 - RNA, 11 nt, Human
cugacccacug

SEQ ID NO: 1822927 - RNA, 19 nt, Human
cugacaggcaaugcuggcu

SEQ ID NO: 1822928 - RNA, 18 nt, Human
cugacaggcaaugcuggc

SEQ ID NO: 1822929 - RNA, 17 nt, Human
cugacaggcaaugcugg

SEQ ID NO: 1822930 - RNA, 16 nt, Human
cugacaggcaaugcug

SEQ ID NO: 1822931 - RNA, 20 nt, Human
cugacaggcaaugcuggcug

SEQ ID NO: 1822932 - RNA, 17 nt, Human
cugacauuguuggccaa

SEQ ID NO: 1822933 - RNA, 21 nt, Human
cugacagacacaggcccggcu

SEQ ID NO: 1822934 - RNA, 17 nt, Human
cugacagacagcccucc

SEQ ID NO: 1822935 - RNA, 19 nt, Human
cugacagacagcccuccau

SEQ ID NO: 1822936 - RNA, 11 nt, Human
cugacaggcaa

SEQ ID NO: 1822937 - RNA, 19 nt, Human
cugacagacacaggcccgg

SEQ ID NO: 1822938 - RNA, 21 nt, Human
cugaauauugccauuaugcuu

SEQ ID NO: 1822939 - RNA, 16 nt, Human
cugaagucacacagug

SEQ ID NO: 1822940 - RNA, 15 nt, Human
cugaagucacacagu

SEQ ID NO: 1822941 - RNA, 14 nt, Human
cugaagucacacag

SEQ ID NO: 1822942 - RNA, 17 nt, Human
cugaagucacugcacag

SEQ ID NO: 1822943 - RNA, 16 nt, Human
cugaagucacugcaca

SEQ ID NO: 1822944 - RNA, 22 nt, Human
cugaagucacugcacagugcau

SEQ ID NO: 1822945 - RNA, 24 nt, Human
cugaagucuuuguacagacaacaa

SEQ ID NO: 1822946 - RNA, 16 nt, Human
cugaauacagaggcaa

SEQ ID NO: 1822947 - RNA, 21 nt, Human
cugaagacucauucuucugua

SEQ ID NO: 1822948 - RNA, 15 nt, Human
cugaacuuggcgcug

SEQ ID NO: 1822949 - RNA, 16 nt, Human
cugaacuuggcgcugc

SEQ ID NO: 1822950 - RNA, 21 nt, Human
cugaacuuggcgcugccccug

SEQ ID NO: 1822951 - RNA, 21 nt, Human
cugaaccuggguaacuaggga

SEQ ID NO: 1822952 - RNA, 18 nt, Human
cucuuugggccuggcucc

SEQ ID NO: 1822953 - RNA, 19 nt, Human
cucuuuggucuacacugug

SEQ ID NO: 1822954 - RNA, 21 nt, Human
cucuuuggucuacacugugcu

SEQ ID NO: 1822955 - RNA, 12 nt, Human
cucuucuccagg

SEQ ID NO: 1822956 - RNA, 19 nt, Human
cucuucuccacuggaugga

SEQ ID NO: 1822957 - RNA, 15 nt, Human
cucuucuccacugga

SEQ ID NO: 1822958 - RNA, 17 nt, Human
cucuucuccacuggaug

SEQ ID NO: 1822959 - RNA, 14 nt, Human
cucuucuccacugg

SEQ ID NO: 1822960 - RNA, 23 nt, Human
cucuuccaggcugggagagccuu

SEQ ID NO: 1822961 - RNA, 22 nt, Human
cucuuccaggcugggagagccu

SEQ ID NO: 1822962 - RNA, 21 nt, Human
cucuuccaggcugggagagcc

SEQ ID NO: 1822963 - RNA, 13 nt, Human
cucuucuccuuuc

SEQ ID NO: 1822964 - RNA, 15 nt, Human
cucuucuccuuucac

SEQ ID NO: 1822965 - RNA, 16 nt, Human
cucuucuccuuucaca

SEQ ID NO: 1822966 - RNA, 15 nt, Human
cucuggagcccacug

SEQ ID NO: 1822967 - RNA, 17 nt, Human
cucuggcagcucagaga

SEQ ID NO: 1822968 - RNA, 18 nt, Human
cucuggcagcucagagag

SEQ ID NO: 1822969 - RNA, 20 nt, Human
cucuguucugcacacagcac

SEQ ID NO: 1822970 - RNA, 21 nt, Human
cucuguucugcacacagcacg

SEQ ID NO: 1822971 - RNA, 19 nt, Human
cucuguucugcacacagca

SEQ ID NO: 1822972 - RNA, 20 nt, Human
cucuggcagcucagagaggg

SEQ ID NO: 1822973 - RNA, 19 nt, Human
cucuggcagcucagagagg

SEQ ID NO: 1822974 - RNA, 13 nt, Human
cucuuaaaaccca

SEQ ID NO: 1822975 - RNA, 24 nt, Human
cucuuaaaacccaagugccuuagc

SEQ ID NO: 1822976 - RNA, 19 nt, Human
cucuucaguuaagccuuug

SEQ ID NO: 1822977 - RNA, 20 nt, Human
cucuucaguuaagccuuugg

SEQ ID NO: 1822978 - RNA, 23 nt, Human
cucuucaguuaagccuuuggaaa

SEQ ID NO: 1822979 - RNA, 15 nt, Human
cucuuuggacacuca

SEQ ID NO: 1822980 - RNA, 18 nt, Human
cucuuuggacacucacac

SEQ ID NO: 1822981 - RNA, 13 nt, Human
cucuuucccuccc

SEQ ID NO: 1822982 - RNA, 17 nt, Human
cucuuuccaucuacccu

SEQ ID NO: 1822983 - RNA, 15 nt, Human
cucuugaccucaggu

SEQ ID NO: 1822984 - RNA, 13 nt, Human
cucuugaccucag

SEQ ID NO: 1822985 - RNA, 16 nt, Human
cucuugaccucaggug

SEQ ID NO: 1822986 - RNA, 18 nt, Human
cucuugaacuccugaccu

SEQ ID NO: 1822987 - RNA, 18 nt, Human
cucuucuggguuccuucc

SEQ ID NO: 1822988 - RNA, 18 nt, Human
cucuugguccugcugcag

SEQ ID NO: 1822989 - RNA, 19 nt, Human
cucuugguccugcugcagu

SEQ ID NO: 1822990 - RNA, 22 nt, Human
cucucaggccagcugcuugggc

SEQ ID NO: 1822991 - RNA, 23 nt, Human
cucucaggccagcugcuugggcu

SEQ ID NO: 1822992 - RNA, 16 nt, Human
cucuccacugccuucg

SEQ ID NO: 1822993 - RNA, 21 nt, Human
cucuccauucccguggaacgu

SEQ ID NO: 1822994 - RNA, 12 nt, Human
cucuccagcccc

SEQ ID NO: 1822995 - RNA, 13 nt, Human
cucuccagccccu

SEQ ID NO: 1822996 - RNA, 13 nt, Human
cucucccaucacu

SEQ ID NO: 1822997 - RNA, 20 nt, Human
cucucccaucacuucccuac

SEQ ID NO: 1822998 - RNA, 14 nt, Human
cucucccaucacuu

SEQ ID NO: 1822999 - RNA, 18 nt, Human
cucucccaucacuucccu

SEQ ID NO: 1823000 - RNA, 13 nt, Human
cucuccccagcaa

SEQ ID NO: 1823001 - RNA, 15 nt, Human
cucuccuguaccucu

SEQ ID NO: 1823002 - RNA, 14 nt, Human
cucuccuguaccuc

SEQ ID NO: 1823003 - RNA, 13 nt, Human
cucuccuguaccu

SEQ ID NO: 1823004 - RNA, 18 nt, Human
cucuccuguaccucuuga

SEQ ID NO: 1823005 - RNA, 17 nt, Human
cucuccuguaccucuug

SEQ ID NO: 1823006 - RNA, 22 nt, Human
cucuccuguaccucuugagccu

SEQ ID NO: 1823007 - RNA, 12 nt, Human
cucucugcaggu

SEQ ID NO: 1823008 - RNA, 13 nt, Human
cucucugcagguc

SEQ ID NO: 1823009 - RNA, 14 nt, Human
cucucugcaggucc

SEQ ID NO: 1823010 - RNA, 16 nt, Human
cucucugcaggucccu

SEQ ID NO: 1823011 - RNA, 17 nt, Human
cucucugcaggucccua

SEQ ID NO: 1823012 - RNA, 19 nt, Human
cucucugcaggucccuaau

SEQ ID NO: 1823013 - RNA, 22 nt, Human
cucucugcaggucccuaauaaa

SEQ ID NO: 1823014 - RNA, 15 nt, Human
cucucucacuccuug

SEQ ID NO: 1823015 - RNA, 16 nt, Human
cucucucacuccuuga

SEQ ID NO: 1823016 - RNA, 12 nt, Human
cucucucaggcc

SEQ ID NO: 1823017 - RNA, 23 nt, Human
cucugcauacucauuaggauggc

SEQ ID NO: 1823018 - RNA, 23 nt, Human
cucugcaggucccuaauaaagcu

SEQ ID NO: 1823019 - RNA, 10 nt, Human
cucugcacaa

SEQ ID NO: 1823020 - RNA, 17 nt, Human
cucugaugaagaggagu

SEQ ID NO: 1823021 - RNA, 22 nt, Human
cucugcaagaauugaagcagga

SEQ ID NO: 1823022 - RNA, 20 nt, Human
cucugagacucgcgacaaug

SEQ ID NO: 1823023 - RNA, 12 nt, Human
cucucugcccua

SEQ ID NO: 1823024 - RNA, 13 nt, Human
cucucugcccuaa

SEQ ID NO: 1823025 - RNA, 21 nt, Human
cucucugcccuaaugcgcagg

SEQ ID NO: 1823026 - RNA, 16 nt, Human
cucugagcaaaugugg

SEQ ID NO: 1823027 - RNA, 15 nt, Human
cucugagccuuggga

SEQ ID NO: 1823028 - RNA, 14 nt, Human
cucugccuccucuu

SEQ ID NO: 1823029 - RNA, 12 nt, Human
cucugcccugcg

SEQ ID NO: 1823030 - RNA, 12 nt, Human
cucugcccuugg

SEQ ID NO: 1823031 - RNA, 23 nt, Human
cucugcccuaaugcgcaggcugg

SEQ ID NO: 1823032 - RNA, 11 nt, Human
cucugcccugc

SEQ ID NO: 1823033 - RNA, 14 nt, Human
cucugcccuccaag

SEQ ID NO: 1823034 - RNA, 15 nt, Human
cucugcccuccaaga

SEQ ID NO: 1823035 - RNA, 16 nt, Human
cucugcccuccaagac

SEQ ID NO: 1823036 - RNA, 23 nt, Human
cucugcccuccaagaccuucucc

SEQ ID NO: 1823037 - RNA, 16 nt, Human
cucugccucugacaca

SEQ ID NO: 1823038 - RNA, 14 nt, Human
cucugccucugaca

SEQ ID NO: 1823039 - RNA, 15 nt, Human
cucugccuccucuuc

SEQ ID NO: 1823040 - RNA, 16 nt, Human
cucugccuccucuuca

SEQ ID NO: 1823041 - RNA, 15 nt, Human
cucugcuuuggaaau

SEQ ID NO: 1823042 - RNA, 14 nt, Human
cucuggaauuugaa

SEQ ID NO: 1823043 - RNA, 14 nt, Human
cucuggacaggcau

SEQ ID NO: 1823044 - RNA, 12 nt, Human
cucuggagccca

SEQ ID NO: 1823045 - RNA, 14 nt, Human
cucauucuucugua

SEQ ID NO: 1823046 - RNA, 13 nt, Human
cucauucuucugu

SEQ ID NO: 1823047 - RNA, 21 nt, Human
cucauuccaccuucccaugcc

SEQ ID NO: 1823048 - RNA, 18 nt, Human
cucauuccaccuucccau

SEQ ID NO: 1823049 - RNA, 23 nt, Human
cucauucuucuguacgucugaca

SEQ ID NO: 1823050 - RNA, 13 nt, Human
cucauugaccuga

SEQ ID NO: 1823051 - RNA, 15 nt, Human
cucauugaccugagg

SEQ ID NO: 1823052 - RNA, 16 nt, Human
cucauugaccugaggc

SEQ ID NO: 1823053 - RNA, 21 nt, Human
cucaucuagguaaauuacagu

SEQ ID NO: 1823054 - RNA, 17 nt, Human
cucaucuccccaucauu

SEQ ID NO: 1823055 - RNA, 21 nt, Human
cucauuagcauuuugcuaaau

SEQ ID NO: 1823056 - RNA, 18 nt, Human
cucauuaggauggcuagu

SEQ ID NO: 1823057 - RNA, 17 nt, Human
cucauuaggauggcuag

SEQ ID NO: 1823058 - RNA, 19 nt, Human
cucauaguaugguggcugg

SEQ ID NO: 1823059 - RNA, 18 nt, Human
cucauaguaugguggcug

SEQ ID NO: 1823060 - RNA, 20 nt, Human
cucauaguaugguggcuggg

SEQ ID NO: 1823061 - RNA, 19 nt, Human
cucaggugucccugcacuu

SEQ ID NO: 1823062 - RNA, 14 nt, Human
cucaggugagaagc

SEQ ID NO: 1823063 - RNA, 18 nt, Human
cucaggugucccugcacu

SEQ ID NO: 1823064 - RNA, 17 nt, Human
cucaggugucccugcac

SEQ ID NO: 1823065 - RNA, 16 nt, Human
cucaggugucccugca

SEQ ID NO: 1823066 - RNA, 15 nt, Human
cucaggugucccugc

SEQ ID NO: 1823067 - RNA, 22 nt, Human
cucagguggggucacucuggca

SEQ ID NO: 1823068 - RNA, 23 nt, Human
cucagguggggucacucuggcag

SEQ ID NO: 1823069 - RNA, 15 nt, Human
cucaggucuguuuuc

SEQ ID NO: 1823070 - RNA, 17 nt, Human
cucaggucccugcaggg

SEQ ID NO: 1823071 - RNA, 18 nt, Human
cucaggucccugcagggc

SEQ ID NO: 1823072 - RNA, 14 nt, Human
cucagggucccugg

SEQ ID NO: 1823073 - RNA, 23 nt, Human
cuaaaagguaugcaaucaaaucu

SEQ ID NO: 1823074 - RNA, 12 nt, Human
cucagggucccu

SEQ ID NO: 1823075 - RNA, 11 nt, Human
cuccaggcucc

SEQ ID NO: 1823076 - RNA, 21 nt, Human
cuccauccugaggcuccacuu

SEQ ID NO: 1823077 - RNA, 18 nt, Human
cuccaucuaaacugcccc

SEQ ID NO: 1823078 - RNA, 13 nt, Human
cuccaucuccacu

SEQ ID NO: 1823079 - RNA, 20 nt, Human
cuccaucgcugucaucucag

SEQ ID NO: 1823080 - RNA, 17 nt, Human
cuccaucuaaacugccc

SEQ ID NO: 1823081 - RNA, 23 nt, Human
cuccauccugaggcuccacuugg

SEQ ID NO: 1823082 - RNA, 18 nt, Human
cuccagcuguucagcugg

SEQ ID NO: 1823083 - RNA, 19 nt, Human
cuccagcuguucagcuggu

SEQ ID NO: 1823084 - RNA, 19 nt, Human
cuccagcuggguuggaaaa

SEQ ID NO: 1823085 - RNA, 13 nt, Human
cuccagcuguuca

SEQ ID NO: 1823086 - RNA, 15 nt, Human
cucccaggcauuccc

SEQ ID NO: 1823087 - RNA, 21 nt, Human
cucccaaggggcccaaauucu

SEQ ID NO: 1823088 - RNA, 22 nt, Human
cucccaaggggcccaaauucuu

SEQ ID NO: 1823089 - RNA, 14 nt, Human
cuccaugugggcua

SEQ ID NO: 1823090 - RNA, 24 nt, Human
cuccauucccguggaacguuuuuc

SEQ ID NO: 1823091 - RNA, 17 nt, Human
cucccaggcauucccca

SEQ ID NO: 1823092 - RNA, 19 nt, Human
cucccaggcauuccccagg

SEQ ID NO: 1823093 - RNA, 20 nt, Human
cucccaggcauuccccagga

SEQ ID NO: 1823094 - RNA, 21 nt, Human
cucccaggcauuccccaggag

SEQ ID NO: 1823095 - RNA, 22 nt, Human
cucccaggcauuccccaggagg

SEQ ID NO: 1823096 - RNA, 14 nt, Human
cucccaggcgcccc

SEQ ID NO: 1823097 - RNA, 12 nt, Human
cuccacccugcu

SEQ ID NO: 1823098 - RNA, 18 nt, Human
cuccaccugccagggaca

SEQ ID NO: 1823099 - RNA, 21 nt, Human
cuccaccugccagggacagag

SEQ ID NO: 1823100 - RNA, 17 nt, Human
cuccaccugccagggac

SEQ ID NO: 1823101 - RNA, 15 nt, Human
cuccaccugccaggg

SEQ ID NO: 1823102 - RNA, 11 nt, Human
cuccacccugc

SEQ ID NO: 1823103 - RNA, 20 nt, Human
cuccacauauuucagugagg

SEQ ID NO: 1823104 - RNA, 20 nt, Human
cuccagcucaccagccccag

SEQ ID NO: 1823105 - RNA, 19 nt, Human
cuccagcucaccagcccca

SEQ ID NO: 1823106 - RNA, 11 nt, Human
cuccacugccu

SEQ ID NO: 1823107 - RNA, 15 nt, Human
cuccagaccccuggc

SEQ ID NO: 1823108 - RNA, 17 nt, Human
cuccagaccccuggcuu

SEQ ID NO: 1823109 - RNA, 18 nt, Human
cuccagaccccuggcuuu

SEQ ID NO: 1823110 - RNA, 19 nt, Human
cuccagaccccuggcuuuu

SEQ ID NO: 1823111 - RNA, 20 nt, Human
cuccagaccccuggcuuuuc

SEQ ID NO: 1823112 - RNA, 20 nt, Human
cucgaguuacagacaaagcg

SEQ ID NO: 1823113 - RNA, 16 nt, Human
cucgaguuacagacaa

SEQ ID NO: 1823114 - RNA, 17 nt, Human
cucgagguuucucaaag

SEQ ID NO: 1823115 - RNA, 13 nt, Human
cucgcgacaaugc

SEQ ID NO: 1823116 - RNA, 19 nt, Human
cucgcuauugucaccaggg

SEQ ID NO: 1823117 - RNA, 15 nt, Human
cucgcgacaaugcaa

SEQ ID NO: 1823118 - RNA, 23 nt, Human
cucggccucccaaagugcuggga

SEQ ID NO: 1823119 - RNA, 22 nt, Human
cucggccucccaaagugcuggg

SEQ ID NO: 1823120 - RNA, 15 nt, Human
cucuaacaguggaca

SEQ ID NO: 1823121 - RNA, 19 nt, Human
cucuaacaguggacaaagu

SEQ ID NO: 1823122 - RNA, 22 nt, Human
cucuaaagucuguugauuaaag

SEQ ID NO: 1823123 - RNA, 22 nt, Human
cucgcuauugucaccagggcug

SEQ ID NO: 1823124 - RNA, 21 nt, Human
cucgcuauugucaccagggcu

SEQ ID NO: 1823125 - RNA, 18 nt, Human
cucggacuuagcugggag

SEQ ID NO: 1823126 - RNA, 19 nt, Human
cucggacuuagcugggaga

SEQ ID NO: 1823127 - RNA, 20 nt, Human
cuccuucuguccuacucugu

SEQ ID NO: 1823128 - RNA, 15 nt, Human
cuccuucuguccuac

SEQ ID NO: 1823129 - RNA, 14 nt, Human
cuccuucuguccua

SEQ ID NO: 1823130 - RNA, 11 nt, Human
cuccuucuucc

SEQ ID NO: 1823131 - RNA, 21 nt, Human
cuccuugaaaacacuguucuc

SEQ ID NO: 1823132 - RNA, 11 nt, Human
cuccugugugu

SEQ ID NO: 1823133 - RNA, 23 nt, Human
cuccugugucuugcaauggcagc

SEQ ID NO: 1823134 - RNA, 15 nt, Human
cuccugugucuugca

SEQ ID NO: 1823135 - RNA, 11 nt, Human
cuccugccacc

SEQ ID NO: 1823136 - RNA, 22 nt, Human
cuccugcaggcagccaggccac

SEQ ID NO: 1823137 - RNA, 15 nt, Human
cuccugcaggcagcc

SEQ ID NO: 1823138 - RNA, 21 nt, Human
cuccugcaggcagccaggcca

SEQ ID NO: 1823139 - RNA, 14 nt, Human
cuccugugugugcg

SEQ ID NO: 1823140 - RNA, 14 nt, Human
cuccuucaccuuug

SEQ ID NO: 1823141 - RNA, 16 nt, Human
cuccuucaccuuuguc

SEQ ID NO: 1823142 - RNA, 19 nt, Human
cuccuucaccuuugucccc

SEQ ID NO: 1823143 - RNA, 21 nt, Human
cuccuucaccuuuguccccac

SEQ ID NO: 1823144 - RNA, 22 nt, Human
cuccuaucagaaguuucucagc

SEQ ID NO: 1823145 - RNA, 12 nt, Human
cuccucagaucu

SEQ ID NO: 1823146 - RNA, 14 nt, Human
cuccucagaucuuc

SEQ ID NO: 1823147 - RNA, 19 nt, Human
cuccucuugccacugccuc

SEQ ID NO: 1823148 - RNA, 14 nt, Human
cuccugaccucagg

SEQ ID NO: 1823149 - RNA, 14 nt, Human
cuccugaccuuagg

SEQ ID NO: 1823150 - RNA, 21 nt, Human
cuccugaguagcuggauuaca

SEQ ID NO: 1823151 - RNA, 17 nt, Human
cuccugaguagcuggga

SEQ ID NO: 1823152 - RNA, 22 nt, Human
cuccugaguagcugggauuaca

SEQ ID NO: 1823153 - RNA, 13 nt, Human
cuccugcaggcag

SEQ ID NO: 1823154 - RNA, 14 nt, Human
cuccugcaggcagc

SEQ ID NO: 1823155 - RNA, 16 nt, Human
cucccuucucuucaca

SEQ ID NO: 1823156 - RNA, 14 nt, Human
cucccuuccucuuu

SEQ ID NO: 1823157 - RNA, 13 nt, Human
cucccuuccucuu

SEQ ID NO: 1823158 - RNA, 17 nt, Human
cucccuuucuucccuac

SEQ ID NO: 1823159 - RNA, 17 nt, Human
cucccuuggauuguccc

SEQ ID NO: 1823160 - RNA, 20 nt, Human
cucccuuggauuguccccga

SEQ ID NO: 1823161 - RNA, 13 nt, Human
cucccuuucaaca

SEQ ID NO: 1823162 - RNA, 12 nt, Human
cucccuucaacc

SEQ ID NO: 1823163 - RNA, 18 nt, Human
cucccuucaaccauuccc

SEQ ID NO: 1823164 - RNA, 19 nt, Human
cucccuucaaccauucccc

SEQ ID NO: 1823165 - RNA, 20 nt, Human
cucccuucaaccauucccca

SEQ ID NO: 1823166 - RNA, 10 nt, Human
cucccuuccu

SEQ ID NO: 1823167 - RNA, 23 nt, Human
cucccuucccaccucucucacuc

SEQ ID NO: 1823168 - RNA, 14 nt, Human
cucccaucacccgc

SEQ ID NO: 1823169 - RNA, 14 nt, Human
cucccaucucacac

SEQ ID NO: 1823170 - RNA, 21 nt, Human
cucccaucucacacaugagca

SEQ ID NO: 1823171 - RNA, 15 nt, Human
cucccaucucacaca

SEQ ID NO: 1823172 - RNA, 18 nt, Human
cucccaucucacacauga

SEQ ID NO: 1823173 - RNA, 23 nt, Human
cuggaauaauccuaaacauauga

SEQ ID NO: 1823174 - RNA, 21 nt, Human
cuggaagugcuaauuuugaaa

SEQ ID NO: 1823175 - RNA, 18 nt, Human
cuggaagcacagcuucau

SEQ ID NO: 1823176 - RNA, 15 nt, Human
cuggaagcacagcuu

SEQ ID NO: 1823177 - RNA, 15 nt, Human
cuggaaugcaguggu

SEQ ID NO: 1823178 - RNA, 14 nt, Human
cuggaaugcagugg

SEQ ID NO: 1823179 - RNA, 21 nt, Human
cugcuuugggcugcccuggug

SEQ ID NO: 1823180 - RNA, 22 nt, Human
cugcuuugggcugcccuggugc

SEQ ID NO: 1823181 - RNA, 23 nt, Human
cugcuuugggcugcccuggugcu

SEQ ID NO: 1823182 - RNA, 19 nt, Human
cugcuuugggcugcccugg

SEQ ID NO: 1823183 - RNA, 20 nt, Human
cugcuuugggcugcccuggu

SEQ ID NO: 1823184 - RNA, 18 nt, Human
cugcuuugggcugcccug

SEQ ID NO: 1823185 - RNA, 12 nt, Human
cugcucugauga

SEQ ID NO: 1823186 - RNA, 21 nt, Human
cuggagcccacuguacuugcu

SEQ ID NO: 1823187 - RNA, 13 nt, Human
cuggagcccacug

SEQ ID NO: 1823188 - RNA, 15 nt, Human
cuggagcccacugua

SEQ ID NO: 1823189 - RNA, 16 nt, Human
cuggagcccacuguac

SEQ ID NO: 1823190 - RNA, 17 nt, Human
cuggagcccacuguacu

SEQ ID NO: 1823191 - RNA, 20 nt, Human
cuggagcccacuguacuugc

SEQ ID NO: 1823192 - RNA, 16 nt, Human
cuggacucaccucccc

SEQ ID NO: 1823193 - RNA, 21 nt, Human
cuggauggaggaaaaccaagc

SEQ ID NO: 1823194 - RNA, 15 nt, Human
cuggauggggcugca

SEQ ID NO: 1823195 - RNA, 15 nt, Human
cuggauguaccacca

SEQ ID NO: 1823196 - RNA, 16 nt, Human
cuggauggggcugcac

SEQ ID NO: 1823197 - RNA, 23 nt, Human
cuggauuaaacuuaaucuaaaug

SEQ ID NO: 1823198 - RNA, 13 nt, Human
cuggauuaaacuu

SEQ ID NO: 1823199 - RNA, 23 nt, Human
cuggauuauucaaaaugauguau

SEQ ID NO: 1823200 - RNA, 17 nt, Human
cuggauuauauuaugaa

SEQ ID NO: 1823201 - RNA, 17 nt, Human
cuggcacagggcagugg

SEQ ID NO: 1823202 - RNA, 13 nt, Human
cuggcacugcuuc

SEQ ID NO: 1823203 - RNA, 14 nt, Human
cuggcacugcuucc

SEQ ID NO: 1823204 - RNA, 23 nt, Human
cuggcacuauaauguaagcucua

SEQ ID NO: 1823205 - RNA, 16 nt, Human
cuggccagaugcacca

SEQ ID NO: 1823206 - RNA, 16 nt, Human
cuggccaacgggguga

SEQ ID NO: 1823207 - RNA, 15 nt, Human
cuggcacugcuucca

SEQ ID NO: 1823208 - RNA, 16 nt, Human
cuggcacugcuuccag

SEQ ID NO: 1823209 - RNA, 17 nt, Human
cuggcacugcuuccagu

SEQ ID NO: 1823210 - RNA, 18 nt, Human
cuggcacugcuuccagug

SEQ ID NO: 1823211 - RNA, 20 nt, Human
cuggccagaugcaccagccc

SEQ ID NO: 1823212 - RNA, 19 nt, Human
cuggccagaugcaccagcc

SEQ ID NO: 1823213 - RNA, 18 nt, Human
cuggccagaugcaccagc

SEQ ID NO: 1823214 - RNA, 17 nt, Human
cuggccagaugcaccag

SEQ ID NO: 1823215 - RNA, 21 nt, Human
cuggccagaugcaccagcccu

SEQ ID NO: 1823216 - RNA, 22 nt, Human
cuggccagaugcaccagcccuu

SEQ ID NO: 1823217 - RNA, 22 nt, Human
cuggccucaagugauucuccug

SEQ ID NO: 1823218 - RNA, 23 nt, Human
cuggccuagcauacguacacauu

SEQ ID NO: 1823219 - RNA, 12 nt, Human
cuggcccacugc

SEQ ID NO: 1823220 - RNA, 13 nt, Human
cuggcccacugca

SEQ ID NO: 1823221 - RNA, 17 nt, Human
cuggccuagcauacgua

SEQ ID NO: 1823222 - RNA, 18 nt, Human
cuggucccacucagucca

SEQ ID NO: 1823223 - RNA, 15 nt, Human
cuggucccacucagu

SEQ ID NO: 1823224 - RNA, 18 nt, Human
cugguccauagagagcaa

SEQ ID NO: 1823225 - RNA, 21 nt, Human
cugguccauagagagcaagac

SEQ ID NO: 1823226 - RNA, 19 nt, Human
cuggguucuacccaggugc

SEQ ID NO: 1823227 - RNA, 13 nt, Human
cuggguuggaggg

SEQ ID NO: 1823228 - RNA, 13 nt, Human
cuggguuggaaaa

SEQ ID NO: 1823229 - RNA, 18 nt, Human
cuggguuggaaaacagua

SEQ ID NO: 1823230 - RNA, 15 nt, Human
cugguccauagagag

SEQ ID NO: 1823231 - RNA, 17 nt, Human
cugguccauagagagca

SEQ ID NO: 1823232 - RNA, 23 nt, Human
cugguggcagugggagcugccug

SEQ ID NO: 1823233 - RNA, 19 nt, Human
cugguggcagugggagcug

SEQ ID NO: 1823234 - RNA, 18 nt, Human
cuggucucaaacuccuga

SEQ ID NO: 1823235 - RNA, 19 nt, Human
cugggcucccuucccaccu

SEQ ID NO: 1823236 - RNA, 21 nt, Human
cugggcuuggggaccagagcu

SEQ ID NO: 1823237 - RNA, 17 nt, Human
cugggcuuggggaccag

SEQ ID NO: 1823238 - RNA, 20 nt, Human
cugggcuuggggaccagagc

SEQ ID NO: 1823239 - RNA, 23 nt, Human
cugggcuucaguggcagcugcuu

SEQ ID NO: 1823240 - RNA, 13 nt, Human
cugggcuugggga

SEQ ID NO: 1823241 - RNA, 22 nt, Human
cugggcuucaguggcagcugcu

SEQ ID NO: 1823242 - RNA, 21 nt, Human
cugggcuucaguggcagcugc

SEQ ID NO: 1823243 - RNA, 20 nt, Human
cugggcuucaguggcagcug

SEQ ID NO: 1823244 - RNA, 19 nt, Human
cugggcuucaguggcagcu

SEQ ID NO: 1823245 - RNA, 17 nt, Human
cugggcuucaguggcag

SEQ ID NO: 1823246 - RNA, 18 nt, Human
cugggcuucaguggcagc

SEQ ID NO: 1823247 - RNA, 18 nt, Human
cugggggccucagugcca

SEQ ID NO: 1823248 - RNA, 17 nt, Human
cugggggccucagugcc

SEQ ID NO: 1823249 - RNA, 13 nt, Human
cugggggccucag

SEQ ID NO: 1823250 - RNA, 17 nt, Human
cugggguggggaccuca

SEQ ID NO: 1823251 - RNA, 18 nt, Human
cugggguggggaccucag

SEQ ID NO: 1823252 - RNA, 19 nt, Human
cugggguggggaccucagg

SEQ ID NO: 1823253 - RNA, 20 nt, Human
cuggguacuuguggacacag

SEQ ID NO: 1823254 - RNA, 23 nt, Human
cugggguggggaccucaggccug

SEQ ID NO: 1823255 - RNA, 21 nt, Human
cugggguggggaccucaggcc

SEQ ID NO: 1823256 - RNA, 22 nt, Human
cugggguggggaccucaggccu

SEQ ID NO: 1823257 - RNA, 23 nt, Human
cuggguacuuguggacacagcuc

SEQ ID NO: 1823258 - RNA, 21 nt, Human
cuggguacuuguggacacagc

SEQ ID NO: 1823259 - RNA, 18 nt, Human
cugggaggucaaggcugc

SEQ ID NO: 1823260 - RNA, 14 nt, Human
cugggaggcaguga

SEQ ID NO: 1823261 - RNA, 16 nt, Human
cugggaggcagugaug

SEQ ID NO: 1823262 - RNA, 15 nt, Human
cugggaggcucugga

SEQ ID NO: 1823263 - RNA, 16 nt, Human
cugggaggcucuggag

SEQ ID NO: 1823264 - RNA, 13 nt, Human
cugggagcucugc

SEQ ID NO: 1823265 - RNA, 14 nt, Human
cugggagcucugca

SEQ ID NO: 1823266 - RNA, 15 nt, Human
cugggagcucugcag

SEQ ID NO: 1823267 - RNA, 13 nt, Human
cugggagugagcu

SEQ ID NO: 1823268 - RNA, 16 nt, Human
cugggagugagcuggu

SEQ ID NO: 1823269 - RNA, 19 nt, Human
cugggauuacaggcuccug

SEQ ID NO: 1823270 - RNA, 20 nt, Human
cugggauuacaggcuccugc

SEQ ID NO: 1823271 - RNA, 21 nt, Human
cugggauuacaggcgugagcc

SEQ ID NO: 1823272 - RNA, 21 nt, Human
cugggauuacaggcuccugcc

SEQ ID NO: 1823273 - RNA, 22 nt, Human
cugggauuacaggcuccugcca

SEQ ID NO: 1823274 - RNA, 23 nt, Human
cugggauuacaggcuccugccac

SEQ ID NO: 1823275 - RNA, 12 nt, Human
cugggccccugc

SEQ ID NO: 1823276 - RNA, 16 nt, Human
cugggccccugccucu

SEQ ID NO: 1823277 - RNA, 17 nt, Human
cugggccccugccucuc

SEQ ID NO: 1823278 - RNA, 10 nt, Human
cugggccccu

SEQ ID NO: 1823279 - RNA, 20 nt, Human
cugggcaaugugauaaaacc

SEQ ID NO: 1823280 - RNA, 15 nt, Human
cuggccugagcuggg

SEQ ID NO: 1823281 - RNA, 17 nt, Human
cuggcucuuccaggcug

SEQ ID NO: 1823282 - RNA, 13 nt, Human
cuggccugagcug

SEQ ID NO: 1823283 - RNA, 20 nt, Human
cuggcucuuccaggcuggga

SEQ ID NO: 1823284 - RNA, 18 nt, Human
cuggcucuuccaggcugg

SEQ ID NO: 1823285 - RNA, 19 nt, Human
cuggcucuuccaggcuggg

SEQ ID NO: 1823286 - RNA, 14 nt, Human
cuggcugccuuaga

SEQ ID NO: 1823287 - RNA, 19 nt, Human
cuggcugccuuagaaccuu

SEQ ID NO: 1823288 - RNA, 19 nt, Human
cuggcuguuggcugggggc

SEQ ID NO: 1823289 - RNA, 22 nt, Human
cuggcuggguggcaccagcagc

SEQ ID NO: 1823290 - RNA, 21 nt, Human
cuggcuggguggcaccagcag

SEQ ID NO: 1823291 - RNA, 20 nt, Human
cuggcuguuggcugggggcc

SEQ ID NO: 1823292 - RNA, 14 nt, Human
cuggcuucacagau

SEQ ID NO: 1823293 - RNA, 15 nt, Human
cuggcuuuucacugc

SEQ ID NO: 1823294 - RNA, 16 nt, Human
cuggcuuuucacugcu

SEQ ID NO: 1823295 - RNA, 19 nt, Human
cugggaacaccauagguca

SEQ ID NO: 1823296 - RNA, 17 nt, Human
cuggcuuuucacugcug

SEQ ID NO: 1823297 - RNA, 19 nt, Human
cuggcuuuucacugcuggc

SEQ ID NO: 1823298 - RNA, 20 nt, Human
cuggcuuuucacugcuggcu

SEQ ID NO: 1823299 - RNA, 22 nt, Human
cuggcuuuucacugcuggcugc

SEQ ID NO: 1823300 - RNA, 15 nt, Human
cugauucccaagcuc

SEQ ID NO: 1823301 - RNA, 18 nt, Human
cugauucccaagcucugc

SEQ ID NO: 1823302 - RNA, 17 nt, Human
cugauucccaagcucug

SEQ ID NO: 1823303 - RNA, 20 nt, Human
cugauucccaagcucugcuc

SEQ ID NO: 1823304 - RNA, 19 nt, Human
cugauucccaagcucugcu

SEQ ID NO: 1823305 - RNA, 22 nt, Human
cugauucccaagcucugcuccu

SEQ ID NO: 1823306 - RNA, 14 nt, Human
cugaucucucguga

SEQ ID NO: 1823307 - RNA, 21 nt, Human
cugauaaagaugagugagcau

SEQ ID NO: 1823308 - RNA, 13 nt, Human
cugauaaagauga

SEQ ID NO: 1823309 - RNA, 22 nt, Human
cugagugggggaucacagccuc

SEQ ID NO: 1823310 - RNA, 15 nt, Human
cugagugccuuuugg

SEQ ID NO: 1823311 - RNA, 16 nt, Human
cugagugccuuuuggu

SEQ ID NO: 1823312 - RNA, 14 nt, Human
cugagugccuuuug

SEQ ID NO: 1823313 - RNA, 17 nt, Human
cugagucugaaggcugg

SEQ ID NO: 1823314 - RNA, 13 nt, Human
cugagucugaagg

SEQ ID NO: 1823315 - RNA, 14 nt, Human
cugagucugaaggc

SEQ ID NO: 1823316 - RNA, 15 nt, Human
cugagucugaaggcu

SEQ ID NO: 1823317 - RNA, 16 nt, Human
cugagucugaaggcug

SEQ ID NO: 1823318 - RNA, 12 nt, Human
cugacccacugc

SEQ ID NO: 1823319 - RNA, 21 nt, Human
cugcacaaagcccuuccaugu

SEQ ID NO: 1823320 - RNA, 18 nt, Human
cugcacaaagcccuucca

SEQ ID NO: 1823321 - RNA, 20 nt, Human
cugcacaaagcccuuccaug

SEQ ID NO: 1823322 - RNA, 13 nt, Human
cugcacaaagccc

SEQ ID NO: 1823323 - RNA, 18 nt, Human
cugcacagugcaucucag

SEQ ID NO: 1823324 - RNA, 18 nt, Human
cugcacaagcugcacccu

SEQ ID NO: 1823325 - RNA, 13 nt, Human
cugcacaagcugc

SEQ ID NO: 1823326 - RNA, 14 nt, Human
cugcacaagcugca

SEQ ID NO: 1823327 - RNA, 15 nt, Human
cugcacaagcugcac

SEQ ID NO: 1823328 - RNA, 16 nt, Human
cugcacaagcugcacc

SEQ ID NO: 1823329 - RNA, 17 nt, Human
cugcacccucaggcagg

SEQ ID NO: 1823330 - RNA, 18 nt, Human
cugcacccucaggcaggu

SEQ ID NO: 1823331 - RNA, 21 nt, Human
cugcacagugcaucucagccc

SEQ ID NO: 1823332 - RNA, 22 nt, Human
cugcacagugcaucucagccca

SEQ ID NO: 1823333 - RNA, 23 nt, Human
cugcagaagacaguauggcagcu

SEQ ID NO: 1823334 - RNA, 13 nt, Human
cugcagaagacag

SEQ ID NO: 1823335 - RNA, 20 nt, Human
cugcagagcaggaaacauga

SEQ ID NO: 1823336 - RNA, 17 nt, Human
cugcacuugcagacucu

SEQ ID NO: 1823337 - RNA, 16 nt, Human
cugcacuugcagacuc

SEQ ID NO: 1823338 - RNA, 14 nt, Human
cugcacuugcagac

SEQ ID NO: 1823339 - RNA, 17 nt, Human
cugcaccggcuggccug

SEQ ID NO: 1823340 - RNA, 18 nt, Human
cugcaccggcuggccugg

SEQ ID NO: 1823341 - RNA, 19 nt, Human
cugcaccggcuggccuggc

SEQ ID NO: 1823342 - RNA, 20 nt, Human
cugcaccggcuggccuggcc

SEQ ID NO: 1823343 - RNA, 11 nt, Human
cugcagccuca

SEQ ID NO: 1823344 - RNA, 20 nt, Human
cugcagccucaaccuccugg

SEQ ID NO: 1823345 - RNA, 19 nt, Human
cugcagccucaaccuccug

SEQ ID NO: 1823346 - RNA, 22 nt, Human
cugcagccucaaccuccugggc

SEQ ID NO: 1823347 - RNA, 22 nt, Human
cugcagggaguccgaaagggac

SEQ ID NO: 1823348 - RNA, 16 nt, Human
cugcagggccaagcac

SEQ ID NO: 1823349 - RNA, 15 nt, Human
cugcagggacugcca

SEQ ID NO: 1823350 - RNA, 17 nt, Human
cugcagggacugccagu

SEQ ID NO: 1823351 - RNA, 13 nt, Human
cugccucagccuc

SEQ ID NO: 1823352 - RNA, 14 nt, Human
cugccucagccucc

SEQ ID NO: 1823353 - RNA, 12 nt, Human
cugcccugggag

SEQ ID NO: 1823354 - RNA, 13 nt, Human
cugcccugggagg

SEQ ID NO: 1823355 - RNA, 11 nt, Human
cugcccuggga

SEQ ID NO: 1823356 - RNA, 15 nt, Human
cugcccugggaggca

SEQ ID NO: 1823357 - RNA, 22 nt, Human
cugcccugggaggcagugaugg

SEQ ID NO: 1823358 - RNA, 13 nt, Human
cugccuauuuuaa

SEQ ID NO: 1823359 - RNA, 15 nt, Human
cugccuaagugcagc

SEQ ID NO: 1823360 - RNA, 15 nt, Human
cugccugcccaggcc

SEQ ID NO: 1823361 - RNA, 14 nt, Human
cugccugcccaggc

SEQ ID NO: 1823362 - RNA, 13 nt, Human
cugccugcccagg

SEQ ID NO: 1823363 - RNA, 12 nt, Human
cugccucucugc

SEQ ID NO: 1823364 - RNA, 13 nt, Human
cugccucucugca

SEQ ID NO: 1823365 - RNA, 14 nt, Human
cugccucucugcag

SEQ ID NO: 1823366 - RNA, 12 nt, Human
cugccucuuccu

SEQ ID NO: 1823367 - RNA, 13 nt, Human
cugccucuucucu

SEQ ID NO: 1823368 - RNA, 14 nt, Human
cugccucuucucua

SEQ ID NO: 1823369 - RNA, 18 nt, Human
cugcuccucuccccagca

SEQ ID NO: 1823370 - RNA, 17 nt, Human
cugcuccucuccccagc

SEQ ID NO: 1823371 - RNA, 16 nt, Human
cugcuccucuccccag

SEQ ID NO: 1823372 - RNA, 19 nt, Human
cugcuccccuaaagccuca

SEQ ID NO: 1823373 - RNA, 15 nt, Human
cugcuccagcuguuc

SEQ ID NO: 1823374 - RNA, 14 nt, Human
cugcuccagcuguu

SEQ ID NO: 1823375 - RNA, 16 nt, Human
cugcgguccacccagg

SEQ ID NO: 1823376 - RNA, 17 nt, Human
cugcgguccacccagga

SEQ ID NO: 1823377 - RNA, 21 nt, Human
cugcggaaugaaccacaucuu

SEQ ID NO: 1823378 - RNA, 15 nt, Human
cugcgguccacccag

SEQ ID NO: 1823379 - RNA, 20 nt, Human
cugcggaaugaaccacaucu

SEQ ID NO: 1823380 - RNA, 20 nt, Human
cugccacccuggggagaaag

SEQ ID NO: 1823381 - RNA, 16 nt, Human
cugccacccuggggag

SEQ ID NO: 1823382 - RNA, 15 nt, Human
cugccacccugggga

SEQ ID NO: 1823383 - RNA, 19 nt, Human
cugccaccacgcccggcua

SEQ ID NO: 1823384 - RNA, 13 nt, Human
cugccacacuuca

SEQ ID NO: 1823385 - RNA, 17 nt, Human
cugccacacuucaggcu

SEQ ID NO: 1823386 - RNA, 22 nt, Human
cugccacacuucaggcucuucu

SEQ ID NO: 1823387 - RNA, 17 nt, Human
cugccaugccagcuuau

SEQ ID NO: 1823388 - RNA, 19 nt, Human
cugccaugccagcuuaucu

SEQ ID NO: 1823389 - RNA, 19 nt, Human
cugccagccgagauagcca

SEQ ID NO: 1823390 - RNA, 15 nt, Human
cugccaggaagccag

SEQ ID NO: 1823391 - RNA, 16 nt, Human
cugccaggaagccagc

SEQ ID NO: 1823392 - RNA, 18 nt, Human
cugccaggaagccagcag

SEQ ID NO: 1823393 - RNA, 19 nt, Human
cugccaggaagccagcagg

SEQ ID NO: 1823394 - RNA, 16 nt, Human
cugccauuucugagau

SEQ ID NO: 1823395 - RNA, 17 nt, Human
cugcccaaccugcucuc

SEQ ID NO: 1823396 - RNA, 13 nt, Human
cugcccaggcccc

SEQ ID NO: 1823397 - RNA, 19 nt, Human
cugcccaaccugcucuccu

SEQ ID NO: 1823398 - RNA, 19 nt, Human
cugcccaggccugccuguu

SEQ ID NO: 1823399 - RNA, 18 nt, Human
cugcccaggccugccugu

SEQ ID NO: 1823400 - RNA, 14 nt, Human
cugccccuggcagc

SEQ ID NO: 1823401 - RNA, 15 nt, Human
cugccccuggcagcc

SEQ ID NO: 1823402 - RNA, 16 nt, Human
cugccccuggcagccc

SEQ ID NO: 1823403 - RNA, 17 nt, Human
cugccccuggcagcccc

SEQ ID NO: 1823404 - RNA, 15 nt, Human
cugcccggcugcgga

SEQ ID NO: 1823405 - RNA, 19 nt, Human
cugcccuccaagaccuucu

SEQ ID NO: 1823406 - RNA, 11 nt, Human
cugcccggcug

SEQ ID NO: 1823407 - RNA, 13 nt, Human
cugcccugcccac

SEQ ID NO: 1823408 - RNA, 14 nt, Human
cugcccugcccacc

SEQ ID NO: 1823409 - RNA, 15 nt, Human
cugcccugcccaccu

SEQ ID NO: 1823410 - RNA, 16 nt, Human
cugcccugcccaccug

SEQ ID NO: 1823411 - RNA, 17 nt, Human
ccucacaguccuuacca

SEQ ID NO: 1823412 - RNA, 17 nt, Human
ccuaucagaaguuucuc

SEQ ID NO: 1823413 - RNA, 15 nt, Human
ccucaccccacugug

SEQ ID NO: 1823414 - RNA, 20 nt, Human
ccucacaguccuuaccagca

SEQ ID NO: 1823415 - RNA, 22 nt, Human
ccucacaguccuuaccagcaga

SEQ ID NO: 1823416 - RNA, 12 nt, Human
ccucaccccacu

SEQ ID NO: 1823417 - RNA, 17 nt, Human
ccucaccuuucccaucu

SEQ ID NO: 1823418 - RNA, 15 nt, Human
ccgggcacucagaag

SEQ ID NO: 1823419 - RNA, 13 nt, Human
ccggcuggccugg

SEQ ID NO: 1823420 - RNA, 22 nt, Human
ccgggaggcagagguugcagug

SEQ ID NO: 1823421 - RNA, 12 nt, Human
ccggcugcccuu

SEQ ID NO: 1823422 - RNA, 12 nt, Human
ccggcuggccug

SEQ ID NO: 1823423 - RNA, 20 nt, Human
ccgggcacucagaagacacu

SEQ ID NO: 1823424 - RNA, 19 nt, Human
ccgggccuggagaacuaga

SEQ ID NO: 1823425 - RNA, 14 nt, Human
ccgugccuucagcu

SEQ ID NO: 1823426 - RNA, 15 nt, Human
ccgugccuucagcuc

SEQ ID NO: 1823427 - RNA, 16 nt, Human
ccgugccuucagcucu

SEQ ID NO: 1823428 - RNA, 17 nt, Human
ccgugccuucagcucua

SEQ ID NO: 1823429 - RNA, 15 nt, Human
ccguggcuucccgcu

SEQ ID NO: 1823430 - RNA, 21 nt, Human
ccguggcuucccgcucagccc

SEQ ID NO: 1823431 - RNA, 23 nt, Human
ccguggcuucccgcucagcccuc

SEQ ID NO: 1823432 - RNA, 12 nt, Human
ccuaaagagaua

SEQ ID NO: 1823433 - RNA, 19 nt, Human
ccuaaagccucaaaacaaa

SEQ ID NO: 1823434 - RNA, 13 nt, Human
ccuaaagccucaa

SEQ ID NO: 1823435 - RNA, 14 nt, Human
ccuaaaguguauuu

SEQ ID NO: 1823436 - RNA, 13 nt, Human
ccuaauuccacag

SEQ ID NO: 1823437 - RNA, 17 nt, Human
ccuaauucuaugccugu

SEQ ID NO: 1823438 - RNA, 14 nt, Human
ccuaauuccacagc

SEQ ID NO: 1823439 - RNA, 15 nt, Human
ccuaauuccacagcu

SEQ ID NO: 1823440 - RNA, 16 nt, Human
ccuaauuccacagcug

SEQ ID NO: 1823441 - RNA, 17 nt, Human
ccuaauuccacagcugc

SEQ ID NO: 1823442 - RNA, 12 nt, Human
ccuaccugguaa

SEQ ID NO: 1823443 - RNA, 13 nt, Human
cccuuccucucca

SEQ ID NO: 1823444 - RNA, 17 nt, Human
cccuuaccacugcucug

SEQ ID NO: 1823445 - RNA, 21 nt, Human
cccuuaccacugcucugauga

SEQ ID NO: 1823446 - RNA, 19 nt, Human
cccuuaccucggugccuuc

SEQ ID NO: 1823447 - RNA, 16 nt, Human
cccuuccucuccacug

SEQ ID NO: 1823448 - RNA, 17 nt, Human
cccuuccucuccacugc

SEQ ID NO: 1823449 - RNA, 20 nt, Human
cccuuccucuccacugccuu

SEQ ID NO: 1823450 - RNA, 22 nt, Human
cccuugccgucuaccugagggg

SEQ ID NO: 1823451 - RNA, 17 nt, Human
cccuugccgucuaccug

SEQ ID NO: 1823452 - RNA, 18 nt, Human
cccuugccgucuaccuga

SEQ ID NO: 1823453 - RNA, 22 nt, Human
cccuuucugggcaccggggccu

SEQ ID NO: 1823454 - RNA, 20 nt, Human
cccuuugacgccaucccagc

SEQ ID NO: 1823455 - RNA, 20 nt, Human
cccuuguggucccaccccac

SEQ ID NO: 1823456 - RNA, 18 nt, Human
cccuuguggucccacccc

SEQ ID NO: 1823457 - RNA, 18 nt, Human
cccuuggggagcaggcuc

SEQ ID NO: 1823458 - RNA, 14 nt, Human
cccuugugguccca

SEQ ID NO: 1823459 - RNA, 16 nt, Human
cccuuguggucccacc

SEQ ID NO: 1823460 - RNA, 18 nt, Human
ccgagaucacgccacugc

SEQ ID NO: 1823461 - RNA, 16 nt, Human
ccgagccuggcuccaa

SEQ ID NO: 1823462 - RNA, 19 nt, Human
ccgagccuggcuccaaacc

SEQ ID NO: 1823463 - RNA, 22 nt, Human
ccgagucucuucuccacuggau

SEQ ID NO: 1823464 - RNA, 19 nt, Human
cccuuuuuuggcugcugaa

SEQ ID NO: 1823465 - RNA, 17 nt, Human
ccgagaaggaagccucc

SEQ ID NO: 1823466 - RNA, 19 nt, Human
ccgagauagccaaggccaa

SEQ ID NO: 1823467 - RNA, 22 nt, Human
ccgagauagccaaggccaaagg

SEQ ID NO: 1823468 - RNA, 17 nt, Human
cccuuuuuuggcugcug

SEQ ID NO: 1823469 - RNA, 18 nt, Human
cccuuuuuuggcugcuga

SEQ ID NO: 1823470 - RNA, 11 nt, Human
cccuuuuccuu

SEQ ID NO: 1823471 - RNA, 13 nt, Human
cccuuuucuguuu

SEQ ID NO: 1823472 - RNA, 13 nt, Human
ccccaggaggcca

SEQ ID NO: 1823473 - RNA, 14 nt, Human
ccccaggaggccag

SEQ ID NO: 1823474 - RNA, 15 nt, Human
ccccaggaggccagc

SEQ ID NO: 1823475 - RNA, 21 nt, Human
ccccaggaggccagccuugac

SEQ ID NO: 1823476 - RNA, 22 nt, Human
ccccaggaggccagccuugacc

SEQ ID NO: 1823477 - RNA, 23 nt, Human
cccccaaccaaguggcucccaca

SEQ ID NO: 1823478 - RNA, 12 nt, Human
ccccacugguga

SEQ ID NO: 1823479 - RNA, 13 nt, Human
ccccacuggugac

SEQ ID NO: 1823480 - RNA, 14 nt, Human
ccccacuggugaca

SEQ ID NO: 1823481 - RNA, 12 nt, Human
cccccagcccca

SEQ ID NO: 1823482 - RNA, 16 nt, Human
cccccaucucuucugg

SEQ ID NO: 1823483 - RNA, 16 nt, Human
ccccgucccccucugg

SEQ ID NO: 1823484 - RNA, 20 nt, Human
ccccgucccccucuggcucc

SEQ ID NO: 1823485 - RNA, 21 nt, Human
ccccgucucugguuccucccc

SEQ ID NO: 1823486 - RNA, 13 nt, Human
cccccucugcccu

SEQ ID NO: 1823487 - RNA, 14 nt, Human
cccccucugcccug

SEQ ID NO: 1823488 - RNA, 16 nt, Human
cccccucugcccugcg

SEQ ID NO: 1823489 - RNA, 21 nt, Human
cccccgcugucagccauuccu

SEQ ID NO: 1823490 - RNA, 16 nt, Human
cccuguuuguuucuga

SEQ ID NO: 1823491 - RNA, 19 nt, Human
cccuguuucagaggcucag

SEQ ID NO: 1823492 - RNA, 16 nt, Human
cccuguuucagaggcu

SEQ ID NO: 1823493 - RNA, 15 nt, Human
cccuguuuguuucug

SEQ ID NO: 1823494 - RNA, 18 nt, Human
cccugugggcccccaaau

SEQ ID NO: 1823495 - RNA, 22 nt, Human
cccugguuuccugcccugggag

SEQ ID NO: 1823496 - RNA, 23 nt, Human
cccugguuuccugcccugggagg

SEQ ID NO: 1823497 - RNA, 21 nt, Human
cccuguagagugggagcugag

SEQ ID NO: 1823498 - RNA, 16 nt, Human
cccugugggcccccaa

SEQ ID NO: 1823499 - RNA, 19 nt, Human
cccugguggcagugggagc

SEQ ID NO: 1823500 - RNA, 16 nt, Human
cccugguggcaguggg

SEQ ID NO: 1823501 - RNA, 21 nt, Human
cccugguggcagugggagcug

SEQ ID NO: 1823502 - RNA, 21 nt, Human
cccugguuuccugcccuggga

SEQ ID NO: 1823503 - RNA, 17 nt, Human
ccccucagggucccugg

SEQ ID NO: 1823504 - RNA, 18 nt, Human
ccccucagggucccuggu

SEQ ID NO: 1823505 - RNA, 20 nt, Human
ccccucagggucccuggugg

SEQ ID NO: 1823506 - RNA, 19 nt, Human
ccccuaaagccucaaaaca

SEQ ID NO: 1823507 - RNA, 19 nt, Human
ccugaagucacacagugag

SEQ ID NO: 1823508 - RNA, 17 nt, Human
ccugaagucacacagug

SEQ ID NO: 1823509 - RNA, 16 nt, Human
ccugaagucacacagu

SEQ ID NO: 1823510 - RNA, 15 nt, Human
ccugaagucacacag

SEQ ID NO: 1823511 - RNA, 13 nt, Human
ccugaaggccccg

SEQ ID NO: 1823512 - RNA, 21 nt, Human
ccugaagacucauucuucugu

SEQ ID NO: 1823513 - RNA, 20 nt, Human
ccugaagcuaucguaaaauu

SEQ ID NO: 1823514 - RNA, 22 nt, Human
ccugaagcuaucguaaaauuaa

SEQ ID NO: 1823515 - RNA, 23 nt, Human
ccugaagcuaucguaaaauuaag

SEQ ID NO: 1823516 - RNA, 18 nt, Human
ccugaaagaggaaugaag

SEQ ID NO: 1823517 - RNA, 23 nt, Human
ccugaaagaggaaugaaguacuc

SEQ ID NO: 1823518 - RNA, 22 nt, Human
ccucuuuggucuacacugugcu

SEQ ID NO: 1823519 - RNA, 15 nt, Human
ccucuuccucccuca

SEQ ID NO: 1823520 - RNA, 16 nt, Human
ccucuuccucccucau

SEQ ID NO: 1823521 - RNA, 19 nt, Human
ccucuuccucccucauucc

SEQ ID NO: 1823522 - RNA, 17 nt, Human
ccucuuaugggcugggu

SEQ ID NO: 1823523 - RNA, 21 nt, Human
ccucuguucugcacacagcac

SEQ ID NO: 1823524 - RNA, 14 nt, Human
ccucuuagaaaaac

SEQ ID NO: 1823525 - RNA, 15 nt, Human
ccucuuaugggcugg

SEQ ID NO: 1823526 - RNA, 16 nt, Human
ccucuuaugggcuggg

SEQ ID NO: 1823527 - RNA, 14 nt, Human
ccucuuaugggcug

SEQ ID NO: 1823528 - RNA, 17 nt, Human
ccucuguccaggcacug

SEQ ID NO: 1823529 - RNA, 14 nt, Human
ccucuguacagagc

SEQ ID NO: 1823530 - RNA, 15 nt, Human
ccucuguacagagcc

SEQ ID NO: 1823531 - RNA, 16 nt, Human
ccucuguacagagccc

SEQ ID NO: 1823532 - RNA, 17 nt, Human
ccucuguacagagccca

SEQ ID NO: 1823533 - RNA, 18 nt, Human
ccucuguacagagcccac

SEQ ID NO: 1823534 - RNA, 23 nt, Human
ccucuguacagagcccacgcccc

SEQ ID NO: 1823535 - RNA, 23 nt, Human
ccugauugugucucuugguccug

SEQ ID NO: 1823536 - RNA, 17 nt, Human
ccugaugcuucuucaga

SEQ ID NO: 1823537 - RNA, 18 nt, Human
ccugaugcuucuucagag

SEQ ID NO: 1823538 - RNA, 14 nt, Human
ccugaugcuucuuc

SEQ ID NO: 1823539 - RNA, 20 nt, Human
ccugaggcuccacuuggucu

SEQ ID NO: 1823540 - RNA, 18 nt, Human
ccugaggcuccacuuggu

SEQ ID NO: 1823541 - RNA, 12 nt, Human
ccugaggcccag

SEQ ID NO: 1823542 - RNA, 13 nt, Human
ccugaggcccaga

SEQ ID NO: 1823543 - RNA, 14 nt, Human
ccugaggcccagag

SEQ ID NO: 1823544 - RNA, 12 nt, Human
ccugacaacacu

SEQ ID NO: 1823545 - RNA, 14 nt, Human
ccugacaacacuca

SEQ ID NO: 1823546 - RNA, 15 nt, Human
ccugacaacacucau

SEQ ID NO: 1823547 - RNA, 16 nt, Human
ccugacaacacucauu

SEQ ID NO: 1823548 - RNA, 23 nt, Human
ccugaggcccuucucuccagccc

SEQ ID NO: 1823549 - RNA, 21 nt, Human
ccugaggcccuucucuccagc

SEQ ID NO: 1823550 - RNA, 22 nt, Human
ccugaggcccuucucuccagcc

SEQ ID NO: 1823551 - RNA, 16 nt, Human
ccugaggcccuucucu

SEQ ID NO: 1823552 - RNA, 17 nt, Human
ccugaggcccuucucuc

SEQ ID NO: 1823553 - RNA, 19 nt, Human
ccugaggcccuucucucca

SEQ ID NO: 1823554 - RNA, 20 nt, Human
ccugaggcccuucucuccag

SEQ ID NO: 1823555 - RNA, 23 nt, Human
ccugacaacacucauugaccuga

SEQ ID NO: 1823556 - RNA, 22 nt, Human
ccucacuaucccggcugcccuu

SEQ ID NO: 1823557 - RNA, 21 nt, Human
ccucacuaggcuucugguuga

SEQ ID NO: 1823558 - RNA, 21 nt, Human
ccucacuaucccggcugcccu

SEQ ID NO: 1823559 - RNA, 14 nt, Human
ccucagcauccugg

SEQ ID NO: 1823560 - RNA, 17 nt, Human
ccucagcauccuggcac

SEQ ID NO: 1823561 - RNA, 16 nt, Human
ccucagcauccuggca

SEQ ID NO: 1823562 - RNA, 23 nt, Human
ccucaggccugggggcugggcag

SEQ ID NO: 1823563 - RNA, 14 nt, Human
ccucagggucccug

SEQ ID NO: 1823564 - RNA, 11 nt, Human
ccucaggccug

SEQ ID NO: 1823565 - RNA, 14 nt, Human
ccucaggccugggg

SEQ ID NO: 1823566 - RNA, 21 nt, Human
ccucaggccugggggcugggc

SEQ ID NO: 1823567 - RNA, 19 nt, Human
ccucaggugauccacccac

SEQ ID NO: 1823568 - RNA, 17 nt, Human
ccucaggugauccaccc

SEQ ID NO: 1823569 - RNA, 22 nt, Human
ccucaggugauccacccaccuc

SEQ ID NO: 1823570 - RNA, 22 nt, Human
ccucagguaaucgaccugccuc

SEQ ID NO: 1823571 - RNA, 23 nt, Human
ccucagguaaucgaccugccucg

SEQ ID NO: 1823572 - RNA, 16 nt, Human
ccucaggugagaagca

SEQ ID NO: 1823573 - RNA, 21 nt, Human
ccucagguaaucgaccugccu

SEQ ID NO: 1823574 - RNA, 15 nt, Human
ccucagggucccugg

SEQ ID NO: 1823575 - RNA, 15 nt, Human
ccucagucuggcccu

SEQ ID NO: 1823576 - RNA, 14 nt, Human
ccucagucucccuc

SEQ ID NO: 1823577 - RNA, 13 nt, Human
ccucccggugccc

SEQ ID NO: 1823578 - RNA, 16 nt, Human
ccucccggugcccaag

SEQ ID NO: 1823579 - RNA, 13 nt, Human
ccucccucccucu

SEQ ID NO: 1823580 - RNA, 15 nt, Human
ccucccucccucuuu

SEQ ID NO: 1823581 - RNA, 13 nt, Human
ccucccugccccu

SEQ ID NO: 1823582 - RNA, 16 nt, Human
ccucccucccucuuuc

SEQ ID NO: 1823583 - RNA, 13 nt, Human
ccuccugccucga

SEQ ID NO: 1823584 - RNA, 14 nt, Human
ccuccuccuggacu

SEQ ID NO: 1823585 - RNA, 22 nt, Human
ccuccugugugugcgccuacag

SEQ ID NO: 1823586 - RNA, 15 nt, Human
ccuccugugugugcg

SEQ ID NO: 1823587 - RNA, 13 nt, Human
ccuccugugugug

SEQ ID NO: 1823588 - RNA, 13 nt, Human
ccuccugggcuaa

SEQ ID NO: 1823589 - RNA, 13 nt, Human
ccuccuggacucc

SEQ ID NO: 1823590 - RNA, 17 nt, Human
ccuccugggaaugaagc

SEQ ID NO: 1823591 - RNA, 13 nt, Human
ccucucugcccua

SEQ ID NO: 1823592 - RNA, 16 nt, Human
ccucugacacacagcu

SEQ ID NO: 1823593 - RNA, 23 nt, Human
ccucugaaaaccaauguucucuc

SEQ ID NO: 1823594 - RNA, 19 nt, Human
ccucuccacugccuucgau

SEQ ID NO: 1823595 - RNA, 12 nt, Human
ccucuccacugc

SEQ ID NO: 1823596 - RNA, 13 nt, Human
ccucuccacugcc

SEQ ID NO: 1823597 - RNA, 14 nt, Human
ccucuccacugccu

SEQ ID NO: 1823598 - RNA, 16 nt, Human
ccucuccacugccuuc

SEQ ID NO: 1823599 - RNA, 12 nt, Human
ccucucccauca

SEQ ID NO: 1823600 - RNA, 23 nt, Human
ccuccugugugugcgccuacagg

SEQ ID NO: 1823601 - RNA, 18 nt, Human
ccuccuuaucaaaggaca

SEQ ID NO: 1823602 - RNA, 20 nt, Human
ccuccuuaucaaaggacacc

SEQ ID NO: 1823603 - RNA, 12 nt, Human
ccucugggacug

SEQ ID NO: 1823604 - RNA, 16 nt, Human
ccucuggcuccagcug

SEQ ID NO: 1823605 - RNA, 17 nt, Human
ccucuggcuccagcugg

SEQ ID NO: 1823606 - RNA, 18 nt, Human
ccucugacacacagcucu

SEQ ID NO: 1823607 - RNA, 17 nt, Human
ccucugacacacagcuc

SEQ ID NO: 1823608 - RNA, 11 nt, Human
ccucugcacaa

SEQ ID NO: 1823609 - RNA, 15 nt, Human
ccucugcacaagcug

SEQ ID NO: 1823610 - RNA, 20 nt, Human
ccucugcacaagcugcaccc

SEQ ID NO: 1823611 - RNA, 17 nt, Human
ccucugcacaagcugca

SEQ ID NO: 1823612 - RNA, 19 nt, Human
ccucugcacaagcugcacc

SEQ ID NO: 1823613 - RNA, 22 nt, Human
ccucugcacuccccugcugggu

SEQ ID NO: 1823614 - RNA, 14 nt, Human
ccucugcacucccc

SEQ ID NO: 1823615 - RNA, 15 nt, Human
ccucugcacuccccu

SEQ ID NO: 1823616 - RNA, 20 nt, Human
ccucugcacuccccugcugg

SEQ ID NO: 1823617 - RNA, 21 nt, Human
ccucugcacuccccugcuggg

SEQ ID NO: 1823618 - RNA, 19 nt, Human
ccugugccucugggacugg

SEQ ID NO: 1823619 - RNA, 15 nt, Human
ccugugccucuggga

SEQ ID NO: 1823620 - RNA, 17 nt, Human
ccugugccucugggacu

SEQ ID NO: 1823621 - RNA, 22 nt, Human
ccugugauggggcccugccucc

SEQ ID NO: 1823622 - RNA, 20 nt, Human
ccugugauggggcccugccu

SEQ ID NO: 1823623 - RNA, 21 nt, Human
ccugugauggggcccugccuc

SEQ ID NO: 1823624 - RNA, 17 nt, Human
ccugugauggggcccug

SEQ ID NO: 1823625 - RNA, 18 nt, Human
ccugugauggggcccugc

SEQ ID NO: 1823626 - RNA, 19 nt, Human
ccugugauggggcccugcc

SEQ ID NO: 1823627 - RNA, 22 nt, Human
ccugugagcuaggaauuguguu

SEQ ID NO: 1823628 - RNA, 20 nt, Human
ccugugaguacuacaguccu

SEQ ID NO: 1823629 - RNA, 17 nt, Human
ccugucccccugacaac

SEQ ID NO: 1823630 - RNA, 18 nt, Human
ccuguccccgcacugggc

SEQ ID NO: 1823631 - RNA, 18 nt, Human
ccuggugcugccacacuu

SEQ ID NO: 1823632 - RNA, 21 nt, Human
ccuggugcugccacacuucag

SEQ ID NO: 1823633 - RNA, 15 nt, Human
ccuggugcugccaca

SEQ ID NO: 1823634 - RNA, 13 nt, Human
ccugguggcagcu

SEQ ID NO: 1823635 - RNA, 12 nt, Human
ccugguggcagc

SEQ ID NO: 1823636 - RNA, 14 nt, Human
ccugguggcagcuc

SEQ ID NO: 1823637 - RNA, 16 nt, Human
ccugguggcagcucac

SEQ ID NO: 1823638 - RNA, 17 nt, Human
ccugguggcagcucacc

SEQ ID NO: 1823639 - RNA, 18 nt, Human
ccugguggcagcucaccu

SEQ ID NO: 1823640 - RNA, 20 nt, Human
ccuguaauccuagcacuuug

SEQ ID NO: 1823641 - RNA, 21 nt, Human
ccuguagagugggagcugagu

SEQ ID NO: 1823642 - RNA, 19 nt, Human
ccuguagagugggagcuga

SEQ ID NO: 1823643 - RNA, 23 nt, Human
ccuguagagugggagcugagugg

SEQ ID NO: 1823644 - RNA, 18 nt, Human
ccuggcaugggaaugaau

SEQ ID NO: 1823645 - RNA, 23 nt, Human
ccuggcaugggaaugaaugucag

SEQ ID NO: 1823646 - RNA, 20 nt, Human
ccuggcuccaaacccucgag

SEQ ID NO: 1823647 - RNA, 12 nt, Human
ccuggcggggug

SEQ ID NO: 1823648 - RNA, 14 nt, Human
ccuggccccucagg

SEQ ID NO: 1823649 - RNA, 16 nt, Human
ccuggccccucagggu

SEQ ID NO: 1823650 - RNA, 12 nt, Human
ccugggcagaag

SEQ ID NO: 1823651 - RNA, 14 nt, Human
ccugggcagaagga

SEQ ID NO: 1823652 - RNA, 15 nt, Human
ccugggcagaaggaa

SEQ ID NO: 1823653 - RNA, 13 nt, Human
ccugggaggcagu

SEQ ID NO: 1823654 - RNA, 13 nt, Human
ccugggaggcucu

SEQ ID NO: 1823655 - RNA, 21 nt, Human
ccugggaggcucuggagccca

SEQ ID NO: 1823656 - RNA, 20 nt, Human
ccugggaggucaaggcugca

SEQ ID NO: 1823657 - RNA, 16 nt, Human
ccugggaucccucauc

SEQ ID NO: 1823658 - RNA, 20 nt, Human
ccugggaucccucauccuca

SEQ ID NO: 1823659 - RNA, 21 nt, Human
ccuggcacugcuuccagugag

SEQ ID NO: 1823660 - RNA, 16 nt, Human
ccuggcagccccuguu

SEQ ID NO: 1823661 - RNA, 12 nt, Human
ccuggcagccgu

SEQ ID NO: 1823662 - RNA, 18 nt, Human
ccuggcagccgugccuuc

SEQ ID NO: 1823663 - RNA, 19 nt, Human
ccuggcagccgugccuuca

SEQ ID NO: 1823664 - RNA, 16 nt, Human
ccuggcaugggaauga

SEQ ID NO: 1823665 - RNA, 17 nt, Human
ccuggcaugggaaugaa

SEQ ID NO: 1823666 - RNA, 20 nt, Human
ccuggcacugcuuccaguga

SEQ ID NO: 1823667 - RNA, 17 nt, Human
ccuggcacugcuuccag

SEQ ID NO: 1823668 - RNA, 14 nt, Human
ccuggacuccugca

SEQ ID NO: 1823669 - RNA, 17 nt, Human
ccuggacugugugcuca

SEQ ID NO: 1823670 - RNA, 20 nt, Human
ccuggacugugugcucagga

SEQ ID NO: 1823671 - RNA, 13 nt, Human
ccuggacccugug

SEQ ID NO: 1823672 - RNA, 14 nt, Human
ccuggacccugugg

SEQ ID NO: 1823673 - RNA, 19 nt, Human
ccugcugguucaggguugg

SEQ ID NO: 1823674 - RNA, 13 nt, Human
ccugcugguucag

SEQ ID NO: 1823675 - RNA, 20 nt, Human
ccugcuuuuuauggccugug

SEQ ID NO: 1823676 - RNA, 18 nt, Human
ccugcuuugggcugcccu

SEQ ID NO: 1823677 - RNA, 17 nt, Human
ccugcuuugggcugccc

SEQ ID NO: 1823678 - RNA, 17 nt, Human
ccugcuaauuccccaga

SEQ ID NO: 1823679 - RNA, 12 nt, Human
ccugcuccagcu

SEQ ID NO: 1823680 - RNA, 13 nt, Human
ccugcuccagcug

SEQ ID NO: 1823681 - RNA, 14 nt, Human
ccugcuccagcugu

SEQ ID NO: 1823682 - RNA, 22 nt, Human
ccugcuccagcuguucagcugg

SEQ ID NO: 1823683 - RNA, 18 nt, Human
ccugcaacaccuuguuuc

SEQ ID NO: 1823684 - RNA, 19 nt, Human
ccugcaaagcccagcuuga

SEQ ID NO: 1823685 - RNA, 19 nt, Human
ccugcaacaccuuguuucc

SEQ ID NO: 1823686 - RNA, 16 nt, Human
ccugcaaccugauugu

SEQ ID NO: 1823687 - RNA, 23 nt, Human
ccugcgucucauacucaccucac

SEQ ID NO: 1823688 - RNA, 16 nt, Human
ccuugaacuggguacu

SEQ ID NO: 1823689 - RNA, 17 nt, Human
ccuugaacuuugaccuc

SEQ ID NO: 1823690 - RNA, 17 nt, Human
ccuugaaugaugccaug

SEQ ID NO: 1823691 - RNA, 19 nt, Human
ccuugaacuuugaccucug

SEQ ID NO: 1823692 - RNA, 14 nt, Human
ccuugaacugggua

SEQ ID NO: 1823693 - RNA, 22 nt, Human
ccuugaaaacacuguucucugc

SEQ ID NO: 1823694 - RNA, 19 nt, Human
ccuugaaaacacuguucuc

SEQ ID NO: 1823695 - RNA, 21 nt, Human
ccuugaaaacacuguucucug

SEQ ID NO: 1823696 - RNA, 18 nt, Human
ccuucgcuccugugucuu

SEQ ID NO: 1823697 - RNA, 15 nt, Human
ccuucgcuccugugu

SEQ ID NO: 1823698 - RNA, 14 nt, Human
ccuucgcuccugug

SEQ ID NO: 1823699 - RNA, 13 nt, Human
ccuucgcuccugu

SEQ ID NO: 1823700 - RNA, 14 nt, Human
ccuucuuuuucuuc

SEQ ID NO: 1823701 - RNA, 16 nt, Human
ccuucuuuuucuucuu

SEQ ID NO: 1823702 - RNA, 15 nt, Human
ccuugaaaacacugu

SEQ ID NO: 1823703 - RNA, 17 nt, Human
ccuugacagggcacacc

SEQ ID NO: 1823704 - RNA, 15 nt, Human
ccuugacagggcaca

SEQ ID NO: 1823705 - RNA, 19 nt, Human
ccuugaccauucuccaccu

SEQ ID NO: 1823706 - RNA, 20 nt, Human
ccuugaccauucuccaccug

SEQ ID NO: 1823707 - RNA, 14 nt, Human
ccuugacagggcac

SEQ ID NO: 1823708 - RNA, 22 nt, Human
ccuugaccauucuccaccugcc

SEQ ID NO: 1823709 - RNA, 21 nt, Human
ccuugaccauucuccaccugc

SEQ ID NO: 1823710 - RNA, 22 nt, Human
ccuugaguugauucagcucugc

SEQ ID NO: 1823711 - RNA, 23 nt, Human
ccuugaguugauucagcucugca

SEQ ID NO: 1823712 - RNA, 13 nt, Human
ccuugacagggca

SEQ ID NO: 1823713 - RNA, 11 nt, Human
ccuuuggcuuc

SEQ ID NO: 1823714 - RNA, 20 nt, Human
ccuguggccaaguucuuagu

SEQ ID NO: 1823715 - RNA, 14 nt, Human
ccuuaccagcagag

SEQ ID NO: 1823716 - RNA, 17 nt, Human
ccuuaccagcagagcac

SEQ ID NO: 1823717 - RNA, 15 nt, Human
ccuuaccagcagagc

SEQ ID NO: 1823718 - RNA, 16 nt, Human
ccuuaccagcagagca

SEQ ID NO: 1823719 - RNA, 20 nt, Human
ccuuaccucggugccuuccu

SEQ ID NO: 1823720 - RNA, 14 nt, Human
ccuuaccugccagg

SEQ ID NO: 1823721 - RNA, 15 nt, Human
ccuucaaagcaaaug

SEQ ID NO: 1823722 - RNA, 19 nt, Human
ccuucaaagcaaaugucuu

SEQ ID NO: 1823723 - RNA, 14 nt, Human
ccuucaaccauucc

SEQ ID NO: 1823724 - RNA, 21 nt, Human
ccuuagacagucccugccaau

SEQ ID NO: 1823725 - RNA, 18 nt, Human
ccuuagacagucccugcc

SEQ ID NO: 1823726 - RNA, 19 nt, Human
ccuuagacagucccugcca

SEQ ID NO: 1823727 - RNA, 14 nt, Human
ccuuagaaccuuuc

SEQ ID NO: 1823728 - RNA, 15 nt, Human
ccuuagaaccuuucu

SEQ ID NO: 1823729 - RNA, 16 nt, Human
ccuuagaaccuuucuu

SEQ ID NO: 1823730 - RNA, 18 nt, Human
ccuuagaaccuuucuuac

SEQ ID NO: 1823731 - RNA, 16 nt, Human
ccuuagacagucccug

SEQ ID NO: 1823732 - RNA, 17 nt, Human
ccuuagacagucccugc

SEQ ID NO: 1823733 - RNA, 14 nt, Human
ccuuccucuuucca

SEQ ID NO: 1823734 - RNA, 15 nt, Human
ccuucgauacaccgg

SEQ ID NO: 1823735 - RNA, 20 nt, Human
ccuucgauacaccgggccug

SEQ ID NO: 1823736 - RNA, 22 nt, Human
ccuucgauacaccgggccugga

SEQ ID NO: 1823737 - RNA, 23 nt, Human
ccuucgauacaccgggccuggag

SEQ ID NO: 1823738 - RNA, 13 nt, Human
ccuucgccaccug

SEQ ID NO: 1823739 - RNA, 15 nt, Human
ccuuccagggguggg

SEQ ID NO: 1823740 - RNA, 16 nt, Human
ccuuccagggguggga

SEQ ID NO: 1823741 - RNA, 19 nt, Human
ccuuccaugucgccucugc

SEQ ID NO: 1823742 - RNA, 20 nt, Human
ccuuccaugucgccucugca

SEQ ID NO: 1823743 - RNA, 21 nt, Human
ccuuccaugucgccucugcau

SEQ ID NO: 1823744 - RNA, 23 nt, Human
ccuuccaugucgccucugcauuc

SEQ ID NO: 1823745 - RNA, 18 nt, Human
ccuuccaggggugggaca

SEQ ID NO: 1823746 - RNA, 22 nt, Human
ccuuccaggggugggacacccu

SEQ ID NO: 1823747 - RNA, 10 nt, Human
ccuucagugc

SEQ ID NO: 1823748 - RNA, 13 nt, Human
ccuucagugccuu

SEQ ID NO: 1823749 - RNA, 14 nt, Human
ccuucagugccuua

SEQ ID NO: 1823750 - RNA, 20 nt, Human
ccuucagugccuuauggaac

SEQ ID NO: 1823751 - RNA, 15 nt, Human
ccuucagugccuuau

SEQ ID NO: 1823752 - RNA, 19 nt, Human
ccuucagugccuuauggaa

SEQ ID NO: 1823753 - RNA, 22 nt, Human
cguuccuucaaagcaaaugucu

SEQ ID NO: 1823754 - RNA, 12 nt, Human
cguucucugccu

SEQ ID NO: 1823755 - RNA, 21 nt, Human
cguuucuaaaggcuaccuuug

SEQ ID NO: 1823756 - RNA, 19 nt, Human
cguuucuaaaggcuaccuu

SEQ ID NO: 1823757 - RNA, 20 nt, Human
cguuucuaugacacaugcaa

SEQ ID NO: 1823758 - RNA, 13 nt, Human
cgugccuucagcu

SEQ ID NO: 1823759 - RNA, 15 nt, Human
cgugccuucagcucu

SEQ ID NO: 1823760 - RNA, 16 nt, Human
cgugccuucagcucua

SEQ ID NO: 1823761 - RNA, 18 nt, Human
cgugccuucagcucuaca

SEQ ID NO: 1823762 - RNA, 12 nt, Human
cgugccuggcca

SEQ ID NO: 1823763 - RNA, 16 nt, Human
cgugccuggccacgcc

SEQ ID NO: 1823764 - RNA, 12 nt, Human
cguggcugcuuc

SEQ ID NO: 1823765 - RNA, 14 nt, Human
cguggcugcuucaa

SEQ ID NO: 1823766 - RNA, 15 nt, Human
cguggcugcuucaag

SEQ ID NO: 1823767 - RNA, 17 nt, Human
cguggcugcuucaagga

SEQ ID NO: 1823768 - RNA, 14 nt, Human
cgucugacaggcaa

SEQ ID NO: 1823769 - RNA, 13 nt, Human
cgucugacaggca

SEQ ID NO: 1823770 - RNA, 14 nt, Human
cgucuaccugaggg

SEQ ID NO: 1823771 - RNA, 22 nt, Human
cgucccccucuggcuccagcug

SEQ ID NO: 1823772 - RNA, 11 nt, Human
cguccccuguc

SEQ ID NO: 1823773 - RNA, 14 nt, Human
cguccccugucccc

SEQ ID NO: 1823774 - RNA, 22 nt, Human
cgugcacacaccagagcccacc

SEQ ID NO: 1823775 - RNA, 18 nt, Human
cgugcauaccacuuuugu

SEQ ID NO: 1823776 - RNA, 14 nt, Human
cgugcauaccacuu

SEQ ID NO: 1823777 - RNA, 19 nt, Human
cgugcauaccacuuuuguu

SEQ ID NO: 1823778 - RNA, 21 nt, Human
cgugcacacaccagagcccac

SEQ ID NO: 1823779 - RNA, 20 nt, Human
cgugcacacaccagagccca

SEQ ID NO: 1823780 - RNA, 12 nt, Human
cgugacaacacu

SEQ ID NO: 1823781 - RNA, 23 nt, Human
cggugcuaucucccccagcccca

SEQ ID NO: 1823782 - RNA, 16 nt, Human
cguauaaaagccuguu

SEQ ID NO: 1823783 - RNA, 17 nt, Human
cguauaaaagccuguuu

SEQ ID NO: 1823784 - RNA, 21 nt, Human
cguauaaaagccuguuuaaga

SEQ ID NO: 1823785 - RNA, 22 nt, Human
cguauaaaagccuguuuaagag

SEQ ID NO: 1823786 - RNA, 22 nt, Human
cguauaugucucaggucccugc

SEQ ID NO: 1823787 - RNA, 14 nt, Human
cgucccccucuggc

SEQ ID NO: 1823788 - RNA, 21 nt, Human
cgucccccucuggcuccagcu

SEQ ID NO: 1823789 - RNA, 17 nt, Human
cgucauaacuagaacug

SEQ ID NO: 1823790 - RNA, 16 nt, Human
cgucauaacuagaacu

SEQ ID NO: 1823791 - RNA, 14 nt, Human
cgucauaacuagaa

SEQ ID NO: 1823792 - RNA, 16 nt, Human
cggaucuuuggacaga

SEQ ID NO: 1823793 - RNA, 19 nt, Human
cggaucuuuggacagaagc

SEQ ID NO: 1823794 - RNA, 20 nt, Human
cggacagccacggccaggcc

SEQ ID NO: 1823795 - RNA, 13 nt, Human
cgcuccugugucu

SEQ ID NO: 1823796 - RNA, 17 nt, Human
cgcuauugucaccaggg

SEQ ID NO: 1823797 - RNA, 18 nt, Human
cggacagccacggccagg

SEQ ID NO: 1823798 - RNA, 16 nt, Human
cggacagccacggcca

SEQ ID NO: 1823799 - RNA, 15 nt, Human
cggacagccacggcc

SEQ ID NO: 1823800 - RNA, 20 nt, Human
cggaaugaaccacaucuugc

SEQ ID NO: 1823801 - RNA, 17 nt, Human
cggccuccauccugagg

SEQ ID NO: 1823802 - RNA, 16 nt, Human
cggccuccauccugag

SEQ ID NO: 1823803 - RNA, 14 nt, Human
cggccucccaaagu

SEQ ID NO: 1823804 - RNA, 15 nt, Human
cggccuuuggcuuca

SEQ ID NO: 1823805 - RNA, 15 nt, Human
cggcuggccuggccc

SEQ ID NO: 1823806 - RNA, 16 nt, Human
cggcuggccuggcccc

SEQ ID NO: 1823807 - RNA, 18 nt, Human
cggcuggccuggccccuc

SEQ ID NO: 1823808 - RNA, 19 nt, Human
cggcuggccuggccccuca

SEQ ID NO: 1823809 - RNA, 20 nt, Human
cgggaggauguucugggaca

SEQ ID NO: 1823810 - RNA, 22 nt, Human
cgggagccugaucaccugcccu

SEQ ID NO: 1823811 - RNA, 21 nt, Human
cgggagccugaucaccugccc

SEQ ID NO: 1823812 - RNA, 21 nt, Human
cgggaggauguucugggacac

SEQ ID NO: 1823813 - RNA, 16 nt, Human
cgggaggucgaggcag

SEQ ID NO: 1823814 - RNA, 17 nt, Human
cgggaggucgaggcagg

SEQ ID NO: 1823815 - RNA, 15 nt, Human
cgggcaugacacgaa

SEQ ID NO: 1823816 - RNA, 12 nt, Human
cgggcaugacac

SEQ ID NO: 1823817 - RNA, 14 nt, Human
ccuuuaagagaaau

SEQ ID NO: 1823818 - RNA, 13 nt, Human
ccuuuaagagaaa

SEQ ID NO: 1823819 - RNA, 14 nt, Human
ccuuggcugcaggg

SEQ ID NO: 1823820 - RNA, 20 nt, Human
ccuuguggucccaccccaca

SEQ ID NO: 1823821 - RNA, 16 nt, Human
ccuuguggucccaccc

SEQ ID NO: 1823822 - RNA, 19 nt, Human
ccuuguggucccaccccac

SEQ ID NO: 1823823 - RNA, 13 nt, Human
ccuuggcugcagg

SEQ ID NO: 1823824 - RNA, 12 nt, Human
ccuuggcugcag

SEQ ID NO: 1823825 - RNA, 16 nt, Human
ccuuugcuugaaagaa

SEQ ID NO: 1823826 - RNA, 14 nt, Human
ccuuugacaaaggu

SEQ ID NO: 1823827 - RNA, 11 nt, Human
cgcaaugugac

SEQ ID NO: 1823828 - RNA, 12 nt, Human
cgauuucuguuu

SEQ ID NO: 1823829 - RNA, 19 nt, Human
cgauucuucugcuucagcc

SEQ ID NO: 1823830 - RNA, 13 nt, Human
cgauucuucugcu

SEQ ID NO: 1823831 - RNA, 21 nt, Human
cgauucuucugcuucagccuc

SEQ ID NO: 1823832 - RNA, 19 nt, Human
cgaucuggguucacugcaa

SEQ ID NO: 1823833 - RNA, 19 nt, Human
cgaggccuucucugaagga

SEQ ID NO: 1823834 - RNA, 18 nt, Human
cgaggccuucucugaagg

SEQ ID NO: 1823835 - RNA, 12 nt, Human
cgaggacaggga

SEQ ID NO: 1823836 - RNA, 13 nt, Human
cgaggacagggag

SEQ ID NO: 1823837 - RNA, 14 nt, Human
cgaggacagggagg

SEQ ID NO: 1823838 - RNA, 20 nt, Human
ccuuuguauucucuccugua

SEQ ID NO: 1823839 - RNA, 18 nt, Human
ccuuuguauucucuccug

SEQ ID NO: 1823840 - RNA, 15 nt, Human
ccuuuguauucucuc

SEQ ID NO: 1823841 - RNA, 20 nt, Human
cgcgugcacacaccagagcc

SEQ ID NO: 1823842 - RNA, 19 nt, Human
cgcgugcacacaccagagc

SEQ ID NO: 1823843 - RNA, 16 nt, Human
cgcgugcacacaccag

SEQ ID NO: 1823844 - RNA, 20 nt, Human
cgcuacuaugauuuaauuug

SEQ ID NO: 1823845 - RNA, 21 nt, Human
cgcuaagagggagggagggcu

SEQ ID NO: 1823846 - RNA, 15 nt, Human
cgcuaagagggaggg

SEQ ID NO: 1823847 - RNA, 16 nt, Human
cgcuaagagggaggga

SEQ ID NO: 1823848 - RNA, 14 nt, Human
cgcuaagagggagg

SEQ ID NO: 1823849 - RNA, 16 nt, Human
cgcgacaaugcaaacc

SEQ ID NO: 1823850 - RNA, 17 nt, Human
cgcgacaaugcaaacca

SEQ ID NO: 1823851 - RNA, 15 nt, Human
cgcccccacugguga

SEQ ID NO: 1823852 - RNA, 12 nt, Human
cgcccaggcugg

SEQ ID NO: 1823853 - RNA, 19 nt, Human
cgcccaggcuggagugcaa

SEQ ID NO: 1823854 - RNA, 20 nt, Human
cgcccaggcuggagugcaau

SEQ ID NO: 1823855 - RNA, 13 nt, Human
cgcagacaggacc

SEQ ID NO: 1823856 - RNA, 14 nt, Human
cgcagacaggacca

SEQ ID NO: 1823857 - RNA, 18 nt, Human
cccaaaaggcagaagcaa

SEQ ID NO: 1823858 - RNA, 13 nt, Human
cccaaaaggcaga

SEQ ID NO: 1823859 - RNA, 20 nt, Human
ccauuuugggguacccacug

SEQ ID NO: 1823860 - RNA, 23 nt, Human
ccauuuuggauucuuauggacaa

SEQ ID NO: 1823861 - RNA, 22 nt, Human
ccauuuugggguacccacugcu

SEQ ID NO: 1823862 - RNA, 16 nt, Human
cccaaagcagugcaug

SEQ ID NO: 1823863 - RNA, 12 nt, Human
cccaaagaugca

SEQ ID NO: 1823864 - RNA, 15 nt, Human
cccaaagaugcagcc

SEQ ID NO: 1823865 - RNA, 18 nt, Human
ccauucugccugcccagg

SEQ ID NO: 1823866 - RNA, 17 nt, Human
ccauucugccugcccag

SEQ ID NO: 1823867 - RNA, 17 nt, Human
ccauucuccaccugcca

SEQ ID NO: 1823868 - RNA, 18 nt, Human
ccauucuccaccugccag

SEQ ID NO: 1823869 - RNA, 20 nt, Human
ccauucugccugcccaggcc

SEQ ID NO: 1823870 - RNA, 19 nt, Human
ccauucugccugcccaggc

SEQ ID NO: 1823871 - RNA, 21 nt, Human
ccauucugccugcccaggccc

SEQ ID NO: 1823872 - RNA, 13 nt, Human
ccauggacuuugu

SEQ ID NO: 1823873 - RNA, 14 nt, Human
ccauggacuuuguu

SEQ ID NO: 1823874 - RNA, 15 nt, Human
ccauucuccaccugc

SEQ ID NO: 1823875 - RNA, 16 nt, Human
ccauucuccaccugcc

SEQ ID NO: 1823876 - RNA, 21 nt, Human
cccacaaaggagagcuagcag

SEQ ID NO: 1823877 - RNA, 14 nt, Human
ccaugaagauguag

SEQ ID NO: 1823878 - RNA, 19 nt, Human
ccaugauuaaccacuucag

SEQ ID NO: 1823879 - RNA, 21 nt, Human
ccaugauuaaccacuucagcu

SEQ ID NO: 1823880 - RNA, 18 nt, Human
ccaugauguuuuccauga

SEQ ID NO: 1823881 - RNA, 14 nt, Human
ccaugcugcccugu

SEQ ID NO: 1823882 - RNA, 13 nt, Human
ccaugcuccuggc

SEQ ID NO: 1823883 - RNA, 11 nt, Human
ccaugcugccc

SEQ ID NO: 1823884 - RNA, 13 nt, Human
ccaugcugcccug

SEQ ID NO: 1823885 - RNA, 22 nt, Human
ccaucauugaaaucuuuuugcu

SEQ ID NO: 1823886 - RNA, 12 nt, Human
ccauccucugua

SEQ ID NO: 1823887 - RNA, 19 nt, Human
ccauccucuguacagagcc

SEQ ID NO: 1823888 - RNA, 13 nt, Human
ccaucaccagaca

SEQ ID NO: 1823889 - RNA, 12 nt, Human
ccauacuaauua

SEQ ID NO: 1823890 - RNA, 13 nt, Human
ccauacuaauuau

SEQ ID NO: 1823891 - RNA, 23 nt, Human
ccauacuaauuauacccccugca

SEQ ID NO: 1823892 - RNA, 20 nt, Human
ccagugaggcucugcccuug

SEQ ID NO: 1823893 - RNA, 18 nt, Human
ccagugaggcucugcccu

SEQ ID NO: 1823894 - RNA, 19 nt, Human
ccagugaggcucugcccuu

SEQ ID NO: 1823895 - RNA, 20 nt, Human
ccauccucuguacagagccc

SEQ ID NO: 1823896 - RNA, 15 nt, Human
ccagguucagcuugu

SEQ ID NO: 1823897 - RNA, 14 nt, Human
ccagguucagcuug

SEQ ID NO: 1823898 - RNA, 21 nt, Human
ccaggugcuaggaacacuccu

SEQ ID NO: 1823899 - RNA, 13 nt, Human
ccaguaucuugaa

SEQ ID NO: 1823900 - RNA, 20 nt, Human
ccagugaaaucaguuacucu

SEQ ID NO: 1823901 - RNA, 19 nt, Human
ccaggugcuaggaacacuc

SEQ ID NO: 1823902 - RNA, 13 nt, Human
ccaggccccugcc

SEQ ID NO: 1823903 - RNA, 19 nt, Human
ccaggcuggucucaaacuc

SEQ ID NO: 1823904 - RNA, 21 nt, Human
ccaggcuggucucgaacuccu

SEQ ID NO: 1823905 - RNA, 20 nt, Human
ccaggcuguaucccaugagc

SEQ ID NO: 1823906 - RNA, 12 nt, Human
ccagggaagggg

SEQ ID NO: 1823907 - RNA, 19 nt, Human
ccaggcuuuuuuaucaugu

SEQ ID NO: 1823908 - RNA, 15 nt, Human
ccaggagccccgagg

SEQ ID NO: 1823909 - RNA, 15 nt, Human
ccaggagcagccaca

SEQ ID NO: 1823910 - RNA, 16 nt, Human
ccaggagcagccacau

SEQ ID NO: 1823911 - RNA, 19 nt, Human
ccaggagccuccugcccuu

SEQ ID NO: 1823912 - RNA, 18 nt, Human
ccaggagccuccugcccu

SEQ ID NO: 1823913 - RNA, 13 nt, Human
ccaggagccuccu

SEQ ID NO: 1823914 - RNA, 14 nt, Human
ccaggagccuccug

SEQ ID NO: 1823915 - RNA, 12 nt, Human
ccaggaggccag

SEQ ID NO: 1823916 - RNA, 14 nt, Human
ccaggaggccagcc

SEQ ID NO: 1823917 - RNA, 13 nt, Human
ccaggaggccagc

SEQ ID NO: 1823918 - RNA, 21 nt, Human
ccaggccacaagacccuugug

SEQ ID NO: 1823919 - RNA, 24 nt, Human
ccaggcauuccccaggaggccagc

SEQ ID NO: 1823920 - RNA, 23 nt, Human
ccaggcauuccccaggaggccag

SEQ ID NO: 1823921 - RNA, 22 nt, Human
ccaggcauuccccaggaggcca

SEQ ID NO: 1823922 - RNA, 13 nt, Human
ccaggcauggugg

SEQ ID NO: 1823923 - RNA, 17 nt, Human
ccaggcauuccccagga

SEQ ID NO: 1823924 - RNA, 14 nt, Human
ccaggcauucccca

SEQ ID NO: 1823925 - RNA, 17 nt, Human
ccagcuggggccaggcu

SEQ ID NO: 1823926 - RNA, 18 nt, Human
ccagcuggggccaggcug

SEQ ID NO: 1823927 - RNA, 19 nt, Human
ccagcuggggccaggcugg

SEQ ID NO: 1823928 - RNA, 20 nt, Human
ccagcuggggccaggcuggg

SEQ ID NO: 1823929 - RNA, 21 nt, Human
ccagcuggggccaggcugggu

SEQ ID NO: 1823930 - RNA, 22 nt, Human
ccagcuggggccaggcuggguc

SEQ ID NO: 1823931 - RNA, 23 nt, Human
ccagcuggggccaggcugggucg

SEQ ID NO: 1823932 - RNA, 22 nt, Human
ccaggaagccagcaggcucuca

SEQ ID NO: 1823933 - RNA, 20 nt, Human
ccaggaagccagcaggcucu

SEQ ID NO: 1823934 - RNA, 16 nt, Human
ccagcgagcccuggug

SEQ ID NO: 1823935 - RNA, 15 nt, Human
ccagcgagcccuggu

SEQ ID NO: 1823936 - RNA, 14 nt, Human
ccagcgagcccugg

SEQ ID NO: 1823937 - RNA, 22 nt, Human
ccagccuugaccauucuccacc

SEQ ID NO: 1823938 - RNA, 11 nt, Human
ccagcucuggu

SEQ ID NO: 1823939 - RNA, 12 nt, Human
ccagcucugguc

SEQ ID NO: 1823940 - RNA, 13 nt, Human
ccagcucuggucc

SEQ ID NO: 1823941 - RNA, 16 nt, Human
ccagagcccaccuugg

SEQ ID NO: 1823942 - RNA, 22 nt, Human
ccagagcccaccuuggcucaag

SEQ ID NO: 1823943 - RNA, 19 nt, Human
ccagccuugaccauucucc

SEQ ID NO: 1823944 - RNA, 20 nt, Human
ccagccuugaccauucucca

SEQ ID NO: 1823945 - RNA, 20 nt, Human
ccagcugcuugggcuucauc

SEQ ID NO: 1823946 - RNA, 23 nt, Human
ccagcugcuugggcuucauccuc

SEQ ID NO: 1823947 - RNA, 24 nt, Human
ccagcuggagaaauaugguacuca

SEQ ID NO: 1823948 - RNA, 14 nt, Human
ccagcucuggucca

SEQ ID NO: 1823949 - RNA, 17 nt, Human
ccagcucugguccauag

SEQ ID NO: 1823950 - RNA, 21 nt, Human
ccagcucugguccauagagag

SEQ ID NO: 1823951 - RNA, 22 nt, Human
ccagcucugguccauagagagc

SEQ ID NO: 1823952 - RNA, 22 nt, Human
cccaggugcuaggaacacuccu

SEQ ID NO: 1823953 - RNA, 23 nt, Human
cccaggugcuaggaacacuccuu

SEQ ID NO: 1823954 - RNA, 20 nt, Human
cccagucuggaaugcagugg

SEQ ID NO: 1823955 - RNA, 13 nt, Human
cccagugcccaca

SEQ ID NO: 1823956 - RNA, 17 nt, Human
cccaggccuccuacagc

SEQ ID NO: 1823957 - RNA, 18 nt, Human
cccaggccuccuacagcu

SEQ ID NO: 1823958 - RNA, 15 nt, Human
cccaggccugccugu

SEQ ID NO: 1823959 - RNA, 16 nt, Human
cccaggccugccuguu

SEQ ID NO: 1823960 - RNA, 18 nt, Human
cccaggcgccccuucccc

SEQ ID NO: 1823961 - RNA, 14 nt, Human
cccaggcugagccu

SEQ ID NO: 1823962 - RNA, 21 nt, Human
cccaggagccccgaggccuuc

SEQ ID NO: 1823963 - RNA, 13 nt, Human
cccaggaggccag

SEQ ID NO: 1823964 - RNA, 22 nt, Human
cccaggaggccagccuugacca

SEQ ID NO: 1823965 - RNA, 13 nt, Human
cccaggcaggucu

SEQ ID NO: 1823966 - RNA, 11 nt, Human
cccaggcaggu

SEQ ID NO: 1823967 - RNA, 22 nt, Human
cccaggccccugccacccuggg

SEQ ID NO: 1823968 - RNA, 21 nt, Human
cccaggccccugccacccugg

SEQ ID NO: 1823969 - RNA, 18 nt, Human
cccaggccccugccaccc

SEQ ID NO: 1823970 - RNA, 16 nt, Human
cccaggccccugccac

SEQ ID NO: 1823971 - RNA, 11 nt, Human
cccaggccccu

SEQ ID NO: 1823972 - RNA, 17 nt, Human
cccaggcaggucuugaa

SEQ ID NO: 1823973 - RNA, 20 nt, Human
cccaggcauuccccaggagg

SEQ ID NO: 1823974 - RNA, 21 nt, Human
cccaggcauuccccaggaggc

SEQ ID NO: 1823975 - RNA, 22 nt, Human
cccaggcauuccccaggaggcc

SEQ ID NO: 1823976 - RNA, 23 nt, Human
cccaggcauuccccaggaggcca

SEQ ID NO: 1823977 - RNA, 15 nt, Human
cccagcgagcccugg

SEQ ID NO: 1823978 - RNA, 18 nt, Human
cccagcgagcccuggugg

SEQ ID NO: 1823979 - RNA, 17 nt, Human
cccagcgagcccuggug

SEQ ID NO: 1823980 - RNA, 23 nt, Human
cccagcgagcccugguggcagug

SEQ ID NO: 1823981 - RNA, 19 nt, Human
cccagcgagcccugguggc

SEQ ID NO: 1823982 - RNA, 11 nt, Human
cccagccccuu

SEQ ID NO: 1823983 - RNA, 23 nt, Human
cccagauugcaacaggcugggcu

SEQ ID NO: 1823984 - RNA, 23 nt, Human
cccagcaagugagagcugggugu

SEQ ID NO: 1823985 - RNA, 22 nt, Human
cccagcaagugagagcugggug

SEQ ID NO: 1823986 - RNA, 21 nt, Human
cccagcaagugagagcugggu

SEQ ID NO: 1823987 - RNA, 20 nt, Human
cccagcaagugagagcuggg

SEQ ID NO: 1823988 - RNA, 19 nt, Human
cccagcaagugagagcugg

SEQ ID NO: 1823989 - RNA, 12 nt, Human
cccagccugcua

SEQ ID NO: 1823990 - RNA, 18 nt, Human
cccagccccuucugaccc

SEQ ID NO: 1823991 - RNA, 18 nt, Human
cccagcaagugagagcug

SEQ ID NO: 1823992 - RNA, 16 nt, Human
cccagcaagugagagc

SEQ ID NO: 1823993 - RNA, 22 nt, Human
cccagauugcaacaggcugggc

SEQ ID NO: 1823994 - RNA, 21 nt, Human
cccagauugcaacaggcuggg

SEQ ID NO: 1823995 - RNA, 20 nt, Human
cccagauugcaacaggcugg

SEQ ID NO: 1823996 - RNA, 20 nt, Human
cccagagggccugcaaggga

SEQ ID NO: 1823997 - RNA, 18 nt, Human
cccagagggccugcaagg

SEQ ID NO: 1823998 - RNA, 23 nt, Human
cccaagggccuggccugagcugg

SEQ ID NO: 1823999 - RNA, 18 nt, Human
cccaagggccuggccuga

SEQ ID NO: 1824000 - RNA, 19 nt, Human
cccaagggccuggccugag

SEQ ID NO: 1824001 - RNA, 13 nt, Human
cccaacacaaaga

SEQ ID NO: 1824002 - RNA, 13 nt, Human
ccccaagccuggc

SEQ ID NO: 1824003 - RNA, 14 nt, Human
ccccaagccuggca

SEQ ID NO: 1824004 - RNA, 14 nt, Human
ccccacccaagggc

SEQ ID NO: 1824005 - RNA, 20 nt, Human
ccccacccaagggccuggcc

SEQ ID NO: 1824006 - RNA, 13 nt, Human
cccauucugccug

SEQ ID NO: 1824007 - RNA, 22 nt, Human
ccccaaauggaaaugggcagag

SEQ ID NO: 1824008 - RNA, 20 nt, Human
cccagugcccacaggaucag

SEQ ID NO: 1824009 - RNA, 15 nt, Human
cccagugcccacagg

SEQ ID NO: 1824010 - RNA, 18 nt, Human
cccagugccgagaaggaa

SEQ ID NO: 1824011 - RNA, 17 nt, Human
cccagugccgagaagga

SEQ ID NO: 1824012 - RNA, 15 nt, Human
cccaugcugcccugu

SEQ ID NO: 1824013 - RNA, 16 nt, Human
cccaugcugcccugug

SEQ ID NO: 1824014 - RNA, 17 nt, Human
cccaugcugcccuguga

SEQ ID NO: 1824015 - RNA, 18 nt, Human
cccaugcugcccugugag

SEQ ID NO: 1824016 - RNA, 17 nt, Human
ccccaggaggccagccu

SEQ ID NO: 1824017 - RNA, 22 nt, Human
ccccucagggucccugguggca

SEQ ID NO: 1824018 - RNA, 16 nt, Human
ccacaggaucagucug

SEQ ID NO: 1824019 - RNA, 15 nt, Human
ccacaggcccuuccu

SEQ ID NO: 1824020 - RNA, 16 nt, Human
ccacaggcccuuccuc

SEQ ID NO: 1824021 - RNA, 17 nt, Human
ccacaggcccuuccucu

SEQ ID NO: 1824022 - RNA, 18 nt, Human
ccacaggcccuuccucuc

SEQ ID NO: 1824023 - RNA, 19 nt, Human
ccacaggcccuuccucucc

SEQ ID NO: 1824024 - RNA, 22 nt, Human
ccacaggcccuuccucuccacu

SEQ ID NO: 1824025 - RNA, 23 nt, Human
ccacaggcccuuccucuccacug

SEQ ID NO: 1824026 - RNA, 12 nt, Human
ccacacuccagc

SEQ ID NO: 1824027 - RNA, 22 nt, Human
ccacacccagcccacuucugcc

SEQ ID NO: 1824028 - RNA, 21 nt, Human
ccacacccagcccacuucugc

SEQ ID NO: 1824029 - RNA, 15 nt, Human
ccacacccagcccac

SEQ ID NO: 1824030 - RNA, 20 nt, Human
ccacacccagcccacuucug

SEQ ID NO: 1824031 - RNA, 15 nt, Human
ccaccaacccucaga

SEQ ID NO: 1824032 - RNA, 21 nt, Human
ccaccaacauacucccaucug

SEQ ID NO: 1824033 - RNA, 16 nt, Human
ccacaugugcacaugc

SEQ ID NO: 1824034 - RNA, 16 nt, Human
ccacauuccugaugcu

SEQ ID NO: 1824035 - RNA, 17 nt, Human
ccacaucuugcucugcu

SEQ ID NO: 1824036 - RNA, 18 nt, Human
ccacaucuugcucugcug

SEQ ID NO: 1824037 - RNA, 19 nt, Human
ccacaucuugcucugcuga

SEQ ID NO: 1824038 - RNA, 20 nt, Human
ccacaucuugcucugcugac

SEQ ID NO: 1824039 - RNA, 20 nt, Human
ccacaguggaaccagcccag

SEQ ID NO: 1824040 - RNA, 16 nt, Human
ccaauauucauagcag

SEQ ID NO: 1824041 - RNA, 23 nt, Human
ccacccaggagccccgaggccuu

SEQ ID NO: 1824042 - RNA, 17 nt, Human
ccacccccacccaaggg

SEQ ID NO: 1824043 - RNA, 19 nt, Human
ccacuuagaaauugcauuu

SEQ ID NO: 1824044 - RNA, 18 nt, Human
ccacugcagaagacagua

SEQ ID NO: 1824045 - RNA, 13 nt, Human
ccacugcagaaga

SEQ ID NO: 1824046 - RNA, 21 nt, Human
ccacuuagaaauugcauuucc

SEQ ID NO: 1824047 - RNA, 13 nt, Human
ccacuucagcuga

SEQ ID NO: 1824048 - RNA, 14 nt, Human
ccacuucagcugac

SEQ ID NO: 1824049 - RNA, 23 nt, Human
ccagaaguuugagaucagccugg

SEQ ID NO: 1824050 - RNA, 22 nt, Human
ccagaaguuugagaucagccug

SEQ ID NO: 1824051 - RNA, 18 nt, Human
ccagaauuucccaaagca

SEQ ID NO: 1824052 - RNA, 21 nt, Human
ccagacaccuugacagggcac

SEQ ID NO: 1824053 - RNA, 21 nt, Human
ccagaauuucccaaagcagug

SEQ ID NO: 1824054 - RNA, 16 nt, Human
ccagaaugcuuuagga

SEQ ID NO: 1824055 - RNA, 23 nt, Human
ccagaauggucuuucuaaugugu

SEQ ID NO: 1824056 - RNA, 13 nt, Human
ccagaauuucaaa

SEQ ID NO: 1824057 - RNA, 12 nt, Human
ccagaauuuccc

SEQ ID NO: 1824058 - RNA, 19 nt, Human
ccagaauuucccaaagcag

SEQ ID NO: 1824059 - RNA, 15 nt, Human
ccagaccccuggcuu

SEQ ID NO: 1824060 - RNA, 16 nt, Human
ccagaccccuggcuuu

SEQ ID NO: 1824061 - RNA, 17 nt, Human
ccagaccccuggcuuuu

SEQ ID NO: 1824062 - RNA, 14 nt, Human
ccagaccccuggcu

SEQ ID NO: 1824063 - RNA, 18 nt, Human
ccacucaguccauagcag

SEQ ID NO: 1824064 - RNA, 20 nt, Human
ccacuccagaccccuggcuu

SEQ ID NO: 1824065 - RNA, 21 nt, Human
ccacuccagaccccuggcuuu

SEQ ID NO: 1824066 - RNA, 22 nt, Human
ccacuccagaccccuggcuuuu

SEQ ID NO: 1824067 - RNA, 16 nt, Human
ccacucaggucuguuu

SEQ ID NO: 1824068 - RNA, 11 nt, Human
ccacucagguc

SEQ ID NO: 1824069 - RNA, 14 nt, Human
ccacuacauucugu

SEQ ID NO: 1824070 - RNA, 15 nt, Human
ccacuacauucuguu

SEQ ID NO: 1824071 - RNA, 11 nt, Human
ccacuacauuc

SEQ ID NO: 1824072 - RNA, 15 nt, Human
ccacuagacccacug

SEQ ID NO: 1824073 - RNA, 17 nt, Human
ccacuagacccacugga

SEQ ID NO: 1824074 - RNA, 17 nt, Human
ccacuacauucuguuaa

SEQ ID NO: 1824075 - RNA, 16 nt, Human
ccacuacauucuguua

SEQ ID NO: 1824076 - RNA, 16 nt, Human
ccacgcuggagugcag

SEQ ID NO: 1824077 - RNA, 15 nt, Human
ccacccccacccaag

SEQ ID NO: 1824078 - RNA, 18 nt, Human
ccacggccaggccagagg

SEQ ID NO: 1824079 - RNA, 16 nt, Human
ccacggccaggccaga

SEQ ID NO: 1824080 - RNA, 19 nt, Human
ccacgcuggagugcaguga

SEQ ID NO: 1824081 - RNA, 18 nt, Human
ccacgcuggagugcagug

SEQ ID NO: 1824082 - RNA, 23 nt, Human
ccacggccaggccagagggagug

SEQ ID NO: 1824083 - RNA, 14 nt, Human
ccacgguguucugu

SEQ ID NO: 1824084 - RNA, 15 nt, Human
ccaccccacacacgc

SEQ ID NO: 1824085 - RNA, 19 nt, Human
ccaaagccaaagcuaggcc

SEQ ID NO: 1824086 - RNA, 23 nt, Human
ccaaagcagugcaugcugucccu

SEQ ID NO: 1824087 - RNA, 19 nt, Human
ccaaagcagugcaugcugu

SEQ ID NO: 1824088 - RNA, 17 nt, Human
ccaaagccuccuccagc

SEQ ID NO: 1824089 - RNA, 22 nt, Human
ccaaagccuccuccagccgcca

SEQ ID NO: 1824090 - RNA, 20 nt, Human
ccaaacucaccugccccuca

SEQ ID NO: 1824091 - RNA, 15 nt, Human
ccaaagcuaggccug

SEQ ID NO: 1824092 - RNA, 17 nt, Human
ccaaagcuaggccuggc

SEQ ID NO: 1824093 - RNA, 16 nt, Human
ccaaagcuaggccugg

SEQ ID NO: 1824094 - RNA, 21 nt, Human
ccaaagcuaggccuggccaga

SEQ ID NO: 1824095 - RNA, 15 nt, Human
ccaaaggaagcacau

SEQ ID NO: 1824096 - RNA, 23 nt, Human
ccaaaggaagcacaugccucucu

SEQ ID NO: 1824097 - RNA, 18 nt, Human
ccaaaguacacuguuuca

SEQ ID NO: 1824098 - RNA, 15 nt, Human
ccaaaguacacuguu

SEQ ID NO: 1824099 - RNA, 17 nt, Human
ccaaauuuucuuuuuau

SEQ ID NO: 1824100 - RNA, 20 nt, Human
ccaaaguacacuguuucaaa

SEQ ID NO: 1824101 - RNA, 20 nt, Human
ccaaccaaguggcucccaca

SEQ ID NO: 1824102 - RNA, 13 nt, Human
ccaacaucaacau

SEQ ID NO: 1824103 - RNA, 21 nt, Human
ccaacauacucccaucuguga

SEQ ID NO: 1824104 - RNA, 22 nt, Human
ccaacauacucccaucugugaa

SEQ ID NO: 1824105 - RNA, 17 nt, Human
ccaacauacucccaucu

SEQ ID NO: 1824106 - RNA, 18 nt, Human
ccaacauacucccaucug

SEQ ID NO: 1824107 - RNA, 19 nt, Human
ccaacauacucccaucugu

SEQ ID NO: 1824108 - RNA, 20 nt, Human
ccaacauacucccaucugug

SEQ ID NO: 1824109 - RNA, 16 nt, Human
ccaacauacucccauc

SEQ ID NO: 1824110 - RNA, 14 nt, Human
ccaacccucagagc

SEQ ID NO: 1824111 - RNA, 15 nt, Human
ccaacccucagagcc

SEQ ID NO: 1824112 - RNA, 15 nt, Human
ccaagaagcccagga

SEQ ID NO: 1824113 - RNA, 12 nt, Human
ccaacccucauc

SEQ ID NO: 1824114 - RNA, 20 nt, Human
ccaagaauagaugcugacug

SEQ ID NO: 1824115 - RNA, 19 nt, Human
ccaagaauagaugcugacu

SEQ ID NO: 1824116 - RNA, 19 nt, Human
ccaagaagcccaggaaagg

SEQ ID NO: 1824117 - RNA, 20 nt, Human
ccaagaagcccaggaaaggc

SEQ ID NO: 1824118 - RNA, 13 nt, Human
ccaagccguggcu

SEQ ID NO: 1824119 - RNA, 22 nt, Human
ccaagccuacuuuugccauuga

SEQ ID NO: 1824120 - RNA, 15 nt, Human
ccaagccuggcaagg

SEQ ID NO: 1824121 - RNA, 14 nt, Human
ccaagcucccaggc

SEQ ID NO: 1824122 - RNA, 15 nt, Human
ccaagcucccaggca

SEQ ID NO: 1824123 - RNA, 16 nt, Human
ccaagcucccaggcau

SEQ ID NO: 1824124 - RNA, 22 nt, Human
ccaagcucccaggcauucccca

SEQ ID NO: 1824125 - RNA, 17 nt, Human
ccaaggccaaaggaagc

SEQ ID NO: 1824126 - RNA, 22 nt, Human
ccaaggggaauguuugccucug

SEQ ID NO: 1824127 - RNA, 19 nt, Human
ccaagggccuggccugagc

SEQ ID NO: 1824128 - RNA, 16 nt, Human
ccaagggccuggccug

SEQ ID NO: 1824129 - RNA, 18 nt, Human
ccaagggccuggccugag

SEQ ID NO: 1824130 - RNA, 15 nt, Human
ccaagggccuggccu

SEQ ID NO: 1824131 - RNA, 18 nt, Human
ccaaggccaaaggaagca

SEQ ID NO: 1824132 - RNA, 21 nt, Human
ccaaggccaaaggaagcacau

SEQ ID NO: 1824133 - RNA, 20 nt, Human
ccaagucaagugaaaaagga

SEQ ID NO: 1824134 - RNA, 18 nt, Human
ccaaggugggaggauugc

SEQ ID NO: 1824135 - RNA, 13 nt, Human
ccaaggugggagg

SEQ ID NO: 1824136 - RNA, 23 nt, Human
ccaagguuuggggaagaacgaag

SEQ ID NO: 1824137 - RNA, 22 nt, Human
ccaauaguuguugauuggcagg

SEQ ID NO: 1824138 - RNA, 17 nt, Human
cauuguuggccaaagcc

SEQ ID NO: 1824139 - RNA, 18 nt, Human
cauuguuggccaaagcca

SEQ ID NO: 1824140 - RNA, 23 nt, Human
cauuguauucagaguugaugguu

SEQ ID NO: 1824141 - RNA, 14 nt, Human
cacccaagggccug

SEQ ID NO: 1824142 - RNA, 15 nt, Human
cacccaagggccugg

SEQ ID NO: 1824143 - RNA, 15 nt, Human
cauuguagagcuucu

SEQ ID NO: 1824144 - RNA, 16 nt, Human
cauuguagagcuucug

SEQ ID NO: 1824145 - RNA, 17 nt, Human
cauuguagagcuucugg

SEQ ID NO: 1824146 - RNA, 19 nt, Human
cauuguagagcuucuggca

SEQ ID NO: 1824147 - RNA, 21 nt, Human
cauuguagagcuucuggcacu

SEQ ID NO: 1824148 - RNA, 13 nt, Human
cauuuccuguguc

SEQ ID NO: 1824149 - RNA, 12 nt, Human
cauuuccugugu

SEQ ID NO: 1824150 - RNA, 16 nt, Human
cauuuaaaagauacag

SEQ ID NO: 1824151 - RNA, 15 nt, Human
cauuuaaaagauaca

SEQ ID NO: 1824152 - RNA, 20 nt, Human
cauuuaaaacauuaaaauau

SEQ ID NO: 1824153 - RNA, 12 nt, Human
cauuuaaaagau

SEQ ID NO: 1824154 - RNA, 21 nt, Human
cauuuaaaacauuaaaauaua

SEQ ID NO: 1824155 - RNA, 15 nt, Human
cauuuccuaaauaua

SEQ ID NO: 1824156 - RNA, 13 nt, Human
cauuuccugacag

SEQ ID NO: 1824157 - RNA, 20 nt, Human
cauuuccugacagaaggacu

SEQ ID NO: 1824158 - RNA, 17 nt, Human
cauuuaggccaugggac

SEQ ID NO: 1824159 - RNA, 22 nt, Human
cauuuaauggggaggacaaaau

SEQ ID NO: 1824160 - RNA, 18 nt, Human
cauuuuucagauauaaaa

SEQ ID NO: 1824161 - RNA, 20 nt, Human
cauuuuucagauauaaaaga

SEQ ID NO: 1824162 - RNA, 23 nt, Human
cauuuuucuuagggaaggauaca

SEQ ID NO: 1824163 - RNA, 19 nt, Human
ccaaacauccuacaagaca

SEQ ID NO: 1824164 - RNA, 20 nt, Human
ccaaacauccuacaagacac

SEQ ID NO: 1824165 - RNA, 17 nt, Human
ccaaacucaccugcccc

SEQ ID NO: 1824166 - RNA, 12 nt, Human
cauuuuguaaua

SEQ ID NO: 1824167 - RNA, 16 nt, Human
cauuuuguaauaauaa

SEQ ID NO: 1824168 - RNA, 13 nt, Human
cauuuuguaauaa

SEQ ID NO: 1824169 - RNA, 18 nt, Human
cauuugagcagggcucag

SEQ ID NO: 1824170 - RNA, 17 nt, Human
cauuugagcagggcuca

SEQ ID NO: 1824171 - RNA, 20 nt, Human
cauuugagcagggcucagcg

SEQ ID NO: 1824172 - RNA, 22 nt, Human
cauuuguuugaacugauaaaga

SEQ ID NO: 1824173 - RNA, 20 nt, Human
cauuuguuugaacugauaaa

SEQ ID NO: 1824174 - RNA, 13 nt, Human
cauuugcugaaua

SEQ ID NO: 1824175 - RNA, 17 nt, Human
cauuuguuugaacugau

SEQ ID NO: 1824176 - RNA, 13 nt, Human
cauuugcuccuuu

SEQ ID NO: 1824177 - RNA, 14 nt, Human
cauuugcuccuuuc

SEQ ID NO: 1824178 - RNA, 21 nt, Human
cauuugaaaccccuguaggcc

SEQ ID NO: 1824179 - RNA, 19 nt, Human
cauuugaaaccccuguagg

SEQ ID NO: 1824180 - RNA, 20 nt, Human
cauuugaaaauuuugauguu

SEQ ID NO: 1824181 - RNA, 22 nt, Human
cauuugaaaauuuugauguuuu

SEQ ID NO: 1824182 - RNA, 13 nt, Human
uuuuuucuuacug

SEQ ID NO: 1824183 - RNA, 23 nt, Human
uguccaagaagcccaggaaaggc

SEQ ID NO: 1824184 - RNA, 13 nt, Human
uucaggcucuucu

SEQ ID NO: 1824185 - RNA, 23 nt, Human
uacaggcuccugccaccacgccc

SEQ ID NO: 1824186 - RNA, 13 nt, Human
uacccgggaaggg

SEQ ID NO: 1824187 - RNA, 18 nt, Human
uaggcauugugggaaggg

SEQ ID NO: 1824188 - RNA, 15 nt, Human
uaagugcagccccgu

SEQ ID NO: 1824189 - RNA, 16 nt, Human
uaaucuggacuccucu

SEQ ID NO: 1824190 - RNA, 14 nt, Human
ugggacuggacaau

SEQ ID NO: 1824191 - RNA, 11 nt, Human
uggccacgccc

SEQ ID NO: 1824192 - RNA, 15 nt, Human
ugcacaaacagaggc

SEQ ID NO: 1824193 - RNA, 18 nt, Human
ugcauccuaacuccaugu

SEQ ID NO: 1824194 - RNA, 19 nt, Human
ugccaggaagccagcaggc

SEQ ID NO: 1824195 - RNA, 15 nt, Human
ucuccacugccuucg

SEQ ID NO: 1824196 - RNA, 13 nt, Human
ucucuaccauccc

SEQ ID NO: 1824197 - RNA, 21 nt, Human
uccgcuuucuacccagcgagc

SEQ ID NO: 1824198 - RNA, 21 nt, Human
uccugcacacgcuccuuccuc

SEQ ID NO: 1824199 - RNA, 12 nt, Human
uaguuaaccacu

SEQ ID NO: 1824200 - RNA, 14 nt, Human
ucaguagccagcau

SEQ ID NO: 1824201 - RNA, 15 nt, Human
ggaggggcugugggc

SEQ ID NO: 1824202 - RNA, 14 nt, Human
ggccccgcccaggc

SEQ ID NO: 1824203 - RNA, 17 nt, Human
gggcaacccuggugacc

SEQ ID NO: 1824204 - RNA, 14 nt, Human
ggcugaaauucaga

SEQ ID NO: 1824205 - RNA, 19 nt, Human
ggccccugccucucugcag

SEQ ID NO: 1824206 - RNA, 13 nt, Human
ggcccggccucuc

SEQ ID NO: 1824207 - RNA, 22 nt, Human
gcuucuucagagacuccugcag

SEQ ID NO: 1824208 - RNA, 20 nt, Human
gcuccagcuggccgggagcc

SEQ ID NO: 1824209 - RNA, 18 nt, Human
ggacgcucucuggccuuc

SEQ ID NO: 1824210 - RNA, 17 nt, Human
gcucucuggccuucggc

SEQ ID NO: 1824211 - RNA, 20 nt, Human
gcucuugaugccuggcgggg

SEQ ID NO: 1824212 - RNA, 17 nt, Human
ggaagcacaugccucuc

SEQ ID NO: 1824213 - RNA, 18 nt, Human
ggucuacacugugcugag

SEQ ID NO: 1824214 - RNA, 17 nt, Human
ggucucaaacuccugac

SEQ ID NO: 1824215 - RNA, 17 nt, Human
ggucucgaacuccugac

SEQ ID NO: 1824216 - RNA, 15 nt, Human
ggcugggucgcccug

SEQ ID NO: 1824217 - RNA, 14 nt, Human
ggcugugggcguga

SEQ ID NO: 1824218 - RNA, 21 nt, Human
ggcuguguguacuaauacaga

SEQ ID NO: 1824219 - RNA, 17 nt, Human
ggccucccaacucaccc

SEQ ID NO: 1824220 - RNA, 16 nt, Human
ggccucugcacucccc

SEQ ID NO: 1824221 - RNA, 18 nt, Human
ggaggguagagcggagaa

SEQ ID NO: 1824222 - RNA, 19 nt, Human
ggagggugacgggggugaa

SEQ ID NO: 1824223 - RNA, 15 nt, Human
ggaugcccaaagaug

SEQ ID NO: 1824224 - RNA, 18 nt, Human
gacccacuggacucaccu

SEQ ID NO: 1824225 - RNA, 17 nt, Human
gaaccaccacacccagc

SEQ ID NO: 1824226 - RNA, 23 nt, Human
gagcugccuguucagcuccagcu

SEQ ID NO: 1824227 - RNA, 20 nt, Human
gagacuuugacucuccagaa

SEQ ID NO: 1824228 - RNA, 13 nt, Human
gagagccuuccag

SEQ ID NO: 1824229 - RNA, 22 nt, Human
gagcccugggaggcucuggagc

SEQ ID NO: 1824230 - RNA, 18 nt, Human
gcacacagcacgggggcc

SEQ ID NO: 1824231 - RNA, 18 nt, Human
gcuaauuuugaaaaacug

SEQ ID NO: 1824232 - RNA, 14 nt, Human
gagcagggcucagc

SEQ ID NO: 1824233 - RNA, 19 nt, Human
gagaaugaaagggcccaga

SEQ ID NO: 1824234 - RNA, 16 nt, Human
cugucgcccaggcugg

SEQ ID NO: 1824235 - RNA, 22 nt, Human
gccccauucugccugcccaggc

SEQ ID NO: 1824236 - RNA, 16 nt, Human
gccucagccuccugag

SEQ ID NO: 1824237 - RNA, 16 nt, Human
gccucccgaguagcug

SEQ ID NO: 1824238 - RNA, 16 nt, Human
gccuccugaguagcug

SEQ ID NO: 1824239 - RNA, 21 nt, Human
gccucucccaucacuucccua

SEQ ID NO: 1824240 - RNA, 22 nt, Human
gcaccccagcuggggccaggcu

SEQ ID NO: 1824241 - RNA, 16 nt, Human
gauucuuuugcccaca

SEQ ID NO: 1824242 - RNA, 17 nt, Human
gcacacugagccagcag

SEQ ID NO: 1824243 - RNA, 12 nt, Human
gccaccaacaua

SEQ ID NO: 1824244 - RNA, 14 nt, Human
gccaccacgcccgg

SEQ ID NO: 1824245 - RNA, 17 nt, Human
gccacggccaggccaga

SEQ ID NO: 1824246 - RNA, 20 nt, Human
gccaggcugggucgcccugg

SEQ ID NO: 1824247 - RNA, 20 nt, Human
agcccuuccaugucgccucu

SEQ ID NO: 1824248 - RNA, 12 nt, Human
agccgggcgugg

SEQ ID NO: 1824249 - RNA, 15 nt, Human
agccaccacgcccgg

SEQ ID NO: 1824250 - RNA, 13 nt, Human
agagcccacgccc

SEQ ID NO: 1824251 - RNA, 18 nt, Human
aggcccagagggccugca

SEQ ID NO: 1824252 - RNA, 22 nt, Human
aggcaccuaccaccacgcccgg

SEQ ID NO: 1824253 - RNA, 23 nt, Human
agggaggacgcucucuggccuuc

SEQ ID NO: 1824254 - RNA, 17 nt, Human
aguuucugccgcagccc

SEQ ID NO: 1824255 - RNA, 19 nt, Human
acggcucacugcagccuca

SEQ ID NO: 1824256 - RNA, 22 nt, Human
acacugaugggcaacccccagc

SEQ ID NO: 1824257 - RNA, 22 nt, Human
cccacagcgcuggccgggaccc

SEQ ID NO: 1824258 - RNA, 16 nt, Human
uuugcugucccuuuuc

SEQ ID NO: 1824259 - RNA, 19 nt, Human
ccugcccugugggccccca

SEQ ID NO: 1824260 - RNA, 17 nt, Human
ggcuggccuggccccuc

SEQ ID NO: 1824261 - RNA, 15 nt, Human
ggccccgcccaggcu

SEQ ID NO: 1824262 - RNA, 15 nt, Human
ggccccugcccggcu

SEQ ID NO: 1824263 - RNA, 16 nt, Human
ggcucuggagcccacu

SEQ ID NO: 1824264 - RNA, 12 nt, Human
ggaagcagcuuu

SEQ ID NO: 1824265 - RNA, 19 nt, Human
uugacagggcacaccgggc

SEQ ID NO: 1824266 - RNA, 13 nt, Human
uugcccacgcugg

SEQ ID NO: 1824267 - RNA, 17 nt, Human
ggccuccauccugaggc

SEQ ID NO: 1824268 - RNA, 14 nt, Human
gggucgcccuggac

SEQ ID NO: 1824269 - RNA, 18 nt, Human
ccuccccuccuccuggac

SEQ ID NO: 1824270 - RNA, 18 nt, Human
ccucuccacugccuucga

SEQ ID NO: 1824271 - RNA, 21 nt, Human
cccaccucucucacuccuuga

SEQ ID NO: 1824272 - RNA, 12 nt, Human
cccacucccugc

SEQ ID NO: 1824273 - RNA, 17 nt, Human
gcucuugaacuccugac

SEQ ID NO: 1824274 - RNA, 20 nt, Human
gcugacuguacuccucccag

SEQ ID NO: 1824275 - RNA, 18 nt, Human
gcugcccuggugcugcca

SEQ ID NO: 1824276 - RNA, 15 nt, Human
gcugggucgcccugg

SEQ ID NO: 1824277 - RNA, 22 nt, Human
gcuaggaccccuccaugugggc

SEQ ID NO: 1824278 - RNA, 17 nt, Human
gcuccaaaugcagcuuu

SEQ ID NO: 1824279 - RNA, 17 nt, Human
gcggccccggccggggu

SEQ ID NO: 1824280 - RNA, 19 nt, Human
cgcgugcacacaccagagc

SEQ ID NO: 1824281 - RNA, 17 nt, Human
cgcugccccuggcagcc

SEQ ID NO: 1824282 - RNA, 19 nt, Human
cgcuggccgggaccccgag

SEQ ID NO: 1824283 - RNA, 15 nt, Human
cgauaguggugguga

SEQ ID NO: 1824284 - RNA, 22 nt, Human
gcgcaugucacggagggugacg

SEQ ID NO: 1824285 - RNA, 14 nt, Human
gcgcuggccgggac

SEQ ID NO: 1824286 - RNA, 13 nt, Human
uuggccaggcugg

SEQ ID NO: 1824287 - RNA, 22 nt, Human
gguagagacuuugacucuccag

SEQ ID NO: 1824288 - RNA, 15 nt, Human
gggugaacuugguuc

SEQ ID NO: 1824289 - RNA, 23 nt, Human
gggugacauguguuggcagccuc

SEQ ID NO: 1824290 - RNA, 22 nt, Human
ggucucacuauguugcccaggc

SEQ ID NO: 1824291 - RNA, 21 nt, Human
ggucucacucugucgcccagu

SEQ ID NO: 1824292 - RNA, 16 nt, Human
gcccaccuggccucug

SEQ ID NO: 1824293 - RNA, 19 nt, Human
gcccugcuuugggcugccc

SEQ ID NO: 1824294 - RNA, 20 nt, Human
gcccuggacugugugcucag

SEQ ID NO: 1824295 - RNA, 18 nt, Human
gcucacagaacccuugga

SEQ ID NO: 1824296 - RNA, 21 nt, Human
gcucagcugucaaggcucagu

SEQ ID NO: 1824297 - RNA, 20 nt, Human
gucuaccugaggggccucuu

SEQ ID NO: 1824298 - RNA, 23 nt, Human
gucacggagggugacggggguga

SEQ ID NO: 1824299 - RNA, 17 nt, Human
guccaagaagcccagga

SEQ ID NO: 1824300 - RNA, 19 nt, Human
ggcuccuuuagcgcccagu

SEQ ID NO: 1824301 - RNA, 23 nt, Human
guacacagaacacauaauucagg

SEQ ID NO: 1824302 - RNA, 15 nt, Human
guacuuguggacaca

SEQ ID NO: 1824303 - RNA, 18 nt, Human
ggcaccagcagccuggac

SEQ ID NO: 1824304 - RNA, 13 nt, Human
ggacuggccucug

SEQ ID NO: 1824305 - RNA, 21 nt, Human
ggauccuggaguucugguucc

SEQ ID NO: 1824306 - RNA, 15 nt, Human
ggcccucugcccacu

SEQ ID NO: 1824307 - RNA, 18 nt, Human
ggaagccagcaggcucuc

SEQ ID NO: 1824308 - RNA, 20 nt, Human
ggggccaggcugggucgccc

SEQ ID NO: 1824309 - RNA, 15 nt, Human
ggggcugacagacag

SEQ ID NO: 1824310 - RNA, 12 nt, Human
ggggugcugggc

SEQ ID NO: 1824311 - RNA, 22 nt, Human
ucacaggagggagggggaaggc

SEQ ID NO: 1824312 - RNA, 20 nt, Human
ucagugucaaugcagccccc

SEQ ID NO: 1824313 - RNA, 16 nt, Human
cuucaaccccaugaga

SEQ ID NO: 1824314 - RNA, 19 nt, Human
cugcgguccacccaggagc

SEQ ID NO: 1824315 - RNA, 22 nt, Human
cuggucccacucaguccauagc

SEQ ID NO: 1824316 - RNA, 22 nt, Human
cucgcucuguugcccaggcugg

SEQ ID NO: 1824317 - RNA, 14 nt, Human
cuaaagcugccagc

SEQ ID NO: 1824318 - RNA, 18 nt, Human
cucccacagcgcuggccg

SEQ ID NO: 1824319 - RNA, 14 nt, Human
cuguucccaugaga

SEQ ID NO: 1824320 - RNA, 17 nt, Human
cuucggccuccauccug

SEQ ID NO: 1824321 - RNA, 14 nt, Human
uccaagcuccaucu

SEQ ID NO: 1824322 - RNA, 21 nt, Human
ucugauccuaguuccaccauc

SEQ ID NO: 1824323 - RNA, 18 nt, Human
gugcugcccugcccaccu

SEQ ID NO: 1824324 - RNA, 22 nt, Human
gugaugaugaaaugaggucaga

SEQ ID NO: 1824325 - RNA, 13 nt, Human
gguccugcugcag

SEQ ID NO: 1824326 - RNA, 20 nt, Human
ggucccggagaggccucgac

SEQ ID NO: 1824327 - RNA, 16 nt, Human
guaugggagagaagag

SEQ ID NO: 1824328 - RNA, 21 nt, Human
uaggcaccuaccaccacgccc

SEQ ID NO: 1824329 - RNA, 21 nt, Human
guucagcuccagcucaccagc

SEQ ID NO: 1824330 - RNA, 14 nt, Human
ugaaggccccgccc

SEQ ID NO: 1824331 - RNA, 15 nt, Human
ugagccaccacgccc

SEQ ID NO: 1824332 - RNA, 20 nt, Human
ugauccacucgccuucaucu

SEQ ID NO: 1824333 - RNA, 15 nt, Human
ugugcucaggagccc

SEQ ID NO: 1824334 - RNA, 23 nt, Human
uuugauguucuuucacccuuuuc

SEQ ID NO: 1824335 - RNA, 18 nt, Human
uugacgccaucccagccc

SEQ ID NO: 1824336 - RNA, 16 nt, Human
gcaguggugcgaucug

SEQ ID NO: 1824337 - RNA, 18 nt, Human
gauccuaguuccaccauc

SEQ ID NO: 1824338 - RNA, 21 nt, Human
gauccuuuuggagucagacag

SEQ ID NO: 1824339 - RNA, 20 nt, Human
gagaccccgggagccgggga

SEQ ID NO: 1824340 - RNA, 16 nt, Human
acccaccucagccucc

SEQ ID NO: 1824341 - RNA, 16 nt, Human
accgcgcccagccuca

SEQ ID NO: 1824342 - RNA, 14 nt, Human
acugaccagccucc

SEQ ID NO: 1824343 - RNA, 21 nt, Human
accuuucaauaggaaaaacug

SEQ ID NO: 1824344 - RNA, 13 nt, Human
ucuucuccaccuc

SEQ ID NO: 1824345 - RNA, 19 nt, Human
ucuucuggguuccuuccuc

SEQ ID NO: 1824346 - RNA, 18 nt, Human
ucuugaugccuggcgggg

SEQ ID NO: 1824347 - RNA, 18 nt, Human
ugagccacugcaccgggc

SEQ ID NO: 1824348 - RNA, 9 nt, Human
ugcccagcc

SEQ ID NO: 1824349 - RNA, 15 nt, Human
uuaaaugcccagccc

SEQ ID NO: 1824350 - RNA, 22 nt, Human
cugcugagucccaggcugagcc

SEQ ID NO: 1824351 - RNA, 14 nt, Human
cucuggagguacga

SEQ ID NO: 1824352 - RNA, 18 nt, Human
cucuggccuucggccucc

SEQ ID NO: 1824353 - RNA, 16 nt, Human
cugcccugcccaccug

SEQ ID NO: 1824354 - RNA, 19 nt, Human
ccugcccuuaccugccagg

SEQ ID NO: 1824355 - RNA, 18 nt, Human
ccuggcgggguggggugg

SEQ ID NO: 1824356 - RNA, 15 nt, Human
ccuggcucucccagc

SEQ ID NO: 1824357 - RNA, 18 nt, Human
cgccccucccacagcgcu

SEQ ID NO: 1824358 - RNA, 21 nt, Human
ccguggcgcuuucugcaguuu

SEQ ID NO: 1824359 - RNA, 13 nt, Human
cuucgccaccugg

SEQ ID NO: 1824360 - RNA, 17 nt, Human
cuucugcuucagccucc

SEQ ID NO: 1824361 - RNA, 17 nt, Human
cuccugccucagccucc

SEQ ID NO: 1824362 - RNA, 19 nt, Human
cucuccuuggugucgggca

SEQ ID NO: 1824363 - RNA, 14 nt, Human
cuaauuccccagau

SEQ ID NO: 1824364 - RNA, 16 nt, Human
cuaccaccacgcccgg

SEQ ID NO: 1824365 - RNA, 18 nt, Human
cggccuccauccugaggc

SEQ ID NO: 1824366 - RNA, 23 nt, Human
cucccacagcgcuggccgggacc

SEQ ID NO: 1824367 - RNA, 16 nt, Human
cuccccuucacuccca

SEQ ID NO: 1824368 - RNA, 14 nt, Human
cucccucauuccac

SEQ ID NO: 1824369 - RNA, 22 nt, Human
cucccuuggggccuaugcagag

SEQ ID NO: 1824370 - RNA, 20 nt, Human
cggagggugacgggggugaa

SEQ ID NO: 1824371 - RNA, 18 nt, Human
cugggaggcucuggagcc

SEQ ID NO: 1824372 - RNA, 15 nt, Human
cugcacuccaugagu

SEQ ID NO: 1824373 - RNA, 16 nt, Human
cugccaccacgcccgg

SEQ ID NO: 1824374 - RNA, 15 nt, Human
cuggggccaggcugg

SEQ ID NO: 1824375 - RNA, 16 nt, Human
cuggucuuauuuguaa

SEQ ID NO: 1824376 - RNA, 17 nt, Human
cugaaauaacauggccu

SEQ ID NO: 1824377 - RNA, 14 nt, Human
cuccucugcugcug

SEQ ID NO: 1824378 - RNA, 17 nt, Human
cuccacucugaguccca

SEQ ID NO: 1824379 - RNA, 17 nt, Human
cucugcaggucccuaau

SEQ ID NO: 1824380 - RNA, 23 nt, Human
cucugcccuaaugcgcaggcugg

SEQ ID NO: 1824381 - RNA, 18 nt, Human
ccaaacauccuacaagac

SEQ ID NO: 1824382 - RNA, 17 nt, Human
ccaaagccuccuccagc

SEQ ID NO: 1824383 - RNA, 14 nt, Human
caggggaggguaga

SEQ ID NO: 1824384 - RNA, 19 nt, Human
caguaauaacucuacccug

SEQ ID NO: 1824385 - RNA, 16 nt, Human
cagcuggccgggagcc

SEQ ID NO: 1824386 - RNA, 18 nt, Human
caggcccuuccucuccac

SEQ ID NO: 1824387 - RNA, 12 nt, Human
cccucgaggcgg

SEQ ID NO: 1824388 - RNA, 22 nt, Human
ccgacccuugccgucuaccuga

SEQ ID NO: 1824389 - RNA, 19 nt, Human
ccuguuucagaggcucaga

SEQ ID NO: 1824390 - RNA, 14 nt, Human
ccaggccacaagac

SEQ ID NO: 1824391 - RNA, 14 nt, Human
cauuugcuggagcu

SEQ ID NO: 1824392 - RNA, 15 nt, Human
ccacugcacuccagc

SEQ ID NO: 1824393 - RNA, 16 nt, Human
cccacagcgcuggccg

SEQ ID NO: 1824394 - RNA, 13 nt, Human
caccagggaaggg

SEQ ID NO: 1824395 - RNA, 15 nt, Human
caccccggccaccug

SEQ ID NO: 1824396 - RNA, 20 nt, Human
ccaauauucauagcagcuua

SEQ ID NO: 1824397 - RNA, 22 nt, Human
ccagcccuccuuaucaaaggac

SEQ ID NO: 1824398 - RNA, 19 nt, Human
ccaggcacugcugcccagc

SEQ ID NO: 1824399 - RNA, 15 nt, Human
cacugccaugccagc

SEQ ID NO: 1824400 - RNA, 14 nt, Human
cagggacugccagu

SEQ ID NO: 1824401 - RNA, 23 nt, Human
caggugugagccaccacgcccgg

SEQ ID NO: 1824402 - RNA, 14 nt, Human
cagguugaacccaa

SEQ ID NO: 1824403 - RNA, 19 nt, Human
ccacagcgcuggccgggac

SEQ ID NO: 1824404 - RNA, 18 nt, Human
caggcgugaccugccagg

SEQ ID NO: 1824405 - RNA, 20 nt, Human
cacuuggucugugagaugcu

SEQ ID NO: 1824406 - RNA, 14 nt, Human
cacagcgcuggccg

SEQ ID NO: 1824407 - RNA, 14 nt, Human
caaaaacauggccu

SEQ ID NO: 1824408 - RNA, 12 nt, Human
caaugccucgac

SEQ ID NO: 1824409 - RNA, 14 nt, Human
cagcagccuggacc

SEQ ID NO: 1824410 - RNA, 17 nt, Human
cagggacccacggagcc

SEQ ID NO: 1824411 - RNA, 17 nt, Human
agauacaggaaaagcug

SEQ ID NO: 1824412 - RNA, 15 nt, Human
agacagaaaaaacug

SEQ ID NO: 1824413 - RNA, 14 nt, Human
agcggcuggcagcc

SEQ ID NO: 1824414 - RNA, 15 nt, Human
agcuccugaaaaaug

SEQ ID NO: 1824415 - RNA, 20 nt, Human
agcaggacauggacaaggau

SEQ ID NO: 1824416 - RNA, 13 nt, Human
caaagugcuggga

SEQ ID NO: 1824417 - RNA, 17 nt, Human
caaaugucuuccuggau

SEQ ID NO: 1824418 - RNA, 20 nt, Human
agccaauuuaaagaaaacug

SEQ ID NO: 1824419 - RNA, 10 nt, Human
aggcggugag

SEQ ID NO: 1824420 - RNA, 19 nt, Human
aggcuggccaacgggguga

SEQ ID NO: 1824421 - RNA, 18 nt, Human
aguuggucccccuuccau

SEQ ID NO: 1824422 - RNA, 14 nt, Human
auccagaaaaacug

SEQ ID NO: 1824423 - RNA, 14 nt, Human
acagcccuccaucu

SEQ ID NO: 1824424 - RNA, 21 nt, Human
ucucugguuccuccccuccuc

SEQ ID NO: 1824425 - RNA, 21 nt, Human
uccuggugguauuuagccacu

SEQ ID NO: 1824426 - RNA, 13 nt, Human
ucggccuccaucc

SEQ ID NO: 1824427 - RNA, 19 nt, Human
gucucacuguugcccaggc

SEQ ID NO: 1824428 - RNA, 15 nt, Human
gucuaaaaauucaga

SEQ ID NO: 1824429 - RNA, 18 nt, Human
auucucauuugucacaca

SEQ ID NO: 1824430 - RNA, 19 nt, Human
auggacuccuguuguugaa

SEQ ID NO: 1824431 - RNA, 22 nt, Human
aggugggaggaucucuugagcc

SEQ ID NO: 1824432 - RNA, 23 nt, Human
auacacacacacgcgugcacaca

SEQ ID NO: 1824433 - RNA, 16 nt, Human
agcuugcccuggugcc

SEQ ID NO: 1824434 - RNA, 20 nt, Human
agcucaucucagcuccugaa

SEQ ID NO: 1824435 - RNA, 23 nt, Human
agcucuguccugggagugagcug

SEQ ID NO: 1824436 - RNA, 15 nt, Human
agcaagugagagcug

SEQ ID NO: 1824437 - RNA, 20 nt, Human
agagguuaagguggguacgg

SEQ ID NO: 1824438 - RNA, 21 nt, Human
agccuggcuccaaacccucga

SEQ ID NO: 1824439 - RNA, 20 nt, Human
agugggggaucacagccucu

SEQ ID NO: 1824440 - RNA, 14 nt, Human
accgcagacaggac

SEQ ID NO: 1824441 - RNA, 24 nt, Human
acgccaggggaaaaucagccugcu

SEQ ID NO: 1824442 - RNA, 23 nt, Human
agaaaaaauauuuuccugccagg

SEQ ID NO: 1824443 - RNA, 17 nt, Human
acugcugcccagccucc

SEQ ID NO: 1824444 - RNA, 23 nt, Human
aucuucugaacuuggcgcugccc

SEQ ID NO: 1824445 - RNA, 13 nt, Human
gcccaggccuccu

SEQ ID NO: 1824446 - RNA, 14 nt, Human
gccaggagccuccu

SEQ ID NO: 1824447 - RNA, 16 nt, Human
gccucggacuuagcug

SEQ ID NO: 1824448 - RNA, 14 nt, Human
gaucuuugcagaca

SEQ ID NO: 1824449 - RNA, 23 nt, Human
gcagaagacaguauggcagcuuu

SEQ ID NO: 1824450 - RNA, 13 nt, Human
gcagugggagcug

SEQ ID NO: 1824451 - RNA, 16 nt, Human
gagccuugggaccccu

SEQ ID NO: 1824452 - RNA, 17 nt, Human
gagggcacugguggccc

SEQ ID NO: 1824453 - RNA, 19 nt, Human
gaaaggacacuagaagauu

SEQ ID NO: 1824454 - RNA, 14 nt, Human
gagccugaucaccu

SEQ ID NO: 1824455 - RNA, 19 nt, Human
gaccccugagcuugcagag

SEQ ID NO: 1824456 - RNA, 17 nt, Human
cucccaccucagccucc

SEQ ID NO: 1824457 - RNA, 22 nt, Human
cugaggacacuaaccacgcugg

SEQ ID NO: 1824458 - RNA, 15 nt, Human
cucuccucuugccac

SEQ ID NO: 1824459 - RNA, 15 nt, Human
cuucccacuggaggc

SEQ ID NO: 1824460 - RNA, 22 nt, Human
cuggggccaggcugggucgccc

SEQ ID NO: 1824461 - RNA, 15 nt, Human
cuguaucccaugagc

SEQ ID NO: 1824462 - RNA, 13 nt, Human
cugugccaugugc

SEQ ID NO: 1824463 - RNA, 21 nt, Human
cugccuguugggccaggagcc

SEQ ID NO: 1824464 - RNA, 19 nt, Human
cugcggugcuaucuccccc

SEQ ID NO: 1824465 - RNA, 12 nt, Human herpesvirus 2
ggccgcuggggg

SEQ ID NO: 1824466 - RNA, 16 nt, Human herpesvirus 2
gggccgacgugccggg

SEQ ID NO: 1824467 - RNA, 21 nt, Human herpesvirus 2
ccucgugcgcaugggccgcca

SEQ ID NO: 1824468 - RNA, 18 nt, Human herpesvirus 2
ccaaccccgucucccugc

SEQ ID NO: 1824469 - RNA, 16 nt, Human herpesvirus 2
guucgcgggcgacgcc

SEQ ID NO: 1824470 - RNA, 15 nt, Human herpesvirus 2
ggcccggacuccgcc

SEQ ID NO: 1824471 - RNA, 19 nt, Human herpesvirus 2
ccgcuacugcgccaccguc

SEQ ID NO: 1824472 - RNA, 20 nt, Human herpesvirus 2
cagcguaacgcacccccgga

SEQ ID NO: 1824473 - RNA, 18 nt, Human herpesvirus 2
caccagcucgggggccag

SEQ ID NO: 1824474 - RNA, 18 nt, Human herpesvirus 2
gccccccgucccgagccc

SEQ ID NO: 1824475 - RNA, 12 nt, Human herpesvirus 2
ccgggcccggcc

SEQ ID NO: 1824476 - RNA, 17 nt, Human herpesvirus 2
gggugugacccccccau

SEQ ID NO: 1824477 - RNA, 19 nt, Human herpesvirus 2
cugaaccgcuggcuggaga

SEQ ID NO: 1824478 - RNA, 23 nt, Human herpesvirus 2
ggacaucacccacgucgcccccc

SEQ ID NO: 1824479 - RNA, 16 nt, Human herpesvirus 2
cgcagaccaccucgcg

SEQ ID NO: 1824480 - RNA, 16 nt, Human herpesvirus 2
cuucgccgacgccuuc

SEQ ID NO: 1824481 - RNA, 12 nt, Human herpesvirus 2
uuguuggaugau

SEQ ID NO: 1824482 - RNA, 17 nt, Human herpesvirus 2
uucuggucauggcccuu

SEQ ID NO: 1824483 - RNA, 17 nt, Human herpesvirus 2
cgacggcgucucccggg

SEQ ID NO: 1824484 - RNA, 13 nt, Human herpesvirus 2
ccccacuccaccc

SEQ ID NO: 1824485 - RNA, 19 nt, Human herpesvirus 2
gccggggagggcagggccg

SEQ ID NO: 1824486 - RNA, 13 nt, Human herpesvirus 2
gaacggucuccgc

SEQ ID NO: 1824487 - RNA, 21 nt, Human herpesvirus 2
ccucucgaucccgaagccauc

SEQ ID NO: 1824488 - RNA, 14 nt, Human herpesvirus 2
cgccaccggccugg

SEQ ID NO: 1824489 - RNA, 22 nt, Human herpesvirus 2
agcccugccccgcccccucucc

SEQ ID NO: 1824490 - RNA, 12 nt, Human herpesvirus 2
acgagacagacg

SEQ ID NO: 1824491 - RNA, 17 nt, Human herpesvirus 2
ugcgacggcgucucccg

SEQ ID NO: 1824492 - RNA, 14 nt, Human herpesvirus 2
cacuucgcugucag

SEQ ID NO: 1824493 - RNA, 14 nt, Human herpesvirus 2
ggacugggagccgc

SEQ ID NO: 1824494 - RNA, 21 nt, Human herpesvirus 2
cuaaccgcgcgccuccucgcg

SEQ ID NO: 1824495 - RNA, 22 nt, Human herpesvirus 2
ccccgggcguuauaagccgccg

SEQ ID NO: 1824496 - RNA, 12 nt, Human herpesvirus 2
uguucuccugga

SEQ ID NO: 1824497 - RNA, 16 nt, Human herpesvirus 2
ccggggagggcagggc

SEQ ID NO: 1824498 - RNA, 19 nt, Human herpesvirus 2
uaggcccggggggggccuc

SEQ ID NO: 1824499 - RNA, 17 nt, Human herpesvirus 2
gcagccgcgccgcugcc

SEQ ID NO: 1824500 - RNA, 20 nt, Human herpesvirus 2
agguggggggggggaaagac

SEQ ID NO: 1824501 - RNA, 22 nt, Human herpesvirus 2
uuugugaugcuuuugacacacu

SEQ ID NO: 1824502 - RNA, 16 nt, Human herpesvirus 2
ggcacgagaagccgcc

SEQ ID NO: 1824503 - RNA, 23 nt, Human herpesvirus 2
ccccugggugucgaccgcugucg

SEQ ID NO: 1824504 - RNA, 16 nt, Human herpesvirus 2
gggggcccgggguucu

SEQ ID NO: 1824505 - RNA, 15 nt, Human herpesvirus 2
cuccccgcuggagcc

SEQ ID NO: 1824506 - RNA, 18 nt, Human herpesvirus 2
gaguucaauagauuuccc

SEQ ID NO: 1824507 - RNA, 14 nt, Human herpesvirus 2
cccaggcgacgcca

SEQ ID NO: 1824508 - RNA, 12 nt, Human herpesvirus 2
ucgggcugcugg

SEQ ID NO: 1824509 - RNA, 15 nt, Human herpesvirus 2
agcucgccgugaaga

SEQ ID NO: 1824510 - RNA, 21 nt, Human herpesvirus 2
gccagagacccugccccccgg

SEQ ID NO: 1824511 - RNA, 15 nt, Human herpesvirus 2
gaggggggcagugca

SEQ ID NO: 1824512 - RNA, 16 nt, Human herpesvirus 2
gccguacgucugcccg

SEQ ID NO: 1824513 - RNA, 14 nt, Human herpesvirus 2
gccccaccccgccc

SEQ ID NO: 1824514 - RNA, 15 nt, Human herpesvirus 2
gggugaggaagaaag

SEQ ID NO: 1824515 - RNA, 15 nt, Human herpesvirus 2
gggcgaaaaggcccg

SEQ ID NO: 1824516 - RNA, 21 nt, Human herpesvirus 2
ucucccucuuucccucccucg

SEQ ID NO: 1824517 - RNA, 16 nt, Human herpesvirus 2
cacccgggcgccgggg

SEQ ID NO: 1824518 - RNA, 21 nt, Human herpesvirus 2
cccggcggccgcauauacugc

SEQ ID NO: 1824519 - RNA, 10 nt, Human herpesvirus 2
cggcugggga

SEQ ID NO: 1824520 - RNA, 22 nt, Human herpesvirus 2
gcgccuaccugguacccacgga

SEQ ID NO: 1824521 - RNA, 16 nt, Human herpesvirus 2
gcuucgggacccgccu

SEQ ID NO: 1824522 - RNA, 16 nt, Human herpesvirus 2
gcgaggccgcucuccg

SEQ ID NO: 1824523 - RNA, 15 nt, Human herpesvirus 2
ggaggcgccucugcc

SEQ ID NO: 1824524 - RNA, 23 nt, Human herpesvirus 2
uagaacgccagauguggggugcg

SEQ ID NO: 1824525 - RNA, 14 nt, Human herpesvirus 2
gcucccugcggcug

SEQ ID NO: 1824526 - RNA, 22 nt, Human herpesvirus 2
uccggcaacccuccucgcugcg

SEQ ID NO: 1824527 - RNA, 13 nt, Human herpesvirus 2
cgguggacaugag

SEQ ID NO: 1824528 - RNA, 13 nt, Human herpesvirus 2
ggcucgcggggcc

SEQ ID NO: 1824529 - RNA, 14 nt, Human herpesvirus 2
ccgggagguucccc

SEQ ID NO: 1824530 - RNA, 15 nt, Human herpesvirus 2
gucaccuggcucgcc

SEQ ID NO: 1824531 - RNA, 19 nt, Human herpesvirus 2
ccuguacgacagcggggac

SEQ ID NO: 1824532 - RNA, 16 nt, Human herpesvirus 2
cggcgcucgguugucc

SEQ ID NO: 1824533 - RNA, 14 nt, Human herpesvirus 2
cgcccgccgcccuc

SEQ ID NO: 1824534 - RNA, 14 nt, Human herpesvirus 2
gcccgaccagcgcc

SEQ ID NO: 1824535 - RNA, 12 nt, Human herpesvirus 2
gagauggggaga

SEQ ID NO: 1824536 - RNA, 15 nt, Human herpesvirus 2
cccggucugugggug

SEQ ID NO: 1824537 - RNA, 14 nt, Human herpesvirus 2
gccuccccgcugga

SEQ ID NO: 1824538 - RNA, 19 nt, Human herpesvirus 2
cggaagagagcgccccgcc

SEQ ID NO: 1824539 - RNA, 12 nt, Human herpesvirus 2
agccccgcaggc

SEQ ID NO: 1824540 - RNA, 20 nt, Human herpesvirus 2
gacgcugucgacgagucuca

SEQ ID NO: 1824541 - RNA, 22 nt, Human herpesvirus 2
ggcccaaggcgcugcgccugcc

SEQ ID NO: 1824542 - RNA, 21 nt, Human herpesvirus 2
gggucccgccucccggccgcc

SEQ ID NO: 1824543 - RNA, 14 nt, Human herpesvirus 2
aaggcggacccaga

SEQ ID NO: 1824544 - RNA, 11 nt, Human herpesvirus 2
gucgcuaacga

SEQ ID NO: 1824545 - RNA, 18 nt, Human herpesvirus 2
gugccucacgguccucac

SEQ ID NO: 1824546 - RNA, 14 nt, Human herpesvirus 2
ggagcggcgaacac

SEQ ID NO: 1824547 - RNA, 13 nt, Human herpesvirus 2
guggcgcgccccc

SEQ ID NO: 1824548 - RNA, 13 nt, Human herpesvirus 2
ggggggggugugu

SEQ ID NO: 1824549 - RNA, 23 nt, Human herpesvirus 2
gcccggcgccgccccgccgcucc

SEQ ID NO: 1824550 - RNA, 23 nt, Human herpesvirus 2
gccccccccccucaccccuccga

SEQ ID NO: 1824551 - RNA, 13 nt, Human herpesvirus 2
gguccuggugggc

SEQ ID NO: 1824552 - RNA, 16 nt, Human herpesvirus 2
caagcuaagcgagaag

SEQ ID NO: 1824553 - RNA, 14 nt, Human herpesvirus 2
ugauggggguccug

SEQ ID NO: 1824554 - RNA, 14 nt, Human herpesvirus 2
aggaggggggccuc

SEQ ID NO: 1824555 - RNA, 14 nt, Human herpesvirus 2
ccuggcggacggcc

SEQ ID NO: 1824556 - RNA, 14 nt, Human herpesvirus 2
gugggugggugugg

SEQ ID NO: 1824557 - RNA, 13 nt, Human herpesvirus 2
cgcgggcgucccc

SEQ ID NO: 1824558 - RNA, 15 nt, Human herpesvirus 2
cccagacccucacag

SEQ ID NO: 1824559 - RNA, 15 nt, Human herpesvirus 2
ggggaaagugggccg

SEQ ID NO: 1824560 - RNA, 23 nt, Human herpesvirus 2
ccuccgcagcguaacgcaccccc

SEQ ID NO: 1824561 - RNA, 23 nt, Human herpesvirus 2
ccaacucauacacgcgcuggccc

SEQ ID NO: 1824562 - RNA, 15 nt, Human herpesvirus 2
caucgcguacagccu

SEQ ID NO: 1824563 - RNA, 21 nt, Human herpesvirus 2
agccccgcgaccaccaaggcc

SEQ ID NO: 1824564 - RNA, 23 nt, Human herpesvirus 2
gacgggugggccuagccgugggc

SEQ ID NO: 1824565 - RNA, 22 nt, Human herpesvirus 2
ccaggaggggggcagugcagua

SEQ ID NO: 1824566 - RNA, 18 nt, Human herpesvirus 2
gcggucgcgcgggccgug

SEQ ID NO: 1824567 - RNA, 16 nt, Human herpesvirus 2
cggacucggagggaag

SEQ ID NO: 1824568 - RNA, 17 nt, Human herpesvirus 2
gaaaggaaaggaaacag

SEQ ID NO: 1824569 - RNA, 11 nt, Human herpesvirus 2
ccgggggcgcu

SEQ ID NO: 1824570 - RNA, 23 nt, Human herpesvirus 2
ggccccagggcuucguggaagag

SEQ ID NO: 1824571 - RNA, 15 nt, Human herpesvirus 2
gccuacgucugggug

SEQ ID NO: 1824572 - RNA, 18 nt, Human herpesvirus 2
gcaccgcgggaggaaggc

SEQ ID NO: 1824573 - RNA, 13 nt, Human herpesvirus 2
gguuacugcacuu

SEQ ID NO: 1824574 - RNA, 19 nt, Human herpesvirus 2
cccacagcugcgccagaaa

SEQ ID NO: 1824575 - RNA, 19 nt, Human herpesvirus 2
cggauaccgacagugacag

SEQ ID NO: 1824576 - RNA, 19 nt, Human herpesvirus 2
gggaccccgacguggcccg

SEQ ID NO: 1824577 - RNA, 16 nt, Human herpesvirus 2
gggagagggggaagga

SEQ ID NO: 1824578 - RNA, 17 nt, Human herpesvirus 2
cagggggcggcgccggc

SEQ ID NO: 1824579 - RNA, 22 nt, Human herpesvirus 2
gguucgcgugcggccagccgcc

SEQ ID NO: 1824580 - RNA, 16 nt, Human herpesvirus 2
ccccucguucugcugc

SEQ ID NO: 1824581 - RNA, 20 nt, Human herpesvirus 2
ccucacgguccucaccgagc

SEQ ID NO: 1824582 - RNA, 20 nt, Human herpesvirus 2
acucuccugcgagcccucac

SEQ ID NO: 1824583 - RNA, 17 nt, Human herpesvirus 2
agcgccccgcggacccc

SEQ ID NO: 1824584 - RNA, 13 nt, Human herpesvirus 2
acccccuccccgu

SEQ ID NO: 1824585 - RNA, 22 nt, Human herpesvirus 2
cgcccaacccgagcgaccuucc

SEQ ID NO: 1824586 - RNA, 20 nt, Human herpesvirus 2
cgcggaccccgcccgcgacc

SEQ ID NO: 1824587 - RNA, 18 nt, Human herpesvirus 2
guuccggguugcgccucc

SEQ ID NO: 1824588 - RNA, 17 nt, Human herpesvirus 2
ccaggcgacgccaggcc

SEQ ID NO: 1824589 - RNA, 12 nt, Human herpesvirus 2
ccuucagccugg

SEQ ID NO: 1824590 - RNA, 17 nt, Human herpesvirus 2
ccuccgcgggucccuuc

SEQ ID NO: 1824591 - RNA, 19 nt, Human herpesvirus 2
gauccgaacggcgcacgcc

SEQ ID NO: 1824592 - RNA, 22 nt, Human herpesvirus 2
cuccgaagagacgaugggagcc

SEQ ID NO: 1824593 - RNA, 16 nt, Human herpesvirus 2
ccgccagcgcccuucc

SEQ ID NO: 1824594 - RNA, 13 nt, Human herpesvirus 2
cacgacccgccuc

SEQ ID NO: 1824595 - RNA, 13 nt, Human herpesvirus 2
gucgggccccggg

SEQ ID NO: 1824596 - RNA, 19 nt, Human herpesvirus 2
cgccccgcgccggcuuccc

SEQ ID NO: 1824597 - RNA, 16 nt, Human herpesvirus 2
guacgaucgagguggc

SEQ ID NO: 1824598 - RNA, 16 nt, Human herpesvirus 2
uccacccgggacgagc

SEQ ID NO: 1824599 - RNA, 22 nt, Human herpesvirus 2
gacccccgaacagccccugggg

SEQ ID NO: 1824600 - RNA, 21 nt, Human herpesvirus 2
ucgccgggugucugcucccca

SEQ ID NO: 1824601 - RNA, 17 nt, Human herpesvirus 2
cuaguacccagaggcug

SEQ ID NO: 1824602 - RNA, 22 nt, Human herpesvirus 2
ccgcggccuuucccguggcccu

SEQ ID NO: 1824603 - RNA, 18 nt, Human herpesvirus 2
acaaacagaccgcggaca

SEQ ID NO: 1824604 - RNA, 18 nt, Human herpesvirus 2
uccuuuccaccccccuuc

SEQ ID NO: 1824605 - RNA, 21 nt, Human herpesvirus 2
cuccugcccgcgaccccccgg

SEQ ID NO: 1824606 - RNA, 19 nt, Human herpesvirus 2
cgcuccgcccgccccaggg

SEQ ID NO: 1824607 - RNA, 16 nt, Human herpesvirus 2
cgcugcagggccuggc

SEQ ID NO: 1824608 - RNA, 20 nt, Human herpesvirus 2
cacuuccuauaaacucuccc

SEQ ID NO: 1824609 - RNA, 21 nt, Human herpesvirus 2
cgcgcccccgacccggggccc

SEQ ID NO: 1824610 - RNA, 24 nt, Human herpesvirus 2
gacgucccccacggucaggaccag

SEQ ID NO: 1824611 - RNA, 19 nt, Human herpesvirus 2
acuccaccccccccucuca

SEQ ID NO: 1824612 - RNA, 23 nt, Human herpesvirus 2
cccccaggaggggggcagugcag

SEQ ID NO: 1824613 - RNA, 18 nt, Human herpesvirus 2
acucgccauggcggccgc

SEQ ID NO: 1824614 - RNA, 22 nt, Human herpesvirus 2
gcgggccguucggcaggcccgc

SEQ ID NO: 1824615 - RNA, 14 nt, Human herpesvirus 2
cucgucguggcccu

SEQ ID NO: 1824616 - RNA, 17 nt, Human herpesvirus 2
ccaagcuaaggcgcccg

SEQ ID NO: 1824617 - RNA, 22 nt, Human herpesvirus 2
cccggccuuugcuuccucgcgg

SEQ ID NO: 1824618 - RNA, 14 nt, Human herpesvirus 2
gggccguggccaga

SEQ ID NO: 1824619 - RNA, 15 nt, Human herpesvirus 2
uggccgcuccugccc

SEQ ID NO: 1824620 - RNA, 19 nt, Human herpesvirus 2
cccgcuggagccccugggg

SEQ ID NO: 1824621 - RNA, 18 nt, Human herpesvirus 2
cgcacccgggccggguga

SEQ ID NO: 1824622 - RNA, 20 nt, Human herpesvirus 2
cgcgguauggcugcccccgc

SEQ ID NO: 1824623 - RNA, 11 nt, Human herpesvirus 2
gacccggggcc

SEQ ID NO: 1824624 - RNA, 15 nt, Human herpesvirus 2
ucgcaaccacagcaa

SEQ ID NO: 1824625 - RNA, 22 nt, Human herpesvirus 2
ggcgagaagcgggaccgucgga

SEQ ID NO: 1824626 - RNA, 22 nt, Human herpesvirus 2
gcugcucucccguaccccgccg

SEQ ID NO: 1824627 - RNA, 13 nt, Human herpesvirus 2
ucuuccccagcuu

SEQ ID NO: 1824628 - RNA, 20 nt, Human herpesvirus 2
gagaggucaauagauuuccc

SEQ ID NO: 1824629 - RNA, 22 nt, Human herpesvirus 2
cacgaaguggguauacuuuugu

SEQ ID NO: 1824630 - RNA, 23 nt, Human herpesvirus 2
ccaggggugcguuaucgcacccc

SEQ ID NO: 1824631 - RNA, 9 nt, Human herpesvirus 2
gccagcgcc

SEQ ID NO: 1824632 - RNA, 22 nt, Human herpesvirus 2
cccgggauccuccgccagcucg

SEQ ID NO: 1824633 - RNA, 12 nt, Human herpesvirus 2
ugcagggccugg

SEQ ID NO: 1824634 - RNA, 15 nt, Human herpesvirus 2
acguccaccuuggcc

SEQ ID NO: 1824635 - RNA, 15 nt, Human herpesvirus 2
aggugcugccgccgc

SEQ ID NO: 1824636 - RNA, 15 nt, Human herpesvirus 2
cgcuggcgggagcca

SEQ ID NO: 1824637 - RNA, 23 nt, Human herpesvirus 2
acacacccccaucgggcugcugg

SEQ ID NO: 1824638 - RNA, 22 nt, Human herpesvirus 2
guacccucucaacgcccaggcc

SEQ ID NO: 1824639 - RNA, 19 nt, Human herpesvirus 2
cgcaacaacggcgggcccc

SEQ ID NO: 1824640 - RNA, 21 nt, Human herpesvirus 2
gaggccuggcguuugggggcg

SEQ ID NO: 1824641 - RNA, 13 nt, Human herpesvirus 2
caccccccugacu

SEQ ID NO: 1824642 - RNA, 19 nt, Human herpesvirus 2
cucaccgagccgcugugcc

SEQ ID NO: 1824643 - RNA, 15 nt, Human herpesvirus 2
ugugggacugggggc

SEQ ID NO: 1824644 - RNA, 19 nt, Human herpesvirus 2
ucgggaaucucgggucgcc

SEQ ID NO: 1824645 - RNA, 22 nt, Human herpesvirus 2
acagugggugcucggggacaga

SEQ ID NO: 1824646 - RNA, 21 nt, Human herpesvirus 2
gccgguagugcaggugggccg

SEQ ID NO: 1824647 - RNA, 14 nt, Human herpesvirus 2
aguucaauagauuu

SEQ ID NO: 1824648 - RNA, 21 nt, Human herpesvirus 2
gggagccagggucggacagga

SEQ ID NO: 1824649 - RNA, 13 nt, Human herpesvirus 2
agccacccugggu

SEQ ID NO: 1824650 - RNA, 13 nt, Human herpesvirus 2
gaccuuccccucc

SEQ ID NO: 1824651 - RNA, 14 nt, Human herpesvirus 2
gcggccaccccgcc

SEQ ID NO: 1824652 - RNA, 21 nt, Human herpesvirus 2
cgacgcgcgcgcccccgaccc

SEQ ID NO: 1824653 - RNA, 12 nt, Human herpesvirus 2
gcagggccuggc

SEQ ID NO: 1824654 - RNA, 17 nt, Human herpesvirus 2
cuccagguacugcugca

SEQ ID NO: 1824655 - RNA, 17 nt, Human herpesvirus 2
uggaggggggugcugug

SEQ ID NO: 1824656 - RNA, 21 nt, Human herpesvirus 2
cagaacccccguaaacaccag

SEQ ID NO: 1824657 - RNA, 17 nt, Human herpesvirus 2
gggcgucgcgguggcaa

SEQ ID NO: 1824658 - RNA, 15 nt, Human herpesvirus 2
augcuaauuaaauac

SEQ ID NO: 1824659 - RNA, 15 nt, Human herpesvirus 2
gcccguggguggcca

SEQ ID NO: 1824660 - RNA, 14 nt, Human herpesvirus 2
uguauucccuugcc

SEQ ID NO: 1824661 - RNA, 21 nt, Human herpesvirus 2
gaugcagcucccccgcgcagg

SEQ ID NO: 1824662 - RNA, 13 nt, Human herpesvirus 2
cggccaccccgcc

SEQ ID NO: 1824663 - RNA, 12 nt, Human herpesvirus 2
gccgggggccau

SEQ ID NO: 1824664 - RNA, 16 nt, Human herpesvirus 2
ggccgccauucccgcu

SEQ ID NO: 1824665 - RNA, 15 nt, Human herpesvirus 2
cgccaccguccaccu

SEQ ID NO: 1824666 - RNA, 14 nt, Human herpesvirus 2
cgugccccuggacu

SEQ ID NO: 1824667 - RNA, 22 nt, Human herpesvirus 2
uucccuccgaguccguaugcaa

SEQ ID NO: 1824668 - RNA, 15 nt, Human herpesvirus 2
uguuguuuucccggg

SEQ ID NO: 1824669 - RNA, 22 nt, Human herpesvirus 2
gcgcggucuagaugccagugga

SEQ ID NO: 1824670 - RNA, 17 nt, Human herpesvirus 2
gucguugggcggccccc

SEQ ID NO: 1824671 - RNA, 18 nt, Human herpesvirus 2
uguggcggucggccagca

SEQ ID NO: 1824672 - RNA, 21 nt, Human herpesvirus 2
cguccguauguuaauugcaau

SEQ ID NO: 1824673 - RNA, 11 nt, Human herpesvirus 2
agcuggcccug

SEQ ID NO: 1824674 - RNA, 17 nt, Human herpesvirus 2
ugguccccgagcagcac

SEQ ID NO: 1824675 - RNA, 20 nt, Human herpesvirus 2
cugggucgggagcaggacag

SEQ ID NO: 1824676 - RNA, 22 nt, Human herpesvirus 2
cacgcggggacccgccagagac

SEQ ID NO: 1824677 - RNA, 17 nt, Human herpesvirus 2
uccgacuuccgcauaca

SEQ ID NO: 1824678 - RNA, 23 nt, Human herpesvirus 2
cccgaauccggggcgugcugugc

SEQ ID NO: 1824679 - RNA, 14 nt, Human herpesvirus 2
aggcgcugcgccug

SEQ ID NO: 1824680 - RNA, 16 nt, Human herpesvirus 2
ccccauccccucccga

SEQ ID NO: 1824681 - RNA, 17 nt, Human herpesvirus 2
ccuccacgcccugcugu

SEQ ID NO: 1824682 - RNA, 17 nt, Human herpesvirus 2
cuguuguuucugggccc

SEQ ID NO: 1824683 - RNA, 22 nt, Human herpesvirus 2
gaaaacggucggcgaacacaac

SEQ ID NO: 1824684 - RNA, 19 nt, Human herpesvirus 2
gcggccccuguuggagccg

SEQ ID NO: 1824685 - RNA, 15 nt, Human herpesvirus 2
gugcugcgcgagccg

SEQ ID NO: 1824686 - RNA, 18 nt, Human herpesvirus 2
agagcggcgagugcucgc

SEQ ID NO: 1824687 - RNA, 18 nt, Human herpesvirus 2
auccaggauuaccgaccc

SEQ ID NO: 1824688 - RNA, 14 nt, Human herpesvirus 2
gggaggagacagga

SEQ ID NO: 1824689 - RNA, 15 nt, Human herpesvirus 2
ccuuuaagacagacg

SEQ ID NO: 1824690 - RNA, 15 nt, Human herpesvirus 2
accgcgcggaccggc

SEQ ID NO: 1824691 - RNA, 22 nt, Human herpesvirus 2
aaacaggcaccgcgggaggaag

SEQ ID NO: 1824692 - RNA, 17 nt, Human herpesvirus 2
agagccgaacgcagguc

SEQ ID NO: 1824693 - RNA, 14 nt, Human herpesvirus 2
gagccucuuugggc

SEQ ID NO: 1824694 - RNA, 20 nt, Human herpesvirus 2
gcgcagcgcaucgccgccga

SEQ ID NO: 1824695 - RNA, 14 nt, Human herpesvirus 2
gacggggaggagac

SEQ ID NO: 1824696 - RNA, 17 nt, Human herpesvirus 2
guccagguacccggcgg

SEQ ID NO: 1824697 - RNA, 21 nt, Human herpesvirus 2
ggcgaugcgacgccgccccug

SEQ ID NO: 1824698 - RNA, 21 nt, Human herpesvirus 2
cacucgaagaaguuggugugu

SEQ ID NO: 1824699 - RNA, 14 nt, Human herpesvirus 2
uugguccgggggcg

SEQ ID NO: 1824700 - RNA, 16 nt, Human herpesvirus 2
gccccgccgggucacc

SEQ ID NO: 1824701 - RNA, 14 nt, Human herpesvirus 2
gggcaagugcagua

SEQ ID NO: 1824702 - RNA, 12 nt, Human herpesvirus 2
ggccagcggggg

SEQ ID NO: 1824703 - RNA, 22 nt, Human herpesvirus 2
aacaugacaacgacgccccucu

SEQ ID NO: 1824704 - RNA, 14 nt, Human herpesvirus 2
cgaccaccaaggcc

SEQ ID NO: 1824705 - RNA, 12 nt, Human herpesvirus 2
uacauuucccca

SEQ ID NO: 1824706 - RNA, 18 nt, Human herpesvirus 2
ccccaggcgacgccaggc

SEQ ID NO: 1824707 - RNA, 14 nt, Human herpesvirus 2
cgggagccgcggcc

SEQ ID NO: 1824708 - RNA, 17 nt, Human herpesvirus 2
acggcgccuaccuggua

SEQ ID NO: 1824709 - RNA, 15 nt, Human herpesvirus 2
ccccgcaggcaggcg

SEQ ID NO: 1824710 - RNA, 20 nt, Human herpesvirus 2
gucgcuuuccacacccccuc

SEQ ID NO: 1824711 - RNA, 22 nt, Human herpesvirus 2
caaccccuaccugcgcgugcag

SEQ ID NO: 1824712 - RNA, 14 nt, Human herpesvirus 2
acgcgcccgcgucc

SEQ ID NO: 1824713 - RNA, 13 nt, Human herpesvirus 2
agagagauuuccc

SEQ ID NO: 1824714 - RNA, 16 nt, Human herpesvirus 2
ugguccccgagcagca

SEQ ID NO: 1824715 - RNA, 13 nt, Human herpesvirus 2
cugcgcgagccgu

SEQ ID NO: 1824716 - RNA, 18 nt, Human herpesvirus 2
gccuagccgugggccugu

SEQ ID NO: 1824717 - RNA, 20 nt, Human herpesvirus 2
uaguguguccccccccccuc

SEQ ID NO: 1824718 - RNA, 16 nt, Human herpesvirus 2
cacaggcccaccacca

SEQ ID NO: 1824719 - RNA, 23 nt, Human herpesvirus 2
cauggcauccgggguuuccccgg

SEQ ID NO: 1824720 - RNA, 22 nt, Human herpesvirus 2
cagccuggaccagaccguggcc

SEQ ID NO: 1824721 - RNA, 14 nt, Human herpesvirus 2
cggccuggucgucc

SEQ ID NO: 1824722 - RNA, 18 nt, Human herpesvirus 2
ugagcggaacgccccggg

SEQ ID NO: 1824723 - RNA, 13 nt, Human herpesvirus 2
guaucggccagga

SEQ ID NO: 1824724 - RNA, 18 nt, Human herpesvirus 2
ggcaccgcgcggaccggc

SEQ ID NO: 1824725 - RNA, 21 nt, Human herpesvirus 2
ggcaggcguguugggaaggga

SEQ ID NO: 1824726 - RNA, 14 nt, Human herpesvirus 2
ccagcuuucccucc

SEQ ID NO: 1824727 - RNA, 16 nt, Human herpesvirus 2
uccgggggccuggugg

SEQ ID NO: 1824728 - RNA, 17 nt, Human herpesvirus 2
gagcagcacggcggcca

SEQ ID NO: 1824729 - RNA, 16 nt, Human herpesvirus 2
ucugugcggcccucuc

SEQ ID NO: 1824730 - RNA, 14 nt, Human herpesvirus 2
ccuagaggcugucc

SEQ ID NO: 1824731 - RNA, 12 nt, Human herpesvirus 2
gcccgaccuguu

SEQ ID NO: 1824732 - RNA, 20 nt, Human herpesvirus 2
ccccgcugcugugcacccua

SEQ ID NO: 1824733 - RNA, 13 nt, Human herpesvirus 2
acccccccccauc

SEQ ID NO: 1824734 - RNA, 15 nt, Human herpesvirus 2
cucaccccaccccau

SEQ ID NO: 1824735 - RNA, 21 nt, Human herpesvirus 2
gacagcgcgaugaggggcacc

SEQ ID NO: 1824736 - RNA, 15 nt, Human herpesvirus 2
ggcgauccugggccu

SEQ ID NO: 1824737 - RNA, 19 nt, Human herpesvirus 2
cuggcggaagugccgcacg

SEQ ID NO: 1824738 - RNA, 19 nt, Human herpesvirus 2
ccgcaguuucaccgcccca

SEQ ID NO: 1824739 - RNA, 18 nt, Human herpesvirus 2
cuugccccucccccggcc

SEQ ID NO: 1824740 - RNA, 17 nt, Human herpesvirus 2
gguuucgguuccacucu

SEQ ID NO: 1824741 - RNA, 17 nt, Human herpesvirus 2
acugccugacccucucg

SEQ ID NO: 1824742 - RNA, 12 nt, Human herpesvirus 2
cgggagcaggac

SEQ ID NO: 1824743 - RNA, 19 nt, Human herpesvirus 2
cggccgcgcuaccucaccc

SEQ ID NO: 1824744 - RNA, 14 nt, Human herpesvirus 2
caaccuggcacagc

SEQ ID NO: 1824745 - RNA, 16 nt, Human herpesvirus 2
uccacgcccugcugua

SEQ ID NO: 1824746 - RNA, 12 nt, Human herpesvirus 2
ccggggcacgcg

SEQ ID NO: 1824747 - RNA, 17 nt, Human herpesvirus 2
gcgagggcccggcgccg

SEQ ID NO: 1824748 - RNA, 18 nt, Human herpesvirus 2
gaccaccgcgaccacccc

SEQ ID NO: 1824749 - RNA, 15 nt, Human herpesvirus 2
cgcccccgugccugu

SEQ ID NO: 1824750 - RNA, 17 nt, Human herpesvirus 2
cugggucgggagcagga

SEQ ID NO: 1824751 - RNA, 16 nt, Human herpesvirus 2
uuucagguuccggggg

SEQ ID NO: 1824752 - RNA, 15 nt, Human herpesvirus 2
ucgcucccucagcau

SEQ ID NO: 1824753 - RNA, 13 nt, Human herpesvirus 2
gugccgcacggcc

SEQ ID NO: 1824754 - RNA, 18 nt, Human herpesvirus 2
cccggcgucaugcacgcc

SEQ ID NO: 1824755 - RNA, 14 nt, Human herpesvirus 2
acaccgggcugggg

SEQ ID NO: 1824756 - RNA, 14 nt, Human herpesvirus 2
ccugggccuguggg

SEQ ID NO: 1824757 - RNA, 14 nt, Human herpesvirus 2
ggguaggccagagc

SEQ ID NO: 1824758 - RNA, 20 nt, Human herpesvirus 2
aucgugugcacgaaaaagag

SEQ ID NO: 1824759 - RNA, 15 nt, Human herpesvirus 2
ggaggguucggggca

SEQ ID NO: 1824760 - RNA, 13 nt, Human herpesvirus 2
ggcauggaagccc

SEQ ID NO: 1824761 - RNA, 13 nt, Human herpesvirus 2
gggaggguggcug

SEQ ID NO: 1824762 - RNA, 15 nt, Human herpesvirus 2
agucucuuggggaaa

SEQ ID NO: 1824763 - RNA, 21 nt, Human herpesvirus 2
ccaccgcccccgcuggcggga

SEQ ID NO: 1824764 - RNA, 14 nt, Human herpesvirus 2
cgaccccccggguu

SEQ ID NO: 1824765 - RNA, 21 nt, Human herpesvirus 2
ggggacuccccucuaccccca

SEQ ID NO: 1824766 - RNA, 15 nt, Human herpesvirus 2
agccagggcugggag

SEQ ID NO: 1824767 - RNA, 20 nt, Human herpesvirus 2
cgggggggggcaagugcagu

SEQ ID NO: 1824768 - RNA, 14 nt, Human herpesvirus 2
cggggccagggcug

SEQ ID NO: 1824769 - RNA, 17 nt, Human herpesvirus 2
agaaggggggugugugu

SEQ ID NO: 1824770 - RNA, 20 nt, Human herpesvirus 2
cgcuuauaagagcgggcccg

SEQ ID NO: 1824771 - RNA, 14 nt, Human herpesvirus 2
ucuuccuguaccug

SEQ ID NO: 1824772 - RNA, 13 nt, Human herpesvirus 2
ggugacugggacc

SEQ ID NO: 1824773 - RNA, 20 nt, Human herpesvirus 2
ggacggguauaaaggccagg

SEQ ID NO: 1824774 - RNA, 21 nt, Human herpesvirus 2
gggagguggggggggggaaag

SEQ ID NO: 1824775 - RNA, 12 nt, Human herpesvirus 2
uugaacucuccc

SEQ ID NO: 1824776 - RNA, 21 nt, Human herpesvirus 2
cgguuggacgaucccgggccc

SEQ ID NO: 1824777 - RNA, 13 nt, Human herpesvirus 2
gaggcccccggcc

SEQ ID NO: 1824778 - RNA, 16 nt, Human herpesvirus 2
cagaauaaaaggcauu

SEQ ID NO: 1824779 - RNA, 17 nt, Human herpesvirus 2
uauugaaacagacauac

SEQ ID NO: 1824780 - RNA, 21 nt, Human herpesvirus 2
gggcccuucgcagcuucaccg

SEQ ID NO: 1824781 - RNA, 19 nt, Human herpesvirus 2
ccgucgccgccggccacgc

SEQ ID NO: 1824782 - RNA, 14 nt, Human herpesvirus 2
acgcucucugccuc

SEQ ID NO: 1824783 - RNA, 21 nt, Human herpesvirus 2
uggccggggagggcagggccg

SEQ ID NO: 1824784 - RNA, 19 nt, Human herpesvirus 2
ucgcacgcgcgcaggcugg

SEQ ID NO: 1824785 - RNA, 16 nt, Human herpesvirus 2
cggguauaagggcagc

SEQ ID NO: 1824786 - RNA, 13 nt, Human herpesvirus 2
ugacauucacccc

SEQ ID NO: 1824787 - RNA, 21 nt, Human herpesvirus 2
cacgcugcgcgcgcaccugcg

SEQ ID NO: 1824788 - RNA, 20 nt, Human herpesvirus 2
cgcgcaucggaccccccauc

SEQ ID NO: 1824789 - RNA, 20 nt, Human herpesvirus 2
gccccgccucaccuccgucu

SEQ ID NO: 1824790 - RNA, 13 nt, Human herpesvirus 2
caccaccaaccug

SEQ ID NO: 1824791 - RNA, 17 nt, Human herpesvirus 2
aaaagggacgcgcagcg

SEQ ID NO: 1824792 - RNA, 21 nt, Human herpesvirus 2
accccuaccugcgcgugcaga

SEQ ID NO: 1824793 - RNA, 15 nt, Human herpesvirus 2
ccgugucccucccgg

SEQ ID NO: 1824794 - RNA, 14 nt, Human herpesvirus 2
gggcccguguggga

SEQ ID NO: 1824795 - RNA, 15 nt, Human herpesvirus 2
gugcuggugguggaa

SEQ ID NO: 1824796 - RNA, 19 nt, Human herpesvirus 2
cgggcugguuaucgccugu

SEQ ID NO: 1824797 - RNA, 16 nt, Human herpesvirus 2
cggccgcggacgaccu

SEQ ID NO: 1824798 - RNA, 19 nt, Human herpesvirus 2
gucugcgucguccagggug

SEQ ID NO: 1824799 - RNA, 22 nt, Human herpesvirus 2
agccgacccgucuagcggccgg

SEQ ID NO: 1824800 - RNA, 12 nt, Human herpesvirus 2
gggaugguggug

SEQ ID NO: 1824801 - RNA, 21 nt, Human herpesvirus 2
accgccucuguuccuuucccu

SEQ ID NO: 1824802 - RNA, 12 nt, Human herpesvirus 2
gccgggagaguu

SEQ ID NO: 1824803 - RNA, 16 nt, Human herpesvirus 2
gagccccugggggacc

SEQ ID NO: 1824804 - RNA, 20 nt, Human herpesvirus 2
accggucgcuuuccacaccc

SEQ ID NO: 1824805 - RNA, 23 nt, Human herpesvirus 2
ggggagguggggggggggaaaga

SEQ ID NO: 1824806 - RNA, 18 nt, Human herpesvirus 2
cgcccccucucccacacg

SEQ ID NO: 1824807 - RNA, 23 nt, Human herpesvirus 2
ggaaaucuauugaacucucccgg

SEQ ID NO: 1824808 - RNA, 14 nt, Human herpesvirus 2
augggggggaaggg

SEQ ID NO: 1824809 - RNA, 17 nt, Human herpesvirus 2
gaggagagcgucagcgc

SEQ ID NO: 1824810 - RNA, 13 nt, Human herpesvirus 2
caucucuguuuca

SEQ ID NO: 1824811 - RNA, 16 nt, Human herpesvirus 2
cguucggaccuggggg

SEQ ID NO: 1824812 - RNA, 16 nt, Human herpesvirus 2
gccgucaaccccgccc

SEQ ID NO: 1824813 - RNA, 19 nt, Human herpesvirus 2
cccgaauccggggcgugcu

SEQ ID NO: 1824814 - RNA, 18 nt, Human herpesvirus 2
gaggauguguucuccugg

SEQ ID NO: 1824815 - RNA, 23 nt, Human herpesvirus 2
ggcgcacacgccaucgacccgga

SEQ ID NO: 1824816 - RNA, 15 nt, Human herpesvirus 2
gucgcuccccuucag

SEQ ID NO: 1824817 - RNA, 13 nt, Human herpesvirus 2
aaccacacacacg

SEQ ID NO: 1824818 - RNA, 18 nt, Human herpesvirus 2
gagggcccggcgccgccc

SEQ ID NO: 1824819 - RNA, 14 nt, Human herpesvirus 2
gggggccaugacac

SEQ ID NO: 1824820 - RNA, 15 nt, Human herpesvirus 2
cccgcaacccgcagg

SEQ ID NO: 1824821 - RNA, 21 nt, Human herpesvirus 2
gccguggggccccagggcuuc

SEQ ID NO: 1824822 - RNA, 14 nt, Human herpesvirus 2
gggccggugggccc

SEQ ID NO: 1824823 - RNA, 14 nt, Human herpesvirus 2
cucguucugcugca

SEQ ID NO: 1824824 - RNA, 11 nt, Human herpesvirus 2
gcugcggggac

SEQ ID NO: 1824825 - RNA, 19 nt, Human herpesvirus 2
uugguuguguuuuguggga

SEQ ID NO: 1824826 - RNA, 13 nt, Human herpesvirus 2
uuauugaccaaau

SEQ ID NO: 1824827 - RNA, 21 nt, Human herpesvirus 2
ucccuaacacggaggagccgg

SEQ ID NO: 1824828 - RNA, 22 nt, Human herpesvirus 2
cggccgccuccccgcuggagcc

SEQ ID NO: 1824829 - RNA, 16 nt, Human herpesvirus 2
aucgcuguauucccuu

SEQ ID NO: 1824830 - RNA, 17 nt, Human herpesvirus 2
gcgcccaccgguccuuc

SEQ ID NO: 1824831 - RNA, 19 nt, Human herpesvirus 2
cgcagucuggucgaggugg

SEQ ID NO: 1824832 - RNA, 19 nt, Human herpesvirus 2
cgcaauaaacgccuucccg

SEQ ID NO: 1824833 - RNA, 14 nt, Human herpesvirus 2
ggacgcccccuccc

SEQ ID NO: 1824834 - RNA, 13 nt, Human herpesvirus 2
cccucgaacaugg

SEQ ID NO: 1824835 - RNA, 18 nt, Human herpesvirus 2
guacccaccacaccccac

SEQ ID NO: 1824836 - RNA, 12 nt, Human herpesvirus 2
gccacccugggu

SEQ ID NO: 1824837 - RNA, 18 nt, Human herpesvirus 2
gucaccgggggccccggg

SEQ ID NO: 1824838 - RNA, 22 nt, Human herpesvirus 2
caccggggcgccccccccgacg

SEQ ID NO: 1824839 - RNA, 23 nt, Human herpesvirus 2
cccgcacgaagugaaccaacugc

SEQ ID NO: 1824840 - RNA, 17 nt, Human herpesvirus 2
cccucggcagcccggac

SEQ ID NO: 1824841 - RNA, 15 nt, Human herpesvirus 2
cacaccgggcugggg

SEQ ID NO: 1824842 - RNA, 11 nt, Human herpesvirus 2
aucugggaaga

SEQ ID NO: 1824843 - RNA, 16 nt, Human herpesvirus 2
cuuccgugccccugga

SEQ ID NO: 1824844 - RNA, 16 nt, Human herpesvirus 2
acagccccuggggcug

SEQ ID NO: 1824845 - RNA, 22 nt, Human herpesvirus 2
ggucggccagcacgaccaggga

SEQ ID NO: 1824846 - RNA, 14 nt, Human herpesvirus 2
cugcagccccgguc

SEQ ID NO: 1824847 - RNA, 14 nt, Human herpesvirus 2
ggcggaagugccgc

SEQ ID NO: 1824848 - RNA, 17 nt, Human herpesvirus 2
ggacagccagggcuggg

SEQ ID NO: 1824849 - RNA, 14 nt, Human herpesvirus 2
gaccgacgggcccc

SEQ ID NO: 1824850 - RNA, 17 nt, Human herpesvirus 2
gcacguacguucugccc

SEQ ID NO: 1824851 - RNA, 21 nt, Human herpesvirus 2
gggcacucuggcguccccagg

SEQ ID NO: 1824852 - RNA, 12 nt, Human herpesvirus 2
uguuccaccgcu

SEQ ID NO: 1824853 - RNA, 15 nt, Human herpesvirus 2
gcucgucccccgagg

SEQ ID NO: 1824854 - RNA, 18 nt, Human herpesvirus 2
gagcugggcuuguguaua

SEQ ID NO: 1824855 - RNA, 12 nt, Human herpesvirus 2
caccgcccccau

SEQ ID NO: 1824856 - RNA, 20 nt, Human herpesvirus 2
ggcaaacacgaucgugcugc

SEQ ID NO: 1824857 - RNA, 24 nt, Human herpesvirus 2
ggccagagcguucggcggagcugg

SEQ ID NO: 1824858 - RNA, 15 nt, Human herpesvirus 2
ugccacacgugggcg

SEQ ID NO: 1824859 - RNA, 19 nt, Human herpesvirus 2
ccucggccggcggagcccc

SEQ ID NO: 1824860 - RNA, 13 nt, Human herpesvirus 2
cauggggaacccc

SEQ ID NO: 1824861 - RNA, 15 nt, Human herpesvirus 2
cccggcggccccggc

SEQ ID NO: 1824862 - RNA, 17 nt, Human herpesvirus 2
ccaggucuuuccguggc

SEQ ID NO: 1824863 - RNA, 19 nt, Human herpesvirus 2
cccgcguauauauccgcga

SEQ ID NO: 1824864 - RNA, 22 nt, Human herpesvirus 2
gccaggucagcgaucgccagcc

SEQ ID NO: 1824865 - RNA, 23 nt, Human herpesvirus 2
gccgccgagcgucaggcccgccg

SEQ ID NO: 1824866 - RNA, 19 nt, Human herpesvirus 2
guuuggggcggcacugggg

SEQ ID NO: 1824867 - RNA, 19 nt, Human herpesvirus 2
ccgugcccccccucguucu

SEQ ID NO: 1824868 - RNA, 15 nt, Human herpesvirus 2
ccgaccccgccgccg

SEQ ID NO: 1824869 - RNA, 19 nt, Human herpesvirus 2
caccucgcggcggcucccc

SEQ ID NO: 1824870 - RNA, 15 nt, Human herpesvirus 2
uggaagcccccggca

SEQ ID NO: 1824871 - RNA, 20 nt, Human herpesvirus 2
cgagagcgccgucgggcccc

SEQ ID NO: 1824872 - RNA, 16 nt, Human herpesvirus 2
gagggcccggcgccgc

SEQ ID NO: 1824873 - RNA, 20 nt, Human herpesvirus 2
ccuagccgugggccuguggg

SEQ ID NO: 1824874 - RNA, 15 nt, Human herpesvirus 2
gugaccacgcgcacg

SEQ ID NO: 1824875 - RNA, 13 nt, Human herpesvirus 2
cgugguccacccg

SEQ ID NO: 1824876 - RNA, 18 nt, Human herpesvirus 2
cgaaccgauggcccccac

SEQ ID NO: 1824877 - RNA, 15 nt, Human herpesvirus 2
cccagcacaggcagg

SEQ ID NO: 1824878 - RNA, 17 nt, Human herpesvirus 2
cuagucacacgcccccc

SEQ ID NO: 1824879 - RNA, 20 nt, Human herpesvirus 2
cgccagacgggccggugggc

SEQ ID NO: 1824880 - RNA, 13 nt, Human herpesvirus 2
ggagcgucccgac

SEQ ID NO: 1824881 - RNA, 13 nt, Human herpesvirus 2
aguaacccaguuc

SEQ ID NO: 1824882 - RNA, 20 nt, Human herpesvirus 2
gacugcagccccgguccccc

SEQ ID NO: 1824883 - RNA, 18 nt, Human herpesvirus 2
uaaaacgcgggcgggggc

SEQ ID NO: 1824884 - RNA, 15 nt, Human herpesvirus 2
gguguguuuggcgug

SEQ ID NO: 1824885 - RNA, 19 nt, Human herpesvirus 2
aacaacacguucgccccgc

SEQ ID NO: 1824886 - RNA, 19 nt, Human herpesvirus 2
acgccuuuccuccccucgc

SEQ ID NO: 1824887 - RNA, 16 nt, Human herpesvirus 2
cggccgcucgcugcag

SEQ ID NO: 1824888 - RNA, 18 nt, Human herpesvirus 2
cccggcgcgggcggcgcc

SEQ ID NO: 1824889 - RNA, 16 nt, Human herpesvirus 2
uuccuccccucgccug

SEQ ID NO: 1824890 - RNA, 17 nt, Human herpesvirus 2
aacaucgggaaaacgga

SEQ ID NO: 1824891 - RNA, 15 nt, Human herpesvirus 2
ggggucgaaggaaag

SEQ ID NO: 1824892 - RNA, 13 nt, Human herpesvirus 2
gccugcugugggu

SEQ ID NO: 1824893 - RNA, 13 nt, Human herpesvirus 2
ugaggaagaaaga

SEQ ID NO: 1824894 - RNA, 22 nt, Human herpesvirus 2
cgugcgcaugggccgccagcag

SEQ ID NO: 1824895 - RNA, 23 nt, Human herpesvirus 2
gcccgaaccccgcggcccugagc

SEQ ID NO: 1824896 - RNA, 20 nt, Human herpesvirus 2
caucgucccccgucugccag

SEQ ID NO: 1824897 - RNA, 19 nt, Human herpesvirus 2
gucgcgcuuuuccgccgcc

SEQ ID NO: 1824898 - RNA, 15 nt, Human herpesvirus 2
gcccaggcccuggcg

SEQ ID NO: 1824899 - RNA, 13 nt, Human herpesvirus 2
guguucuccugga

SEQ ID NO: 1824900 - RNA, 22 nt, Human herpesvirus 2
cgcuugagcuuauagagcgaag

SEQ ID NO: 1824901 - RNA, 23 nt, Human herpesvirus 2
gcuucucgccucucuucuucccc

SEQ ID NO: 1824902 - RNA, 21 nt, Human herpesvirus 2
ccgugcugggcgcgagccagg

SEQ ID NO: 1824903 - RNA, 21 nt, Human herpesvirus 2
ggaacaaagaaauagaagaaa

SEQ ID NO: 1824904 - RNA, 20 nt, Human herpesvirus 2
uccgccccggcgaccgcccc

SEQ ID NO: 1824905 - RNA, 13 nt, Human herpesvirus 2
gacgcucucugcc

SEQ ID NO: 1824906 - RNA, 9 nt, Human herpesvirus 2
cggggagga

SEQ ID NO: 1824907 - RNA, 14 nt, Human herpesvirus 2
auaggccacacagu

SEQ ID NO: 1824908 - RNA, 12 nt, Human herpesvirus 2
gggaggaggcgg

SEQ ID NO: 1824909 - RNA, 18 nt, Human herpesvirus 2
cgcgagggcccggcgccg

SEQ ID NO: 1824910 - RNA, 23 nt, Human herpesvirus 2
gggcuuggacugggagccgcgau

SEQ ID NO: 1824911 - RNA, 20 nt, Human herpesvirus 2
auaugcggaucgcgagcucc

SEQ ID NO: 1824912 - RNA, 18 nt, Human herpesvirus 2
uccuuggaauuccagcag

SEQ ID NO: 1824913 - RNA, 18 nt, Human herpesvirus 2
ccuggcgauccugggccu

SEQ ID NO: 1824914 - RNA, 12 nt, Human herpesvirus 2
cgcgcaccgcug

SEQ ID NO: 1824915 - RNA, 11 nt, Human herpesvirus 2
uggggagaggg

SEQ ID NO: 1824916 - RNA, 17 nt, Human herpesvirus 2
cuacgugccccccgacg

SEQ ID NO: 1824917 - RNA, 18 nt, Human herpesvirus 2
gcgcggggguucggggcc

SEQ ID NO: 1824918 - RNA, 14 nt, Human herpesvirus 2
gggggcugcugccc

SEQ ID NO: 1824919 - RNA, 21 nt, Human herpesvirus 2
ccgcgagacuagaggcccgga

SEQ ID NO: 1824920 - RNA, 19 nt, Human herpesvirus 2
ggucaauagauuuccccaa

SEQ ID NO: 1824921 - RNA, 16 nt, Human herpesvirus 2
gccgaucgcagcgucc

SEQ ID NO: 1824922 - RNA, 22 nt, Human herpesvirus 2
gugcuguggcggucggccagca

SEQ ID NO: 1824923 - RNA, 15 nt, Human herpesvirus 2
gcgucgggcacaggc

SEQ ID NO: 1824924 - RNA, 21 nt, Human herpesvirus 2
caggcccucgcugcucucccg

SEQ ID NO: 1824925 - RNA, 23 nt, Human herpesvirus 2
cgcccgcgugccgcagaccaccu

SEQ ID NO: 1824926 - RNA, 12 nt, Human herpesvirus 2
cuggcgggagcc

SEQ ID NO: 1824927 - RNA, 22 nt, Human herpesvirus 2
ccaacgcgcuguggcgcgcccc

SEQ ID NO: 1824928 - RNA, 16 nt, Human herpesvirus 2
cagcgcgucggugccg

SEQ ID NO: 1824929 - RNA, 13 nt, Human herpesvirus 2
cucacucuuuauu

SEQ ID NO: 1824930 - RNA, 14 nt, Human herpesvirus 2
ccggggggggccuc

SEQ ID NO: 1824931 - RNA, 20 nt, Human herpesvirus 2
auccggcggcggggaaacgu

SEQ ID NO: 1824932 - RNA, 16 nt, Human herpesvirus 2
cgaggccgcucuccga

SEQ ID NO: 1824933 - RNA, 13 nt, Human herpesvirus 2
uggcgccucugcg

SEQ ID NO: 1824934 - RNA, 15 nt, Human herpesvirus 2
gcgauccugggccug

SEQ ID NO: 1824935 - RNA, 21 nt, Human herpesvirus 2
ccgagccgcugugccaggugg

SEQ ID NO: 1824936 - RNA, 20 nt, Human herpesvirus 2
cgggcgggggucgggcgggc

SEQ ID NO: 1824937 - RNA, 19 nt, Human herpesvirus 2
ccguggggccccagggcuu

SEQ ID NO: 1824938 - RNA, 16 nt, Human herpesvirus 2
uccgacgacgcggacg

SEQ ID NO: 1824939 - RNA, 17 nt, Human herpesvirus 2
gcgggaaaucaaggucg

SEQ ID NO: 1824940 - RNA, 21 nt, Human herpesvirus 2
aucgcacccauccaucuggga

SEQ ID NO: 1824941 - RNA, 15 nt, Human herpesvirus 2
cgggggucccgccuc

SEQ ID NO: 1824942 - RNA, 14 nt, Human herpesvirus 2
aacaccguccccga

SEQ ID NO: 1824943 - RNA, 15 nt, Human herpesvirus 2
cuccggucccuuccc

SEQ ID NO: 1824944 - RNA, 20 nt, Human herpesvirus 2
auugaccggggccccaucug

SEQ ID NO: 1824945 - RNA, 18 nt, Human herpesvirus 2
cagcgcccuuccgcgucc

SEQ ID NO: 1824946 - RNA, 13 nt, Human herpesvirus 2
gggggggaaggga

SEQ ID NO: 1824947 - RNA, 16 nt, Human herpesvirus 2
gggguguagggcccaa

SEQ ID NO: 1824948 - RNA, 15 nt, Human herpesvirus 2
aggcuucccccccgc

SEQ ID NO: 1824949 - RNA, 16 nt, Human herpesvirus 2
gggcggacguccaggg

SEQ ID NO: 1824950 - RNA, 22 nt, Human herpesvirus 2
ggccgcucgcugcagggccugg

SEQ ID NO: 1824951 - RNA, 13 nt, Human herpesvirus 2
ggggcagugcagu

SEQ ID NO: 1824952 - RNA, 12 nt, Human herpesvirus 2
ggccgcucuccg

SEQ ID NO: 1824953 - RNA, 17 nt, Human herpesvirus 2
cucuggcuccaggccgc

SEQ ID NO: 1824954 - RNA, 14 nt, Human herpesvirus 2
ugcgucguccaggg

SEQ ID NO: 1824955 - RNA, 15 nt, Human herpesvirus 2
gaacgggggucccgc

SEQ ID NO: 1824956 - RNA, 15 nt, Human herpesvirus 2
ucccguggcccucca

SEQ ID NO: 1824957 - RNA, 15 nt, Human herpesvirus 2
cucuggcguccccag

SEQ ID NO: 1824958 - RNA, 21 nt, Human herpesvirus 2
cauaggccgggagcguggggc

SEQ ID NO: 1824959 - RNA, 12 nt, Human herpesvirus 2
cgaccugcagga

SEQ ID NO: 1824960 - RNA, 17 nt, Human herpesvirus 2
cgcgcuggcggaagugc

SEQ ID NO: 1824961 - RNA, 19 nt, Human herpesvirus 2
cccucguucugcugcaccg

SEQ ID NO: 1824962 - RNA, 12 nt, Human herpesvirus 2
accccccccucu

SEQ ID NO: 1824963 - RNA, 23 nt, Human herpesvirus 2
ccccgggaggaggcggcgccugc

SEQ ID NO: 1824964 - RNA, 20 nt, Human herpesvirus 2
guuugagcagccgcgccgcu

SEQ ID NO: 1824965 - RNA, 15 nt, Human herpesvirus 2
auuuucuggaagagc

SEQ ID NO: 1824966 - RNA, 12 nt, Human herpesvirus 2
aauagauuuccc

SEQ ID NO: 1824967 - RNA, 14 nt, Human herpesvirus 2
ggcgcugcgccugc

SEQ ID NO: 1824968 - RNA, 22 nt, Human herpesvirus 2
ggcgguucgcgugcggccagcc

SEQ ID NO: 1824969 - RNA, 22 nt, Human herpesvirus 2
ccagggcgucgcuaacgagcgc

SEQ ID NO: 1824970 - RNA, 22 nt, Human herpesvirus 2
ugccugacccucucgggcaugg

SEQ ID NO: 1824971 - RNA, 16 nt, Human herpesvirus 2
ggggaggggggaagga

SEQ ID NO: 1824972 - RNA, 12 nt, Human herpesvirus 2
ugccgcagacca

SEQ ID NO: 1824973 - RNA, 14 nt, Human herpesvirus 2
cugcccgcggacca

SEQ ID NO: 1824974 - RNA, 15 nt, Human herpesvirus 2
ggccagauggggccc

SEQ ID NO: 1824975 - RNA, 13 nt, Human herpesvirus 2
gccccucugcuuu

SEQ ID NO: 1824976 - RNA, 12 nt, Human herpesvirus 2
ccccccccucca

SEQ ID NO: 1824977 - RNA, 14 nt, Human herpesvirus 2
cgccgcgcgggccc

SEQ ID NO: 1824978 - RNA, 21 nt, Human herpesvirus 2
cggcaucguuuggguggagga

SEQ ID NO: 1824979 - RNA, 17 nt, Human herpesvirus 2
caauaaacgccuucccg

SEQ ID NO: 1824980 - RNA, 18 nt, Human herpesvirus 2
accuguuuuuacgggccc

SEQ ID NO: 1824981 - RNA, 12 nt, Human herpesvirus 2
cugcacgagguc

SEQ ID NO: 1824982 - RNA, 17 nt, Human herpesvirus 2
ccacgugcacagccugg

SEQ ID NO: 1824983 - RNA, 14 nt, Human herpesvirus 2
ccgacaucaaccac

SEQ ID NO: 1824984 - RNA, 21 nt, Human herpesvirus 2
caugugcuaacgggaaaacca

SEQ ID NO: 1824985 - RNA, 21 nt, Human herpesvirus 2
cccuguccccgccccccccag

SEQ ID NO: 1824986 - RNA, 23 nt, Human herpesvirus 2
ucccacacggucggugcccccca

SEQ ID NO: 1824987 - RNA, 15 nt, Human herpesvirus 2
ucgcccuagaggcug

SEQ ID NO: 1824988 - RNA, 20 nt, Human herpesvirus 2
gcccccggccuuugcuuccu

SEQ ID NO: 1824989 - RNA, 14 nt, Human herpesvirus 2
guaccucugggccc

SEQ ID NO: 1824990 - RNA, 12 nt, Human herpesvirus 2
ccgaugcccagu

SEQ ID NO: 1824991 - RNA, 16 nt, Human herpesvirus 2
ggucaauagauuuccc

SEQ ID NO: 1824992 - RNA, 14 nt, Human herpesvirus 2
ugauacuuaaaugc

SEQ ID NO: 1824993 - RNA, 15 nt, Human herpesvirus 2
cucguaggcccgggg

SEQ ID NO: 1824994 - RNA, 16 nt, Human herpesvirus 2
accggggccccaucug

SEQ ID NO: 1824995 - RNA, 14 nt, Human herpesvirus 2
aggaaacgcaaaaa

SEQ ID NO: 1824996 - RNA, 16 nt, Human herpesvirus 2
ugggguuuuggcggcc

SEQ ID NO: 1824997 - RNA, 13 nt, Human herpesvirus 2
gcgcgcacucccg

SEQ ID NO: 1824998 - RNA, 16 nt, Human herpesvirus 2
agcggcgaacacugcc

SEQ ID NO: 1824999 - RNA, 22 nt, Human herpesvirus 2
gacacacuuuguuguuggccuu

SEQ ID NO: 1825000 - RNA, 18 nt, Human herpesvirus 2
aggcuggagcucugccug

SEQ ID NO: 1825001 - RNA, 14 nt, Human herpesvirus 2
cgugggugacuggg

SEQ ID NO: 1825002 - RNA, 20 nt, Human herpesvirus 2
aggggcuccucagcgcggcc

SEQ ID NO: 1825003 - RNA, 22 nt, Human herpesvirus 2
acugggccgaugugcccugcaa

SEQ ID NO: 1825004 - RNA, 20 nt, Human herpesvirus 2
uggggccucucgacggagag

SEQ ID NO: 1825005 - RNA, 23 nt, Human herpesvirus 2
gaguuucggaaagccggccccgg

SEQ ID NO: 1825006 - RNA, 21 nt, Human herpesvirus 2
cgcauaucgccauggaucccg

SEQ ID NO: 1825007 - RNA, 19 nt, Human herpesvirus 2
uugugcuuuuacccucacc

SEQ ID NO: 1825008 - RNA, 21 nt, Human herpesvirus 2
cccgucuuuuuuuuuccuguu

SEQ ID NO: 1825009 - RNA, 13 nt, Human herpesvirus 2
accccaaaccaac

SEQ ID NO: 1825010 - RNA, 20 nt, Human herpesvirus 2
gaagucucuuggggaaaucu

SEQ ID NO: 1825011 - RNA, 21 nt, Human herpesvirus 2
ggcagcgcgccgacgaccugc

SEQ ID NO: 1825012 - RNA, 22 nt, Human herpesvirus 2
gcggcauaccuccgaccggcgg

SEQ ID NO: 1825013 - RNA, 19 nt, Human herpesvirus 2
gccgcacggccgugucgcu

SEQ ID NO: 1825014 - RNA, 14 nt, Human herpesvirus 2
cccgagcgugcccu

SEQ ID NO: 1825015 - RNA, 18 nt, Human herpesvirus 2
uuuugcuggcgccgccgg

SEQ ID NO: 1825016 - RNA, 16 nt, Human herpesvirus 2
cgaaucccccaaggaa

SEQ ID NO: 1825017 - RNA, 14 nt, Human herpesvirus 2
caauuagcuguuua

SEQ ID NO: 1825018 - RNA, 22 nt, Human herpesvirus 2
uccggugugccccacccccgag

SEQ ID NO: 1825019 - RNA, 14 nt, Human herpesvirus 2
ggcggggggugugg

SEQ ID NO: 1825020 - RNA, 15 nt, Human herpesvirus 2
cucgcugcucucccg

SEQ ID NO: 1825021 - RNA, 23 nt, Human herpesvirus 2
caggggcagcucgcccccgugcc

SEQ ID NO: 1825022 - RNA, 12 nt, Human herpesvirus 2
ucgaaggucggg

SEQ ID NO: 1825023 - RNA, 16 nt, Human herpesvirus 2
ccgacuuccgugcccc

SEQ ID NO: 1825024 - RNA, 14 nt, Human herpesvirus 2
cccgcaccagcucg

SEQ ID NO: 1825025 - RNA, 20 nt, Human herpesvirus 2
acaccagacggcgggacccc

SEQ ID NO: 1825026 - RNA, 13 nt, Human herpesvirus 2
agugccgcacggc

SEQ ID NO: 1825027 - RNA, 23 nt, Human herpesvirus 2
ucuuucggccaccaccccccucc

SEQ ID NO: 1825028 - RNA, 18 nt, Human herpesvirus 2
ucgccgacuccaggagcu

SEQ ID NO: 1825029 - RNA, 14 nt, Human herpesvirus 2
ccggucccuucccc

SEQ ID NO: 1825030 - RNA, 20 nt, Human herpesvirus 2
uucgccgacgccuucccugu

SEQ ID NO: 1825031 - RNA, 20 nt, Human herpesvirus 2
aggaguuucggaaagccggc

SEQ ID NO: 1825032 - RNA, 18 nt, Human herpesvirus 2
gccaaaccagccccgcag

SEQ ID NO: 1825033 - RNA, 12 nt, Human herpesvirus 2
gcgagcgacagc

SEQ ID NO: 1825034 - RNA, 19 nt, Human herpesvirus 2
gguaauuagaaacuuuuaa

SEQ ID NO: 1825035 - RNA, 15 nt, Human herpesvirus 2
gccucuuugggccgu

SEQ ID NO: 1825036 - RNA, 13 nt, Human herpesvirus 2
gcugcugccccgc

SEQ ID NO: 1825037 - RNA, 21 nt, Human herpesvirus 2
gcggccgccgcaacacccggc

SEQ ID NO: 1825038 - RNA, 14 nt, Human herpesvirus 2
accccccccucuca

SEQ ID NO: 1825039 - RNA, 19 nt, Human herpesvirus 2
cccguguaccucugggccc

SEQ ID NO: 1825040 - RNA, 22 nt, Human herpesvirus 2
gggacgcccggcccauaaacag

SEQ ID NO: 1825041 - RNA, 16 nt, Human herpesvirus 2
gcggccccgacccaac

SEQ ID NO: 1825042 - RNA, 17 nt, Human herpesvirus 2
cggacagccagggcugg

SEQ ID NO: 1825043 - RNA, 20 nt, Human herpesvirus 2
agccagggucggacaggagg

SEQ ID NO: 1825044 - RNA, 14 nt, Human herpesvirus 2
gacacacacacccc

SEQ ID NO: 1825045 - RNA, 15 nt, Human herpesvirus 2
caggccgcccccagc

SEQ ID NO: 1825046 - RNA, 22 nt, Human herpesvirus 2
ggauguguucuccuggacgcgg

SEQ ID NO: 1825047 - RNA, 14 nt, Human herpesvirus 2
ggcgagcuggcccu

SEQ ID NO: 1825048 - RNA, 15 nt, Human herpesvirus 2
gccgacuccaggagc

SEQ ID NO: 1825049 - RNA, 17 nt, Human herpesvirus 2
acacaccgggcuggggg

SEQ ID NO: 1825050 - RNA, 13 nt, Human herpesvirus 2
agcucgggggcca

SEQ ID NO: 1825051 - RNA, 21 nt, Human herpesvirus 2
uguacaaacacggggacggcc

SEQ ID NO: 1825052 - RNA, 18 nt, Human herpesvirus 2
ggucccggccgccauccc

SEQ ID NO: 1825053 - RNA, 17 nt, Human herpesvirus 2
gcccgaaggaagccgcc

SEQ ID NO: 1825054 - RNA, 21 nt, Human herpesvirus 2
gcagggccgcugggggggcgg

SEQ ID NO: 1825055 - RNA, 19 nt, Human herpesvirus 2
gguaauuagcaacuuuuaa

SEQ ID NO: 1825056 - RNA, 18 nt, Human herpesvirus 2
ggccccgacuccgcgaau

SEQ ID NO: 1825057 - RNA, 14 nt, Human herpesvirus 2
agggacgcgcagcg

SEQ ID NO: 1825058 - RNA, 20 nt, Human herpesvirus 2
cggacaggaggcgcagcugg

SEQ ID NO: 1825059 - RNA, 15 nt, Human herpesvirus 2
gcccggaacgagguu

SEQ ID NO: 1825060 - RNA, 21 nt, Human herpesvirus 2
gcaggcccucgcugcucuccc

SEQ ID NO: 1825061 - RNA, 14 nt, Human herpesvirus 2
agaaacggcaagaa

SEQ ID NO: 1825062 - RNA, 21 nt, Human herpesvirus 2
gcccgggugaccacgcgcacg

SEQ ID NO: 1825063 - RNA, 21 nt, Human herpesvirus 2
cgccucgauguauggcgccuu

SEQ ID NO: 1825064 - RNA, 14 nt, Human herpesvirus 2
ugccaguggagcca

SEQ ID NO: 1825065 - RNA, 21 nt, Human herpesvirus 2
ccaacucauacacgcgcuggc

SEQ ID NO: 1825066 - RNA, 23 nt, Human herpesvirus 2
ccgacggggagggacaaggagga

SEQ ID NO: 1825067 - RNA, 13 nt, Human herpesvirus 2
ggaaggaaauggg

SEQ ID NO: 1825068 - RNA, 22 nt, Human herpesvirus 2
ucccacacucgcgucuggcugu

SEQ ID NO: 1825069 - RNA, 21 nt, Human herpesvirus 2
gccagguggcccuuccggacc

SEQ ID NO: 1825070 - RNA, 23 nt, Human herpesvirus 2
aagccacccugggucgggagcag

SEQ ID NO: 1825071 - RNA, 20 nt, Human herpesvirus 2
cgucccagaauuuagccagg

SEQ ID NO: 1825072 - RNA, 23 nt, Human herpesvirus 2
cgcucggggguucgcgcaucucu

SEQ ID NO: 1825073 - RNA, 18 nt, Human herpesvirus 2
uagaaguuacccucuucu

SEQ ID NO: 1825074 - RNA, 23 nt, Human herpesvirus 2
ggagcgggggaggggggagaugg

SEQ ID NO: 1825075 - RNA, 13 nt, Human herpesvirus 2
gauggggguccug

SEQ ID NO: 1825076 - RNA, 20 nt, Human herpesvirus 2
ggaggagggcgaugacccac

SEQ ID NO: 1825077 - RNA, 21 nt, Human herpesvirus 2
uccccaggcgacgccaggccc

SEQ ID NO: 1825078 - RNA, 23 nt, Human herpesvirus 2
cgggaggaaggacacgccucccu

SEQ ID NO: 1825079 - RNA, 14 nt, Human herpesvirus 2
gacgaggccuuccc

SEQ ID NO: 1825080 - RNA, 16 nt, Human herpesvirus 2
cgugcgcucgcucucc

SEQ ID NO: 1825081 - RNA, 19 nt, Human herpesvirus 2
cugggcgaagucccgcacg

SEQ ID NO: 1825082 - RNA, 21 nt, Human herpesvirus 2
cgcggacgagcccguggccca

SEQ ID NO: 1825083 - RNA, 19 nt, Human herpesvirus 2
ucugcgucguccagggugg

SEQ ID NO: 1825084 - RNA, 20 nt, Human herpesvirus 2
acggacacccccccccaucu

SEQ ID NO: 1825085 - RNA, 17 nt, Human herpesvirus 2
aaccggcgagggcggcc

SEQ ID NO: 1825086 - RNA, 16 nt, Human herpesvirus 2
cgcucgcugcagggcc

SEQ ID NO: 1825087 - RNA, 15 nt, Human herpesvirus 2
ccgaacggaaggccu

SEQ ID NO: 1825088 - RNA, 14 nt, Human herpesvirus 2
uuccgugccccugg

SEQ ID NO: 1825089 - RNA, 18 nt, Human herpesvirus 2
ccgucacgagccccuggg

SEQ ID NO: 1825090 - RNA, 21 nt, Human herpesvirus 2
gacugauucucaccuggggcu

SEQ ID NO: 1825091 - RNA, 17 nt, Human herpesvirus 2
cgggcgagcuggcccug

SEQ ID NO: 1825092 - RNA, 16 nt, Human herpesvirus 2
cgcaucuucgccgggu

SEQ ID NO: 1825093 - RNA, 14 nt, Human herpesvirus 2
ggcgccggccaacc

SEQ ID NO: 1825094 - RNA, 16 nt, Human herpesvirus 2
cggacgucggcgauga

SEQ ID NO: 1825095 - RNA, 16 nt, Human herpesvirus 2
ugucggagaggcccgc

SEQ ID NO: 1825096 - RNA, 13 nt, Human herpesvirus 2
ggcugcgggcgug

SEQ ID NO: 1825097 - RNA, 14 nt, Human herpesvirus 2
gggcggcgaaccgg

SEQ ID NO: 1825098 - RNA, 15 nt, Human herpesvirus 2
gacccgccgggggcg

SEQ ID NO: 1825099 - RNA, 22 nt, Human herpesvirus 2
cccagggcuucguggaagagga

SEQ ID NO: 1825100 - RNA, 14 nt, Human herpesvirus 2
uuauaagccgccgc

SEQ ID NO: 1825101 - RNA, 14 nt, Human herpesvirus 2
ggcggcccccggcc

SEQ ID NO: 1825102 - RNA, 16 nt, Human herpesvirus 2
gcccgggguucugggg

SEQ ID NO: 1825103 - RNA, 15 nt, Human herpesvirus 2
cgugcgcgugggagg

SEQ ID NO: 1825104 - RNA, 23 nt, Human herpesvirus 2
gccgccccgcaguuucaccgccc

SEQ ID NO: 1825105 - RNA, 19 nt, Human herpesvirus 2
cgcauauacugcugggcca

SEQ ID NO: 1825106 - RNA, 21 nt, Human herpesvirus 2
cgcgcuuuuccgccgccggga

SEQ ID NO: 1825107 - RNA, 14 nt, Human herpesvirus 2
agaaauaaagaacg

SEQ ID NO: 1825108 - RNA, 17 nt, Human herpesvirus 2
gucuuuuuuuuuccugu

SEQ ID NO: 1825109 - RNA, 14 nt, Human herpesvirus 2
cuccgccagcgccc

SEQ ID NO: 1825110 - RNA, 11 nt, Human herpesvirus 2
accaccaaggc

SEQ ID NO: 1825111 - RNA, 22 nt, Human herpesvirus 2
caguucgcgaccgaucuggagc

SEQ ID NO: 1825112 - RNA, 14 nt, Human herpesvirus 2
acacagacuggccg

SEQ ID NO: 1825113 - RNA, 14 nt, Human herpesvirus 2
cgggggcugcugcc

SEQ ID NO: 1825114 - RNA, 16 nt, Human herpesvirus 2
gcguccgacacccggg

SEQ ID NO: 1825115 - RNA, 22 nt, Human herpesvirus 2
cgcccucgagaugugccuucca

SEQ ID NO: 1825116 - RNA, 13 nt, Human herpesvirus 2
cacgucgcaugca

SEQ ID NO: 1825117 - RNA, 13 nt, Human herpesvirus 2
ccgcgggaggaag

SEQ ID NO: 1825118 - RNA, 18 nt, Human herpesvirus 2
cucgucgccaacggccag

SEQ ID NO: 1825119 - RNA, 16 nt, Human herpesvirus 2
uuccccccccccuccc

SEQ ID NO: 1825120 - RNA, 16 nt, Human herpesvirus 2
cucuucgggcaccccg

SEQ ID NO: 1825121 - RNA, 22 nt, Human herpesvirus 2
ccagcauguguguuaacgcaac

SEQ ID NO: 1825122 - RNA, 13 nt, Human herpesvirus 2
gcgugcugugccc

SEQ ID NO: 1825123 - RNA, 14 nt, Human herpesvirus 2
aguaacccaguucc

SEQ ID NO: 1825124 - RNA, 16 nt, Human herpesvirus 2
gccgcuuuaccccgcg

SEQ ID NO: 1825125 - RNA, 14 nt, Human herpesvirus 2
acccggguccccga

SEQ ID NO: 1825126 - RNA, 21 nt, Human herpesvirus 2
uucuggccaagcauccucacc

SEQ ID NO: 1825127 - RNA, 23 nt, Human herpesvirus 2
cacguccguauguuaauugcaau

SEQ ID NO: 1825128 - RNA, 18 nt, Human herpesvirus 2
cacggcaaccccaccuuc

SEQ ID NO: 1825129 - RNA, 19 nt, Human herpesvirus 2
cuauggggggggaaaggaa

SEQ ID NO: 1825130 - RNA, 13 nt, Human herpesvirus 2
accgaagaggugc

SEQ ID NO: 1825131 - RNA, 13 nt, Human herpesvirus 2
cuuggccuucccg

SEQ ID NO: 1825132 - RNA, 15 nt, Human herpesvirus 2
gggggugguggugcu

SEQ ID NO: 1825133 - RNA, 13 nt, Human herpesvirus 2
aguguuugggaaa

SEQ ID NO: 1825134 - RNA, 22 nt, Human herpesvirus 2
ugccucuguuucuccaggcgcu

SEQ ID NO: 1825135 - RNA, 22 nt, Human herpesvirus 2
cuccgcaauaaacgccuucccg

SEQ ID NO: 1825136 - RNA, 15 nt, Human herpesvirus 2
cauauacugcugggc

SEQ ID NO: 1825137 - RNA, 19 nt, Human herpesvirus 2
ggccucccgcaagagccug

SEQ ID NO: 1825138 - RNA, 14 nt, Human herpesvirus 2
ggcuccaggccgcc

SEQ ID NO: 1825139 - RNA, 13 nt, Human herpesvirus 2
cagauaugugagu

SEQ ID NO: 1825140 - RNA, 14 nt, Human herpesvirus 2
gccugcccccgccu

SEQ ID NO: 1825141 - RNA, 18 nt, Human herpesvirus 2
cgcguccagguacccggc

SEQ ID NO: 1825142 - RNA, 18 nt, Human herpesvirus 2
uaaccgcgcgccuccucg

SEQ ID NO: 1825143 - RNA, 23 nt, Human herpesvirus 2
cggaggccugucccugcgucgcc

SEQ ID NO: 1825144 - RNA, 22 nt, Human herpesvirus 2
ucgaccggggacuccccucuac

SEQ ID NO: 1825145 - RNA, 16 nt, Human herpesvirus 2
ccgggugaccacgcgc

SEQ ID NO: 1825146 - RNA, 15 nt, Human herpesvirus 2
gcgccgccgucagcu

SEQ ID NO: 1825147 - RNA, 16 nt, Human herpesvirus 2
cugugccagguggccc

SEQ ID NO: 1825148 - RNA, 20 nt, Human herpesvirus 2
caccaaccuggcacagcggg

SEQ ID NO: 1825149 - RNA, 15 nt, Human herpesvirus 2
gcagcacggcggcca

SEQ ID NO: 1825150 - RNA, 21 nt, Human herpesvirus 2
cacccuaaggaugcccgccag

SEQ ID NO: 1825151 - RNA, 20 nt, Human herpesvirus 2
ugagagggggggguggagug

SEQ ID NO: 1825152 - RNA, 21 nt, Human herpesvirus 2
cgccgcuguggcccuggcgga

SEQ ID NO: 1825153 - RNA, 18 nt, Human herpesvirus 2
acggccccggccgccucc

SEQ ID NO: 1825154 - RNA, 19 nt, Human herpesvirus 2
gcccaggcccuggcgcacc

SEQ ID NO: 1825155 - RNA, 16 nt, Human herpesvirus 2
uucccuuuugguccuu

SEQ ID NO: 1825156 - RNA, 19 nt, Human herpesvirus 2
ggccguguggucgccccca

SEQ ID NO: 1825157 - RNA, 16 nt, Human herpesvirus 2
ggcggcgccugcgccc

SEQ ID NO: 1825158 - RNA, 23 nt, Human herpesvirus 2
gugcacguguuugagucagggac

SEQ ID NO: 1825159 - RNA, 22 nt, Human herpesvirus 2
gaccggucgcuuuccacacccc

SEQ ID NO: 1825160 - RNA, 17 nt, Human herpesvirus 2
cugccucccccccggag

SEQ ID NO: 1825161 - RNA, 23 nt, Human herpesvirus 2
gggccucggucgacgaggccugg

SEQ ID NO: 1825162 - RNA, 20 nt, Human herpesvirus 2
ccacggucaggaccagggac

SEQ ID NO: 1825163 - RNA, 18 nt, Human herpesvirus 2
ggggcaccaaaaaccagg

SEQ ID NO: 1825164 - RNA, 17 nt, Human herpesvirus 2
auggccgcuccugcccg

SEQ ID NO: 1825165 - RNA, 12 nt, Human herpesvirus 2
cgccgaccagaa

SEQ ID NO: 1825166 - RNA, 15 nt, Human herpesvirus 2
gcgccaccggccugg

SEQ ID NO: 1825167 - RNA, 15 nt, Human herpesvirus 2
acuuggacuccgcau

SEQ ID NO: 1825168 - RNA, 18 nt, Human herpesvirus 2
ggaacugggguacugcac

SEQ ID NO: 1825169 - RNA, 16 nt, Human herpesvirus 2
gcgggagccagggucg

SEQ ID NO: 1825170 - RNA, 18 nt, Human herpesvirus 2
gugucggagaggcccgcc

SEQ ID NO: 1825171 - RNA, 12 nt, Human herpesvirus 2
guucggcaggcc

SEQ ID NO: 1825172 - RNA, 21 nt, Human herpesvirus 2
gccauccccggcgccaugagc

SEQ ID NO: 1825173 - RNA, 14 nt, Human herpesvirus 2
gcccgccccugcgc

SEQ ID NO: 1825174 - RNA, 23 nt, Human herpesvirus 2
ccuacgccccccucggcagcccg

SEQ ID NO: 1825175 - RNA, 17 nt, Human herpesvirus 2
gccucauccggcccgcc

SEQ ID NO: 1825176 - RNA, 16 nt, Human herpesvirus 2
ccgacgucucggcccc

SEQ ID NO: 1825177 - RNA, 19 nt, Human herpesvirus 2
aagcgaagacgaggccgcc

SEQ ID NO: 1825178 - RNA, 19 nt, Human herpesvirus 2
ggccggggagggcagggcc

SEQ ID NO: 1825179 - RNA, 18 nt, Human herpesvirus 2
gaguugcgccggcaccag

SEQ ID NO: 1825180 - RNA, 19 nt, Human herpesvirus 2
ccaccuggaagcugccucc

SEQ ID NO: 1825181 - RNA, 21 nt, Human herpesvirus 2
ccuggcggccccuguuggagc

SEQ ID NO: 1825182 - RNA, 17 nt, Human herpesvirus 2
cugccgccgcgggagga

SEQ ID NO: 1825183 - RNA, 21 nt, Human herpesvirus 2
aguuccuccgugcuggggaaa

SEQ ID NO: 1825184 - RNA, 15 nt, Human herpesvirus 2
cugcagggccuggcg

SEQ ID NO: 1825185 - RNA, 15 nt, Human herpesvirus 2
gcggaggcgugguga

SEQ ID NO: 1825186 - RNA, 17 nt, Human herpesvirus 2
ugcccauggcgucggcg

SEQ ID NO: 1825187 - RNA, 19 nt, Human herpesvirus 2
cacucuggcguccccaggc

SEQ ID NO: 1825188 - RNA, 18 nt, Human herpesvirus 2
gcguugcguuggggcacg

SEQ ID NO: 1825189 - RNA, 14 nt, Human herpesvirus 2
gcucguccccuggg

SEQ ID NO: 1825190 - RNA, 18 nt, Human herpesvirus 2
uuaggucggaggggugag

SEQ ID NO: 1825191 - RNA, 22 nt, Human herpesvirus 2
gacuccccucuacccccaccca

SEQ ID NO: 1825192 - RNA, 20 nt, Human herpesvirus 2
gccgcccccgccggcccgcg

SEQ ID NO: 1825193 - RNA, 19 nt, Human herpesvirus 2
agcuggcccuggacccaga

SEQ ID NO: 1825194 - RNA, 22 nt, Human herpesvirus 2
gacgcuguuguuucugggcccg

SEQ ID NO: 1825195 - RNA, 16 nt, Human herpesvirus 2
accgcacccgggccgg

SEQ ID NO: 1825196 - RNA, 14 nt, Human herpesvirus 2
aaaccugggcggcc

SEQ ID NO: 1825197 - RNA, 14 nt, Human herpesvirus 2
ccaauucuucccgg

SEQ ID NO: 1825198 - RNA, 17 nt, Human herpesvirus 2
ucccuucuccauuccug

SEQ ID NO: 1825199 - RNA, 17 nt, Human herpesvirus 2
cgaagcggccccgaccc

SEQ ID NO: 1825200 - RNA, 13 nt, Human herpesvirus 2
auacucuguuuau

SEQ ID NO: 1825201 - RNA, 21 nt, Human herpesvirus 2
gggcaugggcuacuaccuggg

SEQ ID NO: 1825202 - RNA, 21 nt, Human herpesvirus 2
cgccgcgcgggacccacgagg

SEQ ID NO: 1825203 - RNA, 21 nt, Human herpesvirus 2
ggacgcagcggcguccacgcc

SEQ ID NO: 1825204 - RNA, 21 nt, Human herpesvirus 2
gcgcggggguucggggccagg

SEQ ID NO: 1825205 - RNA, 15 nt, Human herpesvirus 2
gcaagccacccuggg

SEQ ID NO: 1825206 - RNA, 17 nt, Human herpesvirus 2
cccgcgccucgggcggc

SEQ ID NO: 1825207 - RNA, 21 nt, Human herpesvirus 2
acuuccgugccccuggacugg

SEQ ID NO: 1825208 - RNA, 21 nt, Human herpesvirus 2
aacgcacccccggaccccgcu

SEQ ID NO: 1825209 - RNA, 17 nt, Human herpesvirus 2
cccgcgcaucacggccc

SEQ ID NO: 1825210 - RNA, 12 nt, Human herpesvirus 2
ccacacaguccg

SEQ ID NO: 1825211 - RNA, 17 nt, Human herpesvirus 2
gaggugcgccaggucag

SEQ ID NO: 1825212 - RNA, 11 nt, Human herpesvirus 2
cugguggugga

SEQ ID NO: 1825213 - RNA, 19 nt, Human herpesvirus 2
accacggucugguggcgcu

SEQ ID NO: 1825214 - RNA, 14 nt, Human herpesvirus 2
ggccauccugccca

SEQ ID NO: 1825215 - RNA, 22 nt, Human herpesvirus 2
gggggucgggcgggcggggguc

SEQ ID NO: 1825216 - RNA, 15 nt, Human herpesvirus 2
cguccaccuuggccc

SEQ ID NO: 1825217 - RNA, 15 nt, Human herpesvirus 2
gccgucgggccccgg

SEQ ID NO: 1825218 - RNA, 16 nt, Human herpesvirus 2
ccgucccggcagaagc

SEQ ID NO: 1825219 - RNA, 24 nt, Human herpesvirus 2
ggaguuccgacgacgcguacgugg

SEQ ID NO: 1825220 - RNA, 14 nt, Human herpesvirus 2
cuuugacuccuggg

SEQ ID NO: 1825221 - RNA, 21 nt, Human herpesvirus 2
gcaccacguguccccagggag

SEQ ID NO: 1825222 - RNA, 21 nt, Human herpesvirus 2
gugguggccgaaagaaaagga

SEQ ID NO: 1825223 - RNA, 17 nt, Human herpesvirus 2
cggacgcggcacaggug

SEQ ID NO: 1825224 - RNA, 14 nt, Human herpesvirus 2
gcacccucgcacgu

SEQ ID NO: 1825225 - RNA, 13 nt, Human herpesvirus 2
cgucgaccgggga

SEQ ID NO: 1825226 - RNA, 20 nt, Human herpesvirus 2
ccgagcagcacggcggccag

SEQ ID NO: 1825227 - RNA, 19 nt, Human herpesvirus 2
cugcgcgcgcaccugcggg

SEQ ID NO: 1825228 - RNA, 22 nt, Human herpesvirus 2
agagucgauugcggggaccgca

SEQ ID NO: 1825229 - RNA, 22 nt, Human herpesvirus 2
uaacuaaaccacagcacggccg

SEQ ID NO: 1825230 - RNA, 15 nt, Human herpesvirus 2
ggcgacgggcggcug

SEQ ID NO: 1825231 - RNA, 23 nt, Human herpesvirus 2
cuggccgagcguaucggccagga

SEQ ID NO: 1825232 - RNA, 18 nt, Human herpesvirus 2
aggacgccggccgguccu

SEQ ID NO: 1825233 - RNA, 20 nt, Human herpesvirus 2
agcggccgggucggcugucc

SEQ ID NO: 1825234 - RNA, 12 nt, Human herpesvirus 2
gcuugcggggcu

SEQ ID NO: 1825235 - RNA, 20 nt, Human herpesvirus 2
gcggggacccgccagagacc

SEQ ID NO: 1825236 - RNA, 19 nt, Human herpesvirus 2
ccccucaccccuccgaccu

SEQ ID NO: 1825237 - RNA, 14 nt, Human herpesvirus 2
ggcggcuggccacc

SEQ ID NO: 1825238 - RNA, 17 nt, Human herpesvirus 2
gcaggcgcgcggguccc

SEQ ID NO: 1825239 - RNA, 13 nt, Human herpesvirus 2
cgcaaccuccggg

SEQ ID NO: 1825240 - RNA, 19 nt, Human herpesvirus 2
cgcuccgaucggggucagg

SEQ ID NO: 1825241 - RNA, 17 nt, Human herpesvirus 2
cggacuccgccccggcg

SEQ ID NO: 1825242 - RNA, 15 nt, Human herpesvirus 2
cgcaccccaccccug

SEQ ID NO: 1825243 - RNA, 15 nt, Human herpesvirus 2
cucccuuuuuucccc

SEQ ID NO: 1825244 - RNA, 13 nt, Human herpesvirus 2
aacagagcucuuu

SEQ ID NO: 1825245 - RNA, 21 nt, Human herpesvirus 2
uggugacggaaaaccugggcg

SEQ ID NO: 1825246 - RNA, 12 nt, Human herpesvirus 2
gggggaaacaca

SEQ ID NO: 1825247 - RNA, 14 nt, Human herpesvirus 2
cgggagcaggacag

SEQ ID NO: 1825248 - RNA, 17 nt, Human herpesvirus 2
gggcaccaaaaaccagg

SEQ ID NO: 1825249 - RNA, 15 nt, Human herpesvirus 2
acggccaggaugggu

SEQ ID NO: 1825250 - RNA, 13 nt, Human herpesvirus 2
cuuucuuuccccc

SEQ ID NO: 1825251 - RNA, 18 nt, Human herpesvirus 2
agauccccggggcccgca

SEQ ID NO: 1825252 - RNA, 20 nt, Human herpesvirus 2
gcuagucuccgaucugcccc

SEQ ID NO: 1825253 - RNA, 16 nt, Human herpesvirus 2
gccgacgaccugcagc

SEQ ID NO: 1825254 - RNA, 22 nt, Human herpesvirus 2
cccccggaccccgcugcugugc

SEQ ID NO: 1825255 - RNA, 20 nt, Human herpesvirus 2
gacacgcaacaacggcgggc

SEQ ID NO: 1825256 - RNA, 14 nt, Human herpesvirus 2
cccauccccucccg

SEQ ID NO: 1825257 - RNA, 20 nt, Human herpesvirus 2
gcaggggggccggggauggg

SEQ ID NO: 1825258 - RNA, 18 nt, Human herpesvirus 2
gcccccgacccggggccc

SEQ ID NO: 1825259 - RNA, 12 nt, Human herpesvirus 2
gggggggaaaga

SEQ ID NO: 1825260 - RNA, 13 nt, Human herpesvirus 2
cggggagggacaa

SEQ ID NO: 1825261 - RNA, 15 nt, Human herpesvirus 2
gacacgcggcggguc

SEQ ID NO: 1825262 - RNA, 15 nt, Human herpesvirus 2
gaugcagcucccccg

SEQ ID NO: 1825263 - RNA, 12 nt, Human herpesvirus 2
ggcuucgugggu

SEQ ID NO: 1825264 - RNA, 17 nt, Human herpesvirus 2
ggcucccccgcggccuu

SEQ ID NO: 1825265 - RNA, 16 nt, Human herpesvirus 2
agagacccugcccccc

SEQ ID NO: 1825266 - RNA, 19 nt, Human herpesvirus 2
aucgucccgguugcguugc

SEQ ID NO: 1825267 - RNA, 15 nt, Human herpesvirus 2
ggcggcguggccgcg

SEQ ID NO: 1825268 - RNA, 21 nt, Human herpesvirus 2
ucgcgugcggccagccgcccc

SEQ ID NO: 1825269 - RNA, 16 nt, Human herpesvirus 2
gaggcccucugggaca

SEQ ID NO: 1825270 - RNA, 20 nt, Human herpesvirus 2
cgguuggaggcgccucugcc

SEQ ID NO: 1825271 - RNA, 15 nt, Human herpesvirus 2
uggacgcgccucccg

SEQ ID NO: 1825272 - RNA, 14 nt, Human herpesvirus 2
ggguccgggggccu

SEQ ID NO: 1825273 - RNA, 16 nt, Human herpesvirus 2
gccccucgcccccgcg

SEQ ID NO: 1825274 - RNA, 19 nt, Human herpesvirus 2
cgcgguggcgucggcggcc

SEQ ID NO: 1825275 - RNA, 22 nt, Human herpesvirus 2
cuuccggaccccgaccccgagc

SEQ ID NO: 1825276 - RNA, 19 nt, Human herpesvirus 2
ccgcgcaucacggcccacc

SEQ ID NO: 1825277 - RNA, 14 nt, Human herpesvirus 2
ccuguuuccuuucc

SEQ ID NO: 1825278 - RNA, 21 nt, Human herpesvirus 2
ugcccgcgggucugcgugggg

SEQ ID NO: 1825279 - RNA, 12 nt, Human herpesvirus 2
ggggggggcuug

SEQ ID NO: 1825280 - RNA, 19 nt, Human herpesvirus 2
gcggacccagaccugccgu

SEQ ID NO: 1825281 - RNA, 21 nt, Human herpesvirus 2
ugaggggcaccaaaaaccagg

SEQ ID NO: 1825282 - RNA, 13 nt, Human herpesvirus 2
ccggggggggccu

SEQ ID NO: 1825283 - RNA, 16 nt, Human herpesvirus 2
cgaguccugggugggu

SEQ ID NO: 1825284 - RNA, 13 nt, Human herpesvirus 2
gacccccagcgcg

SEQ ID NO: 1825285 - RNA, 20 nt, Human herpesvirus 2
ggccggcguucccgcucgcg

SEQ ID NO: 1825286 - RNA, 13 nt, Human herpesvirus 2
cacacacaggccc

SEQ ID NO: 1825287 - RNA, 17 nt, Human herpesvirus 2
cucgaacacgagccgca

SEQ ID NO: 1825288 - RNA, 19 nt, Human herpesvirus 2
gcccccccuccgcgcagga

SEQ ID NO: 1825289 - RNA, 16 nt, Human herpesvirus 2
gaucgacgacgccugg

SEQ ID NO: 1825290 - RNA, 20 nt, Human herpesvirus 2
cuucccgggaaaccacacac

SEQ ID NO: 1825291 - RNA, 18 nt, Human herpesvirus 2
uugggggggggggaagag

SEQ ID NO: 1825292 - RNA, 13 nt, Human herpesvirus 2
cgcggcggcuccc

SEQ ID NO: 1825293 - RNA, 15 nt, Human herpesvirus 2
ccccuguuggagccg

SEQ ID NO: 1825294 - RNA, 21 nt, Human herpesvirus 2
cgucgcucucggucccgcaua

SEQ ID NO: 1825295 - RNA, 23 nt, Human herpesvirus 2
gcuaccgcggcuucuucgccgcc

SEQ ID NO: 1825296 - RNA, 21 nt, Human herpesvirus 2
cccggggcggguaggccagag

SEQ ID NO: 1825297 - RNA, 13 nt, Human herpesvirus 2
ccuguugggcaca

SEQ ID NO: 1825298 - RNA, 15 nt, Human herpesvirus 2
gugggucucggggcc

SEQ ID NO: 1825299 - RNA, 16 nt, Human herpesvirus 2
aggaccaaaagggaaa

SEQ ID NO: 1825300 - RNA, 16 nt, Human herpesvirus 2
ccaggaacucacggca

SEQ ID NO: 1825301 - RNA, 21 nt, Human herpesvirus 2
uuucggaaagccggccccggu

SEQ ID NO: 1825302 - RNA, 15 nt, Human herpesvirus 2
guggggugggucgcc

SEQ ID NO: 1825303 - RNA, 15 nt, Human herpesvirus 2
ccagcguccugcgcg

SEQ ID NO: 1825304 - RNA, 17 nt, Human herpesvirus 2
ccgcgaugaccucccgg

SEQ ID NO: 1825305 - RNA, 19 nt, Human herpesvirus 2
gcucgcugcagggccuggc

SEQ ID NO: 1825306 - RNA, 12 nt, Human herpesvirus 2
guaggccagagc

SEQ ID NO: 1825307 - RNA, 21 nt, Human herpesvirus 2
accguggccgacaacugccug

SEQ ID NO: 1825308 - RNA, 15 nt, Human herpesvirus 2
cgacagcggggaccc

SEQ ID NO: 1825309 - RNA, 21 nt, Human herpesvirus 2
uggcacaaaaagcgacacucc

SEQ ID NO: 1825310 - RNA, 20 nt, Human herpesvirus 2
gggagugggggggggggacg

SEQ ID NO: 1825311 - RNA, 14 nt, Human herpesvirus 2
gaaacuuccgggag

SEQ ID NO: 1825312 - RNA, 21 nt, Human herpesvirus 2
gagacggccaugaccucgccc

SEQ ID NO: 1825313 - RNA, 20 nt, Human herpesvirus 2
cgacccccgugucgcucccc

SEQ ID NO: 1825314 - RNA, 12 nt, Human herpesvirus 2
gccucguggggc

SEQ ID NO: 1825315 - RNA, 23 nt, Human herpesvirus 2
uagaggguucgcaaccacagcaa

SEQ ID NO: 1825316 - RNA, 19 nt, Human herpesvirus 2
gccgcagaccaccucgcgg

SEQ ID NO: 1825317 - RNA, 23 nt, Human herpesvirus 2
ccgaaucuuuucaucgaaagggu

SEQ ID NO: 1825318 - RNA, 18 nt, Human herpesvirus 2
acacgccugcccccgccu

SEQ ID NO: 1825319 - RNA, 15 nt, Human herpesvirus 2
ggagggcggccagcc

SEQ ID NO: 1825320 - RNA, 20 nt, Human herpesvirus 2
ggcgacccgccgggggcgga

SEQ ID NO: 1825321 - RNA, 20 nt, Human herpesvirus 2
acggcaacaaagggccuccg

SEQ ID NO: 1825322 - RNA, 13 nt, Human herpesvirus 2
gcacggaggaacu

SEQ ID NO: 1825323 - RNA, 20 nt, Human herpesvirus 2
cgagccgcugugccaggugg

SEQ ID NO: 1825324 - RNA, 14 nt, Human herpesvirus 2
ccugcggcagcgcg

SEQ ID NO: 1825325 - RNA, 13 nt, Human herpesvirus 2
ggcggcguggccg

SEQ ID NO: 1825326 - RNA, 13 nt, Human herpesvirus 2
cgaugggagcccc

SEQ ID NO: 1825327 - RNA, 18 nt, Human herpesvirus 2
gcaucccagacgcccgcg

SEQ ID NO: 1825328 - RNA, 12 nt, Human herpesvirus 2
uuucucuucccc

SEQ ID NO: 1825329 - RNA, 14 nt, Human herpesvirus 2
gacuuucuggccuu

SEQ ID NO: 1825330 - RNA, 12 nt, Human herpesvirus 2
ucugaggccuca

SEQ ID NO: 1825331 - RNA, 20 nt, Human herpesvirus 2
gacgcccggcccauaaacag

SEQ ID NO: 1825332 - RNA, 11 nt, Human herpesvirus 2
gauuuccccag

SEQ ID NO: 1825333 - RNA, 16 nt, Human herpesvirus 2
ggccagcacgaccagg

SEQ ID NO: 1825334 - RNA, 21 nt, Human herpesvirus 2
cgaccaucaagaauucccagg

SEQ ID NO: 1825335 - RNA, 15 nt, Human herpesvirus 2
ccggcccgcgucccc

SEQ ID NO: 1825336 - RNA, 17 nt, Human herpesvirus 2
ggguuccccgagagccc

SEQ ID NO: 1825337 - RNA, 20 nt, Human herpesvirus 2
ugcuuggaggcccucuggga

SEQ ID NO: 1825338 - RNA, 16 nt, Human herpesvirus 2
gagcccugccccgccc

SEQ ID NO: 1825339 - RNA, 13 nt, Human herpesvirus 2
cgacgccaggccc

SEQ ID NO: 1825340 - RNA, 17 nt, Human herpesvirus 2
cguacgucugcccgugg

SEQ ID NO: 1825341 - RNA, 15 nt, Human herpesvirus 2
gagagccggaccggg

SEQ ID NO: 1825342 - RNA, 20 nt, Human herpesvirus 2
gaguucaauagauuucccaa

SEQ ID NO: 1825343 - RNA, 14 nt, Human herpesvirus 2
cccacagccaccuc

SEQ ID NO: 1825344 - RNA, 18 nt, Human herpesvirus 2
gagaagccgcccccaccc

SEQ ID NO: 1825345 - RNA, 19 nt, Human herpesvirus 2
cgagcucccugcggcuggc

SEQ ID NO: 1825346 - RNA, 21 nt, Human herpesvirus 2
ugcaguaacccaguuccucag

SEQ ID NO: 1825347 - RNA, 16 nt, Human herpesvirus 2
gcgcacccuggccguc

SEQ ID NO: 1825348 - RNA, 21 nt, Human herpesvirus 2
cagcuuucccuccacccgccc

SEQ ID NO: 1825349 - RNA, 13 nt, Human herpesvirus 2
ccgggcccuuggg

SEQ ID NO: 1825350 - RNA, 12 nt, Human herpesvirus 2
cgcgacggcccc

SEQ ID NO: 1825351 - RNA, 20 nt, Human herpesvirus 2
gucgcccuagaggcuguccg

SEQ ID NO: 1825352 - RNA, 22 nt, Human herpesvirus 2
cuagcucgcggagggcggccag

SEQ ID NO: 1825353 - RNA, 11 nt, Human herpesvirus 2
guaaaaaagaa

SEQ ID NO: 1825354 - RNA, 23 nt, Human herpesvirus 2
cggugccgcuuuaccccgcggcc

SEQ ID NO: 1825355 - RNA, 15 nt, Human herpesvirus 2
gacgccagcugcugg

SEQ ID NO: 1825356 - RNA, 16 nt, Human herpesvirus 2
ugacgacggccccggc

SEQ ID NO: 1825357 - RNA, 16 nt, Human herpesvirus 2
cgcacccaccggcccc

SEQ ID NO: 1825358 - RNA, 21 nt, Human herpesvirus 2
cucuguuccuuucccuucucc

SEQ ID NO: 1825359 - RNA, 16 nt, Human herpesvirus 2
augcuaauuaaauaca

SEQ ID NO: 1825360 - RNA, 16 nt, Human herpesvirus 2
aaggccaggggggcag

SEQ ID NO: 1825361 - RNA, 14 nt, Human herpesvirus 2
gacaucaaccaccu

SEQ ID NO: 1825362 - RNA, 14 nt, Human herpesvirus 2
cguugcccccccgg

SEQ ID NO: 1825363 - RNA, 21 nt, Human herpesvirus 2
cccagggcuucguggaagagg

SEQ ID NO: 1825364 - RNA, 15 nt, Human herpesvirus 2
ugccgggggccauga

SEQ ID NO: 1825365 - RNA, 13 nt, Human herpesvirus 2
ccgcgcgccgccg

SEQ ID NO: 1825366 - RNA, 12 nt, Human herpesvirus 2
ccucuaccccca

SEQ ID NO: 1825367 - RNA, 13 nt, Human herpesvirus 2
uggcggaagugcc

SEQ ID NO: 1825368 - RNA, 12 nt, Human herpesvirus 2
cgcgccucccgg

SEQ ID NO: 1825369 - RNA, 12 nt, Human herpesvirus 2
caccccccugac

SEQ ID NO: 1825370 - RNA, 14 nt, Human herpesvirus 2
ccgcccccgcuggc

SEQ ID NO: 1825371 - RNA, 19 nt, Human herpesvirus 2
uuuacgccuuuccuccccu

SEQ ID NO: 1825372 - RNA, 18 nt, Human herpesvirus 2
guuguccguucugucguc

SEQ ID NO: 1825373 - RNA, 20 nt, Human herpesvirus 2
ccuggaagcugccucccccc

SEQ ID NO: 1825374 - RNA, 18 nt, Human herpesvirus 2
cauggcggggggggggcu

SEQ ID NO: 1825375 - RNA, 13 nt, Human herpesvirus 2
gacggggaggaga

SEQ ID NO: 1825376 - RNA, 16 nt, Human herpesvirus 2
gucucaauaaagccag

SEQ ID NO: 1825377 - RNA, 16 nt, Human herpesvirus 2
uuccacacccccuccc

SEQ ID NO: 1825378 - RNA, 20 nt, Human herpesvirus 2
gcgcugcugcgcauggccug

SEQ ID NO: 1825379 - RNA, 20 nt, Human herpesvirus 2
ccuccgccagcgcccuuccg

SEQ ID NO: 1825380 - RNA, 17 nt, Human herpesvirus 2
ccccucguucugcugca

SEQ ID NO: 1825381 - RNA, 19 nt, Human herpesvirus 2
acccucaccccaccccauc

SEQ ID NO: 1825382 - RNA, 14 nt, Human herpesvirus 2
agccccuggggcug

SEQ ID NO: 1825383 - RNA, 17 nt, Human herpesvirus 2
gacagacaauaaagcau

SEQ ID NO: 1825384 - RNA, 18 nt, Human herpesvirus 2
cguccggcuggcggcgcg

SEQ ID NO: 1825385 - RNA, 15 nt, Human herpesvirus 2
caacggcgggccccg

SEQ ID NO: 1825386 - RNA, 20 nt, Human herpesvirus 2
cucuuuauugaccggggccc

SEQ ID NO: 1825387 - RNA, 13 nt, Human herpesvirus 2
cgagaagccgccc

SEQ ID NO: 1825388 - RNA, 15 nt, Human herpesvirus 2
gcucugccugcacga

SEQ ID NO: 1825389 - RNA, 23 nt, Human herpesvirus 2
ucgcggacgagcccguggcccac

SEQ ID NO: 1825390 - RNA, 12 nt, Human herpesvirus 2
uccacacccccu

SEQ ID NO: 1825391 - RNA, 14 nt, Human herpesvirus 2
cggcccuggagcgc

SEQ ID NO: 1825392 - RNA, 15 nt, Human herpesvirus 2
cgcgucggugccgcu

SEQ ID NO: 1825393 - RNA, 16 nt, Human herpesvirus 2
ggguccgggggccugg

SEQ ID NO: 1825394 - RNA, 13 nt, Human herpesvirus 2
uucccucccucgc

SEQ ID NO: 1825395 - RNA, 14 nt, Human herpesvirus 2
uccccgcuggagcc

SEQ ID NO: 1825396 - RNA, 13 nt, Human herpesvirus 2
cgcguccccggcc

SEQ ID NO: 1825397 - RNA, 21 nt, Human herpesvirus 2
gugcugcgcgagccguccggg

SEQ ID NO: 1825398 - RNA, 19 nt, Human herpesvirus 2
ggcuccaaacgccuccgga

SEQ ID NO: 1825399 - RNA, 15 nt, Human herpesvirus 2
auuuccaaacagggc

SEQ ID NO: 1825400 - RNA, 15 nt, Human herpesvirus 2
cggccauccccggcg

SEQ ID NO: 1825401 - RNA, 15 nt, Human herpesvirus 2
uaaggcaggggcagc

SEQ ID NO: 1825402 - RNA, 20 nt, Human herpesvirus 2
cauuguugucguguggugug

SEQ ID NO: 1825403 - RNA, 22 nt, Human herpesvirus 2
cuuuuguuccaccgcucaccca

SEQ ID NO: 1825404 - RNA, 19 nt, Human herpesvirus 2
cccagcgcggacgcggcca

SEQ ID NO: 1825405 - RNA, 12 nt, Human herpesvirus 2
acccccccgccg

SEQ ID NO: 1825406 - RNA, 17 nt, Human herpesvirus 2
cacaccagacggcggga

SEQ ID NO: 1825407 - RNA, 16 nt, Human herpesvirus 2
cggacuccgccccggc

SEQ ID NO: 1825408 - RNA, 22 nt, Human herpesvirus 2
uccgcggcuuuaucaccccgcu

SEQ ID NO: 1825409 - RNA, 17 nt, Human herpesvirus 2
ucgauguauggcgccuu

SEQ ID NO: 1825410 - RNA, 18 nt, Human herpesvirus 2
gggugugcugcuguuggg

SEQ ID NO: 1825411 - RNA, 11 nt, Human herpesvirus 2
gcgugccaacu

SEQ ID NO: 1825412 - RNA, 14 nt, Human herpesvirus 2
augaacugauugcc

SEQ ID NO: 1825413 - RNA, 16 nt, Human herpesvirus 2
cuuccuguaccugacg

SEQ ID NO: 1825414 - RNA, 21 nt, Human herpesvirus 2
cauuguugucguguggugugu

SEQ ID NO: 1825415 - RNA, 22 nt, Human herpesvirus 2
accaggucuuuccguggcgccu

SEQ ID NO: 1825416 - RNA, 19 nt, Human herpesvirus 2
uuagggggacgaacaggcg

SEQ ID NO: 1825417 - RNA, 17 nt, Human herpesvirus 2
ccgcggccauccugccc

SEQ ID NO: 1825418 - RNA, 21 nt, Human herpesvirus 2
ggaugccccgagccagcaggu

SEQ ID NO: 1825419 - RNA, 16 nt, Human herpesvirus 2
gacccaccgcccccgc

SEQ ID NO: 1825420 - RNA, 23 nt, Human herpesvirus 2
ccuguuuuuacgggccccggaca

SEQ ID NO: 1825421 - RNA, 13 nt, Human herpesvirus 2
agucucgaaggag

SEQ ID NO: 1825422 - RNA, 19 nt, Human herpesvirus 2
ccucuguuucuccaggcgc

SEQ ID NO: 1825423 - RNA, 23 nt, Human herpesvirus 2
ccucucaacgcccaggcccuggc

SEQ ID NO: 1825424 - RNA, 12 nt, Human herpesvirus 2
gacgaaaacgua

SEQ ID NO: 1825425 - RNA, 12 nt, Human herpesvirus 2
ugcgaaacagag

SEQ ID NO: 1825426 - RNA, 19 nt, Human herpesvirus 2
cacgaccagggaggccaga

SEQ ID NO: 1825427 - RNA, 16 nt, Human herpesvirus 2
uacauaaaacccaccc

SEQ ID NO: 1825428 - RNA, 12 nt, Human herpesvirus 2
accccccggguu

SEQ ID NO: 1825429 - RNA, 17 nt, Human herpesvirus 2
gcgucguccaggguggg

SEQ ID NO: 1825430 - RNA, 14 nt, Human herpesvirus 2
ugcccgccagggcc

SEQ ID NO: 1825431 - RNA, 13 nt, Human herpesvirus 2
ccgcccccacccc

SEQ ID NO: 1825432 - RNA, 20 nt, Human herpesvirus 2
ggaccacgugcacagccugg

SEQ ID NO: 1825433 - RNA, 12 nt, Human herpesvirus 2
cacacacccccu

SEQ ID NO: 1825434 - RNA, 15 nt, Human herpesvirus 2
gauggcggggauggg

SEQ ID NO: 1825435 - RNA, 19 nt, Human herpesvirus 2
gucgccgacuccaggagcu

SEQ ID NO: 1825436 - RNA, 14 nt, Human herpesvirus 2
gucugucugcccgg

SEQ ID NO: 1825437 - RNA, 13 nt, Human herpesvirus 2
cuuucccccccuc

SEQ ID NO: 1825438 - RNA, 16 nt, Human herpesvirus 2
cugggggauuguggga

SEQ ID NO: 1825439 - RNA, 16 nt, Human herpesvirus 2
gucuuugggccccgcc

SEQ ID NO: 1825440 - RNA, 21 nt, Human herpesvirus 2
cggccccgccgggucaccggg

SEQ ID NO: 1825441 - RNA, 14 nt, Human herpesvirus 2
cagccccuggggcu

SEQ ID NO: 1825442 - RNA, 17 nt, Human herpesvirus 2
gccgcgacggccccggc

SEQ ID NO: 1825443 - RNA, 16 nt, Human herpesvirus 2
cccuagccuucggcca

SEQ ID NO: 1825444 - RNA, 16 nt, Human herpesvirus 2
gggcacgcggggugcg

SEQ ID NO: 1825445 - RNA, 23 nt, Human herpesvirus 2
cgucucccgggggcgcuuggccg

SEQ ID NO: 1825446 - RNA, 22 nt, Human herpesvirus 2
gcacguacguucugccccgcgu

SEQ ID NO: 1825447 - RNA, 12 nt, Human herpesvirus 2
cgggccucccgc

SEQ ID NO: 1825448 - RNA, 23 nt, Human herpesvirus 2
cggcggccaccccgccgcagcuc

SEQ ID NO: 1825449 - RNA, 15 nt, Human herpesvirus 2
ggccccucgcucccc

SEQ ID NO: 1825450 - RNA, 14 nt, Human herpesvirus 2
cgcugcggggacca

SEQ ID NO: 1825451 - RNA, 15 nt, Human herpesvirus 2
ucugcuugccccucc

SEQ ID NO: 1825452 - RNA, 11 nt, Human herpesvirus 2
accaaccuggc

SEQ ID NO: 1825453 - RNA, 15 nt, Human herpesvirus 2
caucccacaaugggg

SEQ ID NO: 1825454 - RNA, 23 nt, Human herpesvirus 2
agggggcaauuaauaaagacugu

SEQ ID NO: 1825455 - RNA, 13 nt, Human herpesvirus 2
ucccguggcccuc

SEQ ID NO: 1825456 - RNA, 17 nt, Human herpesvirus 2
guucuggcggcccugga

SEQ ID NO: 1825457 - RNA, 19 nt, Human herpesvirus 2
gaacucucccggcuccucc

SEQ ID NO: 1825458 - RNA, 18 nt, Human herpesvirus 2
gccccgacaucaaccacc

SEQ ID NO: 1825459 - RNA, 14 nt, Human herpesvirus 2
acccacacacaccc

SEQ ID NO: 1825460 - RNA, 21 nt, Human herpesvirus 2
gccuuucccguggcccuccac

SEQ ID NO: 1825461 - RNA, 17 nt, Human herpesvirus 2
gccagccgcccccgccg

SEQ ID NO: 1825462 - RNA, 20 nt, Human herpesvirus 2
guggcggaggccugucccug

SEQ ID NO: 1825463 - RNA, 13 nt, Human herpesvirus 2
accccccacgccc

SEQ ID NO: 1825464 - RNA, 20 nt, Human herpesvirus 2
cgcuccagguacugcugcac

SEQ ID NO: 1825465 - RNA, 16 nt, Human herpesvirus 2
acgccaggccccccgg

SEQ ID NO: 1825466 - RNA, 19 nt, Human herpesvirus 2
cgccguggcggaggccugu

SEQ ID NO: 1825467 - RNA, 16 nt, Human herpesvirus 2
cugcugggccauggau

SEQ ID NO: 1825468 - RNA, 15 nt, Human herpesvirus 2
ucgauugcggggacc

SEQ ID NO: 1825469 - RNA, 15 nt, Human herpesvirus 2
gaaaccgcaggcgcg

SEQ ID NO: 1825470 - RNA, 17 nt, Human herpesvirus 2
cgaccagcgccgggugg

SEQ ID NO: 1825471 - RNA, 19 nt, Human herpesvirus 2
ccuguccccgcccccccca

SEQ ID NO: 1825472 - RNA, 19 nt, Human herpesvirus 2
uccgaggugcggagccucu

SEQ ID NO: 1825473 - RNA, 16 nt, Human herpesvirus 2
agaaggaggggggccu

SEQ ID NO: 1825474 - RNA, 15 nt, Human herpesvirus 2
gcgugcggcccugcc

SEQ ID NO: 1825475 - RNA, 16 nt, Human herpesvirus 2
cgacgaggccuucccg

SEQ ID NO: 1825476 - RNA, 21 nt, Human herpesvirus 2
caggcgcuccagguacugcug

SEQ ID NO: 1825477 - RNA, 15 nt, Human herpesvirus 2
ggcuggagcucugcc

SEQ ID NO: 1825478 - RNA, 18 nt, Human herpesvirus 2
ccaccccccccccccuuc

SEQ ID NO: 1825479 - RNA, 12 nt, Human herpesvirus 2
cccgccauggcg

SEQ ID NO: 1825480 - RNA, 17 nt, Human herpesvirus 2
caggcguguugggaagg

SEQ ID NO: 1825481 - RNA, 13 nt, Human herpesvirus 2
gccgcacccacga

SEQ ID NO: 1825482 - RNA, 15 nt, Human herpesvirus 2
ggcuggcggcgcggc

SEQ ID NO: 1825483 - RNA, 23 nt, Human herpesvirus 2
gggaaacacaguuccgggaaggc

SEQ ID NO: 1825484 - RNA, 21 nt, Human herpesvirus 2
gugucgcuccccuucagccug

SEQ ID NO: 1825485 - RNA, 14 nt, Human herpesvirus 2
ggcggcucccccgc

SEQ ID NO: 1825486 - RNA, 18 nt, Human herpesvirus 2
agacaauaaagcaucacg

SEQ ID NO: 1825487 - RNA, 15 nt, Human herpesvirus 2
ccccggguuccccga

SEQ ID NO: 1825488 - RNA, 21 nt, Human herpesvirus 2
ucgggggcucggggggguacg

SEQ ID NO: 1825489 - RNA, 16 nt, Human herpesvirus 2
gcaugguaauuagcaa

SEQ ID NO: 1825490 - RNA, 12 nt, Human herpesvirus 2
ucucggggaggg

SEQ ID NO: 1825491 - RNA, 21 nt, Human herpesvirus 2
cagcuuggccguguggucgcc

SEQ ID NO: 1825492 - RNA, 16 nt, Human herpesvirus 2
agaaauaaagaacgag

SEQ ID NO: 1825493 - RNA, 16 nt, Human herpesvirus 2
gccgcgggggaggcgc

SEQ ID NO: 1825494 - RNA, 16 nt, Human herpesvirus 2
gauguguucuccugga

SEQ ID NO: 1825495 - RNA, 11 nt, Human herpesvirus 2
agaauaaaagg

SEQ ID NO: 1825496 - RNA, 17 nt, Human herpesvirus 2
ggacuggcagccgggac

SEQ ID NO: 1825497 - RNA, 23 nt, Human herpesvirus 2
guggugauggggguccugguggg

SEQ ID NO: 1825498 - RNA, 15 nt, Human herpesvirus 2
gaccacgugcacagc

SEQ ID NO: 1825499 - RNA, 13 nt, Human herpesvirus 2
uguaccucugggc

SEQ ID NO: 1825500 - RNA, 13 nt, Human herpesvirus 2
gccagcgcccuuc

SEQ ID NO: 1825501 - RNA, 15 nt, Human herpesvirus 2
auggggggggaaagg

SEQ ID NO: 1825502 - RNA, 16 nt, Human herpesvirus 2
ugucugucugcccggc

SEQ ID NO: 1825503 - RNA, 18 nt, Human herpesvirus 2
ccugcucgaccagcggcc

SEQ ID NO: 1825504 - RNA, 12 nt, Human herpesvirus 2
agcguggggcgc

SEQ ID NO: 1825505 - RNA, 22 nt, Human herpesvirus 2
gacgcgguuauccugcggcagg

SEQ ID NO: 1825506 - RNA, 18 nt, Human herpesvirus 2
cgcagcguccggcuggcg

SEQ ID NO: 1825507 - RNA, 21 nt, Human herpesvirus 2
gcccccggccuuugcuuccuc

SEQ ID NO: 1825508 - RNA, 13 nt, Human herpesvirus 2
uccagcuuggccg

SEQ ID NO: 1825509 - RNA, 22 nt, Human herpesvirus 2
gaaggaaucgggcgucugugcg

SEQ ID NO: 1825510 - RNA, 14 nt, Human herpesvirus 2
agcgcgccaggacc

SEQ ID NO: 1825511 - RNA, 17 nt, Human herpesvirus 2
ucggggccagggcuggc

SEQ ID NO: 1825512 - RNA, 16 nt, Human herpesvirus 2
aacuaggacaguucau

SEQ ID NO: 1825513 - RNA, 21 nt, Human herpesvirus 2
cgccgcucgucccccgaggcc

SEQ ID NO: 1825514 - RNA, 14 nt, Human herpesvirus 2
gggggcgggggugc

SEQ ID NO: 1825515 - RNA, 14 nt, Human herpesvirus 2
agauggggagaggg

SEQ ID NO: 1825516 - RNA, 13 nt, Human herpesvirus 2
acggcaagaaaga

SEQ ID NO: 1825517 - RNA, 18 nt, Human herpesvirus 2
aacacgagccgcaggaac

SEQ ID NO: 1825518 - RNA, 19 nt, Human herpesvirus 2
guuugugcgggugcccaug

SEQ ID NO: 1825519 - RNA, 14 nt, Human herpesvirus 2
aacacugaggaacu

SEQ ID NO: 1825520 - RNA, 18 nt, Human herpesvirus 2
gaacccgguaaauaccac

SEQ ID NO: 1825521 - RNA, 14 nt, Human herpesvirus 2
cucgccgcuguggc

SEQ ID NO: 1825522 - RNA, 15 nt, Human herpesvirus 2
ugcccgaccuguuaa

SEQ ID NO: 1825523 - RNA, 19 nt, Human herpesvirus 2
gacgcuguuguuucugggc

SEQ ID NO: 1825524 - RNA, 13 nt, Human herpesvirus 2
uaccacggggagg

SEQ ID NO: 1825525 - RNA, 15 nt, Human herpesvirus 2
gcaaacgugggauga

SEQ ID NO: 1825526 - RNA, 12 nt, Human herpesvirus 2
gaggauuacuuu

SEQ ID NO: 1825527 - RNA, 18 nt, Human herpesvirus 2
gcuuagggugugaccccc

SEQ ID NO: 1825528 - RNA, 14 nt, Human herpesvirus 2
gugccaguccgcuc

SEQ ID NO: 1825529 - RNA, 22 nt, Human herpesvirus 2
cugccccgcggaggcgugguga

SEQ ID NO: 1825530 - RNA, 14 nt, Human herpesvirus 2
gggcguccccgagc

SEQ ID NO: 1825531 - RNA, 14 nt, Human herpesvirus 2
cacacccccugucc

SEQ ID NO: 1825532 - RNA, 16 nt, Human herpesvirus 2
gacccggggcccgaag

SEQ ID NO: 1825533 - RNA, 14 nt, Human herpesvirus 2
cagcugcgccagaa

SEQ ID NO: 1825534 - RNA, 12 nt, Human herpesvirus 2
cggcccugccuc

SEQ ID NO: 1825535 - RNA, 14 nt, Human herpesvirus 2
gccaguggagccaa

SEQ ID NO: 1825536 - RNA, 22 nt, Human herpesvirus 2
cgcgagcucccugcggcuggcg

SEQ ID NO: 1825537 - RNA, 22 nt, Human herpesvirus 2
cgggaccacggucugguggcgc

SEQ ID NO: 1825538 - RNA, 19 nt, Human herpesvirus 2
uaccccuuugacuccuggg

SEQ ID NO: 1825539 - RNA, 13 nt, Human herpesvirus 2
guucggggggacg

SEQ ID NO: 1825540 - RNA, 11 nt, Human herpesvirus 2
ccaccgggccu

SEQ ID NO: 1825541 - RNA, 14 nt, Human herpesvirus 2
cgggcugcugguga

SEQ ID NO: 1825542 - RNA, 16 nt, Human herpesvirus 2
cagccccgcaggcagg

SEQ ID NO: 1825543 - RNA, 15 nt, Human herpesvirus 2
cuguuccuuucccuu

SEQ ID NO: 1825544 - RNA, 23 nt, Human herpesvirus 2
aacgguaagcagcgcguccaggu

SEQ ID NO: 1825545 - RNA, 19 nt, Human herpesvirus 2
ugguguguuuggcgugugu

SEQ ID NO: 1825546 - RNA, 14 nt, Human herpesvirus 2
gggcgugcugugcc

SEQ ID NO: 1825547 - RNA, 16 nt, Human herpesvirus 2
accacguguccccagg

SEQ ID NO: 1825548 - RNA, 12 nt, Human herpesvirus 2
gcccccaccccc

SEQ ID NO: 1825549 - RNA, 17 nt, Human herpesvirus 2
gacagcggggacccggg

SEQ ID NO: 1825550 - RNA, 12 nt, Human herpesvirus 2
ccucccacuucc

SEQ ID NO: 1825551 - RNA, 20 nt, Human herpesvirus 2
ggcgcgcggcgcgagcuccc

SEQ ID NO: 1825552 - RNA, 20 nt, Human herpesvirus 2
ggaccccucaucgccgcgcc

SEQ ID NO: 1825553 - RNA, 15 nt, Human herpesvirus 2
cucguggugcugggg

SEQ ID NO: 1825554 - RNA, 19 nt, Human herpesvirus 2
cucggggacagaggacgcc

SEQ ID NO: 1825555 - RNA, 16 nt, Human herpesvirus 2
agagcgggcccggggc

SEQ ID NO: 1825556 - RNA, 12 nt, Human herpesvirus 2
ccgugccccugg

SEQ ID NO: 1825557 - RNA, 17 nt, Human herpesvirus 2
ccuucgcgagggccccg

SEQ ID NO: 1825558 - RNA, 15 nt, Human herpesvirus 2
cucuuggggaaaucu

SEQ ID NO: 1825559 - RNA, 14 nt, Human herpesvirus 2
cacgacaggugggg

SEQ ID NO: 1825560 - RNA, 17 nt, Human herpesvirus 2
accccgcccgcuugcau

SEQ ID NO: 1825561 - RNA, 15 nt, Human herpesvirus 2
cggucaggaccaggg

SEQ ID NO: 1825562 - RNA, 19 nt, Human herpesvirus 2
agagggggggaaagaaaga

SEQ ID NO: 1825563 - RNA, 14 nt, Human herpesvirus 2
ucguguucgugggg

SEQ ID NO: 1825564 - RNA, 19 nt, Human herpesvirus 2
gcgaccgucuuugggcccc

SEQ ID NO: 1825565 - RNA, 23 nt, Human herpesvirus 2
gaacucgcccgccguuggggaua

SEQ ID NO: 1825566 - RNA, 18 nt, Human herpesvirus 2
cggcgcgggcggcgccgc

SEQ ID NO: 1825567 - RNA, 15 nt, Human herpesvirus 2
gccgucuuggccgug

SEQ ID NO: 1825568 - RNA, 14 nt, Human herpesvirus 2
ucuggaagagcucc

SEQ ID NO: 1825569 - RNA, 17 nt, Human herpesvirus 2
gcucgcggagggcggcc

SEQ ID NO: 1825570 - RNA, 19 nt, Human herpesvirus 2
cugcagaugcugcccgcgg

SEQ ID NO: 1825571 - RNA, 19 nt, Human herpesvirus 2
ugcugggcgcgagccaggc

SEQ ID NO: 1825572 - RNA, 16 nt, Human herpesvirus 2
gccccgacggcccaca

SEQ ID NO: 1825573 - RNA, 15 nt, Human herpesvirus 2
cgggccgccauuccc

SEQ ID NO: 1825574 - RNA, 14 nt, Human herpesvirus 2
aauugaaaucgcuu

SEQ ID NO: 1825575 - RNA, 14 nt, Human herpesvirus 2
gcaagagccugccg

SEQ ID NO: 1825576 - RNA, 23 nt, Human herpesvirus 2
uuccuccgugcuggggaaaucuc

SEQ ID NO: 1825577 - RNA, 24 nt, Human herpesvirus 2
aucgccaacucugucuucgugugg

SEQ ID NO: 1825578 - RNA, 19 nt, Human herpesvirus 2
caacgccgggcgcgcggcg

SEQ ID NO: 1825579 - RNA, 22 nt, Human herpesvirus 2
cggcgguucgcgugcggccagc

SEQ ID NO: 1825580 - RNA, 16 nt, Human herpesvirus 2
ggacgcguucgagggu

SEQ ID NO: 1825581 - RNA, 17 nt, Human herpesvirus 2
gcguugccgggggccau

SEQ ID NO: 1825582 - RNA, 15 nt, Human herpesvirus 2
cccuugcccgcuucc

SEQ ID NO: 1825583 - RNA, 20 nt, Human herpesvirus 2
ccgaaggaggaaaguggggg

SEQ ID NO: 1825584 - RNA, 14 nt, Human herpesvirus 2
guccgcgcggggcg

SEQ ID NO: 1825585 - RNA, 21 nt, Human herpesvirus 2
ucuggcggcccuggagcgcca

SEQ ID NO: 1825586 - RNA, 23 nt, Human herpesvirus 2
gggacccgccagagacccugccc

SEQ ID NO: 1825587 - RNA, 24 nt, Human herpesvirus 2
gcgccgcuacugcgccaccgucca

SEQ ID NO: 1825588 - RNA, 17 nt, Human herpesvirus 2
gcgugcguucuggcggc

SEQ ID NO: 1825589 - RNA, 16 nt, Human herpesvirus 2
ggcgggggugccgugg

SEQ ID NO: 1825590 - RNA, 21 nt, Human herpesvirus 2
uccccggauggcaugggaggc

SEQ ID NO: 1825591 - RNA, 16 nt, Human herpesvirus 2
uuuccgccgccgggaa

SEQ ID NO: 1825592 - RNA, 13 nt, Human herpesvirus 2
ccgggagcguggg

SEQ ID NO: 1825593 - RNA, 15 nt, Human herpesvirus 2
aacgacccccagcgc

SEQ ID NO: 1825594 - RNA, 21 nt, Human herpesvirus 2
ccagcgccggguggcgccucu

SEQ ID NO: 1825595 - RNA, 20 nt, Human herpesvirus 2
gggcgaagucccgcacgaag

SEQ ID NO: 1825596 - RNA, 15 nt, Human herpesvirus 2
gucgccggcgugggu

SEQ ID NO: 1825597 - RNA, 15 nt, Human herpesvirus 2
ccacggucagucugg

SEQ ID NO: 1825598 - RNA, 15 nt, Human herpesvirus 2
accaccgccccgccu

SEQ ID NO: 1825599 - RNA, 16 nt, Human herpesvirus 2
gcgcagcgcaucgccg

SEQ ID NO: 1825600 - RNA, 14 nt, Human herpesvirus 2
ucgcugcucucccg

SEQ ID NO: 1825601 - RNA, 14 nt, Human herpesvirus 2
uggggaaagggaag

SEQ ID NO: 1825602 - RNA, 13 nt, Human herpesvirus 2
uuagcaacuuuua

SEQ ID NO: 1825603 - RNA, 13 nt, Human herpesvirus 2
cgccccccccagg

SEQ ID NO: 1825604 - RNA, 11 nt, Human herpesvirus 2
gcaccccaccg

SEQ ID NO: 1825605 - RNA, 20 nt, Human herpesvirus 2
aagcgggccguucggcaggc

SEQ ID NO: 1825606 - RNA, 15 nt, Human herpesvirus 2
cggcgcgagcucccu

SEQ ID NO: 1825607 - RNA, 15 nt, Human herpesvirus 2
cugcccgaccgggcg

SEQ ID NO: 1825608 - RNA, 11 nt, Human herpesvirus 2
gaccugcagga

SEQ ID NO: 1825609 - RNA, 19 nt, Human herpesvirus 2
agccaccgucccgcccgcc

SEQ ID NO: 1825610 - RNA, 20 nt, Human herpesvirus 2
gguucggggccagggcuggc

SEQ ID NO: 1825611 - RNA, 17 nt, Human herpesvirus 2
ccuugugugguuuauuc

SEQ ID NO: 1825612 - RNA, 16 nt, Human herpesvirus 2
cucuggcguccccagg

SEQ ID NO: 1825613 - RNA, 18 nt, Human herpesvirus 2
ccgccaacgcgcuguggc

SEQ ID NO: 1825614 - RNA, 15 nt, Human herpesvirus 2
ugccccucccccggc

SEQ ID NO: 1825615 - RNA, 12 nt, Human herpesvirus 2
ccaccaaccugg

SEQ ID NO: 1825616 - RNA, 10 nt, Human herpesvirus 2
cggcccgugg

SEQ ID NO: 1825617 - RNA, 15 nt, Human herpesvirus 2
cgaaggucgggccgu

SEQ ID NO: 1825618 - RNA, 12 nt, Human herpesvirus 2
cguucugcugca

SEQ ID NO: 1825619 - RNA, 23 nt, Human herpesvirus 2
cacacccccaucgggcugcuggu

SEQ ID NO: 1825620 - RNA, 12 nt, Human herpesvirus 2
guggcuggaggc

SEQ ID NO: 1825621 - RNA, 14 nt, Human herpesvirus 2
ccgagcagcacggc

SEQ ID NO: 1825622 - RNA, 17 nt, Human herpesvirus 2
cgcgcaggcuggagcuc

SEQ ID NO: 1825623 - RNA, 16 nt, Human herpesvirus 2
ggccgcgacaagaccc

SEQ ID NO: 1825624 - RNA, 18 nt, Human herpesvirus 2
cugcccguggguggccac

SEQ ID NO: 1825625 - RNA, 12 nt, Human herpesvirus 2
guucugccccgc

SEQ ID NO: 1825626 - RNA, 21 nt, Human herpesvirus 2
ugcgcgcggcgacggcaccgc

SEQ ID NO: 1825627 - RNA, 17 nt, Human herpesvirus 2
caggccaucgccgggga

SEQ ID NO: 1825628 - RNA, 22 nt, Human herpesvirus 2
cuucgaucgacgaacuggggcg

SEQ ID NO: 1825629 - RNA, 14 nt, Human herpesvirus 2
gcagcucccccgcg

SEQ ID NO: 1825630 - RNA, 18 nt, Human herpesvirus 2
agcucgcggagggcggcc

SEQ ID NO: 1825631 - RNA, 16 nt, Human herpesvirus 2
gucaauagauuucccc

SEQ ID NO: 1825632 - RNA, 17 nt, Human herpesvirus 2
uccggaguuagcaaaac

SEQ ID NO: 1825633 - RNA, 15 nt, Human herpesvirus 2
ggcggccaccccgcc

SEQ ID NO: 1825634 - RNA, 20 nt, Human herpesvirus 2
gugcgugcugcugagcccug

SEQ ID NO: 1825635 - RNA, 18 nt, Human herpesvirus 2
cagggggcggcgccggcc

SEQ ID NO: 1825636 - RNA, 17 nt, Human herpesvirus 2
uccccagggagccccgg

SEQ ID NO: 1825637 - RNA, 23 nt, Human herpesvirus 2
cggccaccaccccccuccucccc

SEQ ID NO: 1825638 - RNA, 14 nt, Human herpesvirus 2
acgccagcugcugg

SEQ ID NO: 1825639 - RNA, 14 nt, Human herpesvirus 2
agcgucaggcccgc

SEQ ID NO: 1825640 - RNA, 14 nt, Human herpesvirus 2
ggggcugguuuugc

SEQ ID NO: 1825641 - RNA, 17 nt, Human herpesvirus 2
ucggucgacgaggccug

SEQ ID NO: 1825642 - RNA, 17 nt, Human herpesvirus 2
cagccgcccccgccggc

SEQ ID NO: 1825643 - RNA, 14 nt, Human herpesvirus 2
gcgccgucgggccc

SEQ ID NO: 1825644 - RNA, 20 nt, Human herpesvirus 2
cuggagauccccggggcccg

SEQ ID NO: 1825645 - RNA, 23 nt, Human herpesvirus 2
ugcaagcgggcgggguggggagg

SEQ ID NO: 1825646 - RNA, 14 nt, Human herpesvirus 2
gcacgcggugcguc

SEQ ID NO: 1825647 - RNA, 22 nt, Human herpesvirus 2
cgcauuuaaggagucgccgccc

SEQ ID NO: 1825648 - RNA, 16 nt, Human herpesvirus 2
acccccgaacagcccc

SEQ ID NO: 1825649 - RNA, 14 nt, Human herpesvirus 2
ccggaaccccucug

SEQ ID NO: 1825650 - RNA, 18 nt, Human herpesvirus 2
gcucgcgguaauuagcag

SEQ ID NO: 1825651 - RNA, 12 nt, Human herpesvirus 2
guaucggccagg

SEQ ID NO: 1825652 - RNA, 22 nt, Human herpesvirus 2
gggcuucguggaagaggaccug

SEQ ID NO: 1825653 - RNA, 16 nt, Human herpesvirus 2
accccgagcgugcccu

SEQ ID NO: 1825654 - RNA, 13 nt, Human herpesvirus 2
cggaccuggggga

SEQ ID NO: 1825655 - RNA, 21 nt, Human herpesvirus 2
acgccgcggccauccugccca

SEQ ID NO: 1825656 - RNA, 15 nt, Human herpesvirus 2
caugcaacgccgggc

SEQ ID NO: 1825657 - RNA, 13 nt, Human herpesvirus 2
ggcgcgcccaccg

SEQ ID NO: 1825658 - RNA, 15 nt, Human herpesvirus 2
aagcaagaaaacggu

SEQ ID NO: 1825659 - RNA, 17 nt, Human herpesvirus 2
caccgguccuucgcggg

SEQ ID NO: 1825660 - RNA, 16 nt, Human herpesvirus 2
cgaccccgccccccga

SEQ ID NO: 1825661 - RNA, 19 nt, Human herpesvirus 2
ggcggcgaaccgguagccg

SEQ ID NO: 1825662 - RNA, 16 nt, Human herpesvirus 2
gcuugcugcccgaagg

SEQ ID NO: 1825663 - RNA, 19 nt, Human herpesvirus 2
ugugcaccgaaggaggaaa

SEQ ID NO: 1825664 - RNA, 16 nt, Human herpesvirus 2
gcuggagcucugccug

SEQ ID NO: 1825665 - RNA, 15 nt, Human herpesvirus 2
cccucccgcaccccc

SEQ ID NO: 1825666 - RNA, 20 nt, Human herpesvirus 2
ccgggcgaaaaggcccggcc

SEQ ID NO: 1825667 - RNA, 13 nt, Human herpesvirus 2
ccgccggcgguga

SEQ ID NO: 1825668 - RNA, 20 nt, Human herpesvirus 2
cgugcgugcugcugagcccu

SEQ ID NO: 1825669 - RNA, 20 nt, Human herpesvirus 2
ggguccgacgaggccuuccc

SEQ ID NO: 1825670 - RNA, 15 nt, Human herpesvirus 2
accucgcggcggcuc

SEQ ID NO: 1825671 - RNA, 14 nt, Human herpesvirus 2
ccccgagcagcacg

SEQ ID NO: 1825672 - RNA, 17 nt, Human herpesvirus 2
cguggggccccagggcu

SEQ ID NO: 1825673 - RNA, 15 nt, Human herpesvirus 2
caugucuuuccacca

SEQ ID NO: 1825674 - RNA, 18 nt, Human herpesvirus 2
acgacagcggggacccgg

SEQ ID NO: 1825675 - RNA, 15 nt, Human herpesvirus 2
gcgguucguucugga

SEQ ID NO: 1825676 - RNA, 17 nt, Human herpesvirus 2
ccucuguuucuccaggc

SEQ ID NO: 1825677 - RNA, 15 nt, Human herpesvirus 2
accgcgcgccgccgc

SEQ ID NO: 1825678 - RNA, 14 nt, Human herpesvirus 2
uccaaacagggccu

SEQ ID NO: 1825679 - RNA, 17 nt, Human herpesvirus 2
cuucgcggcggccgcac

SEQ ID NO: 1825680 - RNA, 19 nt, Human herpesvirus 2
ugcgcacgacagaccuccc

SEQ ID NO: 1825681 - RNA, 17 nt, Human herpesvirus 2
cccacccuuguuggagc

SEQ ID NO: 1825682 - RNA, 11 nt, Human herpesvirus 2
gggcuccucag

SEQ ID NO: 1825683 - RNA, 23 nt, Human herpesvirus 2
cugacccucucgggcaugggcua

SEQ ID NO: 1825684 - RNA, 18 nt, Human herpesvirus 2
gugcucgcagcagucgug

SEQ ID NO: 1825685 - RNA, 20 nt, Human herpesvirus 2
accuuccccucccacuuccc

SEQ ID NO: 1825686 - RNA, 15 nt, Human herpesvirus 2
accgcgcccacagcc

SEQ ID NO: 1825687 - RNA, 18 nt, Human herpesvirus 2
agcuccucuucgggcacc

SEQ ID NO: 1825688 - RNA, 12 nt, Human herpesvirus 2
agagauuucccc

SEQ ID NO: 1825689 - RNA, 19 nt, Human herpesvirus 2
agcgcgggggacgggccgc

SEQ ID NO: 1825690 - RNA, 20 nt, Human herpesvirus 2
gaaauaaagaacgagacaga

SEQ ID NO: 1825691 - RNA, 17 nt, Human herpesvirus 2
acggucgccacucuccu

SEQ ID NO: 1825692 - RNA, 13 nt, Human herpesvirus 2
ggcgccgccccgc

SEQ ID NO: 1825693 - RNA, 16 nt, Human herpesvirus 2
uaggcauauccuccuu

SEQ ID NO: 1825694 - RNA, 12 nt, Human herpesvirus 2
ccaccgcacccg

SEQ ID NO: 1825695 - RNA, 12 nt, Human herpesvirus 2
acaacugccuga

SEQ ID NO: 1825696 - RNA, 17 nt, Human herpesvirus 2
gccucguggucgggggc

SEQ ID NO: 1825697 - RNA, 21 nt, Human herpesvirus 2
ucuggaggguucggggcacuu

SEQ ID NO: 1825698 - RNA, 16 nt, Human herpesvirus 2
cacgcgcuggccccuc

SEQ ID NO: 1825699 - RNA, 20 nt, Human herpesvirus 2
ugcacugccccccuccuggg

SEQ ID NO: 1825700 - RNA, 23 nt, Human herpesvirus 2
ccccuugacgugguccacccggg

SEQ ID NO: 1825701 - RNA, 20 nt, Human herpesvirus 2
cgccagcucggacaccagca

SEQ ID NO: 1825702 - RNA, 21 nt, Human herpesvirus 2
ggcggcgaaccgguagccggg

SEQ ID NO: 1825703 - RNA, 21 nt, Human herpesvirus 2
ucgacacacacaccccccuuc

SEQ ID NO: 1825704 - RNA, 17 nt, Human herpesvirus 2
uccccuucagccuggac

SEQ ID NO: 1825705 - RNA, 15 nt, Human herpesvirus 2
ccuguggggccugcu

SEQ ID NO: 1825706 - RNA, 14 nt, Human herpesvirus 2
cgcaucggaccccc

SEQ ID NO: 1825707 - RNA, 22 nt, Human herpesvirus 2
agcuuggccguguggucgcccc

SEQ ID NO: 1825708 - RNA, 16 nt, Human herpesvirus 2
cccaccgcccccgcug

SEQ ID NO: 1825709 - RNA, 14 nt, Human herpesvirus 2
uccccccggggggc

SEQ ID NO: 1825710 - RNA, 16 nt, Human herpesvirus 2
cggcggggccccgggc

SEQ ID NO: 1825711 - RNA, 14 nt, Human herpesvirus 2
cgagggccccggcc

SEQ ID NO: 1825712 - RNA, 17 nt, Human herpesvirus 2
gccggcggagccccgga

SEQ ID NO: 1825713 - RNA, 15 nt, Human herpesvirus 2
ucccgcacccccgcg

SEQ ID NO: 1825714 - RNA, 16 nt, Human herpesvirus 2
ccaccgcgcccacagc

SEQ ID NO: 1825715 - RNA, 13 nt, Human herpesvirus 2
ccccgggcagccg

SEQ ID NO: 1825716 - RNA, 20 nt, Human herpesvirus 2
gcuuggccguguggucgccc

SEQ ID NO: 1825717 - RNA, 14 nt, Human herpesvirus 2
guccucacggccaa

SEQ ID NO: 1825718 - RNA, 14 nt, Human herpesvirus 2
ucauccggcccgcc

SEQ ID NO: 1825719 - RNA, 19 nt, Human herpesvirus 2
cucgugcucgcgugguaca

SEQ ID NO: 1825720 - RNA, 14 nt, Human herpesvirus 2
gacgcggccagaaa

SEQ ID NO: 1825721 - RNA, 19 nt, Human herpesvirus 2
ucucaaacaaaaacacaag

SEQ ID NO: 1825722 - RNA, 21 nt, Human herpesvirus 2
cggccccuguuggagccggag

SEQ ID NO: 1825723 - RNA, 15 nt, Human herpesvirus 2
ucgcgucgggccaga

SEQ ID NO: 1825724 - RNA, 15 nt, Human herpesvirus 2
gcucgaccagcggcc

SEQ ID NO: 1825725 - RNA, 11 nt, Human herpesvirus 2
guucuccugga

SEQ ID NO: 1825726 - RNA, 14 nt, Human herpesvirus 2
gagcaggacagccg

SEQ ID NO: 1825727 - RNA, 23 nt, Human herpesvirus 2
ccuggcgauccugggccuguggg

SEQ ID NO: 1825728 - RNA, 13 nt, Human herpesvirus 2
gccaacagggagu

SEQ ID NO: 1825729 - RNA, 17 nt, Human herpesvirus 2
ugggggcgcugguggcc

SEQ ID NO: 1825730 - RNA, 9 nt, Human herpesvirus 2
gggacggcg

SEQ ID NO: 1825731 - RNA, 17 nt, Human herpesvirus 2
acgucgcaugcaaauua

SEQ ID NO: 1825732 - RNA, 14 nt, Human herpesvirus 2
aggcggucccggcc

SEQ ID NO: 1825733 - RNA, 20 nt, Human herpesvirus 2
gcgaccgggcggcgcgcccc

SEQ ID NO: 1825734 - RNA, 21 nt, Human herpesvirus 2
gagccgguagugcaggugggc

SEQ ID NO: 1825735 - RNA, 17 nt, Human herpesvirus 2
ggcgagcuggcccugga

SEQ ID NO: 1825736 - RNA, 20 nt, Human herpesvirus 2
uuuuuggcaccuugccgccc

SEQ ID NO: 1825737 - RNA, 14 nt, Human herpesvirus 2
ggccgccccgcagu

SEQ ID NO: 1825738 - RNA, 14 nt, Human herpesvirus 2
gugcucgcagcagu

SEQ ID NO: 1825739 - RNA, 16 nt, Human herpesvirus 2
gcggguaggccagagc

SEQ ID NO: 1825740 - RNA, 16 nt, Human herpesvirus 2
gggcccgaagccgacc

SEQ ID NO: 1825741 - RNA, 17 nt, Human herpesvirus 2
gauuccggugugcccca

SEQ ID NO: 1825742 - RNA, 22 nt, Human herpesvirus 2
cggcguuucugaccggcgccga

SEQ ID NO: 1825743 - RNA, 14 nt, Human herpesvirus 2
gucaggcccgccga

SEQ ID NO: 1825744 - RNA, 19 nt, Human herpesvirus 2
cgcgguaauuagcagcuuu

SEQ ID NO: 1825745 - RNA, 17 nt, Human herpesvirus 2
agccggggcacgcgguc

SEQ ID NO: 1825746 - RNA, 22 nt, Human herpesvirus 2
cgacgagguccgucguuugggg

SEQ ID NO: 1825747 - RNA, 13 nt, Human herpesvirus 2
gauccaggggagg

SEQ ID NO: 1825748 - RNA, 13 nt, Human herpesvirus 2
aguuugagcagcc

SEQ ID NO: 1825749 - RNA, 13 nt, Human herpesvirus 2
agcucugccugca

SEQ ID NO: 1825750 - RNA, 13 nt, Human herpesvirus 2
gcuggccccucug

SEQ ID NO: 1825751 - RNA, 19 nt, Human herpesvirus 2
ccuuucccguggcccucca

SEQ ID NO: 1825752 - RNA, 18 nt, Human herpesvirus 2
cggccaacgaggaccacg

SEQ ID NO: 1825753 - RNA, 16 nt, Human herpesvirus 2
ccgcgaugaccucccg

SEQ ID NO: 1825754 - RNA, 17 nt, Human herpesvirus 2
aacgcgggcguccccga

SEQ ID NO: 1825755 - RNA, 20 nt, Human herpesvirus 2
accuucgccuccgcccuccg

SEQ ID NO: 1825756 - RNA, 16 nt, Human herpesvirus 2
acuagaaaaacaaaug

SEQ ID NO: 1825757 - RNA, 21 nt, Human herpesvirus 2
aacaguccguuucgaccccuu

SEQ ID NO: 1825758 - RNA, 22 nt, Human herpesvirus 2
ugcguuaacacacaugcugguu

SEQ ID NO: 1825759 - RNA, 21 nt, Human herpesvirus 2
gccuccgcccuccgccagcgc

SEQ ID NO: 1825760 - RNA, 16 nt, Human herpesvirus 2
ggcgccaagcgccccg

SEQ ID NO: 1825761 - RNA, 19 nt, Human herpesvirus 2
ccuuuccaccccccuuccc

SEQ ID NO: 1825762 - RNA, 14 nt, Human herpesvirus 2
gaccccgcugcugu

SEQ ID NO: 1825763 - RNA, 21 nt, Human herpesvirus 2
ccugccgacuuccgugccccu

SEQ ID NO: 1825764 - RNA, 16 nt, Human herpesvirus 2
cugcggcaggcgaccc

SEQ ID NO: 1825765 - RNA, 21 nt, Human herpesvirus 2
ccaacucgcggcaccgcgcgg

SEQ ID NO: 1825766 - RNA, 20 nt, Human herpesvirus 2
ccaacagggaguccucgccg

SEQ ID NO: 1825767 - RNA, 15 nt, Human herpesvirus 2
ccuggucacaaaagg

SEQ ID NO: 1825768 - RNA, 19 nt, Human herpesvirus 2
cgcuguggcgcgcccccgc

SEQ ID NO: 1825769 - RNA, 20 nt, Human herpesvirus 2
gcugcacgucggacgccagc

SEQ ID NO: 1825770 - RNA, 20 nt, Human herpesvirus 2
uggcaaacacaccgggcugg

SEQ ID NO: 1825771 - RNA, 12 nt, Human herpesvirus 2
gggccgggugac

SEQ ID NO: 1825772 - RNA, 18 nt, Human herpesvirus 2
cagcuuuuaacgggccgc

SEQ ID NO: 1825773 - RNA, 14 nt, Human herpesvirus 2
gcccaccggcucca

SEQ ID NO: 1825774 - RNA, 15 nt, Human herpesvirus 2
ccccaaccacccaac

SEQ ID NO: 1825775 - RNA, 13 nt, Human herpesvirus 2
cagacgacagaca

SEQ ID NO: 1825776 - RNA, 18 nt, Human herpesvirus 2
ggcccucgcugcucuccc

SEQ ID NO: 1825777 - RNA, 16 nt, Human herpesvirus 2
cuuuccccccccccuc

SEQ ID NO: 1825778 - RNA, 17 nt, Human herpesvirus 2
ggucggguguccccgga

SEQ ID NO: 1825779 - RNA, 22 nt, Human herpesvirus 2
gccgccgagcgucaggcccgcc

SEQ ID NO: 1825780 - RNA, 12 nt, Human herpesvirus 2
cccagcuuuccc

SEQ ID NO: 1825781 - RNA, 20 nt, Human herpesvirus 2
gcgagcucccugcggcuggc

SEQ ID NO: 1825782 - RNA, 14 nt, Human herpesvirus 2
ccaucgcucccagg

SEQ ID NO: 1825783 - RNA, 13 nt, Human herpesvirus 2
ucgcggggacagc

SEQ ID NO: 1825784 - RNA, 18 nt, Human herpesvirus 2
gcgcgccaccgcccgcac

SEQ ID NO: 1825785 - RNA, 16 nt, Human herpesvirus 2
agagggggggaaagaa

SEQ ID NO: 1825786 - RNA, 18 nt, Human herpesvirus 2
gcguccgacacccgggcc

SEQ ID NO: 1825787 - RNA, 14 nt, Human herpesvirus 2
ggcaggcgacccgc

SEQ ID NO: 1825788 - RNA, 17 nt, Human herpesvirus 2
cgugcucugccacacgu

SEQ ID NO: 1825789 - RNA, 14 nt, Human herpesvirus 2
uuggggggggugug

SEQ ID NO: 1825790 - RNA, 17 nt, Human herpesvirus 2
acugcacuugccccccc

SEQ ID NO: 1825791 - RNA, 16 nt, Human herpesvirus 2
uggacgaucccgggcc

SEQ ID NO: 1825792 - RNA, 17 nt, Human herpesvirus 2
caggcuggagcucugcc

SEQ ID NO: 1825793 - RNA, 20 nt, Human herpesvirus 2
acacacaggcccaccaccau

SEQ ID NO: 1825794 - RNA, 13 nt, Human herpesvirus 2
cgagcuggcccug

SEQ ID NO: 1825795 - RNA, 21 nt, Human herpesvirus 2
gauuccggugugccccacccc

SEQ ID NO: 1825796 - RNA, 15 nt, Human herpesvirus 2
guggcccacgagcuc

SEQ ID NO: 1825797 - RNA, 14 nt, Human herpesvirus 2
ggagcggugcaggg

SEQ ID NO: 1825798 - RNA, 13 nt, Human herpesvirus 2
gccaccggccugg

SEQ ID NO: 1825799 - RNA, 17 nt, Human herpesvirus 2
cuucgccuccgcccucc

SEQ ID NO: 1825800 - RNA, 21 nt, Human herpesvirus 2
caacgcacguacguucugccc

SEQ ID NO: 1825801 - RNA, 15 nt, Human herpesvirus 2
guauaguacggggga

SEQ ID NO: 1825802 - RNA, 15 nt, Human herpesvirus 2
ccgcccccucuccca

SEQ ID NO: 1825803 - RNA, 20 nt, Human herpesvirus 2
agcucgcggagggcggccag

SEQ ID NO: 1825804 - RNA, 23 nt, Human herpesvirus 2
ggcgaccgucuuugggccccgcc

SEQ ID NO: 1825805 - RNA, 14 nt, Human herpesvirus 2
caaucgcccgaggc

SEQ ID NO: 1825806 - RNA, 18 nt, Human herpesvirus 2
ggaagccgccccccaccg

SEQ ID NO: 1825807 - RNA, 19 nt, Human herpesvirus 2
aggggggcuuggacuggga

SEQ ID NO: 1825808 - RNA, 15 nt, Human herpesvirus 2
ccagauggggccccg

SEQ ID NO: 1825809 - RNA, 17 nt, Human herpesvirus 2
ugccugacccucucggg

SEQ ID NO: 1825810 - RNA, 13 nt, Human herpesvirus 2
agccgcugugcca

SEQ ID NO: 1825811 - RNA, 21 nt, Human herpesvirus 2
cgcacucccgaaaccgcaggc

SEQ ID NO: 1825812 - RNA, 18 nt, Human herpesvirus 2
gaccagggaggccagaaa

SEQ ID NO: 1825813 - RNA, 21 nt, Human herpesvirus 2
gccgcucgcugcagggccugg

SEQ ID NO: 1825814 - RNA, 22 nt, Human herpesvirus 2
cgcaggcccucgcugcucuccc

SEQ ID NO: 1825815 - RNA, 23 nt, Human herpesvirus 2
ugcguucuggcggcccuggagcg

SEQ ID NO: 1825816 - RNA, 17 nt, Human herpesvirus 2
accgucgccgccggcca

SEQ ID NO: 1825817 - RNA, 20 nt, Human herpesvirus 2
accugggggauugugggaau

SEQ ID NO: 1825818 - RNA, 17 nt, Human herpesvirus 2
gcauacaccccacccua

SEQ ID NO: 1825819 - RNA, 13 nt, Human herpesvirus 2
ccgccaacaccag

SEQ ID NO: 1825820 - RNA, 14 nt, Human herpesvirus 2
gcgagcuggcccug

SEQ ID NO: 1825821 - RNA, 16 nt, Human herpesvirus 2
ucucaauaaagccagg

SEQ ID NO: 1825822 - RNA, 22 nt, Human herpesvirus 2
uccuauaaacucucccccgcaa

SEQ ID NO: 1825823 - RNA, 21 nt, Human herpesvirus 2
ugucgcggggacagccccggg

SEQ ID NO: 1825824 - RNA, 17 nt, Human herpesvirus 2
ccucgggccuacgcacc

SEQ ID NO: 1825825 - RNA, 23 nt, Human herpesvirus 2
cccggcguggagcgccgggccuc

SEQ ID NO: 1825826 - RNA, 12 nt, Human herpesvirus 2
gagaugugccuu

SEQ ID NO: 1825827 - RNA, 20 nt, Human herpesvirus 2
cugcacugccccccuccugg

SEQ ID NO: 1825828 - RNA, 23 nt, Human herpesvirus 2
gggcguccugcggcagcgcgccg

SEQ ID NO: 1825829 - RNA, 22 nt, Human herpesvirus 2
cccccgggcgucguggcaugga

SEQ ID NO: 1825830 - RNA, 15 nt, Human herpesvirus 2
cgagagcccagggaa

SEQ ID NO: 1825831 - RNA, 20 nt, Human herpesvirus 2
gccacguccaccuuggcccg

SEQ ID NO: 1825832 - RNA, 15 nt, Human herpesvirus 2
gcucggacaccagca

SEQ ID NO: 1825833 - RNA, 16 nt, Human herpesvirus 2
gcgggucccuucccaa

SEQ ID NO: 1825834 - RNA, 18 nt, Human herpesvirus 2
ccgggcgagcuggcccug

SEQ ID NO: 1825835 - RNA, 17 nt, Human herpesvirus 2
ccccucaaagaacgugg

SEQ ID NO: 1825836 - RNA, 14 nt, Human herpesvirus 2
guucggaccugggg

SEQ ID NO: 1825837 - RNA, 15 nt, Human herpesvirus 2
gcugguuucucugcg

SEQ ID NO: 1825838 - RNA, 11 nt, Human herpesvirus 2
uguugggaagg

SEQ ID NO: 1825839 - RNA, 14 nt, Human herpesvirus 2
gguacuggggcccc

SEQ ID NO: 1825840 - RNA, 12 nt, Human herpesvirus 2
guguuucccccc

SEQ ID NO: 1825841 - RNA, 19 nt, Human herpesvirus 2
gccuggcguuugggggcgg

SEQ ID NO: 1825842 - RNA, 11 nt, Human herpesvirus 2
ugcggggaccg

SEQ ID NO: 1825843 - RNA, 13 nt, Human herpesvirus 2
ccgcugcugugca

SEQ ID NO: 1825844 - RNA, 13 nt, Human herpesvirus 2
uuagaaacuuuua

SEQ ID NO: 1825845 - RNA, 14 nt, Human herpesvirus 2
acgacgaugcaugu

SEQ ID NO: 1825846 - RNA, 17 nt, Human herpesvirus 2
gggccggcguucccgcu

SEQ ID NO: 1825847 - RNA, 14 nt, Human herpesvirus 2
cuuucuuucccccc

SEQ ID NO: 1825848 - RNA, 15 nt, Human herpesvirus 2
aauuagcaacuuuua

SEQ ID NO: 1825849 - RNA, 18 nt, Human herpesvirus 2
cucaccgagccgcugugc

SEQ ID NO: 1825850 - RNA, 16 nt, Human herpesvirus 2
aggccucauccggccc

SEQ ID NO: 1825851 - RNA, 22 nt, Human herpesvirus 2
gaccucgcccccgucgcccccc

SEQ ID NO: 1825852 - RNA, 21 nt, Human herpesvirus 2
ucgucuggagcccguacccgg

SEQ ID NO: 1825853 - RNA, 17 nt, Human herpesvirus 2
cguggagcgccgggccu

SEQ ID NO: 1825854 - RNA, 20 nt, Human herpesvirus 2
agagaaaaagaaaaaaggag

SEQ ID NO: 1825855 - RNA, 15 nt, Human herpesvirus 2
cguccgcggccccac

SEQ ID NO: 1825856 - RNA, 18 nt, Human herpesvirus 2
aggacgcgagcgacagcg

SEQ ID NO: 1825857 - RNA, 17 nt, Human herpesvirus 2
ccgggcgagcuggcccu

SEQ ID NO: 1825858 - RNA, 15 nt, Human herpesvirus 2
cccggcccggcccgc

SEQ ID NO: 1825859 - RNA, 16 nt, Human herpesvirus 2
cgcgcaggggggccgg

SEQ ID NO: 1825860 - RNA, 17 nt, Human herpesvirus 2
agccgauccggccucgg

SEQ ID NO: 1825861 - RNA, 18 nt, Human herpesvirus 2
gagcggacacgcuugaag

SEQ ID NO: 1825862 - RNA, 15 nt, Human herpesvirus 2
ggcgcgagccaggca

SEQ ID NO: 1825863 - RNA, 11 nt, Human herpesvirus 2
cuccgcccucg

SEQ ID NO: 1825864 - RNA, 21 nt, Human herpesvirus 2
aggcccgccccaccgccccca

SEQ ID NO: 1825865 - RNA, 13 nt, Human herpesvirus 2
ggcggcggggaag

SEQ ID NO: 1825866 - RNA, 22 nt, Human herpesvirus 2
ggcucucgccuccuuguggugg

SEQ ID NO: 1825867 - RNA, 21 nt, Human herpesvirus 2
cagacgcccuccgaggagauc

SEQ ID NO: 1825868 - RNA, 18 nt, Human herpesvirus 2
cucacaccgcgucuguuu

SEQ ID NO: 1825869 - RNA, 12 nt, Human herpesvirus 2
gggggggcuggu

SEQ ID NO: 1825870 - RNA, 13 nt, Human herpesvirus 2
uccacacccccuc

SEQ ID NO: 1825871 - RNA, 18 nt, Human herpesvirus 2
gagagaugacacgacagg

SEQ ID NO: 1825872 - RNA, 14 nt, Human herpesvirus 2
ccugugucagcucc

SEQ ID NO: 1825873 - RNA, 17 nt, Human herpesvirus 2
ggagccgcggccccgcc

SEQ ID NO: 1825874 - RNA, 14 nt, Human herpesvirus 2
cguaucggccagga

SEQ ID NO: 1825875 - RNA, 20 nt, Human herpesvirus 2
gcgugugugagaaauaaaga

SEQ ID NO: 1825876 - RNA, 22 nt, Human herpesvirus 2
gccaggaacuccagcuuggccg

SEQ ID NO: 1825877 - RNA, 23 nt, Human herpesvirus 2
cucauacacgcgcuggccccucu

SEQ ID NO: 1825878 - RNA, 18 nt, Human herpesvirus 2
uaacagcuacccgcaucc

SEQ ID NO: 1825879 - RNA, 12 nt, Human herpesvirus 2
gcggacuggcag

SEQ ID NO: 1825880 - RNA, 13 nt, Human herpesvirus 2
caauauggcccag

SEQ ID NO: 1825881 - RNA, 11 nt, Human herpesvirus 2
aaaccacacac

SEQ ID NO: 1825882 - RNA, 14 nt, Human herpesvirus 2
ccacgcccugcugu

SEQ ID NO: 1825883 - RNA, 16 nt, Human herpesvirus 2
cccgccucccggccgc

SEQ ID NO: 1825884 - RNA, 14 nt, Human herpesvirus 2
ggcgcugguggccg

SEQ ID NO: 1825885 - RNA, 23 nt, Human herpesvirus 2
gacugccuccacgcccugcugua

SEQ ID NO: 1825886 - RNA, 13 nt, Human herpesvirus 2
agggaauaugcaa

SEQ ID NO: 1825887 - RNA, 20 nt, Human herpesvirus 2
cgaggaccacgugcacagcc

SEQ ID NO: 1825888 - RNA, 11 nt, Human herpesvirus 2
ggcgggagcca

SEQ ID NO: 1825889 - RNA, 15 nt, Human herpesvirus 2
gcccgcgagccgcac

SEQ ID NO: 1825890 - RNA, 21 nt, Human herpesvirus 2
gccgcccgcgcaucacggccc

SEQ ID NO: 1825891 - RNA, 17 nt, Human herpesvirus 2
agagugggggcgugagc

SEQ ID NO: 1825892 - RNA, 19 nt, Human herpesvirus 2
gcacuggggugauacuuaa

SEQ ID NO: 1825893 - RNA, 13 nt, Human herpesvirus 2
ggaggggcgggag

SEQ ID NO: 1825894 - RNA, 22 nt, Human herpesvirus 2
gacgccucgauguauggcgccu

SEQ ID NO: 1825895 - RNA, 18 nt, Human herpesvirus 2
uuccgggagcgggggagg

SEQ ID NO: 1825896 - RNA, 20 nt, Human herpesvirus 2
ggggaaauguauggguccuu

SEQ ID NO: 1825897 - RNA, 21 nt, Human herpesvirus 2
cugguacucccuuugugcuuu

SEQ ID NO: 1825898 - RNA, 17 nt, Human herpesvirus 2
gacgaacuggggcgccg

SEQ ID NO: 1825899 - RNA, 22 nt, Human herpesvirus 2
gcggagccucuuugggccgugg

SEQ ID NO: 1825900 - RNA, 22 nt, Human herpesvirus 2
aagagugguuugccguggagcu

SEQ ID NO: 1825901 - RNA, 19 nt, Human herpesvirus 2
cggacgccagcugcuggcc

SEQ ID NO: 1825902 - RNA, 15 nt, Human herpesvirus 2
cuucccccccccuac

SEQ ID NO: 1825903 - RNA, 17 nt, Human herpesvirus 2
ccgaguccguaugcaac

SEQ ID NO: 1825904 - RNA, 17 nt, Human herpesvirus 2
cccagcgcacccuggcc

SEQ ID NO: 1825905 - RNA, 22 nt, Human herpesvirus 2
cggcccaaggcgcugcgccugc

SEQ ID NO: 1825906 - RNA, 16 nt, Human herpesvirus 2
ucaccccaccccaucc

SEQ ID NO: 1825907 - RNA, 17 nt, Human herpesvirus 2
accuccccggcggccgc

SEQ ID NO: 1825908 - RNA, 15 nt, Human herpesvirus 2
cgggggcgggcgggc

SEQ ID NO: 1825909 - RNA, 21 nt, Human herpesvirus 2
agccuaucuugaucccccgga

SEQ ID NO: 1825910 - RNA, 16 nt, Human herpesvirus 2
gugucggagaggcccg

SEQ ID NO: 1825911 - RNA, 14 nt, Human herpesvirus 2
cgccuuuccucccc

SEQ ID NO: 1825912 - RNA, 16 nt, Human herpesvirus 2
ccaugagccgccgggu

SEQ ID NO: 1825913 - RNA, 14 nt, Human herpesvirus 2
gcgggcggcgccgc

SEQ ID NO: 1825914 - RNA, 21 nt, Human herpesvirus 2
uacacgcgcuggccccucugc

SEQ ID NO: 1825915 - RNA, 13 nt, Human herpesvirus 2
uuguuguuggccu

SEQ ID NO: 1825916 - RNA, 19 nt, Human herpesvirus 2
aggcccucugggacaccca

SEQ ID NO: 1825917 - RNA, 15 nt, Human herpesvirus 2
gggcucguccccugg

SEQ ID NO: 1825918 - RNA, 23 nt, Human herpesvirus 2
ggacgcacgcggggacccgccag

SEQ ID NO: 1825919 - RNA, 14 nt, Human herpesvirus 2
cgaguccugggugg

SEQ ID NO: 1825920 - RNA, 15 nt, Human herpesvirus 2
caugagccgccgggu

SEQ ID NO: 1825921 - RNA, 12 nt, Human herpesvirus 2
cccccccaucug

SEQ ID NO: 1825922 - RNA, 21 nt, Human herpesvirus 2
cugaggccucauccggcccgc

SEQ ID NO: 1825923 - RNA, 16 nt, Human herpesvirus 2
cucgaccagcggcccc

SEQ ID NO: 1825924 - RNA, 16 nt, Human herpesvirus 2
ggcgaccgccccgcgc

SEQ ID NO: 1825925 - RNA, 15 nt, Human herpesvirus 2
gucaccgggggcccc

SEQ ID NO: 1825926 - RNA, 15 nt, Human herpesvirus 2
gguccgcugcagcug

SEQ ID NO: 1825927 - RNA, 15 nt, Human herpesvirus 2
ggcuucgggccaaca

SEQ ID NO: 1825928 - RNA, 15 nt, Human herpesvirus 2
cuuggugcgccgccg

SEQ ID NO: 1825929 - RNA, 14 nt, Human herpesvirus 2
acgcccauauguac

SEQ ID NO: 1825930 - RNA, 22 nt, Human herpesvirus 2
gcucccguguaccucugggccc

SEQ ID NO: 1825931 - RNA, 22 nt, Human herpesvirus 2
ccgucgcggccgcccgcgccgc

SEQ ID NO: 1825932 - RNA, 18 nt, Human herpesvirus 2
acaacagccccugggugu

SEQ ID NO: 1825933 - RNA, 21 nt, Human herpesvirus 2
auucccgcuuaugguaauuaa

SEQ ID NO: 1825934 - RNA, 16 nt, Human herpesvirus 2
cggguggcgccucugc

SEQ ID NO: 1825935 - RNA, 15 nt, Human herpesvirus 2
cacgcgcuggccccu

SEQ ID NO: 1825936 - RNA, 18 nt, Human herpesvirus 2
ucacccacccccccccca

SEQ ID NO: 1825937 - RNA, 20 nt, Human herpesvirus 2
cucccuuuuuucccccccuc

SEQ ID NO: 1825938 - RNA, 23 nt, Human herpesvirus 2
agacccugccccccggcgcgggc

SEQ ID NO: 1825939 - RNA, 13 nt, Human herpesvirus 2
cauuggcaagcaa

SEQ ID NO: 1825940 - RNA, 19 nt, Human herpesvirus 2
acgguccucaccgagccgc

SEQ ID NO: 1825941 - RNA, 13 nt, Human herpesvirus 2
ggcguuuggccaa

SEQ ID NO: 1825942 - RNA, 18 nt, Human herpesvirus 2
gcgaacacaagcucgccg

SEQ ID NO: 1825943 - RNA, 15 nt, Human herpesvirus 2
gauccccggggggag

SEQ ID NO: 1825944 - RNA, 15 nt, Human herpesvirus 2
ccuggcggccccugu

SEQ ID NO: 1825945 - RNA, 19 nt, Human herpesvirus 2
gcuccagguacugcugcac

SEQ ID NO: 1825946 - RNA, 20 nt, Human herpesvirus 2
ugcgcuuuccggcccucccg

SEQ ID NO: 1825947 - RNA, 13 nt, Human herpesvirus 2
cggcccugcggcc

SEQ ID NO: 1825948 - RNA, 17 nt, Human herpesvirus 2
ucgcccuaccgcuccga

SEQ ID NO: 1825949 - RNA, 20 nt, Human herpesvirus 2
ggcacgagaagccgccccca

SEQ ID NO: 1825950 - RNA, 13 nt, Human herpesvirus 2
ggcccaccugcac

SEQ ID NO: 1825951 - RNA, 13 nt, Human herpesvirus 2
ugccccccaucuc

SEQ ID NO: 1825952 - RNA, 21 nt, Human herpesvirus 2
cagcgugucaaaggccagcag

SEQ ID NO: 1825953 - RNA, 17 nt, Human herpesvirus 2
ccaggauuaccgacccc

SEQ ID NO: 1825954 - RNA, 14 nt, Human herpesvirus 2
auggagaagggaaa

SEQ ID NO: 1825955 - RNA, 13 nt, Human herpesvirus 2
gccgccgaacagc

SEQ ID NO: 1825956 - RNA, 18 nt, Human herpesvirus 2
gggccaacagggaguccu

SEQ ID NO: 1825957 - RNA, 16 nt, Human herpesvirus 2
cgaacagccccugggg

SEQ ID NO: 1825958 - RNA, 14 nt, Human herpesvirus 2
ugacuccuggguca

SEQ ID NO: 1825959 - RNA, 14 nt, Human herpesvirus 2
ggacggccgggcag

SEQ ID NO: 1825960 - RNA, 13 nt, Human herpesvirus 2
cccacaacccauc

SEQ ID NO: 1825961 - RNA, 23 nt, Human herpesvirus 2
ccuggguccgggggccugguggc

SEQ ID NO: 1825962 - RNA, 19 nt, Human herpesvirus 2
aaaagacaccgauguucaa

SEQ ID NO: 1825963 - RNA, 12 nt, Human herpesvirus 2
cccgggcacgcg

SEQ ID NO: 1825964 - RNA, 22 nt, Human herpesvirus 2
cgggccuuuuuucggacgguga

SEQ ID NO: 1825965 - RNA, 18 nt, Human herpesvirus 2
gcuccccuucagccugga

SEQ ID NO: 1825966 - RNA, 18 nt, Human herpesvirus 2
gcggggguucggggccag

SEQ ID NO: 1825967 - RNA, 15 nt, Human herpesvirus 2
ucgggcugcugguga

SEQ ID NO: 1825968 - RNA, 10 nt, Human herpesvirus 2
ggcaccccau

SEQ ID NO: 1825969 - RNA, 18 nt, Human herpesvirus 2
gggcaggcgggcccauca

SEQ ID NO: 1825970 - RNA, 20 nt, Human herpesvirus 2
auuuacgcggugcgccccgc

SEQ ID NO: 1825971 - RNA, 16 nt, Human herpesvirus 2
cacguucgccccgcag

SEQ ID NO: 1825972 - RNA, 15 nt, Human herpesvirus 2
aaggagucgccgccc

SEQ ID NO: 1825973 - RNA, 23 nt, Human herpesvirus 2
ucagcaccccaccgaaaaacgga

SEQ ID NO: 1825974 - RNA, 15 nt, Human herpesvirus 2
uccccggcccucucu

SEQ ID NO: 1825975 - RNA, 21 nt, Human herpesvirus 2
gcagcgugucaaaggccagca

SEQ ID NO: 1825976 - RNA, 15 nt, Human herpesvirus 2
ccucccagugccccg

SEQ ID NO: 1825977 - RNA, 22 nt, Human herpesvirus 2
uaaagaacgagacagacgaaaa

SEQ ID NO: 1825978 - RNA, 15 nt, Human herpesvirus 2
cgcgggaggcggugg

SEQ ID NO: 1825979 - RNA, 19 nt, Human herpesvirus 2
guuauaggccacacagucc

SEQ ID NO: 1825980 - RNA, 22 nt, Human herpesvirus 2
ggccgccuccccgcuggagccc

SEQ ID NO: 1825981 - RNA, 21 nt, Human herpesvirus 2
gaaagaaacacaaggccccga

SEQ ID NO: 1825982 - RNA, 17 nt, Human herpesvirus 2
cauucacccccaccccc

SEQ ID NO: 1825983 - RNA, 22 nt, Human herpesvirus 2
agauggggagagggggaaggaa

SEQ ID NO: 1825984 - RNA, 15 nt, Human herpesvirus 2
cacacacacaggccc

SEQ ID NO: 1825985 - RNA, 16 nt, Human herpesvirus 2
agcguaucggccagga

SEQ ID NO: 1825986 - RNA, 13 nt, Human herpesvirus 2
cgcccccgcuggc

SEQ ID NO: 1825987 - RNA, 16 nt, Human herpesvirus 2
cccgugucgcuccccu

SEQ ID NO: 1825988 - RNA, 12 nt, Human herpesvirus 2
cauaugcccugg

SEQ ID NO: 1825989 - RNA, 15 nt, Human herpesvirus 2
cagugccccgacauc

SEQ ID NO: 1825990 - RNA, 12 nt, Human herpesvirus 2
ugcggcaggcga

SEQ ID NO: 1825991 - RNA, 17 nt, Human herpesvirus 2
cagcgcgucggugccgc

SEQ ID NO: 1825992 - RNA, 20 nt, Human herpesvirus 2
agaguucaauagauuuccca

SEQ ID NO: 1825993 - RNA, 15 nt, Human herpesvirus 2
gugggccuagccgug

SEQ ID NO: 1825994 - RNA, 16 nt, Human herpesvirus 2
gaagggaaaggaacag

SEQ ID NO: 1825995 - RNA, 22 nt, Human herpesvirus 2
cagugggugcucggggacagag

SEQ ID NO: 1825996 - RNA, 15 nt, Human herpesvirus 2
gcugcugagcccugc

SEQ ID NO: 1825997 - RNA, 22 nt, Human herpesvirus 2
gcuccgcgugguccccgagcag

SEQ ID NO: 1825998 - RNA, 14 nt, Human herpesvirus 2
gccccgcgugcagc

SEQ ID NO: 1825999 - RNA, 12 nt, Human herpesvirus 2
ggucggacagga

SEQ ID NO: 1826000 - RNA, 14 nt, Human herpesvirus 2
cgggggccuggugg

SEQ ID NO: 1826001 - RNA, 14 nt, Human herpesvirus 2
ucaucgucccgguu

SEQ ID NO: 1826002 - RNA, 21 nt, Human herpesvirus 2
cucacgucuucgcccaccgau

SEQ ID NO: 1826003 - RNA, 17 nt, Human herpesvirus 2
gacgucaaucgcccgag

SEQ ID NO: 1826004 - RNA, 22 nt, Human herpesvirus 2
gccaacucgcggcaccgcgcgg

SEQ ID NO: 1826005 - RNA, 13 nt, Human herpesvirus 2
gcuccaggccgcc

SEQ ID NO: 1826006 - RNA, 24 nt, Human herpesvirus 2
ugguggcaccuccccggcggccgc

SEQ ID NO: 1826007 - RNA, 20 nt, Human herpesvirus 2
aaaccccgguuggggcgggc

SEQ ID NO: 1826008 - RNA, 14 nt, Human herpesvirus 2
ggccgagaagagcg

SEQ ID NO: 1826009 - RNA, 18 nt, Human herpesvirus 2
cgguucgcgugcggccag

SEQ ID NO: 1826010 - RNA, 14 nt, Human herpesvirus 2
cuucuucgccgccc

SEQ ID NO: 1826011 - RNA, 21 nt, Human herpesvirus 2
accgcgcgccgccgcgcgggc

SEQ ID NO: 1826012 - RNA, 22 nt, Human herpesvirus 2
acaggccaucgccggggaccgc

SEQ ID NO: 1826013 - RNA, 13 nt, Human herpesvirus 2
ucagcaccccacc

SEQ ID NO: 1826014 - RNA, 12 nt, Human herpesvirus 2
ccccccaucugc

SEQ ID NO: 1826015 - RNA, 22 nt, Human herpesvirus 2
uccacgccguggacgcccccuc

SEQ ID NO: 1826016 - RNA, 10 nt, Human herpesvirus 2
aacgcccccu

SEQ ID NO: 1826017 - RNA, 16 nt, Human herpesvirus 2
cgccaggccccccggg

SEQ ID NO: 1826018 - RNA, 19 nt, Human herpesvirus 2
ccggggacacgcggcgggu

SEQ ID NO: 1826019 - RNA, 16 nt, Human herpesvirus 2
gcgcaggcuggagcuc

SEQ ID NO: 1826020 - RNA, 21 nt, Human herpesvirus 2
uauucaccacacagaaacaca

SEQ ID NO: 1826021 - RNA, 13 nt, Human herpesvirus 2
acugcacuugccc

SEQ ID NO: 1826022 - RNA, 16 nt, Human herpesvirus 2
cuccgaccggcggggc

SEQ ID NO: 1826023 - RNA, 15 nt, Human herpesvirus 2
ccucugcgcgcggcg

SEQ ID NO: 1826024 - RNA, 17 nt, Human herpesvirus 2
cggccagcacgaccagg

SEQ ID NO: 1826025 - RNA, 22 nt, Human herpesvirus 2
gggcgguugcgguucguucugg

SEQ ID NO: 1826026 - RNA, 19 nt, Human herpesvirus 2
gaugauaacgacgaccacc

SEQ ID NO: 1826027 - RNA, 16 nt, Human herpesvirus 2
auggggggggaaagga

SEQ ID NO: 1826028 - RNA, 12 nt, Human herpesvirus 2
gggggguggugg

SEQ ID NO: 1826029 - RNA, 19 nt, Human herpesvirus 2
accgcacccgggccgggug

SEQ ID NO: 1826030 - RNA, 14 nt, Human herpesvirus 2
cccagggagccccg

SEQ ID NO: 1826031 - RNA, 20 nt, Human herpesvirus 2
cggccaagcuaaggcgcccg

SEQ ID NO: 1826032 - RNA, 12 nt, Human herpesvirus 2
guccccuggggc

SEQ ID NO: 1826033 - RNA, 21 nt, Human herpesvirus 2
cggacgcacgcggggacccgc

SEQ ID NO: 1826034 - RNA, 16 nt, Human herpesvirus 2
accaggcgcugcugcg

SEQ ID NO: 1826035 - RNA, 20 nt, Human herpesvirus 2
cuccgcccucgccgucuugg

SEQ ID NO: 1826036 - RNA, 19 nt, Human herpesvirus 2
cccucucaacgcccaggcc

SEQ ID NO: 1826037 - RNA, 12 nt, Human herpesvirus 2
cugcugagcccu

SEQ ID NO: 1826038 - RNA, 10 nt, Human herpesvirus 2
ccuuccuguc

SEQ ID NO: 1826039 - RNA, 19 nt, Human herpesvirus 2
cuccgugcuggggaaaucu

SEQ ID NO: 1826040 - RNA, 15 nt, Human herpesvirus 2
cggccgaauggcugc

SEQ ID NO: 1826041 - RNA, 16 nt, Human herpesvirus 2
ccuuaaaaggcacccc

SEQ ID NO: 1826042 - RNA, 24 nt, Human herpesvirus 2
ggugcgccccgccggggcgcacaa

SEQ ID NO: 1826043 - RNA, 22 nt, Human herpesvirus 2
cggacggccccucgcuccccgc

SEQ ID NO: 1826044 - RNA, 17 nt, Human herpesvirus 2
cauggggaacccccaga

SEQ ID NO: 1826045 - RNA, 17 nt, Human herpesvirus 2
acgccuggcggccccug

SEQ ID NO: 1826046 - RNA, 21 nt, Human herpesvirus 2
ccccgauuccggugugcccca

SEQ ID NO: 1826047 - RNA, 13 nt, Human herpesvirus 2
ccgggcccggccg

SEQ ID NO: 1826048 - RNA, 15 nt, Human herpesvirus 2
ggcgagugcucgcag

SEQ ID NO: 1826049 - RNA, 22 nt, Human herpesvirus 2
acacggucggugccccccaucu

SEQ ID NO: 1826050 - RNA, 13 nt, Human herpesvirus 2
ccgcgucugcuac

SEQ ID NO: 1826051 - RNA, 18 nt, Human herpesvirus 2
gugguuugccguggagcu

SEQ ID NO: 1826052 - RNA, 19 nt, Human herpesvirus 2
cgcugcucucccguacccc

SEQ ID NO: 1826053 - RNA, 21 nt, Human herpesvirus 2
cuuucccccccacuccacccc

SEQ ID NO: 1826054 - RNA, 12 nt, Human herpesvirus 2
cggccucuccgg

SEQ ID NO: 1826055 - RNA, 14 nt, Human herpesvirus 2
cacggacacggccc

SEQ ID NO: 1826056 - RNA, 17 nt, Human herpesvirus 2
ggaugcccgccagggcc

SEQ ID NO: 1826057 - RNA, 14 nt, Human herpesvirus 2
agcgccgaccagaa

SEQ ID NO: 1826058 - RNA, 19 nt, Human herpesvirus 2
cgggccaacagggaguccu

SEQ ID NO: 1826059 - RNA, 13 nt, Human herpesvirus 2
gccgccauccuca

SEQ ID NO: 1826060 - RNA, 21 nt, Human herpesvirus 2
cgcggccauccugcccaccgg

SEQ ID NO: 1826061 - RNA, 18 nt, Human herpesvirus 2
ggaggggggcagugcagu

SEQ ID NO: 1826062 - RNA, 23 nt, Human herpesvirus 2
cgcacccccgcgccgccucgggg

SEQ ID NO: 1826063 - RNA, 14 nt, Human herpesvirus 2
gaggagccgggaga

SEQ ID NO: 1826064 - RNA, 15 nt, Human herpesvirus 2
gucccgauggccgcc

SEQ ID NO: 1826065 - RNA, 18 nt, Human herpesvirus 2
cugacgccggccaaccuc

SEQ ID NO: 1826066 - RNA, 17 nt, Human herpesvirus 2
ccgcgggucccuuccca

SEQ ID NO: 1826067 - RNA, 20 nt, Human herpesvirus 2
ccgggacgagccaaaccagc

SEQ ID NO: 1826068 - RNA, 12 nt, Human herpesvirus 2
gagcccagggaa

SEQ ID NO: 1826069 - RNA, 16 nt, Human herpesvirus 2
ccgcggccccacgguc

SEQ ID NO: 1826070 - RNA, 18 nt, Human herpesvirus 2
aggacccauacauuuccc

SEQ ID NO: 1826071 - RNA, 18 nt, Human herpesvirus 2
guucaauagauuucccaa

SEQ ID NO: 1826072 - RNA, 18 nt, Human herpesvirus 2
acuaggacaguucauagg

SEQ ID NO: 1826073 - RNA, 13 nt, Human herpesvirus 2
cuuugacuccugg

SEQ ID NO: 1826074 - RNA, 12 nt, Human herpesvirus 2
ucuggaagagcu

SEQ ID NO: 1826075 - RNA, 21 nt, Human herpesvirus 2
accacccccccacuuuccucc

SEQ ID NO: 1826076 - RNA, 15 nt, Human herpesvirus 2
gauguauggcgccuu

SEQ ID NO: 1826077 - RNA, 15 nt, Human herpesvirus 2
ccacgcugcgcggcg

SEQ ID NO: 1826078 - RNA, 19 nt, Human herpesvirus 2
cguggccgacaacugccug

SEQ ID NO: 1826079 - RNA, 23 nt, Human herpesvirus 2
cggcgggucggguguccccggac

SEQ ID NO: 1826080 - RNA, 22 nt, Human herpesvirus 2
gacucgccuuugguuaaacaau

SEQ ID NO: 1826081 - RNA, 20 nt, Human herpesvirus 2
cccuccucgcugcgccgggc

SEQ ID NO: 1826082 - RNA, 18 nt, Human herpesvirus 2
ggagaguucaauagauuu

SEQ ID NO: 1826083 - RNA, 12 nt, Human herpesvirus 2
ugcagccccggu

SEQ ID NO: 1826084 - RNA, 15 nt, Human herpesvirus 2
ccgcgcgggcccgga

SEQ ID NO: 1826085 - RNA, 15 nt, Human herpesvirus 2
guccgaccugcagga

SEQ ID NO: 1826086 - RNA, 15 nt, Human herpesvirus 2
gcugcugccccgcgu

SEQ ID NO: 1826087 - RNA, 21 nt, Human herpesvirus 2
gguccgcguauaaaggcaggc

SEQ ID NO: 1826088 - RNA, 13 nt, Human herpesvirus 2
accgcgcgccucc

SEQ ID NO: 1826089 - RNA, 17 nt, Human herpesvirus 2
ggcagccgggcccgcca

SEQ ID NO: 1826090 - RNA, 12 nt, Human herpesvirus 2
uccccugcguaa

SEQ ID NO: 1826091 - RNA, 21 nt, Human herpesvirus 2
gugcuguggcggucggccagc

SEQ ID NO: 1826092 - RNA, 19 nt, Human herpesvirus 2
acacggugcgugcggcccu

SEQ ID NO: 1826093 - RNA, 12 nt, Human herpesvirus 2
uuccccaagaga

SEQ ID NO: 1826094 - RNA, 13 nt, Human herpesvirus 2
augcaagcgggcg

SEQ ID NO: 1826095 - RNA, 14 nt, Human herpesvirus 2
ggcgcuuggccggg

SEQ ID NO: 1826096 - RNA, 13 nt, Human herpesvirus 2
cggcggccccggc

SEQ ID NO: 1826097 - RNA, 18 nt, Human herpesvirus 2
ggccgggucggcugucca

SEQ ID NO: 1826098 - RNA, 23 nt, Human herpesvirus 2
cucguuuuguuuucucuucuuuc

SEQ ID NO: 1826099 - RNA, 16 nt, Human herpesvirus 2
gccggggcggccccga

SEQ ID NO: 1826100 - RNA, 15 nt, Human herpesvirus 2
gcgcgcaucggaccc

SEQ ID NO: 1826101 - RNA, 19 nt, Human herpesvirus 2
uaaaacccagacccgagcu

SEQ ID NO: 1826102 - RNA, 20 nt, Human herpesvirus 2
ggugccucacgguccucacc

SEQ ID NO: 1826103 - RNA, 12 nt, Human herpesvirus 2
cguggcccucca

SEQ ID NO: 1826104 - RNA, 18 nt, Human herpesvirus 2
ccguguaccucugggccc

SEQ ID NO: 1826105 - RNA, 17 nt, Human herpesvirus 2
cgcggugccugacgccg

SEQ ID NO: 1826106 - RNA, 16 nt, Human herpesvirus 2
acgcccuacaagaaag

SEQ ID NO: 1826107 - RNA, 12 nt, Human herpesvirus 2
agggggcggcgc

SEQ ID NO: 1826108 - RNA, 12 nt, Human herpesvirus 2
ggguccuggugg

SEQ ID NO: 1826109 - RNA, 19 nt, Human herpesvirus 2
ugagcagccgcgccgcugc

SEQ ID NO: 1826110 - RNA, 12 nt, Human herpesvirus 2
ccggcaccaggc

SEQ ID NO: 1826111 - RNA, 21 nt, Human herpesvirus 2
gagagagggggggaaagaaag

SEQ ID NO: 1826112 - RNA, 14 nt, Human herpesvirus 2
gcuucaucaccccc

SEQ ID NO: 1826113 - RNA, 13 nt, Human herpesvirus 2
gccgcggccccgc

SEQ ID NO: 1826114 - RNA, 15 nt, Human herpesvirus 2
caccguccaccuccg

SEQ ID NO: 1826115 - RNA, 21 nt, Human herpesvirus 2
ggcuucuucuuccccagcuuu

SEQ ID NO: 1826116 - RNA, 12 nt, Human herpesvirus 2
cgcgauuccgag

SEQ ID NO: 1826117 - RNA, 18 nt, Human herpesvirus 2
ccgacgacgugcgcgugg

SEQ ID NO: 1826118 - RNA, 15 nt, Human herpesvirus 2
acugccuccacgccc

SEQ ID NO: 1826119 - RNA, 13 nt, Human herpesvirus 2
uccgcgagggccc

SEQ ID NO: 1826120 - RNA, 19 nt, Human herpesvirus 2
gggucugcgucguccaggg

SEQ ID NO: 1826121 - RNA, 20 nt, Human herpesvirus 2
cguccccuuucuuuuccccc

SEQ ID NO: 1826122 - RNA, 22 nt, Human herpesvirus 2
cggcgccgccccgccgcuccgc

SEQ ID NO: 1826123 - RNA, 14 nt, Human herpesvirus 2
cgcaccccaccccu

SEQ ID NO: 1826124 - RNA, 14 nt, Human herpesvirus 2
cagacucucgguga

SEQ ID NO: 1826125 - RNA, 23 nt, Human herpesvirus 2
gaccggcgccgaucgcagcgucc

SEQ ID NO: 1826126 - RNA, 16 nt, Human herpesvirus 2
gcgccgcgcccgcgug

SEQ ID NO: 1826127 - RNA, 20 nt, Human herpesvirus 2
cccgaacagccccuggggcu

SEQ ID NO: 1826128 - RNA, 12 nt, Human herpesvirus 2
aggcacggcgcc

SEQ ID NO: 1826129 - RNA, 16 nt, Human herpesvirus 2
ggugcaguuugagcag

SEQ ID NO: 1826130 - RNA, 21 nt, Human herpesvirus 2
cgccggccaaccgcgcgccgc

SEQ ID NO: 1826131 - RNA, 18 nt, Human herpesvirus 2
gggcguuauaagccgccg

SEQ ID NO: 1826132 - RNA, 14 nt, Human herpesvirus 2
ccgggagccgcggc

SEQ ID NO: 1826133 - RNA, 18 nt, Human herpesvirus 2
ccgggggggggcaagugc

SEQ ID NO: 1826134 - RNA, 14 nt, Human herpesvirus 2
gcgcgggcggcgcc

SEQ ID NO: 1826135 - RNA, 22 nt, Human herpesvirus 2
ggacaguucauaggccgggagc

SEQ ID NO: 1826136 - RNA, 21 nt, Human herpesvirus 2
ugcaguaccccaguuccuccg

SEQ ID NO: 1826137 - RNA, 17 nt, Human herpesvirus 2
cuucuuuaaccgcgagc

SEQ ID NO: 1826138 - RNA, 14 nt, Human herpesvirus 2
ggggcaagugcagu

SEQ ID NO: 1826139 - RNA, 15 nt, Human herpesvirus 2
gaaaucucucugccg

SEQ ID NO: 1826140 - RNA, 22 nt, Human herpesvirus 2
acacucgcgucuggcuguguuu

SEQ ID NO: 1826141 - RNA, 14 nt, Human herpesvirus 2
cuguccgccgggcg

SEQ ID NO: 1826142 - RNA, 19 nt, Human herpesvirus 2
agcgccgcuacugcgccac

SEQ ID NO: 1826143 - RNA, 11 nt, Human herpesvirus 2
aagaagguuuc

SEQ ID NO: 1826144 - RNA, 22 nt, Human herpesvirus 2
ccggacugcagccccggucccc

SEQ ID NO: 1826145 - RNA, 15 nt, Human herpesvirus 2
acagccccuggggcu

SEQ ID NO: 1826146 - RNA, 19 nt, Human herpesvirus 2
cccgcguccgacacccggg

SEQ ID NO: 1826147 - RNA, 23 nt, Human herpesvirus 2
ccccaggaggggggcagugcagu

SEQ ID NO: 1826148 - RNA, 20 nt, Human herpesvirus 2
cccccugaguugcgccggca

SEQ ID NO: 1826149 - RNA, 18 nt, Human herpesvirus 2
uucuggcggcccuggagc

SEQ ID NO: 1826150 - RNA, 16 nt, Human herpesvirus 2
ggcgugcugugcccug

SEQ ID NO: 1826151 - RNA, 18 nt, Human herpesvirus 2
auagauuuccccaagaga

SEQ ID NO: 1826152 - RNA, 14 nt, Human herpesvirus 2
ccggcccaccccca

SEQ ID NO: 1826153 - RNA, 16 nt, Human herpesvirus 2
ggcggucccggccgcc

SEQ ID NO: 1826154 - RNA, 21 nt, Human herpesvirus 2
ggcucccccgcggaccuuggc

SEQ ID NO: 1826155 - RNA, 14 nt, Human herpesvirus 2
guccucaccgagcc

SEQ ID NO: 1826156 - RNA, 22 nt, Human herpesvirus 2
gcucguaaaaauggcggccgcc

SEQ ID NO: 1826157 - RNA, 21 nt, Human herpesvirus 2
cucggccggcggagccccgga

SEQ ID NO: 1826158 - RNA, 13 nt, Human herpesvirus 2
ccccuuccguccc

SEQ ID NO: 1826159 - RNA, 19 nt, Human herpesvirus 2
ucgguggacaugaggcuga

SEQ ID NO: 1826160 - RNA, 17 nt, Human herpesvirus 2
ggaagaggcggacccag

SEQ ID NO: 1826161 - RNA, 20 nt, Human herpesvirus 2
agccugcgaaucccccaagg

SEQ ID NO: 1826162 - RNA, 22 nt, Human herpesvirus 2
gcccgccccagggggcggcgcc

SEQ ID NO: 1826163 - RNA, 15 nt, Human herpesvirus 2
cagagcucuuuauug

SEQ ID NO: 1826164 - RNA, 15 nt, Human herpesvirus 2
aucggccaggagguc

SEQ ID NO: 1826165 - RNA, 13 nt, Human herpesvirus 2
acgagacagacga

SEQ ID NO: 1826166 - RNA, 16 nt, Human herpesvirus 2
acagcacggccgggug

SEQ ID NO: 1826167 - RNA, 17 nt, Human herpesvirus 2
uccgcacccccgccuac

SEQ ID NO: 1826168 - RNA, 23 nt, Human herpesvirus 2
ugcccccccucguucugcugcac

SEQ ID NO: 1826169 - RNA, 16 nt, Human herpesvirus 2
gggcacggcguccucc

SEQ ID NO: 1826170 - RNA, 13 nt, Human herpesvirus 2
cggacacggcccc

SEQ ID NO: 1826171 - RNA, 13 nt, Human herpesvirus 2
ucagccuggacca

SEQ ID NO: 1826172 - RNA, 16 nt, Human herpesvirus 2
cccgcccccucuccca

SEQ ID NO: 1826173 - RNA, 18 nt, Human herpesvirus 2
cucuggcuccaggccgcc

SEQ ID NO: 1826174 - RNA, 17 nt, Human herpesvirus 2
ugggcgcgagccaggca

SEQ ID NO: 1826175 - RNA, 18 nt, Human herpesvirus 2
ccgggucaccggggcgcc

SEQ ID NO: 1826176 - RNA, 10 nt, Human herpesvirus 2
cgucgcuguu

SEQ ID NO: 1826177 - RNA, 17 nt, Human herpesvirus 2
ggcgccacgguggugca

SEQ ID NO: 1826178 - RNA, 22 nt, Human herpesvirus 2
ggggacccgggcgagcuggccc

SEQ ID NO: 1826179 - RNA, 21 nt, Human herpesvirus 2
gcccgacggggagggacaagg

SEQ ID NO: 1826180 - RNA, 21 nt, Human herpesvirus 2
agaguucaauagauuucccaa

SEQ ID NO: 1826181 - RNA, 15 nt, Human herpesvirus 2
guuucugggcccgcc

SEQ ID NO: 1826182 - RNA, 20 nt, Human herpesvirus 2
cucccccgcgagcaccgacc

SEQ ID NO: 1826183 - RNA, 17 nt, Human herpesvirus 2
cgacggcuccugccacc

SEQ ID NO: 1826184 - RNA, 13 nt, Human herpesvirus 2
cgcggccccacgg

SEQ ID NO: 1826185 - RNA, 23 nt, Human herpesvirus 2
cgccucgauguauggcgccuucu

SEQ ID NO: 1826186 - RNA, 17 nt, Human herpesvirus 2
accggcccccggagucc

SEQ ID NO: 1826187 - RNA, 14 nt, Human herpesvirus 2
ccucuguuucucca

SEQ ID NO: 1826188 - RNA, 14 nt, Human herpesvirus 2
gucaccgggggccc

SEQ ID NO: 1826189 - RNA, 13 nt, Human herpesvirus 2
gcgauccccaagc

SEQ ID NO: 1826190 - RNA, 23 nt, Human herpesvirus 2
gacgcgcuaguacccagaggcug

SEQ ID NO: 1826191 - RNA, 16 nt, Human herpesvirus 2
augucaguccucgggg

SEQ ID NO: 1826192 - RNA, 18 nt, Human herpesvirus 2
cccgcccccgacgggcgc

SEQ ID NO: 1826193 - RNA, 14 nt, Human herpesvirus 2
agcccguggcccac

SEQ ID NO: 1826194 - RNA, 21 nt, Human herpesvirus 2
ggcugguuggauguuuuugca

SEQ ID NO: 1826195 - RNA, 19 nt, Human herpesvirus 2
gggccccgccccgccccac

SEQ ID NO: 1826196 - RNA, 12 nt, Human herpesvirus 2
ccacacacaccc

SEQ ID NO: 1826197 - RNA, 13 nt, Human herpesvirus 2
guucuccuggacg

SEQ ID NO: 1826198 - RNA, 18 nt, Human herpesvirus 2
gcgcacacgccaucgacc

SEQ ID NO: 1826199 - RNA, 14 nt, Human herpesvirus 2
gccgggggcggacg

SEQ ID NO: 1826200 - RNA, 20 nt, Human herpesvirus 2
cacgagcacaaacgugcucu

SEQ ID NO: 1826201 - RNA, 20 nt, Human herpesvirus 2
cgucguggcauggaagcccc

SEQ ID NO: 1826202 - RNA, 19 nt, Human herpesvirus 2
cgcgccaccgcccgcacca

SEQ ID NO: 1826203 - RNA, 13 nt, Human herpesvirus 2
agacacaaaagcu

SEQ ID NO: 1826204 - RNA, 14 nt, Human herpesvirus 2
ggggaugguggugg

SEQ ID NO: 1826205 - RNA, 15 nt, Human herpesvirus 2
accggggacuccccu

SEQ ID NO: 1826206 - RNA, 13 nt, Human herpesvirus 2
ccuguuuggggca

SEQ ID NO: 1826207 - RNA, 14 nt, Human herpesvirus 2
gcggugcagggccu

SEQ ID NO: 1826208 - RNA, 14 nt, Human herpesvirus 2
gggguugggucugc

SEQ ID NO: 1826209 - RNA, 18 nt, Human herpesvirus 2
gcacgcgcgcaggcugga

SEQ ID NO: 1826210 - RNA, 11 nt, Human herpesvirus 2
ugugccaggug

SEQ ID NO: 1826211 - RNA, 13 nt, Human herpesvirus 2
cggaccccgaccc

SEQ ID NO: 1826212 - RNA, 17 nt, Human herpesvirus 2
ccacacacacccccugu

SEQ ID NO: 1826213 - RNA, 20 nt, Human herpesvirus 2
gcgggcacucuggcgucccc

SEQ ID NO: 1826214 - RNA, 13 nt, Human herpesvirus 2
ggcccuccacgcc

SEQ ID NO: 1826215 - RNA, 20 nt, Human herpesvirus 2
uccccaagagacuucccuaa

SEQ ID NO: 1826216 - RNA, 13 nt, Human herpesvirus 2
caauaauaaagcu

SEQ ID NO: 1826217 - RNA, 15 nt, Human herpesvirus 2
ucggacaccagcagc

SEQ ID NO: 1826218 - RNA, 17 nt, Human herpesvirus 2
gagccccccacgugggc

SEQ ID NO: 1826219 - RNA, 15 nt, Human herpesvirus 2
ccuagaggcuguccg

SEQ ID NO: 1826220 - RNA, 14 nt, Human herpesvirus 2
gccccgccgcuccg

SEQ ID NO: 1826221 - RNA, 16 nt, Human herpesvirus 2
auggagaagggaaagg

SEQ ID NO: 1826222 - RNA, 23 nt, Human herpesvirus 2
ccggccgcucgcugcagggccug

SEQ ID NO: 1826223 - RNA, 19 nt, Human herpesvirus 2
acaacaguacucaucggga

SEQ ID NO: 1826224 - RNA, 14 nt, Human herpesvirus 2
gggggcuaggagcc

SEQ ID NO: 1826225 - RNA, 16 nt, Human herpesvirus 2
uggcuucgggccaaca

SEQ ID NO: 1826226 - RNA, 14 nt, Human herpesvirus 2
uguuguuucugggc

SEQ ID NO: 1826227 - RNA, 21 nt, Human herpesvirus 2
cgaagagacgaugggagcccc

SEQ ID NO: 1826228 - RNA, 18 nt, Human herpesvirus 2
gcagugcaguaccccagu

SEQ ID NO: 1826229 - RNA, 16 nt, Human herpesvirus 2
gguagcggacgcacgg

SEQ ID NO: 1826230 - RNA, 18 nt, Human herpesvirus 2
agucaaacgucccaaacu

SEQ ID NO: 1826231 - RNA, 14 nt, Human herpesvirus 2
gaggcgaccccgcc

SEQ ID NO: 1826232 - RNA, 17 nt, Human herpesvirus 2
cucgggggccaggaacu

SEQ ID NO: 1826233 - RNA, 19 nt, Human herpesvirus 2
agaccaccucgcggcggcu

SEQ ID NO: 1826234 - RNA, 13 nt, Human herpesvirus 2
ucgugcacagagc

SEQ ID NO: 1826235 - RNA, 22 nt, Human herpesvirus 2
ggcgcucgguuguccguucugu

SEQ ID NO: 1826236 - RNA, 13 nt, Human herpesvirus 2
guuucgccccacg

SEQ ID NO: 1826237 - RNA, 19 nt, Human herpesvirus 2
ccggcguggagcgccgggc

SEQ ID NO: 1826238 - RNA, 16 nt, Human herpesvirus 2
cggggcgugcugugcc

SEQ ID NO: 1826239 - RNA, 18 nt, Human herpesvirus 2
ugcgcggcguuggcgcgc

SEQ ID NO: 1826240 - RNA, 15 nt, Human herpesvirus 2
acagacaauaaagca

SEQ ID NO: 1826241 - RNA, 19 nt, Human herpesvirus 2
cggcgauuaacaacaccaa

SEQ ID NO: 1826242 - RNA, 12 nt, Human herpesvirus 2
augagccgccgg

SEQ ID NO: 1826243 - RNA, 13 nt, Human herpesvirus 2
aacuccgcccucg

SEQ ID NO: 1826244 - RNA, 19 nt, Human herpesvirus 2
cgcgcggcgcgagcucccu

SEQ ID NO: 1826245 - RNA, 15 nt, Human herpesvirus 2
aggggggcagugcag

SEQ ID NO: 1826246 - RNA, 16 nt, Human herpesvirus 2
cggucggccagcacga

SEQ ID NO: 1826247 - RNA, 12 nt, Human herpesvirus 2
ggcgccgaucgc

SEQ ID NO: 1826248 - RNA, 12 nt, Human herpesvirus 2
gccaacaccagg

SEQ ID NO: 1826249 - RNA, 22 nt, Human herpesvirus 2
gauggggagagggggaaggaau

SEQ ID NO: 1826250 - RNA, 21 nt, Human herpesvirus 2
gccgacuuccgugccccugga

SEQ ID NO: 1826251 - RNA, 14 nt, Human herpesvirus 2
cccucgcugcucuc

SEQ ID NO: 1826252 - RNA, 21 nt, Human herpesvirus 2
caccgagccgcugugccaggu

SEQ ID NO: 1826253 - RNA, 19 nt, Human herpesvirus 2
aggccgcccccagcaggug

SEQ ID NO: 1826254 - RNA, 17 nt, Human herpesvirus 2
cccccgggacuucugga

SEQ ID NO: 1826255 - RNA, 15 nt, Human herpesvirus 2
cccgccagagacccu

SEQ ID NO: 1826256 - RNA, 20 nt, Human herpesvirus 2
uuccucaguguuugggaaau

SEQ ID NO: 1826257 - RNA, 19 nt, Human herpesvirus 2
cggggccguggggccccag

SEQ ID NO: 1826258 - RNA, 16 nt, Human herpesvirus 2
ggggaugggggggaag

SEQ ID NO: 1826259 - RNA, 21 nt, Human herpesvirus 2
gaaggaacgcccgaaaccaga

SEQ ID NO: 1826260 - RNA, 20 nt, Human herpesvirus 2
ggcgaccgucuuugggcccc

SEQ ID NO: 1826261 - RNA, 15 nt, Human herpesvirus 2
ccccacgucaccggg

SEQ ID NO: 1826262 - RNA, 20 nt, Human herpesvirus 2
gcagcagucguggagcgucc

SEQ ID NO: 1826263 - RNA, 17 nt, Human herpesvirus 2
ggauguguucuccugga

SEQ ID NO: 1826264 - RNA, 15 nt, Human herpesvirus 2
uccccuucagccugg

SEQ ID NO: 1826265 - RNA, 14 nt, Human herpesvirus 2
caccgaaggaggaa

SEQ ID NO: 1826266 - RNA, 16 nt, Human herpesvirus 2
ccgcuguggcccuggc

SEQ ID NO: 1826267 - RNA, 17 nt, Human herpesvirus 2
ccuaaggaugcccgcca

SEQ ID NO: 1826268 - RNA, 14 nt, Human herpesvirus 2
cgucgcuaucacau

SEQ ID NO: 1826269 - RNA, 15 nt, Human herpesvirus 2
uggggggggugugug

SEQ ID NO: 1826270 - RNA, 18 nt, Human herpesvirus 2
ccggguuauaggccacac

SEQ ID NO: 1826271 - RNA, 20 nt, Human herpesvirus 2
guuuccccggcccaccccca

SEQ ID NO: 1826272 - RNA, 15 nt, Human herpesvirus 2
cccggcuccuccgug

SEQ ID NO: 1826273 - RNA, 16 nt, Human herpesvirus 2
gggggccggggcucuu

SEQ ID NO: 1826274 - RNA, 16 nt, Human herpesvirus 2
cgggacgagccaaacc

SEQ ID NO: 1826275 - RNA, 15 nt, Human herpesvirus 2
gaaugacacaaaaau

SEQ ID NO: 1826276 - RNA, 16 nt, Human herpesvirus 2
gaacacgagccgcagg

SEQ ID NO: 1826277 - RNA, 19 nt, Human herpesvirus 2
cgggacgcccggcccauaa

SEQ ID NO: 1826278 - RNA, 14 nt, Human herpesvirus 2
ggggagggcggcac

SEQ ID NO: 1826279 - RNA, 22 nt, Human herpesvirus 2
accugccguaugcuaauuaaau

SEQ ID NO: 1826280 - RNA, 19 nt, Human herpesvirus 2
gcucugucccccgggcagc

SEQ ID NO: 1826281 - RNA, 21 nt, Human herpesvirus 2
ggcgugauguuuuccgcaucu

SEQ ID NO: 1826282 - RNA, 20 nt, Human herpesvirus 2
gucugcgccaccggccuggu

SEQ ID NO: 1826283 - RNA, 13 nt, Human herpesvirus 2
cccgccggggcgc

SEQ ID NO: 1826284 - RNA, 18 nt, Human herpesvirus 2
ucguggugcuggccaaug

SEQ ID NO: 1826285 - RNA, 20 nt, Human herpesvirus 2
ugcaucccagacgcccgcga

SEQ ID NO: 1826286 - RNA, 20 nt, Human herpesvirus 2
ccuccgcccuccgccagcgc

SEQ ID NO: 1826287 - RNA, 17 nt, Human herpesvirus 2
aagugcaguaacccagu

SEQ ID NO: 1826288 - RNA, 18 nt, Human herpesvirus 2
agccgccaccccccuccc

SEQ ID NO: 1826289 - RNA, 14 nt, Human herpesvirus 2
gaagucacccgggu

SEQ ID NO: 1826290 - RNA, 24 nt, Human herpesvirus 2
cggcgccuaccugguacccacgga

SEQ ID NO: 1826291 - RNA, 14 nt, Human herpesvirus 2
ugaggaacuggguu

SEQ ID NO: 1826292 - RNA, 18 nt, Human herpesvirus 2
cacguguccccagggagc

SEQ ID NO: 1826293 - RNA, 13 nt, Human herpesvirus 2
gggacgcgagccu

SEQ ID NO: 1826294 - RNA, 19 nt, Human herpesvirus 2
gcccgcagcuucgggggcu

SEQ ID NO: 1826295 - RNA, 15 nt, Human herpesvirus 2
agcucaucgcacggc

SEQ ID NO: 1826296 - RNA, 21 nt, Human herpesvirus 2
cgggcggacguccaggggugc

SEQ ID NO: 1826297 - RNA, 16 nt, Human herpesvirus 2
gcgccaccgcccgcac

SEQ ID NO: 1826298 - RNA, 18 nt, Human herpesvirus 2
ccuggguccgggggccug

SEQ ID NO: 1826299 - RNA, 23 nt, Human herpesvirus 2
ccgccagagacccugccccccgg

SEQ ID NO: 1826300 - RNA, 21 nt, Human herpesvirus 2
gcggagagagggggggaaaga

SEQ ID NO: 1826301 - RNA, 21 nt, Human herpesvirus 2
gaccgcugucgcccccgucug

SEQ ID NO: 1826302 - RNA, 23 nt, Human herpesvirus 2
ccacgagcacaaacgugcucugc

SEQ ID NO: 1826303 - RNA, 22 nt, Human herpesvirus 2
gccuagccgugggccugugggg

SEQ ID NO: 1826304 - RNA, 13 nt, Human herpesvirus 2
uccaccuuggccc

SEQ ID NO: 1826305 - RNA, 12 nt, Human herpesvirus 2
cuacccccaccc

SEQ ID NO: 1826306 - RNA, 13 nt, Human herpesvirus 2
ggcgugcugugcc

SEQ ID NO: 1826307 - RNA, 15 nt, Human herpesvirus 2
gcccccggcccugcg

SEQ ID NO: 1826308 - RNA, 16 nt, Human herpesvirus 2
ugucgccggcgugggu

SEQ ID NO: 1826309 - RNA, 16 nt, Human herpesvirus 2
ugugucgcggggacag

SEQ ID NO: 1826310 - RNA, 18 nt, Human herpesvirus 2
gucguccgcggccccacg

SEQ ID NO: 1826311 - RNA, 20 nt, Human herpesvirus 2
uuucugggcccgccgaccgc

SEQ ID NO: 1826312 - RNA, 16 nt, Human herpesvirus 2
uguuguguuugcuggg

SEQ ID NO: 1826313 - RNA, 17 nt, Human herpesvirus 2
cacggucugguggcgcu

SEQ ID NO: 1826314 - RNA, 23 nt, Human herpesvirus 2
uggaagaggaccugcguguuuuc

SEQ ID NO: 1826315 - RNA, 20 nt, Human herpesvirus 2
caagugcaguaacccaguuc

SEQ ID NO: 1826316 - RNA, 16 nt, Human herpesvirus 2
agcgccgggccucccg

SEQ ID NO: 1826317 - RNA, 21 nt, Human herpesvirus 2
auggcgccuucuucgccccca

SEQ ID NO: 1826318 - RNA, 15 nt, Human herpesvirus 2
gggagggcagggccg

SEQ ID NO: 1826319 - RNA, 13 nt, Human herpesvirus 2
ccagguggcccuu

SEQ ID NO: 1826320 - RNA, 14 nt, Human herpesvirus 2
ugcccccccccggg

SEQ ID NO: 1826321 - RNA, 23 nt, Human herpesvirus 2
cgggcggugcccaucuacguggc

SEQ ID NO: 1826322 - RNA, 14 nt, Human herpesvirus 2
uaugcuaauuaaau

SEQ ID NO: 1826323 - RNA, 13 nt, Human herpesvirus 2
agagcccagggaa

SEQ ID NO: 1826324 - RNA, 13 nt, Human herpesvirus 2
cgcacgcggugcg

SEQ ID NO: 1826325 - RNA, 21 nt, Human herpesvirus 2
cccccucucaaacaaaaacac

SEQ ID NO: 1826326 - RNA, 19 nt, Human herpesvirus 2
gcgccugcgccccgacggc

SEQ ID NO: 1826327 - RNA, 12 nt, Human herpesvirus 2
agggggaaggaa

SEQ ID NO: 1826328 - RNA, 23 nt, Human herpesvirus 2
cgggcgggguggggaggaaagaa

SEQ ID NO: 1826329 - RNA, 18 nt, Human herpesvirus 2
gacuggccgugcugggcg

SEQ ID NO: 1826330 - RNA, 16 nt, Human herpesvirus 2
ggugcguuccagcgcg

SEQ ID NO: 1826331 - RNA, 18 nt, Human herpesvirus 2
cgcgaugaccucccggcc

SEQ ID NO: 1826332 - RNA, 15 nt, Human herpesvirus 2
gggacuccccucuac

SEQ ID NO: 1826333 - RNA, 19 nt, Human herpesvirus 2
ucacggcccaccugcacga

SEQ ID NO: 1826334 - RNA, 16 nt, Human herpesvirus 2
ugggaaaucuauugaa

SEQ ID NO: 1826335 - RNA, 20 nt, Human herpesvirus 2
cgacgauuagccaccgcgcc

SEQ ID NO: 1826336 - RNA, 22 nt, Human herpesvirus 2
cagaugcugcccgcggaccacc

SEQ ID NO: 1826337 - RNA, 20 nt, Human herpesvirus 2
cuuccgaccgacgggccccc

SEQ ID NO: 1826338 - RNA, 14 nt, Human herpesvirus 2
agccagggcuggga

SEQ ID NO: 1826339 - RNA, 17 nt, Human herpesvirus 2
ugauucucaccuggggc

SEQ ID NO: 1826340 - RNA, 16 nt, Human herpesvirus 2
cucgaacauggacccg

SEQ ID NO: 1826341 - RNA, 17 nt, Human herpesvirus 2
cgcccauacaaauuaaa

SEQ ID NO: 1826342 - RNA, 19 nt, Human herpesvirus 2
cuggguuacugcacuugcc

SEQ ID NO: 1826343 - RNA, 14 nt, Human herpesvirus 2
gacaggaggcgcag

SEQ ID NO: 1826344 - RNA, 18 nt, Human herpesvirus 2
cguguacaaacacgggga

SEQ ID NO: 1826345 - RNA, 22 nt, Human herpesvirus 2
uucccuucgcgagggccccggc

SEQ ID NO: 1826346 - RNA, 17 nt, Human herpesvirus 2
ccgcauauacugcuggg

SEQ ID NO: 1826347 - RNA, 13 nt, Human herpesvirus 2
gguuguguuuugu

SEQ ID NO: 1826348 - RNA, 16 nt, Human herpesvirus 2
cccgaccccgccgccg

SEQ ID NO: 1826349 - RNA, 20 nt, Human herpesvirus 2
cgcgaccgucgccgccggcc

SEQ ID NO: 1826350 - RNA, 17 nt, Human herpesvirus 2
cccggcgaccgccccgc

SEQ ID NO: 1826351 - RNA, 13 nt, Human herpesvirus 2
ggcccacgagcuc

SEQ ID NO: 1826352 - RNA, 22 nt, Human herpesvirus 2
ccccgggcgaaaaggcccggcc

SEQ ID NO: 1826353 - RNA, 18 nt, Human herpesvirus 2
gccguucggaccuggggg

SEQ ID NO: 1826354 - RNA, 23 nt, Human herpesvirus 2
aguaacaaacagagaaaaaaaac

SEQ ID NO: 1826355 - RNA, 19 nt, Human herpesvirus 2
gcgccaagcgccccgcgga

SEQ ID NO: 1826356 - RNA, 20 nt, Human herpesvirus 2
uggcggcuggggaaagggaa

SEQ ID NO: 1826357 - RNA, 23 nt, Human herpesvirus 2
aacuggguuacugcacuugcccc

SEQ ID NO: 1826358 - RNA, 12 nt, Human herpesvirus 2
cacccgcccguc

SEQ ID NO: 1826359 - RNA, 20 nt, Human herpesvirus 2
ugugauagcgacgacagaac

SEQ ID NO: 1826360 - RNA, 14 nt, Human herpesvirus 2
guuccguagacagc

SEQ ID NO: 1826361 - RNA, 15 nt, Human herpesvirus 2
aauaaaacccagacc

SEQ ID NO: 1826362 - RNA, 17 nt, Human herpesvirus 2
gcgcucauggccggaga

SEQ ID NO: 1826363 - RNA, 14 nt, Human herpesvirus 2
gccgaacgccucac

SEQ ID NO: 1826364 - RNA, 21 nt, Human herpesvirus 2
ucuccgcaauaaacgccuucc

SEQ ID NO: 1826365 - RNA, 16 nt, Human herpesvirus 2
guggcccuuccggacc

SEQ ID NO: 1826366 - RNA, 19 nt, Human herpesvirus 2
ucccgcucgcgguaauuag

SEQ ID NO: 1826367 - RNA, 14 nt, Human herpesvirus 2
ggggugaggaagaa

SEQ ID NO: 1826368 - RNA, 17 nt, Human herpesvirus 2
ggcguuccuucccuuuc

SEQ ID NO: 1826369 - RNA, 14 nt, Human herpesvirus 2
cggucaggaccagg

SEQ ID NO: 1826370 - RNA, 18 nt, Human herpesvirus 2
cacccccaaaccccgguu

SEQ ID NO: 1826371 - RNA, 16 nt, Human herpesvirus 2
ugccgcagaccaccuc

SEQ ID NO: 1826372 - RNA, 13 nt, Human herpesvirus 2
gcgccgggcagac

SEQ ID NO: 1826373 - RNA, 22 nt, Human herpesvirus 2
caggcgcuccagguacugcugc

SEQ ID NO: 1826374 - RNA, 17 nt, Human herpesvirus 2
ggcggacguccaggggu

SEQ ID NO: 1826375 - RNA, 22 nt, Human herpesvirus 2
gagccgcccauccgaggaccgc

SEQ ID NO: 1826376 - RNA, 15 nt, Human herpesvirus 2
ucguccucacggcca

SEQ ID NO: 1826377 - RNA, 16 nt, Human herpesvirus 2
cugcgcgcgcaccugc

SEQ ID NO: 1826378 - RNA, 19 nt, Human herpesvirus 2
cgcaucacggcccaccugc

SEQ ID NO: 1826379 - RNA, 19 nt, Human herpesvirus 2
gucgggccagauggggccc

SEQ ID NO: 1826380 - RNA, 13 nt, Human herpesvirus 2
uuuaagcgcugcg

SEQ ID NO: 1826381 - RNA, 22 nt, Human herpesvirus 2
gaaacuuccgggagcgggggag

SEQ ID NO: 1826382 - RNA, 22 nt, Human herpesvirus 2
ccgugcugggcgcgagccaggc

SEQ ID NO: 1826383 - RNA, 19 nt, Human herpesvirus 2
gaugagccgguagugcagg

SEQ ID NO: 1826384 - RNA, 19 nt, Human herpesvirus 2
aggucugcgcgaggccgcu

SEQ ID NO: 1826385 - RNA, 14 nt, Human herpesvirus 2
ggcggcccuggagc

SEQ ID NO: 1826386 - RNA, 17 nt, Human herpesvirus 2
accccccggccccccgc

SEQ ID NO: 1826387 - RNA, 13 nt, Human herpesvirus 2
gacggcgggaccc

SEQ ID NO: 1826388 - RNA, 13 nt, Human herpesvirus 2
gaccggcggggcc

SEQ ID NO: 1826389 - RNA, 13 nt, Human herpesvirus 2
gguauggcugccc

SEQ ID NO: 1826390 - RNA, 18 nt, Human herpesvirus 2
cccaggaggggggcagug

SEQ ID NO: 1826391 - RNA, 14 nt, Human herpesvirus 2
gcgcgcccccgccg

SEQ ID NO: 1826392 - RNA, 17 nt, Human herpesvirus 2
ucgcaagccacccuggg

SEQ ID NO: 1826393 - RNA, 20 nt, Human herpesvirus 2
gucgcccccaaagucacgcc

SEQ ID NO: 1826394 - RNA, 23 nt, Human herpesvirus 2
aaggcauuguugucguguggugu

SEQ ID NO: 1826395 - RNA, 23 nt, Human herpesvirus 2
agcggcuuaagauuuuucggugc

SEQ ID NO: 1826396 - RNA, 11 nt, Human herpesvirus 2
cgagacagacg

SEQ ID NO: 1826397 - RNA, 14 nt, Human herpesvirus 2
gcacgcggucagca

SEQ ID NO: 1826398 - RNA, 21 nt, Human herpesvirus 2
cagaccgaagaggugcugccg

SEQ ID NO: 1826399 - RNA, 18 nt, Human herpesvirus 2
ucgggccgugucccuccc

SEQ ID NO: 1826400 - RNA, 21 nt, Human herpesvirus 2
gccucuguuucuccaggcgcu

SEQ ID NO: 1826401 - RNA, 14 nt, Human herpesvirus 2
gccugugucagcuc

SEQ ID NO: 1826402 - RNA, 17 nt, Human herpesvirus 2
gucugaccacgagcaca

SEQ ID NO: 1826403 - RNA, 12 nt, Human herpesvirus 2
caccccacccua

SEQ ID NO: 1826404 - RNA, 13 nt, Human herpesvirus 2
cugcacuuuauug

SEQ ID NO: 1826405 - RNA, 16 nt, Human herpesvirus 2
uucaauagauuuccca

SEQ ID NO: 1826406 - RNA, 17 nt, Human herpesvirus 2
uggagaagggaaaggaa

SEQ ID NO: 1826407 - RNA, 14 nt, Human herpesvirus 2
gggaagucucuugg

SEQ ID NO: 1826408 - RNA, 19 nt, Human herpesvirus 2
cauccgaucgaugagccgg

SEQ ID NO: 1826409 - RNA, 13 nt, Human herpesvirus 2
ucguggcccuccu

SEQ ID NO: 1826410 - RNA, 17 nt, Human herpesvirus 2
gcccgggguucuggggg

SEQ ID NO: 1826411 - RNA, 23 nt, Human herpesvirus 2
cggggcgugucuguccguugccc

SEQ ID NO: 1826412 - RNA, 18 nt, Human herpesvirus 2
ucgccucucuucuucccc

SEQ ID NO: 1826413 - RNA, 20 nt, Human herpesvirus 2
cagacccgagcuccggggga

SEQ ID NO: 1826414 - RNA, 12 nt, Human herpesvirus 2
gucccgcccgcc

SEQ ID NO: 1826415 - RNA, 17 nt, Human herpesvirus 2
gugagucacggcaaccc

SEQ ID NO: 1826416 - RNA, 17 nt, Human herpesvirus 2
auccucaaacaggccau

SEQ ID NO: 1826417 - RNA, 19 nt, Human herpesvirus 2
ucaccuggggcuccugcgc

SEQ ID NO: 1826418 - RNA, 13 nt, Human herpesvirus 2
gccgcugugccag

SEQ ID NO: 1826419 - RNA, 20 nt, Human herpesvirus 2
cgugcugggcgcgagccagg

SEQ ID NO: 1826420 - RNA, 16 nt, Human herpesvirus 2
gacaacugccugaccc

SEQ ID NO: 1826421 - RNA, 19 nt, Human herpesvirus 2
accggcgccgaucgcagcg

SEQ ID NO: 1826422 - RNA, 17 nt, Human herpesvirus 2
cgggggaggggggagau

SEQ ID NO: 1826423 - RNA, 14 nt, Human herpesvirus 2
gacagcggggaccc

SEQ ID NO: 1826424 - RNA, 20 nt, Human herpesvirus 2
uccuuggaauuccagcagcu

SEQ ID NO: 1826425 - RNA, 17 nt, Human herpesvirus 2
gcaaccaaaucaccccc

SEQ ID NO: 1826426 - RNA, 17 nt, Human herpesvirus 2
cgggggucgggcgggcg

SEQ ID NO: 1826427 - RNA, 20 nt, Human herpesvirus 2
uugaccgccgccggggggcg

SEQ ID NO: 1826428 - RNA, 23 nt, Human herpesvirus 2
gcggaggggaucagcaaccaggc

SEQ ID NO: 1826429 - RNA, 14 nt, Human herpesvirus 2
ugcccgcgggucug

SEQ ID NO: 1826430 - RNA, 18 nt, Human herpesvirus 2
cccggcggccccccgcgc

SEQ ID NO: 1826431 - RNA, 18 nt, Human herpesvirus 2
gccgcuguggcccuggcg

SEQ ID NO: 1826432 - RNA, 14 nt, Human herpesvirus 2
ccucaaacaggcca

SEQ ID NO: 1826433 - RNA, 16 nt, Human herpesvirus 2
cgacccuguggcgggc

SEQ ID NO: 1826434 - RNA, 15 nt, Human herpesvirus 2
acgagcgcgcugccg

SEQ ID NO: 1826435 - RNA, 20 nt, Human herpesvirus 2
ucgccccacacgccuuccag

SEQ ID NO: 1826436 - RNA, 15 nt, Human herpesvirus 2
gccgacaacugccug

SEQ ID NO: 1826437 - RNA, 23 nt, Human herpesvirus 2
cgaccgguuucgguuccacucua

SEQ ID NO: 1826438 - RNA, 13 nt, Human herpesvirus 2
gaccgaucuggag

SEQ ID NO: 1826439 - RNA, 23 nt, Human herpesvirus 2
ccucuaucaugucuuuccaccac

SEQ ID NO: 1826440 - RNA, 17 nt, Human herpesvirus 2
ccggccgccauccccgc

SEQ ID NO: 1826441 - RNA, 21 nt, Human herpesvirus 2
caccagagccgaacgcagguc

SEQ ID NO: 1826442 - RNA, 16 nt, Human herpesvirus 2
auucucaccuggggcu

SEQ ID NO: 1826443 - RNA, 21 nt, Human herpesvirus 2
acgcgcuguggcgcgcccccg

SEQ ID NO: 1826444 - RNA, 19 nt, Human herpesvirus 2
cagcaccaccaccccccca

SEQ ID NO: 1826445 - RNA, 21 nt, Human herpesvirus 2
cguuauuuccaaacagggccu

SEQ ID NO: 1826446 - RNA, 19 nt, Human herpesvirus 2
gucugcguggggacgaggc

SEQ ID NO: 1826447 - RNA, 23 nt, Human herpesvirus 2
uccgggguuuccccggcccaccc

SEQ ID NO: 1826448 - RNA, 22 nt, Human herpesvirus 2
ccguguuagggaagucucuugg

SEQ ID NO: 1826449 - RNA, 19 nt, Human herpesvirus 2
accacguguccccagggag

SEQ ID NO: 1826450 - RNA, 20 nt, Human herpesvirus 2
ggucuuuccguggcgccugg

SEQ ID NO: 1826451 - RNA, 15 nt, Human herpesvirus 2
cgacaucaaccaccu

SEQ ID NO: 1826452 - RNA, 16 nt, Human herpesvirus 2
ccgcgggaggcggugg

SEQ ID NO: 1826453 - RNA, 17 nt, Human herpesvirus 2
ugggggcccaggucccc

SEQ ID NO: 1826454 - RNA, 16 nt, Human herpesvirus 2
acccuagccuucggcc

SEQ ID NO: 1826455 - RNA, 15 nt, Human herpesvirus 2
ggcguugcugcgcug

SEQ ID NO: 1826456 - RNA, 18 nt, Human herpesvirus 2
guacccggcagagagauu

SEQ ID NO: 1826457 - RNA, 13 nt, Human herpesvirus 2
aggcgccucugcc

SEQ ID NO: 1826458 - RNA, 17 nt, Human herpesvirus 2
caaagaaauagaagaaa

SEQ ID NO: 1826459 - RNA, 13 nt, Human herpesvirus 2
cacgggcgucccc

SEQ ID NO: 1826460 - RNA, 21 nt, Human herpesvirus 2
gcccacgaauuugacgucgug

SEQ ID NO: 1826461 - RNA, 22 nt, Human herpesvirus 2
caaaaauacacaugacuucugg

SEQ ID NO: 1826462 - RNA, 19 nt, Human herpesvirus 2
cugcccgcggaccaccggg

SEQ ID NO: 1826463 - RNA, 20 nt, Human herpesvirus 2
gucgccaacggccagcgggg

SEQ ID NO: 1826464 - RNA, 13 nt, Human herpesvirus 2
augggcucggcgu

SEQ ID NO: 1826465 - RNA, 19 nt, Human herpesvirus 2
gggggaugguggugggccu

SEQ ID NO: 1826466 - RNA, 15 nt, Human herpesvirus 2
cuuuccaccccccuu

SEQ ID NO: 1826467 - RNA, 15 nt, Human herpesvirus 2
cuguuguuguuucug

SEQ ID NO: 1826468 - RNA, 19 nt, Human herpesvirus 2
gccaaaccagccccgcagg

SEQ ID NO: 1826469 - RNA, 23 nt, Human herpesvirus 2
gcgggcucguguuggccaccaac

SEQ ID NO: 1826470 - RNA, 20 nt, Human herpesvirus 2
accgcacccgggccggguga

SEQ ID NO: 1826471 - RNA, 13 nt, Human herpesvirus 2
gaggcggacccag

SEQ ID NO: 1826472 - RNA, 20 nt, Human herpesvirus 2
gugcccuggguccgggggcc

SEQ ID NO: 1826473 - RNA, 21 nt, Human herpesvirus 2
gacgggcgccacgguggugca

SEQ ID NO: 1826474 - RNA, 20 nt, Human herpesvirus 2
acuauggggggggaaaggaa

SEQ ID NO: 1826475 - RNA, 14 nt, Human herpesvirus 2
acccacccucggug

SEQ ID NO: 1826476 - RNA, 20 nt, Human herpesvirus 2
uggccggguuuuuggcccug

SEQ ID NO: 1826477 - RNA, 18 nt, Human herpesvirus 2
gcaucgcaagccacccug

SEQ ID NO: 1826478 - RNA, 23 nt, Human herpesvirus 2
ccgcgacggccccggccgccucc

SEQ ID NO: 1826479 - RNA, 14 nt, Human herpesvirus 2
cgcucgcucuccgu

SEQ ID NO: 1826480 - RNA, 10 nt, Human herpesvirus 2
cccccucucu

SEQ ID NO: 1826481 - RNA, 17 nt, Human herpesvirus 2
aggcuucccccccgcca

SEQ ID NO: 1826482 - RNA, 13 nt, Human herpesvirus 2
ccugcggcaggcg

SEQ ID NO: 1826483 - RNA, 16 nt, Human herpesvirus 2
cgggaggggcuuggcc

SEQ ID NO: 1826484 - RNA, 21 nt, Human herpesvirus 2
gcuggcaccguaucagcaccc

SEQ ID NO: 1826485 - RNA, 14 nt, Human herpesvirus 2
ggagauggggagag

SEQ ID NO: 1826486 - RNA, 14 nt, Human herpesvirus 2
gcccgcguccccgg

SEQ ID NO: 1826487 - RNA, 10 nt, Human herpesvirus 2
uaaggcaggg

SEQ ID NO: 1826488 - RNA, 16 nt, Human herpesvirus 2
cucgaacacgagccgc

SEQ ID NO: 1826489 - RNA, 14 nt, Human herpesvirus 2
cgcgcgcgcgcuuc

SEQ ID NO: 1826490 - RNA, 14 nt, Human herpesvirus 2
gcggcgcgagcucc

SEQ ID NO: 1826491 - RNA, 23 nt, Human herpesvirus 2
gguggcccuuccggaccccgacc

SEQ ID NO: 1826492 - RNA, 22 nt, Human herpesvirus 2
cgguagugcaggugggccgacg

SEQ ID NO: 1826493 - RNA, 13 nt, Human herpesvirus 2
ggccacacagaga

SEQ ID NO: 1826494 - RNA, 18 nt, Human herpesvirus 2
uccgggagcgggggaggg

SEQ ID NO: 1826495 - RNA, 15 nt, Human herpesvirus 2
caccacccccccacu

SEQ ID NO: 1826496 - RNA, 19 nt, Human herpesvirus 2
aagucucuuggggaaaucu

SEQ ID NO: 1826497 - RNA, 14 nt, Human herpesvirus 2
gcgcucgcucuccg

SEQ ID NO: 1826498 - RNA, 13 nt, Human herpesvirus 2
gcuccccuucagc

SEQ ID NO: 1826499 - RNA, 19 nt, Human herpesvirus 2
ugccuccacgcccugcugu

SEQ ID NO: 1826500 - RNA, 13 nt, Human herpesvirus 2
cugcugggccaug

SEQ ID NO: 1826501 - RNA, 16 nt, Human herpesvirus 2
guccccggugucuccg

SEQ ID NO: 1826502 - RNA, 12 nt, Human herpesvirus 2
ccgccgcccgcg

SEQ ID NO: 1826503 - RNA, 20 nt, Human herpesvirus 2
gcgaugaccucccggcccgc

SEQ ID NO: 1826504 - RNA, 19 nt, Human herpesvirus 2
cagccuacaucaccccagg

SEQ ID NO: 1826505 - RNA, 22 nt, Human herpesvirus 2
gcggggucgagcgcgccaggac

SEQ ID NO: 1826506 - RNA, 17 nt, Human herpesvirus 2
cacguguccccagggag

SEQ ID NO: 1826507 - RNA, 20 nt, Human herpesvirus 2
cucauacacgcgcuggcccc

SEQ ID NO: 1826508 - RNA, 16 nt, Human herpesvirus 2
guucggcaggcccgcc

SEQ ID NO: 1826509 - RNA, 16 nt, Human herpesvirus 2
uuacgcaggcccucgc

SEQ ID NO: 1826510 - RNA, 19 nt, Human herpesvirus 2
gucgccggcgacacccacc

SEQ ID NO: 1826511 - RNA, 17 nt, Human herpesvirus 2
cugguuuuucugggggu

SEQ ID NO: 1826512 - RNA, 15 nt, Human herpesvirus 2
cgggguucugggggu

SEQ ID NO: 1826513 - RNA, 13 nt, Human herpesvirus 2
caccgcaccacca

SEQ ID NO: 1826514 - RNA, 18 nt, Human herpesvirus 2
aaccagccccgcaggcag

SEQ ID NO: 1826515 - RNA, 12 nt, Human herpesvirus 2
aaacaggcaccg

SEQ ID NO: 1826516 - RNA, 15 nt, Human herpesvirus 2
cagcacggcggccag

SEQ ID NO: 1826517 - RNA, 21 nt, Human herpesvirus 2
guccccuacgccccccucggc

SEQ ID NO: 1826518 - RNA, 15 nt, Human herpesvirus 2
cuggccccucugcuu

SEQ ID NO: 1826519 - RNA, 13 nt, Human herpesvirus 2
uggcccagcgcac

SEQ ID NO: 1826520 - RNA, 14 nt, Human herpesvirus 2
acacacaccccccu

SEQ ID NO: 1826521 - RNA, 16 nt, Human herpesvirus 2
gggggcccaggucccc

SEQ ID NO: 1826522 - RNA, 15 nt, Human herpesvirus 2
cacaugacuucuggu

SEQ ID NO: 1826523 - RNA, 18 nt, Human herpesvirus 2
cucccguguaccucuggg

SEQ ID NO: 1826524 - RNA, 21 nt, Human herpesvirus 2
ugacgcggcccaaggcgcugc

SEQ ID NO: 1826525 - RNA, 17 nt, Human herpesvirus 2
uguuggaucccuuugug

SEQ ID NO: 1826526 - RNA, 23 nt, Human herpesvirus 2
gucuucccgggaaaccacacaca

SEQ ID NO: 1826527 - RNA, 19 nt, Human herpesvirus 2
ugauggggacgacgggcgc

SEQ ID NO: 1826528 - RNA, 14 nt, Human herpesvirus 2
cugggucagcucau

SEQ ID NO: 1826529 - RNA, 16 nt, Human herpesvirus 2
gccaagcgccccgcgg

SEQ ID NO: 1826530 - RNA, 17 nt, Human herpesvirus 2
cgcccccgcuggcggga

SEQ ID NO: 1826531 - RNA, 20 nt, Human herpesvirus 2
ggggcaccaaaaaccagguc

SEQ ID NO: 1826532 - RNA, 12 nt, Human herpesvirus 2
cgcgggggccgg

SEQ ID NO: 1826533 - RNA, 19 nt, Human herpesvirus 2
cuccucgcggaguaugacc

SEQ ID NO: 1826534 - RNA, 21 nt, Human herpesvirus 2
cggcgaccgccccgcgccggc

SEQ ID NO: 1826535 - RNA, 17 nt, Human herpesvirus 2
ccugaguugcgccggca

SEQ ID NO: 1826536 - RNA, 16 nt, Human herpesvirus 2
ccuccgcccuccgcca

SEQ ID NO: 1826537 - RNA, 23 nt, Human herpesvirus 2
cuagcggccgggucggcugucca

SEQ ID NO: 1826538 - RNA, 13 nt, Human herpesvirus 2
acacacuuuguug

SEQ ID NO: 1826539 - RNA, 14 nt, Human herpesvirus 2
cgacgugccgggga

SEQ ID NO: 1826540 - RNA, 18 nt, Human herpesvirus 2
ggucacaaaaggcacggc

SEQ ID NO: 1826541 - RNA, 20 nt, Human herpesvirus 2
acgcgucgggggccggggcg

SEQ ID NO: 1826542 - RNA, 21 nt, Human herpesvirus 2
ggccggggagggcagggccgc

SEQ ID NO: 1826543 - RNA, 15 nt, Human herpesvirus 2
caaaaaaaagaaaca

SEQ ID NO: 1826544 - RNA, 21 nt, Human herpesvirus 2
agcccgaacggaaggccuccc

SEQ ID NO: 1826545 - RNA, 15 nt, Human herpesvirus 2
ccgguaugcccggcc

SEQ ID NO: 1826546 - RNA, 10 nt, Human herpesvirus 2
cacagccacc

SEQ ID NO: 1826547 - RNA, 17 nt, Human herpesvirus 2
acgagaagccgccccca

SEQ ID NO: 1826548 - RNA, 18 nt, Human herpesvirus 2
ucguggcauggaagcccc

SEQ ID NO: 1826549 - RNA, 21 nt, Human herpesvirus 2
cagcguaacgcacccccggac

SEQ ID NO: 1826550 - RNA, 14 nt, Human herpesvirus 2
acaucaagcccaca

SEQ ID NO: 1826551 - RNA, 19 nt, Human herpesvirus 2
ccgugaugucgggcguggg

SEQ ID NO: 1826552 - RNA, 18 nt, Human herpesvirus 2
aucuuggcguuauuucca

SEQ ID NO: 1826553 - RNA, 14 nt, Human herpesvirus 2
gccagugcauccca

SEQ ID NO: 1826554 - RNA, 17 nt, Human herpesvirus 2
cauccgacggcaugcag

SEQ ID NO: 1826555 - RNA, 15 nt, Human herpesvirus 2
gucugucgcgacgcc

SEQ ID NO: 1826556 - RNA, 20 nt, Human herpesvirus 2
cggggcgcgccucugaccca

SEQ ID NO: 1826557 - RNA, 20 nt, Human herpesvirus 2
gccgggucaccggggcgccc

SEQ ID NO: 1826558 - RNA, 22 nt, Human herpesvirus 2
acggacaaccgagcgccgggca

SEQ ID NO: 1826559 - RNA, 17 nt, Human herpesvirus 2
cggucccuuccccacca

SEQ ID NO: 1826560 - RNA, 23 nt, Human herpesvirus 2
cgcccaggcccuggcgcaccugc

SEQ ID NO: 1826561 - RNA, 17 nt, Human herpesvirus 2
gccguggacgcccccuc

SEQ ID NO: 1826562 - RNA, 11 nt, Human herpesvirus 2
cgagcucccug

SEQ ID NO: 1826563 - RNA, 12 nt, Human herpesvirus 2
cgcagaccaccu

SEQ ID NO: 1826564 - RNA, 20 nt, Human herpesvirus 2
cugugccagguggcccuucc

SEQ ID NO: 1826565 - RNA, 22 nt, Human herpesvirus 2
gggcuuguguauaaauaaaaag

SEQ ID NO: 1826566 - RNA, 13 nt, Human herpesvirus 2
ccccgcgcacgcg

SEQ ID NO: 1826567 - RNA, 19 nt, Human herpesvirus 2
acguucggacggccccucg

SEQ ID NO: 1826568 - RNA, 17 nt, Human herpesvirus 2
ccgacggcggggccccg

SEQ ID NO: 1826569 - RNA, 12 nt, Human herpesvirus 2
ccggucucccuc

SEQ ID NO: 1826570 - RNA, 9 nt, Human herpesvirus 2
ggccgccgg

SEQ ID NO: 1826571 - RNA, 22 nt, Human herpesvirus 2
uucuucgcgggcaggccgcggc

SEQ ID NO: 1826572 - RNA, 19 nt, Human herpesvirus 2
gcguuccuucccuuucccc

SEQ ID NO: 1826573 - RNA, 18 nt, Human herpesvirus 2
ccuuuccaccccccuucc

SEQ ID NO: 1826574 - RNA, 19 nt, Human herpesvirus 2
acuuccgugccccuggacu

SEQ ID NO: 1826575 - RNA, 20 nt, Human herpesvirus 2
agaggucaauagauuucccc

SEQ ID NO: 1826576 - RNA, 19 nt, Human herpesvirus 2
guggaugccggggccgugg

SEQ ID NO: 1826577 - RNA, 18 nt, Human herpesvirus 2
ggaggaggcggcgccugc

SEQ ID NO: 1826578 - RNA, 22 nt, Human herpesvirus 2
uuuugccucccaacgcccccuu

SEQ ID NO: 1826579 - RNA, 15 nt, Human herpesvirus 2
cggguauaagggcag

SEQ ID NO: 1826580 - RNA, 22 nt, Human herpesvirus 2
cccgggggggggcaagugcagu

SEQ ID NO: 1826581 - RNA, 16 nt, Human herpesvirus 2
gaggcuggagcgcugg

SEQ ID NO: 1826582 - RNA, 23 nt, Human herpesvirus 2
ucucuucuuuccccccccccucc

SEQ ID NO: 1826583 - RNA, 16 nt, Human herpesvirus 2
gccuccgcccuccgcc

SEQ ID NO: 1826584 - RNA, 21 nt, Human herpesvirus 2
ccgcaauaaacgccuucccgg

SEQ ID NO: 1826585 - RNA, 14 nt, Human herpesvirus 2
ccuggggcuccugc

SEQ ID NO: 1826586 - RNA, 17 nt, Human herpesvirus 2
cugcccgcggaccaccg

SEQ ID NO: 1826587 - RNA, 19 nt, Human herpesvirus 2
ggccucgcccgucccggca

SEQ ID NO: 1826588 - RNA, 23 nt, Human herpesvirus 2
cggcaauaaaagaacagaauaaa

SEQ ID NO: 1826589 - RNA, 14 nt, Human herpesvirus 2
uacaccccacccua

SEQ ID NO: 1826590 - RNA, 18 nt, Human herpesvirus 2
cuccgccagcgcccuucc

SEQ ID NO: 1826591 - RNA, 15 nt, Human herpesvirus 2
gaacugauugccauc

SEQ ID NO: 1826592 - RNA, 15 nt, Human herpesvirus 2
ggcggcgccgcgccc

SEQ ID NO: 1826593 - RNA, 17 nt, Human herpesvirus 2
cggccacgucguccggg

SEQ ID NO: 1826594 - RNA, 22 nt, Human herpesvirus 2
gcacgcgcgcaggcuggagcuc

SEQ ID NO: 1826595 - RNA, 22 nt, Human herpesvirus 2
ucgccccacggaccuccgggac

SEQ ID NO: 1826596 - RNA, 13 nt, Human herpesvirus 2
gugccgcagacca

SEQ ID NO: 1826597 - RNA, 18 nt, Human herpesvirus 2
ccgccccagggggcggcg

SEQ ID NO: 1826598 - RNA, 20 nt, Human herpesvirus 2
gagccaaaccagccccgcag

SEQ ID NO: 1826599 - RNA, 16 nt, Human herpesvirus 2
cgcacccccggacccc

SEQ ID NO: 1826600 - RNA, 13 nt, Human herpesvirus 2
ccgucgcuccggc

SEQ ID NO: 1826601 - RNA, 13 nt, Human herpesvirus 2
acgacgccuggcg

SEQ ID NO: 1826602 - RNA, 13 nt, Human herpesvirus 2
gggcagugcagua

SEQ ID NO: 1826603 - RNA, 17 nt, Human herpesvirus 2
cagacccgagcuccggg

SEQ ID NO: 1826604 - RNA, 15 nt, Human herpesvirus 2
acgagccaaaccagc

SEQ ID NO: 1826605 - RNA, 18 nt, Human herpesvirus 2
augcgacgccgccccugc

SEQ ID NO: 1826606 - RNA, 19 nt, Human herpesvirus 2
cgccuuccgacgcucucug

SEQ ID NO: 1826607 - RNA, 14 nt, Human herpesvirus 2
cgcgggccguggcc

SEQ ID NO: 1826608 - RNA, 21 nt, Human herpesvirus 2
caccacguguccccagggagc

SEQ ID NO: 1826609 - RNA, 14 nt, Human herpesvirus 2
gggcggcguggccg

SEQ ID NO: 1826610 - RNA, 16 nt, Human herpesvirus 2
cagcacggccggguga

SEQ ID NO: 1826611 - RNA, 17 nt, Human herpesvirus 2
gcaugcgacggcgucuc

SEQ ID NO: 1826612 - RNA, 14 nt, Human herpesvirus 2
aauacaccagagcc

SEQ ID NO: 1826613 - RNA, 17 nt, Human herpesvirus 2
uguggcggucggccagc

SEQ ID NO: 1826614 - RNA, 14 nt, Human herpesvirus 2
cgaucgugcugcgc

SEQ ID NO: 1826615 - RNA, 21 nt, Human herpesvirus 2
ugcagcgcgggcgacgggcgg

SEQ ID NO: 1826616 - RNA, 16 nt, Human herpesvirus 2
uccucaccgagccgcu

SEQ ID NO: 1826617 - RNA, 14 nt, Human herpesvirus 2
ccccgcgcaggggg

SEQ ID NO: 1826618 - RNA, 15 nt, Human herpesvirus 2
cccuguuggagccgg

SEQ ID NO: 1826619 - RNA, 21 nt, Human herpesvirus 2
ccgggguuuccccggcccacc

SEQ ID NO: 1826620 - RNA, 17 nt, Human herpesvirus 2
cggacacccccccccau

SEQ ID NO: 1826621 - RNA, 18 nt, Human herpesvirus 2
gccgagcgucaggcccgc

SEQ ID NO: 1826622 - RNA, 23 nt, Human herpesvirus 2
gcgaccgucuuugggccccgccc

SEQ ID NO: 1826623 - RNA, 21 nt, Human herpesvirus 2
aggauggguccgacgaggccu

SEQ ID NO: 1826624 - RNA, 17 nt, Human herpesvirus 2
caucgccaacucugucu

SEQ ID NO: 1826625 - RNA, 13 nt, Human herpesvirus 2
gcccagcacaggc

SEQ ID NO: 1826626 - RNA, 23 nt, Human herpesvirus 2
caacgcgaccgucgccgccggcc

SEQ ID NO: 1826627 - RNA, 14 nt, Human herpesvirus 2
uguggggccccggc

SEQ ID NO: 1826628 - RNA, 13 nt, Human herpesvirus 2
ggucccccggacc

SEQ ID NO: 1826629 - RNA, 19 nt, Human herpesvirus 2
gaagugccgcacggccgug

SEQ ID NO: 1826630 - RNA, 19 nt, Human herpesvirus 2
ccagcugcuggccaaacau

SEQ ID NO: 1826631 - RNA, 15 nt, Human herpesvirus 2
ccgggcagccgggcc

SEQ ID NO: 1826632 - RNA, 12 nt, Human herpesvirus 2
ccccccccuucc

SEQ ID NO: 1826633 - RNA, 20 nt, Human herpesvirus 2
cggguuccccgagagcccag

SEQ ID NO: 1826634 - RNA, 21 nt, Human herpesvirus 2
cggggaagaugacguacagca

SEQ ID NO: 1826635 - RNA, 22 nt, Human herpesvirus 2
cccacggucagucuggucucag

SEQ ID NO: 1826636 - RNA, 13 nt, Human herpesvirus 2
ucgccggggaccg

SEQ ID NO: 1826637 - RNA, 16 nt, Human herpesvirus 2
ugucucgcggcccggc

SEQ ID NO: 1826638 - RNA, 14 nt, Human herpesvirus 2
gccgcggccauccu

SEQ ID NO: 1826639 - RNA, 12 nt, Human herpesvirus 2
ccgccgccggga

SEQ ID NO: 1826640 - RNA, 14 nt, Human herpesvirus 2
ggaugggcggggcc

SEQ ID NO: 1826641 - RNA, 16 nt, Human herpesvirus 2
ccgcccgaccagcgcc

SEQ ID NO: 1826642 - RNA, 15 nt, Human herpesvirus 2
ugugcguaugugaua

SEQ ID NO: 1826643 - RNA, 14 nt, Human herpesvirus 2
ugccagguggcccu

SEQ ID NO: 1826644 - RNA, 17 nt, Human herpesvirus 2
cgguggggccggcgguc

SEQ ID NO: 1826645 - RNA, 21 nt, Human herpesvirus 2
accucgucgcgcgcaucgcca

SEQ ID NO: 1826646 - RNA, 14 nt, Human herpesvirus 2
ccccagggcuucgu

SEQ ID NO: 1826647 - RNA, 17 nt, Human herpesvirus 2
gcgacccgccgggggcg

SEQ ID NO: 1826648 - RNA, 20 nt, Human herpesvirus 2
gugucgaccgcugucgcccc

SEQ ID NO: 1826649 - RNA, 19 nt, Human herpesvirus 2
uggcgucggcggccccggc

SEQ ID NO: 1826650 - RNA, 14 nt, Human herpesvirus 2
gacgauuagccacc

SEQ ID NO: 1826651 - RNA, 23 nt, Human herpesvirus 2
uccgccagcgcccuuccgcgucc

SEQ ID NO: 1826652 - RNA, 20 nt, Human herpesvirus 2
cagcucccccgcgcaggggg

SEQ ID NO: 1826653 - RNA, 17 nt, Human herpesvirus 2
cgggggauggugguggg

SEQ ID NO: 1826654 - RNA, 14 nt, Human herpesvirus 2
cacgacccgccucg

SEQ ID NO: 1826655 - RNA, 23 nt, Human herpesvirus 2
auaacuuugguugucgccacacg

SEQ ID NO: 1826656 - RNA, 16 nt, Human herpesvirus 2
cucaccgcgcccgggc

SEQ ID NO: 1826657 - RNA, 21 nt, Human herpesvirus 2
cugggggcggggggugggagg

SEQ ID NO: 1826658 - RNA, 15 nt, Human herpesvirus 2
ccccagcuuucccuc

SEQ ID NO: 1826659 - RNA, 22 nt, Human herpesvirus 2
aaacgcgcgcccccauccccuc

SEQ ID NO: 1826660 - RNA, 22 nt, Human herpesvirus 2
gcccgccauuuaggauggcugc

SEQ ID NO: 1826661 - RNA, 19 nt, Human herpesvirus 2
ccauauguacgcguacccc

SEQ ID NO: 1826662 - RNA, 18 nt, Human herpesvirus 2
cgguccucaccgagccgc

SEQ ID NO: 1826663 - RNA, 22 nt, Human herpesvirus 2
cuacugcgccaccguccaccuc

SEQ ID NO: 1826664 - RNA, 15 nt, Human herpesvirus 2
ccgcacccgggccgg

SEQ ID NO: 1826665 - RNA, 13 nt, Human herpesvirus 2
ccaguuccucagu

SEQ ID NO: 1826666 - RNA, 19 nt, Human herpesvirus 2
uccccaggcgacgccaggc

SEQ ID NO: 1826667 - RNA, 15 nt, Human herpesvirus 2
cuuuuucucuucccc

SEQ ID NO: 1826668 - RNA, 17 nt, Human herpesvirus 2
ucuccauuccuguuucc

SEQ ID NO: 1826669 - RNA, 20 nt, Human herpesvirus 2
gcggccagccgcccccgccg

SEQ ID NO: 1826670 - RNA, 17 nt, Human herpesvirus 2
cccuccgccagcgcccu

SEQ ID NO: 1826671 - RNA, 22 nt, Human herpesvirus 2
ccgucgcuccggcucccggccc

SEQ ID NO: 1826672 - RNA, 21 nt, Human herpesvirus 2
ggacgacgggcgcccccgccu

SEQ ID NO: 1826673 - RNA, 21 nt, Human herpesvirus 2
cagcaaccaggcgcugcugcg

SEQ ID NO: 1826674 - RNA, 21 nt, Human herpesvirus 2
cccgccgggucaccggggcgc

SEQ ID NO: 1826675 - RNA, 13 nt, Human herpesvirus 2
ccgacucccuccg

SEQ ID NO: 1826676 - RNA, 14 nt, Human herpesvirus 2
ccccgauuccggug

SEQ ID NO: 1826677 - RNA, 16 nt, Human herpesvirus 2
ccgggcccggccgccg

SEQ ID NO: 1826678 - RNA, 14 nt, Human herpesvirus 2
guggcggaggccug

SEQ ID NO: 1826679 - RNA, 12 nt, Human herpesvirus 2
cugcgcaggucc

SEQ ID NO: 1826680 - RNA, 14 nt, Human herpesvirus 2
cgcuguggcgcgcc

SEQ ID NO: 1826681 - RNA, 17 nt, Human herpesvirus 2
gcacgugcgucuuccca

SEQ ID NO: 1826682 - RNA, 22 nt, Human herpesvirus 2
ccccggcggggcauggaccccc

SEQ ID NO: 1826683 - RNA, 15 nt, Human herpesvirus 2
accgcucacccaccc

SEQ ID NO: 1826684 - RNA, 21 nt, Human herpesvirus 2
ggccgagcguaucggccagga

SEQ ID NO: 1826685 - RNA, 20 nt, Human herpesvirus 2
ccucuguuccuuucccuucu

SEQ ID NO: 1826686 - RNA, 19 nt, Human herpesvirus 2
gccgcaucaguccgcgcgg

SEQ ID NO: 1826687 - RNA, 22 nt, Human herpesvirus 2
uuguaaaacgcgggcgggggcg

SEQ ID NO: 1826688 - RNA, 22 nt, Human herpesvirus 2
ccgugucgcuccccuucagccu

SEQ ID NO: 1826689 - RNA, 24 nt, Human herpesvirus 2
cucgucgcgcgcaucgccaacucu

SEQ ID NO: 1826690 - RNA, 19 nt, Human herpesvirus 2
uggagcucugccugcacga

SEQ ID NO: 1826691 - RNA, 18 nt, Human herpesvirus 2
gugcacagccuggccgug

SEQ ID NO: 1826692 - RNA, 17 nt, Human herpesvirus 2
gguccggguaaaaaaga

SEQ ID NO: 1826693 - RNA, 20 nt, Human herpesvirus 2
gaaacuuccgggagcggggg

SEQ ID NO: 1826694 - RNA, 11 nt, Human herpesvirus 2
uguuucaucau

SEQ ID NO: 1826695 - RNA, 20 nt, Human herpesvirus 2
gcguacagccuacaucaccc

SEQ ID NO: 1826696 - RNA, 22 nt, Human herpesvirus 2
ggccaucgccggggaccgcagu

SEQ ID NO: 1826697 - RNA, 14 nt, Human herpesvirus 2
cggggggggccucg

SEQ ID NO: 1826698 - RNA, 18 nt, Human herpesvirus 2
gccgcccaagcggcccga

SEQ ID NO: 1826699 - RNA, 12 nt, Human herpesvirus 2
uacaccccaccc

SEQ ID NO: 1826700 - RNA, 13 nt, Human herpesvirus 2
ucccagggcacca

SEQ ID NO: 1826701 - RNA, 15 nt, Human herpesvirus 2
cggcaugcagcccag

SEQ ID NO: 1826702 - RNA, 16 nt, Human herpesvirus 2
ccguccuuuccacccc

SEQ ID NO: 1826703 - RNA, 18 nt, Human herpesvirus 2
cauccgacggcaugcagc

SEQ ID NO: 1826704 - RNA, 15 nt, Human herpesvirus 2
cgugcgucuucccag

SEQ ID NO: 1826705 - RNA, 12 nt, Human herpesvirus 2
uggggggggucg

SEQ ID NO: 1826706 - RNA, 19 nt, Human herpesvirus 2
ggcuuugguguuuuuggca

SEQ ID NO: 1826707 - RNA, 13 nt, Human herpesvirus 2
gagccgcaggaac

SEQ ID NO: 1826708 - RNA, 23 nt, Human herpesvirus 2
acuugacggucgccacucuccug

SEQ ID NO: 1826709 - RNA, 21 nt, Human herpesvirus 2
gguguuuuuggcaccuugccg

SEQ ID NO: 1826710 - RNA, 18 nt, Human herpesvirus 2
ggggaugggggggaaggg

SEQ ID NO: 1826711 - RNA, 20 nt, Human herpesvirus 2
agcguaacgcacccccggac

SEQ ID NO: 1826712 - RNA, 20 nt, Human herpesvirus 2
acugggguacugcacugccc

SEQ ID NO: 1826713 - RNA, 20 nt, Human herpesvirus 2
cucauaaaaaucgugaguca

SEQ ID NO: 1826714 - RNA, 14 nt, Human herpesvirus 2
ggcccggcgccgcc

SEQ ID NO: 1826715 - RNA, 15 nt, Human herpesvirus 2
gacuuccgugccccu

SEQ ID NO: 1826716 - RNA, 17 nt, Human herpesvirus 2
ccggggggucggcaugc

SEQ ID NO: 1826717 - RNA, 21 nt, Human herpesvirus 2
cgaggugucccgccugugugc

SEQ ID NO: 1826718 - RNA, 17 nt, Human herpesvirus 2
cagugcaguaccccagu

SEQ ID NO: 1826719 - RNA, 10 nt, Human herpesvirus 2
ucgggccccu

SEQ ID NO: 1826720 - RNA, 16 nt, Human herpesvirus 2
gcggcgacggcaccgc

SEQ ID NO: 1826721 - RNA, 21 nt, Human herpesvirus 2
acgacagcggggacccgggcg

SEQ ID NO: 1826722 - RNA, 19 nt, Human herpesvirus 2
gggccuuuuuucggacggu

SEQ ID NO: 1826723 - RNA, 20 nt, Human herpesvirus 2
cuuuucccccuacccuuccc

SEQ ID NO: 1826724 - RNA, 14 nt, Human herpesvirus 2
ggucuguggguggu

SEQ ID NO: 1826725 - RNA, 20 nt, Human herpesvirus 2
gaucccgaagccaucugaag

SEQ ID NO: 1826726 - RNA, 14 nt, Human herpesvirus 2
ccuccgaggagauc

SEQ ID NO: 1826727 - RNA, 13 nt, Human herpesvirus 2
guucggggccagg

SEQ ID NO: 1826728 - RNA, 23 nt, Human herpesvirus 2
augucuguuucaauaaaaaguaa

SEQ ID NO: 1826729 - RNA, 14 nt, Human herpesvirus 2
uugggggggggugg

SEQ ID NO: 1826730 - RNA, 14 nt, Human herpesvirus 2
aguaccccaguucc

SEQ ID NO: 1826731 - RNA, 20 nt, Human herpesvirus 2
cgacgacgccuggcggcccc

SEQ ID NO: 1826732 - RNA, 14 nt, Human herpesvirus 2
cugggguacugcac

SEQ ID NO: 1826733 - RNA, 20 nt, Human herpesvirus 2
cuggcugcggggggcggugg

SEQ ID NO: 1826734 - RNA, 24 nt, Human herpesvirus 2
cagcucucgcgaauugacaagcgg

SEQ ID NO: 1826735 - RNA, 17 nt, Human herpesvirus 2
cccguguaccucugggc

SEQ ID NO: 1826736 - RNA, 14 nt, Human herpesvirus 2
cgacagcggggacc

SEQ ID NO: 1826737 - RNA, 16 nt, Human herpesvirus 2
cgcgacggccccggcc

SEQ ID NO: 1826738 - RNA, 13 nt, Human herpesvirus 2
guccccuggggcg

SEQ ID NO: 1826739 - RNA, 13 nt, Human herpesvirus 2
uuggggaaaucua

SEQ ID NO: 1826740 - RNA, 13 nt, Human herpesvirus 2
cucucgaucccga

SEQ ID NO: 1826741 - RNA, 16 nt, Human herpesvirus 2
ccgccggucucccucu

SEQ ID NO: 1826742 - RNA, 15 nt, Human herpesvirus 2
gcccgaaccccgcgg

SEQ ID NO: 1826743 - RNA, 16 nt, Human herpesvirus 2
caccgcccccgcuggc

SEQ ID NO: 1826744 - RNA, 18 nt, Human herpesvirus 2
cgcgcgguucugacgcgg

SEQ ID NO: 1826745 - RNA, 11 nt, Human herpesvirus 2
uuuuggcccug

SEQ ID NO: 1826746 - RNA, 19 nt, Human herpesvirus 2
gcgcuuauaagagcgggcc

SEQ ID NO: 1826747 - RNA, 16 nt, Human herpesvirus 2
uuucuggucuuccggg

SEQ ID NO: 1826748 - RNA, 17 nt, Human herpesvirus 2
uucuucgccgcccucgc

SEQ ID NO: 1826749 - RNA, 12 nt, Human herpesvirus 2
gaagagcuccaa

SEQ ID NO: 1826750 - RNA, 15 nt, Human herpesvirus 2
gucccgccugugugc

SEQ ID NO: 1826751 - RNA, 19 nt, Human herpesvirus 2
guucagcgcaucaggcuca

SEQ ID NO: 1826752 - RNA, 21 nt, Human herpesvirus 2
ccaggaggggggcagugcagu

SEQ ID NO: 1826753 - RNA, 20 nt, Human herpesvirus 2
aggucugcgcgaggccgcuc

SEQ ID NO: 1826754 - RNA, 18 nt, Human herpesvirus 2
cuucgcugucagcacgcg

SEQ ID NO: 1826755 - RNA, 19 nt, Human herpesvirus 2
gccgccaccccccuccccu

SEQ ID NO: 1826756 - RNA, 15 nt, Human herpesvirus 2
gcccuccgcuacacg

SEQ ID NO: 1826757 - RNA, 15 nt, Human herpesvirus 2
ucuuuccguggcgcc

SEQ ID NO: 1826758 - RNA, 19 nt, Human herpesvirus 2
ccggggcacgcggucagca

SEQ ID NO: 1826759 - RNA, 16 nt, Human herpesvirus 2
ggcccuggcggacggc

SEQ ID NO: 1826760 - RNA, 17 nt, Human herpesvirus 2
ccgagcgccgggcagac

SEQ ID NO: 1826761 - RNA, 21 nt, Human herpesvirus 2
ucgggugacuuggugcgccgc

SEQ ID NO: 1826762 - RNA, 15 nt, Human herpesvirus 2
cgggcgagcuggccc

SEQ ID NO: 1826763 - RNA, 20 nt, Human herpesvirus 2
aguuccuccgugcuggggaa

SEQ ID NO: 1826764 - RNA, 23 nt, Human herpesvirus 2
ggaaagcgucauccgcccgacca

SEQ ID NO: 1826765 - RNA, 21 nt, Human herpesvirus 2
cggcgacccgccgggggcgga

SEQ ID NO: 1826766 - RNA, 20 nt, Human herpesvirus 2
ggcgccuaccugguacccac

SEQ ID NO: 1826767 - RNA, 14 nt, Human herpesvirus 2
uguuucccccccua

SEQ ID NO: 1826768 - RNA, 12 nt, Human herpesvirus 2
ccaucgccgggg

SEQ ID NO: 1826769 - RNA, 12 nt, Human herpesvirus 2
acggucagucug

SEQ ID NO: 1826770 - RNA, 23 nt, Human herpesvirus 2
gaccaccgcggacagccagggcu

SEQ ID NO: 1826771 - RNA, 16 nt, Human herpesvirus 2
ccccgcgugcagcgcg

SEQ ID NO: 1826772 - RNA, 21 nt, Human herpesvirus 2
cccuggguccgggggccuggu

SEQ ID NO: 1826773 - RNA, 23 nt, Human herpesvirus 2
guagccuaucuugaucccccgga

SEQ ID NO: 1826774 - RNA, 12 nt, Human herpesvirus 2
guuacugcacuu

SEQ ID NO: 1826775 - RNA, 12 nt, Human herpesvirus 2
gccaacucuguc

SEQ ID NO: 1826776 - RNA, 12 nt, Human herpesvirus 2
ugcugggguccg

SEQ ID NO: 1826777 - RNA, 23 nt, Human herpesvirus 2
cgccaagcgccccgcggaccccg

SEQ ID NO: 1826778 - RNA, 18 nt, Human herpesvirus 2
gaucgcagcguccggcug

SEQ ID NO: 1826779 - RNA, 14 nt, Human herpesvirus 2
gcccagcacaggca

SEQ ID NO: 1826780 - RNA, 19 nt, Human herpesvirus 2
cgggaggggcgggaggaag

SEQ ID NO: 1826781 - RNA, 19 nt, Human herpesvirus 2
cuuggccguguggucgccc

SEQ ID NO: 1826782 - RNA, 18 nt, Human herpesvirus 2
gugacccccccauggcau

SEQ ID NO: 1826783 - RNA, 19 nt, Human herpesvirus 2
gcuuggaggcccucuggga

SEQ ID NO: 1826784 - RNA, 18 nt, Human herpesvirus 2
ccgcagaccaccucgcgg

SEQ ID NO: 1826785 - RNA, 19 nt, Human herpesvirus 2
cgggcgaaaaggcccggcc

SEQ ID NO: 1826786 - RNA, 18 nt, Human herpesvirus 2
acgugcacagccuggccg

SEQ ID NO: 1826787 - RNA, 19 nt, Human herpesvirus 2
augccguucggaccugggg

SEQ ID NO: 1826788 - RNA, 14 nt, Human herpesvirus 2
cgaaucugggaaga

SEQ ID NO: 1826789 - RNA, 15 nt, Human herpesvirus 2
gaccggcggggcccc

SEQ ID NO: 1826790 - RNA, 12 nt, Human herpesvirus 2
agggcagggccg

SEQ ID NO: 1826791 - RNA, 21 nt, Human herpesvirus 2
uggacggguauaaaggccagg

SEQ ID NO: 1826792 - RNA, 17 nt, Human herpesvirus 2
ccccuuugacuccuggg

SEQ ID NO: 1826793 - RNA, 14 nt, Human herpesvirus 2
cgcgcgagcggccg

SEQ ID NO: 1826794 - RNA, 21 nt, Human herpesvirus 2
ccugcgccccgacggcccaca

SEQ ID NO: 1826795 - RNA, 23 nt, Human herpesvirus 2
ccgcaguuucaccgccccagcac

SEQ ID NO: 1826796 - RNA, 14 nt, Human herpesvirus 2
cagcgccggguggc

SEQ ID NO: 1826797 - RNA, 15 nt, Human herpesvirus 2
cggccgcacccacga

SEQ ID NO: 1826798 - RNA, 24 nt, Human herpesvirus 2
cggccaauucuucccggagcgccg

SEQ ID NO: 1826799 - RNA, 17 nt, Human herpesvirus 2
uaagcgcugcggggacc

SEQ ID NO: 1826800 - RNA, 22 nt, Human herpesvirus 2
gcaccggacgcgcacguggggc

SEQ ID NO: 1826801 - RNA, 22 nt, Human herpesvirus 2
cgcaugacgacacgucccgcca

SEQ ID NO: 1826802 - RNA, 23 nt, Human herpesvirus 2
agcuucauuuugugggggcccag

SEQ ID NO: 1826803 - RNA, 15 nt, Human herpesvirus 2
ccgagccgcugugcc

SEQ ID NO: 1826804 - RNA, 13 nt, Human herpesvirus 2
cgacgccuggcgg

SEQ ID NO: 1826805 - RNA, 23 nt, Human herpesvirus 2
cgaguucccccgggacuucugga

SEQ ID NO: 1826806 - RNA, 18 nt, Human herpesvirus 2
cacccagaugcgccuggu

SEQ ID NO: 1826807 - RNA, 21 nt, Human herpesvirus 2
gccgccgagcgucaggcccgc

SEQ ID NO: 1826808 - RNA, 18 nt, Human herpesvirus 2
gaggucaauagauuuccc

SEQ ID NO: 1826809 - RNA, 14 nt, Human herpesvirus 2
ucccccggaccccg

SEQ ID NO: 1826810 - RNA, 20 nt, Human herpesvirus 2
ggccagccgcccccgccggc

SEQ ID NO: 1826811 - RNA, 15 nt, Human herpesvirus 2
accaaccccgucucc

SEQ ID NO: 1826812 - RNA, 12 nt, Human herpesvirus 2
cccguggcccac

SEQ ID NO: 1826813 - RNA, 21 nt, Human herpesvirus 2
ccgcgaccaccaaggcccgga

SEQ ID NO: 1826814 - RNA, 18 nt, Human herpesvirus 2
guuagguugggagguggc

SEQ ID NO: 1826815 - RNA, 13 nt, Human herpesvirus 2
gaucccccggaag

SEQ ID NO: 1826816 - RNA, 23 nt, Human herpesvirus 2
uggcccguuucuucggggggccc

SEQ ID NO: 1826817 - RNA, 12 nt, Human herpesvirus 2
ggaggggcuccu

SEQ ID NO: 1826818 - RNA, 17 nt, Human herpesvirus 2
cccgaacagccccuggg

SEQ ID NO: 1826819 - RNA, 14 nt, Human herpesvirus 2
cuacuaccugggga

SEQ ID NO: 1826820 - RNA, 23 nt, Human herpesvirus 2
cgcgcgcccccgacccggggccc

SEQ ID NO: 1826821 - RNA, 14 nt, Human herpesvirus 2
gugccccuggacug

SEQ ID NO: 1826822 - RNA, 14 nt, Human herpesvirus 2
uccggcggccaccc

SEQ ID NO: 1826823 - RNA, 20 nt, Human herpesvirus 2
uugcgcuuuccggcccuccc

SEQ ID NO: 1826824 - RNA, 18 nt, Human herpesvirus 2
caggccaucgccggggac

SEQ ID NO: 1826825 - RNA, 20 nt, Human herpesvirus 2
guccuccggcgcgcacuccc

SEQ ID NO: 1826826 - RNA, 15 nt, Human herpesvirus 2
cccgaacggaaggcc

SEQ ID NO: 1826827 - RNA, 19 nt, Human herpesvirus 2
cgagcguggccggcgaccc

SEQ ID NO: 1826828 - RNA, 22 nt, Human herpesvirus 2
acuggagguggucggcggccaa

SEQ ID NO: 1826829 - RNA, 21 nt, Human herpesvirus 2
gcuuccaccccccccccccuu

SEQ ID NO: 1826830 - RNA, 16 nt, Human herpesvirus 2
ggacaaacccgccggg

SEQ ID NO: 1826831 - RNA, 19 nt, Human herpesvirus 2
gucgcuaaacagggggauc

SEQ ID NO: 1826832 - RNA, 19 nt, Human herpesvirus 2
cgguccuaaggcgccgacg

SEQ ID NO: 1826833 - RNA, 14 nt, Human herpesvirus 2
cccuuucccccuuc

SEQ ID NO: 1826834 - RNA, 12 nt, Human herpesvirus 2
cgguggacauga

SEQ ID NO: 1826835 - RNA, 19 nt, Human herpesvirus 2
cacgaggccguaaacugcu

SEQ ID NO: 1826836 - RNA, 23 nt, Human herpesvirus 2
guccucgccgcuguggcccuggc

SEQ ID NO: 1826837 - RNA, 23 nt, Human herpesvirus 2
agggccuggcgauccugggccug

SEQ ID NO: 1826838 - RNA, 12 nt, Human herpesvirus 2
ggcggacccaga

SEQ ID NO: 1826839 - RNA, 16 nt, Human herpesvirus 2
ggaagaagagaggcga

SEQ ID NO: 1826840 - RNA, 12 nt, Human herpesvirus 2
cuguaucugguc

SEQ ID NO: 1826841 - RNA, 20 nt, Human herpesvirus 2
auaccggucgaucucggcgu

SEQ ID NO: 1826842 - RNA, 12 nt, Human herpesvirus 2
gggcagugcagu

SEQ ID NO: 1826843 - RNA, 13 nt, Human herpesvirus 2
guccggggggacg

SEQ ID NO: 1826844 - RNA, 11 nt, Human herpesvirus 2
uuacccacaca

SEQ ID NO: 1826845 - RNA, 18 nt, Human herpesvirus 2
ggccauccccggcgccau

SEQ ID NO: 1826846 - RNA, 18 nt, Human herpesvirus 2
cucgacggagagccggac

SEQ ID NO: 1826847 - RNA, 15 nt, Human herpesvirus 2
uucucguacccccuc

SEQ ID NO: 1826848 - RNA, 13 nt, Human herpesvirus 2
aguaccccaguuc

SEQ ID NO: 1826849 - RNA, 12 nt, Human herpesvirus 2
ccguccaccucc

SEQ ID NO: 1826850 - RNA, 14 nt, Human herpesvirus 2
cggccauccugccc

SEQ ID NO: 1826851 - RNA, 22 nt, Human herpesvirus 2
cacgcccaacccaaccgacucc

SEQ ID NO: 1826852 - RNA, 14 nt, Human herpesvirus 2
gaaggcggacccag

SEQ ID NO: 1826853 - RNA, 14 nt, Human herpesvirus 2
ucgggggccaggaa

SEQ ID NO: 1826854 - RNA, 15 nt, Human herpesvirus 2
ccggcgcgggcggcg

SEQ ID NO: 1826855 - RNA, 18 nt, Human herpesvirus 2
acguucggacggccccuc

SEQ ID NO: 1826856 - RNA, 23 nt, Human herpesvirus 2
agggugggggugguggugguggg

SEQ ID NO: 1826857 - RNA, 21 nt, Human herpesvirus 2
ggcaccguaucagcaccccac

SEQ ID NO: 1826858 - RNA, 17 nt, Human herpesvirus 2
agcucgucgcgacccug

SEQ ID NO: 1826859 - RNA, 12 nt, Human herpesvirus 2
acgaccugcagc

SEQ ID NO: 1826860 - RNA, 20 nt, Human herpesvirus 2
uuagucccggguccggggcg

SEQ ID NO: 1826861 - RNA, 21 nt, Human herpesvirus 2
cagccccucgcccccgcggcc

SEQ ID NO: 1826862 - RNA, 20 nt, Human herpesvirus 2
cagccuacaucaccccaggg

SEQ ID NO: 1826863 - RNA, 16 nt, Human herpesvirus 2
accuccccgugcgugc

SEQ ID NO: 1826864 - RNA, 19 nt, Human herpesvirus 2
gcuguuuauuacgggacca

SEQ ID NO: 1826865 - RNA, 15 nt, Human herpesvirus 2
acgcgcuggccccuc

SEQ ID NO: 1826866 - RNA, 20 nt, Human herpesvirus 2
ccggugucucgcggcccggc

SEQ ID NO: 1826867 - RNA, 18 nt, Human herpesvirus 2
gccucgcgucgggccaga

SEQ ID NO: 1826868 - RNA, 19 nt, Human herpesvirus 2
gaggaccacgugcacagcc

SEQ ID NO: 1826869 - RNA, 13 nt, Human herpesvirus 2
cguacgaggugcu

SEQ ID NO: 1826870 - RNA, 16 nt, Human herpesvirus 2
ggugcgccccgccggg

SEQ ID NO: 1826871 - RNA, 14 nt, Human herpesvirus 2
accgucgccgccgg

SEQ ID NO: 1826872 - RNA, 23 nt, Human herpesvirus 2
gugccgcuuuaccccgcggccuc

SEQ ID NO: 1826873 - RNA, 17 nt, Human herpesvirus 2
ccaggcuauuaaacagc

SEQ ID NO: 1826874 - RNA, 22 nt, Human herpesvirus 2
uguucgcgggcgacgccgcggc

SEQ ID NO: 1826875 - RNA, 21 nt, Human herpesvirus 2
gucccccgggcagccgggccc

SEQ ID NO: 1826876 - RNA, 17 nt, Human herpesvirus 2
ccugcggcagcgcgccg

SEQ ID NO: 1826877 - RNA, 22 nt, Human herpesvirus 2
gacuugacggucgccacucucc

SEQ ID NO: 1826878 - RNA, 18 nt, Human herpesvirus 2
gagccaccgucccgcccg

SEQ ID NO: 1826879 - RNA, 14 nt, Human herpesvirus 2
ggucgcucuguccc

SEQ ID NO: 1826880 - RNA, 18 nt, Human herpesvirus 2
ggcccucugggacaccca

SEQ ID NO: 1826881 - RNA, 23 nt, Human herpesvirus 2
cccgggggggggcaagugcagua

SEQ ID NO: 1826882 - RNA, 18 nt, Human herpesvirus 2
cguggagcgccgggccuc

SEQ ID NO: 1826883 - RNA, 15 nt, Human herpesvirus 2
acacguucuuugcca

SEQ ID NO: 1826884 - RNA, 20 nt, Human herpesvirus 2
uccgacguugcuuuuaccca

SEQ ID NO: 1826885 - RNA, 20 nt, Human herpesvirus 2
cccgcggucgcgcgggccgu

SEQ ID NO: 1826886 - RNA, 17 nt, Human herpesvirus 2
gaccccgauaguccccc

SEQ ID NO: 1826887 - RNA, 18 nt, Human herpesvirus 2
gcccccggagucccccgg

SEQ ID NO: 1826888 - RNA, 21 nt, Human herpesvirus 2
gagccucuuugggccgugggu

SEQ ID NO: 1826889 - RNA, 12 nt, Human herpesvirus 2
uaaaggcaggcg

SEQ ID NO: 1826890 - RNA, 15 nt, Human herpesvirus 2
ggcccugccuccgga

SEQ ID NO: 1826891 - RNA, 17 nt, Human herpesvirus 2
gcgcgacggccgagaag

SEQ ID NO: 1826892 - RNA, 22 nt, Human herpesvirus 2
gccgccauccucaaacaggcca

SEQ ID NO: 1826893 - RNA, 17 nt, Human herpesvirus 2
accgucggugccagacc

SEQ ID NO: 1826894 - RNA, 13 nt, Human herpesvirus 2
accgcgcgccgcc

SEQ ID NO: 1826895 - RNA, 17 nt, Human herpesvirus 2
gcccccggcccugcggc

SEQ ID NO: 1826896 - RNA, 14 nt, Human herpesvirus 2
gggacgcgagccug

SEQ ID NO: 1826897 - RNA, 21 nt, Human herpesvirus 2
cgccucucccuuuuuuccccc

SEQ ID NO: 1826898 - RNA, 20 nt, Human herpesvirus 2
acccucaccccaccccaucc

SEQ ID NO: 1826899 - RNA, 19 nt, Human herpesvirus 2
ccggcgugggugacuggga

SEQ ID NO: 1826900 - RNA, 15 nt, Human herpesvirus 2
gcgcgcuggcggaag

SEQ ID NO: 1826901 - RNA, 18 nt, Human herpesvirus 2
ugcugcugagcccugccc

SEQ ID NO: 1826902 - RNA, 13 nt, Human herpesvirus 2
ucaaacgcggaca

SEQ ID NO: 1826903 - RNA, 19 nt, Human herpesvirus 2
cggugccucacgguccuca

SEQ ID NO: 1826904 - RNA, 15 nt, Human herpesvirus 2
gccccgcaggcaggc

SEQ ID NO: 1826905 - RNA, 15 nt, Human herpesvirus 2
uuuccguggcgccug

SEQ ID NO: 1826906 - RNA, 13 nt, Human herpesvirus 2
ucgcggcggcucc

SEQ ID NO: 1826907 - RNA, 16 nt, Human herpesvirus 2
cccuggcgcaccugca

SEQ ID NO: 1826908 - RNA, 13 nt, Human herpesvirus 2
gugcccgcccccg

SEQ ID NO: 1826909 - RNA, 20 nt, Human herpesvirus 2
ccuggccguccggggggacg

SEQ ID NO: 1826910 - RNA, 21 nt, Human herpesvirus 2
acacacaccagcauuuuguua

SEQ ID NO: 1826911 - RNA, 19 nt, Human herpesvirus 2
ccagacgcuguuguuucug

SEQ ID NO: 1826912 - RNA, 22 nt, Human herpesvirus 2
acucccuccguguccgcggucu

SEQ ID NO: 1826913 - RNA, 22 nt, Human herpesvirus 2
ggggcugguuggauguuuuugc

SEQ ID NO: 1826914 - RNA, 13 nt, Human herpesvirus 2
cuggcgggagcca

SEQ ID NO: 1826915 - RNA, 14 nt, Human herpesvirus 2
ccgcccgcagcugc

SEQ ID NO: 1826916 - RNA, 15 nt, Human herpesvirus 2
uccccccccccucca

SEQ ID NO: 1826917 - RNA, 21 nt, Human herpesvirus 2
gccauccucaaacaggccauc

SEQ ID NO: 1826918 - RNA, 13 nt, Human herpesvirus 2
gggggggaagaga

SEQ ID NO: 1826919 - RNA, 12 nt, Human herpesvirus 2
gcggcccucucg

SEQ ID NO: 1826920 - RNA, 20 nt, Human herpesvirus 2
gccgucguuggucggugggu

SEQ ID NO: 1826921 - RNA, 19 nt, Human herpesvirus 2
gcagccccggucccccgga

SEQ ID NO: 1826922 - RNA, 16 nt, Human herpesvirus 2
cggggcgugucugucc

SEQ ID NO: 1826923 - RNA, 18 nt, Human herpesvirus 2
cgccacgguggugcaguu

SEQ ID NO: 1826924 - RNA, 15 nt, Human herpesvirus 2
uugcgcucgucgccg

SEQ ID NO: 1826925 - RNA, 20 nt, Human herpesvirus 2
cuguuuccuuuccuuucccc

SEQ ID NO: 1826926 - RNA, 14 nt, Human herpesvirus 2
uggcugucgugugu

SEQ ID NO: 1826927 - RNA, 19 nt, Human herpesvirus 2
cgcuuuccacacccccucc

SEQ ID NO: 1826928 - RNA, 16 nt, Human herpesvirus 2
ccuggcgauccugggc

SEQ ID NO: 1826929 - RNA, 12 nt, Human herpesvirus 2
cccccggaagga

SEQ ID NO: 1826930 - RNA, 18 nt, Human herpesvirus 2
ccagcagcuugcggggcu

SEQ ID NO: 1826931 - RNA, 20 nt, Human herpesvirus 2
ggaagggugggggugguggu

SEQ ID NO: 1826932 - RNA, 14 nt, Human herpesvirus 2
gcggucggccagca

SEQ ID NO: 1826933 - RNA, 17 nt, Human herpesvirus 2
gugggccgacgugccgg

SEQ ID NO: 1826934 - RNA, 18 nt, Human herpesvirus 2
gcacgcguuuguggcgag

SEQ ID NO: 1826935 - RNA, 14 nt, Human herpesvirus 2
aacuguguuucccc

SEQ ID NO: 1826936 - RNA, 16 nt, Human herpesvirus 2
cuguggguggugaugg

SEQ ID NO: 1826937 - RNA, 13 nt, Human herpesvirus 2
ugacccucucggg

SEQ ID NO: 1826938 - RNA, 17 nt, Human herpesvirus 2
gaacucucccggcuccu

SEQ ID NO: 1826939 - RNA, 20 nt, Human herpesvirus 2
cguucagcgcaucaggcuca

SEQ ID NO: 1826940 - RNA, 16 nt, Human herpesvirus 2
acacgacccgccucgg

SEQ ID NO: 1826941 - RNA, 22 nt, Human herpesvirus 2
gccccgccgggucaccggggcg

SEQ ID NO: 1826942 - RNA, 15 nt, Human herpesvirus 2
ugaucgacgacgccu

SEQ ID NO: 1826943 - RNA, 15 nt, Human herpesvirus 2
caggcgacgccaggc

SEQ ID NO: 1826944 - RNA, 21 nt, Human herpesvirus 2
cagaggcuggagcgcuggugg

SEQ ID NO: 1826945 - RNA, 12 nt, Human herpesvirus 2
gagggggggcgg

SEQ ID NO: 1826946 - RNA, 22 nt, Human herpesvirus 2
aaggggguagugucggagaggc

SEQ ID NO: 1826947 - RNA, 14 nt, Human herpesvirus 2
ugggaaaucuauug

SEQ ID NO: 1826948 - RNA, 12 nt, Human herpesvirus 2
caaaaacacaag

SEQ ID NO: 1826949 - RNA, 21 nt, Human herpesvirus 2
gguccaauauggcccagcgca

SEQ ID NO: 1826950 - RNA, 18 nt, Human herpesvirus 2
ccucccucgccgccuucc

SEQ ID NO: 1826951 - RNA, 18 nt, Human herpesvirus 2
uguuccggccguggccug

SEQ ID NO: 1826952 - RNA, 14 nt, Human herpesvirus 2
cugcgcgaggccgc

SEQ ID NO: 1826953 - RNA, 16 nt, Human herpesvirus 2
cgcgaccaccaaggcc

SEQ ID NO: 1826954 - RNA, 21 nt, Human herpesvirus 2
gggccauggaugaugaccugg

SEQ ID NO: 1826955 - RNA, 15 nt, Human herpesvirus 2
guuuacuauccuugc

SEQ ID NO: 1826956 - RNA, 11 nt, Human herpesvirus 2
agaggcugucc

SEQ ID NO: 1826957 - RNA, 23 nt, Human herpesvirus 2
gccccggguuccccgagagccca

SEQ ID NO: 1826958 - RNA, 21 nt, Human herpesvirus 2
gaccggcccccggaguccccc

SEQ ID NO: 1826959 - RNA, 22 nt, Human herpesvirus 2
gcagcgugucaaaggccagcag

SEQ ID NO: 1826960 - RNA, 15 nt, Human herpesvirus 2
cugguacccacggac

SEQ ID NO: 1826961 - RNA, 18 nt, Human herpesvirus 2
cgcucuccgugccccugg

SEQ ID NO: 1826962 - RNA, 22 nt, Human herpesvirus 2
cgccacucuccugcgagcccuc

SEQ ID NO: 1826963 - RNA, 21 nt, Human herpesvirus 2
gcaccggacgcgcacgugggg

SEQ ID NO: 1826964 - RNA, 16 nt, Human herpesvirus 2
cccgcggaccaccggg

SEQ ID NO: 1826965 - RNA, 12 nt, Human herpesvirus 2
aggggggagaug

SEQ ID NO: 1826966 - RNA, 15 nt, Human herpesvirus 2
aggcccaccaccauc

SEQ ID NO: 1826967 - RNA, 23 nt, Human herpesvirus 2
cacacggucggugccccccaucu

SEQ ID NO: 1826968 - RNA, 23 nt, Human herpesvirus 2
ccccgcucguggcgggcgcggca

SEQ ID NO: 1826969 - RNA, 21 nt, Human herpesvirus 2
cacgauaccguuuaucgugua

SEQ ID NO: 1826970 - RNA, 14 nt, Human herpesvirus 2
gcccaccugcacga

SEQ ID NO: 1826971 - RNA, 14 nt, Human herpesvirus 2
uguuuuucuguugu

SEQ ID NO: 1826972 - RNA, 15 nt, Human herpesvirus 2
ggcugcuauccagga

SEQ ID NO: 1826973 - RNA, 15 nt, Human herpesvirus 2
acgcgccucccgggg

SEQ ID NO: 1826974 - RNA, 13 nt, Human herpesvirus 2
cggcccuggagcg

SEQ ID NO: 1826975 - RNA, 17 nt, Human herpesvirus 2
guugccgggggccauga

SEQ ID NO: 1826976 - RNA, 22 nt, Human herpesvirus 2
cuccgcagcguaacgcaccccc

SEQ ID NO: 1826977 - RNA, 16 nt, Human herpesvirus 2
cggaggaacuggggua

SEQ ID NO: 1826978 - RNA, 10 nt, Human herpesvirus 2
ugauccuggc

SEQ ID NO: 1826979 - RNA, 21 nt, Human herpesvirus 2
ggcuggagcgcuggugggacg

SEQ ID NO: 1826980 - RNA, 15 nt, Human herpesvirus 2
ucggaauuucacccc

SEQ ID NO: 1826981 - RNA, 14 nt, Human herpesvirus 2
cuuuuccgccgccg

SEQ ID NO: 1826982 - RNA, 18 nt, Human herpesvirus 2
ccgugcugggcgcgagcc

SEQ ID NO: 1826983 - RNA, 22 nt, Human herpesvirus 2
cccgccauggcggggggggggc

SEQ ID NO: 1826984 - RNA, 17 nt, Human herpesvirus 2
aggucccgauggccgcc

SEQ ID NO: 1826985 - RNA, 12 nt, Human herpesvirus 2
uauacugcuggg

SEQ ID NO: 1826986 - RNA, 13 nt, Human herpesvirus 2
cccacccccgagg

SEQ ID NO: 1826987 - RNA, 14 nt, Human herpesvirus 2
gcgauccugggccu

SEQ ID NO: 1826988 - RNA, 18 nt, Human herpesvirus 2
gguccaauauggcccagc

SEQ ID NO: 1826989 - RNA, 14 nt, Human herpesvirus 2
uccgcucccgccuc

SEQ ID NO: 1826990 - RNA, 16 nt, Human herpesvirus 2
gccccggucugugggu

SEQ ID NO: 1826991 - RNA, 13 nt, Human herpesvirus 2
ccuucgucuggag

SEQ ID NO: 1826992 - RNA, 17 nt, Human herpesvirus 2
cccgccgggucaccggg

SEQ ID NO: 1826993 - RNA, 18 nt, Human herpesvirus 2
ccgaaggaagccgccccc

SEQ ID NO: 1826994 - RNA, 23 nt, Human herpesvirus 2
gcgcaucuucgccgggugucugc

SEQ ID NO: 1826995 - RNA, 23 nt, Human herpesvirus 2
ccugccacccgaacauggcucgc

SEQ ID NO: 1826996 - RNA, 14 nt, Human herpesvirus 2
ccuggccgcgcgga

SEQ ID NO: 1826997 - RNA, 13 nt, Human herpesvirus 2
acagccccugggg

SEQ ID NO: 1826998 - RNA, 21 nt, Human herpesvirus 2
gacccgggcgagcuggcccug

SEQ ID NO: 1826999 - RNA, 20 nt, Human herpesvirus 2
cgcaguuucaccgccccagc

SEQ ID NO: 1827000 - RNA, 16 nt, Human herpesvirus 2
ccgacgcgcgcgcccc

SEQ ID NO: 1827001 - RNA, 14 nt, Human herpesvirus 2
gccaggggggcagg

SEQ ID NO: 1827002 - RNA, 19 nt, Human herpesvirus 2
gacggcaauaaaagaacag

SEQ ID NO: 1827003 - RNA, 15 nt, Human herpesvirus 2
acacaccgggcuggg

SEQ ID NO: 1827004 - RNA, 15 nt, Human herpesvirus 2
cucccccgcuucugg

SEQ ID NO: 1827005 - RNA, 18 nt, Human herpesvirus 2
gggcuucguggaagagga

SEQ ID NO: 1827006 - RNA, 16 nt, Human herpesvirus 2
acccccaucgggcugc

SEQ ID NO: 1827007 - RNA, 22 nt, Human herpesvirus 2
uccgucguuuggggcuccccga

SEQ ID NO: 1827008 - RNA, 17 nt, Human herpesvirus 2
gacaugauagagggaac

SEQ ID NO: 1827009 - RNA, 20 nt, Human herpesvirus 2
uaugcaagcgggcggggugg

SEQ ID NO: 1827010 - RNA, 20 nt, Human herpesvirus 2
uggcgaguccugggugggug

SEQ ID NO: 1827011 - RNA, 15 nt, Human herpesvirus 2
ccgaacagccccugg

SEQ ID NO: 1827012 - RNA, 18 nt, Human herpesvirus 2
gcacgggcccggggcgaa

SEQ ID NO: 1827013 - RNA, 22 nt, Human herpesvirus 2
gaaagcgaagacgaggccgcca

SEQ ID NO: 1827014 - RNA, 22 nt, Human herpesvirus 2
ggacacggcccccgaauccggg

SEQ ID NO: 1827015 - RNA, 20 nt, Human herpesvirus 2
ccaggaggggggcagugcag

SEQ ID NO: 1827016 - RNA, 23 nt, Human herpesvirus 2
gacgcggggucgagcgcgccagg

SEQ ID NO: 1827017 - RNA, 15 nt, Human herpesvirus 2
uguggcuggaggcaa

SEQ ID NO: 1827018 - RNA, 20 nt, Human herpesvirus 2
cgccgcgggggaggcgcgcg

SEQ ID NO: 1827019 - RNA, 16 nt, Human herpesvirus 2
cugggagcccuccucg

SEQ ID NO: 1827020 - RNA, 17 nt, Human herpesvirus 2
acugcacugccccccuc

SEQ ID NO: 1827021 - RNA, 20 nt, Human herpesvirus 2
gggcguagagcucggccucg

SEQ ID NO: 1827022 - RNA, 23 nt, Human herpesvirus 2
uggugcgucuccggucccuuccc

SEQ ID NO: 1827023 - RNA, 20 nt, Human herpesvirus 2
gcaaccaggcgcugcugcgc

SEQ ID NO: 1827024 - RNA, 23 nt, Human herpesvirus 2
ucacgcaggccgcccccagcagg

SEQ ID NO: 1827025 - RNA, 18 nt, Human herpesvirus 2
gacacacacaccccccuu

SEQ ID NO: 1827026 - RNA, 22 nt, Human herpesvirus 2
ggacgcagcggcguccacgccc

SEQ ID NO: 1827027 - RNA, 20 nt, Human herpesvirus 2
agcggcgagugcucgcagca

SEQ ID NO: 1827028 - RNA, 13 nt, Human herpesvirus 2
ccgaagaggugcu

SEQ ID NO: 1827029 - RNA, 23 nt, Human herpesvirus 2
cucgaacacgagccgcaggaacg

SEQ ID NO: 1827030 - RNA, 14 nt, Human herpesvirus 2
cccggcguggagcg

SEQ ID NO: 1827031 - RNA, 18 nt, Human herpesvirus 2
gaccaaaacggaccccgc

SEQ ID NO: 1827032 - RNA, 14 nt, Human herpesvirus 2
ccuggcgcaccugc

SEQ ID NO: 1827033 - RNA, 23 nt, Human herpesvirus 2
cgcggugcgccccgccggggcgc

SEQ ID NO: 1827034 - RNA, 14 nt, Human herpesvirus 2
ccagauggggcccc

SEQ ID NO: 1827035 - RNA, 17 nt, Human herpesvirus 2
gacgucacgcccgucag

SEQ ID NO: 1827036 - RNA, 22 nt, Human herpesvirus 2
gccccgaacagcaacacacacc

SEQ ID NO: 1827037 - RNA, 20 nt, Human herpesvirus 2
guccugcggcagcgcgccga

SEQ ID NO: 1827038 - RNA, 23 nt, Human herpesvirus 2
cgcuuauaagagcgggcccgggg

SEQ ID NO: 1827039 - RNA, 17 nt, Human herpesvirus 2
cagccccgcaggcaggc

SEQ ID NO: 1827040 - RNA, 16 nt, Human herpesvirus 2
gaaccgguagccgggg

SEQ ID NO: 1827041 - RNA, 16 nt, Human herpesvirus 2
cggccacgccacgcug

SEQ ID NO: 1827042 - RNA, 15 nt, Human herpesvirus 2
cgaaggcggacccag

SEQ ID NO: 1827043 - RNA, 14 nt, Human herpesvirus 2
cggggcauggaccc

SEQ ID NO: 1827044 - RNA, 16 nt, Human herpesvirus 2
accggggaaacaggca

SEQ ID NO: 1827045 - RNA, 12 nt, Human herpesvirus 2
cgaacacugccu

SEQ ID NO: 1827046 - RNA, 15 nt, Human herpesvirus 2
ccgagagcccaggga

SEQ ID NO: 1827047 - RNA, 20 nt, Human herpesvirus 2
gcccccgacccggggcccga

SEQ ID NO: 1827048 - RNA, 19 nt, Human herpesvirus 2
cguauucaccgaccccccc

SEQ ID NO: 1827049 - RNA, 15 nt, Human herpesvirus 2
aggcaccccauccga

SEQ ID NO: 1827050 - RNA, 15 nt, Human herpesvirus 2
ucccguaccccgccg

SEQ ID NO: 1827051 - RNA, 13 nt, Human herpesvirus 2
agaugccagugga

SEQ ID NO: 1827052 - RNA, 14 nt, Human herpesvirus 2
gccgguagugcagg

SEQ ID NO: 1827053 - RNA, 19 nt, Human herpesvirus 2
cucaccuggggcuccugcg

SEQ ID NO: 1827054 - RNA, 21 nt, Human herpesvirus 2
ucugcuuuuggugcgucuccg

SEQ ID NO: 1827055 - RNA, 19 nt, Human herpesvirus 2
ggggcgcgcaccgcugucc

SEQ ID NO: 1827056 - RNA, 15 nt, Human herpesvirus 2
uggaccccccacgcc

SEQ ID NO: 1827057 - RNA, 15 nt, Human herpesvirus 2
cgcccccgacccggg

SEQ ID NO: 1827058 - RNA, 21 nt, Human herpesvirus 2
ugcaucgcaagccacccuggg

SEQ ID NO: 1827059 - RNA, 13 nt, Human herpesvirus 2
gggaggagacagg

SEQ ID NO: 1827060 - RNA, 19 nt, Human herpesvirus 2
cgaccgggcggugcccauc

SEQ ID NO: 1827061 - RNA, 20 nt, Human herpesvirus 2
caauauggcccagcgcaccc

SEQ ID NO: 1827062 - RNA, 19 nt, Human herpesvirus 2
cucucggugaucuuggcgu

SEQ ID NO: 1827063 - RNA, 14 nt, Human herpesvirus 2
caccgcgcccacag

SEQ ID NO: 1827064 - RNA, 23 nt, Human herpesvirus 2
ccccgaauaccaccggcguguga

SEQ ID NO: 1827065 - RNA, 12 nt, Human herpesvirus 2
ggaccacgugca

SEQ ID NO: 1827066 - RNA, 14 nt, Human herpesvirus 2
ccggggagggcagg

SEQ ID NO: 1827067 - RNA, 12 nt, Human herpesvirus 2
cuucuuuccccc

SEQ ID NO: 1827068 - RNA, 21 nt, Human herpesvirus 2
gcgugcggcccugccuccgga

SEQ ID NO: 1827069 - RNA, 22 nt, Human herpesvirus 2
guacagccuacaucaccccagg

SEQ ID NO: 1827070 - RNA, 13 nt, Human herpesvirus 2
gcauaaagggagu

SEQ ID NO: 1827071 - RNA, 22 nt, Human herpesvirus 2
acgaaguggguauacuuuuguc

SEQ ID NO: 1827072 - RNA, 18 nt, Human herpesvirus 2
aaacacaaaccacacgcu

SEQ ID NO: 1827073 - RNA, 17 nt, Human herpesvirus 2
cgcgggggacgggccgc

SEQ ID NO: 1827074 - RNA, 17 nt, Human herpesvirus 2
cgcgggcgacgggcggc

SEQ ID NO: 1827075 - RNA, 12 nt, Human herpesvirus 2
gccucccaacgc

SEQ ID NO: 1827076 - RNA, 13 nt, Human herpesvirus 2
cacgcccccacuc

SEQ ID NO: 1827077 - RNA, 16 nt, Human herpesvirus 2
ccgacauuccccucuc

SEQ ID NO: 1827078 - RNA, 21 nt, Human herpesvirus 2
agucacgcccccugaguugcg

SEQ ID NO: 1827079 - RNA, 22 nt, Human herpesvirus 2
uuggccggggagggcagggccg

SEQ ID NO: 1827080 - RNA, 13 nt, Human herpesvirus 2
gcggggccccggg

SEQ ID NO: 1827081 - RNA, 19 nt, Human herpesvirus 2
gcccauaaacaggccccgc

SEQ ID NO: 1827082 - RNA, 21 nt, Human herpesvirus 2
gugcugggcgcgagccaggca

SEQ ID NO: 1827083 - RNA, 17 nt, Human herpesvirus 2
gccaacgcgggcguccc

SEQ ID NO: 1827084 - RNA, 20 nt, Human herpesvirus 2
cuuucggccaccaccccccu

SEQ ID NO: 1827085 - RNA, 13 nt, Human herpesvirus 2
uggcggccgccgc

SEQ ID NO: 1827086 - RNA, 20 nt, Human herpesvirus 2
ugaacugauugccaucgcgg

SEQ ID NO: 1827087 - RNA, 12 nt, Human herpesvirus 2
ucgccggggacc

SEQ ID NO: 1827088 - RNA, 14 nt, Human herpesvirus 2
gagcugccccgcgg

SEQ ID NO: 1827089 - RNA, 17 nt, Human herpesvirus 2
ccgccccccccaggggg

SEQ ID NO: 1827090 - RNA, 19 nt, Human herpesvirus 2
cggcgugcgcgugggagga

SEQ ID NO: 1827091 - RNA, 15 nt, Human herpesvirus 2
auguguucuccugga

SEQ ID NO: 1827092 - RNA, 19 nt, Human herpesvirus 2
gcauggaccccccacgccc

SEQ ID NO: 1827093 - RNA, 12 nt, Human herpesvirus 2
ucgcggacgagc

SEQ ID NO: 1827094 - RNA, 17 nt, Human herpesvirus 2
cgccgagcgucaggccc

SEQ ID NO: 1827095 - RNA, 16 nt, Human herpesvirus 2
caccaaccuggcacag

SEQ ID NO: 1827096 - RNA, 13 nt, Human herpesvirus 2
ggucaccggggcg

SEQ ID NO: 1827097 - RNA, 17 nt, Human herpesvirus 2
aggaaacgcgcgccccc

SEQ ID NO: 1827098 - RNA, 19 nt, Human herpesvirus 2
ucgcgcaucucuggcucca

SEQ ID NO: 1827099 - RNA, 14 nt, Human herpesvirus 2
acauuccccucucg

SEQ ID NO: 1827100 - RNA, 22 nt, Human herpesvirus 2
gcccgccagugcaucccagacg

SEQ ID NO: 1827101 - RNA, 19 nt, Human herpesvirus 2
guuugggaacacaggcgcu

SEQ ID NO: 1827102 - RNA, 19 nt, Human herpesvirus 2
gaaagacggggaggagaca

SEQ ID NO: 1827103 - RNA, 13 nt, Human herpesvirus 2
ggggagggcggca

SEQ ID NO: 1827104 - RNA, 20 nt, Human herpesvirus 2
gccgcgacaagacccggcgg

SEQ ID NO: 1827105 - RNA, 21 nt, Human herpesvirus 2
auccugggccugugggucugc

SEQ ID NO: 1827106 - RNA, 18 nt, Human herpesvirus 2
ccguuucuucggggggcc

SEQ ID NO: 1827107 - RNA, 16 nt, Human herpesvirus 2
gacuuggugcgccgcc

SEQ ID NO: 1827108 - RNA, 22 nt, Human herpesvirus 2
gcgaccgggcggcgcgcccccc

SEQ ID NO: 1827109 - RNA, 14 nt, Human herpesvirus 2
ggaacgacaaaaaa

SEQ ID NO: 1827110 - RNA, 16 nt, Human herpesvirus 2
cucgggcggcguggcc

SEQ ID NO: 1827111 - RNA, 12 nt, Human herpesvirus 2
ggccccgccggg

SEQ ID NO: 1827112 - RNA, 15 nt, Human herpesvirus 2
caggcccucgcugcu

SEQ ID NO: 1827113 - RNA, 20 nt, Human herpesvirus 2
ugaucuuggcguuauuucca

SEQ ID NO: 1827114 - RNA, 16 nt, Human herpesvirus 2
auugccaucgcggacg

SEQ ID NO: 1827115 - RNA, 18 nt, Human herpesvirus 2
caggggggcaggcgggcc

SEQ ID NO: 1827116 - RNA, 21 nt, Human herpesvirus 2
ggaaagggaacagcgaccaaa

SEQ ID NO: 1827117 - RNA, 18 nt, Human herpesvirus 2
uggcuggaggcaaacacg

SEQ ID NO: 1827118 - RNA, 20 nt, Human herpesvirus 2
ccgggcguuauaagccgccg

SEQ ID NO: 1827119 - RNA, 20 nt, Human herpesvirus 2
gaccgccugccccgcggagg

SEQ ID NO: 1827120 - RNA, 22 nt, Human herpesvirus 2
ggaagcugccucccccccggag

SEQ ID NO: 1827121 - RNA, 23 nt, Human herpesvirus 2
auuaauaaagagugagaaccaac

SEQ ID NO: 1827122 - RNA, 12 nt, Human herpesvirus 2
acacccccuccc

SEQ ID NO: 1827123 - RNA, 22 nt, Human herpesvirus 2
accgcgaccagcguccugcgcg

SEQ ID NO: 1827124 - RNA, 14 nt, Human herpesvirus 2
gucccugcgucgcc

SEQ ID NO: 1827125 - RNA, 20 nt, Human herpesvirus 2
cgagcggcgcaucuucgccg

SEQ ID NO: 1827126 - RNA, 14 nt, Human herpesvirus 2
ccuucagccuggac

SEQ ID NO: 1827127 - RNA, 20 nt, Human herpesvirus 2
gaagcugccucccccccgga

SEQ ID NO: 1827128 - RNA, 20 nt, Human herpesvirus 2
acugcacugccccccuccug

SEQ ID NO: 1827129 - RNA, 13 nt, Human herpesvirus 2
cggggagcuucau

SEQ ID NO: 1827130 - RNA, 21 nt, Human herpesvirus 2
ggugcccaucuacguggccgg

SEQ ID NO: 1827131 - RNA, 17 nt, Human herpesvirus 2
gucgggagcaggacagc

SEQ ID NO: 1827132 - RNA, 11 nt, Human herpesvirus 2
uuuccuccccu

SEQ ID NO: 1827133 - RNA, 19 nt, Human herpesvirus 2
uggagaagggaaaggaaca

SEQ ID NO: 1827134 - RNA, 13 nt, Human herpesvirus 2
cggggggcggugg

SEQ ID NO: 1827135 - RNA, 19 nt, Human herpesvirus 2
ggaacuguguuuccccccc

SEQ ID NO: 1827136 - RNA, 18 nt, Human herpesvirus 2
ucacccccgaguuccccc

SEQ ID NO: 1827137 - RNA, 18 nt, Human herpesvirus 2
cacguucgccccgcagcc

SEQ ID NO: 1827138 - RNA, 16 nt, Human herpesvirus 2
aggcgcgccaccgccc

SEQ ID NO: 1827139 - RNA, 21 nt, Human herpesvirus 2
caggagggcgggccacgucgg

SEQ ID NO: 1827140 - RNA, 22 nt, Human herpesvirus 2
gugcgggaugugucgcggggac

SEQ ID NO: 1827141 - RNA, 17 nt, Human herpesvirus 2
cgagcccguggcccacg

SEQ ID NO: 1827142 - RNA, 19 nt, Human herpesvirus 2
gacccggacugcagccccg

SEQ ID NO: 1827143 - RNA, 17 nt, Human herpesvirus 2
cacgcgcgacugccucc

SEQ ID NO: 1827144 - RNA, 10 nt, Human herpesvirus 2
auaaagagcu

SEQ ID NO: 1827145 - RNA, 17 nt, Human herpesvirus 2
cguggcgccuggggacu

SEQ ID NO: 1827146 - RNA, 15 nt, Human herpesvirus 2
ggcggucggccagca

SEQ ID NO: 1827147 - RNA, 15 nt, Human herpesvirus 2
ccccgcguuccggug

SEQ ID NO: 1827148 - RNA, 11 nt, Human herpesvirus 2
ugacuccuggg

SEQ ID NO: 1827149 - RNA, 14 nt, Human herpesvirus 2
cccgagagcccagg

SEQ ID NO: 1827150 - RNA, 12 nt, Human herpesvirus 2
gugggggcccag

SEQ ID NO: 1827151 - RNA, 16 nt, Human herpesvirus 2
gacaucaaccaccuuc

SEQ ID NO: 1827152 - RNA, 16 nt, Human herpesvirus 2
caggcgucgcucucgg

SEQ ID NO: 1827153 - RNA, 16 nt, Human herpesvirus 2
ccggaaccccucuggg

SEQ ID NO: 1827154 - RNA, 17 nt, Human herpesvirus 2
ccuguggggccugcugu

SEQ ID NO: 1827155 - RNA, 20 nt, Human herpesvirus 2
ucggccagcacgaccaggga

SEQ ID NO: 1827156 - RNA, 20 nt, Human herpesvirus 2
cuuucccuucuccauuccug

SEQ ID NO: 1827157 - RNA, 11 nt, Human herpesvirus 2
cacgacagacc

SEQ ID NO: 1827158 - RNA, 12 nt, Human herpesvirus 2
ggcaagugcagu

SEQ ID NO: 1827159 - RNA, 15 nt, Human herpesvirus 2
ccgagggcagguccc

SEQ ID NO: 1827160 - RNA, 13 nt, Human herpesvirus 2
gagagcccaggga

SEQ ID NO: 1827161 - RNA, 17 nt, Human herpesvirus 2
uggcaccguaucagcac

SEQ ID NO: 1827162 - RNA, 20 nt, Human herpesvirus 2
caccagcucgggggccagga

SEQ ID NO: 1827163 - RNA, 13 nt, Human herpesvirus 2
ccgggggccuggu

SEQ ID NO: 1827164 - RNA, 14 nt, Human herpesvirus 2
aggggcaccaaaaa

SEQ ID NO: 1827165 - RNA, 15 nt, Human herpesvirus 2
ucucugccuccuucg

SEQ ID NO: 1827166 - RNA, 16 nt, Human herpesvirus 2
gcgccgucgucgcccg

SEQ ID NO: 1827167 - RNA, 17 nt, Human herpesvirus 2
gggccggguugguguuu

SEQ ID NO: 1827168 - RNA, 21 nt, Human herpesvirus 2
gguggugauggggguccuggu

SEQ ID NO: 1827169 - RNA, 16 nt, Human herpesvirus 2
gucgggcacaggcccg

SEQ ID NO: 1827170 - RNA, 21 nt, Human herpesvirus 2
ccugcgaggugcgccagguca

SEQ ID NO: 1827171 - RNA, 15 nt, Human herpesvirus 2
cacccccgcgccgcc

SEQ ID NO: 1827172 - RNA, 15 nt, Human herpesvirus 2
aaauaaaaagacacc

SEQ ID NO: 1827173 - RNA, 14 nt, Human herpesvirus 2
gguccccgaacaaa

SEQ ID NO: 1827174 - RNA, 14 nt, Human herpesvirus 2
ggcgaccgccccgc

SEQ ID NO: 1827175 - RNA, 22 nt, Human herpesvirus 2
cgcgucguccgucacgagcccc

SEQ ID NO: 1827176 - RNA, 20 nt, Human herpesvirus 2
gggccucccgcaagagccug

SEQ ID NO: 1827177 - RNA, 13 nt, Human herpesvirus 2
cgcacccuugccc

SEQ ID NO: 1827178 - RNA, 21 nt, Human herpesvirus 2
cgcucuccgugccccugguga

SEQ ID NO: 1827179 - RNA, 21 nt, Human herpesvirus 2
cccagggggcggcgccggcca

SEQ ID NO: 1827180 - RNA, 16 nt, Human herpesvirus 2
cgggcguuccuucccu

SEQ ID NO: 1827181 - RNA, 15 nt, Human herpesvirus 2
gcuguaucuggucug

SEQ ID NO: 1827182 - RNA, 19 nt, Human herpesvirus 2
gggcugggagcccuccucg

SEQ ID NO: 1827183 - RNA, 15 nt, Human herpesvirus 2
aguuugagcagccgc

SEQ ID NO: 1827184 - RNA, 21 nt, Human herpesvirus 2
cuucccgguaugguaauuaga

SEQ ID NO: 1827185 - RNA, 13 nt, Human herpesvirus 2
cgcgagggcccgg

SEQ ID NO: 1827186 - RNA, 20 nt, Human herpesvirus 2
ucggugccccccaucucugu

SEQ ID NO: 1827187 - RNA, 22 nt, Human herpesvirus 2
gaccaccgcggacagccagggc

SEQ ID NO: 1827188 - RNA, 14 nt, Human herpesvirus 2
cucuguuccuuucc

SEQ ID NO: 1827189 - RNA, 22 nt, Human herpesvirus 2
uugcacaaaaagacgcggcccu

SEQ ID NO: 1827190 - RNA, 20 nt, Human herpesvirus 2
guccggcggccaccccgccg

SEQ ID NO: 1827191 - RNA, 20 nt, Human herpesvirus 2
caacgagcugccccgcgguc

SEQ ID NO: 1827192 - RNA, 15 nt, Human herpesvirus 2
caccgccccagcacc

SEQ ID NO: 1827193 - RNA, 14 nt, Human herpesvirus 2
caggcgcugcugcg

SEQ ID NO: 1827194 - RNA, 19 nt, Human herpesvirus 2
cagccuggaccagaccgug

SEQ ID NO: 1827195 - RNA, 15 nt, Human herpesvirus 2
cagcacgaccaggga

SEQ ID NO: 1827196 - RNA, 19 nt, Human herpesvirus 2
ccgcagggauaggggcagg

SEQ ID NO: 1827197 - RNA, 19 nt, Human herpesvirus 2
gggcguccugcggcagcgc

SEQ ID NO: 1827198 - RNA, 15 nt, Human herpesvirus 2
cgcuggccccucugc

SEQ ID NO: 1827199 - RNA, 19 nt, Human herpesvirus 2
ccgcuguggcccuggcgga

SEQ ID NO: 1827200 - RNA, 19 nt, Human herpesvirus 2
gaccugggggauuguggga

SEQ ID NO: 1827201 - RNA, 15 nt, Human herpesvirus 2
gugcgccuuuaagac

SEQ ID NO: 1827202 - RNA, 17 nt, Human herpesvirus 2
ccagcucgggggccagg

SEQ ID NO: 1827203 - RNA, 22 nt, Human herpesvirus 2
cgacggcaugcagcccagagga

SEQ ID NO: 1827204 - RNA, 21 nt, Human herpesvirus 2
cgugcugggcgcgagccaggc

SEQ ID NO: 1827205 - RNA, 11 nt, Human herpesvirus 2
gcgcugguggc

SEQ ID NO: 1827206 - RNA, 12 nt, Human herpesvirus 2
cccgccgcagcu

SEQ ID NO: 1827207 - RNA, 14 nt, Human herpesvirus 2
cagcgcggacgcgg

SEQ ID NO: 1827208 - RNA, 18 nt, Human herpesvirus 2
gaccaccccaaaaaccgc

SEQ ID NO: 1827209 - RNA, 20 nt, Human herpesvirus 2
gcagcguaacgcacccccgg

SEQ ID NO: 1827210 - RNA, 14 nt, Human herpesvirus 2
cccggcccgggccc

SEQ ID NO: 1827211 - RNA, 15 nt, Human herpesvirus 2
gacccaacagccuag

SEQ ID NO: 1827212 - RNA, 21 nt, Human herpesvirus 2
cccaccggauaaauguggggc

SEQ ID NO: 1827213 - RNA, 15 nt, Human herpesvirus 2
cggccccacggucag

SEQ ID NO: 1827214 - RNA, 12 nt, Human herpesvirus 2
accgguagccgg

SEQ ID NO: 1827215 - RNA, 20 nt, Human herpesvirus 2
aacacguucgccccgcagcc

SEQ ID NO: 1827216 - RNA, 17 nt, Human herpesvirus 2
aacgcgaccgucgccgc

SEQ ID NO: 1827217 - RNA, 20 nt, Human herpesvirus 2
ugggccgacgugccggggaa

SEQ ID NO: 1827218 - RNA, 22 nt, Human herpesvirus 2
cugaaccgcuggcuggagaccg

SEQ ID NO: 1827219 - RNA, 21 nt, Human herpesvirus 2
cgcgccgccgcgcgggcccgg

SEQ ID NO: 1827220 - RNA, 17 nt, Human herpesvirus 2
auccguggguuagaaaa

SEQ ID NO: 1827221 - RNA, 12 nt, Human herpesvirus 2
cccccgggggug

SEQ ID NO: 1827222 - RNA, 14 nt, Human herpesvirus 2
caucgggcugcugg

SEQ ID NO: 1827223 - RNA, 13 nt, Human herpesvirus 2
uccccgccccccc

SEQ ID NO: 1827224 - RNA, 14 nt, Human herpesvirus 2
agucucuuggggaa

SEQ ID NO: 1827225 - RNA, 23 nt, Human herpesvirus 2
agggcggccucggccggcggagc

SEQ ID NO: 1827226 - RNA, 19 nt, Human herpesvirus 2
cggcaauaaaagaacagaa

SEQ ID NO: 1827227 - RNA, 17 nt, Human herpesvirus 2
ccgcaccggggcggcga

SEQ ID NO: 1827228 - RNA, 17 nt, Human herpesvirus 2
ccgagcuccgggggacu

SEQ ID NO: 1827229 - RNA, 19 nt, Human herpesvirus 2
cgucugcccguggguggcc

SEQ ID NO: 1827230 - RNA, 22 nt, Human herpesvirus 2
gagccccgcgaccaccaaggcc

SEQ ID NO: 1827231 - RNA, 20 nt, Human herpesvirus 2
gccuguuugcaacgagcugc

SEQ ID NO: 1827232 - RNA, 13 nt, Human herpesvirus 2
ugcgccggcacca

SEQ ID NO: 1827233 - RNA, 20 nt, Human herpesvirus 2
ugcacgccaucgcucccagg

SEQ ID NO: 1827234 - RNA, 15 nt, Human herpesvirus 2
cgcccgaaaccagag

SEQ ID NO: 1827235 - RNA, 21 nt, Human herpesvirus 2
cccucugcuuuuggugcgucu

SEQ ID NO: 1827236 - RNA, 15 nt, Human herpesvirus 2
uggggaaaucuauug

SEQ ID NO: 1827237 - RNA, 22 nt, Human herpesvirus 2
gucaggcgcgcgguaugcgugg

SEQ ID NO: 1827238 - RNA, 14 nt, Human herpesvirus 2
ggccugcugugggu

SEQ ID NO: 1827239 - RNA, 22 nt, Human herpesvirus 2
gaacagcucgcggacgagcccg

SEQ ID NO: 1827240 - RNA, 16 nt, Human herpesvirus 2
cugggcgcgagccagg

SEQ ID NO: 1827241 - RNA, 17 nt, Human herpesvirus 2
uggacgcgccucccggg

SEQ ID NO: 1827242 - RNA, 15 nt, Human herpesvirus 2
cgcggaccggccccc

SEQ ID NO: 1827243 - RNA, 14 nt, Human herpesvirus 2
ggaugauggggacg

SEQ ID NO: 1827244 - RNA, 21 nt, Human herpesvirus 2
cgccgaccgccccccccggcg

SEQ ID NO: 1827245 - RNA, 14 nt, Human herpesvirus 2
ccgaguucccccgg

SEQ ID NO: 1827246 - RNA, 15 nt, Human herpesvirus 2
accccuuugacuccu

SEQ ID NO: 1827247 - RNA, 20 nt, Human herpesvirus 2
gcgaugacggcaauaaaaga

SEQ ID NO: 1827248 - RNA, 20 nt, Human herpesvirus 2
ccgcugugccagguggcccu

SEQ ID NO: 1827249 - RNA, 16 nt, Human herpesvirus 2
gcugcggggaccagcc

SEQ ID NO: 1827250 - RNA, 20 nt, Human herpesvirus 2
cuuggaggcccucugggaca

SEQ ID NO: 1827251 - RNA, 23 nt, Human herpesvirus 2
gccgucgcacgcgcgcaggcugg

SEQ ID NO: 1827252 - RNA, 20 nt, Human herpesvirus 2
agacauggggaacccccaga

SEQ ID NO: 1827253 - RNA, 10 nt, Human herpesvirus 2
ggacugggcc

SEQ ID NO: 1827254 - RNA, 14 nt, Human herpesvirus 2
gcucgccagcgacc

SEQ ID NO: 1827255 - RNA, 14 nt, Human herpesvirus 2
agcacgaccaggga

SEQ ID NO: 1827256 - RNA, 17 nt, Human herpesvirus 2
gggcccggacuccgccc

SEQ ID NO: 1827257 - RNA, 16 nt, Human herpesvirus 2
ggagugcgcucuucgc

SEQ ID NO: 1827258 - RNA, 18 nt, Human herpesvirus 2
acaccucccagugccccg

SEQ ID NO: 1827259 - RNA, 13 nt, Human herpesvirus 2
aggcgaccccgcc

SEQ ID NO: 1827260 - RNA, 21 nt, Human herpesvirus 2
gggcccacagcugcgccagaa

SEQ ID NO: 1827261 - RNA, 18 nt, Human herpesvirus 2
ucccgguaugguaauuag

SEQ ID NO: 1827262 - RNA, 19 nt, Human herpesvirus 2
caccggaaaauccucggcc

SEQ ID NO: 1827263 - RNA, 21 nt, Human herpesvirus 2
uaacagcuacccgcauccgca

SEQ ID NO: 1827264 - RNA, 18 nt, Human herpesvirus 2
gggggcgggggugccgug

SEQ ID NO: 1827265 - RNA, 17 nt, Human herpesvirus 2
cgcgggcaggccgcggc

SEQ ID NO: 1827266 - RNA, 14 nt, Human herpesvirus 2
cuuuccuuuccccc

SEQ ID NO: 1827267 - RNA, 16 nt, Human herpesvirus 2
ggaucgggggcugcug

SEQ ID NO: 1827268 - RNA, 17 nt, Human herpesvirus 2
cuccgcgggucccuucc

SEQ ID NO: 1827269 - RNA, 18 nt, Human herpesvirus 2
gggcggcaagaccugccc

SEQ ID NO: 1827270 - RNA, 21 nt, Human herpesvirus 2
cggcgauggccgcgcgcgugu

SEQ ID NO: 1827271 - RNA, 23 nt, Human herpesvirus 2
cgggcacucuggcguccccaggc

SEQ ID NO: 1827272 - RNA, 20 nt, Human herpesvirus 2
cgccauccucaaacaggcca

SEQ ID NO: 1827273 - RNA, 15 nt, Human herpesvirus 2
gacccggcggcgguc

SEQ ID NO: 1827274 - RNA, 12 nt, Human herpesvirus 2
gggggcgggcac

SEQ ID NO: 1827275 - RNA, 13 nt, Human herpesvirus 2
caaaaaccagguc

SEQ ID NO: 1827276 - RNA, 14 nt, Human herpesvirus 2
cggaacgccccggg

SEQ ID NO: 1827277 - RNA, 11 nt, Human herpesvirus 2
gcacacaugau

SEQ ID NO: 1827278 - RNA, 14 nt, Human herpesvirus 2
uccggucccuuccc

SEQ ID NO: 1827279 - RNA, 14 nt, Human herpesvirus 2
ggccccggccgccu

SEQ ID NO: 1827280 - RNA, 13 nt, Human herpesvirus 2
gggccgcccggag

SEQ ID NO: 1827281 - RNA, 18 nt, Human herpesvirus 2
uccgugcuggggaaaucu

SEQ ID NO: 1827282 - RNA, 17 nt, Human herpesvirus 2
cgagccgcugugccagg

SEQ ID NO: 1827283 - RNA, 20 nt, Human herpesvirus 2
gugucguugggcggcccccg

SEQ ID NO: 1827284 - RNA, 15 nt, Human herpesvirus 2
cgcugccggacgcgg

SEQ ID NO: 1827285 - RNA, 16 nt, Human herpesvirus 2
acgaggcccacccccc

SEQ ID NO: 1827286 - RNA, 11 nt, Human herpesvirus 2
cguuuggccaa

SEQ ID NO: 1827287 - RNA, 14 nt, Human herpesvirus 2
gcgugcggcccugc

SEQ ID NO: 1827288 - RNA, 11 nt, Human herpesvirus 2
accagccgccu

SEQ ID NO: 1827289 - RNA, 13 nt, Human herpesvirus 2
cguucggacggcc

SEQ ID NO: 1827290 - RNA, 16 nt, Human herpesvirus 2
cccguacuacccuuuc

SEQ ID NO: 1827291 - RNA, 16 nt, Human herpesvirus 2
acacugaggaacuggg

SEQ ID NO: 1827292 - RNA, 14 nt, Human herpesvirus 2
cccuguuggagccg

SEQ ID NO: 1827293 - RNA, 12 nt, Human herpesvirus 2
ggccgaggcgcc

SEQ ID NO: 1827294 - RNA, 16 nt, Human herpesvirus 2
gguccgcggggggcac

SEQ ID NO: 1827295 - RNA, 20 nt, Human herpesvirus 2
uaggcguugcguuggggcac

SEQ ID NO: 1827296 - RNA, 15 nt, Human herpesvirus 2
agcgcggccgugggc

SEQ ID NO: 1827297 - RNA, 13 nt, Human herpesvirus 2
ccuggggcugucg

SEQ ID NO: 1827298 - RNA, 20 nt, Human herpesvirus 2
cuggccguccggggggacgc

SEQ ID NO: 1827299 - RNA, 21 nt, Human herpesvirus 2
aagcccgaacggaaggccucc

SEQ ID NO: 1827300 - RNA, 15 nt, Human herpesvirus 2
cguaugucuguuuca

SEQ ID NO: 1827301 - RNA, 19 nt, Human herpesvirus 2
ggcacagugggugcucggg

SEQ ID NO: 1827302 - RNA, 21 nt, Human herpesvirus 2
cacccaccccccccccaacuc

SEQ ID NO: 1827303 - RNA, 23 nt, Human herpesvirus 2
cguuuccuccgcgggucccuucc

SEQ ID NO: 1827304 - RNA, 12 nt, Human herpesvirus 2
ccuacgcacccu

SEQ ID NO: 1827305 - RNA, 13 nt, Human herpesvirus 2
gcccgccccaggg

SEQ ID NO: 1827306 - RNA, 22 nt, Human herpesvirus 2
guccucaccgagccgcugugcc

SEQ ID NO: 1827307 - RNA, 19 nt, Human herpesvirus 2
ggaugugucgcggggacag

SEQ ID NO: 1827308 - RNA, 15 nt, Human herpesvirus 2
cgaccccgccccccg

SEQ ID NO: 1827309 - RNA, 16 nt, Human herpesvirus 2
cgggcugggggucccg

SEQ ID NO: 1827310 - RNA, 16 nt, Human herpesvirus 2
gcaucucuggcuccag

SEQ ID NO: 1827311 - RNA, 16 nt, Human herpesvirus 2
gccgccgcgcgggccc

SEQ ID NO: 1827312 - RNA, 19 nt, Human herpesvirus 2
uuggacgaucccgggcccu

SEQ ID NO: 1827313 - RNA, 20 nt, Human herpesvirus 2
aggaggggggcagugcagua

SEQ ID NO: 1827314 - RNA, 16 nt, Human herpesvirus 2
gcuccucagcgcggcc

SEQ ID NO: 1827315 - RNA, 15 nt, Human herpesvirus 2
aucccccggaaggac

SEQ ID NO: 1827316 - RNA, 22 nt, Human herpesvirus 2
cuagucuccgaucugccccgac

SEQ ID NO: 1827317 - RNA, 16 nt, Human herpesvirus 2
ccagacggcgggaccc

SEQ ID NO: 1827318 - RNA, 20 nt, Human herpesvirus 2
cgcaugggccgccagcaguc

SEQ ID NO: 1827319 - RNA, 19 nt, Human herpesvirus 2
ugcgacggcgucucccggg

SEQ ID NO: 1827320 - RNA, 14 nt, Human herpesvirus 2
acgagcugccccgc

SEQ ID NO: 1827321 - RNA, 15 nt, Human herpesvirus 2
augcggggcgggguu

SEQ ID NO: 1827322 - RNA, 16 nt, Human herpesvirus 2
accaccccccuccucc

SEQ ID NO: 1827323 - RNA, 20 nt, Human herpesvirus 2
ucgcuuuccacacccccucc

SEQ ID NO: 1827324 - RNA, 19 nt, Human herpesvirus 2
aggcgacgccaggcccccc

SEQ ID NO: 1827325 - RNA, 17 nt, Human herpesvirus 2
ggaugauggauugauug

SEQ ID NO: 1827326 - RNA, 16 nt, Human herpesvirus 2
ccguaucagcacccca

SEQ ID NO: 1827327 - RNA, 13 nt, Human herpesvirus 2
uccaccaccagca

SEQ ID NO: 1827328 - RNA, 21 nt, Human herpesvirus 2
gacgcuguuguuucugggccc

SEQ ID NO: 1827329 - RNA, 17 nt, Human herpesvirus 2
caauaaaccugugacgu

SEQ ID NO: 1827330 - RNA, 14 nt, Human herpesvirus 2
acuagaaaaacaaa

SEQ ID NO: 1827331 - RNA, 22 nt, Human herpesvirus 2
gcggucgucguccucacggcca

SEQ ID NO: 1827332 - RNA, 16 nt, Human herpesvirus 2
aggugcaguugauucg

SEQ ID NO: 1827333 - RNA, 13 nt, Human herpesvirus 2
ggcguggacgccg

SEQ ID NO: 1827334 - RNA, 15 nt, Human herpesvirus 2
cacacaggcccacca

SEQ ID NO: 1827335 - RNA, 14 nt, Human herpesvirus 2
caagccacccuggg

SEQ ID NO: 1827336 - RNA, 19 nt, Human herpesvirus 2
ggcaccgcgggaggaaggc

SEQ ID NO: 1827337 - RNA, 19 nt, Human herpesvirus 2
gacgacgaccaugggcccc

SEQ ID NO: 1827338 - RNA, 11 nt, Human herpesvirus 2
aaucacggcac

SEQ ID NO: 1827339 - RNA, 13 nt, Human herpesvirus 2
gcaggcaggcguc

SEQ ID NO: 1827340 - RNA, 21 nt, Human herpesvirus 2
gcccucucgaucccgaagcca

SEQ ID NO: 1827341 - RNA, 20 nt, Human herpesvirus 2
cccuuucuuuucccccuacc

SEQ ID NO: 1827342 - RNA, 22 nt, Human herpesvirus 2
gccucccgcaagagccugccgu

SEQ ID NO: 1827343 - RNA, 18 nt, Human herpesvirus 2
gauucucaccuggggcuc

SEQ ID NO: 1827344 - RNA, 17 nt, Human herpesvirus 2
acgggggucccgccucc

SEQ ID NO: 1827345 - RNA, 18 nt, Human herpesvirus 2
ccaacucgcggcaccgcg

SEQ ID NO: 1827346 - RNA, 19 nt, Human herpesvirus 2
cuggccuugcccccacccc

SEQ ID NO: 1827347 - RNA, 14 nt, Human herpesvirus 2
ggggccccagggcu

SEQ ID NO: 1827348 - RNA, 15 nt, Human herpesvirus 2
ggcguuauuuccaaa

SEQ ID NO: 1827349 - RNA, 17 nt, Human herpesvirus 2
aggcgaccccgcccccc

SEQ ID NO: 1827350 - RNA, 20 nt, Human herpesvirus 2
uaccccgccggucucccucu

SEQ ID NO: 1827351 - RNA, 19 nt, Human herpesvirus 2
ccucagcauccugaaccgc

SEQ ID NO: 1827352 - RNA, 16 nt, Human herpesvirus 2
gcaccggacgcgcacg

SEQ ID NO: 1827353 - RNA, 16 nt, Human herpesvirus 2
agcggcguccacgccc

SEQ ID NO: 1827354 - RNA, 14 nt, Human herpesvirus 2
gccgcugugccagg

SEQ ID NO: 1827355 - RNA, 18 nt, Human herpesvirus 2
ccuccgcgggucccuucc

SEQ ID NO: 1827356 - RNA, 23 nt, Human herpesvirus 2
cagcugguucauacccaauggcu

SEQ ID NO: 1827357 - RNA, 15 nt, Human herpesvirus 2
ccgagcgcgggggac

SEQ ID NO: 1827358 - RNA, 22 nt, Human herpesvirus 2
gcgcuucaucgucgccgacucc

SEQ ID NO: 1827359 - RNA, 15 nt, Human herpesvirus 2
ccagcgcacccuggc

SEQ ID NO: 1827360 - RNA, 22 nt, Human herpesvirus 2
cccccuuuacgccuuuccuccc

SEQ ID NO: 1827361 - RNA, 15 nt, Human herpesvirus 2
gccgccuccccgcug

SEQ ID NO: 1827362 - RNA, 18 nt, Human herpesvirus 2
agcugaugucccgcaucu

SEQ ID NO: 1827363 - RNA, 13 nt, Human herpesvirus 2
aaggcgcugcgcc

SEQ ID NO: 1827364 - RNA, 21 nt, Human herpesvirus 2
augcgacggcgucucccgggg

SEQ ID NO: 1827365 - RNA, 22 nt, Human herpesvirus 2
gaggaggcggcgccugcgcccc

SEQ ID NO: 1827366 - RNA, 15 nt, Human herpesvirus 2
accccaccuucgccu

SEQ ID NO: 1827367 - RNA, 19 nt, Human herpesvirus 2
cuguuuuuacgggccccgg

SEQ ID NO: 1827368 - RNA, 14 nt, Human herpesvirus 2
cuggcggccccugu

SEQ ID NO: 1827369 - RNA, 14 nt, Human herpesvirus 2
cgagcgguuggagg

SEQ ID NO: 1827370 - RNA, 13 nt, Human herpesvirus 2
accccgcugcugu

SEQ ID NO: 1827371 - RNA, 15 nt, Human herpesvirus 2
auaacgcgcccgcgu

SEQ ID NO: 1827372 - RNA, 21 nt, Human herpesvirus 2
gguggguguggucguggugcu

SEQ ID NO: 1827373 - RNA, 18 nt, Human herpesvirus 2
ucggccggcggagccccg

SEQ ID NO: 1827374 - RNA, 23 nt, Human herpesvirus 2
cgaauccggggcgugcugugccc

SEQ ID NO: 1827375 - RNA, 14 nt, Human herpesvirus 2
gccaggccccccgg

SEQ ID NO: 1827376 - RNA, 14 nt, Human herpesvirus 2
gccccccccccacc

SEQ ID NO: 1827377 - RNA, 22 nt, Human herpesvirus 2
cgcucugucccccgggcagccg

SEQ ID NO: 1827378 - RNA, 21 nt, Human herpesvirus 2
ucgcaccccaccccugugugc

SEQ ID NO: 1827379 - RNA, 19 nt, Human herpesvirus 2
acgcgcgcaggcuggagcu

SEQ ID NO: 1827380 - RNA, 14 nt, Human herpesvirus 2
gucccccggacccc

SEQ ID NO: 1827381 - RNA, 17 nt, Human herpesvirus 2
ccgagccgcugugccag

SEQ ID NO: 1827382 - RNA, 14 nt, Human herpesvirus 2
auccggccucgggu

SEQ ID NO: 1827383 - RNA, 17 nt, Human herpesvirus 2
cuccggucccuucccca

SEQ ID NO: 1827384 - RNA, 15 nt, Human herpesvirus 2
acgcgcgcgcccccg

SEQ ID NO: 1827385 - RNA, 13 nt, Human herpesvirus 2
uucagggaaacag

SEQ ID NO: 1827386 - RNA, 19 nt, Human herpesvirus 2
cccagcuuucccuccaccc

SEQ ID NO: 1827387 - RNA, 16 nt, Human herpesvirus 2
aaggaagccgcccccc

SEQ ID NO: 1827388 - RNA, 23 nt, Human herpesvirus 2
ccagacgaagucacccggguccc

SEQ ID NO: 1827389 - RNA, 19 nt, Human herpesvirus 2
cacgaccaaaacggacccc

SEQ ID NO: 1827390 - RNA, 23 nt, Human herpesvirus 2
ggcguuauuuccaaacagggccu

SEQ ID NO: 1827391 - RNA, 13 nt, Human herpesvirus 2
gguggggggcgag

SEQ ID NO: 1827392 - RNA, 21 nt, Human herpesvirus 2
ucgggaggggaugggggcgcg

SEQ ID NO: 1827393 - RNA, 22 nt, Human herpesvirus 2
ccccgguuggggcgggcagccg

SEQ ID NO: 1827394 - RNA, 18 nt, Human herpesvirus 2
guccugcggcagcgcgcc

SEQ ID NO: 1827395 - RNA, 21 nt, Human herpesvirus 2
gcuccagguacugcugcacgu

SEQ ID NO: 1827396 - RNA, 16 nt, Human herpesvirus 2
ccgcggacagccaggg

SEQ ID NO: 1827397 - RNA, 19 nt, Human herpesvirus 2
cuuggggaaaucuauugac

SEQ ID NO: 1827398 - RNA, 19 nt, Human herpesvirus 2
ccgcaggcgcgccaccgcc

SEQ ID NO: 1827399 - RNA, 14 nt, Human herpesvirus 2
ucggaggggugagg

SEQ ID NO: 1827400 - RNA, 12 nt, Human herpesvirus 2
ccagccccgcag

SEQ ID NO: 1827401 - RNA, 20 nt, Human herpesvirus 2
gcucccguguaccucugggc

SEQ ID NO: 1827402 - RNA, 19 nt, Human herpesvirus 2
gucgcgggcgggagcggcg

SEQ ID NO: 1827403 - RNA, 14 nt, Human herpesvirus 2
cucguggggcugga

SEQ ID NO: 1827404 - RNA, 24 nt, Human herpesvirus 2
gcccacuuucccccccacuccacc

SEQ ID NO: 1827405 - RNA, 15 nt, Human herpesvirus 2
cucgcgucgggccag

SEQ ID NO: 1827406 - RNA, 15 nt, Human herpesvirus 2
gcguugcgcuuuccg

SEQ ID NO: 1827407 - RNA, 13 nt, Human herpesvirus 2
ugcgagaucuucc

SEQ ID NO: 1827408 - RNA, 15 nt, Human herpesvirus 2
cagaggacgccggcc

SEQ ID NO: 1827409 - RNA, 16 nt, Human herpesvirus 2
ccgaccagcgccgggu

SEQ ID NO: 1827410 - RNA, 20 nt, Human herpesvirus 2
agugggggggggggacggac

SEQ ID NO: 1827411 - RNA, 18 nt, Human herpesvirus 2
cgcgcuguggcgcgcccc

SEQ ID NO: 1827412 - RNA, 11 nt, Human herpesvirus 2
ggccugguggc

SEQ ID NO: 1827413 - RNA, 20 nt, Human herpesvirus 2
gggggacccgacccuguggc

SEQ ID NO: 1827414 - RNA, 16 nt, Human herpesvirus 2
ugggcggcccccggcc

SEQ ID NO: 1827415 - RNA, 18 nt, Human herpesvirus 2
cgccucgggggcaggggg

SEQ ID NO: 1827416 - RNA, 14 nt, Human herpesvirus 2
gucccuuccccacc

SEQ ID NO: 1827417 - RNA, 19 nt, Human herpesvirus 2
ucgcggccgcccgcgccgc

SEQ ID NO: 1827418 - RNA, 22 nt, Human herpesvirus 2
cccccggccuuugcuuccucgc

SEQ ID NO: 1827419 - RNA, 21 nt, Human herpesvirus 2
ggaacuguguuucccccccua

SEQ ID NO: 1827420 - RNA, 15 nt, Human herpesvirus 2
acgacccgccucggg

SEQ ID NO: 1827421 - RNA, 21 nt, Human herpesvirus 2
cacggugcgugcggcccugcc

SEQ ID NO: 1827422 - RNA, 13 nt, Human herpesvirus 2
caguaacggggga

SEQ ID NO: 1827423 - RNA, 15 nt, Human herpesvirus 2
ccuuucccccuuccc

SEQ ID NO: 1827424 - RNA, 18 nt, Human herpesvirus 2
ccaggaggggggcagugc

SEQ ID NO: 1827425 - RNA, 15 nt, Human herpesvirus 2
ucgugggggagugcg

SEQ ID NO: 1827426 - RNA, 11 nt, Human herpesvirus 2
cgcgcagcgca

SEQ ID NO: 1827427 - RNA, 17 nt, Human herpesvirus 2
cccugccccgcccccuc

SEQ ID NO: 1827428 - RNA, 16 nt, Human herpesvirus 2
gugcugcugagcccug

SEQ ID NO: 1827429 - RNA, 18 nt, Human herpesvirus 2
ccuucgccgacgccuucc

SEQ ID NO: 1827430 - RNA, 11 nt, Human herpesvirus 2
cccagggcacc

SEQ ID NO: 1827431 - RNA, 19 nt, Human herpesvirus 2
cgccgucgcuaccgcggcu

SEQ ID NO: 1827432 - RNA, 23 nt, Human herpesvirus 2
uuuccuccgcgggucccuuccca

SEQ ID NO: 1827433 - RNA, 13 nt, Human herpesvirus 2
ggaggggggagau

SEQ ID NO: 1827434 - RNA, 17 nt, Human herpesvirus 2
cgagcguaucggccagg

SEQ ID NO: 1827435 - RNA, 23 nt, Human herpesvirus 2
ccggggggacgcgagccuguguc

SEQ ID NO: 1827436 - RNA, 14 nt, Human herpesvirus 2
cuguacgacagcgg

SEQ ID NO: 1827437 - RNA, 18 nt, Human herpesvirus 2
accgcggcuucuucgccg

SEQ ID NO: 1827438 - RNA, 15 nt, Human herpesvirus 2
cuggccgugcugggc

SEQ ID NO: 1827439 - RNA, 17 nt, Human herpesvirus 2
cuccccgaaagccacca

SEQ ID NO: 1827440 - RNA, 19 nt, Human herpesvirus 2
ccgugcugggcgcgagcca

SEQ ID NO: 1827441 - RNA, 16 nt, Human herpesvirus 2
ccuaccugcgcgugca

SEQ ID NO: 1827442 - RNA, 22 nt, Human herpesvirus 2
guaugucuguuucaauaaaaag

SEQ ID NO: 1827443 - RNA, 14 nt, Human herpesvirus 2
ggccgggacggcgc

SEQ ID NO: 1827444 - RNA, 13 nt, Human herpesvirus 2
cucuggcuccagg

SEQ ID NO: 1827445 - RNA, 23 nt, Human herpesvirus 2
uuccccgcucccguguaccucug

SEQ ID NO: 1827446 - RNA, 13 nt, Human herpesvirus 2
ccgcucccgccuc

SEQ ID NO: 1827447 - RNA, 20 nt, Human herpesvirus 2
caucgucgccgacuccagga

SEQ ID NO: 1827448 - RNA, 19 nt, Human herpesvirus 2
cccggucccccggaccccg

SEQ ID NO: 1827449 - RNA, 17 nt, Human herpesvirus 2
agcugccucccccccgg

SEQ ID NO: 1827450 - RNA, 13 nt, Human herpesvirus 2
cgccccccucggc

SEQ ID NO: 1827451 - RNA, 17 nt, Human herpesvirus 2
cguccggcuggcggcgc

SEQ ID NO: 1827452 - RNA, 17 nt, Human herpesvirus 2
gccgcuguggcccuggc

SEQ ID NO: 1827453 - RNA, 12 nt, Human herpesvirus 2
guugucugucug

SEQ ID NO: 1827454 - RNA, 22 nt, Human herpesvirus 2
ggcgagcuggcccuggacccag

SEQ ID NO: 1827455 - RNA, 14 nt, Human herpesvirus 2
cggcgagggcggcc

SEQ ID NO: 1827456 - RNA, 15 nt, Human herpesvirus 2
ggcgcgcccccgccg

SEQ ID NO: 1827457 - RNA, 12 nt, Human herpesvirus 2
gucccggccgcc

SEQ ID NO: 1827458 - RNA, 12 nt, Human herpesvirus 2
ccacagccaccu

SEQ ID NO: 1827459 - RNA, 20 nt, Human herpesvirus 2
ccucgggggcagggggaggu

SEQ ID NO: 1827460 - RNA, 18 nt, Human herpesvirus 2
guuccaccgcucacccac

SEQ ID NO: 1827461 - RNA, 20 nt, Human herpesvirus 2
gagaguucaauagauuuccc

SEQ ID NO: 1827462 - RNA, 15 nt, Human herpesvirus 2
cccucgccgccuucc

SEQ ID NO: 1827463 - RNA, 17 nt, Human herpesvirus 2
uggggugggggaagaag

SEQ ID NO: 1827464 - RNA, 19 nt, Human herpesvirus 2
ucuguuuugguugguucuc

SEQ ID NO: 1827465 - RNA, 12 nt, Human herpesvirus 2
ggccccucugcu

SEQ ID NO: 1827466 - RNA, 12 nt, Human herpesvirus 2
cgccgccuuccg

SEQ ID NO: 1827467 - RNA, 21 nt, Human herpesvirus 2
uugggggggguguguguuuuc

SEQ ID NO: 1827468 - RNA, 20 nt, Human herpesvirus 2
ccgcggcccugagccgcgcg

SEQ ID NO: 1827469 - RNA, 15 nt, Human herpesvirus 2
ggcgcgcuggcggaa

SEQ ID NO: 1827470 - RNA, 17 nt, Human herpesvirus 2
agcggcgaacacugccu

SEQ ID NO: 1827471 - RNA, 18 nt, Human herpesvirus 2
ugcccaucuacguggccg

SEQ ID NO: 1827472 - RNA, 13 nt, Human herpesvirus 2
ggcccucugggac

SEQ ID NO: 1827473 - RNA, 23 nt, Human herpesvirus 2
gcucugccugcacgagcgccguc

SEQ ID NO: 1827474 - RNA, 13 nt, Human herpesvirus 2
gccgccccgcagu

SEQ ID NO: 1827475 - RNA, 18 nt, Human herpesvirus 2
gccgcgcgacggccgaga

SEQ ID NO: 1827476 - RNA, 17 nt, Human herpesvirus 2
acgccagcugcuggcca

SEQ ID NO: 1827477 - RNA, 23 nt, Human herpesvirus 2
ccccggaggggcuccucagcgcg

SEQ ID NO: 1827478 - RNA, 18 nt, Human herpesvirus 2
ccggggaccgcagucugg

SEQ ID NO: 1827479 - RNA, 18 nt, Human herpesvirus 2
gaugacggcaauaaaaga

SEQ ID NO: 1827480 - RNA, 14 nt, Human herpesvirus 2
ccccaccccggagg

SEQ ID NO: 1827481 - RNA, 19 nt, Human herpesvirus 2
gcagcuuuuaacgggccgc

SEQ ID NO: 1827482 - RNA, 12 nt, Human herpesvirus 2
ccaacucugucu

SEQ ID NO: 1827483 - RNA, 19 nt, Human herpesvirus 2
ggacagccagggcugggag

SEQ ID NO: 1827484 - RNA, 19 nt, Human herpesvirus 2
cacgugggcggcgaaccgg

SEQ ID NO: 1827485 - RNA, 12 nt, Human herpesvirus 2
uuacccacacac

SEQ ID NO: 1827486 - RNA, 16 nt, Human herpesvirus 2
acggucgauuuaacca

SEQ ID NO: 1827487 - RNA, 21 nt, Human herpesvirus 2
aggaacccaauggccgcuccu

SEQ ID NO: 1827488 - RNA, 23 nt, Human herpesvirus 2
caccagacggcgggaccccgacg

SEQ ID NO: 1827489 - RNA, 20 nt, Human herpesvirus 2
ugcacuugcccccccccggg

SEQ ID NO: 1827490 - RNA, 21 nt, Human herpesvirus 2
gucgcuccccuucagccugga

SEQ ID NO: 1827491 - RNA, 15 nt, Human herpesvirus 2
ggugugaccccccca

SEQ ID NO: 1827492 - RNA, 15 nt, Human herpesvirus 2
agcuaaggcgcccgc

SEQ ID NO: 1827493 - RNA, 23 nt, Human herpesvirus 2
ccgcgagcgccgcuacugcgcca

SEQ ID NO: 1827494 - RNA, 22 nt, Human herpesvirus 2
cggggaccgcaccggacgcgca

SEQ ID NO: 1827495 - RNA, 22 nt, Human herpesvirus 2
uccguguccgcggucuguuugu

SEQ ID NO: 1827496 - RNA, 19 nt, Human herpesvirus 2
gucgcccauacaaauuaaa

SEQ ID NO: 1827497 - RNA, 20 nt, Human herpesvirus 2
agccccccccccucaccccu

SEQ ID NO: 1827498 - RNA, 21 nt, Human herpesvirus 2
gcuuagggugugaccccccca

SEQ ID NO: 1827499 - RNA, 19 nt, Human herpesvirus 2
ucaugucuuuccaccacca

SEQ ID NO: 1827500 - RNA, 13 nt, Human herpesvirus 2
acccagaggcugg

SEQ ID NO: 1827501 - RNA, 21 nt, Human herpesvirus 2
ggaucgugugcacgaaaaaga

SEQ ID NO: 1827502 - RNA, 13 nt, Human herpesvirus 2
ucaggaccaggga

SEQ ID NO: 1827503 - RNA, 17 nt, Human herpesvirus 2
ccucccuuccgagcgcg

SEQ ID NO: 1827504 - RNA, 22 nt, Human herpesvirus 2
gugaucuuggcguuauuuccaa

SEQ ID NO: 1827505 - RNA, 23 nt, Human herpesvirus 2
acugcacuugcccccccccgggg

SEQ ID NO: 1827506 - RNA, 16 nt, Human herpesvirus 2
gcgucggcggccccgg

SEQ ID NO: 1827507 - RNA, 18 nt, Human herpesvirus 2
ccaccggccgaggcgccu

SEQ ID NO: 1827508 - RNA, 14 nt, Human herpesvirus 2
ccuuccccaccacc

SEQ ID NO: 1827509 - RNA, 13 nt, Human herpesvirus 2
caggcuggagcuc

SEQ ID NO: 1827510 - RNA, 13 nt, Human herpesvirus 2
gcgcgcauccaca

SEQ ID NO: 1827511 - RNA, 16 nt, Human herpesvirus 2
gcuuuuacccucaccc

SEQ ID NO: 1827512 - RNA, 19 nt, Human herpesvirus 2
agacgcccgcgagccgcac

SEQ ID NO: 1827513 - RNA, 23 nt, Human herpesvirus 2
gccucggccggcggagccccgga

SEQ ID NO: 1827514 - RNA, 16 nt, Human herpesvirus 2
uggcgugugucucuga

SEQ ID NO: 1827515 - RNA, 14 nt, Human herpesvirus 2
cgcaccgcuguccc

SEQ ID NO: 1827516 - RNA, 12 nt, Human herpesvirus 2
gcccggcgccgc

SEQ ID NO: 1827517 - RNA, 15 nt, Human herpesvirus 2
aacccccgaccccgc

SEQ ID NO: 1827518 - RNA, 24 nt, Human herpesvirus 2
acccccgaacagccccuggggcug

SEQ ID NO: 1827519 - RNA, 14 nt, Human herpesvirus 2
cucggucgacgagg

SEQ ID NO: 1827520 - RNA, 19 nt, Human herpesvirus 2
guugcguuggggcacggcg

SEQ ID NO: 1827521 - RNA, 11 nt, Human herpesvirus 2
ccacacagaaa

SEQ ID NO: 1827522 - RNA, 23 nt, Human herpesvirus 2
gcuggcugcggggggcggugggu

SEQ ID NO: 1827523 - RNA, 19 nt, Human herpesvirus 2
caugucuuuccaccaccag

SEQ ID NO: 1827524 - RNA, 12 nt, Human herpesvirus 2
accaccaaggcc

SEQ ID NO: 1827525 - RNA, 21 nt, Human herpesvirus 2
ggaggggcuccucagcgcggc

SEQ ID NO: 1827526 - RNA, 20 nt, Human herpesvirus 2
agccaccgucccgcccgcca

SEQ ID NO: 1827527 - RNA, 23 nt, Human herpesvirus 2
aacgcgcuguggcgcgcccccgc

SEQ ID NO: 1827528 - RNA, 17 nt, Human herpesvirus 2
ccauacaaauuaaauac

SEQ ID NO: 1827529 - RNA, 15 nt, Human herpesvirus 2
gaggcgccucugccc

SEQ ID NO: 1827530 - RNA, 19 nt, Human herpesvirus 2
gccgugucgcuaaacaggg

SEQ ID NO: 1827531 - RNA, 15 nt, Human herpesvirus 2
gugcgugcggcccug

SEQ ID NO: 1827532 - RNA, 23 nt, Human herpesvirus 2
cgguuuuuuuuuguugucugucu

SEQ ID NO: 1827533 - RNA, 22 nt, Human herpesvirus 2
gaggugcgccaggucagcgauc

SEQ ID NO: 1827534 - RNA, 20 nt, Human herpesvirus 2
gucagcgaucgccagccgcg

SEQ ID NO: 1827535 - RNA, 16 nt, Human herpesvirus 2
gcgaacccccuaaccg

SEQ ID NO: 1827536 - RNA, 20 nt, Human herpesvirus 2
gggcaccacguguccccagg

SEQ ID NO: 1827537 - RNA, 15 nt, Human herpesvirus 2
uccuugaugguuccg

SEQ ID NO: 1827538 - RNA, 18 nt, Human herpesvirus 2
cuugcuugggggggcguc

SEQ ID NO: 1827539 - RNA, 24 nt, Human herpesvirus 2
acgaggccgccaacgacuuccucg

SEQ ID NO: 1827540 - RNA, 22 nt, Human herpesvirus 2
gcaacgggugguggccgaacgc

SEQ ID NO: 1827541 - RNA, 15 nt, Human herpesvirus 2
cugcgucguccaggg

SEQ ID NO: 1827542 - RNA, 12 nt, Human herpesvirus 2
aaagguuggugu

SEQ ID NO: 1827543 - RNA, 21 nt, Human herpesvirus 2
gagcccucacgucuucgccca

SEQ ID NO: 1827544 - RNA, 22 nt, Human herpesvirus 2
gggaggaggggggugguggccg

SEQ ID NO: 1827545 - RNA, 15 nt, Human herpesvirus 2
gaagggacccgcgga

SEQ ID NO: 1827546 - RNA, 14 nt, Human herpesvirus 2
acgggggggcuggu

SEQ ID NO: 1827547 - RNA, 21 nt, Human herpesvirus 2
gaguucaauagauuucccaaa

SEQ ID NO: 1827548 - RNA, 17 nt, Human herpesvirus 2
ugccaucgcucgggggu

SEQ ID NO: 1827549 - RNA, 19 nt, Human herpesvirus 2
uuuccggcaacccuccucg

SEQ ID NO: 1827550 - RNA, 21 nt, Human herpesvirus 2
aggggcaccaaaaaccagguc

SEQ ID NO: 1827551 - RNA, 13 nt, Human herpesvirus 2
caucaccccaggg

SEQ ID NO: 1827552 - RNA, 21 nt, Human herpesvirus 2
ggcggccgcacccacgacauc

SEQ ID NO: 1827553 - RNA, 20 nt, Human herpesvirus 2
gccagcacgaccagggaggc

SEQ ID NO: 1827554 - RNA, 13 nt, Human herpesvirus 2
ggguguggucgug

SEQ ID NO: 1827555 - RNA, 16 nt, Human herpesvirus 2
cggucaauaaagagcu

SEQ ID NO: 1827556 - RNA, 21 nt, Human herpesvirus 2
ccccuaaccgcgcgccuccuc

SEQ ID NO: 1827557 - RNA, 15 nt, Human herpesvirus 2
agggcgagcucggcu

SEQ ID NO: 1827558 - RNA, 17 nt, Human herpesvirus 2
ggcacagguggugcacg

SEQ ID NO: 1827559 - RNA, 18 nt, Human herpesvirus 2
ggcgaacgggggaucugu

SEQ ID NO: 1827560 - RNA, 19 nt, Human herpesvirus 2
gcgcgccgacgaccugcag

SEQ ID NO: 1827561 - RNA, 17 nt, Human herpesvirus 2
cgcuacacgacccugga

SEQ ID NO: 1827562 - RNA, 21 nt, Human herpesvirus 2
cgagagcgccgucgggccccg

SEQ ID NO: 1827563 - RNA, 21 nt, Human herpesvirus 2
gugaaauuccgagaauuucuu

SEQ ID NO: 1827564 - RNA, 20 nt, Human herpesvirus 2
ucugcgcgaggccgcucucc

SEQ ID NO: 1827565 - RNA, 21 nt, Human herpesvirus 2
aucggccaggagguccuggag

SEQ ID NO: 1827566 - RNA, 18 nt, Human herpesvirus 2
ugcugggcgcgagccagg

SEQ ID NO: 1827567 - RNA, 13 nt, Human herpesvirus 2
gccaacucugucu

SEQ ID NO: 1827568 - RNA, 18 nt, Human herpesvirus 2
ggaugggcggggcccggg

SEQ ID NO: 1827569 - RNA, 13 nt, Human herpesvirus 2
ggcaagugcagua

SEQ ID NO: 1827570 - RNA, 18 nt, Human herpesvirus 2
cucucaaacaaaaacaca

SEQ ID NO: 1827571 - RNA, 12 nt, Human herpesvirus 2
gcggggccccgg

SEQ ID NO: 1827572 - RNA, 16 nt, Human herpesvirus 2
gcgccguccucgugga

SEQ ID NO: 1827573 - RNA, 12 nt, Human herpesvirus 2
cggcccccggcc

SEQ ID NO: 1827574 - RNA, 21 nt, Human herpesvirus 2
aggaacugggguacugcacug

SEQ ID NO: 1827575 - RNA, 14 nt, Human herpesvirus 2
ccgagaauuucuua

SEQ ID NO: 1827576 - RNA, 23 nt, Human herpesvirus 2
aagacucggugcguuccagcgcg

SEQ ID NO: 1827577 - RNA, 18 nt, Human herpesvirus 2
ggaagcugccuccccccc

SEQ ID NO: 1827578 - RNA, 14 nt, Human herpesvirus 2
ccccagcuuucccu

SEQ ID NO: 1827579 - RNA, 24 nt, Human herpesvirus 2
ccacagcaauaaacauuggcaagc

SEQ ID NO: 1827580 - RNA, 19 nt, Human herpesvirus 2
ugcgccuccguccuuucca

SEQ ID NO: 1827581 - RNA, 12 nt, Human herpesvirus 2
cguaaacaccaa

SEQ ID NO: 1827582 - RNA, 15 nt, Human herpesvirus 2
gcagccccggucccc

SEQ ID NO: 1827583 - RNA, 22 nt, Human herpesvirus 2
ccgagcgccgggcagacagaca

SEQ ID NO: 1827584 - RNA, 11 nt, Human herpesvirus 2
gaccgcccccc

SEQ ID NO: 1827585 - RNA, 20 nt, Human herpesvirus 2
ccuagccuucggccaccugg

SEQ ID NO: 1827586 - RNA, 22 nt, Human herpesvirus 2
augaggggcaccaaaaaccagg

SEQ ID NO: 1827587 - RNA, 21 nt, Human herpesvirus 2
cgcucgcugcagggccuggcg

SEQ ID NO: 1827588 - RNA, 12 nt, Human herpesvirus 2
ggaaagaaagaa

SEQ ID NO: 1827589 - RNA, 18 nt, Human herpesvirus 2
gaggggcuuggccuuccc

SEQ ID NO: 1827590 - RNA, 21 nt, Human herpesvirus 2
ggggacccgccagagacccug

SEQ ID NO: 1827591 - RNA, 13 nt, Human herpesvirus 2
ucucgaaggaggg

SEQ ID NO: 1827592 - RNA, 19 nt, Human herpesvirus 2
gcgcgccccccccccacca

SEQ ID NO: 1827593 - RNA, 15 nt, Human herpesvirus 2
caccccccuucuccu

SEQ ID NO: 1827594 - RNA, 17 nt, Human herpesvirus 2
ccuagccccccccccuc

SEQ ID NO: 1827595 - RNA, 16 nt, Human herpesvirus 2
cgugugggaggguggc

SEQ ID NO: 1827596 - RNA, 15 nt, Human herpesvirus 2
cguucgucgggccgu

SEQ ID NO: 1827597 - RNA, 19 nt, Human herpesvirus 2
ggauccuccgccagcucgg

SEQ ID NO: 1827598 - RNA, 14 nt, Human herpesvirus 2
uuacgugacgucaa

SEQ ID NO: 1827599 - RNA, 17 nt, Human herpesvirus 2
acagcgggcacucuggc

SEQ ID NO: 1827600 - RNA, 16 nt, Human herpesvirus 2
acaugaggcugagggg

SEQ ID NO: 1827601 - RNA, 14 nt, Human herpesvirus 2
ccccgcuggcggga

SEQ ID NO: 1827602 - RNA, 19 nt, Human herpesvirus 2
cccgggcgagcuggcccug

SEQ ID NO: 1827603 - RNA, 15 nt, Human herpesvirus 2
acggccccgaacagc

SEQ ID NO: 1827604 - RNA, 16 nt, Human herpesvirus 2
auuaccgaccccccgg

SEQ ID NO: 1827605 - RNA, 18 nt, Human herpesvirus 2
aaccccgcggcccugagc

SEQ ID NO: 1827606 - RNA, 18 nt, Human herpesvirus 2
agggcuucguggaagagg

SEQ ID NO: 1827607 - RNA, 17 nt, Human herpesvirus 2
gacgggccggugggccc

SEQ ID NO: 1827608 - RNA, 19 nt, Human herpesvirus 2
ggggacggccgggcagagc

SEQ ID NO: 1827609 - RNA, 14 nt, Human herpesvirus 2
cgagcggugucgcg

SEQ ID NO: 1827610 - RNA, 22 nt, Human herpesvirus 2
cgccaggccccccgggagccgc

SEQ ID NO: 1827611 - RNA, 11 nt, Human herpesvirus 2
gauugauuuua

SEQ ID NO: 1827612 - RNA, 15 nt, Human herpesvirus 2
cagccagggcuggga

SEQ ID NO: 1827613 - RNA, 22 nt, Human herpesvirus 2
gcacucgggcguagagcucggc

SEQ ID NO: 1827614 - RNA, 19 nt, Human herpesvirus 2
gacgugcgaugacgugggu

SEQ ID NO: 1827615 - RNA, 19 nt, Human herpesvirus 2
gcgcgugugugagaaauaa

SEQ ID NO: 1827616 - RNA, 23 nt, Human herpesvirus 2
ccgcggggggcacgggcccgggg

SEQ ID NO: 1827617 - RNA, 21 nt, Human herpesvirus 2
accaggucuuuccguggcgcc

SEQ ID NO: 1827618 - RNA, 14 nt, Human herpesvirus 2
ggcgcggugccuga

SEQ ID NO: 1827619 - RNA, 15 nt, Human herpesvirus 2
cugggcgcgagccag

SEQ ID NO: 1827620 - RNA, 17 nt, Human herpesvirus 2
acggcccaccugcacga

SEQ ID NO: 1827621 - RNA, 16 nt, Human herpesvirus 2
cccguguaccucuggg

SEQ ID NO: 1827622 - RNA, 17 nt, Human herpesvirus 2
ccugcgucgccccgugc

SEQ ID NO: 1827623 - RNA, 21 nt, Human herpesvirus 2
ugucugagugucugguuuuuc

SEQ ID NO: 1827624 - RNA, 15 nt, Human herpesvirus 2
caccggggaaacagg

SEQ ID NO: 1827625 - RNA, 14 nt, Human herpesvirus 2
agagccgauccggc

SEQ ID NO: 1827626 - RNA, 22 nt, Human herpesvirus 2
agccacccugggucgggagcag

SEQ ID NO: 1827627 - RNA, 20 nt, Human herpesvirus 2
gcgcggccacgucguccggg

SEQ ID NO: 1827628 - RNA, 13 nt, Human herpesvirus 2
uauaaaggccagg

SEQ ID NO: 1827629 - RNA, 13 nt, Human herpesvirus 2
gcucggucgccuu

SEQ ID NO: 1827630 - RNA, 17 nt, Human herpesvirus 2
cggcagcccggaccccu

SEQ ID NO: 1827631 - RNA, 16 nt, Human herpesvirus 2
cggacgcggccagaaa

SEQ ID NO: 1827632 - RNA, 14 nt, Human herpesvirus 2
ggagucccccggcu

SEQ ID NO: 1827633 - RNA, 12 nt, Human herpesvirus 2
caccccccccuc

SEQ ID NO: 1827634 - RNA, 23 nt, Human herpesvirus 2
gcuugccccucccccggcccagc

SEQ ID NO: 1827635 - RNA, 17 nt, Human herpesvirus 2
caguguuugggaaaucu

SEQ ID NO: 1827636 - RNA, 17 nt, Human herpesvirus 2
gaggcccucugggacac

SEQ ID NO: 1827637 - RNA, 18 nt, Human herpesvirus 2
caaaagaaacggcaagaa

SEQ ID NO: 1827638 - RNA, 16 nt, Human herpesvirus 2
ccacaagcuaugcauc

SEQ ID NO: 1827639 - RNA, 16 nt, Human herpesvirus 2
accccgccgcagcuca

SEQ ID NO: 1827640 - RNA, 19 nt, Human herpesvirus 2
ccuguuuuuacgggccccg

SEQ ID NO: 1827641 - RNA, 23 nt, Human herpesvirus 2
aggcgcauaaagguccggcggcc

SEQ ID NO: 1827642 - RNA, 17 nt, Human herpesvirus 2
cuuggaggcccucuggg

SEQ ID NO: 1827643 - RNA, 15 nt, Human herpesvirus 2
ggcccgugugggagg

SEQ ID NO: 1827644 - RNA, 20 nt, Human herpesvirus 2
cacaagacacacacacaggc

SEQ ID NO: 1827645 - RNA, 13 nt, Human herpesvirus 2
uaacgggccgcca

SEQ ID NO: 1827646 - RNA, 20 nt, Human herpesvirus 2
ccucgcccagacgcccuccg

SEQ ID NO: 1827647 - RNA, 17 nt, Human herpesvirus 2
acacaggcccaccacca

SEQ ID NO: 1827648 - RNA, 22 nt, Human herpesvirus 2
uguuguggcuggaggcaaacac

SEQ ID NO: 1827649 - RNA, 19 nt, Human herpesvirus 2
gugggcguugccgggggcc

SEQ ID NO: 1827650 - RNA, 18 nt, Human herpesvirus 2
cgucccccacggucagga

SEQ ID NO: 1827651 - RNA, 19 nt, Human herpesvirus 2
cauuuugugggggcccagg

SEQ ID NO: 1827652 - RNA, 20 nt, Human herpesvirus 2
gcacaagacacacacacagg

SEQ ID NO: 1827653 - RNA, 22 nt, Human herpesvirus 2
aaggucccgauggccgccccgc

SEQ ID NO: 1827654 - RNA, 15 nt, Human herpesvirus 2
gcggccauccugccc

SEQ ID NO: 1827655 - RNA, 20 nt, Human herpesvirus 2
ggggcgugugacuagaaaaa

SEQ ID NO: 1827656 - RNA, 17 nt, Human herpesvirus 2
ggcacgggcccggggcg

SEQ ID NO: 1827657 - RNA, 16 nt, Human herpesvirus 2
ggcgcccagacccuca

SEQ ID NO: 1827658 - RNA, 20 nt, Human herpesvirus 2
agacgcccgcgagccgcaca

SEQ ID NO: 1827659 - RNA, 19 nt, Human herpesvirus 2
cgccgccgggaaccccggc

SEQ ID NO: 1827660 - RNA, 23 nt, Human herpesvirus 2
acgacccccgaacagccccuggg

SEQ ID NO: 1827661 - RNA, 15 nt, Human herpesvirus 2
ccggcgugggugacu

SEQ ID NO: 1827662 - RNA, 23 nt, Human herpesvirus 2
gcuuccaccccccccccccuucc

SEQ ID NO: 1827663 - RNA, 12 nt, Human herpesvirus 2
cagcaccccacc

SEQ ID NO: 1827664 - RNA, 21 nt, Human herpesvirus 2
auagucccccguauaggcaua

SEQ ID NO: 1827665 - RNA, 13 nt, Human herpesvirus 2
auggggagagggg

SEQ ID NO: 1827666 - RNA, 21 nt, Human herpesvirus 2
gggagauggggagagggggaa

SEQ ID NO: 1827667 - RNA, 22 nt, Human herpesvirus 2
aagagacgaugggagccccgcg

SEQ ID NO: 1827668 - RNA, 18 nt, Human herpesvirus 2
gcuacacgacccuggaga

SEQ ID NO: 1827669 - RNA, 22 nt, Human herpesvirus 2
uugugcgggaggggcuuggccu

SEQ ID NO: 1827670 - RNA, 15 nt, Human herpesvirus 2
cgagaagccgccccc

SEQ ID NO: 1827671 - RNA, 15 nt, Human herpesvirus 2
acagccagggcuggg

SEQ ID NO: 1827672 - RNA, 17 nt, Human herpesvirus 2
ugggugcucggggacag

SEQ ID NO: 1827673 - RNA, 23 nt, Human herpesvirus 2
ccaggcaaacgguaagcagcgcg

SEQ ID NO: 1827674 - RNA, 23 nt, Human herpesvirus 2
cuacgcguguacgcgaaggcgga

SEQ ID NO: 1827675 - RNA, 22 nt, Human herpesvirus 2
cgcuccagguacugcugcacgu

SEQ ID NO: 1827676 - RNA, 17 nt, Human herpesvirus 2
acgucacgcaggccgcc

SEQ ID NO: 1827677 - RNA, 18 nt, Human herpesvirus 2
gaggcgccucgggggcag

SEQ ID NO: 1827678 - RNA, 13 nt, Human herpesvirus 2
caccgcacccggg

SEQ ID NO: 1827679 - RNA, 14 nt, Human herpesvirus 2
cacggucugguggc

SEQ ID NO: 1827680 - RNA, 13 nt, Human herpesvirus 2
ggggacagccccg

SEQ ID NO: 1827681 - RNA, 21 nt, Human herpesvirus 2
cccccggggggcguggagggg

SEQ ID NO: 1827682 - RNA, 17 nt, Human herpesvirus 2
auuuuccccccaccccu

SEQ ID NO: 1827683 - RNA, 17 nt, Human herpesvirus 2
ccguggcggaggccugu

SEQ ID NO: 1827684 - RNA, 19 nt, Human herpesvirus 2
cgugcuuuuguuccaccgc

SEQ ID NO: 1827685 - RNA, 14 nt, Human herpesvirus 2
ggggccugcugugg

SEQ ID NO: 1827686 - RNA, 20 nt, Human herpesvirus 2
uuggucaauaaaccggggcc

SEQ ID NO: 1827687 - RNA, 17 nt, Human herpesvirus 2
ccaggcgcugcugcgca

SEQ ID NO: 1827688 - RNA, 22 nt, Human herpesvirus 2
ccgcaucaguccgcgcggggcg

SEQ ID NO: 1827689 - RNA, 18 nt, Human herpesvirus 2
ucgggagcaggacagccg

SEQ ID NO: 1827690 - RNA, 21 nt, Human herpesvirus 2
cgcacguacguucugccccgc

SEQ ID NO: 1827691 - RNA, 14 nt, Human herpesvirus 2
gcaugcaaauuaaa

SEQ ID NO: 1827692 - RNA, 22 nt, Human herpesvirus 2
gcugggcuuguguauaaauaaa

SEQ ID NO: 1827693 - RNA, 11 nt, Human herpesvirus 2
ugcagggccug

SEQ ID NO: 1827694 - RNA, 17 nt, Human herpesvirus 2
cguacguucugccccgc

SEQ ID NO: 1827695 - RNA, 18 nt, Human herpesvirus 2
acccccggcgauucccuu

SEQ ID NO: 1827696 - RNA, 18 nt, Human herpesvirus 2
gguuccuauaacccacaa

SEQ ID NO: 1827697 - RNA, 17 nt, Human herpesvirus 2
aucucuggcuccaggcc

SEQ ID NO: 1827698 - RNA, 21 nt, Human herpesvirus 2
aggucugcgcgaggccgcucu

SEQ ID NO: 1827699 - RNA, 21 nt, Human herpesvirus 2
cuucauuuugugggggcccag

SEQ ID NO: 1827700 - RNA, 19 nt, Human herpesvirus 2
gcguccggaaccccucugg

SEQ ID NO: 1827701 - RNA, 22 nt, Human herpesvirus 2
gggccucucgacggagagccgg

SEQ ID NO: 1827702 - RNA, 18 nt, Human herpesvirus 2
uccgccagcgcccuuccg

SEQ ID NO: 1827703 - RNA, 21 nt, Human herpesvirus 2
ccaccccccccccccuucccg

SEQ ID NO: 1827704 - RNA, 15 nt, Human herpesvirus 2
cccacccccccgccg

SEQ ID NO: 1827705 - RNA, 15 nt, Human herpesvirus 2
cagguggcccuuccg

SEQ ID NO: 1827706 - RNA, 21 nt, Human herpesvirus 2
cggcgcgcguuucugaucgac

SEQ ID NO: 1827707 - RNA, 16 nt, Human herpesvirus 2
accagcggccccaucc

SEQ ID NO: 1827708 - RNA, 22 nt, Human herpesvirus 2
cacgcaggccgcccccagcagg

SEQ ID NO: 1827709 - RNA, 18 nt, Human herpesvirus 2
cgacgaccaccgcgacca

SEQ ID NO: 1827710 - RNA, 22 nt, Human herpesvirus 2
cgcgcaggcuggagcucugccu

SEQ ID NO: 1827711 - RNA, 13 nt, Human herpesvirus 2
gagcagcacggcg

SEQ ID NO: 1827712 - RNA, 18 nt, Human herpesvirus 2
acggucggcgaacacaac

SEQ ID NO: 1827713 - RNA, 15 nt, Human herpesvirus 2
gcccacccccccacc

SEQ ID NO: 1827714 - RNA, 17 nt, Human herpesvirus 2
cccggccgccccccguc

SEQ ID NO: 1827715 - RNA, 20 nt, Human herpesvirus 2
cggcgggucccuccgcggcc

SEQ ID NO: 1827716 - RNA, 12 nt, Human herpesvirus 2
gccgggcagaca

SEQ ID NO: 1827717 - RNA, 22 nt, Human herpesvirus 2
agaggucaauagauuuccccaa

SEQ ID NO: 1827718 - RNA, 23 nt, Human herpesvirus 2
gcccaacccaaccgacucccucc

SEQ ID NO: 1827719 - RNA, 12 nt, Human herpesvirus 2
cguuauuuccaa

SEQ ID NO: 1827720 - RNA, 15 nt, Human herpesvirus 2
ggggcaagugcagua

SEQ ID NO: 1827721 - RNA, 19 nt, Human herpesvirus 2
cccggcccugcggccaagc

SEQ ID NO: 1827722 - RNA, 19 nt, Human herpesvirus 2
cgccggccaaccgcgcgcc

SEQ ID NO: 1827723 - RNA, 18 nt, Human herpesvirus 2
gcggccauccugcccacc

SEQ ID NO: 1827724 - RNA, 17 nt, Human herpesvirus 2
cauggaagcccccggca

SEQ ID NO: 1827725 - RNA, 15 nt, Human herpesvirus 2
gcacggcggacacaa

SEQ ID NO: 1827726 - RNA, 15 nt, Human herpesvirus 2
ccgacggcggggccc

SEQ ID NO: 1827727 - RNA, 20 nt, Human herpesvirus 2
cacguguccccagggagccc

SEQ ID NO: 1827728 - RNA, 12 nt, Human herpesvirus 2
accggggcggcg

SEQ ID NO: 1827729 - RNA, 13 nt, Human herpesvirus 2
agaacgagacaga

SEQ ID NO: 1827730 - RNA, 16 nt, Human herpesvirus 2
cgcgagggccccggcc

SEQ ID NO: 1827731 - RNA, 20 nt, Human herpesvirus 2
caccagacggcgggaccccg

SEQ ID NO: 1827732 - RNA, 16 nt, Human herpesvirus 2
aaacguucggacggcc

SEQ ID NO: 1827733 - RNA, 17 nt, Human herpesvirus 2
gagcccguggcccacga

SEQ ID NO: 1827734 - RNA, 17 nt, Human herpesvirus 2
uugugggacugggggcg

SEQ ID NO: 1827735 - RNA, 16 nt, Human herpesvirus 2
caucaucgucccgguu

SEQ ID NO: 1827736 - RNA, 14 nt, Human herpesvirus 2
gcagagagauuucc

SEQ ID NO: 1827737 - RNA, 14 nt, Human herpesvirus 2
ggcggccaccccgc

SEQ ID NO: 1827738 - RNA, 13 nt, Human herpesvirus 2
ccuuuaagacaga

SEQ ID NO: 1827739 - RNA, 16 nt, Human herpesvirus 2
gaacuguguuuccccc

SEQ ID NO: 1827740 - RNA, 19 nt, Human herpesvirus 2
cacggcaaccccagggcgu

SEQ ID NO: 1827741 - RNA, 20 nt, Human herpesvirus 2
ccaaccuggcacagcgggca

SEQ ID NO: 1827742 - RNA, 23 nt, Human herpesvirus 2
uccagaacccccguaaacaccag

SEQ ID NO: 1827743 - RNA, 20 nt, Human herpesvirus 2
ggccgcucgcugcagggccu

SEQ ID NO: 1827744 - RNA, 19 nt, Human herpesvirus 2
cgaggcccccggcccugcg

SEQ ID NO: 1827745 - RNA, 19 nt, Human herpesvirus 2
cucgcuguuuuuuuucucu

SEQ ID NO: 1827746 - RNA, 12 nt, Human herpesvirus 2
cagaugcugccc

SEQ ID NO: 1827747 - RNA, 16 nt, Human herpesvirus 2
gaccagaccguggccg

SEQ ID NO: 1827748 - RNA, 22 nt, Human herpesvirus 2
ccgcggucgcgcgggccguggc

SEQ ID NO: 1827749 - RNA, 20 nt, Human herpesvirus 2
cgcggggguucggggccagg

SEQ ID NO: 1827750 - RNA, 19 nt, Human herpesvirus 2
cuaaccgcgcgccuccucg

SEQ ID NO: 1827751 - RNA, 13 nt, Human herpesvirus 2
cgcgccucccggg

SEQ ID NO: 1827752 - RNA, 14 nt, Human herpesvirus 2
cggcgaccaccgcg

SEQ ID NO: 1827753 - RNA, 17 nt, Human herpesvirus 2
ccacaucgauuccgcca

SEQ ID NO: 1827754 - RNA, 14 nt, Human herpesvirus 2
cgaucccgggcccu

SEQ ID NO: 1827755 - RNA, 20 nt, Human herpesvirus 2
gaaacacgguggcgcgcugg

SEQ ID NO: 1827756 - RNA, 15 nt, Human herpesvirus 2
gccaacagggagucc

SEQ ID NO: 1827757 - RNA, 14 nt, Human herpesvirus 2
gcggcggggguggg

SEQ ID NO: 1827758 - RNA, 23 nt, Human herpesvirus 2
aaggcaggggcagcucgcccccg

SEQ ID NO: 1827759 - RNA, 19 nt, Human herpesvirus 2
uggggaggggggggugagg

SEQ ID NO: 1827760 - RNA, 13 nt, Human herpesvirus 2
ccgucgggccccg

SEQ ID NO: 1827761 - RNA, 13 nt, Human herpesvirus 2
ugggggaagagag

SEQ ID NO: 1827762 - RNA, 21 nt, Human herpesvirus 2
ccucguuuuguuuucucuucu

SEQ ID NO: 1827763 - RNA, 14 nt, Human herpesvirus 2
ucgccaacucuguc

SEQ ID NO: 1827764 - RNA, 19 nt, Human herpesvirus 2
gagggcucaucgggaaucu

SEQ ID NO: 1827765 - RNA, 14 nt, Human herpesvirus 2
gcaggcggcgggga

SEQ ID NO: 1827766 - RNA, 19 nt, Human herpesvirus 2
cuuuccaccccccuucccc

SEQ ID NO: 1827767 - RNA, 19 nt, Human herpesvirus 2
ggucaauaaagagcucugu

SEQ ID NO: 1827768 - RNA, 21 nt, Human herpesvirus 2
ucccgaaaccgcaggcgcgcc

SEQ ID NO: 1827769 - RNA, 21 nt, Human herpesvirus 2
cgaggcgccucgggggcaggg

SEQ ID NO: 1827770 - RNA, 12 nt, Human herpesvirus 2
gcgcauaaaggu

SEQ ID NO: 1827771 - RNA, 15 nt, Human herpesvirus 2
ucccaauucgucacc

SEQ ID NO: 1827772 - RNA, 23 nt, Human herpesvirus 2
cgccuuccgacgcucucugccuc

SEQ ID NO: 1827773 - RNA, 13 nt, Human herpesvirus 2
ccccuucuccuua

SEQ ID NO: 1827774 - RNA, 18 nt, Human herpesvirus 2
cugcuuaagcggaacccg

SEQ ID NO: 1827775 - RNA, 18 nt, Human herpesvirus 2
cagcacggaggaacuggg

SEQ ID NO: 1827776 - RNA, 12 nt, Human herpesvirus 2
uggcguccccag

SEQ ID NO: 1827777 - RNA, 20 nt, Human herpesvirus 2
cggcaggcgacccgccgccc

SEQ ID NO: 1827778 - RNA, 21 nt, Human herpesvirus 2
aucacaguuccguuggggaac

SEQ ID NO: 1827779 - RNA, 17 nt, Human herpesvirus 2
agcgccggguggcgccu

SEQ ID NO: 1827780 - RNA, 20 nt, Human herpesvirus 2
ccuuggguuccgcggacgcc

SEQ ID NO: 1827781 - RNA, 20 nt, Human herpesvirus 2
caggcuggagcucugccugc

SEQ ID NO: 1827782 - RNA, 15 nt, Human herpesvirus 2
ccgucccgcccgcca

SEQ ID NO: 1827783 - RNA, 17 nt, Human herpesvirus 2
guguuuauuuucccccc

SEQ ID NO: 1827784 - RNA, 15 nt, Human herpesvirus 2
gggggcuaggagccg

SEQ ID NO: 1827785 - RNA, 11 nt, Human herpesvirus 2
ggacgcgcagc

SEQ ID NO: 1827786 - RNA, 13 nt, Human herpesvirus 2
ggacugggggcgg

SEQ ID NO: 1827787 - RNA, 14 nt, Human herpesvirus 2
ggggcagugcagua

SEQ ID NO: 1827788 - RNA, 17 nt, Human herpesvirus 2
uuggggauacgggggcg

SEQ ID NO: 1827789 - RNA, 16 nt, Human herpesvirus 2
cagccgcgccgcugcc

SEQ ID NO: 1827790 - RNA, 16 nt, Human herpesvirus 2
cgcgggcgggggcgcg

SEQ ID NO: 1827791 - RNA, 14 nt, Human herpesvirus 2
agccaaaccagccc

SEQ ID NO: 1827792 - RNA, 20 nt, Human herpesvirus 2
acgagccaaaccagccccgc

SEQ ID NO: 1827793 - RNA, 15 nt, Human herpesvirus 2
gaaaacuugaggaaa

SEQ ID NO: 1827794 - RNA, 11 nt, Human herpesvirus 2
ucuucuucccc

SEQ ID NO: 1827795 - RNA, 22 nt, Human herpesvirus 2
aacagcucgcggacgagcccgu

SEQ ID NO: 1827796 - RNA, 13 nt, Human herpesvirus 2
cccggggggagga

SEQ ID NO: 1827797 - RNA, 20 nt, Human herpesvirus 2
gcaugguaauuagcaacuuu

SEQ ID NO: 1827798 - RNA, 23 nt, Human herpesvirus 2
gcgagaugucaguccucggggac

SEQ ID NO: 1827799 - RNA, 15 nt, Human herpesvirus 2
ucaauagauuuccca

SEQ ID NO: 1827800 - RNA, 14 nt, Human herpesvirus 2
gucugcgcgaggcc

SEQ ID NO: 1827801 - RNA, 17 nt, Human herpesvirus 2
ggcugcgggcgugucgu

SEQ ID NO: 1827802 - RNA, 17 nt, Human herpesvirus 2
cgagggcggccucggcc

SEQ ID NO: 1827803 - RNA, 22 nt, Human herpesvirus 2
gccccgcggucgcgcgggccgu

SEQ ID NO: 1827804 - RNA, 14 nt, Human herpesvirus 2
ucccauuggcccca

SEQ ID NO: 1827805 - RNA, 13 nt, Human herpesvirus 2
ggucaauagauuu

SEQ ID NO: 1827806 - RNA, 18 nt, Human herpesvirus 2
ucuggcguccccaggcga

SEQ ID NO: 1827807 - RNA, 15 nt, Human herpesvirus 2
gccgccauccccgcg

SEQ ID NO: 1827808 - RNA, 15 nt, Human herpesvirus 2
ugcccgcuuccaccc

SEQ ID NO: 1827809 - RNA, 18 nt, Human herpesvirus 2
aggacagccgacccgucu

SEQ ID NO: 1827810 - RNA, 13 nt, Human herpesvirus 2
gacgggcucgcca

SEQ ID NO: 1827811 - RNA, 15 nt, Human herpesvirus 2
uacccggcagagaga

SEQ ID NO: 1827812 - RNA, 21 nt, Human herpesvirus 2
gccccuggugaagacgacccc

SEQ ID NO: 1827813 - RNA, 19 nt, Human herpesvirus 2
ggaggggggcagugcagua

SEQ ID NO: 1827814 - RNA, 16 nt, Human herpesvirus 2
gacccaccgcaccacc

SEQ ID NO: 1827815 - RNA, 14 nt, Human herpesvirus 2
gaggggggggugag

SEQ ID NO: 1827816 - RNA, 12 nt, Human herpesvirus 2
ugggcacagugg

SEQ ID NO: 1827817 - RNA, 14 nt, Human herpesvirus 2
ccccgacgcgcgcg

SEQ ID NO: 1827818 - RNA, 17 nt, Human herpesvirus 2
gaggggaugggggcgcg

SEQ ID NO: 1827819 - RNA, 21 nt, Human herpesvirus 2
aacaugacaacgacgccccuc

SEQ ID NO: 1827820 - RNA, 17 nt, Human herpesvirus 2
cucgccagcgacccgca

SEQ ID NO: 1827821 - RNA, 14 nt, Human herpesvirus 2
cguccccuggggcg

SEQ ID NO: 1827822 - RNA, 18 nt, Human herpesvirus 2
aaccggcgagggcggccu

SEQ ID NO: 1827823 - RNA, 13 nt, Human herpesvirus 2
gccagggcuggga

SEQ ID NO: 1827824 - RNA, 20 nt, Human herpesvirus 2
ggacgcggccagaaacccgg

SEQ ID NO: 1827825 - RNA, 15 nt, Human herpesvirus 2
aauuagaaacuuuua

SEQ ID NO: 1827826 - RNA, 13 nt, Human herpesvirus 2
cccuagaggcugu

SEQ ID NO: 1827827 - RNA, 19 nt, Human herpesvirus 2
ggguacggcgaggugcagu

SEQ ID NO: 1827828 - RNA, 23 nt, Human herpesvirus 2
gccccagagccccccacgugggc

SEQ ID NO: 1827829 - RNA, 15 nt, Human herpesvirus 2
gcaucacggcccacc

SEQ ID NO: 1827830 - RNA, 13 nt, Human herpesvirus 2
ccggggcucuucu

SEQ ID NO: 1827831 - RNA, 17 nt, Human herpesvirus 2
gugaggcguugugcggg

SEQ ID NO: 1827832 - RNA, 17 nt, Human herpesvirus 2
cacagguggugcacgug

SEQ ID NO: 1827833 - RNA, 24 nt, Human herpesvirus 2
ccucgugcgcaugggccgccagca

SEQ ID NO: 1827834 - RNA, 14 nt, Human herpesvirus 2
cucgcggcaccgcg

SEQ ID NO: 1827835 - RNA, 12 nt, Human herpesvirus 2
cucaccccaccc

SEQ ID NO: 1827836 - RNA, 15 nt, Human herpesvirus 2
cgagaacgagauggu

SEQ ID NO: 1827837 - RNA, 15 nt, Human herpesvirus 2
ucgcccccgugccug

SEQ ID NO: 1827838 - RNA, 19 nt, Human herpesvirus 2
caguuucaccgccccagca

SEQ ID NO: 1827839 - RNA, 12 nt, Human herpesvirus 2
aauaaacacaaa

SEQ ID NO: 1827840 - RNA, 16 nt, Human herpesvirus 2
gcccccgcggccuccc

SEQ ID NO: 1827841 - RNA, 15 nt, Human herpesvirus 2
cggacgagcccgugg

SEQ ID NO: 1827842 - RNA, 17 nt, Human herpesvirus 2
ccggacgcgcacguggg

SEQ ID NO: 1827843 - RNA, 13 nt, Human herpesvirus 2
cggcggccccccg

SEQ ID NO: 1827844 - RNA, 11 nt, Human herpesvirus 2
gcaucgcugua

SEQ ID NO: 1827845 - RNA, 18 nt, Human herpesvirus 2
agggugugacccccccau

SEQ ID NO: 1827846 - RNA, 13 nt, Human herpesvirus 2
ggggcgccccccc

SEQ ID NO: 1827847 - RNA, 19 nt, Human herpesvirus 2
auugaccggggccccaucu

SEQ ID NO: 1827848 - RNA, 12 nt, Human herpesvirus 2
cgcuggccccuc

SEQ ID NO: 1827849 - RNA, 17 nt, Human herpesvirus 2
aacaacaguacucaucg

SEQ ID NO: 1827850 - RNA, 22 nt, Human herpesvirus 2
gcgcaggaucgugugcacgaaa

SEQ ID NO: 1827851 - RNA, 12 nt, Human herpesvirus 2
cacaggcccacc

SEQ ID NO: 1827852 - RNA, 19 nt, Human herpesvirus 2
gccccacgucaccgggggc

SEQ ID NO: 1827853 - RNA, 15 nt, Human herpesvirus 2
gugcucggggacaga

SEQ ID NO: 1827854 - RNA, 19 nt, Human herpesvirus 2
ugcgcuuuccggcccuccc

SEQ ID NO: 1827855 - RNA, 12 nt, Human herpesvirus 2
ucggggccaggg

SEQ ID NO: 1827856 - RNA, 14 nt, Human herpesvirus 2
cagggaaacagaaa

SEQ ID NO: 1827857 - RNA, 14 nt, Human herpesvirus 2
cgcccccgccucgc

SEQ ID NO: 1827858 - RNA, 14 nt, Human herpesvirus 2
cggcccgccaaccc

SEQ ID NO: 1827859 - RNA, 11 nt, Human herpesvirus 2
ucucccacacg

SEQ ID NO: 1827860 - RNA, 23 nt, Human herpesvirus 2
gauggccgcgcgcgugugugaga

SEQ ID NO: 1827861 - RNA, 17 nt, Human herpesvirus 2
gaaccaacugccgaaag

SEQ ID NO: 1827862 - RNA, 17 nt, Human herpesvirus 2
cucaaacaaaaacacaa

SEQ ID NO: 1827863 - RNA, 14 nt, Human herpesvirus 2
cugcggggaccagc

SEQ ID NO: 1827864 - RNA, 18 nt, Human herpesvirus 2
agaaaagcgacgaggucc

SEQ ID NO: 1827865 - RNA, 22 nt, Human herpesvirus 2
gccgcauauacugcugggccau

SEQ ID NO: 1827866 - RNA, 15 nt, Human herpesvirus 2
uccucacgggggggc

SEQ ID NO: 1827867 - RNA, 11 nt, Human herpesvirus 2
cgacccgccuc

SEQ ID NO: 1827868 - RNA, 18 nt, Human herpesvirus 2
cugcaucgcaagccaccc

SEQ ID NO: 1827869 - RNA, 17 nt, Human herpesvirus 2
acacaccccccuucucc

SEQ ID NO: 1827870 - RNA, 22 nt, Human herpesvirus 2
ccccgcucccguguaccucugg

SEQ ID NO: 1827871 - RNA, 14 nt, Human herpesvirus 2
ccaggcgcugcugc

SEQ ID NO: 1827872 - RNA, 19 nt, Human herpesvirus 2
cucaucgggacgcccggcc

SEQ ID NO: 1827873 - RNA, 16 nt, Human herpesvirus 2
aagugccgcacggccg

SEQ ID NO: 1827874 - RNA, 14 nt, Human herpesvirus 2
ggagcguggggcgc

SEQ ID NO: 1827875 - RNA, 14 nt, Human herpesvirus 2
cggcccugagccgc

SEQ ID NO: 1827876 - RNA, 18 nt, Human herpesvirus 2
gagcuuugcacgcggggu

SEQ ID NO: 1827877 - RNA, 22 nt, Human herpesvirus 2
ucgucgggccgucguuggccag

SEQ ID NO: 1827878 - RNA, 16 nt, Human herpesvirus 2
ccccauggcauccggg

SEQ ID NO: 1827879 - RNA, 21 nt, Human herpesvirus 2
cggcucccccgacgucucggc

SEQ ID NO: 1827880 - RNA, 11 nt, Human herpesvirus 2
ggggcgccccc

SEQ ID NO: 1827881 - RNA, 15 nt, Human herpesvirus 2
gcgggucccuuccca

SEQ ID NO: 1827882 - RNA, 17 nt, Human herpesvirus 2
cucuuccccccccccca

SEQ ID NO: 1827883 - RNA, 17 nt, Human herpesvirus 2
aacucgcggcaccgcgc

SEQ ID NO: 1827884 - RNA, 15 nt, Human herpesvirus 2
ccgcccgccccaggg

SEQ ID NO: 1827885 - RNA, 23 nt, Human herpesvirus 2
agaccuccccgugcgugcugcug

SEQ ID NO: 1827886 - RNA, 15 nt, Human herpesvirus 2
ucgggggccggggcg

SEQ ID NO: 1827887 - RNA, 13 nt, Human herpesvirus 2
augacacaaaaau

SEQ ID NO: 1827888 - RNA, 14 nt, Human herpesvirus 2
gcuccuagcccccc

SEQ ID NO: 1827889 - RNA, 13 nt, Human herpesvirus 2
cucccggcuccuc

SEQ ID NO: 1827890 - RNA, 21 nt, Human herpesvirus 2
ggaacacaggcgcuucaucgu

SEQ ID NO: 1827891 - RNA, 12 nt, Human herpesvirus 2
acgcccgcgucu

SEQ ID NO: 1827892 - RNA, 14 nt, Human herpesvirus 2
gggcguugccgggg

SEQ ID NO: 1827893 - RNA, 16 nt, Human herpesvirus 2
cagaccgcggacacgg

SEQ ID NO: 1827894 - RNA, 23 nt, Human herpesvirus 2
uggcgaccgucuuugggccccgc

SEQ ID NO: 1827895 - RNA, 15 nt, Human herpesvirus 2
uggccggggagggca

SEQ ID NO: 1827896 - RNA, 13 nt, Human herpesvirus 2
ccgcaccggggcg

SEQ ID NO: 1827897 - RNA, 19 nt, Human herpesvirus 2
caccggcguuucggugcug

SEQ ID NO: 1827898 - RNA, 14 nt, Human herpesvirus 2
cagcccagaggagc

SEQ ID NO: 1827899 - RNA, 23 nt, Human herpesvirus 2
gcccgaccagcgccggguggcgc

SEQ ID NO: 1827900 - RNA, 14 nt, Human herpesvirus 2
uccgcuaccgccuc

SEQ ID NO: 1827901 - RNA, 15 nt, Human herpesvirus 2
auaaagacuguugau

SEQ ID NO: 1827902 - RNA, 20 nt, Human herpesvirus 2
ggccgagaagagcggcgagu

SEQ ID NO: 1827903 - RNA, 15 nt, Human herpesvirus 2
gaaacggcaagaaag

SEQ ID NO: 1827904 - RNA, 13 nt, Human herpesvirus 2
cuggcgcaccugc

SEQ ID NO: 1827905 - RNA, 19 nt, Human herpesvirus 2
uggauaacagcuacccgca

SEQ ID NO: 1827906 - RNA, 12 nt, Human herpesvirus 2
aggcccccggcc

SEQ ID NO: 1827907 - RNA, 15 nt, Human herpesvirus 2
ccaccccgccgcagc

SEQ ID NO: 1827908 - RNA, 20 nt, Human herpesvirus 2
ugauuucgcccuaccgcucc

SEQ ID NO: 1827909 - RNA, 16 nt, Human herpesvirus 2
ccauaaacaggccccg

SEQ ID NO: 1827910 - RNA, 14 nt, Human herpesvirus 2
gcugcugagcccug

SEQ ID NO: 1827911 - RNA, 20 nt, Human herpesvirus 2
cccggaccccgcugcugugc

SEQ ID NO: 1827912 - RNA, 22 nt, Human herpesvirus 2
cgccgucaaccccgcccuccgc

SEQ ID NO: 1827913 - RNA, 19 nt, Human herpesvirus 2
gcgucgcucucggucccgc

SEQ ID NO: 1827914 - RNA, 14 nt, Human herpesvirus 2
acggucuccgccau

SEQ ID NO: 1827915 - RNA, 17 nt, Human herpesvirus 2
guccucgccgcuguggc

SEQ ID NO: 1827916 - RNA, 13 nt, Human herpesvirus 2
gcuggggaaaucu

SEQ ID NO: 1827917 - RNA, 18 nt, Human herpesvirus 2
gauccugggccugugggu

SEQ ID NO: 1827918 - RNA, 23 nt, Human herpesvirus 2
gccccccgucccgagccccgcga

SEQ ID NO: 1827919 - RNA, 20 nt, Human herpesvirus 2
aucaucgaaggucgggccgu

SEQ ID NO: 1827920 - RNA, 13 nt, Human herpesvirus 2
uggugguggggug

SEQ ID NO: 1827921 - RNA, 15 nt, Human herpesvirus 2
gagaugugccuucca

SEQ ID NO: 1827922 - RNA, 19 nt, Human herpesvirus 2
gaagcccgaacggaaggcc

SEQ ID NO: 1827923 - RNA, 16 nt, Human herpesvirus 2
ucgcaagccacccugg

SEQ ID NO: 1827924 - RNA, 20 nt, Human herpesvirus 2
ugugccagguggcccuuccg

SEQ ID NO: 1827925 - RNA, 13 nt, Human herpesvirus 2
ccgggggccccgg

SEQ ID NO: 1827926 - RNA, 23 nt, Human herpesvirus 2
caggcaggcgucgaucucaucaa

SEQ ID NO: 1827927 - RNA, 20 nt, Human herpesvirus 2
cgccauuucaaauaaaaggc

SEQ ID NO: 1827928 - RNA, 21 nt, Human herpesvirus 2
ccggauaaauguggggccccg

SEQ ID NO: 1827929 - RNA, 19 nt, Human herpesvirus 2
agacacggugcgugcggcc

SEQ ID NO: 1827930 - RNA, 23 nt, Human herpesvirus 2
acgcgucgggggccggggcggcc

SEQ ID NO: 1827931 - RNA, 16 nt, Human herpesvirus 2
gccgggccucccgcaa

SEQ ID NO: 1827932 - RNA, 23 nt, Human herpesvirus 2
auccgcgagggcccggcgccgcc

SEQ ID NO: 1827933 - RNA, 20 nt, Human herpesvirus 2
gucgggggggauccagggga

SEQ ID NO: 1827934 - RNA, 18 nt, Human herpesvirus 2
cuuggccggggagggcag

SEQ ID NO: 1827935 - RNA, 22 nt, Human herpesvirus 2
gccagcacgaccagggaggcca

SEQ ID NO: 1827936 - RNA, 14 nt, Human herpesvirus 2
guaguguguccccc

SEQ ID NO: 1827937 - RNA, 16 nt, Human herpesvirus 2
ccggguuuuuggcccu

SEQ ID NO: 1827938 - RNA, 15 nt, Human herpesvirus 2
cggcuggcgcggugc

SEQ ID NO: 1827939 - RNA, 15 nt, Human herpesvirus 2
acccccuguccccgc

SEQ ID NO: 1827940 - RNA, 18 nt, Human herpesvirus 2
cgggugucugcuccccac

SEQ ID NO: 1827941 - RNA, 12 nt, Human herpesvirus 2
cccagacacggu

SEQ ID NO: 1827942 - RNA, 13 nt, Human herpesvirus 2
gccccgccccacc

SEQ ID NO: 1827943 - RNA, 20 nt, Human herpesvirus 2
agcgaccggucgcagggaga

SEQ ID NO: 1827944 - RNA, 21 nt, Human herpesvirus 2
cgccucccggccgccccccgu

SEQ ID NO: 1827945 - RNA, 15 nt, Human herpesvirus 2
ggcgacccgccgccc

SEQ ID NO: 1827946 - RNA, 23 nt, Human herpesvirus 2
cccccggcgcgggcggcgccgcg

SEQ ID NO: 1827947 - RNA, 19 nt, Human herpesvirus 2
ggcgggccccguggguggg

SEQ ID NO: 1827948 - RNA, 20 nt, Human herpesvirus 2
gacgcggcacagguggugca

SEQ ID NO: 1827949 - RNA, 13 nt, Human herpesvirus 2
gacgcccgcgagc

SEQ ID NO: 1827950 - RNA, 11 nt, Human herpesvirus 2
gcgagccaggc

SEQ ID NO: 1827951 - RNA, 20 nt, Human herpesvirus 2
gcccgaacggaaggccuccc

SEQ ID NO: 1827952 - RNA, 19 nt, Human herpesvirus 2
cacucguggaugccggggc

SEQ ID NO: 1827953 - RNA, 18 nt, Human herpesvirus 2
cugccguaugcuaauuaa

SEQ ID NO: 1827954 - RNA, 14 nt, Human herpesvirus 2
cuccagcuuggccg

SEQ ID NO: 1827955 - RNA, 14 nt, Human herpesvirus 2
cgaacagccccugg

SEQ ID NO: 1827956 - RNA, 16 nt, Human herpesvirus 2
uaagcgcugcggggac

SEQ ID NO: 1827957 - RNA, 16 nt, Human herpesvirus 2
gccgcgacggccccgg

SEQ ID NO: 1827958 - RNA, 14 nt, Human herpesvirus 2
cgcccaacccgagc

SEQ ID NO: 1827959 - RNA, 16 nt, Human herpesvirus 2
uggccgcuccugcccg

SEQ ID NO: 1827960 - RNA, 19 nt, Human herpesvirus 2
uguuuuuacgggccccgga

SEQ ID NO: 1827961 - RNA, 20 nt, Human herpesvirus 2
ggccggggagggcagggccg

SEQ ID NO: 1827962 - RNA, 17 nt, Human herpesvirus 2
agggcuucguggaagag

SEQ ID NO: 1827963 - RNA, 15 nt, Human herpesvirus 2
acgccccccucggca

SEQ ID NO: 1827964 - RNA, 19 nt, Human herpesvirus 2
gccaggagguccuggaggg

SEQ ID NO: 1827965 - RNA, 21 nt, Human herpesvirus 2
ucgagguggcggaggggauca

SEQ ID NO: 1827966 - RNA, 23 nt, Human herpesvirus 2
acucacucguggaugccggggcc

SEQ ID NO: 1827967 - RNA, 22 nt, Human herpesvirus 2
cgccggcccgaaccccgcggcc

SEQ ID NO: 1827968 - RNA, 20 nt, Human herpesvirus 2
acgaugggagccccgcguau

SEQ ID NO: 1827969 - RNA, 16 nt, Human herpesvirus 2
gucaccggggcgcccc

SEQ ID NO: 1827970 - RNA, 17 nt, Human herpesvirus 2
agccgcccaagcggccc

SEQ ID NO: 1827971 - RNA, 17 nt, Human herpesvirus 2
cccggggcccgcagcuu

SEQ ID NO: 1827972 - RNA, 18 nt, Human herpesvirus 2
ccugcagaugcugcccgc

SEQ ID NO: 1827973 - RNA, 19 nt, Human herpesvirus 2
ggcccaccugcacgagguc

SEQ ID NO: 1827974 - RNA, 17 nt, Human herpesvirus 2
ccuggguccgggggccu

SEQ ID NO: 1827975 - RNA, 23 nt, Human herpesvirus 2
ccguggguuacgcaggcccucgc

SEQ ID NO: 1827976 - RNA, 17 nt, Human herpesvirus 2
ugcgccccgccggggcg

SEQ ID NO: 1827977 - RNA, 19 nt, Human herpesvirus 2
ccacguccaccuuggcccg

SEQ ID NO: 1827978 - RNA, 16 nt, Human herpesvirus 2
gccaugagccgccggg

SEQ ID NO: 1827979 - RNA, 23 nt, Human herpesvirus 2
ccgccccccaccggaccaccggc

SEQ ID NO: 1827980 - RNA, 14 nt, Human herpesvirus 2
cggcggccccccgc

SEQ ID NO: 1827981 - RNA, 17 nt, Human herpesvirus 2
gacagccagggcuggga

SEQ ID NO: 1827982 - RNA, 12 nt, Human herpesvirus 2
gccgcgcccgcg

SEQ ID NO: 1827983 - RNA, 22 nt, Human herpesvirus 2
ccgcaguuucaccgccccagca

SEQ ID NO: 1827984 - RNA, 19 nt, Human herpesvirus 2
cgcggggggcacgggcccg

SEQ ID NO: 1827985 - RNA, 20 nt, Human herpesvirus 2
ccugcgaaucccccaaggaa

SEQ ID NO: 1827986 - RNA, 22 nt, Human herpesvirus 2
gaucuggcgaccgucuuugggc

SEQ ID NO: 1827987 - RNA, 12 nt, Human herpesvirus 2
gggacgaacagg

SEQ ID NO: 1827988 - RNA, 15 nt, Human herpesvirus 2
auagagggaacaaag

SEQ ID NO: 1827989 - RNA, 15 nt, Human herpesvirus 2
ggcacagguggugca

SEQ ID NO: 1827990 - RNA, 18 nt, Human herpesvirus 2
ugcuggugguggaaagac

SEQ ID NO: 1827991 - RNA, 16 nt, Human herpesvirus 2
cuucggcggggcaccg

SEQ ID NO: 1827992 - RNA, 18 nt, Human herpesvirus 2
aggauguguucuccugga

SEQ ID NO: 1827993 - RNA, 12 nt, Human herpesvirus 2
cggcggccaccc

SEQ ID NO: 1827994 - RNA, 16 nt, Human herpesvirus 2
cccagggggcggcgcc

SEQ ID NO: 1827995 - RNA, 14 nt, Human herpesvirus 2
ggugcgccccgccg

SEQ ID NO: 1827996 - RNA, 21 nt, Human herpesvirus 2
ccgcauauacugcugggccau

SEQ ID NO: 1827997 - RNA, 13 nt, Human herpesvirus 2
gcccgccagggcc

SEQ ID NO: 1827998 - RNA, 13 nt, Human herpesvirus 2
gcgggcgggauga

SEQ ID NO: 1827999 - RNA, 21 nt, Human herpesvirus 2
cuuuccgugcuucgggacccg

SEQ ID NO: 1828000 - RNA, 18 nt, Human herpesvirus 2
gcuuucccuccacccgcc

SEQ ID NO: 1828001 - RNA, 23 nt, Human herpesvirus 2
ucgggcggacguccaggggugcg

SEQ ID NO: 1828002 - RNA, 13 nt, Human herpesvirus 2
cccaggcccuggc

SEQ ID NO: 1828003 - RNA, 15 nt, Human herpesvirus 2
ggaauuuccgcgucc

SEQ ID NO: 1828004 - RNA, 12 nt, Human herpesvirus 2
caccccccuucu

SEQ ID NO: 1828005 - RNA, 18 nt, Human herpesvirus 2
cucccgaaaccgcaggcg

SEQ ID NO: 1828006 - RNA, 13 nt, Human herpesvirus 2
ggggcauggaccc

SEQ ID NO: 1828007 - RNA, 20 nt, Human herpesvirus 2
gucggacgccagcugcuggc

SEQ ID NO: 1828008 - RNA, 19 nt, Human herpesvirus 2
ggaccacgugcacagccug

SEQ ID NO: 1828009 - RNA, 20 nt, Human herpesvirus 2
ccccgaguucccccgggacu

SEQ ID NO: 1828010 - RNA, 21 nt, Human herpesvirus 2
acggcccaccugcacgagguc

SEQ ID NO: 1828011 - RNA, 16 nt, Human herpesvirus 2
gcacccccgcgccgcc

SEQ ID NO: 1828012 - RNA, 22 nt, Human herpesvirus 2
gccggccaauucuucccggagc

SEQ ID NO: 1828013 - RNA, 23 nt, Human herpesvirus 2
caggaauggagaagggaaaggaa

SEQ ID NO: 1828014 - RNA, 22 nt, Human herpesvirus 2
cccaggaggggggcagugcagu

SEQ ID NO: 1828015 - RNA, 19 nt, Human herpesvirus 2
gucgcucugucccccgggc

SEQ ID NO: 1828016 - RNA, 21 nt, Human herpesvirus 2
agccgcgccgcugcccgacgc

SEQ ID NO: 1828017 - RNA, 13 nt, Human herpesvirus 2
ugacuccuggguc

SEQ ID NO: 1828018 - RNA, 20 nt, Human herpesvirus 2
ccccugaguugcgccggcac

SEQ ID NO: 1828019 - RNA, 17 nt, Human herpesvirus 2
cgucaccgggggccccg

SEQ ID NO: 1828020 - RNA, 21 nt, Human herpesvirus 2
ggaagggacccgcggaggaaa

SEQ ID NO: 1828021 - RNA, 16 nt, Human herpesvirus 2
cggcguggccgcgacc

SEQ ID NO: 1828022 - RNA, 15 nt, Human herpesvirus 2
acacacccccugucc

SEQ ID NO: 1828023 - RNA, 23 nt, Human herpesvirus 2
cccgagcgugcccuuuucugcga

SEQ ID NO: 1828024 - RNA, 17 nt, Human herpesvirus 2
ugucgaaucugggaaga

SEQ ID NO: 1828025 - RNA, 18 nt, Human herpesvirus 2
gcuccgcgugguccccga

SEQ ID NO: 1828026 - RNA, 13 nt, Human herpesvirus 2
ucucugccuccuu

SEQ ID NO: 1828027 - RNA, 21 nt, Human herpesvirus 2
cgcaggcuggagcucugccug

SEQ ID NO: 1828028 - RNA, 21 nt, Human herpesvirus 2
gccaccgucccgcccgccagu

SEQ ID NO: 1828029 - RNA, 22 nt, Human herpesvirus 2
cugucccgacgauuagccaccg

SEQ ID NO: 1828030 - RNA, 18 nt, Human herpesvirus 2
uccgacgaggccuucccg

SEQ ID NO: 1828031 - RNA, 19 nt, Human herpesvirus 2
aaacuuuauauuuauaaaa

SEQ ID NO: 1828032 - RNA, 12 nt, Human herpesvirus 2
ggcggggcaugg

SEQ ID NO: 1828033 - RNA, 22 nt, Human herpesvirus 2
cccgaacagccccuggggcugu

SEQ ID NO: 1828034 - RNA, 19 nt, Human herpesvirus 2
gggcucgccagcgacccgc

SEQ ID NO: 1828035 - RNA, 20 nt, Human herpesvirus 2
agcaaccgccgcgcgacggc

SEQ ID NO: 1828036 - RNA, 14 nt, Human herpesvirus 2
ggagccacucccgc

SEQ ID NO: 1828037 - RNA, 22 nt, Human herpesvirus 2
ccuccggggcuugugcccucgu

SEQ ID NO: 1828038 - RNA, 23 nt, Human herpesvirus 2
caccagagccgaacgcagguccu

SEQ ID NO: 1828039 - RNA, 19 nt, Human herpesvirus 2
cgggauccuccgccagcuc

SEQ ID NO: 1828040 - RNA, 23 nt, Human herpesvirus 2
cccugggccgcucguuccucacg

SEQ ID NO: 1828041 - RNA, 17 nt, Human herpesvirus 2
ccggcgguucgcgugcg

SEQ ID NO: 1828042 - RNA, 20 nt, Human herpesvirus 2
gcaggcgggcccaucacugu

SEQ ID NO: 1828043 - RNA, 18 nt, Human herpesvirus 2
cggggccguggggcccca

SEQ ID NO: 1828044 - RNA, 14 nt, Human herpesvirus 2
ccuuccuccacccc

SEQ ID NO: 1828045 - RNA, 11 nt, Human herpesvirus 2
ccccgccgggu

SEQ ID NO: 1828046 - RNA, 20 nt, Human herpesvirus 2
cgcggggggcacgggcccgg

SEQ ID NO: 1828047 - RNA, 20 nt, Human herpesvirus 2
cguugccgggggccaugaca

SEQ ID NO: 1828048 - RNA, 15 nt, Human herpesvirus 2
gggcgcugguggccg

SEQ ID NO: 1828049 - RNA, 17 nt, Human herpesvirus 2
cccugcgucgccccgug

SEQ ID NO: 1828050 - RNA, 18 nt, Human herpesvirus 2
ccgucuuugggccccgcc

SEQ ID NO: 1828051 - RNA, 21 nt, Human herpesvirus 2
aggcccuggcgcaccugcaga

SEQ ID NO: 1828052 - RNA, 15 nt, Human herpesvirus 2
guccgacacccgggc

SEQ ID NO: 1828053 - RNA, 21 nt, Human herpesvirus 2
gggggaacgcgcacccuugcc

SEQ ID NO: 1828054 - RNA, 14 nt, Human herpesvirus 2
gggccguggggccc

SEQ ID NO: 1828055 - RNA, 17 nt, Human herpesvirus 2
caucgcaagccacccug

SEQ ID NO: 1828056 - RNA, 21 nt, Human herpesvirus 2
ccggaggaaacccccgacccc

SEQ ID NO: 1828057 - RNA, 14 nt, Human herpesvirus 2
gccuggcggcagca

SEQ ID NO: 1828058 - RNA, 22 nt, Human herpesvirus 2
auccgcgagggcccggcgccgc

SEQ ID NO: 1828059 - RNA, 22 nt, Human herpesvirus 2
ccggauaaauguggggccccgg

SEQ ID NO: 1828060 - RNA, 13 nt, Human herpesvirus 2
aacgacugcacuu

SEQ ID NO: 1828061 - RNA, 15 nt, Human herpesvirus 2
cggggacuccccucu

SEQ ID NO: 1828062 - RNA, 21 nt, Human herpesvirus 2
cgguaagcagcgcguccaggu

SEQ ID NO: 1828063 - RNA, 19 nt, Human herpesvirus 2
aggagggaaacuaggacag

SEQ ID NO: 1828064 - RNA, 22 nt, Human herpesvirus 2
ggucccgcgcucauggccggag

SEQ ID NO: 1828065 - RNA, 21 nt, Human herpesvirus 2
caaggaacccaauggccgcuc

SEQ ID NO: 1828066 - RNA, 16 nt, Human herpesvirus 2
guaacccaguuccuca

SEQ ID NO: 1828067 - RNA, 14 nt, Human herpesvirus 2
ccagauguggggug

SEQ ID NO: 1828068 - RNA, 17 nt, Human herpesvirus 2
gugcaccgaaggaggaa

SEQ ID NO: 1828069 - RNA, 16 nt, Human herpesvirus 2
cauacaccccacccua

SEQ ID NO: 1828070 - RNA, 22 nt, Human herpesvirus 2
caccagagccgaacgcaggucc

SEQ ID NO: 1828071 - RNA, 16 nt, Human herpesvirus 2
ccgcgugcuuccgcac

SEQ ID NO: 1828072 - RNA, 12 nt, Human herpesvirus 2
ggcggccagaaa

SEQ ID NO: 1828073 - RNA, 13 nt, Human herpesvirus 2
accaaaagggaaa

SEQ ID NO: 1828074 - RNA, 21 nt, Human herpesvirus 2
cggcaugcgacggcgucuccc

SEQ ID NO: 1828075 - RNA, 13 nt, Human herpesvirus 2
gccgcgcccccgg

SEQ ID NO: 1828076 - RNA, 19 nt, Human herpesvirus 2
gcgcaugggccgccagcag

SEQ ID NO: 1828077 - RNA, 18 nt, Human herpesvirus 2
ccggcccucccgcacccc

SEQ ID NO: 1828078 - RNA, 23 nt, Human herpesvirus 2
gcaccugcagaugcugcccgcgg

SEQ ID NO: 1828079 - RNA, 17 nt, Human herpesvirus 2
guucgcgcaucucuggc

SEQ ID NO: 1828080 - RNA, 18 nt, Human herpesvirus 2
ucgcucucggucccgcau

SEQ ID NO: 1828081 - RNA, 12 nt, Human herpesvirus 2
cccuacccuucc

SEQ ID NO: 1828082 - RNA, 18 nt, Human herpesvirus 2
cgcgcuaguacccagagg

SEQ ID NO: 1828083 - RNA, 23 nt, Human herpesvirus 2
cuguccccgccccccccaggggg

SEQ ID NO: 1828084 - RNA, 17 nt, Human herpesvirus 2
accccuuccuuuucuuu

SEQ ID NO: 1828085 - RNA, 12 nt, Human herpesvirus 2
cgccccccccga

SEQ ID NO: 1828086 - RNA, 21 nt, Human herpesvirus 2
gaugcgcgccgguacuggggc

SEQ ID NO: 1828087 - RNA, 14 nt, Human herpesvirus 2
ccacguccaccuug

SEQ ID NO: 1828088 - RNA, 20 nt, Human herpesvirus 2
aggcggucccggccgccauc

SEQ ID NO: 1828089 - RNA, 18 nt, Human herpesvirus 2
gcgcgaggccgcucuccg

SEQ ID NO: 1828090 - RNA, 20 nt, Human herpesvirus 2
caggaggggggcagugcagu

SEQ ID NO: 1828091 - RNA, 11 nt, Human herpesvirus 2
ggagccucuuu

SEQ ID NO: 1828092 - RNA, 19 nt, Human herpesvirus 2
cgccggguggcgccucugc

SEQ ID NO: 1828093 - RNA, 20 nt, Human herpesvirus 2
gcuguuguuucugggcccgc

SEQ ID NO: 1828094 - RNA, 20 nt, Human herpesvirus 2
aggacgcgcuaguacccaga

SEQ ID NO: 1828095 - RNA, 23 nt, Human herpesvirus 2
agcacggaggaacugggguacug

SEQ ID NO: 1828096 - RNA, 22 nt, Human herpesvirus 2
ccgcgcacgcgcgacugccucc

SEQ ID NO: 1828097 - RNA, 20 nt, Human herpesvirus 2
caagcgggcgggguggggag

SEQ ID NO: 1828098 - RNA, 18 nt, Human herpesvirus 2
ggcauaccuccgaccggc

SEQ ID NO: 1828099 - RNA, 16 nt, Human herpesvirus 2
ccauacauuuccccau

SEQ ID NO: 1828100 - RNA, 17 nt, Human herpesvirus 2
gaaaccgggggucgcac

SEQ ID NO: 1828101 - RNA, 15 nt, Human herpesvirus 2
ccaucucuguuucau

SEQ ID NO: 1828102 - RNA, 14 nt, Human herpesvirus 2
ggaccgcagucugg

SEQ ID NO: 1828103 - RNA, 15 nt, Human herpesvirus 2
ugggugacugggacc

SEQ ID NO: 1828104 - RNA, 15 nt, Human herpesvirus 2
ggcaccuccccggcg

SEQ ID NO: 1828105 - RNA, 19 nt, Human herpesvirus 2
gcaggcguguugggaaggg

SEQ ID NO: 1828106 - RNA, 21 nt, Human herpesvirus 2
gaguaugaccgucggugccag

SEQ ID NO: 1828107 - RNA, 20 nt, Human herpesvirus 2
accucggggugacccacgcc

SEQ ID NO: 1828108 - RNA, 21 nt, Human herpesvirus 2
acuacccuuucgacgcgcugg

SEQ ID NO: 1828109 - RNA, 12 nt, Human herpesvirus 2
uaaacucucccc

SEQ ID NO: 1828110 - RNA, 12 nt, Human herpesvirus 2
ggcguccccagg

SEQ ID NO: 1828111 - RNA, 18 nt, Human herpesvirus 2
gcgagcgguuggaggcgc

SEQ ID NO: 1828112 - RNA, 16 nt, Human herpesvirus 2
gaucgccagccgcggu

SEQ ID NO: 1828113 - RNA, 21 nt, Human herpesvirus 2
cgugguccccgagcagcacgg

SEQ ID NO: 1828114 - RNA, 18 nt, Human herpesvirus 2
gcgacgccgccccugccg

SEQ ID NO: 1828115 - RNA, 14 nt, Human herpesvirus 2
uaaaacccacccuc

SEQ ID NO: 1828116 - RNA, 22 nt, Human herpesvirus 2
gucacgagccccugggccgcuc

SEQ ID NO: 1828117 - RNA, 20 nt, Human herpesvirus 2
cacgguccucaccgagccgc

SEQ ID NO: 1828118 - RNA, 19 nt, Human herpesvirus 2
ccccgcccccucucccaca

SEQ ID NO: 1828119 - RNA, 15 nt, Human herpesvirus 2
ccccgugcuccaacu

SEQ ID NO: 1828120 - RNA, 13 nt, Human herpesvirus 2
cgcuaccucaccc

SEQ ID NO: 1828121 - RNA, 17 nt, Human herpesvirus 2
cccgcgugccuggccgc

SEQ ID NO: 1828122 - RNA, 15 nt, Human herpesvirus 2
ggggagggggugugg

SEQ ID NO: 1828123 - RNA, 15 nt, Human herpesvirus 2
cuggacgggaguucc

SEQ ID NO: 1828124 - RNA, 12 nt, Human herpesvirus 2
ccaugggccccg

SEQ ID NO: 1828125 - RNA, 19 nt, Human herpesvirus 2
guuggacgcguuucccuuu

SEQ ID NO: 1828126 - RNA, 15 nt, Human herpesvirus 2
cgccgacgccuuccc

SEQ ID NO: 1828127 - RNA, 18 nt, Human herpesvirus 2
aaaugucacgauaagaac

SEQ ID NO: 1828128 - RNA, 12 nt, Human herpesvirus 2
ggcgccgccggu

SEQ ID NO: 1828129 - RNA, 21 nt, Human herpesvirus 2
acccgacccuguggcgggcgc

SEQ ID NO: 1828130 - RNA, 15 nt, Human herpesvirus 2
cgcgugcggccagcc

SEQ ID NO: 1828131 - RNA, 19 nt, Human herpesvirus 2
ggcacgggcccggggcgaa

SEQ ID NO: 1828132 - RNA, 20 nt, Human herpesvirus 2
ccccgugguagucuuccggg

SEQ ID NO: 1828133 - RNA, 21 nt, Human herpesvirus 2
ugcugcugagcccugccccgc

SEQ ID NO: 1828134 - RNA, 20 nt, Human herpesvirus 2
gccaccgucccgcccgccag

SEQ ID NO: 1828135 - RNA, 20 nt, Human herpesvirus 2
gcgcucgcucuccgugcccc

SEQ ID NO: 1828136 - RNA, 18 nt, Human herpesvirus 2
ggggccgucgcggccgcc

SEQ ID NO: 1828137 - RNA, 21 nt, Human herpesvirus 2
gcccuggguccgggggccugg

SEQ ID NO: 1828138 - RNA, 16 nt, Human herpesvirus 2
ccgagcgucaggcccg

SEQ ID NO: 1828139 - RNA, 23 nt, Human herpesvirus 2
cgcccucgagaugugccuuccag

SEQ ID NO: 1828140 - RNA, 21 nt, Human herpesvirus 2
ccuccuucgccgacgccuucc

SEQ ID NO: 1828141 - RNA, 13 nt, Human herpesvirus 2
aggaacagaggcg

SEQ ID NO: 1828142 - RNA, 17 nt, Human herpesvirus 2
agcugcuggccaaacau

SEQ ID NO: 1828143 - RNA, 13 nt, Human herpesvirus 2
gcugccccgcggu

SEQ ID NO: 1828144 - RNA, 21 nt, Human herpesvirus 2
gugcuuuuacccucaccccac

SEQ ID NO: 1828145 - RNA, 15 nt, Human herpesvirus 2
agcacgaccagggag

SEQ ID NO: 1828146 - RNA, 22 nt, Human herpesvirus 2
ggguucgcgcaucucuggcucc

SEQ ID NO: 1828147 - RNA, 11 nt, Human herpesvirus 2
ccagagccuca

SEQ ID NO: 1828148 - RNA, 13 nt, Human herpesvirus 2
cgccccgccgggg

SEQ ID NO: 1828149 - RNA, 21 nt, Human herpesvirus 2
acaccagcagcuugcggggcu

SEQ ID NO: 1828150 - RNA, 17 nt, Human herpesvirus 2
cccacggaccuccggga

SEQ ID NO: 1828151 - RNA, 22 nt, Human herpesvirus 2
ggcggccucggccggcggagcc

SEQ ID NO: 1828152 - RNA, 23 nt, Human herpesvirus 2
ucggccaccuggaagcugccucc

SEQ ID NO: 1828153 - RNA, 19 nt, Human herpesvirus 2
cggcguggagcgccgggcc

SEQ ID NO: 1828154 - RNA, 17 nt, Human herpesvirus 2
ucgcuccggcucccggc

SEQ ID NO: 1828155 - RNA, 16 nt, Human herpesvirus 2
cggaaaauccucggcc

SEQ ID NO: 1828156 - RNA, 14 nt, Human herpesvirus 2
gcggcaccggggaa

SEQ ID NO: 1828157 - RNA, 15 nt, Human herpesvirus 2
cccaguuccucagug

SEQ ID NO: 1828158 - RNA, 23 nt, Human herpesvirus 2
cuccggucccuuccccaccacca

SEQ ID NO: 1828159 - RNA, 13 nt, Human herpesvirus 2
gccgcgacccacg

SEQ ID NO: 1828160 - RNA, 22 nt, Human herpesvirus 2
ccgggggggggcaagugcagua

SEQ ID NO: 1828161 - RNA, 18 nt, Human herpesvirus 2
acgugggaugacggaggc

SEQ ID NO: 1828162 - RNA, 12 nt, Human herpesvirus 2
cggcggagcccc

SEQ ID NO: 1828163 - RNA, 17 nt, Human herpesvirus 2
ccguggggccccagggc

SEQ ID NO: 1828164 - RNA, 21 nt, Human herpesvirus 2
guccgcuaccgccucuguucc

SEQ ID NO: 1828165 - RNA, 22 nt, Human herpesvirus 2
cugccgacuuccgugccccugg

SEQ ID NO: 1828166 - RNA, 18 nt, Human herpesvirus 2
ccaccgucccgcccgcca

SEQ ID NO: 1828167 - RNA, 18 nt, Human herpesvirus 2
cugggccgcucguuccuc

SEQ ID NO: 1828168 - RNA, 15 nt, Human herpesvirus 2
aggcccccggcccug

SEQ ID NO: 1828169 - RNA, 13 nt, Human herpesvirus 2
uacuugcgcggcu

SEQ ID NO: 1828170 - RNA, 11 nt, Human herpesvirus 2
ggccgcccccc

SEQ ID NO: 1828171 - RNA, 22 nt, Human herpesvirus 2
ugcucguaaaaauggcggccgc

SEQ ID NO: 1828172 - RNA, 12 nt, Human herpesvirus 2
ccuggcucgccg

SEQ ID NO: 1828173 - RNA, 22 nt, Human herpesvirus 2
gguugucuucuuuuccaccccu

SEQ ID NO: 1828174 - RNA, 15 nt, Human herpesvirus 2
gccggguggcgccuc

SEQ ID NO: 1828175 - RNA, 16 nt, Human herpesvirus 2
ggaggggggagauggg

SEQ ID NO: 1828176 - RNA, 22 nt, Human herpesvirus 2
ccacuuccuauaaacucucccc

SEQ ID NO: 1828177 - RNA, 16 nt, Human herpesvirus 2
gacuugacggucgcca

SEQ ID NO: 1828178 - RNA, 19 nt, Human herpesvirus 2
uccugcgcacgacagaccu

SEQ ID NO: 1828179 - RNA, 11 nt, Human herpesvirus 2
aauuaaauaca

SEQ ID NO: 1828180 - RNA, 14 nt, Human herpesvirus 2
gccgccauccccgc

SEQ ID NO: 1828181 - RNA, 16 nt, Human herpesvirus 2
ggaggcgccucugccc

SEQ ID NO: 1828182 - RNA, 18 nt, Human herpesvirus 2
cagcgcgaugaggggcac

SEQ ID NO: 1828183 - RNA, 23 nt, Human herpesvirus 2
cauggauaacagcuacccgcauc

SEQ ID NO: 1828184 - RNA, 19 nt, Human herpesvirus 2
ucgccccccgucgcuccgg

SEQ ID NO: 1828185 - RNA, 15 nt, Human herpesvirus 2
cgcccaggcccuggc

SEQ ID NO: 1828186 - RNA, 22 nt, Human herpesvirus 2
ggcuccagacgaaggacccaua

SEQ ID NO: 1828187 - RNA, 14 nt, Human herpesvirus 2
ggacgggugggccu

SEQ ID NO: 1828188 - RNA, 17 nt, Human herpesvirus 2
ugggggggggggaagag

SEQ ID NO: 1828189 - RNA, 14 nt, Human herpesvirus 2
ccgcgugccgcaga

SEQ ID NO: 1828190 - RNA, 17 nt, Human herpesvirus 2
gaauugacaagcggggg

SEQ ID NO: 1828191 - RNA, 19 nt, Human herpesvirus 2
aaggaacgcccgaaaccag

SEQ ID NO: 1828192 - RNA, 21 nt, Human herpesvirus 2
gcguucuggcggcccuggagc

SEQ ID NO: 1828193 - RNA, 14 nt, Human herpesvirus 2
cggccgggcagagc

SEQ ID NO: 1828194 - RNA, 14 nt, Human herpesvirus 2
uccugcggcucaug

SEQ ID NO: 1828195 - RNA, 13 nt, Human herpesvirus 2
ggcagcccggacc

SEQ ID NO: 1828196 - RNA, 14 nt, Human herpesvirus 2
uguuuugguugguu

SEQ ID NO: 1828197 - RNA, 18 nt, Human herpesvirus 2
gucgguugguuucuguau

SEQ ID NO: 1828198 - RNA, 14 nt, Human herpesvirus 2
cagcugcuggccaa

SEQ ID NO: 1828199 - RNA, 19 nt, Human herpesvirus 2
acuacucggaaagcgaaga

SEQ ID NO: 1828200 - RNA, 21 nt, Human herpesvirus 2
gcguugguucucguacccccu

SEQ ID NO: 1828201 - RNA, 13 nt, Human herpesvirus 2
cgaccggcggggc

SEQ ID NO: 1828202 - RNA, 19 nt, Human herpesvirus 2
aucaguccgcgcggggcgc

SEQ ID NO: 1828203 - RNA, 20 nt, Human herpesvirus 2
gcacucccgaaaccgcaggc

SEQ ID NO: 1828204 - RNA, 14 nt, Human herpesvirus 2
ggccgcccccagca

SEQ ID NO: 1828205 - RNA, 21 nt, Human herpesvirus 2
acuuucuggccuuguugaaaa

SEQ ID NO: 1828206 - RNA, 12 nt, Human herpesvirus 2
cguccggcuggc

SEQ ID NO: 1828207 - RNA, 17 nt, Human herpesvirus 2
ggaaaggaaaggaaaca

SEQ ID NO: 1828208 - RNA, 16 nt, Human herpesvirus 2
gcugcugcgcauggcc

SEQ ID NO: 1828209 - RNA, 18 nt, Human herpesvirus 2
ggagccccggagcuccga

SEQ ID NO: 1828210 - RNA, 19 nt, Human herpesvirus 2
uggccggguuuuuggcccu

SEQ ID NO: 1828211 - RNA, 22 nt, Human herpesvirus 2
cgccuuuccuccccucgccugu

SEQ ID NO: 1828212 - RNA, 12 nt, Human herpesvirus 2
cggucaggacca

SEQ ID NO: 1828213 - RNA, 12 nt, Human herpesvirus 2
gggaucagcaac

SEQ ID NO: 1828214 - RNA, 22 nt, Human herpesvirus 2
ccuggagcgccagacgggccgg

SEQ ID NO: 1828215 - RNA, 17 nt, Human herpesvirus 2
cucccucuuucccuccc

SEQ ID NO: 1828216 - RNA, 13 nt, Human herpesvirus 2
cgaguccugggug

SEQ ID NO: 1828217 - RNA, 13 nt, Human herpesvirus 2
guccugcggcuca

SEQ ID NO: 1828218 - RNA, 17 nt, Human herpesvirus 2
ggggcacgcggucagca

SEQ ID NO: 1828219 - RNA, 14 nt, Human herpesvirus 2
caucaggcucauug

SEQ ID NO: 1828220 - RNA, 16 nt, Human herpesvirus 2
cccggcgccgccccgc

SEQ ID NO: 1828221 - RNA, 21 nt, Human herpesvirus 2
cgggggucccgccucccggcc

SEQ ID NO: 1828222 - RNA, 15 nt, Human herpesvirus 2
accuaauuuuugugu

SEQ ID NO: 1828223 - RNA, 13 nt, Human herpesvirus 2
ggugggggaagaa

SEQ ID NO: 1828224 - RNA, 13 nt, Human herpesvirus 2
cgcccgccccugc

SEQ ID NO: 1828225 - RNA, 13 nt, Human herpesvirus 2
augcaaauuaaaa

SEQ ID NO: 1828226 - RNA, 19 nt, Human herpesvirus 2
cgccuccccgcuggagccc

SEQ ID NO: 1828227 - RNA, 13 nt, Human herpesvirus 2
gaugcgacgccgc

SEQ ID NO: 1828228 - RNA, 21 nt, Human herpesvirus 2
gccuccggaagagagcgcccc

SEQ ID NO: 1828229 - RNA, 20 nt, Human herpesvirus 2
cagagacccugccccccggc

SEQ ID NO: 1828230 - RNA, 22 nt, Human herpesvirus 2
cccuauacgcgguauggcugcc

SEQ ID NO: 1828231 - RNA, 19 nt, Human herpesvirus 2
cccacuuucccccccacuc

SEQ ID NO: 1828232 - RNA, 19 nt, Human herpesvirus 2
gacauguuacaccccccug

SEQ ID NO: 1828233 - RNA, 14 nt, Human herpesvirus 2
ugcacugccccccu

SEQ ID NO: 1828234 - RNA, 14 nt, Human herpesvirus 2
ccuccccgugcgug

SEQ ID NO: 1828235 - RNA, 12 nt, Human herpesvirus 2
agccgcccaagc

SEQ ID NO: 1828236 - RNA, 12 nt, Human herpesvirus 2
gcccagcacagg

SEQ ID NO: 1828237 - RNA, 15 nt, Human herpesvirus 2
gcgggcgggggcgcg

SEQ ID NO: 1828238 - RNA, 18 nt, Human herpesvirus 2
ggagauggggagaggggg

SEQ ID NO: 1828239 - RNA, 16 nt, Human herpesvirus 2
acggcaccgccgggcg

SEQ ID NO: 1828240 - RNA, 12 nt, Human herpesvirus 2
cggccgcaccca

SEQ ID NO: 1828241 - RNA, 15 nt, Human herpesvirus 2
gcuaguacccagagg

SEQ ID NO: 1828242 - RNA, 12 nt, Human herpesvirus 2
cggggcccgcag

SEQ ID NO: 1828243 - RNA, 20 nt, Human herpesvirus 2
caggugggccgacgugccgg

SEQ ID NO: 1828244 - RNA, 22 nt, Human herpesvirus 2
gauguugucgggggggauccag

SEQ ID NO: 1828245 - RNA, 18 nt, Human herpesvirus 2
cacggucggugcccccca

SEQ ID NO: 1828246 - RNA, 21 nt, Human herpesvirus 2
gcagacgcguauucaccgacc

SEQ ID NO: 1828247 - RNA, 15 nt, Human herpesvirus 2
ggggccccagggcuu

SEQ ID NO: 1828248 - RNA, 14 nt, Human herpesvirus 2
aaaucuauugaacu

SEQ ID NO: 1828249 - RNA, 14 nt, Human herpesvirus 2
caaacaaaaacaca

SEQ ID NO: 1828250 - RNA, 18 nt, Human herpesvirus 2
gcccccgccguggcggag

SEQ ID NO: 1828251 - RNA, 11 nt, Human herpesvirus 2
ccaaaaaccag

SEQ ID NO: 1828252 - RNA, 19 nt, Human herpesvirus 2
gcaggcuggagcucugccu

SEQ ID NO: 1828253 - RNA, 18 nt, Human herpesvirus 2
cucguccccuggggcggc

SEQ ID NO: 1828254 - RNA, 22 nt, Human herpesvirus 2
gcucuccgagggcgagcucggc

SEQ ID NO: 1828255 - RNA, 18 nt, Human herpesvirus 2
ucuuucggccaccacccc

SEQ ID NO: 1828256 - RNA, 17 nt, Human herpesvirus 2
uggaggggggggcuggu

SEQ ID NO: 1828257 - RNA, 22 nt, Human herpesvirus 2
guugguucguccgaccugcagg

SEQ ID NO: 1828258 - RNA, 20 nt, Human herpesvirus 2
cacgagcucgacggcgccua

SEQ ID NO: 1828259 - RNA, 15 nt, Human herpesvirus 2
ggcccggccgccggu

SEQ ID NO: 1828260 - RNA, 14 nt, Human herpesvirus 2
gacgcggcacaggu

SEQ ID NO: 1828261 - RNA, 16 nt, Human herpesvirus 2
gccacgucgggguccc

SEQ ID NO: 1828262 - RNA, 14 nt, Human herpesvirus 2
aaaaucguuauuau

SEQ ID NO: 1828263 - RNA, 16 nt, Human herpesvirus 2
gacggccccggccgcc

SEQ ID NO: 1828264 - RNA, 21 nt, Human herpesvirus 2
ggacaguucauaggccgggag

SEQ ID NO: 1828265 - RNA, 16 nt, Human herpesvirus 2
ccgccuaccagccccu

SEQ ID NO: 1828266 - RNA, 13 nt, Human herpesvirus 2
ugaucccccggaa

SEQ ID NO: 1828267 - RNA, 14 nt, Human herpesvirus 2
uguguuuuguggga

SEQ ID NO: 1828268 - RNA, 21 nt, Human herpesvirus 2
ccucggggacgcacggcaccc

SEQ ID NO: 1828269 - RNA, 13 nt, Human herpesvirus 2
cuuaugguaauua

SEQ ID NO: 1828270 - RNA, 21 nt, Human herpesvirus 2
acgucguccggggggugccac

SEQ ID NO: 1828271 - RNA, 20 nt, Human herpesvirus 2
cugaucgacgacgccuggcg

SEQ ID NO: 1828272 - RNA, 23 nt, Human herpesvirus 2
ccugccguaugcuaauuaaauac

SEQ ID NO: 1828273 - RNA, 13 nt, Human herpesvirus 2
auauaaggcaggg

SEQ ID NO: 1828274 - RNA, 18 nt, Human herpesvirus 2
gcgguaauuagcagcuuu

SEQ ID NO: 1828275 - RNA, 17 nt, Human herpesvirus 2
guccucaccgagccgcu

SEQ ID NO: 1828276 - RNA, 20 nt, Human herpesvirus 2
ggccgccuccccgcuggagc

SEQ ID NO: 1828277 - RNA, 16 nt, Human herpesvirus 2
ccguguggucgccccc

SEQ ID NO: 1828278 - RNA, 18 nt, Human herpesvirus 2
accgccaacaccagggca

SEQ ID NO: 1828279 - RNA, 19 nt, Human herpesvirus 2
cacgucggacgccagcugc

SEQ ID NO: 1828280 - RNA, 15 nt, Human herpesvirus 2
cugcgaggugcgcca

SEQ ID NO: 1828281 - RNA, 12 nt, Human herpesvirus 2
cccuucagccug

SEQ ID NO: 1828282 - RNA, 13 nt, Human herpesvirus 2
ggaggccuguccc

SEQ ID NO: 1828283 - RNA, 18 nt, Human herpesvirus 2
cggacacggccccgaaca

SEQ ID NO: 1828284 - RNA, 19 nt, Human herpesvirus 2
aggucuguuguguuugcug

SEQ ID NO: 1828285 - RNA, 22 nt, Human herpesvirus 2
caggugggugcuucggggacuu

SEQ ID NO: 1828286 - RNA, 20 nt, Human herpesvirus 2
ucccgacgauuagccaccgc

SEQ ID NO: 1828287 - RNA, 19 nt, Human herpesvirus 2
ggucgaucucggggagggc

SEQ ID NO: 1828288 - RNA, 17 nt, Human herpesvirus 2
gcgccgggccucccgca

SEQ ID NO: 1828289 - RNA, 20 nt, Human herpesvirus 2
ucccgauggccgccccgcag

SEQ ID NO: 1828290 - RNA, 21 nt, Human herpesvirus 2
guucgggcggcggaaacaaca

SEQ ID NO: 1828291 - RNA, 20 nt, Human herpesvirus 2
cguggaugccggggccgugg

SEQ ID NO: 1828292 - RNA, 18 nt, Human herpesvirus 2
cguguuugagucagggac

SEQ ID NO: 1828293 - RNA, 17 nt, Human herpesvirus 2
ccagggcugggagcccu

SEQ ID NO: 1828294 - RNA, 23 nt, Human herpesvirus 2
gccccggccgccuccccgcugga

SEQ ID NO: 1828295 - RNA, 14 nt, Human herpesvirus 2
cggcaauaaaagaa

SEQ ID NO: 1828296 - RNA, 20 nt, Human herpesvirus 2
cgggaggggcgggaggggcg

SEQ ID NO: 1828297 - RNA, 21 nt, Human herpesvirus 2
uccuagccccccccccucacc

SEQ ID NO: 1828298 - RNA, 12 nt, Human herpesvirus 2
uaccagccccuc

SEQ ID NO: 1828299 - RNA, 20 nt, Human herpesvirus 2
agcauccugaaccgcuggcu

SEQ ID NO: 1828300 - RNA, 13 nt, Human herpesvirus 2
gggcgugugacua

SEQ ID NO: 1828301 - RNA, 12 nt, Human herpesvirus 2
cccagggcacca

SEQ ID NO: 1828302 - RNA, 13 nt, Human herpesvirus 2
ucugccaggaggg

SEQ ID NO: 1828303 - RNA, 15 nt, Human herpesvirus 2
cuggcguccccaggc

SEQ ID NO: 1828304 - RNA, 13 nt, Human herpesvirus 2
ccacguccaccuu

SEQ ID NO: 1828305 - RNA, 21 nt, Human herpesvirus 2
gcuaacgagcgcgcugccgga

SEQ ID NO: 1828306 - RNA, 17 nt, Human herpesvirus 2
gccauccucaaacaggc

SEQ ID NO: 1828307 - RNA, 19 nt, Human herpesvirus 2
ggagagggggaaggaaucg

SEQ ID NO: 1828308 - RNA, 20 nt, Human herpesvirus 2
gccacccgaacauggcucgc

SEQ ID NO: 1828309 - RNA, 20 nt, Human herpesvirus 2
cggcggccaccccgccgcag

SEQ ID NO: 1828310 - RNA, 20 nt, Human herpesvirus 2
gacugggccgaugugcccug

SEQ ID NO: 1828311 - RNA, 20 nt, Human herpesvirus 2
cgaugcgacgccgccccugc

SEQ ID NO: 1828312 - RNA, 20 nt, Human herpesvirus 2
guaucagugggugacagagu

SEQ ID NO: 1828313 - RNA, 17 nt, Human herpesvirus 2
gccccucgcuccccgcg

SEQ ID NO: 1828314 - RNA, 16 nt, Human herpesvirus 2
ggucugugggugguga

SEQ ID NO: 1828315 - RNA, 23 nt, Human herpesvirus 2
gccgcuuuaccccgcggccucgc

SEQ ID NO: 1828316 - RNA, 20 nt, Human herpesvirus 2
cagggcuucguggaagagga

SEQ ID NO: 1828317 - RNA, 12 nt, Human herpesvirus 2
aggaagaaagaa

SEQ ID NO: 1828318 - RNA, 22 nt, Human herpesvirus 2
ggucccuuccccaccaccaacc

SEQ ID NO: 1828319 - RNA, 16 nt, Human herpesvirus 2
ccucguggggcuggac

SEQ ID NO: 1828320 - RNA, 13 nt, Human herpesvirus 2
accguccaccucc

SEQ ID NO: 1828321 - RNA, 21 nt, Human herpesvirus 2
ccgccgucucccccgcgagca

SEQ ID NO: 1828322 - RNA, 16 nt, Human herpesvirus 2
cucuggugucggccgc

SEQ ID NO: 1828323 - RNA, 22 nt, Human herpesvirus 2
uaauaggcggucccggccgcca

SEQ ID NO: 1828324 - RNA, 16 nt, Human herpesvirus 2
agaagggaaaggaaca

SEQ ID NO: 1828325 - RNA, 14 nt, Human herpesvirus 2
aggcuggagcucug

SEQ ID NO: 1828326 - RNA, 15 nt, Human herpesvirus 2
cgcuggagccccugg

SEQ ID NO: 1828327 - RNA, 19 nt, Human herpesvirus 2
caucaagaauucccagggc

SEQ ID NO: 1828328 - RNA, 16 nt, Human herpesvirus 2
gcagccccgguccccc

SEQ ID NO: 1828329 - RNA, 19 nt, Human herpesvirus 2
auugugggaauccucgggu

SEQ ID NO: 1828330 - RNA, 13 nt, Human herpesvirus 2
ggccaccccgccg

SEQ ID NO: 1828331 - RNA, 12 nt, Human herpesvirus 2
ucccccccucaa

SEQ ID NO: 1828332 - RNA, 15 nt, Human herpesvirus 2
cugguggcaccuccc

SEQ ID NO: 1828333 - RNA, 11 nt, Human herpesvirus 2
gggaugugucu

SEQ ID NO: 1828334 - RNA, 15 nt, Human herpesvirus 2
cuucagccuggacca

SEQ ID NO: 1828335 - RNA, 15 nt, Human herpesvirus 2
uccacgccguggacg

SEQ ID NO: 1828336 - RNA, 14 nt, Human herpesvirus 2
guucggcaggcccg

SEQ ID NO: 1828337 - RNA, 14 nt, Human herpesvirus 2
cgaggcccccggcc

SEQ ID NO: 1828338 - RNA, 18 nt, Human herpesvirus 2
ugccagguggcccuuccg

SEQ ID NO: 1828339 - RNA, 19 nt, Human herpesvirus 2
cggaggaaacccccgaccc

SEQ ID NO: 1828340 - RNA, 12 nt, Human herpesvirus 2
ggcugcuccgcu

SEQ ID NO: 1828341 - RNA, 23 nt, Human herpesvirus 2
ggggccucggucgacgaggccug

SEQ ID NO: 1828342 - RNA, 21 nt, Human herpesvirus 2
cuucgaucgacgaacuggggc

SEQ ID NO: 1828343 - RNA, 20 nt, Human herpesvirus 2
gccguuggggauacgggggc

SEQ ID NO: 1828344 - RNA, 22 nt, Human herpesvirus 2
gccccgauauucaagcccgcgg

SEQ ID NO: 1828345 - RNA, 19 nt, Human herpesvirus 2
cgcuggcggaagugccgca

SEQ ID NO: 1828346 - RNA, 19 nt, Human herpesvirus 2
gaccgucuuugggccccgc

SEQ ID NO: 1828347 - RNA, 17 nt, Human herpesvirus 2
auuucuuuguucccucu

SEQ ID NO: 1828348 - RNA, 21 nt, Human herpesvirus 2
ggcaucguuuggguggaggag

SEQ ID NO: 1828349 - RNA, 15 nt, Human herpesvirus 2
gggccgugucccucc

SEQ ID NO: 1828350 - RNA, 21 nt, Human herpesvirus 2
cacggcacaccggcggggcgg

SEQ ID NO: 1828351 - RNA, 15 nt, Human herpesvirus 2
ggcgagcuggcccug

SEQ ID NO: 1828352 - RNA, 20 nt, Human herpesvirus 2
cccucccgcacccccgcguu

SEQ ID NO: 1828353 - RNA, 19 nt, Human herpesvirus 2
aucuuggcguuauuuccaa

SEQ ID NO: 1828354 - RNA, 19 nt, Human herpesvirus 2
agacuggccgugcugggcg

SEQ ID NO: 1828355 - RNA, 20 nt, Human herpesvirus 2
cgaggcccacccccccaccc

SEQ ID NO: 1828356 - RNA, 13 nt, Human herpesvirus 2
ggagcuucaucac

SEQ ID NO: 1828357 - RNA, 14 nt, Human herpesvirus 2
ccgcgggaggaugu

SEQ ID NO: 1828358 - RNA, 16 nt, Human herpesvirus 2
acccccagcgcggacg

SEQ ID NO: 1828359 - RNA, 17 nt, Human herpesvirus 2
cccaaggcgcugcgccu

SEQ ID NO: 1828360 - RNA, 14 nt, Human herpesvirus 2
gucgcgacccugcu

SEQ ID NO: 1828361 - RNA, 15 nt, Human herpesvirus 2
auucgucaccuggcu

SEQ ID NO: 1828362 - RNA, 16 nt, Human herpesvirus 2
gugcugugcccugggu

SEQ ID NO: 1828363 - RNA, 17 nt, Human herpesvirus 2
gcagcgugucaaaggcc

SEQ ID NO: 1828364 - RNA, 13 nt, Human herpesvirus 2
ggcccggccgccg

SEQ ID NO: 1828365 - RNA, 15 nt, Human herpesvirus 2
ggacgacgggcgccc

SEQ ID NO: 1828366 - RNA, 12 nt, Human herpesvirus 2
accaaaagggaa

SEQ ID NO: 1828367 - RNA, 19 nt, Human herpesvirus 2
acgcccaggcccuggcgca

SEQ ID NO: 1828368 - RNA, 20 nt, Human herpesvirus 2
gcuaguacccagaggcugga

SEQ ID NO: 1828369 - RNA, 21 nt, Human herpesvirus 2
gaaacacgguggcgcgcuggc

SEQ ID NO: 1828370 - RNA, 22 nt, Human herpesvirus 2
gggcagugcaguaccccaguuc

SEQ ID NO: 1828371 - RNA, 21 nt, Human herpesvirus 2
ugugcgggaggggcuuggccu

SEQ ID NO: 1828372 - RNA, 17 nt, Human herpesvirus 2
cgccucugcccgaccgg

SEQ ID NO: 1828373 - RNA, 20 nt, Human herpesvirus 2
gcgccgucgucgcccgcccg

SEQ ID NO: 1828374 - RNA, 14 nt, Human herpesvirus 2
ccgaccccgccgcc

SEQ ID NO: 1828375 - RNA, 16 nt, Human herpesvirus 2
guccccaggcgacgcc

SEQ ID NO: 1828376 - RNA, 11 nt, Human herpesvirus 2
auaaaagccaa

SEQ ID NO: 1828377 - RNA, 22 nt, Human herpesvirus 2
agccaggcaaacgguaagcagc

SEQ ID NO: 1828378 - RNA, 15 nt, Human herpesvirus 2
gggcgcccccgccuc

SEQ ID NO: 1828379 - RNA, 15 nt, Human herpesvirus 2
ggccucguggucggg

SEQ ID NO: 1828380 - RNA, 16 nt, Human herpesvirus 2
cggccaacgaggacca

SEQ ID NO: 1828381 - RNA, 18 nt, Human herpesvirus 2
acgagaacgagaugguuu

SEQ ID NO: 1828382 - RNA, 19 nt, Human herpesvirus 2
cuccgcgggucccuuccca

SEQ ID NO: 1828383 - RNA, 14 nt, Human herpesvirus 2
cguccugcggcuca

SEQ ID NO: 1828384 - RNA, 15 nt, Human herpesvirus 2
cgcacgcggggaccc

SEQ ID NO: 1828385 - RNA, 15 nt, Human herpesvirus 2
ggcuggcgcggugcc

SEQ ID NO: 1828386 - RNA, 14 nt, Human herpesvirus 2
ccacgucaccgggg

SEQ ID NO: 1828387 - RNA, 15 nt, Human herpesvirus 2
ucuucuuccccagcu

SEQ ID NO: 1828388 - RNA, 23 nt, Human herpesvirus 2
ggccccgccccgccccaccccgc

SEQ ID NO: 1828389 - RNA, 11 nt, Human herpesvirus 2
gagccccgcgu

SEQ ID NO: 1828390 - RNA, 11 nt, Human herpesvirus 2
cggggaaacag

SEQ ID NO: 1828391 - RNA, 20 nt, Human herpesvirus 2
uugaugggcggggggguucg

SEQ ID NO: 1828392 - RNA, 14 nt, Human herpesvirus 2
cgcgcgcagaggga

SEQ ID NO: 1828393 - RNA, 22 nt, Human herpesvirus 2
ggugggccuagccgugggccug

SEQ ID NO: 1828394 - RNA, 18 nt, Human herpesvirus 2
uccggggguugggucugc

SEQ ID NO: 1828395 - RNA, 16 nt, Human herpesvirus 2
gagccgcugugccagg

SEQ ID NO: 1828396 - RNA, 19 nt, Human herpesvirus 2
ggaagagagcgccccgccc

SEQ ID NO: 1828397 - RNA, 23 nt, Human herpesvirus 2
gcagcgcgggcgacgggcggcug

SEQ ID NO: 1828398 - RNA, 15 nt, Human herpesvirus 2
cagccuacaucaccc

SEQ ID NO: 1828399 - RNA, 17 nt, Human herpesvirus 2
accaucgcguacagccu

SEQ ID NO: 1828400 - RNA, 20 nt, Human herpesvirus 2
acacgcgcuggccccucugc

SEQ ID NO: 1828401 - RNA, 14 nt, Human herpesvirus 2
gucugcggccgaca

SEQ ID NO: 1828402 - RNA, 14 nt, Human herpesvirus 2
gucgcccuucacca

SEQ ID NO: 1828403 - RNA, 14 nt, Human herpesvirus 2
gaccugcagccggc

SEQ ID NO: 1828404 - RNA, 21 nt, Human herpesvirus 2
ccgggggggggcaagugcagu

SEQ ID NO: 1828405 - RNA, 15 nt, Human herpesvirus 2
cccaccgcaccacca

SEQ ID NO: 1828406 - RNA, 16 nt, Human herpesvirus 2
gcuuggacugggagcc

SEQ ID NO: 1828407 - RNA, 19 nt, Human herpesvirus 2
uccuccgugcuggggaaau

SEQ ID NO: 1828408 - RNA, 14 nt, Human herpesvirus 2
ggcgcgagccaggc

SEQ ID NO: 1828409 - RNA, 15 nt, Human herpesvirus 2
ugcacuugccccccc

SEQ ID NO: 1828410 - RNA, 15 nt, Human herpesvirus 2
accccgucucccugc

SEQ ID NO: 1828411 - RNA, 22 nt, Human herpesvirus 2
uguuacaccccccugacucagg

SEQ ID NO: 1828412 - RNA, 15 nt, Human herpesvirus 2
ucaauagauuucccc

SEQ ID NO: 1828413 - RNA, 17 nt, Human herpesvirus 2
cagcauccugaaccgcu

SEQ ID NO: 1828414 - RNA, 23 nt, Human herpesvirus 2
ugggcccgugugggaggguggcu

SEQ ID NO: 1828415 - RNA, 21 nt, Human herpesvirus 2
ugucaucguauaccagccgcc

SEQ ID NO: 1828416 - RNA, 19 nt, Human herpesvirus 2
gucccgccucccggccgcc

SEQ ID NO: 1828417 - RNA, 18 nt, Human herpesvirus 2
ccagaccgaagaggugcu

SEQ ID NO: 1828418 - RNA, 18 nt, Human herpesvirus 2
cugcgucguccagggugg

SEQ ID NO: 1828419 - RNA, 18 nt, Human herpesvirus 2
agccccccccccucaccc

SEQ ID NO: 1828420 - RNA, 18 nt, Human herpesvirus 2
acgcucucugccuccuuc

SEQ ID NO: 1828421 - RNA, 16 nt, Human herpesvirus 2
ccgcugguuucucugc

SEQ ID NO: 1828422 - RNA, 19 nt, Human herpesvirus 2
ccggaccccgcugcugugc

SEQ ID NO: 1828423 - RNA, 17 nt, Human herpesvirus 2
gucgccggaugcgggcg

SEQ ID NO: 1828424 - RNA, 14 nt, Human herpesvirus 2
cccgacccuguggc

SEQ ID NO: 1828425 - RNA, 20 nt, Human herpesvirus 2
ccacgucaccgggggccccg

SEQ ID NO: 1828426 - RNA, 16 nt, Human herpesvirus 2
ccagaggcuggagcgc

SEQ ID NO: 1828427 - RNA, 15 nt, Human herpesvirus 2
gccaucgccggggac

SEQ ID NO: 1828428 - RNA, 14 nt, Human herpesvirus 2
caggcccgccgacg

SEQ ID NO: 1828429 - RNA, 15 nt, Human herpesvirus 2
acuuccgggagcggg

SEQ ID NO: 1828430 - RNA, 10 nt, Human herpesvirus 2
cccgucccga

SEQ ID NO: 1828431 - RNA, 14 nt, Human herpesvirus 2
gccuccgcccuccg

SEQ ID NO: 1828432 - RNA, 15 nt, Human herpesvirus 2
aagagagcgccccgc

SEQ ID NO: 1828433 - RNA, 15 nt, Human herpesvirus 2
cggaacgccccgggc

SEQ ID NO: 1828434 - RNA, 12 nt, Human herpesvirus 2
gcaauaaaagaa

SEQ ID NO: 1828435 - RNA, 16 nt, Human herpesvirus 2
cacaccggagacccaa

SEQ ID NO: 1828436 - RNA, 13 nt, Human herpesvirus 2
agccccuggggcu

SEQ ID NO: 1828437 - RNA, 11 nt, Human herpesvirus 2
cuuugacuccu

SEQ ID NO: 1828438 - RNA, 21 nt, Human herpesvirus 2
gccucccgcaagagccugccg

SEQ ID NO: 1828439 - RNA, 18 nt, Human herpesvirus 2
acccaaccgacucccucc

SEQ ID NO: 1828440 - RNA, 17 nt, Human herpesvirus 2
cgcgugccgcagaccac

SEQ ID NO: 1828441 - RNA, 22 nt, Human herpesvirus 2
cgcgcgcccccgacccggggcc

SEQ ID NO: 1828442 - RNA, 15 nt, Human herpesvirus 2
cugacggaccucggg

SEQ ID NO: 1828443 - RNA, 23 nt, Human herpesvirus 2
cccggcggccgcauauacugcug

SEQ ID NO: 1828444 - RNA, 12 nt, Human herpesvirus 2
gcuccauccuga

SEQ ID NO: 1828445 - RNA, 14 nt, Human herpesvirus 2
gagcccugccccgc

SEQ ID NO: 1828446 - RNA, 17 nt, Human herpesvirus 2
ccucgcugcucucccgu

SEQ ID NO: 1828447 - RNA, 12 nt, Human herpesvirus 2
gcuggcccugga

SEQ ID NO: 1828448 - RNA, 22 nt, Human herpesvirus 2
cguggccggguuuuuggcccug

SEQ ID NO: 1828449 - RNA, 22 nt, Human herpesvirus 2
cgguggcgucggcggccccggc

SEQ ID NO: 1828450 - RNA, 12 nt, Human herpesvirus 2
ccuucuucgccc

SEQ ID NO: 1828451 - RNA, 17 nt, Human herpesvirus 2
agaggcccggaacgagg

SEQ ID NO: 1828452 - RNA, 14 nt, Human herpesvirus 2
gcucugccugcacg

SEQ ID NO: 1828453 - RNA, 20 nt, Human herpesvirus 2
ggucuagaugccaguggagc

SEQ ID NO: 1828454 - RNA, 16 nt, Human herpesvirus 2
cccucaccccacccca

SEQ ID NO: 1828455 - RNA, 22 nt, Human herpesvirus 2
guuucgggcguuccuucccuuu

SEQ ID NO: 1828456 - RNA, 14 nt, Human herpesvirus 2
cuggguuacugcac

SEQ ID NO: 1828457 - RNA, 21 nt, Human herpesvirus 2
cacacaggcccaccaccaucc

SEQ ID NO: 1828458 - RNA, 11 nt, Human herpesvirus 2
gagagcccagg

SEQ ID NO: 1828459 - RNA, 19 nt, Human herpesvirus 2
uucaccgaccccccccucg

SEQ ID NO: 1828460 - RNA, 17 nt, Human herpesvirus 2
caccuccccggcggccg

SEQ ID NO: 1828461 - RNA, 18 nt, Human herpesvirus 2
cgcgggcgacgccgcggc

SEQ ID NO: 1828462 - RNA, 18 nt, Human herpesvirus 2
caccggggaaacaggcac

SEQ ID NO: 1828463 - RNA, 15 nt, Human herpesvirus 2
cgacgccuucccugu

SEQ ID NO: 1828464 - RNA, 17 nt, Human herpesvirus 2
uccccgcuggagccccu

SEQ ID NO: 1828465 - RNA, 19 nt, Human herpesvirus 2
acgcgcacguggggccucu

SEQ ID NO: 1828466 - RNA, 16 nt, Human herpesvirus 2
ccuugcccccacccca

SEQ ID NO: 1828467 - RNA, 18 nt, Human herpesvirus 2
cucucccuuuuuuccccc

SEQ ID NO: 1828468 - RNA, 22 nt, Human herpesvirus 2
cugggcccgccgaccgcccccc

SEQ ID NO: 1828469 - RNA, 16 nt, Human herpesvirus 2
ccggcggagccccgga

SEQ ID NO: 1828470 - RNA, 15 nt, Human herpesvirus 2
ccgcacccccgccua

SEQ ID NO: 1828471 - RNA, 20 nt, Human herpesvirus 2
cccgcgugccgcagaccacc

SEQ ID NO: 1828472 - RNA, 20 nt, Human herpesvirus 2
ggcgacggcaccgccgggcg

SEQ ID NO: 1828473 - RNA, 18 nt, Human herpesvirus 2
gcaggcgcgccaccgccc

SEQ ID NO: 1828474 - RNA, 19 nt, Human herpesvirus 2
ccagagccccccacguggg

SEQ ID NO: 1828475 - RNA, 16 nt, Human herpesvirus 2
uccccgaaagccacca

SEQ ID NO: 1828476 - RNA, 17 nt, Human herpesvirus 2
ucaauaaaaaacaccaa

SEQ ID NO: 1828477 - RNA, 22 nt, Human herpesvirus 2
accugcgcggcguuggcgcgcu

SEQ ID NO: 1828478 - RNA, 19 nt, Human herpesvirus 2
ccccaggaggggggcagug

SEQ ID NO: 1828479 - RNA, 16 nt, Human herpesvirus 2
cguggccagagccuca

SEQ ID NO: 1828480 - RNA, 22 nt, Human herpesvirus 2
aggaggcggcgccugcgccccg

SEQ ID NO: 1828481 - RNA, 13 nt, Human herpesvirus 2
acgcguuucccuu

SEQ ID NO: 1828482 - RNA, 14 nt, Human herpesvirus 2
cccgccccccccag

SEQ ID NO: 1828483 - RNA, 16 nt, Human herpesvirus 2
cuuggcgcgcgcggcg

SEQ ID NO: 1828484 - RNA, 22 nt, Human herpesvirus 2
ccuuuccuuaaaaggcacccca

SEQ ID NO: 1828485 - RNA, 13 nt, Human herpesvirus 2
cccucaccccucc

SEQ ID NO: 1828486 - RNA, 18 nt, Human herpesvirus 2
gguccuggaggggggugc

SEQ ID NO: 1828487 - RNA, 14 nt, Human herpesvirus 2
cucaucgcacggcg

SEQ ID NO: 1828488 - RNA, 12 nt, Human herpesvirus 2
gcaggggagggg

SEQ ID NO: 1828489 - RNA, 16 nt, Human herpesvirus 2
gggcgcgagccaggca

SEQ ID NO: 1828490 - RNA, 22 nt, Human herpesvirus 2
gaaggcguuuauugcggagaga

SEQ ID NO: 1828491 - RNA, 17 nt, Human herpesvirus 2
cccacccccgcacccca

SEQ ID NO: 1828492 - RNA, 13 nt, Human herpesvirus 2
cagggaggccaga

SEQ ID NO: 1828493 - RNA, 16 nt, Human herpesvirus 2
gccugcgccccgacgg

SEQ ID NO: 1828494 - RNA, 12 nt, Human herpesvirus 2
cucgaaggaggg

SEQ ID NO: 1828495 - RNA, 20 nt, Human herpesvirus 2
ggccuggcguuugggggcgg

SEQ ID NO: 1828496 - RNA, 22 nt, Human herpesvirus 2
uggcgcgucguucggggggacg

SEQ ID NO: 1828497 - RNA, 14 nt, Human herpesvirus 2
accucgcggcggcu

SEQ ID NO: 1828498 - RNA, 13 nt, Human herpesvirus 2
caccccgccgcag

SEQ ID NO: 1828499 - RNA, 19 nt, Human herpesvirus 2
uauuuccaaacagggccuu

SEQ ID NO: 1828500 - RNA, 18 nt, Human herpesvirus 2
guucguguuguggcugga

SEQ ID NO: 1828501 - RNA, 14 nt, Human herpesvirus 2
uccgaccugcagga

SEQ ID NO: 1828502 - RNA, 22 nt, Human herpesvirus 2
gcaagcgggcgggguggggagg

SEQ ID NO: 1828503 - RNA, 13 nt, Human herpesvirus 2
ccaccggccuggu

SEQ ID NO: 1828504 - RNA, 13 nt, Human herpesvirus 2
cucgcgguaauua

SEQ ID NO: 1828505 - RNA, 18 nt, Human herpesvirus 2
cuugauuuacgagggggc

SEQ ID NO: 1828506 - RNA, 21 nt, Human herpesvirus 2
ggccgcgcccccggccgcggu

SEQ ID NO: 1828507 - RNA, 18 nt, Human herpesvirus 2
acccccgggggggggcaa

SEQ ID NO: 1828508 - RNA, 20 nt, Human herpesvirus 2
cugcgccaccggccuggucg

SEQ ID NO: 1828509 - RNA, 18 nt, Human herpesvirus 2
ccggggcgaacgggggau

SEQ ID NO: 1828510 - RNA, 12 nt, Human herpesvirus 2
cgggcggugccc

SEQ ID NO: 1828511 - RNA, 21 nt, Human herpesvirus 2
gugugggaggguggcuggggu

SEQ ID NO: 1828512 - RNA, 20 nt, Human herpesvirus 2
ccaccuucgcucccucagca

SEQ ID NO: 1828513 - RNA, 19 nt, Human herpesvirus 2
uccgcacgggcguccccgg

SEQ ID NO: 1828514 - RNA, 14 nt, Human herpesvirus 2
ccgccuaccagccc

SEQ ID NO: 1828515 - RNA, 15 nt, Human herpesvirus 2
ccagacgcccuccga

SEQ ID NO: 1828516 - RNA, 23 nt, Human herpesvirus 2
gugcccccccucguucugcugca

SEQ ID NO: 1828517 - RNA, 19 nt, Human herpesvirus 2
gcccggcgccgccccgccg

SEQ ID NO: 1828518 - RNA, 22 nt, Human herpesvirus 2
ccccggcgaccgccccgcgccg

SEQ ID NO: 1828519 - RNA, 16 nt, Human herpesvirus 2
cguguccccagggagc

SEQ ID NO: 1828520 - RNA, 18 nt, Human herpesvirus 2
ugggauaucucacacaga

SEQ ID NO: 1828521 - RNA, 20 nt, Human herpesvirus 2
ggcgacgccaggccccccgg

SEQ ID NO: 1828522 - RNA, 22 nt, Human herpesvirus 2
acuauccuugccucguggggcu

SEQ ID NO: 1828523 - RNA, 14 nt, Human herpesvirus 2
ggggaaagugggcc

SEQ ID NO: 1828524 - RNA, 18 nt, Human herpesvirus 2
gcaccugcagaugcugcc

SEQ ID NO: 1828525 - RNA, 20 nt, Human herpesvirus 2
ucgcggagggcggccagccg

SEQ ID NO: 1828526 - RNA, 16 nt, Human herpesvirus 2
caccaacuccgcccuc

SEQ ID NO: 1828527 - RNA, 18 nt, Human herpesvirus 2
gguauuugggugggacuu

SEQ ID NO: 1828528 - RNA, 20 nt, Human herpesvirus 2
ccgggacuucgagcucgucu

SEQ ID NO: 1828529 - RNA, 23 nt, Human herpesvirus 2
caggcgucgaucucaucaaacac

SEQ ID NO: 1828530 - RNA, 16 nt, Human herpesvirus 2
agauggggagaggggg

SEQ ID NO: 1828531 - RNA, 21 nt, Human herpesvirus 2
ggacccgccagagacccugcc

SEQ ID NO: 1828532 - RNA, 16 nt, Human herpesvirus 2
aagaggcggacccagu

SEQ ID NO: 1828533 - RNA, 17 nt, Human herpesvirus 2
uugagaggggggggugg

SEQ ID NO: 1828534 - RNA, 18 nt, Human herpesvirus 2
gacggccaugaccucgcc

SEQ ID NO: 1828535 - RNA, 13 nt, Human herpesvirus 2
cggccgccccccg

SEQ ID NO: 1828536 - RNA, 13 nt, Human herpesvirus 2
acgguccucaccg

SEQ ID NO: 1828537 - RNA, 13 nt, Human herpesvirus 2
acacacacacagg

SEQ ID NO: 1828538 - RNA, 17 nt, Human herpesvirus 2
cucgcugcagggccugg

SEQ ID NO: 1828539 - RNA, 13 nt, Human herpesvirus 2
gaggggcuccuca

SEQ ID NO: 1828540 - RNA, 16 nt, Human herpesvirus 2
accgagccgcugugcc

SEQ ID NO: 1828541 - RNA, 12 nt, Human herpesvirus 2
gcagccgggccc

SEQ ID NO: 1828542 - RNA, 18 nt, Human herpesvirus 2
gccgguagugcagguggg

SEQ ID NO: 1828543 - RNA, 18 nt, Human herpesvirus 2
agucgcccauacaaauua

SEQ ID NO: 1828544 - RNA, 16 nt, Human herpesvirus 2
gcuucccccgcccacc

SEQ ID NO: 1828545 - RNA, 15 nt, Human herpesvirus 2
cgccugcgccccgac

SEQ ID NO: 1828546 - RNA, 17 nt, Human herpesvirus 2
cgcgggucccuucccaa

SEQ ID NO: 1828547 - RNA, 23 nt, Human herpesvirus 2
cugcgcauggccugcgaggugcg

SEQ ID NO: 1828548 - RNA, 22 nt, Human herpesvirus 2
gcggcaccauaacaccgucccc

SEQ ID NO: 1828549 - RNA, 16 nt, Human herpesvirus 2
gaugugucgcggggac

SEQ ID NO: 1828550 - RNA, 11 nt, Human herpesvirus 2
ggcaggccgcg

SEQ ID NO: 1828551 - RNA, 21 nt, Human herpesvirus 2
gggcuuggacgcgccucccgg

SEQ ID NO: 1828552 - RNA, 16 nt, Human herpesvirus 2
gacacacacacaggcc

SEQ ID NO: 1828553 - RNA, 17 nt, Human herpesvirus 2
gcgccggcaccaggcua

SEQ ID NO: 1828554 - RNA, 14 nt, Human herpesvirus 2
gacaccagcagcuu

SEQ ID NO: 1828555 - RNA, 11 nt, Human herpesvirus 2
gacuggccgug

SEQ ID NO: 1828556 - RNA, 20 nt, Human herpesvirus 2
ccaccaauacaccagagccg

SEQ ID NO: 1828557 - RNA, 17 nt, Human herpesvirus 2
cgggauccuccgccagc

SEQ ID NO: 1828558 - RNA, 22 nt, Human herpesvirus 2
cguggugauacaacacaccccc

SEQ ID NO: 1828559 - RNA, 18 nt, Human herpesvirus 2
ggaacuggguuacugcac

SEQ ID NO: 1828560 - RNA, 23 nt, Human herpesvirus 2
ucgcacgcgcgcaggcuggagcu

SEQ ID NO: 1828561 - RNA, 14 nt, Human herpesvirus 2
guacucaucgggac

SEQ ID NO: 1828562 - RNA, 17 nt, Human herpesvirus 2
ucaccgagagcgccguc

SEQ ID NO: 1828563 - RNA, 22 nt, Human herpesvirus 2
cgcccucgcccagacgcccucc

SEQ ID NO: 1828564 - RNA, 12 nt, Human herpesvirus 2
gcggggaugggg

SEQ ID NO: 1828565 - RNA, 20 nt, Human herpesvirus 2
guggagcgccgggccucccg

SEQ ID NO: 1828566 - RNA, 19 nt, Human herpesvirus 2
ccgcgauuccgagggcagg

SEQ ID NO: 1828567 - RNA, 14 nt, Human herpesvirus 2
ccccgcggaccccg

SEQ ID NO: 1828568 - RNA, 17 nt, Human herpesvirus 2
gcucauggccggagaaa

SEQ ID NO: 1828569 - RNA, 21 nt, Human herpesvirus 2
guggccggguuuuuggcccug

SEQ ID NO: 1828570 - RNA, 14 nt, Human herpesvirus 2
ccggggcccgcagc

SEQ ID NO: 1828571 - RNA, 21 nt, Human herpesvirus 2
ccuccggaagagagcgccccg

SEQ ID NO: 1828572 - RNA, 23 nt, Human herpesvirus 2
ugcguccgucucaauaaagccag

SEQ ID NO: 1828573 - RNA, 20 nt, Human herpesvirus 2
gggccguggggccccagggc

SEQ ID NO: 1828574 - RNA, 17 nt, Human herpesvirus 2
cauuuaggauggcugcu

SEQ ID NO: 1828575 - RNA, 15 nt, Human herpesvirus 2
cggcccugcggccaa

SEQ ID NO: 1828576 - RNA, 12 nt, Human herpesvirus 2
acuuuauuggga

SEQ ID NO: 1828577 - RNA, 14 nt, Human herpesvirus 2
gcgccagggggauc

SEQ ID NO: 1828578 - RNA, 14 nt, Human herpesvirus 2
cgcaucuacgaccc

SEQ ID NO: 1828579 - RNA, 13 nt, Human herpesvirus 2
agcggcgagugcu

SEQ ID NO: 1828580 - RNA, 22 nt, Human herpesvirus 2
gaccaccucgcggcggcucccc

SEQ ID NO: 1828581 - RNA, 12 nt, Human herpesvirus 2
gccguggccaga

SEQ ID NO: 1828582 - RNA, 12 nt, Human herpesvirus 2
cgugcucugcca

SEQ ID NO: 1828583 - RNA, 17 nt, Human herpesvirus 2
cucccccgacgucucgg

SEQ ID NO: 1828584 - RNA, 18 nt, Human herpesvirus 2
cgcuuacggcaacaaagg

SEQ ID NO: 1828585 - RNA, 19 nt, Human herpesvirus 2
uacgacccccgaacagccc

SEQ ID NO: 1828586 - RNA, 11 nt, Human herpesvirus 2
gauagcaaacg

SEQ ID NO: 1828587 - RNA, 15 nt, Human herpesvirus 2
cgcgucgggggccgg

SEQ ID NO: 1828588 - RNA, 20 nt, Human herpesvirus 2
gugccggggauaaaagccaa

SEQ ID NO: 1828589 - RNA, 23 nt, Human herpesvirus 2
cgcgaggccgcucuccgaagaga

SEQ ID NO: 1828590 - RNA, 11 nt, Human herpesvirus 2
agggcaggucc

SEQ ID NO: 1828591 - RNA, 22 nt, Human herpesvirus 2
uggagaagggaaaggaacagag

SEQ ID NO: 1828592 - RNA, 21 nt, Human herpesvirus 2
guccuggaggggggugcugug

SEQ ID NO: 1828593 - RNA, 11 nt, Human herpesvirus 2
cgcggcgccaa

SEQ ID NO: 1828594 - RNA, 23 nt, Human herpesvirus 2
acuuccuauaaacucucccccgc

SEQ ID NO: 1828595 - RNA, 14 nt, Human herpesvirus 2
ucgacgaggccugg

SEQ ID NO: 1828596 - RNA, 19 nt, Human herpesvirus 2
ccggggcgugcugugcccu

SEQ ID NO: 1828597 - RNA, 18 nt, Human herpesvirus 2
uccagcagcuucccauga

SEQ ID NO: 1828598 - RNA, 22 nt, Human herpesvirus 2
cuggccgagcguaucggccagg

SEQ ID NO: 1828599 - RNA, 21 nt, Human herpesvirus 2
ucgaugagccgguagugcagg

SEQ ID NO: 1828600 - RNA, 22 nt, Human herpesvirus 2
gguaguguguccccccccccuc

SEQ ID NO: 1828601 - RNA, 17 nt, Human herpesvirus 2
auggagaagggaaagga

SEQ ID NO: 1828602 - RNA, 18 nt, Human herpesvirus 2
gugucgaaucugggaaga

SEQ ID NO: 1828603 - RNA, 23 nt, Human herpesvirus 2
cacggcacccccggcgauucccu

SEQ ID NO: 1828604 - RNA, 13 nt, Human herpesvirus 2
accucucgccgcu

SEQ ID NO: 1828605 - RNA, 22 nt, Human herpesvirus 2
gauagucccccgaagcggcccc

SEQ ID NO: 1828606 - RNA, 21 nt, Human herpesvirus 2
cgccgggggcggacggccccu

SEQ ID NO: 1828607 - RNA, 14 nt, Human herpesvirus 2
gggggcggcgccgg

SEQ ID NO: 1828608 - RNA, 20 nt, Human herpesvirus 2
cgccuguuguuggucggguu

SEQ ID NO: 1828609 - RNA, 12 nt, Human herpesvirus 2
ugaagggcacuc

SEQ ID NO: 1828610 - RNA, 12 nt, Human herpesvirus 2
gcaagugcagua

SEQ ID NO: 1828611 - RNA, 19 nt, Human herpesvirus 2
cgggaggggcuuggccuuc

SEQ ID NO: 1828612 - RNA, 13 nt, Human herpesvirus 2
cccgugugggagg

SEQ ID NO: 1828613 - RNA, 15 nt, Human herpesvirus 2
cguccgaccugcagg

SEQ ID NO: 1828614 - RNA, 21 nt, Human herpesvirus 2
ggggacgaggcccaccccccc

SEQ ID NO: 1828615 - RNA, 22 nt, Human herpesvirus 2
uuccccagcacggaggaacugg

SEQ ID NO: 1828616 - RNA, 17 nt, Human herpesvirus 2
gagcguaucggccagga

SEQ ID NO: 1828617 - RNA, 18 nt, Human herpesvirus 2
ggcggacguccaggggug

SEQ ID NO: 1828618 - RNA, 17 nt, Human herpesvirus 2
gguuggggcgggcagcc

SEQ ID NO: 1828619 - RNA, 20 nt, Human herpesvirus 2
uggagaacggauaccgacag

SEQ ID NO: 1828620 - RNA, 18 nt, Human herpesvirus 2
uccguuucgaccccuuua

SEQ ID NO: 1828621 - RNA, 14 nt, Human herpesvirus 2
ggcaggggcagcuc

SEQ ID NO: 1828622 - RNA, 19 nt, Human herpesvirus 2
cggaaagccggccccgguc

SEQ ID NO: 1828623 - RNA, 16 nt, Human herpesvirus 2
uccgacacccgggccc

SEQ ID NO: 1828624 - RNA, 22 nt, Human herpesvirus 2
acggggaggagacaggaagugg

SEQ ID NO: 1828625 - RNA, 18 nt, Human herpesvirus 2
gcgugguccccgagcagc

SEQ ID NO: 1828626 - RNA, 15 nt, Human herpesvirus 2
uuggugcgccgccgu

SEQ ID NO: 1828627 - RNA, 12 nt, Human herpesvirus 2
cuguuggagccg

SEQ ID NO: 1828628 - RNA, 20 nt, Human herpesvirus 2
cuacgccccccucggcagcc

SEQ ID NO: 1828629 - RNA, 20 nt, Human herpesvirus 2
uguguuuugugggacugggg

SEQ ID NO: 1828630 - RNA, 13 nt, Human herpesvirus 2
cgcaugguaauua

SEQ ID NO: 1828631 - RNA, 24 nt, Human herpesvirus 2
gcccccggggccgucgcggccgcc

SEQ ID NO: 1828632 - RNA, 18 nt, Human herpesvirus 2
uuggaggcgccucugccc

SEQ ID NO: 1828633 - RNA, 21 nt, Human herpesvirus 2
ggacuccgccccggcgaccgc

SEQ ID NO: 1828634 - RNA, 15 nt, Human herpesvirus 2
ugccccccuccuggg

SEQ ID NO: 1828635 - RNA, 20 nt, Human herpesvirus 2
ggagccugcgaaucccccaa

SEQ ID NO: 1828636 - RNA, 17 nt, Human herpesvirus 2
gcucgucgcgacccugc

SEQ ID NO: 1828637 - RNA, 21 nt, Human herpesvirus 2
cgccgaccaagacucggugcg

SEQ ID NO: 1828638 - RNA, 14 nt, Human herpesvirus 2
cacaaacacacggg

SEQ ID NO: 1828639 - RNA, 23 nt, Human herpesvirus 2
gcucucaacacccacgacccacc

SEQ ID NO: 1828640 - RNA, 22 nt, Human herpesvirus 2
uccgcgugguccccgagcagca

SEQ ID NO: 1828641 - RNA, 17 nt, Human herpesvirus 2
gccgcacauccccuccg

SEQ ID NO: 1828642 - RNA, 18 nt, Human herpesvirus 2
ucaccggggcgccccccc

SEQ ID NO: 1828643 - RNA, 16 nt, Human herpesvirus 2
accugccccggcgcgu

SEQ ID NO: 1828644 - RNA, 23 nt, Human herpesvirus 2
gacgacagacaauaaagcaucac

SEQ ID NO: 1828645 - RNA, 14 nt, Human herpesvirus 2
aggguggcuggggu

SEQ ID NO: 1828646 - RNA, 21 nt, Human herpesvirus 2
cccggccgcucgcugcagggc

SEQ ID NO: 1828647 - RNA, 15 nt, Human herpesvirus 2
ccccggggcccgcag

SEQ ID NO: 1828648 - RNA, 13 nt, Human herpesvirus 2
gcguuucccuuuu

SEQ ID NO: 1828649 - RNA, 11 nt, Human herpesvirus 2
caguggagcca

SEQ ID NO: 1828650 - RNA, 19 nt, Human herpesvirus 2
ucgccgccccgacucugug

SEQ ID NO: 1828651 - RNA, 18 nt, Human herpesvirus 2
gggaugggggggaaggga

SEQ ID NO: 1828652 - RNA, 23 nt, Human herpesvirus 2
gcauccgaucgaugagccgguag

SEQ ID NO: 1828653 - RNA, 22 nt, Human herpesvirus 2
gcggggguucggggccagggcu

SEQ ID NO: 1828654 - RNA, 16 nt, Human herpesvirus 2
cacccccccacuuucc

SEQ ID NO: 1828655 - RNA, 19 nt, Human herpesvirus 2
gguaauuagcagcuuuuaa

SEQ ID NO: 1828656 - RNA, 13 nt, Human herpesvirus 2
cccggcgccgccc

SEQ ID NO: 1828657 - RNA, 22 nt, Human herpesvirus 2
cuccacgcccugcuguaucugg

SEQ ID NO: 1828658 - RNA, 13 nt, Human herpesvirus 2
gcgccaggucagc

SEQ ID NO: 1828659 - RNA, 14 nt, Human herpesvirus 2
cggccagccgcgcg

SEQ ID NO: 1828660 - RNA, 18 nt, Human herpesvirus 2
caauucgucaccuggcuc

SEQ ID NO: 1828661 - RNA, 22 nt, Human herpesvirus 2
ccgcauauacugcugggccaug

SEQ ID NO: 1828662 - RNA, 23 nt, Human herpesvirus 2
uggacauguuacaccccccugac

SEQ ID NO: 1828663 - RNA, 20 nt, Human herpesvirus 2
ggggaaagaaagagaaacaa

SEQ ID NO: 1828664 - RNA, 13 nt, Human herpesvirus 2
ccagguacugcug

SEQ ID NO: 1828665 - RNA, 14 nt, Human herpesvirus 2
aacauuggcaagca

SEQ ID NO: 1828666 - RNA, 21 nt, Human herpesvirus 2
cucggcuugauggagccugcg

SEQ ID NO: 1828667 - RNA, 17 nt, Human herpesvirus 2
uggcgcuugggcgucgc

SEQ ID NO: 1828668 - RNA, 19 nt, Human herpesvirus 2
uccucguuuuguuuucucu

SEQ ID NO: 1828669 - RNA, 16 nt, Human herpesvirus 2
cccuggacugggccgc

SEQ ID NO: 1828670 - RNA, 13 nt, Human herpesvirus 2
caccgggcugggg

SEQ ID NO: 1828671 - RNA, 14 nt, Human herpesvirus 2
caggcccaccacca

SEQ ID NO: 1828672 - RNA, 15 nt, Human herpesvirus 2
uacacgacccgccuc

SEQ ID NO: 1828673 - RNA, 15 nt, Human herpesvirus 2
uagccccccccccuc

SEQ ID NO: 1828674 - RNA, 13 nt, Human herpesvirus 2
gcgggaggggcgg

SEQ ID NO: 1828675 - RNA, 19 nt, Human herpesvirus 2
auggggggggaaaggaaag

SEQ ID NO: 1828676 - RNA, 18 nt, Human herpesvirus 2
auacuugcgcggcuugcg

SEQ ID NO: 1828677 - RNA, 11 nt, Human herpesvirus 2
gaggggggcag

SEQ ID NO: 1828678 - RNA, 16 nt, Human herpesvirus 2
agaagccuacuacucg

SEQ ID NO: 1828679 - RNA, 18 nt, Human herpesvirus 2
ccaaagucacgcccccug

SEQ ID NO: 1828680 - RNA, 15 nt, Human herpesvirus 2
cggcgcgggcggcgc

SEQ ID NO: 1828681 - RNA, 17 nt, Human herpesvirus 2
ucggagaggcccgccgc

SEQ ID NO: 1828682 - RNA, 12 nt, Human herpesvirus 2
gggcgggagggg

SEQ ID NO: 1828683 - RNA, 15 nt, Human herpesvirus 2
acguguccccaggga

SEQ ID NO: 1828684 - RNA, 22 nt, Human herpesvirus 2
cugcacgucggacgccagcugc

SEQ ID NO: 1828685 - RNA, 17 nt, Human herpesvirus 2
cgcaggccgcccccagc

SEQ ID NO: 1828686 - RNA, 16 nt, Human herpesvirus 2
auggccgcuccugccc

SEQ ID NO: 1828687 - RNA, 16 nt, Human herpesvirus 2
cacgucggacgccagc

SEQ ID NO: 1828688 - RNA, 22 nt, Human herpesvirus 2
cucuccgcaauaaacgccuucc

SEQ ID NO: 1828689 - RNA, 16 nt, Human herpesvirus 2
ccuugcggaugugggc

SEQ ID NO: 1828690 - RNA, 13 nt, Human herpesvirus 2
accaccaaggccc

SEQ ID NO: 1828691 - RNA, 17 nt, Human herpesvirus 2
gcccucgcugcucuccc

SEQ ID NO: 1828692 - RNA, 13 nt, Human herpesvirus 2
agggucggacagg

SEQ ID NO: 1828693 - RNA, 21 nt, Human herpesvirus 2
uccccggcgccaugagccgcc

SEQ ID NO: 1828694 - RNA, 21 nt, Human herpesvirus 2
cugugccagguggcccuuccg

SEQ ID NO: 1828695 - RNA, 21 nt, Human herpesvirus 2
gagcucggcuugauggagccu

SEQ ID NO: 1828696 - RNA, 15 nt, Human herpesvirus 2
cagcaaccaggcgcu

SEQ ID NO: 1828697 - RNA, 21 nt, Human herpesvirus 2
ugcgcuuauaagagcgggccc

SEQ ID NO: 1828698 - RNA, 18 nt, Human herpesvirus 2
agaauucccagggcacca

SEQ ID NO: 1828699 - RNA, 18 nt, Human herpesvirus 2
ugcgcgcuggucgugggg

SEQ ID NO: 1828700 - RNA, 18 nt, Human herpesvirus 2
cgcccagacccucacaga

SEQ ID NO: 1828701 - RNA, 15 nt, Human herpesvirus 2
cggcgccgccccgcc

SEQ ID NO: 1828702 - RNA, 17 nt, Human herpesvirus 2
gcacccccggaccccgc

SEQ ID NO: 1828703 - RNA, 16 nt, Human herpesvirus 2
caucgccaacucuguc

SEQ ID NO: 1828704 - RNA, 18 nt, Human herpesvirus 2
ugcgacggcgucucccgg

SEQ ID NO: 1828705 - RNA, 21 nt, Human herpesvirus 2
acugggggcggggggugggag

SEQ ID NO: 1828706 - RNA, 20 nt, Human herpesvirus 2
cggggagggcagggccgcug

SEQ ID NO: 1828707 - RNA, 16 nt, Human herpesvirus 2
cgcgacaagacccggc

SEQ ID NO: 1828708 - RNA, 16 nt, Human herpesvirus 2
cgggggucgggcgggc

SEQ ID NO: 1828709 - RNA, 17 nt, Human herpesvirus 2
gugcgcaugggccgcca

SEQ ID NO: 1828710 - RNA, 16 nt, Human herpesvirus 2
gaaagaaagagaaaca

SEQ ID NO: 1828711 - RNA, 16 nt, Human herpesvirus 2
ccacguccaccuuggc

SEQ ID NO: 1828712 - RNA, 16 nt, Human herpesvirus 2
cgagcaccgacccccu

SEQ ID NO: 1828713 - RNA, 14 nt, Human herpesvirus 2
gggccgccauuccc

SEQ ID NO: 1828714 - RNA, 15 nt, Human herpesvirus 2
gcgacgccaggcccc

SEQ ID NO: 1828715 - RNA, 16 nt, Human herpesvirus 2
gcccccauccccuccc

SEQ ID NO: 1828716 - RNA, 23 nt, Human herpesvirus 2
ggaggcccucugggacacccaga

SEQ ID NO: 1828717 - RNA, 12 nt, Human herpesvirus 2
uaagacagacgc

SEQ ID NO: 1828718 - RNA, 21 nt, Human herpesvirus 2
cuccccgaaagccaccaauac

SEQ ID NO: 1828719 - RNA, 19 nt, Human herpesvirus 2
uaugcguguguuggauccc

SEQ ID NO: 1828720 - RNA, 15 nt, Human herpesvirus 2
caugcaaaugggauu

SEQ ID NO: 1828721 - RNA, 20 nt, Human herpesvirus 2
ccuccggagaacccccugcc

SEQ ID NO: 1828722 - RNA, 21 nt, Human herpesvirus 2
cacccuagccuucggccaccu

SEQ ID NO: 1828723 - RNA, 20 nt, Human herpesvirus 2
gcugcugagcccugccccgc

SEQ ID NO: 1828724 - RNA, 12 nt, Human herpesvirus 2
cguccgacaccc

SEQ ID NO: 1828725 - RNA, 23 nt, Human herpesvirus 2
caccggccuggucguccgcggcc

SEQ ID NO: 1828726 - RNA, 15 nt, Human herpesvirus 2
gagccgcggccccgc

SEQ ID NO: 1828727 - RNA, 22 nt, Human herpesvirus 2
gccugccccgcggaggcguggu

SEQ ID NO: 1828728 - RNA, 12 nt, Human herpesvirus 2
uccgcccgcccc

SEQ ID NO: 1828729 - RNA, 17 nt, Human herpesvirus 2
ccaccuggaagcugccu

SEQ ID NO: 1828730 - RNA, 17 nt, Human herpesvirus 2
cccgccgacgccucguc

SEQ ID NO: 1828731 - RNA, 19 nt, Human herpesvirus 2
ccggccgcgacaagacccg

SEQ ID NO: 1828732 - RNA, 17 nt, Human herpesvirus 2
cggcggccccggcggcc

SEQ ID NO: 1828733 - RNA, 23 nt, Human herpesvirus 2
cuuuccuuaaaaggcaccccauc

SEQ ID NO: 1828734 - RNA, 16 nt, Human herpesvirus 2
gcgcuccgaucggggu

SEQ ID NO: 1828735 - RNA, 15 nt, Human herpesvirus 2
cgcgcaucacggccc

SEQ ID NO: 1828736 - RNA, 23 nt, Human herpesvirus 2
ccugggggacccgacccuguggc

SEQ ID NO: 1828737 - RNA, 21 nt, Human herpesvirus 2
cgaaccuguuuuuacgggccc

SEQ ID NO: 1828738 - RNA, 15 nt, Human herpesvirus 2
gccgccggccacgcc

SEQ ID NO: 1828739 - RNA, 23 nt, Human herpesvirus 2
gggagcuucauuuugugggggcc

SEQ ID NO: 1828740 - RNA, 13 nt, Human herpesvirus 2
ucaauagauuucc

SEQ ID NO: 1828741 - RNA, 17 nt, Human herpesvirus 2
gaccgccugccccgcgg

SEQ ID NO: 1828742 - RNA, 18 nt, Human herpesvirus 2
aaccacccaaccaacgga

SEQ ID NO: 1828743 - RNA, 17 nt, Human herpesvirus 2
gacgucggcggacacgc

SEQ ID NO: 1828744 - RNA, 17 nt, Human herpesvirus 2
cgccgcgggggaggcgc

SEQ ID NO: 1828745 - RNA, 13 nt, Human herpesvirus 2
cagccgcgccgcu

SEQ ID NO: 1828746 - RNA, 13 nt, Human herpesvirus 2
gccacucccgcgg

SEQ ID NO: 1828747 - RNA, 18 nt, Human herpesvirus 2
gccguggggccccagggc

SEQ ID NO: 1828748 - RNA, 18 nt, Human herpesvirus 2
agcgccgcuacugcgcca

SEQ ID NO: 1828749 - RNA, 20 nt, Human herpesvirus 2
cuagccccccccccucaccc

SEQ ID NO: 1828750 - RNA, 21 nt, Human herpesvirus 2
gugucuucccgggaaaccaca

SEQ ID NO: 1828751 - RNA, 22 nt, Human herpesvirus 2
acggugcgugcggcccugccuc

SEQ ID NO: 1828752 - RNA, 22 nt, Human herpesvirus 2
gccaggaccgccugccccgcgg

SEQ ID NO: 1828753 - RNA, 22 nt, Human herpesvirus 2
uacgagucugugcggcccucuc

SEQ ID NO: 1828754 - RNA, 21 nt, Human herpesvirus 2
cggcucccccgcggccuuucc

SEQ ID NO: 1828755 - RNA, 13 nt, Human herpesvirus 2
ccguggggcccca

SEQ ID NO: 1828756 - RNA, 20 nt, Human herpesvirus 2
uuggaggcccucugggacac

SEQ ID NO: 1828757 - RNA, 15 nt, Human herpesvirus 2
ggucccgauggccgc

SEQ ID NO: 1828758 - RNA, 22 nt, Human herpesvirus 2
uccgggggccugguggcaccuc

SEQ ID NO: 1828759 - RNA, 14 nt, Human herpesvirus 2
ccgaagcggccccg

SEQ ID NO: 1828760 - RNA, 16 nt, Human herpesvirus 2
cugccucccccccgga

SEQ ID NO: 1828761 - RNA, 18 nt, Human herpesvirus 2
ggggcaccggcaccggga

SEQ ID NO: 1828762 - RNA, 12 nt, Human herpesvirus 2
ucccgcaagagc

SEQ ID NO: 1828763 - RNA, 14 nt, Human herpesvirus 2
cggaggggcuccuc

SEQ ID NO: 1828764 - RNA, 14 nt, Human herpesvirus 2
cucccgccuccggc

SEQ ID NO: 1828765 - RNA, 14 nt, Human herpesvirus 2
cggcacccccggcg

SEQ ID NO: 1828766 - RNA, 23 nt, Human herpesvirus 2
uggguguggucguggugcuggcc

SEQ ID NO: 1828767 - RNA, 17 nt, Human herpesvirus 2
ucaccgagccgcugugc

SEQ ID NO: 1828768 - RNA, 16 nt, Human herpesvirus 2
gcggggcauggacccc

SEQ ID NO: 1828769 - RNA, 13 nt, Human herpesvirus 2
ucgcgucacagaa

SEQ ID NO: 1828770 - RNA, 18 nt, Human herpesvirus 2
gcggacgcacgcggggac

SEQ ID NO: 1828771 - RNA, 21 nt, Human herpesvirus 2
gaugggggggaagggaggagg

SEQ ID NO: 1828772 - RNA, 22 nt, Human herpesvirus 2
cuggugacggaaaaccugggcg

SEQ ID NO: 1828773 - RNA, 16 nt, Human herpesvirus 2
cgucacccccaggggg

SEQ ID NO: 1828774 - RNA, 22 nt, Human herpesvirus 2
cggccaccccgccgcagcucau

SEQ ID NO: 1828775 - RNA, 13 nt, Human herpesvirus 2
ccaguuccuccgu

SEQ ID NO: 1828776 - RNA, 19 nt, Human herpesvirus 2
gcccggcccauaaacaggc

SEQ ID NO: 1828777 - RNA, 13 nt, Human herpesvirus 2
gucccgacgcccg

SEQ ID NO: 1828778 - RNA, 21 nt, Human herpesvirus 2
ggcuccuagccccccccccuc

SEQ ID NO: 1828779 - RNA, 18 nt, Human herpesvirus 2
cgucuccggucccuuccc

SEQ ID NO: 1828780 - RNA, 20 nt, Human herpesvirus 2
ccaggcgacgccaggccccc

SEQ ID NO: 1828781 - RNA, 18 nt, Human herpesvirus 2
cacugccccccuccuggg

SEQ ID NO: 1828782 - RNA, 12 nt, Human herpesvirus 2
ucuuuuugccuc

SEQ ID NO: 1828783 - RNA, 19 nt, Human herpesvirus 2
gaggauguguucuccugga

SEQ ID NO: 1828784 - RNA, 12 nt, Human herpesvirus 2
caucgccgggga

SEQ ID NO: 1828785 - RNA, 22 nt, Human herpesvirus 2
acacccccuguccccgcccccc

SEQ ID NO: 1828786 - RNA, 21 nt, Human herpesvirus 2
ccccgcgcacgcgcgacugcc

SEQ ID NO: 1828787 - RNA, 23 nt, Human herpesvirus 2
cccaggaggggggcagugcagua

SEQ ID NO: 1828788 - RNA, 21 nt, Human herpesvirus 2
gugcgcucgcucuccgugccc

SEQ ID NO: 1828789 - RNA, 22 nt, Human herpesvirus 2
ugggccugugggucugcgccac

SEQ ID NO: 1828790 - RNA, 19 nt, Human herpesvirus 2
gcgguauggcugcccccgc

SEQ ID NO: 1828791 - RNA, 22 nt, Human herpesvirus 2
uguacccucucaacgcccaggc

SEQ ID NO: 1828792 - RNA, 14 nt, Human herpesvirus 2
gcuugaagggcacu

SEQ ID NO: 1828793 - RNA, 17 nt, Human herpesvirus 2
ugcaguaccccaguucc

SEQ ID NO: 1828794 - RNA, 15 nt, Human herpesvirus 2
cgcuggugggacgcc

SEQ ID NO: 1828795 - RNA, 17 nt, Human herpesvirus 2
cagcgccggguggcgcc

SEQ ID NO: 1828796 - RNA, 12 nt, Human herpesvirus 2
aggagggcgggc

SEQ ID NO: 1828797 - RNA, 20 nt, Human herpesvirus 2
cugcacuugcccccccccgg

SEQ ID NO: 1828798 - RNA, 20 nt, Human herpesvirus 2
ggaaacgcaaaaaaaacaag

SEQ ID NO: 1828799 - RNA, 12 nt, Human herpesvirus 2
ccgaccagaacc

SEQ ID NO: 1828800 - RNA, 21 nt, Human herpesvirus 2
aagcgccgcgcgggacccacg

SEQ ID NO: 1828801 - RNA, 17 nt, Human herpesvirus 2
ccccagggagccccggg

SEQ ID NO: 1828802 - RNA, 14 nt, Human herpesvirus 2
cuggaggcaaacac

SEQ ID NO: 1828803 - RNA, 17 nt, Human herpesvirus 2
ggacgagccaaaccagc

SEQ ID NO: 1828804 - RNA, 12 nt, Human herpesvirus 2
aucauuucuguc

SEQ ID NO: 1828805 - RNA, 16 nt, Human herpesvirus 2
ccgucuuugggccccg

SEQ ID NO: 1828806 - RNA, 16 nt, Human herpesvirus 2
ggucgugggggcgcug

SEQ ID NO: 1828807 - RNA, 15 nt, Human herpesvirus 2
gcuggcccuggaccc

SEQ ID NO: 1828808 - RNA, 11 nt, Human herpesvirus 2
gcgggccccgu

SEQ ID NO: 1828809 - RNA, 14 nt, Human herpesvirus 2
ccgcaggcgcgcca

SEQ ID NO: 1828810 - RNA, 22 nt, Human herpesvirus 2
agacggccaugaccucgccccc

SEQ ID NO: 1828811 - RNA, 23 nt, Human herpesvirus 2
ucgagguggcggaggggaucagc

SEQ ID NO: 1828812 - RNA, 20 nt, Human herpesvirus 2
gaaagacaugauagagggaa

SEQ ID NO: 1828813 - RNA, 22 nt, Human herpesvirus 2
cugcgcagguccgagacggcca

SEQ ID NO: 1828814 - RNA, 22 nt, Human herpesvirus 2
ccgugcuggggaaaucucucug

SEQ ID NO: 1828815 - RNA, 21 nt, Human herpesvirus 2
cacgaggucgucgugggccgg

SEQ ID NO: 1828816 - RNA, 22 nt, Human herpesvirus 2
cgucacgcccgucaggcgcgcg

SEQ ID NO: 1828817 - RNA, 15 nt, Human herpesvirus 2
cccgcgcaggggggc

SEQ ID NO: 1828818 - RNA, 19 nt, Human herpesvirus 2
gcgaggggcgggaggggcg

SEQ ID NO: 1828819 - RNA, 16 nt, Human herpesvirus 2
cgagugcucgcagcag

SEQ ID NO: 1828820 - RNA, 19 nt, Human herpesvirus 2
gcggaccccgcccgcgacc

SEQ ID NO: 1828821 - RNA, 14 nt, Human herpesvirus 2
gcuaccucacccca

SEQ ID NO: 1828822 - RNA, 22 nt, Human herpesvirus 2
gccgacuuccgugccccuggac

SEQ ID NO: 1828823 - RNA, 13 nt, Human herpesvirus 2
uccgaccugcagg

SEQ ID NO: 1828824 - RNA, 19 nt, Human herpesvirus 2
ggagguggucggcggccaa

SEQ ID NO: 1828825 - RNA, 14 nt, Human herpesvirus 2
gagccgcugugcca

SEQ ID NO: 1828826 - RNA, 17 nt, Human herpesvirus 2
ccgaaggaggaaagugg

SEQ ID NO: 1828827 - RNA, 22 nt, Human herpesvirus 2
gauggggacgacgggcgccccc

SEQ ID NO: 1828828 - RNA, 16 nt, Human herpesvirus 2
gccauggcggccgcgc

SEQ ID NO: 1828829 - RNA, 14 nt, Human herpesvirus 2
gggggcaggcgggc

SEQ ID NO: 1828830 - RNA, 17 nt, Human herpesvirus 2
gcugcccgcggaccacc

SEQ ID NO: 1828831 - RNA, 23 nt, Human herpesvirus 2
aacaccguccccgagagccugau

SEQ ID NO: 1828832 - RNA, 20 nt, Human herpesvirus 2
ggcgauguccggggcgguga

SEQ ID NO: 1828833 - RNA, 14 nt, Human herpesvirus 2
aaagaacguggugu

SEQ ID NO: 1828834 - RNA, 21 nt, Human herpesvirus 2
acgucgguuuauuaaaacgaa

SEQ ID NO: 1828835 - RNA, 17 nt, Human herpesvirus 2
caagaccugccccggcg

SEQ ID NO: 1828836 - RNA, 22 nt, Human herpesvirus 2
cacggccgugucgcuaaacagg

SEQ ID NO: 1828837 - RNA, 20 nt, Human herpesvirus 2
gccgagcguaucggccagga

SEQ ID NO: 1828838 - RNA, 16 nt, Human herpesvirus 2
cccgccccgccccacc

SEQ ID NO: 1828839 - RNA, 16 nt, Human herpesvirus 2
ucgcgucuccacaaaa

SEQ ID NO: 1828840 - RNA, 23 nt, Human herpesvirus 2
ggggagcuucauuuugugggggc

SEQ ID NO: 1828841 - RNA, 16 nt, Human herpesvirus 2
cgccgcuacugcgcca

SEQ ID NO: 1828842 - RNA, 19 nt, Human herpesvirus 2
cccggguuaccgguacgcc

SEQ ID NO: 1828843 - RNA, 22 nt, Human herpesvirus 2
cggccagcgggggcccgggguu

SEQ ID NO: 1828844 - RNA, 15 nt, Human herpesvirus 2
gcagcgcgggcgacg

SEQ ID NO: 1828845 - RNA, 15 nt, Human herpesvirus 2
agagcgccgucgggc

SEQ ID NO: 1828846 - RNA, 20 nt, Human herpesvirus 2
gugucugguuuuucuggggg

SEQ ID NO: 1828847 - RNA, 12 nt, Human herpesvirus 2
gcgcgcuugcac

SEQ ID NO: 1828848 - RNA, 20 nt, Human herpesvirus 2
ccgaggcgccucgggggcag

SEQ ID NO: 1828849 - RNA, 20 nt, Human herpesvirus 2
gcgcacccuggccguccggg

SEQ ID NO: 1828850 - RNA, 17 nt, Human herpesvirus 2
gggggcaagugcaguaa

SEQ ID NO: 1828851 - RNA, 21 nt, Human herpesvirus 2
gcaagagccugccgucgcacg

SEQ ID NO: 1828852 - RNA, 17 nt, Human herpesvirus 2
agcgccagacgggccgg

SEQ ID NO: 1828853 - RNA, 16 nt, Human herpesvirus 2
auugggauaucucaca

SEQ ID NO: 1828854 - RNA, 15 nt, Human herpesvirus 2
gcgcgccaccgcccg

SEQ ID NO: 1828855 - RNA, 13 nt, Human herpesvirus 2
ccgacccuguggc

SEQ ID NO: 1828856 - RNA, 16 nt, Human herpesvirus 2
ugcgccguccucgugg

SEQ ID NO: 1828857 - RNA, 14 nt, Human herpesvirus 2
ugccugacccucuc

SEQ ID NO: 1828858 - RNA, 15 nt, Human herpesvirus 2
ugcgcucgcucuccg

SEQ ID NO: 1828859 - RNA, 16 nt, Human herpesvirus 2
ucgcccuagaggcugu

SEQ ID NO: 1828860 - RNA, 15 nt, Human herpesvirus 2
cgcggaguaugaccg

SEQ ID NO: 1828861 - RNA, 17 nt, Human herpesvirus 2
aucccgaagccaucuga

SEQ ID NO: 1828862 - RNA, 23 nt, Human herpesvirus 2
gggcaagugcaguaacccaguuc

SEQ ID NO: 1828863 - RNA, 14 nt, Human herpesvirus 2
auggcggccgccgc

SEQ ID NO: 1828864 - RNA, 14 nt, Human herpesvirus 2
cgccaggccccccg

SEQ ID NO: 1828865 - RNA, 16 nt, Human herpesvirus 2
caggcgacccgccgcc

SEQ ID NO: 1828866 - RNA, 13 nt, Human herpesvirus 2
ccggcggcgggga

SEQ ID NO: 1828867 - RNA, 17 nt, Human herpesvirus 2
ccacagcacggccgggu

SEQ ID NO: 1828868 - RNA, 23 nt, Human herpesvirus 2
accgccucuguuccuuucccuuc

SEQ ID NO: 1828869 - RNA, 18 nt, Human herpesvirus 2
cccggcgaccgccccgcg

SEQ ID NO: 1828870 - RNA, 16 nt, Human herpesvirus 2
cucccccgcuucuggc

SEQ ID NO: 1828871 - RNA, 22 nt, Human herpesvirus 2
cgcaggaacguguugaccugcu

SEQ ID NO: 1828872 - RNA, 16 nt, Human herpesvirus 2
cgcgugcggccagccg

SEQ ID NO: 1828873 - RNA, 14 nt, Human herpesvirus 2
cgaccgggcggugc

SEQ ID NO: 1828874 - RNA, 17 nt, Human herpesvirus 2
cggccaccccgccgcag

SEQ ID NO: 1828875 - RNA, 14 nt, Human herpesvirus 2
cucuucuuccccca

SEQ ID NO: 1828876 - RNA, 19 nt, Human herpesvirus 2
cacccuagccuucggccac

SEQ ID NO: 1828877 - RNA, 15 nt, Human herpesvirus 2
auuccagcagcuucc

SEQ ID NO: 1828878 - RNA, 12 nt, Human herpesvirus 2
aggguggggcug

SEQ ID NO: 1828879 - RNA, 14 nt, Human herpesvirus 2
aggucaauagauuu

SEQ ID NO: 1828880 - RNA, 20 nt, Human herpesvirus 2
cuccuuuuuucuuuuucucu

SEQ ID NO: 1828881 - RNA, 11 nt, Human herpesvirus 2
gggcccggacu

SEQ ID NO: 1828882 - RNA, 18 nt, Human herpesvirus 2
gcuguauucccuugcccg

SEQ ID NO: 1828883 - RNA, 21 nt, Human herpesvirus 2
ggggcugcgggcgugucgucc

SEQ ID NO: 1828884 - RNA, 12 nt, Human herpesvirus 2
gguacugcacug

SEQ ID NO: 1828885 - RNA, 18 nt, Human herpesvirus 2
aggggcgggaggaaggac

SEQ ID NO: 1828886 - RNA, 20 nt, Human herpesvirus 2
ggccgagcguaucggccagg

SEQ ID NO: 1828887 - RNA, 16 nt, Human herpesvirus 2
ggcucgcggggccggg

SEQ ID NO: 1828888 - RNA, 18 nt, Human herpesvirus 2
cgggcgucugugcgccuu

SEQ ID NO: 1828889 - RNA, 22 nt, Human herpesvirus 2
gcgggaccccgacguggcccgc

SEQ ID NO: 1828890 - RNA, 16 nt, Human herpesvirus 2
gcgcgccgccgcgcgg

SEQ ID NO: 1828891 - RNA, 16 nt, Human herpesvirus 2
cgcccgccgcccucga

SEQ ID NO: 1828892 - RNA, 22 nt, Human herpesvirus 2
gaccggcggggcccccgaccga

SEQ ID NO: 1828893 - RNA, 17 nt, Human herpesvirus 2
gagacccugccccccgg

SEQ ID NO: 1828894 - RNA, 11 nt, Human herpesvirus 2
guuuggggcau

SEQ ID NO: 1828895 - RNA, 16 nt, Human herpesvirus 2
ccgguacgccgcggcc

SEQ ID NO: 1828896 - RNA, 21 nt, Human herpesvirus 2
cggggcuuggacgcgccuccc

SEQ ID NO: 1828897 - RNA, 12 nt, Human herpesvirus 2
acaccagggcau

SEQ ID NO: 1828898 - RNA, 16 nt, Human herpesvirus 2
ccucugggacacccag

SEQ ID NO: 1828899 - RNA, 20 nt, Human herpesvirus 2
ccgaacggaaggccucccgg

SEQ ID NO: 1828900 - RNA, 14 nt, Human herpesvirus 2
cguggacgcccccu

SEQ ID NO: 1828901 - RNA, 19 nt, Human herpesvirus 2
cuuuccacacccccucccc

SEQ ID NO: 1828902 - RNA, 18 nt, Human herpesvirus 2
gcaggagggcgggccacg

SEQ ID NO: 1828903 - RNA, 14 nt, Human herpesvirus 2
ugcacgaaaaagag

SEQ ID NO: 1828904 - RNA, 17 nt, Human herpesvirus 2
gugcugcugagcccugc

SEQ ID NO: 1828905 - RNA, 16 nt, Human herpesvirus 2
ucgccaucgugcgcuc

SEQ ID NO: 1828906 - RNA, 17 nt, Human herpesvirus 2
ugcaguaacccaguucc

SEQ ID NO: 1828907 - RNA, 13 nt, Human herpesvirus 2
acagcaacacaca

SEQ ID NO: 1828908 - RNA, 18 nt, Human herpesvirus 2
aucgaguccgaagaagag

SEQ ID NO: 1828909 - RNA, 13 nt, Human herpesvirus 2
cuguggcgggcgc

SEQ ID NO: 1828910 - RNA, 14 nt, Human herpesvirus 2
aauuuuugugucau

SEQ ID NO: 1828911 - RNA, 18 nt, Human herpesvirus 2
gucgggcgugggggaaga

SEQ ID NO: 1828912 - RNA, 14 nt, Human herpesvirus 2
cucuggcuccaggc

SEQ ID NO: 1828913 - RNA, 15 nt, Human herpesvirus 2
ccgaagcggccccga

SEQ ID NO: 1828914 - RNA, 16 nt, Human herpesvirus 2
cgccgagcgucaggcc

SEQ ID NO: 1828915 - RNA, 22 nt, Human herpesvirus 2
acguacguucugccccgcgucg

SEQ ID NO: 1828916 - RNA, 23 nt, Human herpesvirus 2
cccccgaacagccccuggggcug

SEQ ID NO: 1828917 - RNA, 18 nt, Human herpesvirus 2
ugggcgcgagccaggcaa

SEQ ID NO: 1828918 - RNA, 18 nt, Human herpesvirus 2
aauguggggccccggccc

SEQ ID NO: 1828919 - RNA, 20 nt, Human herpesvirus 2
gcaaccaaaucacccccaga

SEQ ID NO: 1828920 - RNA, 15 nt, Human herpesvirus 2
cggcgaacacugccu

SEQ ID NO: 1828921 - RNA, 13 nt, Human herpesvirus 2
cgguggggccggc

SEQ ID NO: 1828922 - RNA, 17 nt, Human herpesvirus 2
cagcucgggggccagga

SEQ ID NO: 1828923 - RNA, 15 nt, Human herpesvirus 2
uacgugugcccgccc

SEQ ID NO: 1828924 - RNA, 22 nt, Human herpesvirus 2
cggcccugagccgcgcggccac

SEQ ID NO: 1828925 - RNA, 13 nt, Human herpesvirus 2
uguugucugucug

SEQ ID NO: 1828926 - RNA, 18 nt, Human herpesvirus 2
cggggcacgcggucagca

SEQ ID NO: 1828927 - RNA, 12 nt, Human herpesvirus 2
gaccaccgggcc

SEQ ID NO: 1828928 - RNA, 15 nt, Human herpesvirus 2
agcgcguccagguac

SEQ ID NO: 1828929 - RNA, 14 nt, Human herpesvirus 2
caccccccuccccu

SEQ ID NO: 1828930 - RNA, 22 nt, Human herpesvirus 2
ggugcccaucuacguggccggg

SEQ ID NO: 1828931 - RNA, 16 nt, Human herpesvirus 2
ccggggaaacaggcac

SEQ ID NO: 1828932 - RNA, 15 nt, Human herpesvirus 2
acggccccucgcucc

SEQ ID NO: 1828933 - RNA, 22 nt, Human herpesvirus 2
uaaggagucgccgccccgacuc

SEQ ID NO: 1828934 - RNA, 19 nt, Human herpesvirus 2
ucgagcguggccggcgacc

SEQ ID NO: 1828935 - RNA, 20 nt, Human herpesvirus 2
ccgggggccugguggcaccu

SEQ ID NO: 1828936 - RNA, 20 nt, Human herpesvirus 2
gccuugcggaugugggccgu

SEQ ID NO: 1828937 - RNA, 21 nt, Human herpesvirus 2
cguccggcuggcggcgcggca

SEQ ID NO: 1828938 - RNA, 19 nt, Human herpesvirus 2
gcgguucgcgugcggccag

SEQ ID NO: 1828939 - RNA, 15 nt, Human herpesvirus 2
ccgaccgggcggugc

SEQ ID NO: 1828940 - RNA, 21 nt, Human herpesvirus 2
cacccccgaguucccccggga

SEQ ID NO: 1828941 - RNA, 18 nt, Human herpesvirus 2
caauggccgcuccugccc

SEQ ID NO: 1828942 - RNA, 23 nt, Human herpesvirus 2
cugcgcacgacagaccuccccgu

SEQ ID NO: 1828943 - RNA, 21 nt, Human herpesvirus 2
cgccgcuacugcgccaccguc

SEQ ID NO: 1828944 - RNA, 10 nt, Human herpesvirus 2
cggagaccca

SEQ ID NO: 1828945 - RNA, 12 nt, Human herpesvirus 2
caauaaagccag

SEQ ID NO: 1828946 - RNA, 18 nt, Human herpesvirus 2
cgucugucgccucucccu

SEQ ID NO: 1828947 - RNA, 19 nt, Human herpesvirus 2
auaaccgcccgcagcugcu

SEQ ID NO: 1828948 - RNA, 18 nt, Human herpesvirus 2
cggcacaccggcggggcg

SEQ ID NO: 1828949 - RNA, 17 nt, Human herpesvirus 2
gcuguauucccuugccc

SEQ ID NO: 1828950 - RNA, 14 nt, Human herpesvirus 2
cgccggucucccuc

SEQ ID NO: 1828951 - RNA, 16 nt, Human herpesvirus 2
gccccgcggaccccgc

SEQ ID NO: 1828952 - RNA, 22 nt, Human herpesvirus 2
cgggaggggcuuggccuucccg

SEQ ID NO: 1828953 - RNA, 13 nt, Human herpesvirus 2
gggggaggcgcgc

SEQ ID NO: 1828954 - RNA, 24 nt, Human herpesvirus 2
ugaggaacuggguuacugcacuug

SEQ ID NO: 1828955 - RNA, 14 nt, Human herpesvirus 2
ggcccacccccaaa

SEQ ID NO: 1828956 - RNA, 13 nt, Human herpesvirus 2
gggugucgaccgc

SEQ ID NO: 1828957 - RNA, 19 nt, Human herpesvirus 2
uucgugugcuuguguuuuu

SEQ ID NO: 1828958 - RNA, 18 nt, Human herpesvirus 2
caaccaggcgcugcugcg

SEQ ID NO: 1828959 - RNA, 22 nt, Human herpesvirus 2
ucaccgguguucggaaccaguu

SEQ ID NO: 1828960 - RNA, 21 nt, Human herpesvirus 2
gugcgcuuauaagagcgggcc

SEQ ID NO: 1828961 - RNA, 17 nt, Human herpesvirus 2
gucugguuuuucugggg

SEQ ID NO: 1828962 - RNA, 13 nt, Human herpesvirus 2
gcgcgucggugcc

SEQ ID NO: 1828963 - RNA, 17 nt, Human herpesvirus 2
ucaucgucgccgacucc

SEQ ID NO: 1828964 - RNA, 13 nt, Human herpesvirus 2
cccccaccccauc

SEQ ID NO: 1828965 - RNA, 13 nt, Human herpesvirus 2
cccucaccccacc

SEQ ID NO: 1828966 - RNA, 14 nt, Human herpesvirus 2
cgguaugcguggcc

SEQ ID NO: 1828967 - RNA, 20 nt, Human herpesvirus 2
gccucccgcaagagccugcc

SEQ ID NO: 1828968 - RNA, 19 nt, Human herpesvirus 2
cggcggcucccccgcggcc

SEQ ID NO: 1828969 - RNA, 15 nt, Human herpesvirus 2
ucgggcgucugugcg

SEQ ID NO: 1828970 - RNA, 11 nt, Human herpesvirus 2
auaaacaggcc

SEQ ID NO: 1828971 - RNA, 15 nt, Human herpesvirus 2
gacggcaauaaaaga

SEQ ID NO: 1828972 - RNA, 16 nt, Human herpesvirus 2
gugcccuggguccggg

SEQ ID NO: 1828973 - RNA, 13 nt, Human herpesvirus 2
gagcgcgccagga

SEQ ID NO: 1828974 - RNA, 19 nt, Human herpesvirus 2
accgcgcgccuccucgcgg

SEQ ID NO: 1828975 - RNA, 14 nt, Human herpesvirus 2
uggagcgcuggugg

SEQ ID NO: 1828976 - RNA, 16 nt, Human herpesvirus 2
uacacgcgcuggcccc

SEQ ID NO: 1828977 - RNA, 20 nt, Human herpesvirus 2
gagccccggguuccccgaga

SEQ ID NO: 1828978 - RNA, 19 nt, Human herpesvirus 2
gagggggggaaagaaagag

SEQ ID NO: 1828979 - RNA, 13 nt, Human herpesvirus 2
ggggaaagaaaga

SEQ ID NO: 1828980 - RNA, 12 nt, Human herpesvirus 2
ccuccgcggccg

SEQ ID NO: 1828981 - RNA, 17 nt, Human herpesvirus 2
ugaggggaaagcuggcg

SEQ ID NO: 1828982 - RNA, 11 nt, Human herpesvirus 2
ccucccggccg

SEQ ID NO: 1828983 - RNA, 15 nt, Human herpesvirus 2
cgccgcaacacccgg

SEQ ID NO: 1828984 - RNA, 13 nt, Human herpesvirus 2
gccacaccacccu

SEQ ID NO: 1828985 - RNA, 20 nt, Human herpesvirus 2
gacggccccucgcuccccgc

SEQ ID NO: 1828986 - RNA, 20 nt, Human herpesvirus 2
cuggagccccugggggaccc

SEQ ID NO: 1828987 - RNA, 14 nt, Human herpesvirus 2
ccggggaaacaggc

SEQ ID NO: 1828988 - RNA, 19 nt, Human herpesvirus 2
cggggaugggggggaaggg

SEQ ID NO: 1828989 - RNA, 14 nt, Human herpesvirus 2
gauacaacacaccc

SEQ ID NO: 1828990 - RNA, 22 nt, Human herpesvirus 2
guccgcgggaagcgccgcgcgg

SEQ ID NO: 1828991 - RNA, 19 nt, Human herpesvirus 2
gucugcgccaccggccugg

SEQ ID NO: 1828992 - RNA, 16 nt, Human herpesvirus 2
gcccagcgcacccugg

SEQ ID NO: 1828993 - RNA, 18 nt, Human herpesvirus 2
ccccaggaggggggcagu

SEQ ID NO: 1828994 - RNA, 18 nt, Human herpesvirus 2
gacggcaugcagcccaga

SEQ ID NO: 1828995 - RNA, 17 nt, Human herpesvirus 2
acuuucccccccacucc

SEQ ID NO: 1828996 - RNA, 12 nt, Human herpesvirus 2
uacaaauuaaau

SEQ ID NO: 1828997 - RNA, 23 nt, Human herpesvirus 2
ccgaagagacgaugggagccccg

SEQ ID NO: 1828998 - RNA, 19 nt, Human herpesvirus 2
ucugcccguggguggccac

SEQ ID NO: 1828999 - RNA, 22 nt, Human herpesvirus 2
uuggcaaacacaccgggcuggg

SEQ ID NO: 1829000 - RNA, 15 nt, Human herpesvirus 2
cagcgcacccuggcc

SEQ ID NO: 1829001 - RNA, 16 nt, Human herpesvirus 2
gaccccccgggaggag

SEQ ID NO: 1829002 - RNA, 17 nt, Human herpesvirus 2
cgcugguuucucugcgu

SEQ ID NO: 1829003 - RNA, 13 nt, Human herpesvirus 2
cagaauaaaaggc

SEQ ID NO: 1829004 - RNA, 16 nt, Human herpesvirus 2
gggugcucggggacag

SEQ ID NO: 1829005 - RNA, 23 nt, Human herpesvirus 2
gccaacucugucuucguguggcg

SEQ ID NO: 1829006 - RNA, 16 nt, Human herpesvirus 2
ugaacucucccggcuc

SEQ ID NO: 1829007 - RNA, 18 nt, Human herpesvirus 2
cgcugcgcgcgcaccugc

SEQ ID NO: 1829008 - RNA, 14 nt, Human herpesvirus 2
cgccagcugcuggc

SEQ ID NO: 1829009 - RNA, 19 nt, Human herpesvirus 2
ccguggcgccuggggacua

SEQ ID NO: 1829010 - RNA, 23 nt, Human herpesvirus 2
gccggcgugggugacugggaccg

SEQ ID NO: 1829011 - RNA, 23 nt, Human herpesvirus 2
ggaagccgccccccaccggacca

SEQ ID NO: 1829012 - RNA, 23 nt, Human herpesvirus 2
caguggagccaaaccccccggcc

SEQ ID NO: 1829013 - RNA, 22 nt, Human herpesvirus 2
ggcagcucgcccccgugccugu

SEQ ID NO: 1829014 - RNA, 14 nt, Human herpesvirus 2
gugguuagggggac

SEQ ID NO: 1829015 - RNA, 17 nt, Human herpesvirus 2
cugugcgccuuuaagac

SEQ ID NO: 1829016 - RNA, 15 nt, Human herpesvirus 2
cuauaaacucucccc

SEQ ID NO: 1829017 - RNA, 21 nt, Human herpesvirus 2
uauuuuccccccaccccuucc

SEQ ID NO: 1829018 - RNA, 19 nt, Human herpesvirus 2
gacacaauaacaaacagac

SEQ ID NO: 1829019 - RNA, 13 nt, Human herpesvirus 2
ccucugggcccgu

SEQ ID NO: 1829020 - RNA, 19 nt, Human herpesvirus 2
cacgccguggacgcccccu

SEQ ID NO: 1829021 - RNA, 23 nt, Human herpesvirus 2
uacguggccggguuuuuggcccu

SEQ ID NO: 1829022 - RNA, 16 nt, Human herpesvirus 2
ggcucuucuggucaug

SEQ ID NO: 1829023 - RNA, 14 nt, Human herpesvirus 2
guccgaccugcagg

SEQ ID NO: 1829024 - RNA, 17 nt, Human herpesvirus 2
ucugaucgacgacgccu

SEQ ID NO: 1829025 - RNA, 18 nt, Human herpesvirus 2
gucaccggggcgcccccc

SEQ ID NO: 1829026 - RNA, 16 nt, Human herpesvirus 2
gucgcuccggcucccg

SEQ ID NO: 1829027 - RNA, 16 nt, Human herpesvirus 2
ccgggggucgcacgcc

SEQ ID NO: 1829028 - RNA, 12 nt, Human herpesvirus 2
agagaaaaagaa

SEQ ID NO: 1829029 - RNA, 16 nt, Human herpesvirus 2
cccgugugggagggug

SEQ ID NO: 1829030 - RNA, 19 nt, Human herpesvirus 2
acccgggcgagcuggcccu

SEQ ID NO: 1829031 - RNA, 14 nt, Human herpesvirus 2
ccggccgccauccc

SEQ ID NO: 1829032 - RNA, 19 nt, Human herpesvirus 2
ccucacgguccucaccgag

SEQ ID NO: 1829033 - RNA, 20 nt, Human herpesvirus 2
cacgcaggccgcccccagca

SEQ ID NO: 1829034 - RNA, 18 nt, Human herpesvirus 2
gcacgccgcgugggcucc

SEQ ID NO: 1829035 - RNA, 17 nt, Human herpesvirus 2
cgacgaccaugggcccc

SEQ ID NO: 1829036 - RNA, 18 nt, Human herpesvirus 2
ccgaccucgucgcgcgca

SEQ ID NO: 1829037 - RNA, 17 nt, Human herpesvirus 2
cggccgccgcaacaccc

SEQ ID NO: 1829038 - RNA, 19 nt, Human herpesvirus 2
gaaccgguagccggggcac

SEQ ID NO: 1829039 - RNA, 20 nt, Human herpesvirus 2
gcgguuggaggcgccucugc

SEQ ID NO: 1829040 - RNA, 20 nt, Human herpesvirus 2
gccgucgcacgcgcgcaggc

SEQ ID NO: 1829041 - RNA, 19 nt, Human herpesvirus 2
uccuccguguuagggaagu

SEQ ID NO: 1829042 - RNA, 20 nt, Human herpesvirus 2
cggagcucgacgcacagcgg

SEQ ID NO: 1829043 - RNA, 13 nt, Human herpesvirus 2
cgcaucgccgccg

SEQ ID NO: 1829044 - RNA, 21 nt, Human herpesvirus 2
gcguggucacccgggcgccgg

SEQ ID NO: 1829045 - RNA, 15 nt, Human herpesvirus 2
ccgggucggcugucc

SEQ ID NO: 1829046 - RNA, 15 nt, Human herpesvirus 2
gcaccacgugucccc

SEQ ID NO: 1829047 - RNA, 21 nt, Human herpesvirus 2
ggggcgugccuguuguuuugg

SEQ ID NO: 1829048 - RNA, 18 nt, Human herpesvirus 2
cugggguacugcacugcc

SEQ ID NO: 1829049 - RNA, 13 nt, Human herpesvirus 2
gcaucgggagggg

SEQ ID NO: 1829050 - RNA, 17 nt, Human herpesvirus 2
cggucgcuuuccacacc

SEQ ID NO: 1829051 - RNA, 22 nt, Human herpesvirus 2
caaaagaaacggcaagaaagac

SEQ ID NO: 1829052 - RNA, 19 nt, Human herpesvirus 2
ggccggcguucccgcucgc

SEQ ID NO: 1829053 - RNA, 13 nt, Human herpesvirus 2
ccccgagcagcac

SEQ ID NO: 1829054 - RNA, 23 nt, Human herpesvirus 2
ucgcuccggcucccggcccgggc

SEQ ID NO: 1829055 - RNA, 20 nt, Human herpesvirus 2
cggcgagggcggccucggcc

SEQ ID NO: 1829056 - RNA, 16 nt, Human herpesvirus 2
cagcguaacgcacccc

SEQ ID NO: 1829057 - RNA, 12 nt, Human herpesvirus 2
gccugcacgagc

SEQ ID NO: 1829058 - RNA, 13 nt, Human herpesvirus 2
ucaaacaggccau

SEQ ID NO: 1829059 - RNA, 20 nt, Human herpesvirus 2
ccgugggccuguggggccug

SEQ ID NO: 1829060 - RNA, 21 nt, Human herpesvirus 2
ccagggcaccacgugucccca

SEQ ID NO: 1829061 - RNA, 18 nt, Human herpesvirus 2
gcaagcgggcgggguggg

SEQ ID NO: 1829062 - RNA, 15 nt, Human herpesvirus 2
cguccucacggccaa

SEQ ID NO: 1829063 - RNA, 17 nt, Human herpesvirus 2
ggcaccggggaaacagg

SEQ ID NO: 1829064 - RNA, 22 nt, Human herpesvirus 2
cguguccgcgggaagcgccgcg

SEQ ID NO: 1829065 - RNA, 14 nt, Human herpesvirus 2
gauccugggccugu

SEQ ID NO: 1829066 - RNA, 23 nt, Human herpesvirus 2
gcggcgaaccgguagccggggca

SEQ ID NO: 1829067 - RNA, 16 nt, Human herpesvirus 2
augaugaccugggguc

SEQ ID NO: 1829068 - RNA, 17 nt, Human herpesvirus 2
ggggccaggaacuccag

SEQ ID NO: 1829069 - RNA, 15 nt, Human herpesvirus 2
gcagggggagguggg

SEQ ID NO: 1829070 - RNA, 16 nt, Human herpesvirus 2
cccaggucccccauac

SEQ ID NO: 1829071 - RNA, 17 nt, Human herpesvirus 2
cuuuuaaugggccggcg

SEQ ID NO: 1829072 - RNA, 21 nt, Human herpesvirus 2
ggaagagaaaaagaaaaaagg

SEQ ID NO: 1829073 - RNA, 19 nt, Human herpesvirus 2
auuuuaaauaaacaaacaa

SEQ ID NO: 1829074 - RNA, 18 nt, Human herpesvirus 2
ucaguguuugggaaaucu

SEQ ID NO: 1829075 - RNA, 12 nt, Human herpesvirus 2
gggugggacuug

SEQ ID NO: 1829076 - RNA, 15 nt, Human herpesvirus 2
gucuuugggccccgc

SEQ ID NO: 1829077 - RNA, 19 nt, Human herpesvirus 2
ccccagggagccccggguu

SEQ ID NO: 1829078 - RNA, 14 nt, Human herpesvirus 2
cuucccccccccua

SEQ ID NO: 1829079 - RNA, 23 nt, Human herpesvirus 2
cagggaguccucgccgcuguggc

SEQ ID NO: 1829080 - RNA, 14 nt, Human herpesvirus 2
gcggugcgccccgc

SEQ ID NO: 1829081 - RNA, 19 nt, Human herpesvirus 2
gcacaaacgugcucugcca

SEQ ID NO: 1829082 - RNA, 21 nt, Human herpesvirus 2
ucagcuccucuucgggcaccc

SEQ ID NO: 1829083 - RNA, 17 nt, Human herpesvirus 2
gccucuuugggccgugg

SEQ ID NO: 1829084 - RNA, 21 nt, Human herpesvirus 2
cgggaggauguguucuccugg

SEQ ID NO: 1829085 - RNA, 17 nt, Human herpesvirus 2
cacaggcccaccaccau

SEQ ID NO: 1829086 - RNA, 16 nt, Human herpesvirus 2
cggcgcgagcucccug

SEQ ID NO: 1829087 - RNA, 21 nt, Human herpesvirus 2
cagggagccacucccgcggcc

SEQ ID NO: 1829088 - RNA, 21 nt, Human herpesvirus 2
uggucgggcggacguccaggg

SEQ ID NO: 1829089 - RNA, 15 nt, Human herpesvirus 2
gcgccgucgggcccc

SEQ ID NO: 1829090 - RNA, 15 nt, Human herpesvirus 2
cgcgcaucggacccc

SEQ ID NO: 1829091 - RNA, 22 nt, Human herpesvirus 2
ccggccaaccucauccgcggcg

SEQ ID NO: 1829092 - RNA, 19 nt, Human herpesvirus 2
auuccgagggcagguccca

SEQ ID NO: 1829093 - RNA, 21 nt, Human herpesvirus 2
acaccagacggcgggaccccg

SEQ ID NO: 1829094 - RNA, 19 nt, Human herpesvirus 2
acacagagaaaggccccca

SEQ ID NO: 1829095 - RNA, 23 nt, Human herpesvirus 2
gcgccgucgucgcccgcccgccg

SEQ ID NO: 1829096 - RNA, 21 nt, Human herpesvirus 2
cgcggggucgagcgcgccagg

SEQ ID NO: 1829097 - RNA, 14 nt, Human herpesvirus 2
ccguggggccccag

SEQ ID NO: 1829098 - RNA, 14 nt, Human herpesvirus 2
ccaccgucagccgc

SEQ ID NO: 1829099 - RNA, 16 nt, Human herpesvirus 2
guggcggucggccagc

SEQ ID NO: 1829100 - RNA, 11 nt, Human herpesvirus 2
guuuuucuguu

SEQ ID NO: 1829101 - RNA, 19 nt, Human herpesvirus 2
gcgcuuagggugugacccc

SEQ ID NO: 1829102 - RNA, 18 nt, Human herpesvirus 2
gcacgugcgucuucccag

SEQ ID NO: 1829103 - RNA, 22 nt, Human herpesvirus 2
ccgcucgucccccgaggccccc

SEQ ID NO: 1829104 - RNA, 19 nt, Human herpesvirus 2
gcucgccagcgacccgcac

SEQ ID NO: 1829105 - RNA, 13 nt, Human herpesvirus 2
caccugcgcggcg

SEQ ID NO: 1829106 - RNA, 11 nt, Human herpesvirus 2
ggacgcccccu

SEQ ID NO: 1829107 - RNA, 15 nt, Human herpesvirus 2
ccaccgcucacccac

SEQ ID NO: 1829108 - RNA, 19 nt, Human herpesvirus 2
cgcccaggcccuggcgcac

SEQ ID NO: 1829109 - RNA, 23 nt, Human herpesvirus 2
cagggacgucacgcccgucaggc

SEQ ID NO: 1829110 - RNA, 17 nt, Human herpesvirus 2
gcacccaccggccccgc

SEQ ID NO: 1829111 - RNA, 15 nt, Human herpesvirus 2
cugggucgggagcag

SEQ ID NO: 1829112 - RNA, 15 nt, Human herpesvirus 2
aaagguccggcggcc

SEQ ID NO: 1829113 - RNA, 20 nt, Human herpesvirus 2
uggggacgacgggcgccccc

SEQ ID NO: 1829114 - RNA, 20 nt, Human herpesvirus 2
guuucgggcguuccuucccu

SEQ ID NO: 1829115 - RNA, 19 nt, Human herpesvirus 2
gcagucuggucgagguggc

SEQ ID NO: 1829116 - RNA, 19 nt, Human herpesvirus 2
gcacccauccaucugggag

SEQ ID NO: 1829117 - RNA, 21 nt, Human herpesvirus 2
cguggaugccggggccguggg

SEQ ID NO: 1829118 - RNA, 19 nt, Human herpesvirus 2
ggagggcagggccgcuggg

SEQ ID NO: 1829119 - RNA, 18 nt, Human herpesvirus 2
accccccuucccccuccu

SEQ ID NO: 1829120 - RNA, 17 nt, Human herpesvirus 2
cuggaggggggugcugu

SEQ ID NO: 1829121 - RNA, 19 nt, Human herpesvirus 2
cccccucccccgcuucugg

SEQ ID NO: 1829122 - RNA, 18 nt, Human herpesvirus 2
gcgcuucaucgucgccga

SEQ ID NO: 1829123 - RNA, 17 nt, Human herpesvirus 2
ccacggaccuccgggac

SEQ ID NO: 1829124 - RNA, 14 nt, Human herpesvirus 2
cacccccagagggg

SEQ ID NO: 1829125 - RNA, 14 nt, Human herpesvirus 2
caagcccacaaccc

SEQ ID NO: 1829126 - RNA, 18 nt, Human herpesvirus 2
cuccugcgagcccucacg

SEQ ID NO: 1829127 - RNA, 16 nt, Human herpesvirus 2
ccagggggcggcgccg

SEQ ID NO: 1829128 - RNA, 13 nt, Human herpesvirus 2
ggacagccagggc

SEQ ID NO: 1829129 - RNA, 23 nt, Human herpesvirus 2
gccaggagguccuggaggggggu

SEQ ID NO: 1829130 - RNA, 15 nt, Human herpesvirus 2
cccuggacugggccg

SEQ ID NO: 1829131 - RNA, 16 nt, Human herpesvirus 2
cgcuuuauaggacgcg

SEQ ID NO: 1829132 - RNA, 16 nt, Human herpesvirus 2
ccccucccccgcuucu

SEQ ID NO: 1829133 - RNA, 15 nt, Human herpesvirus 2
gacuagaaaaacaaa

SEQ ID NO: 1829134 - RNA, 17 nt, Human herpesvirus 2
gccccccgacgugcgcg

SEQ ID NO: 1829135 - RNA, 15 nt, Human herpesvirus 2
auacaaauuaaauac

SEQ ID NO: 1829136 - RNA, 18 nt, Human herpesvirus 2
gccagauggggccccggu

SEQ ID NO: 1829137 - RNA, 16 nt, Human herpesvirus 2
cgagccgcugugccag

SEQ ID NO: 1829138 - RNA, 23 nt, Human herpesvirus 2
agcucgcggacgagcccguggcc

SEQ ID NO: 1829139 - RNA, 16 nt, Human herpesvirus 2
ucaccgccccagcacc

SEQ ID NO: 1829140 - RNA, 19 nt, Human herpesvirus 2
cgggccgucguuggccagc

SEQ ID NO: 1829141 - RNA, 15 nt, Human herpesvirus 2
gagccgcugugccag

SEQ ID NO: 1829142 - RNA, 16 nt, Human herpesvirus 2
gggggcaagugcagua

SEQ ID NO: 1829143 - RNA, 16 nt, Human herpesvirus 2
uaguccgcgccuccug

SEQ ID NO: 1829144 - RNA, 16 nt, Human herpesvirus 2
gggcauggacccccca

SEQ ID NO: 1829145 - RNA, 20 nt, Human herpesvirus 2
acagcugcgccagaaaccgg

SEQ ID NO: 1829146 - RNA, 15 nt, Human herpesvirus 2
ugcgaugacgugggu

SEQ ID NO: 1829147 - RNA, 21 nt, Human herpesvirus 2
gacuccgccccggcgaccgcc

SEQ ID NO: 1829148 - RNA, 16 nt, Human herpesvirus 2
ugcgcagguccgagac

SEQ ID NO: 1829149 - RNA, 17 nt, Human herpesvirus 2
gcccagcacaggcaggc

SEQ ID NO: 1829150 - RNA, 12 nt, Human herpesvirus 2
ggggcccccgac

SEQ ID NO: 1829151 - RNA, 17 nt, Human herpesvirus 2
auuuaaggagucgccgc

SEQ ID NO: 1829152 - RNA, 19 nt, Human herpesvirus 2
cuccggagaacccccugcc

SEQ ID NO: 1829153 - RNA, 14 nt, Human herpesvirus 2
ggcgccccccccga

SEQ ID NO: 1829154 - RNA, 20 nt, Human herpesvirus 2
ccguggguacggacaccccc

SEQ ID NO: 1829155 - RNA, 20 nt, Human herpesvirus 2
cccacgacauccgcggcuuu

SEQ ID NO: 1829156 - RNA, 23 nt, Human herpesvirus 2
ccccagcuuucccuccacccgcc

SEQ ID NO: 1829157 - RNA, 20 nt, Human herpesvirus 2
ggacgacgaccaugggcccc

SEQ ID NO: 1829158 - RNA, 20 nt, Human herpesvirus 2
ggguuccccgagagcccagg

SEQ ID NO: 1829159 - RNA, 15 nt, Human herpesvirus 2
cgccccgcgccggcu

SEQ ID NO: 1829160 - RNA, 13 nt, Human herpesvirus 2
guuauccugcggc

SEQ ID NO: 1829161 - RNA, 13 nt, Human herpesvirus 2
gcugcccccgcgc

SEQ ID NO: 1829162 - RNA, 16 nt, Human herpesvirus 2
cuccacccgcccgucu

SEQ ID NO: 1829163 - RNA, 18 nt, Human herpesvirus 2
gaggggggcagugcagua

SEQ ID NO: 1829164 - RNA, 13 nt, Human herpesvirus 2
caccccgcccgcu

SEQ ID NO: 1829165 - RNA, 13 nt, Human herpesvirus 2
ccucagcgcggcc

SEQ ID NO: 1829166 - RNA, 19 nt, Human herpesvirus 2
cugcucgcgcaccugcgcg

SEQ ID NO: 1829167 - RNA, 19 nt, Human herpesvirus 2
gccuaucuugaucccccgg

SEQ ID NO: 1829168 - RNA, 14 nt, Human herpesvirus 2
ggaaacgcaaaaaa

SEQ ID NO: 1829169 - RNA, 19 nt, Human herpesvirus 2
gccccagggggcggcgccg

SEQ ID NO: 1829170 - RNA, 18 nt, Human herpesvirus 2
ucggcgauguccggggcg

SEQ ID NO: 1829171 - RNA, 13 nt, Human herpesvirus 2
gcggaccccgccc

SEQ ID NO: 1829172 - RNA, 20 nt, Human herpesvirus 2
gaugauggggacgacgggcg

SEQ ID NO: 1829173 - RNA, 18 nt, Human herpesvirus 2
ggcgccccgaaacgcggg

SEQ ID NO: 1829174 - RNA, 16 nt, Human herpesvirus 2
gaugaccucccggccc

SEQ ID NO: 1829175 - RNA, 20 nt, Human herpesvirus 2
ucccccgggcagccgggccc

SEQ ID NO: 1829176 - RNA, 14 nt, Human herpesvirus 2
ucuuugggccccgc

SEQ ID NO: 1829177 - RNA, 19 nt, Human herpesvirus 2
gagcagcacggcggccaga

SEQ ID NO: 1829178 - RNA, 15 nt, Human herpesvirus 2
ccguguaccucuggg

SEQ ID NO: 1829179 - RNA, 16 nt, Human herpesvirus 2
ccgcagaccaccucgc

SEQ ID NO: 1829180 - RNA, 23 nt, Human herpesvirus 2
cagcggggacccgggcgagcugg

SEQ ID NO: 1829181 - RNA, 16 nt, Human herpesvirus 2
cgugcuuccgcacccc

SEQ ID NO: 1829182 - RNA, 19 nt, Human herpesvirus 2
gaacuccagcuuggccgug

SEQ ID NO: 1829183 - RNA, 18 nt, Human herpesvirus 2
cggugcgugcggcccugc

SEQ ID NO: 1829184 - RNA, 15 nt, Human herpesvirus 2
gcaaccuccggggcu

SEQ ID NO: 1829185 - RNA, 13 nt, Human herpesvirus 2
ugccccgcccccu

SEQ ID NO: 1829186 - RNA, 13 nt, Human herpesvirus 2
cggguggggcgga

SEQ ID NO: 1829187 - RNA, 21 nt, Human herpesvirus 2
gcgcuccgaucggggucaggc

SEQ ID NO: 1829188 - RNA, 15 nt, Human herpesvirus 2
cgacacccgggcccc

SEQ ID NO: 1829189 - RNA, 21 nt, Human herpesvirus 2
cugcacuugcccccccccggg

SEQ ID NO: 1829190 - RNA, 21 nt, Human herpesvirus 2
cccagcgcggacgcggccaga

SEQ ID NO: 1829191 - RNA, 20 nt, Human herpesvirus 2
agcagcuuuuaacgggccgc

SEQ ID NO: 1829192 - RNA, 13 nt, Human herpesvirus 2
ccagccccgcagg

SEQ ID NO: 1829193 - RNA, 18 nt, Human herpesvirus 2
uggcggucgcguccggaa

SEQ ID NO: 1829194 - RNA, 13 nt, Human herpesvirus 2
cucccgcaccccc

SEQ ID NO: 1829195 - RNA, 20 nt, Human herpesvirus 2
cgcccgcguccgacacccgg

SEQ ID NO: 1829196 - RNA, 12 nt, Human herpesvirus 2
ccacccuggguc

SEQ ID NO: 1829197 - RNA, 20 nt, Human herpesvirus 2
cagcuuuuaacgggccgcca

SEQ ID NO: 1829198 - RNA, 22 nt, Human herpesvirus 2
uucccaaacacugaggaacugg

SEQ ID NO: 1829199 - RNA, 23 nt, Human herpesvirus 2
gagcccugccccgcccccucucc

SEQ ID NO: 1829200 - RNA, 12 nt, Human herpesvirus 2
gucguuggccag

SEQ ID NO: 1829201 - RNA, 13 nt, Human herpesvirus 2
gucguagaucggg

SEQ ID NO: 1829202 - RNA, 17 nt, Human herpesvirus 2
cucgucguggcccuccu

SEQ ID NO: 1829203 - RNA, 10 nt, Human herpesvirus 2
gauggggaga

SEQ ID NO: 1829204 - RNA, 14 nt, Human herpesvirus 2
cgcacgcggggacc

SEQ ID NO: 1829205 - RNA, 14 nt, Human herpesvirus 2
gaccggggacuccc

SEQ ID NO: 1829206 - RNA, 19 nt, Human herpesvirus 2
gcgaccccgauaguccccc

SEQ ID NO: 1829207 - RNA, 15 nt, Human herpesvirus 2
ugccagguggcccuu

SEQ ID NO: 1829208 - RNA, 20 nt, Human herpesvirus 2
cucaccgagccgcugugcca

SEQ ID NO: 1829209 - RNA, 18 nt, Human herpesvirus 2
ugccguucggaccugggg

SEQ ID NO: 1829210 - RNA, 17 nt, Human herpesvirus 2
uaaccgcgagcgccgcu

SEQ ID NO: 1829211 - RNA, 16 nt, Human herpesvirus 2
ccaugaccucgccccc

SEQ ID NO: 1829212 - RNA, 13 nt, Human herpesvirus 2
gugcagggccuga

SEQ ID NO: 1829213 - RNA, 14 nt, Human herpesvirus 2
cguuacugaugugu

SEQ ID NO: 1829214 - RNA, 18 nt, Human herpesvirus 2
ggcgcuucaucgucgccg

SEQ ID NO: 1829215 - RNA, 11 nt, Human herpesvirus 2
aucggaccccc

SEQ ID NO: 1829216 - RNA, 17 nt, Human herpesvirus 2
gggccgacgugccgggg

SEQ ID NO: 1829217 - RNA, 16 nt, Human herpesvirus 2
gggggaucucgaacac

SEQ ID NO: 1829218 - RNA, 18 nt, Human herpesvirus 2
ugccccgcccccucuccc

SEQ ID NO: 1829219 - RNA, 19 nt, Human herpesvirus 2
ugcgcgagccguccgggaa

SEQ ID NO: 1829220 - RNA, 16 nt, Human herpesvirus 2
gcgugccuggccgcgc

SEQ ID NO: 1829221 - RNA, 22 nt, Human herpesvirus 2
ccggcggccgcauauacugcug

SEQ ID NO: 1829222 - RNA, 15 nt, Human herpesvirus 2
gaggaggaggagggg

SEQ ID NO: 1829223 - RNA, 16 nt, Human herpesvirus 2
guacuucuacaccucc

SEQ ID NO: 1829224 - RNA, 22 nt, Human herpesvirus 2
cagcauccgaucgaugagccgg

SEQ ID NO: 1829225 - RNA, 18 nt, Human herpesvirus 2
cuggguccgggggccugg

SEQ ID NO: 1829226 - RNA, 15 nt, Human herpesvirus 2
gcccgcccccgacgg

SEQ ID NO: 1829227 - RNA, 22 nt, Human herpesvirus 2
cgugcuuccgcacccccgccua

SEQ ID NO: 1829228 - RNA, 19 nt, Human herpesvirus 2
cggcaagaccugccccggc

SEQ ID NO: 1829229 - RNA, 21 nt, Human herpesvirus 2
cgugugugagaaauaaagaac

SEQ ID NO: 1829230 - RNA, 19 nt, Human herpesvirus 2
gucccccggaccccgaccc

SEQ ID NO: 1829231 - RNA, 13 nt, Human herpesvirus 2
cgacaacagcccc

SEQ ID NO: 1829232 - RNA, 21 nt, Human herpesvirus 2
ggugccguacgucugcccgug

SEQ ID NO: 1829233 - RNA, 23 nt, Human herpesvirus 2
ggcagcgcgccgacgaccugcag

SEQ ID NO: 1829234 - RNA, 15 nt, Human herpesvirus 2
cugcccgcgaccccc

SEQ ID NO: 1829235 - RNA, 22 nt, Human herpesvirus 2
cugucaucguauaccagccgcc

SEQ ID NO: 1829236 - RNA, 15 nt, Human herpesvirus 2
cgacccccgaacagc

SEQ ID NO: 1829237 - RNA, 17 nt, Human herpesvirus 2
aggcggucccggccgcc

SEQ ID NO: 1829238 - RNA, 12 nt, Human herpesvirus 2
ccacacccccuc

SEQ ID NO: 1829239 - RNA, 15 nt, Human herpesvirus 2
acgugcgucuuccca

SEQ ID NO: 1829240 - RNA, 16 nt, Human herpesvirus 2
cggccccucgcucccc

SEQ ID NO: 1829241 - RNA, 18 nt, Human herpesvirus 2
ggucgcguuuucucuguu

SEQ ID NO: 1829242 - RNA, 20 nt, Human herpesvirus 2
gcaccagcucgggggccagg

SEQ ID NO: 1829243 - RNA, 13 nt, Human herpesvirus 2
cggcaacccuccu

SEQ ID NO: 1829244 - RNA, 21 nt, Human herpesvirus 2
ggagaguucaauagauuuccc

SEQ ID NO: 1829245 - RNA, 17 nt, Human herpesvirus 2
cccucuuucccucccuc

SEQ ID NO: 1829246 - RNA, 17 nt, Human herpesvirus 2
gauuuacgagggggcaa

SEQ ID NO: 1829247 - RNA, 20 nt, Human herpesvirus 2
ucuuacccuuuucugcauuu

SEQ ID NO: 1829248 - RNA, 16 nt, Human herpesvirus 2
ccaugcaacgccgggc

SEQ ID NO: 1829249 - RNA, 15 nt, Human herpesvirus 2
aacgagcgugugguu

SEQ ID NO: 1829250 - RNA, 22 nt, Human herpesvirus 2
cgcggaguaugaccgucggugc

SEQ ID NO: 1829251 - RNA, 22 nt, Human herpesvirus 2
guaccggcgcgcaucggacccc

SEQ ID NO: 1829252 - RNA, 18 nt, Human herpesvirus 2
gguggcaaaauccaaaaa

SEQ ID NO: 1829253 - RNA, 18 nt, Human herpesvirus 2
cuuucuuuuugccuccca

SEQ ID NO: 1829254 - RNA, 15 nt, Human herpesvirus 2
uccucaaacaggcca

SEQ ID NO: 1829255 - RNA, 21 nt, Human herpesvirus 2
ggacgucuccaagcucuccga

SEQ ID NO: 1829256 - RNA, 11 nt, Human herpesvirus 2
uucucuucccc

SEQ ID NO: 1829257 - RNA, 14 nt, Human herpesvirus 2
aggggggggcuggu

SEQ ID NO: 1829258 - RNA, 16 nt, Human herpesvirus 2
ugugggggcccagguc

SEQ ID NO: 1829259 - RNA, 14 nt, Human herpesvirus 2
uagaagaaaaccac

SEQ ID NO: 1829260 - RNA, 16 nt, Human herpesvirus 2
cgggcgcccccgccuc

SEQ ID NO: 1829261 - RNA, 15 nt, Human herpesvirus 2
cgaaggaagccgccc

SEQ ID NO: 1829262 - RNA, 16 nt, Human herpesvirus 2
ccagcuuucccuccac

SEQ ID NO: 1829263 - RNA, 13 nt, Human herpesvirus 2
aucgacccggacu

SEQ ID NO: 1829264 - RNA, 16 nt, Human herpesvirus 2
cucccggcccgggccc

SEQ ID NO: 1829265 - RNA, 21 nt, Human herpesvirus 2
cuggcggaagugccgcacggc

SEQ ID NO: 1829266 - RNA, 18 nt, Human herpesvirus 2
acugccccccuccugggg

SEQ ID NO: 1829267 - RNA, 15 nt, Human herpesvirus 2
guggcccuccacgcc

SEQ ID NO: 1829268 - RNA, 14 nt, Human herpesvirus 2
cgcacccuugcccg

SEQ ID NO: 1829269 - RNA, 23 nt, Human herpesvirus 2
gcucuguuucgcauaugcccugg

SEQ ID NO: 1829270 - RNA, 22 nt, Human herpesvirus 2
ggcgccggccaaccgcgcgccg

SEQ ID NO: 1829271 - RNA, 22 nt, Human herpesvirus 2
ucaccgagccgcugugccaggu

SEQ ID NO: 1829272 - RNA, 14 nt, Human herpesvirus 2
uuucagguuccggg

SEQ ID NO: 1829273 - RNA, 18 nt, Human herpesvirus 2
ggaagaggcggacccagu

SEQ ID NO: 1829274 - RNA, 18 nt, Human herpesvirus 2
gagcguaucggccaggag

SEQ ID NO: 1829275 - RNA, 13 nt, Human herpesvirus 2
aaaggccagcaga

SEQ ID NO: 1829276 - RNA, 14 nt, Human herpesvirus 2
ccgaucuggagccg

SEQ ID NO: 1829277 - RNA, 16 nt, Human herpesvirus 2
cgcgggggacgggccg

SEQ ID NO: 1829278 - RNA, 18 nt, Human herpesvirus 2
cggagcggugcagggccu

SEQ ID NO: 1829279 - RNA, 19 nt, Human herpesvirus 2
ccucagcgcggccgugggc

SEQ ID NO: 1829280 - RNA, 14 nt, Human herpesvirus 2
uuuuguuuguuugu

SEQ ID NO: 1829281 - RNA, 16 nt, Human herpesvirus 2
cugcgccaccggccug

SEQ ID NO: 1829282 - RNA, 20 nt, Human herpesvirus 2
ccgcucgcugcagggccugg

SEQ ID NO: 1829283 - RNA, 20 nt, Human herpesvirus 2
gugcugggcgcgagccaggc

SEQ ID NO: 1829284 - RNA, 15 nt, Human herpesvirus 2
cgcccgcguccgaca

SEQ ID NO: 1829285 - RNA, 16 nt, Human herpesvirus 2
gaacagccccuggggc

SEQ ID NO: 1829286 - RNA, 11 nt, Human herpesvirus 2
gcagggccuga

SEQ ID NO: 1829287 - RNA, 11 nt, Human herpesvirus 2
ggggggccucg

SEQ ID NO: 1829288 - RNA, 15 nt, Human herpesvirus 2
gcuuuccacaccccc

SEQ ID NO: 1829289 - RNA, 23 nt, Human herpesvirus 2
aggcguggugauacaacacaccc

SEQ ID NO: 1829290 - RNA, 16 nt, Human herpesvirus 2
uggacgcgccucccgg

SEQ ID NO: 1829291 - RNA, 20 nt, Human herpesvirus 2
ccgggggggggcaagugcag

SEQ ID NO: 1829292 - RNA, 23 nt, Human herpesvirus 2
gacgcgcgcgcccccgacccggg

SEQ ID NO: 1829293 - RNA, 18 nt, Human herpesvirus 2
guaucgugccuggcggca

SEQ ID NO: 1829294 - RNA, 19 nt, Human herpesvirus 2
cucaguguuugggaaaucu

SEQ ID NO: 1829295 - RNA, 17 nt, Human herpesvirus 2
gggcugucgggcgaugc

SEQ ID NO: 1829296 - RNA, 18 nt, Human herpesvirus 2
ggccaaccgcgcgccgcc

SEQ ID NO: 1829297 - RNA, 24 nt, Human herpesvirus 2
cggggacuugacggucgccacucu

SEQ ID NO: 1829298 - RNA, 22 nt, Human herpesvirus 2
ugguggccgaaagaaaaggaag

SEQ ID NO: 1829299 - RNA, 13 nt, Human herpesvirus 2
ggggcacgcgguc

SEQ ID NO: 1829300 - RNA, 20 nt, Human herpesvirus 2
ccggggccguggggccccag

SEQ ID NO: 1829301 - RNA, 17 nt, Human herpesvirus 2
uccaccaccagcaccac

SEQ ID NO: 1829302 - RNA, 21 nt, Human herpesvirus 2
uuguuauggacuuucuggccu

SEQ ID NO: 1829303 - RNA, 18 nt, Human herpesvirus 2
acgagccaaaccagcccc

SEQ ID NO: 1829304 - RNA, 23 nt, Human herpesvirus 2
ccccgggggggggcaagugcagu

SEQ ID NO: 1829305 - RNA, 23 nt, Human herpesvirus 2
cugcccaccggcuccauccugag

SEQ ID NO: 1829306 - RNA, 13 nt, Human herpesvirus 2
acgucgccccccc

SEQ ID NO: 1829307 - RNA, 14 nt, Human herpesvirus 2
gaugcgccuggugg

SEQ ID NO: 1829308 - RNA, 14 nt, Human herpesvirus 2
guucgccccgcagc

SEQ ID NO: 1829309 - RNA, 19 nt, Human herpesvirus 2
acagccccuggggcugucg

SEQ ID NO: 1829310 - RNA, 20 nt, Human herpesvirus 2
cuggcuguguuugucugucg

SEQ ID NO: 1829311 - RNA, 20 nt, Human herpesvirus 2
augcacguaaaacacgggcg

SEQ ID NO: 1829312 - RNA, 22 nt, Human herpesvirus 2
cugggguauuugggugggacuu

SEQ ID NO: 1829313 - RNA, 17 nt, Human herpesvirus 2
cuucucgccucucuucu

SEQ ID NO: 1829314 - RNA, 18 nt, Human herpesvirus 2
gaggcccggaacgagguu

SEQ ID NO: 1829315 - RNA, 22 nt, Human herpesvirus 2
ccuuuuuucuuuuucucuuccc

SEQ ID NO: 1829316 - RNA, 10 nt, Human herpesvirus 2
gccccacgga

SEQ ID NO: 1829317 - RNA, 21 nt, Human herpesvirus 2
cacgccguggacgcccccucc

SEQ ID NO: 1829318 - RNA, 22 nt, Human herpesvirus 2
ccguaaacugcuuggaggcccu

SEQ ID NO: 1829319 - RNA, 17 nt, Human herpesvirus 2
aagagacgaugggagcc

SEQ ID NO: 1829320 - RNA, 20 nt, Human herpesvirus 2
aguccucggggacgcacggc

SEQ ID NO: 1829321 - RNA, 22 nt, Human herpesvirus 2
gaccuccccgugcgugcugcug

SEQ ID NO: 1829322 - RNA, 22 nt, Human herpesvirus 2
auccgacggcaugcagcccaga

SEQ ID NO: 1829323 - RNA, 18 nt, Human herpesvirus 2
cguggccggcgacccgcc

SEQ ID NO: 1829324 - RNA, 21 nt, Human herpesvirus 2
ggcguuucugaccggcgccga

SEQ ID NO: 1829325 - RNA, 16 nt, Human herpesvirus 2
ggauguguucuccugg

SEQ ID NO: 1829326 - RNA, 22 nt, Human herpesvirus 2
gcacgcggggacccgccagaga

SEQ ID NO: 1829327 - RNA, 15 nt, Human herpesvirus 2
ggcggccccccgcgc

SEQ ID NO: 1829328 - RNA, 18 nt, Human herpesvirus 2
gaggagacaggaaguggg

SEQ ID NO: 1829329 - RNA, 22 nt, Human herpesvirus 2
ccggcguuucugaccggcgccg

SEQ ID NO: 1829330 - RNA, 23 nt, Human herpesvirus 2
gaggccugucccugcgucgcccc

SEQ ID NO: 1829331 - RNA, 16 nt, Human herpesvirus 2
cggguuuuuggcccug

SEQ ID NO: 1829332 - RNA, 19 nt, Human herpesvirus 2
acacccccuguccccgccc

SEQ ID NO: 1829333 - RNA, 16 nt, Human herpesvirus 2
cuggcgauccugggcc

SEQ ID NO: 1829334 - RNA, 15 nt, Human herpesvirus 2
gcccguggcccacga

SEQ ID NO: 1829335 - RNA, 15 nt, Human herpesvirus 2
gcccggccgcgacaa

SEQ ID NO: 1829336 - RNA, 19 nt, Human herpesvirus 2
gccgccgagcgucaggccc

SEQ ID NO: 1829337 - RNA, 15 nt, Human herpesvirus 2
ucccggcccgggccc

SEQ ID NO: 1829338 - RNA, 12 nt, Human herpesvirus 2
cagguggcccuu

SEQ ID NO: 1829339 - RNA, 13 nt, Human herpesvirus 2
aauuccagcagcu

SEQ ID NO: 1829340 - RNA, 10 nt, Human herpesvirus 2
cccagguccc

SEQ ID NO: 1829341 - RNA, 19 nt, Human herpesvirus 2
cgcggacgagcccguggcc

SEQ ID NO: 1829342 - RNA, 21 nt, Human herpesvirus 2
aggaacuggguuacugcacuu

SEQ ID NO: 1829343 - RNA, 18 nt, Human herpesvirus 2
ggggcgcugguggccgcg

SEQ ID NO: 1829344 - RNA, 17 nt, Human herpesvirus 2
cgugucccucccggcca

SEQ ID NO: 1829345 - RNA, 13 nt, Human herpesvirus 2
cccugcgucgccc

SEQ ID NO: 1829346 - RNA, 16 nt, Human herpesvirus 2
auuuuccccccacccc

SEQ ID NO: 1829347 - RNA, 20 nt, Human herpesvirus 2
ggcccguagucuccgcgaga

SEQ ID NO: 1829348 - RNA, 12 nt, Human herpesvirus 2
cgccggggaccg

SEQ ID NO: 1829349 - RNA, 18 nt, Human herpesvirus 2
gacgucaaauucgugggc

SEQ ID NO: 1829350 - RNA, 18 nt, Human herpesvirus 2
auugaccucucgcccccc

SEQ ID NO: 1829351 - RNA, 17 nt, Human herpesvirus 2
ggcacaccggcggggcg

SEQ ID NO: 1829352 - RNA, 18 nt, Human herpesvirus 2
agcguaucggccaggagg

SEQ ID NO: 1829353 - RNA, 22 nt, Human herpesvirus 2
ggucaccgguguucggaaccag

SEQ ID NO: 1829354 - RNA, 16 nt, Human herpesvirus 2
gccgggagcguggggc

SEQ ID NO: 1829355 - RNA, 13 nt, Human herpesvirus 2
aacacaccgggcu

SEQ ID NO: 1829356 - RNA, 13 nt, Human herpesvirus 2
gcgcgggcggcgc

SEQ ID NO: 1829357 - RNA, 15 nt, Human herpesvirus 2
aucucaucaaacacg

SEQ ID NO: 1829358 - RNA, 20 nt, Human herpesvirus 2
ucuuuccaccaccagcacca

SEQ ID NO: 1829359 - RNA, 23 nt, Human herpesvirus 2
aucccgaagccaucugaagccgu

SEQ ID NO: 1829360 - RNA, 13 nt, Human herpesvirus 2
ccucgcugcgccg

SEQ ID NO: 1829361 - RNA, 18 nt, Human herpesvirus 2
accagccccucgcccccg

SEQ ID NO: 1829362 - RNA, 22 nt, Human herpesvirus 2
cgccgcgcauuuaaggagucgc

SEQ ID NO: 1829363 - RNA, 15 nt, Human herpesvirus 2
cucccugcggcuggc

SEQ ID NO: 1829364 - RNA, 13 nt, Human herpesvirus 2
ccucgccgccuuc

SEQ ID NO: 1829365 - RNA, 19 nt, Human herpesvirus 2
ucccgccgucucccccgcg

SEQ ID NO: 1829366 - RNA, 19 nt, Human herpesvirus 2
cugaauuucccgcagaacc

SEQ ID NO: 1829367 - RNA, 19 nt, Human herpesvirus 2
agaggcccggaacgagguu

SEQ ID NO: 1829368 - RNA, 15 nt, Human herpesvirus 2
gaugcggggcggggu

SEQ ID NO: 1829369 - RNA, 16 nt, Human herpesvirus 2
ccagccccgcaggcag

SEQ ID NO: 1829370 - RNA, 17 nt, Human herpesvirus 2
gcggaccggcccccgga

SEQ ID NO: 1829371 - RNA, 19 nt, Human herpesvirus 2
acccccaucgggcugcugg

SEQ ID NO: 1829372 - RNA, 18 nt, Human herpesvirus 2
uuucggcacccguccucg

SEQ ID NO: 1829373 - RNA, 18 nt, Human herpesvirus 2
ccacuccaccccccccuc

SEQ ID NO: 1829374 - RNA, 22 nt, Human herpesvirus 2
agggccuggcgauccugggccu

SEQ ID NO: 1829375 - RNA, 17 nt, Human herpesvirus 2
cccgcggcccugagccg

SEQ ID NO: 1829376 - RNA, 16 nt, Human herpesvirus 2
cggggauaaaagccaa

SEQ ID NO: 1829377 - RNA, 17 nt, Human herpesvirus 2
uggccagagccucaucg

SEQ ID NO: 1829378 - RNA, 14 nt, Human herpesvirus 2
cugugcggcccucu

SEQ ID NO: 1829379 - RNA, 19 nt, Human herpesvirus 2
ggccgccgcaacacccggc

SEQ ID NO: 1829380 - RNA, 23 nt, Human herpesvirus 2
caacgcccccuuuacgccuuucc

SEQ ID NO: 1829381 - RNA, 22 nt, Human herpesvirus 2
ccagguggcccuuccggacccc

SEQ ID NO: 1829382 - RNA, 19 nt, Human herpesvirus 2
aagugggggggugguggug

SEQ ID NO: 1829383 - RNA, 21 nt, Human herpesvirus 2
cacucccgaaaccgcaggcgc

SEQ ID NO: 1829384 - RNA, 13 nt, Human herpesvirus 2
uggcggcugggga

SEQ ID NO: 1829385 - RNA, 18 nt, Human herpesvirus 2
gcuggagcgcugguggga

SEQ ID NO: 1829386 - RNA, 15 nt, Human herpesvirus 2
ccucaccccacccca

SEQ ID NO: 1829387 - RNA, 13 nt, Human herpesvirus 2
ggcggaggccugu

SEQ ID NO: 1829388 - RNA, 21 nt, Human herpesvirus 2
cugaucgacgacgccuggcgg

SEQ ID NO: 1829389 - RNA, 17 nt, Human herpesvirus 2
aaacaggaauggagaag

SEQ ID NO: 1829390 - RNA, 14 nt, Human herpesvirus 2
cgcuacugcgccac

SEQ ID NO: 1829391 - RNA, 23 nt, Human herpesvirus 2
ccagcucgggggccaggaacucc

SEQ ID NO: 1829392 - RNA, 23 nt, Human herpesvirus 2
agccuccgaggugcggagccucu

SEQ ID NO: 1829393 - RNA, 13 nt, Human herpesvirus 2
acucggagggaag

SEQ ID NO: 1829394 - RNA, 15 nt, Human herpesvirus 2
aacgcgggcgggggc

SEQ ID NO: 1829395 - RNA, 18 nt, Human herpesvirus 2
ucuggcggcccuggagcg

SEQ ID NO: 1829396 - RNA, 19 nt, Human herpesvirus 2
ggcccccgaauccggggcg

SEQ ID NO: 1829397 - RNA, 13 nt, Human herpesvirus 2
aggcgcugcugcg

SEQ ID NO: 1829398 - RNA, 23 nt, Human herpesvirus 2
uuccucaguguuugggaaaucua

SEQ ID NO: 1829399 - RNA, 16 nt, Human herpesvirus 2
ggaggggggugcugug

SEQ ID NO: 1829400 - RNA, 16 nt, Human herpesvirus 2
gcagagagauuucccc

SEQ ID NO: 1829401 - RNA, 16 nt, Human herpesvirus 2
guggggacgaggccca

SEQ ID NO: 1829402 - RNA, 16 nt, Human herpesvirus 2
cauaaaacccacccuc

SEQ ID NO: 1829403 - RNA, 15 nt, Human herpesvirus 2
gaaacgaugaaggac

SEQ ID NO: 1829404 - RNA, 13 nt, Human herpesvirus 2
uguguuaacgcaa

SEQ ID NO: 1829405 - RNA, 18 nt, Human herpesvirus 2
ggacgcggcauaccuccg

SEQ ID NO: 1829406 - RNA, 17 nt, Human herpesvirus 2
gagugggggggggggac

SEQ ID NO: 1829407 - RNA, 15 nt, Human herpesvirus 2
ccuggcucgccgugc

SEQ ID NO: 1829408 - RNA, 18 nt, Human herpesvirus 2
ugccccccggcgcgggcg

SEQ ID NO: 1829409 - RNA, 15 nt, Human herpesvirus 2
uaccccaguuccucc

SEQ ID NO: 1829410 - RNA, 16 nt, Human herpesvirus 2
gugauggggguccugg

SEQ ID NO: 1829411 - RNA, 17 nt, Human herpesvirus 2
ccacguguccccaggga

SEQ ID NO: 1829412 - RNA, 20 nt, Human herpesvirus 2
uggagccaaaccccccggcc

SEQ ID NO: 1829413 - RNA, 22 nt, Human herpesvirus 2
caagcgccccgcggaccccgcc

SEQ ID NO: 1829414 - RNA, 21 nt, Human herpesvirus 2
ugcgcacgacagaccuccccg

SEQ ID NO: 1829415 - RNA, 15 nt, Human herpesvirus 2
uaaauaaacaaacaa

SEQ ID NO: 1829416 - RNA, 17 nt, Human herpesvirus 2
ccgguguucggaaccag

SEQ ID NO: 1829417 - RNA, 19 nt, Human herpesvirus 2
gagcccugccccgcccccu

SEQ ID NO: 1829418 - RNA, 22 nt, Human herpesvirus 2
cgccgcuguggcccuggcggac

SEQ ID NO: 1829419 - RNA, 19 nt, Human herpesvirus 2
ccgcgcccgcgugccgcag

SEQ ID NO: 1829420 - RNA, 16 nt, Human herpesvirus 2
ccacccaaccagcgcg

SEQ ID NO: 1829421 - RNA, 15 nt, Human herpesvirus 2
auguucaaaaauaca

SEQ ID NO: 1829422 - RNA, 15 nt, Human herpesvirus 2
gcuccggcucccggc

SEQ ID NO: 1829423 - RNA, 20 nt, Human herpesvirus 2
ugacggucgccacucuccug

SEQ ID NO: 1829424 - RNA, 15 nt, Human herpesvirus 2
guggugcuggccaau

SEQ ID NO: 1829425 - RNA, 22 nt, Human herpesvirus 2
ccugacccucucgggcaugggc

SEQ ID NO: 1829426 - RNA, 15 nt, Human herpesvirus 2
accgaaggaggaaag

SEQ ID NO: 1829427 - RNA, 15 nt, Human herpesvirus 2
gaaccccucuggggu

SEQ ID NO: 1829428 - RNA, 16 nt, Human herpesvirus 2
ccucaaacaggccauc

SEQ ID NO: 1829429 - RNA, 22 nt, Human herpesvirus 2
gccggcggagccccggagcucc

SEQ ID NO: 1829430 - RNA, 20 nt, Human herpesvirus 2
gucgccgccggccacgccac

SEQ ID NO: 1829431 - RNA, 23 nt, Human herpesvirus 2
cgaacgggggucccgccucccgg

SEQ ID NO: 1829432 - RNA, 15 nt, Human herpesvirus 2
ccgguaugguaauua

SEQ ID NO: 1829433 - RNA, 16 nt, Human herpesvirus 2
ugggggggggggggcg

SEQ ID NO: 1829434 - RNA, 17 nt, Human herpesvirus 2
aaaucgugcacagagcc

SEQ ID NO: 1829435 - RNA, 17 nt, Human herpesvirus 2
gggcgugcugugcccug

SEQ ID NO: 1829436 - RNA, 17 nt, Human herpesvirus 2
cucgcggcggcuccccc

SEQ ID NO: 1829437 - RNA, 16 nt, Human herpesvirus 2
gcggacgaccugguga

SEQ ID NO: 1829438 - RNA, 19 nt, Human herpesvirus 2
ggccggguuuuuggcccug

SEQ ID NO: 1829439 - RNA, 18 nt, Human herpesvirus 2
ccugggcggccucuccgg

SEQ ID NO: 1829440 - RNA, 21 nt, Human herpesvirus 2
cgccucgcgucgggccagaug

SEQ ID NO: 1829441 - RNA, 23 nt, Human herpesvirus 2
uguaauggggccgcaguguuuuu

SEQ ID NO: 1829442 - RNA, 14 nt, Human herpesvirus 2
ucggggggacgagc

SEQ ID NO: 1829443 - RNA, 21 nt, Human herpesvirus 2
aagugcaguaacccaguuccu

SEQ ID NO: 1829444 - RNA, 15 nt, Human herpesvirus 2
aggggcgggaggggc

SEQ ID NO: 1829445 - RNA, 20 nt, Human herpesvirus 2
cuccccuucagccuggacca

SEQ ID NO: 1829446 - RNA, 15 nt, Human herpesvirus 2
cccaguuccuccgug

SEQ ID NO: 1829447 - RNA, 20 nt, Human herpesvirus 2
uccgacgacgcguacguggc

SEQ ID NO: 1829448 - RNA, 14 nt, Human herpesvirus 2
cggccuccccggcg

SEQ ID NO: 1829449 - RNA, 14 nt, Human herpesvirus 2
gacuccgccccggc

SEQ ID NO: 1829450 - RNA, 21 nt, Human herpesvirus 2
ccccaaaccccgguuggggcg

SEQ ID NO: 1829451 - RNA, 18 nt, Human herpesvirus 2
cgccgcuguggcccuggc

SEQ ID NO: 1829452 - RNA, 14 nt, Human herpesvirus 2
caggccccccggga

SEQ ID NO: 1829453 - RNA, 17 nt, Human herpesvirus 2
ccacacccccuccccgu

SEQ ID NO: 1829454 - RNA, 20 nt, Human herpesvirus 2
gcaacccgacggcggggccc

SEQ ID NO: 1829455 - RNA, 14 nt, Human herpesvirus 2
ugcaacgagcugcc

SEQ ID NO: 1829456 - RNA, 15 nt, Human herpesvirus 2
guuggaagaggcgga

SEQ ID NO: 1829457 - RNA, 14 nt, Human herpesvirus 2
uguguucuccugga

SEQ ID NO: 1829458 - RNA, 23 nt, Human herpesvirus 2
cggaguaugaccgucggugccag

SEQ ID NO: 1829459 - RNA, 13 nt, Human herpesvirus 2
gggaaacuaggac

SEQ ID NO: 1829460 - RNA, 16 nt, Human herpesvirus 2
uccggguaaaaaagaa

SEQ ID NO: 1829461 - RNA, 17 nt, Human herpesvirus 2
ugcucucccguaccccg

SEQ ID NO: 1829462 - RNA, 13 nt, Human herpesvirus 2
cggacccaccgca

SEQ ID NO: 1829463 - RNA, 11 nt, Human herpesvirus 2
ugggggaagaa

SEQ ID NO: 1829464 - RNA, 21 nt, Human herpesvirus 2
gccgccccgacucugugucuu

SEQ ID NO: 1829465 - RNA, 20 nt, Human herpesvirus 2
gcgaagguguuguagggccg

SEQ ID NO: 1829466 - RNA, 19 nt, Human herpesvirus 2
uggcguccccaggcgacgc

SEQ ID NO: 1829467 - RNA, 13 nt, Human herpesvirus 2
agccccccccccu

SEQ ID NO: 1829468 - RNA, 14 nt, Human herpesvirus 2
cagccgcgccgcug

SEQ ID NO: 1829469 - RNA, 19 nt, Human herpesvirus 2
ggcggaggccugucccugc

SEQ ID NO: 1829470 - RNA, 14 nt, Human herpesvirus 2
agccuucggccacc

SEQ ID NO: 1829471 - RNA, 15 nt, Human herpesvirus 2
ugggggauuguggga

SEQ ID NO: 1829472 - RNA, 17 nt, Human herpesvirus 2
cgcggacgccgggcggc

SEQ ID NO: 1829473 - RNA, 16 nt, Human herpesvirus 2
uagcucgcggagggcg

SEQ ID NO: 1829474 - RNA, 15 nt, Human herpesvirus 2
ccacggaccuccggg

SEQ ID NO: 1829475 - RNA, 21 nt, Human herpesvirus 2
gaggucaauagauuuccccaa

SEQ ID NO: 1829476 - RNA, 13 nt, Human herpesvirus 2
uuuucggacggug

SEQ ID NO: 1829477 - RNA, 18 nt, Human herpesvirus 2
cgcgggcggcgccgcgcc

SEQ ID NO: 1829478 - RNA, 21 nt, Human herpesvirus 2
agucgcccauacaaauuaaau

SEQ ID NO: 1829479 - RNA, 16 nt, Human herpesvirus 2
gcccuccgccagcgcc

SEQ ID NO: 1829480 - RNA, 14 nt, Human herpesvirus 2
ccccgacgcgcgcg

SEQ ID NO: 1829481 - RNA, 15 nt, Human herpesvirus 2
ccccgcgcacgcgcg

SEQ ID NO: 1829482 - RNA, 12 nt, Human herpesvirus 2
ccccgcgccgcc

SEQ ID NO: 1829483 - RNA, 14 nt, Human herpesvirus 2
ccccgcgugcagcg

SEQ ID NO: 1829484 - RNA, 16 nt, Human herpesvirus 2
ccccagggagccccgg

SEQ ID NO: 1829485 - RNA, 18 nt, Human herpesvirus 2
ccccgaagcggccccgac

SEQ ID NO: 1829486 - RNA, 19 nt, Human herpesvirus 2
ccccgaauaccaccggcgu

SEQ ID NO: 1829487 - RNA, 20 nt, Human herpesvirus 2
ccccaacucauacacgcgcu

SEQ ID NO: 1829488 - RNA, 22 nt, Human herpesvirus 2
ccaggaacucacggcagacgcg

SEQ ID NO: 1829489 - RNA, 19 nt, Human herpesvirus 2
ccagcgcguugguccgggg

SEQ ID NO: 1829490 - RNA, 15 nt, Human herpesvirus 2
ccauaacgcgcccgc

SEQ ID NO: 1829491 - RNA, 17 nt, Human herpesvirus 2
ccaucgacccggacugc

SEQ ID NO: 1829492 - RNA, 16 nt, Human herpesvirus 2
cccaguaccggcgcgc

SEQ ID NO: 1829493 - RNA, 15 nt, Human herpesvirus 2
cccaguuccuccgug

SEQ ID NO: 1829494 - RNA, 12 nt, Human herpesvirus 2
ccagggcgucgc

SEQ ID NO: 1829495 - RNA, 13 nt, Human herpesvirus 2
ccagggcuucgug

SEQ ID NO: 1829496 - RNA, 14 nt, Human herpesvirus 2
ccaacgacggcguu

SEQ ID NO: 1829497 - RNA, 18 nt, Human herpesvirus 2
ccaacgcgggcggucugg

SEQ ID NO: 1829498 - RNA, 19 nt, Human herpesvirus 2
cauuugcccgcgggucugc

SEQ ID NO: 1829499 - RNA, 14 nt, Human herpesvirus 2
caggggcccgccgc

SEQ ID NO: 1829500 - RNA, 17 nt, Human herpesvirus 2
cagggaguccucgccgc

SEQ ID NO: 1829501 - RNA, 20 nt, Human herpesvirus 2
cagggagccacucccgcggc

SEQ ID NO: 1829502 - RNA, 22 nt, Human herpesvirus 2
cagggccuggcgauccugggcc

SEQ ID NO: 1829503 - RNA, 17 nt, Human herpesvirus 2
cagggggcggcgccggc

SEQ ID NO: 1829504 - RNA, 23 nt, Human herpesvirus 2
caggggggcuuggacugggagcc

SEQ ID NO: 1829505 - RNA, 14 nt, Human herpesvirus 2
cauguucggcgucg

SEQ ID NO: 1829506 - RNA, 14 nt, Human herpesvirus 2
augcgacgccgccc

SEQ ID NO: 1829507 - RNA, 14 nt, Human herpesvirus 2
auggccgccccgca

SEQ ID NO: 1829508 - RNA, 14 nt, Human herpesvirus 2
auggcggccgccgc

SEQ ID NO: 1829509 - RNA, 15 nt, Human herpesvirus 2
auggcggccgcgccc

SEQ ID NO: 1829510 - RNA, 23 nt, Human herpesvirus 2
auggcggccgcgcccccggccgc

SEQ ID NO: 1829511 - RNA, 14 nt, Human herpesvirus 2
auggcguacccggg

SEQ ID NO: 1829512 - RNA, 16 nt, Human herpesvirus 2
augcgccugguggucg

SEQ ID NO: 1829513 - RNA, 22 nt, Human herpesvirus 2
augggccggcguucccgcucgc

SEQ ID NO: 1829514 - RNA, 19 nt, Human herpesvirus 2
augucaggggcccgccgcc

SEQ ID NO: 1829515 - RNA, 20 nt, Human herpesvirus 2
caaaccccgguuggggcggg

SEQ ID NO: 1829516 - RNA, 17 nt, Human herpesvirus 2
caggcccgccccaccgc

SEQ ID NO: 1829517 - RNA, 22 nt, Human herpesvirus 2
cgcugcggggaccagccgacgu

SEQ ID NO: 1829518 - RNA, 12 nt, Human herpesvirus 2
cgcugcgccggg

SEQ ID NO: 1829519 - RNA, 23 nt, Human herpesvirus 2
cgcguugguccgggggcgggcgg

SEQ ID NO: 1829520 - RNA, 16 nt, Human herpesvirus 2
cgcccuucaccaacga

SEQ ID NO: 1829521 - RNA, 16 nt, Human herpesvirus 2
cgccgacaacguccgg

SEQ ID NO: 1829522 - RNA, 17 nt, Human herpesvirus 2
cgcguucagacgacaga

SEQ ID NO: 1829523 - RNA, 18 nt, Human herpesvirus 2
cgcccuuccgcguccgcg

SEQ ID NO: 1829524 - RNA, 20 nt, Human herpesvirus 2
cgcccgggugaccacgcgca

SEQ ID NO: 1829525 - RNA, 18 nt, Human herpesvirus 2
cgcccggagcggugggga

SEQ ID NO: 1829526 - RNA, 20 nt, Human herpesvirus 2
cgcaccgcugucccgacgau

SEQ ID NO: 1829527 - RNA, 12 nt, Human herpesvirus 2
cgcccgccccag

SEQ ID NO: 1829528 - RNA, 13 nt, Human herpesvirus 2
cgcccgcgugccg

SEQ ID NO: 1829529 - RNA, 13 nt, Human herpesvirus 2
cgccccgcggacc

SEQ ID NO: 1829530 - RNA, 23 nt, Human herpesvirus 2
cgccccgccccaccccgccccac

SEQ ID NO: 1829531 - RNA, 16 nt, Human herpesvirus 2
cgcccccgcggccucc

SEQ ID NO: 1829532 - RNA, 16 nt, Human herpesvirus 2
cgccaagcgccccgcg

SEQ ID NO: 1829533 - RNA, 15 nt, Human herpesvirus 2
cgcauaaagguccgg

SEQ ID NO: 1829534 - RNA, 13 nt, Human herpesvirus 2
cgcagcggcgucc

SEQ ID NO: 1829535 - RNA, 12 nt, Human herpesvirus 2
cgcagcguccgg

SEQ ID NO: 1829536 - RNA, 18 nt, Human herpesvirus 2
cgcaacaacggcgggccc

SEQ ID NO: 1829537 - RNA, 18 nt, Human herpesvirus 2
cgagccccgcgaccacca

SEQ ID NO: 1829538 - RNA, 20 nt, Human herpesvirus 2
cgagccccgcgaccaccaag

SEQ ID NO: 1829539 - RNA, 17 nt, Human herpesvirus 2
cgagccaccgucccgcc

SEQ ID NO: 1829540 - RNA, 16 nt, Human herpesvirus 2
ccgauagccuccgagg

SEQ ID NO: 1829541 - RNA, 16 nt, Human herpesvirus 2
cgagcaccgacccccu

SEQ ID NO: 1829542 - RNA, 15 nt, Human herpesvirus 2
ccgacguggcccgcc

SEQ ID NO: 1829543 - RNA, 15 nt, Human herpesvirus 2
ccgacgcgaggcgcg

SEQ ID NO: 1829544 - RNA, 14 nt, Human herpesvirus 2
cccggcggcggucg

SEQ ID NO: 1829545 - RNA, 20 nt, Human herpesvirus 2
cccggggcccucgagaugcg

SEQ ID NO: 1829546 - RNA, 15 nt, Human herpesvirus 2
cccggggggggccuc

SEQ ID NO: 1829547 - RNA, 13 nt, Human herpesvirus 2
cccggguccgggg

SEQ ID NO: 1829548 - RNA, 17 nt, Human herpesvirus 2
ccgacccuguggcgggc

SEQ ID NO: 1829549 - RNA, 20 nt, Human herpesvirus 2
ccgacgauuagccaccgcgc

SEQ ID NO: 1829550 - RNA, 17 nt, Human herpesvirus 2
cccgcgugccuggccgc

SEQ ID NO: 1829551 - RNA, 20 nt, Human herpesvirus 2
cccgcguccgacacccgggc

SEQ ID NO: 1829552 - RNA, 17 nt, Human herpesvirus 2
cccgcggaccaccgggc

SEQ ID NO: 1829553 - RNA, 21 nt, Human herpesvirus 2
cccggcgaccgccccgcgccg

SEQ ID NO: 1829554 - RNA, 20 nt, Human herpesvirus 2
cccgcguauauauccgcgag

SEQ ID NO: 1829555 - RNA, 20 nt, Human herpesvirus 2
aaacccgccggggcuucgug

SEQ ID NO: 1829556 - RNA, 17 nt, Human herpesvirus 2
aacacaagcucgccgug

SEQ ID NO: 1829557 - RNA, 13 nt, Human herpesvirus 2
aacacccggcgcc

SEQ ID NO: 1829558 - RNA, 19 nt, Human herpesvirus 2
aacaacacguucgccccgc

SEQ ID NO: 1829559 - RNA, 18 nt, Human herpesvirus 2
ucgcgcuuuuccgccgcc

SEQ ID NO: 1829560 - RNA, 20 nt, Human herpesvirus 2
ucgcggacgcacgcggggac

SEQ ID NO: 1829561 - RNA, 16 nt, Human herpesvirus 2
ucgcggcccggcgcca

SEQ ID NO: 1829562 - RNA, 18 nt, Human herpesvirus 2
ucgcggccgcccgcgccg

SEQ ID NO: 1829563 - RNA, 19 nt, Human herpesvirus 2
uccagcgcgucggugccgc

SEQ ID NO: 1829564 - RNA, 17 nt, Human herpesvirus 2
ucaucgggaaucucggg

SEQ ID NO: 1829565 - RNA, 18 nt, Human herpesvirus 2
ucaucaaacacgggcucg

SEQ ID NO: 1829566 - RNA, 19 nt, Human herpesvirus 2
gggggcuugauuugcgcgc

SEQ ID NO: 1829567 - RNA, 11 nt, Human herpesvirus 2
ggggggccucg

SEQ ID NO: 1829568 - RNA, 12 nt, Human herpesvirus 2
ggggguggcggc

SEQ ID NO: 1829569 - RNA, 14 nt, Human herpesvirus 2
ucaguccgcgcggg

SEQ ID NO: 1829570 - RNA, 17 nt, Human herpesvirus 2
ggcgucuagcucgcgga

SEQ ID NO: 1829571 - RNA, 23 nt, Human herpesvirus 2
ggccgccgcaacacccggcgcca

SEQ ID NO: 1829572 - RNA, 14 nt, Human herpesvirus 2
ggcggcguggccgc

SEQ ID NO: 1829573 - RNA, 23 nt, Human herpesvirus 2
ggcgggaccccgacguggcccgc

SEQ ID NO: 1829574 - RNA, 15 nt, Human herpesvirus 2
ggcggggccccgggc

SEQ ID NO: 1829575 - RNA, 12 nt, Human herpesvirus 2
ggcuccugcgca

SEQ ID NO: 1829576 - RNA, 15 nt, Human herpesvirus 2
gggcguugccggggg

SEQ ID NO: 1829577 - RNA, 19 nt, Human herpesvirus 2
gggcggccagccgcgcgac

SEQ ID NO: 1829578 - RNA, 19 nt, Human herpesvirus 2
gggcggcguggccgcgacc

SEQ ID NO: 1829579 - RNA, 12 nt, Human herpesvirus 2
gggcgggagggg

SEQ ID NO: 1829580 - RNA, 13 nt, Human herpesvirus 2
gggcgggcgggcg

SEQ ID NO: 1829581 - RNA, 12 nt, Human herpesvirus 2
gggcgggcgggg

SEQ ID NO: 1829582 - RNA, 19 nt, Human herpesvirus 2
gggcgggggugccguggac

SEQ ID NO: 1829583 - RNA, 14 nt, Human herpesvirus 2
gggcguccugcggc

SEQ ID NO: 1829584 - RNA, 22 nt, Human herpesvirus 2
gggcguccugcggcagcgcgcc

SEQ ID NO: 1829585 - RNA, 22 nt, Human herpesvirus 2
gggcgugauguuuuccgcaucu

SEQ ID NO: 1829586 - RNA, 14 nt, Human herpesvirus 2
gggcgcugagggcg

SEQ ID NO: 1829587 - RNA, 12 nt, Human herpesvirus 2
ggcuggcggcgc

SEQ ID NO: 1829588 - RNA, 14 nt, Human herpesvirus 2
gggcgagcuggccc

SEQ ID NO: 1829589 - RNA, 13 nt, Human herpesvirus 2
ggcugcggggggc

SEQ ID NO: 1829590 - RNA, 13 nt, Human herpesvirus 2
ggcucgcggggcc

SEQ ID NO: 1829591 - RNA, 18 nt, Human herpesvirus 2
gggggcgcugguggccgc

SEQ ID NO: 1829592 - RNA, 17 nt, Human herpesvirus 2
gggcgcgcggcgcgagc

SEQ ID NO: 1829593 - RNA, 13 nt, Human herpesvirus 2
gggggaggcgcgc

SEQ ID NO: 1829594 - RNA, 21 nt, Human herpesvirus 2
ggggcuccucagcgcggccgu

SEQ ID NO: 1829595 - RNA, 19 nt, Human herpesvirus 2
ggggcuugugcccucguag

SEQ ID NO: 1829596 - RNA, 17 nt, Human herpesvirus 2
ggggcgcugguggccgc

SEQ ID NO: 1829597 - RNA, 19 nt, Human herpesvirus 2
ggggacuugacggucgcca

SEQ ID NO: 1829598 - RNA, 21 nt, Human herpesvirus 2
ggggccccaguaccggcgcgc

SEQ ID NO: 1829599 - RNA, 14 nt, Human herpesvirus 2
ggggccccggcccg

SEQ ID NO: 1829600 - RNA, 15 nt, Human herpesvirus 2
ggggcccgccgccgc

SEQ ID NO: 1829601 - RNA, 18 nt, Human herpesvirus 2
ggggccggggcggccccg

SEQ ID NO: 1829602 - RNA, 17 nt, Human herpesvirus 2
ggggccgucgcggccgc

SEQ ID NO: 1829603 - RNA, 19 nt, Human herpesvirus 2
gggcuuuagucccggcccg

SEQ ID NO: 1829604 - RNA, 18 nt, Human herpesvirus 2
ggggaaagcuggcgucgg

SEQ ID NO: 1829605 - RNA, 20 nt, Human herpesvirus 2
ggggaagcccuacggcggcc

SEQ ID NO: 1829606 - RNA, 21 nt, Human herpesvirus 2
ggggaaggaaucgggcgucug

SEQ ID NO: 1829607 - RNA, 20 nt, Human herpesvirus 2
ggggacacgcggcgggucgg

SEQ ID NO: 1829608 - RNA, 23 nt, Human herpesvirus 2
ggggacccgacccuguggcgggc

SEQ ID NO: 1829609 - RNA, 13 nt, Human herpesvirus 2
ggggagggcgugg

SEQ ID NO: 1829610 - RNA, 21 nt, Human herpesvirus 2
ggggaucugucgccggcgugg

SEQ ID NO: 1829611 - RNA, 16 nt, Human herpesvirus 2
ggggaugguggugggc

SEQ ID NO: 1829612 - RNA, 15 nt, Human herpesvirus 2
ggggcaccggcaccg

SEQ ID NO: 1829613 - RNA, 21 nt, Human herpesvirus 2
ggccgcccaacccgagcgacc

SEQ ID NO: 1829614 - RNA, 23 nt, Human herpesvirus 2
ggccgcacccacgacauccgcgg

SEQ ID NO: 1829615 - RNA, 22 nt, Human herpesvirus 2
ggccgcagggauaggggcaggc

SEQ ID NO: 1829616 - RNA, 23 nt, Human herpesvirus 2
ggcccggggcccuucgcagcuuc

SEQ ID NO: 1829617 - RNA, 19 nt, Human herpesvirus 2
ggcccuccacgccguggac

SEQ ID NO: 1829618 - RNA, 17 nt, Human herpesvirus 2
ggccgacgugccgggga

SEQ ID NO: 1829619 - RNA, 15 nt, Human herpesvirus 2
ggcccuggacccaga

SEQ ID NO: 1829620 - RNA, 19 nt, Human herpesvirus 2
ggcccuuggacgggugggc

SEQ ID NO: 1829621 - RNA, 22 nt, Human herpesvirus 2
ggccgaacgccucaccgcgccc

SEQ ID NO: 1829622 - RNA, 14 nt, Human herpesvirus 2
ggcccggggggggc

SEQ ID NO: 1829623 - RNA, 14 nt, Human herpesvirus 2
ggcccggccgcgac

SEQ ID NO: 1829624 - RNA, 21 nt, Human herpesvirus 2
ggcccgcuucauagcgcgucc

SEQ ID NO: 1829625 - RNA, 14 nt, Human herpesvirus 2
ggcccgaggcgacc

SEQ ID NO: 1829626 - RNA, 13 nt, Human herpesvirus 2
ggcccgcagcuuc

SEQ ID NO: 1829627 - RNA, 13 nt, Human herpesvirus 2
gcgcggacgcggc

SEQ ID NO: 1829628 - RNA, 22 nt, Human herpesvirus 2
ggccccccgcgccucgggcggc

SEQ ID NO: 1829629 - RNA, 20 nt, Human herpesvirus 2
ggcccccgcaccggggcggc

SEQ ID NO: 1829630 - RNA, 17 nt, Human herpesvirus 2
ggccccgccccgcccca

SEQ ID NO: 1829631 - RNA, 19 nt, Human herpesvirus 2
ggccccgcucguggcgggc

SEQ ID NO: 1829632 - RNA, 16 nt, Human herpesvirus 2
ggccccggcggccccg

SEQ ID NO: 1829633 - RNA, 12 nt, Human herpesvirus 2
ggccaggggggc

SEQ ID NO: 1829634 - RNA, 22 nt, Human herpesvirus 2
ggccaggggggcaggcgggccc

SEQ ID NO: 1829635 - RNA, 15 nt, Human herpesvirus 2
ggccacucgucgcca

SEQ ID NO: 1829636 - RNA, 14 nt, Human herpesvirus 2
ggccagcgggggcc

SEQ ID NO: 1829637 - RNA, 13 nt, Human herpesvirus 2
gcgcgcuucgcgg

SEQ ID NO: 1829638 - RNA, 17 nt, Human herpesvirus 2
gcgcccccggccgcggu

SEQ ID NO: 1829639 - RNA, 15 nt, Human herpesvirus 2
gcgccccgccggggc

SEQ ID NO: 1829640 - RNA, 21 nt, Human herpesvirus 2
gcgccauuacccuauacgcgg

SEQ ID NO: 1829641 - RNA, 19 nt, Human herpesvirus 2
gcgcccccgacccggggcc

SEQ ID NO: 1829642 - RNA, 13 nt, Human herpesvirus 2
gcgcgcguccgua

SEQ ID NO: 1829643 - RNA, 17 nt, Human herpesvirus 2
cucgaccagcggcccca

SEQ ID NO: 1829644 - RNA, 22 nt, Human herpesvirus 2
cuccgccaugcaacgccgggcg

SEQ ID NO: 1829645 - RNA, 18 nt, Human herpesvirus 2
cuccgcaauaaacgccuu

SEQ ID NO: 1829646 - RNA, 17 nt, Human herpesvirus 2
gcgccaacgcgggcguc

SEQ ID NO: 1829647 - RNA, 15 nt, Human herpesvirus 2
gcgccaagcgccccg

SEQ ID NO: 1829648 - RNA, 16 nt, Human herpesvirus 2
gcgcaucgccaacucu

SEQ ID NO: 1829649 - RNA, 17 nt, Human herpesvirus 2
ccgaucgaugagccggu

SEQ ID NO: 1829650 - RNA, 11 nt, Human herpesvirus 2
ccgccauccuc

SEQ ID NO: 1829651 - RNA, 22 nt, Human herpesvirus 2
ccgcgguggcgucggcggcccc

SEQ ID NO: 1829652 - RNA, 14 nt, Human herpesvirus 2
ccgccagcagucgg

SEQ ID NO: 1829653 - RNA, 22 nt, Human herpesvirus 2
ccgcagccuauguucgcgggcg

SEQ ID NO: 1829654 - RNA, 18 nt, Human herpesvirus 2
cguguuguggcuggaggc

SEQ ID NO: 1829655 - RNA, 13 nt, Human herpesvirus 2
cucccucgccgcc

SEQ ID NO: 1829656 - RNA, 21 nt, Human herpesvirus 2
cucccggccauccccggcgcc

SEQ ID NO: 1829657 - RNA, 16 nt, Human herpesvirus 2
cucccggcccgccgac

SEQ ID NO: 1829658 - RNA, 18 nt, Human herpesvirus 2
cucccggcccgccgacca

SEQ ID NO: 1829659 - RNA, 15 nt, Human herpesvirus 2
cuaaggcgccgacgg

SEQ ID NO: 1829660 - RNA, 14 nt, Human herpesvirus 2
cguucccaccgcac

SEQ ID NO: 1829661 - RNA, 18 nt, Human herpesvirus 2
cguuugggggcggacgug

SEQ ID NO: 1829662 - RNA, 23 nt, Human herpesvirus 2
cguuggccagcgcguugguccgg

SEQ ID NO: 1829663 - RNA, 16 nt, Human herpesvirus 2
cguucggcaggcccgc

SEQ ID NO: 1829664 - RNA, 15 nt, Human herpesvirus 2
cguucguucgcccgg

SEQ ID NO: 1829665 - RNA, 12 nt, Human herpesvirus 2
ccgcuggcggga

SEQ ID NO: 1829666 - RNA, 12 nt, Human herpesvirus 2
ccguggguacgg

SEQ ID NO: 1829667 - RNA, 17 nt, Human herpesvirus 2
ccguguaccucugggcc

SEQ ID NO: 1829668 - RNA, 16 nt, Human herpesvirus 2
ccucagcgcggccgug

SEQ ID NO: 1829669 - RNA, 19 nt, Human herpesvirus 2
ccuauaaacucucccccgc

SEQ ID NO: 1829670 - RNA, 14 nt, Human herpesvirus 2
ccuaucuugauccc

SEQ ID NO: 1829671 - RNA, 13 nt, Human herpesvirus 2
cagccccuggggc

SEQ ID NO: 1829672 - RNA, 22 nt, Human herpesvirus 2
cagccccuggggcugucgggcg

SEQ ID NO: 1829673 - RNA, 14 nt, Human herpesvirus 2
cagcccggaccccu

SEQ ID NO: 1829674 - RNA, 15 nt, Human herpesvirus 2
cacguucgccccgca

SEQ ID NO: 1829675 - RNA, 21 nt, Human herpesvirus 2
cacgcaggccgcccccagcag

SEQ ID NO: 1829676 - RNA, 19 nt, Human herpesvirus 2
cacgacccaccgcccccgc

SEQ ID NO: 1829677 - RNA, 20 nt, Human herpesvirus 2
cacgcaacaacggcgggccc

SEQ ID NO: 1829678 - RNA, 23 nt, Human herpesvirus 2
caccgggcugggggucccgcgcu

SEQ ID NO: 1829679 - RNA, 13 nt, Human herpesvirus 2
caccgggggcccc

SEQ ID NO: 1829680 - RNA, 18 nt, Human herpesvirus 2
cacgaaaaagagcucggg

SEQ ID NO: 1829681 - RNA, 20 nt, Human herpesvirus 2
caccuggcucgccgugcgcu

SEQ ID NO: 1829682 - RNA, 16 nt, Human herpesvirus 2
acguccugcggcucau

SEQ ID NO: 1829683 - RNA, 13 nt, Human herpesvirus 2
acgugugcccgcc

SEQ ID NO: 1829684 - RNA, 13 nt, Human herpesvirus 2
agaccuccccgug

SEQ ID NO: 1829685 - RNA, 14 nt, Human herpesvirus 2
agacgaggccgcca

SEQ ID NO: 1829686 - RNA, 23 nt, Human herpesvirus 2
agaacggacaaccgagcgccggg

SEQ ID NO: 1829687 - RNA, 19 nt, Human herpesvirus 2
agagacgaugggagccccg

SEQ ID NO: 1829688 - RNA, 12 nt, Human herpesvirus 2
agagauuucccc

SEQ ID NO: 1829689 - RNA, 15 nt, Human herpesvirus 2
agagccgauccggcc

SEQ ID NO: 1829690 - RNA, 12 nt, Human herpesvirus 2
cacccgcccguc

SEQ ID NO: 1829691 - RNA, 15 nt, Human herpesvirus 2
caccgccccagcacc

SEQ ID NO: 1829692 - RNA, 15 nt, Human herpesvirus 2
cacccugggucggga

SEQ ID NO: 1829693 - RNA, 15 nt, Human herpesvirus 2
acggccagcgggggc

SEQ ID NO: 1829694 - RNA, 16 nt, Human herpesvirus 2
acggugaucgaggugu

SEQ ID NO: 1829695 - RNA, 15 nt, Human herpesvirus 2
acggcgucucccggg

SEQ ID NO: 1829696 - RNA, 23 nt, Human herpesvirus 2
acggccccggccgccuccccgcu

SEQ ID NO: 1829697 - RNA, 22 nt, Human herpesvirus 2
acgcgggcguccccgagcggcg

SEQ ID NO: 1829698 - RNA, 15 nt, Human herpesvirus 2
acggccucgugcucg

SEQ ID NO: 1829699 - RNA, 20 nt, Human herpesvirus 2
acgcgguauggcugcccccg

SEQ ID NO: 1829700 - RNA, 19 nt, Human herpesvirus 2
acgcgguauuguacccccg

SEQ ID NO: 1829701 - RNA, 21 nt, Human herpesvirus 2
acgcgcgacugccuccacgcc

SEQ ID NO: 1829702 - RNA, 17 nt, Human herpesvirus 2
acgcgaccgucgccgcc

SEQ ID NO: 1829703 - RNA, 13 nt, Human herpesvirus 2
acgccgaugccca

SEQ ID NO: 1829704 - RNA, 24 nt, Human herpesvirus 2
acgccuccggaagagagcgccccg

SEQ ID NO: 1829705 - RNA, 16 nt, Human herpesvirus 2
acgccaauaucaucga

SEQ ID NO: 1829706 - RNA, 16 nt, Human herpesvirus 2
gcguacguggcgucgg

SEQ ID NO: 1829707 - RNA, 14 nt, Human herpesvirus 2
gcguaccccuuuga

SEQ ID NO: 1829708 - RNA, 23 nt, Human herpesvirus 2
gcggugcgagaguuucuucgcgg

SEQ ID NO: 1829709 - RNA, 14 nt, Human herpesvirus 2
ggacgcccggccca

SEQ ID NO: 1829710 - RNA, 15 nt, Human herpesvirus 2
ggacgcagcggcguc

SEQ ID NO: 1829711 - RNA, 19 nt, Human herpesvirus 2
gcuccccuucagccuggac

SEQ ID NO: 1829712 - RNA, 14 nt, Human herpesvirus 2
ggacgacgggcgcc

SEQ ID NO: 1829713 - RNA, 22 nt, Human herpesvirus 2
ggacgagccaaaccagccccgc

SEQ ID NO: 1829714 - RNA, 21 nt, Human herpesvirus 2
gcguauaaaggcaggcgcgcg

SEQ ID NO: 1829715 - RNA, 17 nt, Human herpesvirus 2
gcucccggcccgggccc

SEQ ID NO: 1829716 - RNA, 12 nt, Human herpesvirus 2
guacccucucaa

SEQ ID NO: 1829717 - RNA, 16 nt, Human herpesvirus 2
guacagcauguggccc

SEQ ID NO: 1829718 - RNA, 13 nt, Human herpesvirus 2
gguuggggcgggc

SEQ ID NO: 1829719 - RNA, 19 nt, Human herpesvirus 2
gguuccccgagagcccagg

SEQ ID NO: 1829720 - RNA, 15 nt, Human herpesvirus 2
gguucccauuggccc

SEQ ID NO: 1829721 - RNA, 15 nt, Human herpesvirus 2
gguugaugggcgggg

SEQ ID NO: 1829722 - RNA, 14 nt, Human herpesvirus 2
gguuuccggccccu

SEQ ID NO: 1829723 - RNA, 13 nt, Human herpesvirus 2
guccgcggggggc

SEQ ID NO: 1829724 - RNA, 16 nt, Human herpesvirus 2
guccucgggccuacgu

SEQ ID NO: 1829725 - RNA, 16 nt, Human herpesvirus 2
guccugcggcagcgcg

SEQ ID NO: 1829726 - RNA, 20 nt, Human herpesvirus 2
guccuaaggcgccgacggcg

SEQ ID NO: 1829727 - RNA, 23 nt, Human herpesvirus 2
guccuaaggcgccgacggcggcg

SEQ ID NO: 1829728 - RNA, 23 nt, Human herpesvirus 2
guccggcggccaccccgccgcag

SEQ ID NO: 1829729 - RNA, 14 nt, Human herpesvirus 2
guccgggggcgggc

SEQ ID NO: 1829730 - RNA, 20 nt, Human herpesvirus 2
guccuucgcgggggccgggg

SEQ ID NO: 1829731 - RNA, 20 nt, Human herpesvirus 2
gucgcccccgucugucgccu

SEQ ID NO: 1829732 - RNA, 15 nt, Human herpesvirus 2
gcccgcgaccccccg

SEQ ID NO: 1829733 - RNA, 18 nt, Human herpesvirus 2
gcccgcgccgcgacggcc

SEQ ID NO: 1829734 - RNA, 20 nt, Human herpesvirus 2
gcccgcgccgcgacggcccc

SEQ ID NO: 1829735 - RNA, 22 nt, Human herpesvirus 2
gccgcgcggccacgucguccgg

SEQ ID NO: 1829736 - RNA, 15 nt, Human herpesvirus 2
gccgcgccgcugccc

SEQ ID NO: 1829737 - RNA, 17 nt, Human herpesvirus 2
gccgcgccgcugcccga

SEQ ID NO: 1829738 - RNA, 18 nt, Human herpesvirus 2
gccgcgcgagcggccgug

SEQ ID NO: 1829739 - RNA, 19 nt, Human herpesvirus 2
gccgcgaccgucgcggcga

SEQ ID NO: 1829740 - RNA, 15 nt, Human herpesvirus 2
gccgcgacggccccg

SEQ ID NO: 1829741 - RNA, 22 nt, Human herpesvirus 2
gccgcgacaagacccggcggcg

SEQ ID NO: 1829742 - RNA, 14 nt, Human herpesvirus 2
gccgccgcgcgggc

SEQ ID NO: 1829743 - RNA, 19 nt, Human herpesvirus 2
gccgcgacccacguccgua

SEQ ID NO: 1829744 - RNA, 20 nt, Human herpesvirus 2
gccggggagggcagggccgc

SEQ ID NO: 1829745 - RNA, 19 nt, Human herpesvirus 2
gccgggaaccccggcgugg

SEQ ID NO: 1829746 - RNA, 23 nt, Human herpesvirus 2
gccgggacgacgaccaugggccc

SEQ ID NO: 1829747 - RNA, 19 nt, Human herpesvirus 2
gcccgcguccccggcccuc

SEQ ID NO: 1829748 - RNA, 21 nt, Human herpesvirus 2
gcccgcgugccgcagaccacc

SEQ ID NO: 1829749 - RNA, 13 nt, Human herpesvirus 2
gcccgcggaccac

SEQ ID NO: 1829750 - RNA, 13 nt, Human herpesvirus 2
gcccggcgccgcc

SEQ ID NO: 1829751 - RNA, 23 nt, Human herpesvirus 2
gcccggaccccucaucgccgcgc

SEQ ID NO: 1829752 - RNA, 18 nt, Human herpesvirus 2
gcccggacuccgccccgg

SEQ ID NO: 1829753 - RNA, 14 nt, Human herpesvirus 2
gcccuacggcggcc

SEQ ID NO: 1829754 - RNA, 17 nt, Human herpesvirus 2
gccgccccccgucccga

SEQ ID NO: 1829755 - RNA, 17 nt, Human herpesvirus 2
gccgcccgcgccgcgac

SEQ ID NO: 1829756 - RNA, 13 nt, Human herpesvirus 2
gccgccggggggc

SEQ ID NO: 1829757 - RNA, 12 nt, Human herpesvirus 2
gccgccggccac

SEQ ID NO: 1829758 - RNA, 16 nt, Human herpesvirus 2
gccgcccaagcggccc

SEQ ID NO: 1829759 - RNA, 21 nt, Human herpesvirus 2
gcccuggacccagacacggug

SEQ ID NO: 1829760 - RNA, 20 nt, Human herpesvirus 2
gcccucacgucuucgcccac

SEQ ID NO: 1829761 - RNA, 22 nt, Human herpesvirus 2
gcgaccccgccccccgacgcca

SEQ ID NO: 1829762 - RNA, 17 nt, Human herpesvirus 2
gccuguucggggcgugu

SEQ ID NO: 1829763 - RNA, 16 nt, Human herpesvirus 2
gcgaccgucgccgccg

SEQ ID NO: 1829764 - RNA, 22 nt, Human herpesvirus 2
gcgacacgcgcccggggcgggu

SEQ ID NO: 1829765 - RNA, 13 nt, Human herpesvirus 2
gcgacgccgcggc

SEQ ID NO: 1829766 - RNA, 22 nt, Human herpesvirus 2
gcgagaaggaggggggccucgg

SEQ ID NO: 1829767 - RNA, 20 nt, Human herpesvirus 2
gcgagaaguaauaguccgug

SEQ ID NO: 1829768 - RNA, 19 nt, Human herpesvirus 2
gcgaaccgguagccggggc

SEQ ID NO: 1829769 - RNA, 20 nt, Human herpesvirus 2
gccuugaacgucacgcaggc

SEQ ID NO: 1829770 - RNA, 16 nt, Human herpesvirus 2
gccugugggucugcgc

SEQ ID NO: 1829771 - RNA, 20 nt, Human herpesvirus 2
gccugugggucugcgccacc

SEQ ID NO: 1829772 - RNA, 15 nt, Human herpesvirus 2
gccgugcgcggcccc

SEQ ID NO: 1829773 - RNA, 16 nt, Human herpesvirus 2
gccugguggucgucgg

SEQ ID NO: 1829774 - RNA, 17 nt, Human herpesvirus 2
gccgucgcacgcgcgca

SEQ ID NO: 1829775 - RNA, 17 nt, Human herpesvirus 2
gccggggcggccccgau

SEQ ID NO: 1829776 - RNA, 20 nt, Human herpesvirus 2
gcgacugccuccacgcccug

SEQ ID NO: 1829777 - RNA, 19 nt, Human herpesvirus 2
gcgcguugguccgggggcg

SEQ ID NO: 1829778 - RNA, 12 nt, Human herpesvirus 2
gcggaugugggc

SEQ ID NO: 1829779 - RNA, 13 nt, Human herpesvirus 2
gcgcugcggggac

SEQ ID NO: 1829780 - RNA, 17 nt, Human herpesvirus 2
gcgcucggcaugcgcgg

SEQ ID NO: 1829781 - RNA, 14 nt, Human herpesvirus 2
gcgcuggccccucu

SEQ ID NO: 1829782 - RNA, 18 nt, Human herpesvirus 2
gcgcuggugggacgccca

SEQ ID NO: 1829783 - RNA, 22 nt, Human herpesvirus 2
gcggcacucgaagaaguuggug

SEQ ID NO: 1829784 - RNA, 22 nt, Human herpesvirus 2
gcggcccugagccgcgcggcca

SEQ ID NO: 1829785 - RNA, 14 nt, Human herpesvirus 2
gcggcccuggagcg

SEQ ID NO: 1829786 - RNA, 16 nt, Human herpesvirus 2
gcggccccggcggccc

SEQ ID NO: 1829787 - RNA, 23 nt, Human herpesvirus 2
gcggccccuguuggagccggagc

SEQ ID NO: 1829788 - RNA, 13 nt, Human herpesvirus 2
gcaugcgacggcg

SEQ ID NO: 1829789 - RNA, 15 nt, Human herpesvirus 2
gcaguugauucgcga

SEQ ID NO: 1829790 - RNA, 12 nt, Human herpesvirus 2
gcagcgcgccga

SEQ ID NO: 1829791 - RNA, 20 nt, Human herpesvirus 2
cucguccccuggggcggcgg

SEQ ID NO: 1829792 - RNA, 17 nt, Human herpesvirus 2
cucugccugcacgagcg

SEQ ID NO: 1829793 - RNA, 20 nt, Human herpesvirus 2
cucucgggggaugguggugg

SEQ ID NO: 1829794 - RNA, 15 nt, Human herpesvirus 2
cucugccacacgugg

SEQ ID NO: 1829795 - RNA, 17 nt, Human herpesvirus 2
cucugcccgaccgggcg

SEQ ID NO: 1829796 - RNA, 16 nt, Human herpesvirus 2
cucguuccucacgggg

SEQ ID NO: 1829797 - RNA, 17 nt, Human herpesvirus 2
cugccccccggcgcggg

SEQ ID NO: 1829798 - RNA, 16 nt, Human herpesvirus 2
cugccggacgcggcac

SEQ ID NO: 1829799 - RNA, 11 nt, Human herpesvirus 2
cugcgaggugc

SEQ ID NO: 1829800 - RNA, 19 nt, Human herpesvirus 2
cugcgcauggccugcgagg

SEQ ID NO: 1829801 - RNA, 13 nt, Human herpesvirus 2
cugucggccgcgg

SEQ ID NO: 1829802 - RNA, 19 nt, Human herpesvirus 2
cuguccagcgucgucgccc

SEQ ID NO: 1829803 - RNA, 11 nt, Human herpesvirus 2
cuguccccgcc

SEQ ID NO: 1829804 - RNA, 21 nt, Human herpesvirus 2
cuggucacaaaaggcacggcg

SEQ ID NO: 1829805 - RNA, 13 nt, Human herpesvirus 2
cugggugucgacc

SEQ ID NO: 1829806 - RNA, 17 nt, Human herpesvirus 2
cuggggcggcggcgucu

SEQ ID NO: 1829807 - RNA, 22 nt, Human herpesvirus 2
cuggggcuuccguugcgcgaca

SEQ ID NO: 1829808 - RNA, 13 nt, Human herpesvirus 2
cugggcccgccga

SEQ ID NO: 1829809 - RNA, 16 nt, Human herpesvirus 2
cugggaacucgcccgc

SEQ ID NO: 1829810 - RNA, 21 nt, Human herpesvirus 2
cugggacacccagaugcgccu

SEQ ID NO: 1829811 - RNA, 20 nt, Human herpesvirus 2
cugcggcagcgcgccgacga

SEQ ID NO: 1829812 - RNA, 22 nt, Human herpesvirus 2
cuggcuggagaccgagcucgug

SEQ ID NO: 1829813 - RNA, 16 nt, Human herpesvirus 2
cugcggacuggcagcc

SEQ ID NO: 1829814 - RNA, 20 nt, Human herpesvirus 2
cugcggggaccagccgacgu

SEQ ID NO: 1829815 - RNA, 12 nt, Human herpesvirus 2
cugcggccgaca

SEQ ID NO: 1829816 - RNA, 19 nt, Human herpesvirus 2
cugcggccgacacggucgg

SEQ ID NO: 1829817 - RNA, 17 nt, Human herpesvirus 2
gcagccuauguucgcgg

SEQ ID NO: 1829818 - RNA, 13 nt, Human herpesvirus 2
gcagccgcgccgc

SEQ ID NO: 1829819 - RNA, 20 nt, Human herpesvirus 2
gcacgcgcgacugccuccac

SEQ ID NO: 1829820 - RNA, 20 nt, Human herpesvirus 2
gcacguaaaacacgggcgcu

SEQ ID NO: 1829821 - RNA, 12 nt, Human herpesvirus 2
gacgcagcggcg

SEQ ID NO: 1829822 - RNA, 16 nt, Human herpesvirus 2
gcacgcggggacccgc

SEQ ID NO: 1829823 - RNA, 18 nt, Human herpesvirus 2
gacgccaacgcgaccguc

SEQ ID NO: 1829824 - RNA, 22 nt, Human herpesvirus 2
gacgaugcauguucggcgucgu

SEQ ID NO: 1829825 - RNA, 15 nt, Human herpesvirus 2
gaccugcagccggcg

SEQ ID NO: 1829826 - RNA, 18 nt, Human herpesvirus 2
gaccugccccggcgcguc

SEQ ID NO: 1829827 - RNA, 15 nt, Human herpesvirus 2
gaccgucgccgccgg

SEQ ID NO: 1829828 - RNA, 17 nt, Human herpesvirus 2
gaccgucgccgccggcc

SEQ ID NO: 1829829 - RNA, 17 nt, Human herpesvirus 2
cuucgcggcggccgcac

SEQ ID NO: 1829830 - RNA, 14 nt, Human herpesvirus 2
cuucccccgcccac

SEQ ID NO: 1829831 - RNA, 13 nt, Human herpesvirus 2
cuguggcggucgg

SEQ ID NO: 1829832 - RNA, 20 nt, Human herpesvirus 2
cggcacacaugauuccggcc

SEQ ID NO: 1829833 - RNA, 18 nt, Human herpesvirus 2
cggcaacaaagggccucc

SEQ ID NO: 1829834 - RNA, 14 nt, Human herpesvirus 2
cggcacugggguga

SEQ ID NO: 1829835 - RNA, 15 nt, Human herpesvirus 2
cgcucggcaugcgcg

SEQ ID NO: 1829836 - RNA, 18 nt, Human herpesvirus 2
cgccuccccgcuggagcc

SEQ ID NO: 1829837 - RNA, 15 nt, Human herpesvirus 2
cgccucccggccgcc

SEQ ID NO: 1829838 - RNA, 18 nt, Human herpesvirus 2
cgccucccggggggucgg

SEQ ID NO: 1829839 - RNA, 14 nt, Human herpesvirus 2
cggagaggcccgcc

SEQ ID NO: 1829840 - RNA, 16 nt, Human herpesvirus 2
cggagaggcccgccgc

SEQ ID NO: 1829841 - RNA, 16 nt, Human herpesvirus 2
cggacugcagccccgg

SEQ ID NO: 1829842 - RNA, 17 nt, Human herpesvirus 2
cggcaaccccaccuucg

SEQ ID NO: 1829843 - RNA, 17 nt, Human herpesvirus 2
cggcaaccccagggcgu

SEQ ID NO: 1829844 - RNA, 23 nt, Human herpesvirus 2
cggagucccccggcuccgaguug

SEQ ID NO: 1829845 - RNA, 19 nt, Human herpesvirus 2
cggagcgccgucgucgccc

SEQ ID NO: 1829846 - RNA, 19 nt, Human herpesvirus 2
cggagcucgacgcacagcg

SEQ ID NO: 1829847 - RNA, 14 nt, Human herpesvirus 2
cgaucugccccgac

SEQ ID NO: 1829848 - RNA, 17 nt, Human herpesvirus 2
cgaugacguggguccgg

SEQ ID NO: 1829849 - RNA, 17 nt, Human herpesvirus 2
cgauagccuccgaggug

SEQ ID NO: 1829850 - RNA, 19 nt, Human herpesvirus 2
cgccgggaaccccggcgug

SEQ ID NO: 1829851 - RNA, 16 nt, Human herpesvirus 2
cgccguggacgccccc

SEQ ID NO: 1829852 - RNA, 20 nt, Human herpesvirus 2
cgccgggcgcgcccaccggu

SEQ ID NO: 1829853 - RNA, 18 nt, Human herpesvirus 2
cgccgggcgcgcggcgcg

SEQ ID NO: 1829854 - RNA, 17 nt, Human herpesvirus 2
cgcccaagcggcccgag

SEQ ID NO: 1829855 - RNA, 23 nt, Human herpesvirus 2
cgccggccgguccucgggccuac

SEQ ID NO: 1829856 - RNA, 14 nt, Human herpesvirus 2
cgccaucgugcgcu

SEQ ID NO: 1829857 - RNA, 22 nt, Human herpesvirus 2
cgcccaacccaaccgacucccu

SEQ ID NO: 1829858 - RNA, 16 nt, Human herpesvirus 2
cgccccccgucccgag

SEQ ID NO: 1829859 - RNA, 16 nt, Human herpesvirus 2
cgcccccacccccgag

SEQ ID NO: 1829860 - RNA, 22 nt, Human herpesvirus 2
cgccggccaaccgcgcgccgcc

SEQ ID NO: 1829861 - RNA, 21 nt, Human herpesvirus 2
cgccaugcaacgccgggcgcg

SEQ ID NO: 1829862 - RNA, 14 nt, Human herpesvirus 2
cgacugucgugccg

SEQ ID NO: 1829863 - RNA, 17 nt, Human herpesvirus 2
cgacuuccucgugcgca

SEQ ID NO: 1829864 - RNA, 23 nt, Human herpesvirus 2
cgagacauggggaacccccagac

SEQ ID NO: 1829865 - RNA, 18 nt, Human herpesvirus 2
cgagaagcgggaccgucg

SEQ ID NO: 1829866 - RNA, 21 nt, Human herpesvirus 2
cgaccccgccccccgacgcca

SEQ ID NO: 1829867 - RNA, 15 nt, Human herpesvirus 2
cgagggcgagcucgg

SEQ ID NO: 1829868 - RNA, 13 nt, Human herpesvirus 2
cgacagcggggac

SEQ ID NO: 1829869 - RNA, 20 nt, Human herpesvirus 2
cgacagcggggacccgggcg

SEQ ID NO: 1829870 - RNA, 15 nt, Human herpesvirus 2
cgacaucaaccaccu

SEQ ID NO: 1829871 - RNA, 21 nt, Human herpesvirus 2
cgaccaaaacggaccccgcgu

SEQ ID NO: 1829872 - RNA, 15 nt, Human herpesvirus 2
cgacaacguccgggc

SEQ ID NO: 1829873 - RNA, 14 nt, Human herpesvirus 2
cgacacccgggccc

SEQ ID NO: 1829874 - RNA, 13 nt, Human herpesvirus 2
cgaaggucugcgc

SEQ ID NO: 1829875 - RNA, 15 nt, Human herpesvirus 2
cgaccgacgggcccc

SEQ ID NO: 1829876 - RNA, 18 nt, Human herpesvirus 2
cgaccgccccgcgccggc

SEQ ID NO: 1829877 - RNA, 14 nt, Human herpesvirus 2
cgaccaugggcccc

SEQ ID NO: 1829878 - RNA, 13 nt, Human herpesvirus 2
cgaccagcggccc

SEQ ID NO: 1829879 - RNA, 18 nt, Human herpesvirus 2
cgaccagcguccugcgcg

SEQ ID NO: 1829880 - RNA, 22 nt, Human herpesvirus 2
ccacucgucgccaacggccagc

SEQ ID NO: 1829881 - RNA, 12 nt, Human herpesvirus 2
ccagacgcccgc

SEQ ID NO: 1829882 - RNA, 18 nt, Human herpesvirus 2
ccugcagaugcugcccgc

SEQ ID NO: 1829883 - RNA, 14 nt, Human herpesvirus 2
ccuggcucgccgug

SEQ ID NO: 1829884 - RNA, 16 nt, Human herpesvirus 2
cauacgauauucgcgu

SEQ ID NO: 1829885 - RNA, 15 nt, Human herpesvirus 2
caugacaacgacgcc

SEQ ID NO: 1829886 - RNA, 16 nt, Human herpesvirus 2
caugaccucucgccgc

SEQ ID NO: 1829887 - RNA, 21 nt, Human herpesvirus 2
caugacgacacgucccgccac

SEQ ID NO: 1829888 - RNA, 15 nt, Human herpesvirus 2
caugcgacggcgucu

SEQ ID NO: 1829889 - RNA, 20 nt, Human herpesvirus 2
augaccucccggcccgccga

SEQ ID NO: 1829890 - RNA, 15 nt, Human herpesvirus 2
augcaacgccgggcg

SEQ ID NO: 1829891 - RNA, 21 nt, Human herpesvirus 2
cagcguccggcuggcggcgcg

SEQ ID NO: 1829892 - RNA, 12 nt, Human herpesvirus 2
agccgcgcgacc

SEQ ID NO: 1829893 - RNA, 14 nt, Human herpesvirus 2
agcccccggcaucg

SEQ ID NO: 1829894 - RNA, 18 nt, Human herpesvirus 2
agccgcccaagcggcccg

SEQ ID NO: 1829895 - RNA, 18 nt, Human herpesvirus 2
agcguccggcuggcggcg

SEQ ID NO: 1829896 - RNA, 17 nt, Human herpesvirus 2
agcguggggcgcgcacc

SEQ ID NO: 1829897 - RNA, 13 nt, Human herpesvirus 2
agcucccugcggc

SEQ ID NO: 1829898 - RNA, 14 nt, Human herpesvirus 2
aggggugggcgugu

SEQ ID NO: 1829899 - RNA, 21 nt, Human herpesvirus 2
agggcgucgcuaacgagcgcg

SEQ ID NO: 1829900 - RNA, 15 nt, Human herpesvirus 2
agcugcucgcgcacc

SEQ ID NO: 1829901 - RNA, 13 nt, Human herpesvirus 2
aggguggggcuga

SEQ ID NO: 1829902 - RNA, 12 nt, Human herpesvirus 2
aggugcggagcc

SEQ ID NO: 1829903 - RNA, 18 nt, Human herpesvirus 2
uuuugucguuccuuccuc

SEQ ID NO: 1829904 - RNA, 14 nt, Human herpesvirus 2
uccccuggggcggc

SEQ ID NO: 1829905 - RNA, 16 nt, Human herpesvirus 2
ucgaaucugggaagac

SEQ ID NO: 1829906 - RNA, 13 nt, Human herpesvirus 2
ucccgagccccgc

SEQ ID NO: 1829907 - RNA, 20 nt, Human herpesvirus 2
ucccgauggccgccccgcag

SEQ ID NO: 1829908 - RNA, 22 nt, Human herpesvirus 2
ucccgauguuguguucgccgac

SEQ ID NO: 1829909 - RNA, 19 nt, Human herpesvirus 2
ucccgcaagagccugccgu

SEQ ID NO: 1829910 - RNA, 15 nt, Human herpesvirus 2
ucccgcagaaccucg

SEQ ID NO: 1829911 - RNA, 20 nt, Human herpesvirus 2
ucccggccgccauccccgcg

SEQ ID NO: 1829912 - RNA, 23 nt, Human herpesvirus 2
ucccggccgccauccccgcgcau

SEQ ID NO: 1829913 - RNA, 13 nt, Human herpesvirus 2
ucccgcccgccag

SEQ ID NO: 1829914 - RNA, 19 nt, Human herpesvirus 2
ucccggucggggccgccag

SEQ ID NO: 1829915 - RNA, 18 nt, Human herpesvirus 2
ucccugcggcuggcgcgg

SEQ ID NO: 1829916 - RNA, 19 nt, Human herpesvirus 2
ucccugcggcuggcgcggu

SEQ ID NO: 1829917 - RNA, 20 nt, Human herpesvirus 2
ucggugccgcuuuaccccgc

SEQ ID NO: 1829918 - RNA, 18 nt, Human herpesvirus 2
ucggggggguacggcgag

SEQ ID NO: 1829919 - RNA, 22 nt, Human herpesvirus 2
ucgggggguggcggucgcgucc

SEQ ID NO: 1829920 - RNA, 14 nt, Human herpesvirus 2
ucgggcggacgucc

SEQ ID NO: 1829921 - RNA, 17 nt, Human herpesvirus 2
uuucggcacccguccuc

SEQ ID NO: 1829922 - RNA, 22 nt, Human herpesvirus 2
ucgugggggagugcgcucuucg

SEQ ID NO: 1829923 - RNA, 12 nt, Human herpesvirus 2
uuuccgccgccg

SEQ ID NO: 1829924 - RNA, 15 nt, Human herpesvirus 2
gcacacgccaucgac

SEQ ID NO: 1829925 - RNA, 13 nt, Human herpesvirus 2
gaugggcgggggg

SEQ ID NO: 1829926 - RNA, 18 nt, Human herpesvirus 2
gcaacuuuuaaugggccg

SEQ ID NO: 1829927 - RNA, 20 nt, Human herpesvirus 2
cgcgcaucucuggcuccagg

SEQ ID NO: 1829928 - RNA, 20 nt, Human herpesvirus 2
cgucgcuccggcucccggcc

SEQ ID NO: 1829929 - RNA, 23 nt, Human herpesvirus 2
cgcgccuacgagcccgcggucgu

SEQ ID NO: 1829930 - RNA, 22 nt, Human herpesvirus 2
cgugcacagagccgauccggcc

SEQ ID NO: 1829931 - RNA, 16 nt, Human herpesvirus 2
cgucucgucgccgcuc

SEQ ID NO: 1829932 - RNA, 18 nt, Human herpesvirus 2
cgugccaacucgcggcac

SEQ ID NO: 1829933 - RNA, 17 nt, Human herpesvirus 2
cgugccgcagaccaccu

SEQ ID NO: 1829934 - RNA, 21 nt, Human herpesvirus 2
cgugcgcucgcucuccgugcc

SEQ ID NO: 1829935 - RNA, 22 nt, Human herpesvirus 2
cuaccgcggcuucuucgccgcc

SEQ ID NO: 1829936 - RNA, 21 nt, Human herpesvirus 2
gaggccucauccggcccgcca

SEQ ID NO: 1829937 - RNA, 17 nt, Human herpesvirus 2
gcaaacgguaagcagcg

SEQ ID NO: 1829938 - RNA, 15 nt, Human herpesvirus 2
gcaacacccggcgcc

SEQ ID NO: 1829939 - RNA, 22 nt, Human herpesvirus 2
gcaaccccaccuucgccuccgc

SEQ ID NO: 1829940 - RNA, 16 nt, Human herpesvirus 2
gaggaggaggaggggg

SEQ ID NO: 1829941 - RNA, 12 nt, Human herpesvirus 2
cacgcgcuggcc

SEQ ID NO: 1829942 - RNA, 12 nt, Human herpesvirus 2
cacggccccgaa

SEQ ID NO: 1829943 - RNA, 13 nt, Human herpesvirus 2
cacggacccgccc

SEQ ID NO: 1829944 - RNA, 17 nt, Human herpesvirus 2
cacgccguggacgcccc

SEQ ID NO: 1829945 - RNA, 19 nt, Human herpesvirus 2
cagacuggccgugcugggc

SEQ ID NO: 1829946 - RNA, 22 nt, Human herpesvirus 2
cagagacccugccccccggcgc

SEQ ID NO: 1829947 - RNA, 17 nt, Human herpesvirus 2
cacggugcgugcggccc

SEQ ID NO: 1829948 - RNA, 17 nt, Human herpesvirus 2
acuggcagccgggacga

SEQ ID NO: 1829949 - RNA, 17 nt, Human herpesvirus 2
cacaguuccgggaaggc

SEQ ID NO: 1829950 - RNA, 21 nt, Human herpesvirus 2
uugucgccggcgacacccacc

SEQ ID NO: 1829951 - RNA, 18 nt, Human herpesvirus 2
uuggcaaacacaccgggc

SEQ ID NO: 1829952 - RNA, 16 nt, Human herpesvirus 2
uugggcggcccccggc

SEQ ID NO: 1829953 - RNA, 17 nt, Human herpesvirus 2
uugggucugcgucgucc

SEQ ID NO: 1829954 - RNA, 17 nt, Human herpesvirus 2
uuagccaccgcgcccac

SEQ ID NO: 1829955 - RNA, 15 nt, Human herpesvirus 2
uguuugugcgggugc

SEQ ID NO: 1829956 - RNA, 19 nt, Human herpesvirus 2
uuaagcggaacccgcgggc

SEQ ID NO: 1829957 - RNA, 21 nt, Human herpesvirus 2
uucccaacacgccugcccccg

SEQ ID NO: 1829958 - RNA, 13 nt, Human herpesvirus 2
uucaucacccccg

SEQ ID NO: 1829959 - RNA, 11 nt, Human herpesvirus 2
uucccccggga

SEQ ID NO: 1829960 - RNA, 17 nt, Human herpesvirus 2
uuccgcggacgccgggc

SEQ ID NO: 1829961 - RNA, 15 nt, Human herpesvirus 2
uuccgcguccgcugg

SEQ ID NO: 1829962 - RNA, 21 nt, Human herpesvirus 2
uucgcggcggccgcacccacg

SEQ ID NO: 1829963 - RNA, 20 nt, Human herpesvirus 2
uugagcggaacgccccgggc

SEQ ID NO: 1829964 - RNA, 14 nt, Human herpesvirus 2
uugcccccccgggg

SEQ ID NO: 1829965 - RNA, 22 nt, Human herpesvirus 2
uugcgcgacacgcgcccggggc

SEQ ID NO: 1829966 - RNA, 12 nt, Human herpesvirus 2
ugggagccccgc

SEQ ID NO: 1829967 - RNA, 11 nt, Human herpesvirus 2
uggcgucggag

SEQ ID NO: 1829968 - RNA, 16 nt, Human herpesvirus 2
uggcgucggcggcccc

SEQ ID NO: 1829969 - RNA, 22 nt, Human herpesvirus 2
uggcggccgccgcaacacccgg

SEQ ID NO: 1829970 - RNA, 14 nt, Human herpesvirus 2
uggcgaggggcggg

SEQ ID NO: 1829971 - RNA, 23 nt, Human herpesvirus 2
uggcgaccgucuuugggccccgc

SEQ ID NO: 1829972 - RNA, 15 nt, Human herpesvirus 2
uggccgugcgcggcc

SEQ ID NO: 1829973 - RNA, 14 nt, Human herpesvirus 2
uggccgcgaccguc

SEQ ID NO: 1829974 - RNA, 23 nt, Human herpesvirus 2
ugcggccgacacggucggaauuu

SEQ ID NO: 1829975 - RNA, 21 nt, Human herpesvirus 2
ugcgggaugugucgcggggac

SEQ ID NO: 1829976 - RNA, 19 nt, Human herpesvirus 2
ugcggggaccgcaccggac

SEQ ID NO: 1829977 - RNA, 20 nt, Human herpesvirus 2
ugggcggggggguucgggcg

SEQ ID NO: 1829978 - RNA, 22 nt, Human herpesvirus 2
ugggccugugggucugcgccac

SEQ ID NO: 1829979 - RNA, 23 nt, Human herpesvirus 2
ugggccugugggucugcgccacc

SEQ ID NO: 1829980 - RNA, 16 nt, Human herpesvirus 2
ugggcccgccgaccgc

SEQ ID NO: 1829981 - RNA, 11 nt, Human herpesvirus 2
ugggccgacgu

SEQ ID NO: 1829982 - RNA, 22 nt, Human herpesvirus 2
ugggcgugucguugggcggccc

SEQ ID NO: 1829983 - RNA, 14 nt, Human herpesvirus 2
ugggcucggcgucg

SEQ ID NO: 1829984 - RNA, 19 nt, Human herpesvirus 2
uggggacgacgggcgcccc

SEQ ID NO: 1829985 - RNA, 16 nt, Human herpesvirus 2
uggggagucgggcccc

SEQ ID NO: 1829986 - RNA, 23 nt, Human herpesvirus 2
uggugcaguuugagcagccgcgc

SEQ ID NO: 1829987 - RNA, 13 nt, Human herpesvirus 2
uggugcgccgccg

SEQ ID NO: 1829988 - RNA, 14 nt, Human herpesvirus 2
uggugguggggugu

SEQ ID NO: 1829989 - RNA, 16 nt, Human herpesvirus 2
uggucgugggggcgcu

SEQ ID NO: 1829990 - RNA, 16 nt, Human herpesvirus 2
ugggggaacgcgcacc

SEQ ID NO: 1829991 - RNA, 17 nt, Human herpesvirus 2
uguaaaacgcgggcggg

SEQ ID NO: 1829992 - RNA, 16 nt, Human herpesvirus 2
ugguccacccgggacg

SEQ ID NO: 1829993 - RNA, 21 nt, Human herpesvirus 2
uguacgacagcggggacccgg

SEQ ID NO: 1829994 - RNA, 13 nt, Human herpesvirus 2
ugccuccacgccc

SEQ ID NO: 1829995 - RNA, 14 nt, Human herpesvirus 2
ugcgcaugggccgc

SEQ ID NO: 1829996 - RNA, 20 nt, Human herpesvirus 2
ucugccccgcgucgggaucc

SEQ ID NO: 1829997 - RNA, 21 nt, Human herpesvirus 2
ucuucgcgggcaggccgcggc

SEQ ID NO: 1829998 - RNA, 14 nt, Human herpesvirus 2
ucuuguagggcguu

SEQ ID NO: 1829999 - RNA, 14 nt, Human herpesvirus 2
ugcaagcgggcggg

SEQ ID NO: 1830000 - RNA, 16 nt, Human herpesvirus 2
ucucugguuucgggcg

SEQ ID NO: 1830001 - RNA, 15 nt, Human herpesvirus 2
ucucccgggggcgcu

SEQ ID NO: 1830002 - RNA, 14 nt, Human herpesvirus 2
uaggccagagcguu

SEQ ID NO: 1830003 - RNA, 22 nt, Human herpesvirus 2
uagugucggagaggcccgccgc

SEQ ID NO: 1830004 - RNA, 23 nt, Human herpesvirus 2
uaguccgcgccuccugcucgacc

SEQ ID NO: 1830005 - RNA, 15 nt, Human herpesvirus 2
uaccugacgcggccc

SEQ ID NO: 1830006 - RNA, 12 nt, Human herpesvirus 2
uacgggggcggg

SEQ ID NO: 1830007 - RNA, 15 nt, Human herpesvirus 2
gugucucgcggcccg

SEQ ID NO: 1830008 - RNA, 22 nt, Human herpesvirus 2
guggugcaguuugagcagccgc

SEQ ID NO: 1830009 - RNA, 19 nt, Human herpesvirus 2
guggucguggugcuggcca

SEQ ID NO: 1830010 - RNA, 23 nt, Human herpesvirus 2
guggucguggugcuggccaaugc

SEQ ID NO: 1830011 - RNA, 15 nt, Human herpesvirus 2
guggggggguggugg

SEQ ID NO: 1830012 - RNA, 22 nt, Human herpesvirus 2
gugggucugcgccaccggccug

SEQ ID NO: 1830013 - RNA, 15 nt, Human herpesvirus 2
gugugcccgcccccg

SEQ ID NO: 1830014 - RNA, 15 nt, Human herpesvirus 2
guggacgcagcggcg

SEQ ID NO: 1830015 - RNA, 15 nt, Human herpesvirus 2
cgggcgacgccgcgg

SEQ ID NO: 1830016 - RNA, 17 nt, Human herpesvirus 2
cgggcgaaaaggcccgg

SEQ ID NO: 1830017 - RNA, 14 nt, Human herpesvirus 2
cgggcgggggcgcg

SEQ ID NO: 1830018 - RNA, 14 nt, Human herpesvirus 2
cgggcgggggucgg

SEQ ID NO: 1830019 - RNA, 17 nt, Human herpesvirus 2
cgggcgggggucgggcg

SEQ ID NO: 1830020 - RNA, 13 nt, Human herpesvirus 2
cggggacgcacgg

SEQ ID NO: 1830021 - RNA, 22 nt, Human herpesvirus 2
cgggcguuauaagccgccgcac

SEQ ID NO: 1830022 - RNA, 11 nt, Human herpesvirus 2
cgggguggugg

SEQ ID NO: 1830023 - RNA, 19 nt, Human herpesvirus 2
cggggugguggacgcgaga

SEQ ID NO: 1830024 - RNA, 22 nt, Human herpesvirus 2
cgguauggcugcccccgcgcac

SEQ ID NO: 1830025 - RNA, 18 nt, Human herpesvirus 2
cgggggcggugacgcccg

SEQ ID NO: 1830026 - RNA, 10 nt, Human herpesvirus 2
cgggggucgg

SEQ ID NO: 1830027 - RNA, 18 nt, Human herpesvirus 2
cggggccguggggcccca

SEQ ID NO: 1830028 - RNA, 19 nt, Human herpesvirus 2
cgggggacgggccgcccgg

SEQ ID NO: 1830029 - RNA, 22 nt, Human herpesvirus 2
cgggggaucugucgccggcgug

SEQ ID NO: 1830030 - RNA, 18 nt, Human herpesvirus 2
cggucggccagcacgacc

SEQ ID NO: 1830031 - RNA, 18 nt, Human herpesvirus 2
cguccggcuggcggcgcg

SEQ ID NO: 1830032 - RNA, 22 nt, Human herpesvirus 2
cguccggcuggcggcgcggcac

SEQ ID NO: 1830033 - RNA, 13 nt, Human herpesvirus 2
cgucccgccacac

SEQ ID NO: 1830034 - RNA, 15 nt, Human herpesvirus 2
cgucacgcaggccgc

SEQ ID NO: 1830035 - RNA, 14 nt, Human herpesvirus 2
cggugaucgaggug

SEQ ID NO: 1830036 - RNA, 22 nt, Human herpesvirus 2
cgucacgagccccugggccgcu

SEQ ID NO: 1830037 - RNA, 15 nt, Human herpesvirus 2
cgucgcccuagaggc

SEQ ID NO: 1830038 - RNA, 22 nt, Human herpesvirus 2
cguccucacggccaacgaggac

SEQ ID NO: 1830039 - RNA, 22 nt, Human herpesvirus 2
cguccugcggcagcgcgccgac

SEQ ID NO: 1830040 - RNA, 17 nt, Human herpesvirus 2
cgucgaccggggacucc

SEQ ID NO: 1830041 - RNA, 21 nt, Human herpesvirus 2
cgucgccgaauacgacgccca

SEQ ID NO: 1830042 - RNA, 22 nt, Human herpesvirus 2
gaagcccgaacggaaggccucc

SEQ ID NO: 1830043 - RNA, 15 nt, Human herpesvirus 2
gaacggucuccgcca

SEQ ID NO: 1830044 - RNA, 20 nt, Human herpesvirus 2
gaacggucuccgccaugcaa

SEQ ID NO: 1830045 - RNA, 24 nt, Human herpesvirus 2
gaacgugguguugggcgccggcca

SEQ ID NO: 1830046 - RNA, 21 nt, Human herpesvirus 2
gaccgccccccccggcggggc

SEQ ID NO: 1830047 - RNA, 16 nt, Human herpesvirus 2
gaccgccccgcgccgg

SEQ ID NO: 1830048 - RNA, 14 nt, Human herpesvirus 2
gaccgccggcccca

SEQ ID NO: 1830049 - RNA, 13 nt, Human herpesvirus 2
gacccugcccccc

SEQ ID NO: 1830050 - RNA, 19 nt, Human herpesvirus 2
gacccugccccccggcgcg

SEQ ID NO: 1830051 - RNA, 18 nt, Human herpesvirus 2
gacccuguggcgggcgcu

SEQ ID NO: 1830052 - RNA, 16 nt, Human herpesvirus 2
gaccccgaccccgagc

SEQ ID NO: 1830053 - RNA, 12 nt, Human herpesvirus 2
gaccccgcgugc

SEQ ID NO: 1830054 - RNA, 19 nt, Human herpesvirus 2
gacccaccgcaccaccaua

SEQ ID NO: 1830055 - RNA, 20 nt, Human herpesvirus 2
gaccacccuaaggaugcccg

SEQ ID NO: 1830056 - RNA, 16 nt, Human herpesvirus 2
gaccaccggccgaggc

SEQ ID NO: 1830057 - RNA, 21 nt, Human herpesvirus 2
gaccacgcgcacgucgggggg

SEQ ID NO: 1830058 - RNA, 22 nt, Human herpesvirus 2
gaccacgcgcacgucggggggc

SEQ ID NO: 1830059 - RNA, 21 nt, Human herpesvirus 2
cuucggggacuugacggucgc

SEQ ID NO: 1830060 - RNA, 13 nt, Human herpesvirus 2
cuggcggcgcggc

SEQ ID NO: 1830061 - RNA, 20 nt, Human herpesvirus 2
cuucgucguagaucgggucc

SEQ ID NO: 1830062 - RNA, 14 nt, Human herpesvirus 2
cuggcgauccuggg

SEQ ID NO: 1830063 - RNA, 15 nt, Human herpesvirus 2
cuugggggggcgucc

SEQ ID NO: 1830064 - RNA, 15 nt, Human herpesvirus 2
cugcagaugcugccc

SEQ ID NO: 1830065 - RNA, 20 nt, Human herpesvirus 2
cuggacccagacacggugcg

SEQ ID NO: 1830066 - RNA, 20 nt, Human herpesvirus 2
gccccacgucaccgggggcc

SEQ ID NO: 1830067 - RNA, 15 nt, Human herpesvirus 2
gccccagagcccccc

SEQ ID NO: 1830068 - RNA, 18 nt, Human herpesvirus 2
gccagugcaucccagacg

SEQ ID NO: 1830069 - RNA, 14 nt, Human herpesvirus 2
gacccagucgccca

SEQ ID NO: 1830070 - RNA, 21 nt, Human herpesvirus 2
gacgggaguuccgacgacgcg

SEQ ID NO: 1830071 - RNA, 23 nt, Human herpesvirus 2
gacgggugggccuagccgugggc

SEQ ID NO: 1830072 - RNA, 23 nt, Human herpesvirus 2
gacucacucguggaugccggggc

SEQ ID NO: 1830073 - RNA, 16 nt, Human herpesvirus 2
gccagggcuggcaccg

SEQ ID NO: 1830074 - RNA, 17 nt, Human herpesvirus 2
gugccccacccccgagc

SEQ ID NO: 1830075 - RNA, 19 nt, Human herpesvirus 2
gugccaacucgcggcaccg

SEQ ID NO: 1830076 - RNA, 12 nt, Human herpesvirus 2
gucucggccccc

SEQ ID NO: 1830077 - RNA, 16 nt, Human herpesvirus 2
gucguuggccagcgcg

SEQ ID NO: 1830078 - RNA, 19 nt, Human herpesvirus 2
gucugucgcgacgccgcgg

SEQ ID NO: 1830079 - RNA, 15 nt, Human herpesvirus 2
gucugcgccaccggc

SEQ ID NO: 1830080 - RNA, 21 nt, Human herpesvirus 2
gucuggugugacgcgaugggg

SEQ ID NO: 1830081 - RNA, 15 nt, Human herpesvirus 2
gucugugggugguga

SEQ ID NO: 1830082 - RNA, 23 nt, Human herpesvirus 2
gucuuccggggacacgcggcggg

SEQ ID NO: 1830083 - RNA, 19 nt, Human herpesvirus 2
gucuugauuuacgaggggg

SEQ ID NO: 1830084 - RNA, 21 nt, Human herpesvirus 2
gugacucgccauggcggccgc

SEQ ID NO: 1830085 - RNA, 19 nt, Human herpesvirus 2
gugacuuggugcgccgccg

SEQ ID NO: 1830086 - RNA, 21 nt, Human herpesvirus 2
ggacacgcaacaacggcgggc

SEQ ID NO: 1830087 - RNA, 16 nt, Human herpesvirus 2
ggacacgcggcggguc

SEQ ID NO: 1830088 - RNA, 12 nt, Human herpesvirus 2
ggaccggccccc

SEQ ID NO: 1830089 - RNA, 14 nt, Human herpesvirus 2
guaggcccgggggg

SEQ ID NO: 1830090 - RNA, 16 nt, Human herpesvirus 2
guaggguccgcggggg

SEQ ID NO: 1830091 - RNA, 20 nt, Human herpesvirus 2
guagacgggcucgccagcga

SEQ ID NO: 1830092 - RNA, 13 nt, Human herpesvirus 2
gucggugccagac

SEQ ID NO: 1830093 - RNA, 14 nt, Human herpesvirus 2
gucgggcguggggg

SEQ ID NO: 1830094 - RNA, 15 nt, Human herpesvirus 2
gucggagaggcccgc

SEQ ID NO: 1830095 - RNA, 20 nt, Human herpesvirus 2
gucggcggccccggcggccc

SEQ ID NO: 1830096 - RNA, 19 nt, Human herpesvirus 2
gucgcgcuuuuccgccgcc

SEQ ID NO: 1830097 - RNA, 21 nt, Human herpesvirus 2
gucgcgcuuuuccgccgccgg

SEQ ID NO: 1830098 - RNA, 20 nt, Human herpesvirus 2
gucgcggggacagccccggg

SEQ ID NO: 1830099 - RNA, 18 nt, Human herpesvirus 2
gucgcuaacgagcgcgcu

SEQ ID NO: 1830100 - RNA, 15 nt, Human herpesvirus 2
guauucccccgcggg

SEQ ID NO: 1830101 - RNA, 18 nt, Human herpesvirus 2
ggaacuguguuucccccc

SEQ ID NO: 1830102 - RNA, 15 nt, Human herpesvirus 2
gucaaaggccagcag

SEQ ID NO: 1830103 - RNA, 19 nt, Human herpesvirus 2
gucacgcaggccgccccca

SEQ ID NO: 1830104 - RNA, 14 nt, Human herpesvirus 2
gcgggggccggggc

SEQ ID NO: 1830105 - RNA, 20 nt, Human herpesvirus 2
gcggggggggggcugcgggc

SEQ ID NO: 1830106 - RNA, 20 nt, Human herpesvirus 2
gcgggugcccauggcgucgg

SEQ ID NO: 1830107 - RNA, 19 nt, Human herpesvirus 2
gcgguagcggacgcacggc

SEQ ID NO: 1830108 - RNA, 22 nt, Human herpesvirus 2
gcgugcguucuggcggcccugg

SEQ ID NO: 1830109 - RNA, 15 nt, Human herpesvirus 2
gcgggcgcggcacac

SEQ ID NO: 1830110 - RNA, 14 nt, Human herpesvirus 2
gcggggcaccggca

SEQ ID NO: 1830111 - RNA, 21 nt, Human herpesvirus 2
gcgggcgggaugaugcggggc

SEQ ID NO: 1830112 - RNA, 15 nt, Human herpesvirus 2
gcgggcgggggucgg

SEQ ID NO: 1830113 - RNA, 21 nt, Human herpesvirus 2
gcgggcguccccgagcggcgc

SEQ ID NO: 1830114 - RNA, 21 nt, Human herpesvirus 2
gcgugucguugggcggccccc

SEQ ID NO: 1830115 - RNA, 17 nt, Human herpesvirus 2
gcguucuggcggcccug

SEQ ID NO: 1830116 - RNA, 16 nt, Human herpesvirus 2
gcguugccgggggcca

SEQ ID NO: 1830117 - RNA, 14 nt, Human herpesvirus 2
gcguggccgcgacc

SEQ ID NO: 1830118 - RNA, 15 nt, Human herpesvirus 2
gcgugcugcugagcc

SEQ ID NO: 1830119 - RNA, 23 nt, Human herpesvirus 2
gcgugcugcugagcccugccccg

SEQ ID NO: 1830120 - RNA, 17 nt, Human herpesvirus 2
gccucugcccgaccggg

SEQ ID NO: 1830121 - RNA, 13 nt, Human herpesvirus 2
gccugcacgagcg

SEQ ID NO: 1830122 - RNA, 15 nt, Human herpesvirus 2
gccucgggcggcgug

SEQ ID NO: 1830123 - RNA, 24 nt, Human herpesvirus 2
gccucgggcggcguggccgcgacc

SEQ ID NO: 1830124 - RNA, 14 nt, Human herpesvirus 2
gcgggaggggcggg

SEQ ID NO: 1830125 - RNA, 21 nt, Human herpesvirus 2
gcgggaugugucgcggggaca

SEQ ID NO: 1830126 - RNA, 17 nt, Human herpesvirus 2
gccuggaucggcgucgg

SEQ ID NO: 1830127 - RNA, 18 nt, Human herpesvirus 2
gcggcuucuucgccgccc

SEQ ID NO: 1830128 - RNA, 15 nt, Human herpesvirus 2
gcggcuugcgcgacc

SEQ ID NO: 1830129 - RNA, 19 nt, Human herpesvirus 2
gccugccgucgcacgcgcg

SEQ ID NO: 1830130 - RNA, 14 nt, Human herpesvirus 2
gcgggaagcgccgc

SEQ ID NO: 1830131 - RNA, 15 nt, Human herpesvirus 2
gcgggcccggggccc

SEQ ID NO: 1830132 - RNA, 16 nt, Human herpesvirus 2
gcgggcaggccgcggc

SEQ ID NO: 1830133 - RNA, 18 nt, Human herpesvirus 2
gcgggcaggccgcggcgc

SEQ ID NO: 1830134 - RNA, 15 nt, Human herpesvirus 2
gcuacccgcauccgc

SEQ ID NO: 1830135 - RNA, 18 nt, Human herpesvirus 2
gcuacccgcauccgcacg

SEQ ID NO: 1830136 - RNA, 15 nt, Human herpesvirus 2
gcucgaccagcggcc

SEQ ID NO: 1830137 - RNA, 18 nt, Human herpesvirus 2
gcucgcggagggcggcca

SEQ ID NO: 1830138 - RNA, 14 nt, Human herpesvirus 2
gcugccgccgcggg

SEQ ID NO: 1830139 - RNA, 13 nt, Human herpesvirus 2
gcucgcggggccg

SEQ ID NO: 1830140 - RNA, 22 nt, Human herpesvirus 2
gcuugugcccucguaggcccgg

SEQ ID NO: 1830141 - RNA, 21 nt, Human herpesvirus 2
gccgacccgucuagcggccgg

SEQ ID NO: 1830142 - RNA, 16 nt, Human herpesvirus 2
gccgcgguggcgucgg

SEQ ID NO: 1830143 - RNA, 21 nt, Human herpesvirus 2
gccgcgguggcgucggcggcc

SEQ ID NO: 1830144 - RNA, 22 nt, Human herpesvirus 2
gccgcgguggcgucggcggccc

SEQ ID NO: 1830145 - RNA, 16 nt, Human herpesvirus 2
gccgacggcggcgcac

SEQ ID NO: 1830146 - RNA, 16 nt, Human herpesvirus 2
gccgacgugccgggga

SEQ ID NO: 1830147 - RNA, 13 nt, Human herpesvirus 2
gccgacuuccgug

SEQ ID NO: 1830148 - RNA, 22 nt, Human herpesvirus 2
gccgugggccuguggggccugc

SEQ ID NO: 1830149 - RNA, 19 nt, Human herpesvirus 2
gccggaaaccgagacggug

SEQ ID NO: 1830150 - RNA, 13 nt, Human herpesvirus 2
gccggaccgggau

SEQ ID NO: 1830151 - RNA, 17 nt, Human herpesvirus 2
gccgcugggggggcggg

SEQ ID NO: 1830152 - RNA, 19 nt, Human herpesvirus 2
gccgcuuuaccccgcggcc

SEQ ID NO: 1830153 - RNA, 20 nt, Human herpesvirus 2
gccgcugugccagguggccc

SEQ ID NO: 1830154 - RNA, 13 nt, Human herpesvirus 2
gccgcuguggccc

SEQ ID NO: 1830155 - RNA, 18 nt, Human herpesvirus 2
gccgcugcccgacgcgcc

SEQ ID NO: 1830156 - RNA, 20 nt, Human herpesvirus 2
auccgaucgaugagccggua

SEQ ID NO: 1830157 - RNA, 20 nt, Human herpesvirus 2
caacaugacaacgacgcccc

SEQ ID NO: 1830158 - RNA, 13 nt, Human herpesvirus 2
caacguccgggcg

SEQ ID NO: 1830159 - RNA, 17 nt, Human herpesvirus 2
caacccaucccacaaug

SEQ ID NO: 1830160 - RNA, 14 nt, Human herpesvirus 2
aggcccggcccgcg

SEQ ID NO: 1830161 - RNA, 19 nt, Human herpesvirus 2
aggccucauccggcccgcc

SEQ ID NO: 1830162 - RNA, 15 nt, Human herpesvirus 2
aggcgcccgccccug

SEQ ID NO: 1830163 - RNA, 23 nt, Human herpesvirus 2
aggccgggagcguggggcgcgca

SEQ ID NO: 1830164 - RNA, 20 nt, Human herpesvirus 2
aggcuguccgccgggcguga

SEQ ID NO: 1830165 - RNA, 17 nt, Human herpesvirus 2
agggcccggcgccgccc

SEQ ID NO: 1830166 - RNA, 20 nt, Human herpesvirus 2
acagagaaaggcccccagac

SEQ ID NO: 1830167 - RNA, 22 nt, Human herpesvirus 2
acagaggcgguagcggacgcac

SEQ ID NO: 1830168 - RNA, 23 nt, Human herpesvirus 2
acagcggggacccgggcgagcug

SEQ ID NO: 1830169 - RNA, 16 nt, Human herpesvirus 2
accgcugucgcccccg

SEQ ID NO: 1830170 - RNA, 20 nt, Human herpesvirus 2
accgcgccucgcgucgggcc

SEQ ID NO: 1830171 - RNA, 14 nt, Human herpesvirus 2
accgcgcgccgccg

SEQ ID NO: 1830172 - RNA, 20 nt, Human herpesvirus 2
accgcggcuucuucgccgcc

SEQ ID NO: 1830173 - RNA, 21 nt, Human herpesvirus 2
accgcagucuggucgaggugg

SEQ ID NO: 1830174 - RNA, 18 nt, Human herpesvirus 2
accgcaccggacgcgcac

SEQ ID NO: 1830175 - RNA, 23 nt, Human herpesvirus 2
accacgugcacagccuggccgug

SEQ ID NO: 1830176 - RNA, 11 nt, Human herpesvirus 2
accgagagcgc

SEQ ID NO: 1830177 - RNA, 12 nt, Human herpesvirus 2
cggaccuccggg

SEQ ID NO: 1830178 - RNA, 12 nt, Human herpesvirus 2
cggaccccgccc

SEQ ID NO: 1830179 - RNA, 16 nt, Human herpesvirus 2
cggacaucacccacgu

SEQ ID NO: 1830180 - RNA, 13 nt, Human herpesvirus 2
cggaaagccggcc

SEQ ID NO: 1830181 - RNA, 22 nt, Human herpesvirus 2
cgcgguucugacgcggggucga

SEQ ID NO: 1830182 - RNA, 17 nt, Human herpesvirus 2
cgcguacguggcgucgg

SEQ ID NO: 1830183 - RNA, 23 nt, Human herpesvirus 2
cgcgggcucguguuccggccgug

SEQ ID NO: 1830184 - RNA, 17 nt, Human herpesvirus 2
cgcgugcagcgcgggcg

SEQ ID NO: 1830185 - RNA, 15 nt, Human herpesvirus 2
cgccgcgugggcucc

SEQ ID NO: 1830186 - RNA, 13 nt, Human herpesvirus 2
cgcggcggccgca

SEQ ID NO: 1830187 - RNA, 18 nt, Human herpesvirus 2
cgccgcgggggaggcgcg

SEQ ID NO: 1830188 - RNA, 22 nt, Human herpesvirus 2
cgccgcgggggaggcgcgcgcg

SEQ ID NO: 1830189 - RNA, 13 nt, Human herpesvirus 2
cgcgggcggcgcc

SEQ ID NO: 1830190 - RNA, 23 nt, Human herpesvirus 2
cgcgggggaggcgcgcgcgcgcu

SEQ ID NO: 1830191 - RNA, 23 nt, Human herpesvirus 2
cgcggggacccgccagagacccu

SEQ ID NO: 1830192 - RNA, 12 nt, Human herpesvirus 2
cgccgccccgac

SEQ ID NO: 1830193 - RNA, 14 nt, Human herpesvirus 2
cgcagaccaccucg

SEQ ID NO: 1830194 - RNA, 22 nt, Human herpesvirus 2
cgcacguacguucugccccgcg

SEQ ID NO: 1830195 - RNA, 17 nt, Human herpesvirus 2
cgccgacggcggcgcac

SEQ ID NO: 1830196 - RNA, 16 nt, Human herpesvirus 2
cgacgcguacguggcg

SEQ ID NO: 1830197 - RNA, 18 nt, Human herpesvirus 2
cgacgcaaccuccggggc

SEQ ID NO: 1830198 - RNA, 15 nt, Human herpesvirus 2
cgacggcggggcccc

SEQ ID NO: 1830199 - RNA, 18 nt, Human herpesvirus 2
cgaccgucgccgccggcc

SEQ ID NO: 1830200 - RNA, 17 nt, Human herpesvirus 2
cgaccgucuuugggccc

SEQ ID NO: 1830201 - RNA, 18 nt, Human herpesvirus 2
cgaccgucuuugggcccc

SEQ ID NO: 1830202 - RNA, 14 nt, Human herpesvirus 2
cgacgaccaccgcg

SEQ ID NO: 1830203 - RNA, 17 nt, Human herpesvirus 2
cgacgaccaugggcccc

SEQ ID NO: 1830204 - RNA, 14 nt, Human herpesvirus 2
cgacgacgugcgcg

SEQ ID NO: 1830205 - RNA, 13 nt, Human herpesvirus 2
cgaccucgucgcg

SEQ ID NO: 1830206 - RNA, 18 nt, Human herpesvirus 2
ccuccgcccuccgccagc

SEQ ID NO: 1830207 - RNA, 19 nt, Human herpesvirus 2
ccucgagcucuucggcugc

SEQ ID NO: 1830208 - RNA, 13 nt, Human herpesvirus 2
ccucgacccgucc

SEQ ID NO: 1830209 - RNA, 23 nt, Human herpesvirus 2
ccucgugcgcaugggccgccagc

SEQ ID NO: 1830210 - RNA, 18 nt, Human herpesvirus 2
ccucugcccgaccgggcg

SEQ ID NO: 1830211 - RNA, 18 nt, Human herpesvirus 2
ccuuguuggagcggucgc

SEQ ID NO: 1830212 - RNA, 17 nt, Human herpesvirus 2
ccuuguuuucggucugg

SEQ ID NO: 1830213 - RNA, 17 nt, Human herpesvirus 2
cgaacgggggucccgcc

SEQ ID NO: 1830214 - RNA, 16 nt, Human herpesvirus 2
cgaccggcggggcccc

SEQ ID NO: 1830215 - RNA, 21 nt, Human herpesvirus 2
cgaccgccggccccaccgucu

SEQ ID NO: 1830216 - RNA, 17 nt, Human herpesvirus 2
ccaucgccggggaccgc

SEQ ID NO: 1830217 - RNA, 17 nt, Human herpesvirus 2
ccaugaccucucgccgc

SEQ ID NO: 1830218 - RNA, 17 nt, Human herpesvirus 2
ccaugcaacgccgggcg
